United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 71

SEQ ID NO: 2558050 - RNA, 18 nt, Chlamydophila pneumoniae J138
uuucuucucuaagaaauu

SEQ ID NO: 2558051 - RNA, 12 nt, Chlamydophila pneumoniae J138
uuucuucuguuu

SEQ ID NO: 2558052 - RNA, 11 nt, Chlamydophila pneumoniae J138
uuucuucuuuc

SEQ ID NO: 2558053 - RNA, 17 nt, Chlamydophila pneumoniae J138
uuucuugauauuugucu

SEQ ID NO: 2558054 - RNA, 15 nt, Chlamydophila pneumoniae J138
uuucuugcaaggagc

SEQ ID NO: 2558055 - RNA, 11 nt, Chlamydophila pneumoniae J138
uuucuuguucc

SEQ ID NO: 2558056 - RNA, 22 nt, Chlamydophila pneumoniae J138
uuucuuguuccaauagagucuc

SEQ ID NO: 2558057 - RNA, 12 nt, Chlamydophila pneumoniae J138
uuucuuguugca

SEQ ID NO: 2558058 - RNA, 16 nt, Chlamydophila pneumoniae J138
uuucuuucacaucuuu

SEQ ID NO: 2558059 - RNA, 13 nt, Chlamydophila pneumoniae J138
uuucuuucuaaga

SEQ ID NO: 2558060 - RNA, 21 nt, Chlamydophila pneumoniae J138
uuucuuuuagcuacuucuucu

SEQ ID NO: 2558061 - RNA, 14 nt, Chlamydophila pneumoniae J138
uuucuuuuucagcu

SEQ ID NO: 2558062 - RNA, 15 nt, Chlamydophila pneumoniae J138
uuugaauucugauga

SEQ ID NO: 2558063 - RNA, 16 nt, Chlamydophila pneumoniae J138
uuugaauuuccaaagg

SEQ ID NO: 2558064 - RNA, 14 nt, Chlamydophila pneumoniae J138
uuugacaaauuuau

SEQ ID NO: 2558065 - RNA, 23 nt, Chlamydophila pneumoniae J138
uuugaccagaugauuuuuugaau

SEQ ID NO: 2558066 - RNA, 18 nt, Chlamydophila pneumoniae J138
uuugacuuucauaugaau

SEQ ID NO: 2558067 - RNA, 13 nt, Chlamydophila pneumoniae J138
uuugagaaugaac

SEQ ID NO: 2558068 - RNA, 22 nt, Chlamydophila pneumoniae J138
uuugagacgaaagagauuucuu

SEQ ID NO: 2558069 - RNA, 17 nt, Chlamydophila pneumoniae J138
uuugaucaggagucucu

SEQ ID NO: 2558070 - RNA, 17 nt, Chlamydophila pneumoniae J138
uuugaugcuucuuucaa

SEQ ID NO: 2558071 - RNA, 21 nt, Chlamydophila pneumoniae J138
uuugaugugcggcgagcucua

SEQ ID NO: 2558072 - RNA, 16 nt, Chlamydophila pneumoniae J138
uuugauucauaaagag

SEQ ID NO: 2558073 - RNA, 22 nt, Chlamydophila pneumoniae J138
uuugauucccggaggcaaagau

SEQ ID NO: 2558074 - RNA, 18 nt, Chlamydophila pneumoniae J138
uuugcaacaaucuuucuu

SEQ ID NO: 2558075 - RNA, 13 nt, Chlamydophila pneumoniae J138
uuugcaugaggag

SEQ ID NO: 2558076 - RNA, 19 nt, Chlamydophila pneumoniae J138
uuugccaguucuugaaacu

SEQ ID NO: 2558077 - RNA, 14 nt, Chlamydophila pneumoniae J138
uuugccauuucuau

SEQ ID NO: 2558078 - RNA, 15 nt, Chlamydophila pneumoniae J138
uuugccauuucuauc

SEQ ID NO: 2558079 - RNA, 16 nt, Chlamydophila pneumoniae J138
uuugcuaaacaaugca

SEQ ID NO: 2558080 - RNA, 14 nt, Chlamydophila pneumoniae J138
uuugcuaagagcuc

SEQ ID NO: 2558081 - RNA, 21 nt, Chlamydophila pneumoniae J138
uuugcuacagcuucuuuucca

SEQ ID NO: 2558082 - RNA, 16 nt, Chlamydophila pneumoniae J138
uuugcuccuccaaaag

SEQ ID NO: 2558083 - RNA, 15 nt, Chlamydophila pneumoniae J138
uuugcucucuagauu

SEQ ID NO: 2558084 - RNA, 12 nt, Chlamydophila pneumoniae J138
uuugcugaagau

SEQ ID NO: 2558085 - RNA, 14 nt, Chlamydophila pneumoniae J138
uuugcugaagauuu

SEQ ID NO: 2558086 - RNA, 14 nt, Chlamydophila pneumoniae J138
uuuggaaagaagag

SEQ ID NO: 2558087 - RNA, 18 nt, Chlamydophila pneumoniae J138
uuuggaaagcucuuucau

SEQ ID NO: 2558088 - RNA, 14 nt, Chlamydophila pneumoniae J138
uuuggaaaugagag

SEQ ID NO: 2558089 - RNA, 20 nt, Chlamydophila pneumoniae J138
uuuggcacaauccucacuau

SEQ ID NO: 2558090 - RNA, 20 nt, Chlamydophila pneumoniae J138
uuuguaaaugucgguuuguu

SEQ ID NO: 2558091 - RNA, 17 nt, Chlamydophila pneumoniae J138
uuuguaaucguuucaua

SEQ ID NO: 2558092 - RNA, 13 nt, Chlamydophila pneumoniae J138
uuuguagauuagg

SEQ ID NO: 2558093 - RNA, 14 nt, Chlamydophila pneumoniae J138
uuuguagcauuucu

SEQ ID NO: 2558094 - RNA, 14 nt, Chlamydophila pneumoniae J138
uuuguaguguugaa

SEQ ID NO: 2558095 - RNA, 16 nt, Chlamydophila pneumoniae J138
uuugucaucacaucag

SEQ ID NO: 2558096 - RNA, 18 nt, Chlamydophila pneumoniae J138
uuugugaagauaagacca

SEQ ID NO: 2558097 - RNA, 19 nt, Chlamydophila pneumoniae J138
uuuguuaaacccaauucuu

SEQ ID NO: 2558098 - RNA, 18 nt, Chlamydophila pneumoniae J138
uuuguuaaauucccaaaa

SEQ ID NO: 2558099 - RNA, 17 nt, Chlamydophila pneumoniae J138
uuuguugggauuuucag

SEQ ID NO: 2558100 - RNA, 15 nt, Chlamydophila pneumoniae J138
uuuguuuuaacucua

SEQ ID NO: 2558101 - RNA, 16 nt, Chlamydophila pneumoniae J138
uuuguuuuuccauuuu

SEQ ID NO: 2558102 - RNA, 13 nt, Chlamydophila pneumoniae J138
uuuuaaagcaaaa

SEQ ID NO: 2558103 - RNA, 18 nt, Chlamydophila pneumoniae J138
uuuuaaagcaaaaauucu

SEQ ID NO: 2558104 - RNA, 20 nt, Chlamydophila pneumoniae J138
uuuuaaagcaaaaauucuag

SEQ ID NO: 2558105 - RNA, 22 nt, Chlamydophila pneumoniae J138
uuuuaaagccuccucaagauaa

SEQ ID NO: 2558106 - RNA, 13 nt, Chlamydophila pneumoniae J138
uuuuaaauacaga

SEQ ID NO: 2558107 - RNA, 22 nt, Chlamydophila pneumoniae J138
uuuuaaguugguccaucgagaa

SEQ ID NO: 2558108 - RNA, 14 nt, Chlamydophila pneumoniae J138
uuuuaauaaaauuu

SEQ ID NO: 2558109 - RNA, 15 nt, Chlamydophila pneumoniae J138
uuuuaccauugagau

SEQ ID NO: 2558110 - RNA, 13 nt, Chlamydophila pneumoniae J138
uuuuacuaucucc

SEQ ID NO: 2558111 - RNA, 14 nt, Chlamydophila pneumoniae J138
uuuuagaacuucaa

SEQ ID NO: 2558112 - RNA, 15 nt, Chlamydophila pneumoniae J138
uuuuagagccuuuuc

SEQ ID NO: 2558113 - RNA, 19 nt, Chlamydophila pneumoniae J138
uuuuagagccuuuucagau

SEQ ID NO: 2558114 - RNA, 20 nt, Chlamydophila pneumoniae J138
uuuuaggacgcuauccuauu

SEQ ID NO: 2558115 - RNA, 20 nt, Chlamydophila pneumoniae J138
uuuuaggaguugguugcagu

SEQ ID NO: 2558116 - RNA, 23 nt, Chlamydophila pneumoniae J138
uuuuaggaucuuuguugagaagg

SEQ ID NO: 2558117 - RNA, 20 nt, Chlamydophila pneumoniae J138
uuuuauaaagaucgggucua

SEQ ID NO: 2558118 - RNA, 16 nt, Chlamydophila pneumoniae J138
uuuuauaggaauaaca

SEQ ID NO: 2558119 - RNA, 18 nt, Chlamydophila pneumoniae J138
uuuuauuaguuuugaaau

SEQ ID NO: 2558120 - RNA, 14 nt, Chlamydophila pneumoniae J138
uuuuauugauaaug

SEQ ID NO: 2558121 - RNA, 17 nt, Chlamydophila pneumoniae J138
uuuucaaaucaucaaaa

SEQ ID NO: 2558122 - RNA, 12 nt, Chlamydophila pneumoniae J138
uuuucaaauucu

SEQ ID NO: 2558123 - RNA, 17 nt, Chlamydophila pneumoniae J138
uuuucaauaaccagaag

SEQ ID NO: 2558124 - RNA, 21 nt, Chlamydophila pneumoniae J138
uuuucaauagcaguaucuaga

SEQ ID NO: 2558125 - RNA, 15 nt, Chlamydophila pneumoniae J138
uuuucaauccuuccu

SEQ ID NO: 2558126 - RNA, 14 nt, Chlamydophila pneumoniae J138
uuuucagaaagcga

SEQ ID NO: 2558127 - RNA, 22 nt, Chlamydophila pneumoniae J138
uuuucagaaagcgaagagcuca

SEQ ID NO: 2558128 - RNA, 12 nt, Chlamydophila pneumoniae J138
uuuucagcacug

SEQ ID NO: 2558129 - RNA, 22 nt, Chlamydophila pneumoniae J138
uuuucagccugucuauaaaaua

SEQ ID NO: 2558130 - RNA, 22 nt, Chlamydophila pneumoniae J138
uuuucaggaggcgcguagaucc

SEQ ID NO: 2558131 - RNA, 14 nt, Chlamydophila pneumoniae J138
uuuucauacuuauc

SEQ ID NO: 2558132 - RNA, 21 nt, Chlamydophila pneumoniae J138
aucaucucccaaauagcuaca

SEQ ID NO: 2558133 - RNA, 16 nt, Chlamydophila pneumoniae J138
aucaucuccugaagcc

SEQ ID NO: 2558134 - RNA, 14 nt, Chlamydophila pneumoniae J138
aucaugaaaaggau

SEQ ID NO: 2558135 - RNA, 21 nt, Chlamydophila pneumoniae J138
aucauggucccuauagaacau

SEQ ID NO: 2558136 - RNA, 21 nt, Chlamydophila pneumoniae J138
aucauguagugcuucuucuau

SEQ ID NO: 2558137 - RNA, 19 nt, Chlamydophila pneumoniae J138
aucauuaagaagauucuuu

SEQ ID NO: 2558138 - RNA, 12 nt, Chlamydophila pneumoniae J138
aucauuagcauc

SEQ ID NO: 2558139 - RNA, 12 nt, Chlamydophila pneumoniae J138
aucauuguugcu

SEQ ID NO: 2558140 - RNA, 19 nt, Chlamydophila pneumoniae J138
aucauuuucauagcagcua

SEQ ID NO: 2558141 - RNA, 13 nt, Chlamydophila pneumoniae J138
auccaaaagcggc

SEQ ID NO: 2558142 - RNA, 18 nt, Chlamydophila pneumoniae J138
auccaaaaugucuuuuuc

SEQ ID NO: 2558143 - RNA, 21 nt, Chlamydophila pneumoniae J138
auccaaacgguuaaugaacuc

SEQ ID NO: 2558144 - RNA, 12 nt, Chlamydophila pneumoniae J138
auccaaagacuu

SEQ ID NO: 2558145 - RNA, 15 nt, Chlamydophila pneumoniae J138
auccaacaaagauga

SEQ ID NO: 2558146 - RNA, 16 nt, Chlamydophila pneumoniae J138
auccaacaaagaugac

SEQ ID NO: 2558147 - RNA, 17 nt, Chlamydophila pneumoniae J138
auccaagaauagccaua

SEQ ID NO: 2558148 - RNA, 13 nt, Chlamydophila pneumoniae J138
auccaagaaugaa

SEQ ID NO: 2558149 - RNA, 18 nt, Chlamydophila pneumoniae J138
auccaauagccaaagacu

SEQ ID NO: 2558150 - RNA, 14 nt, Chlamydophila pneumoniae J138
auccaaugacaauc

SEQ ID NO: 2558151 - RNA, 23 nt, Chlamydophila pneumoniae J138
auccacagacugcaggaaauuau

SEQ ID NO: 2558152 - RNA, 13 nt, Chlamydophila pneumoniae J138
auccacagauacg

SEQ ID NO: 2558153 - RNA, 20 nt, Chlamydophila pneumoniae J138
auccacagaucguaaucugu

SEQ ID NO: 2558154 - RNA, 14 nt, Chlamydophila pneumoniae J138
auccacauccuugu

SEQ ID NO: 2558155 - RNA, 18 nt, Chlamydophila pneumoniae J138
auccacauccuuguagaa

SEQ ID NO: 2558156 - RNA, 22 nt, Chlamydophila pneumoniae J138
auccacauccuuguagaacuuc

SEQ ID NO: 2558157 - RNA, 15 nt, Chlamydophila pneumoniae J138
auccaccaagacuga

SEQ ID NO: 2558158 - RNA, 16 nt, Chlamydophila pneumoniae J138
auccacugcuuuaggc

SEQ ID NO: 2558159 - RNA, 23 nt, Chlamydophila pneumoniae J138
auccagaaucuccauuuagaaug

SEQ ID NO: 2558160 - RNA, 15 nt, Chlamydophila pneumoniae J138
auccagauuagaaaa

SEQ ID NO: 2558161 - RNA, 14 nt, Chlamydophila pneumoniae J138
auccagcuccauaa

SEQ ID NO: 2558162 - RNA, 15 nt, Chlamydophila pneumoniae J138
auccaggaauagaaa

SEQ ID NO: 2558163 - RNA, 19 nt, Chlamydophila pneumoniae J138
auccaggaauagaaagaca

SEQ ID NO: 2558164 - RNA, 20 nt, Chlamydophila pneumoniae J138
auccaggaauagaaagacau

SEQ ID NO: 2558165 - RNA, 17 nt, Chlamydophila pneumoniae J138
auccagguuguccuaua

SEQ ID NO: 2558166 - RNA, 19 nt, Chlamydophila pneumoniae J138
auccaguagaucuucugaa

SEQ ID NO: 2558167 - RNA, 17 nt, Chlamydophila pneumoniae J138
auccaucggcauuucuc

SEQ ID NO: 2558168 - RNA, 20 nt, Chlamydophila pneumoniae J138
auccaugacuugacacagga

SEQ ID NO: 2558169 - RNA, 17 nt, Chlamydophila pneumoniae J138
auccaugcuagaagaca

SEQ ID NO: 2558170 - RNA, 12 nt, Chlamydophila pneumoniae J138
auccauucuuaa

SEQ ID NO: 2558171 - RNA, 13 nt, Chlamydophila pneumoniae J138
auccauuuugccc

SEQ ID NO: 2558172 - RNA, 15 nt, Chlamydophila pneumoniae J138
aucccaaacuucuuc

SEQ ID NO: 2558173 - RNA, 23 nt, Chlamydophila pneumoniae J138
aucccaagggagaggucugcucu

SEQ ID NO: 2558174 - RNA, 16 nt, Chlamydophila pneumoniae J138
aucccaaguauggucc

SEQ ID NO: 2558175 - RNA, 16 nt, Chlamydophila pneumoniae J138
aucccacagaaauguc

SEQ ID NO: 2558176 - RNA, 16 nt, Chlamydophila pneumoniae J138
aucccaccgacaagau

SEQ ID NO: 2558177 - RNA, 19 nt, Chlamydophila pneumoniae J138
aucccacgggucaggaggu

SEQ ID NO: 2558178 - RNA, 23 nt, Chlamydophila pneumoniae J138
aucccagauaaagacaucucuuu

SEQ ID NO: 2558179 - RNA, 21 nt, Chlamydophila pneumoniae J138
aucccauaaauguauaggcau

SEQ ID NO: 2558180 - RNA, 16 nt, Chlamydophila pneumoniae J138
aucccaucaaaggcaa

SEQ ID NO: 2558181 - RNA, 18 nt, Chlamydophila pneumoniae J138
auccccgggauuguucuu

SEQ ID NO: 2558182 - RNA, 12 nt, Chlamydophila pneumoniae J138
auccccucagaa

SEQ ID NO: 2558183 - RNA, 14 nt, Chlamydophila pneumoniae J138
auccccucagaaag

SEQ ID NO: 2558184 - RNA, 18 nt, Chlamydophila pneumoniae J138
auccccucagaaaggaga

SEQ ID NO: 2558185 - RNA, 15 nt, Chlamydophila pneumoniae J138
aucccgaacaaucaa

SEQ ID NO: 2558186 - RNA, 18 nt, Chlamydophila pneumoniae J138
aucccgaagcaauccagu

SEQ ID NO: 2558187 - RNA, 15 nt, Chlamydophila pneumoniae J138
aucccgaguccuaaa

SEQ ID NO: 2558188 - RNA, 19 nt, Chlamydophila pneumoniae J138
aucccuaagguuuccauga

SEQ ID NO: 2558189 - RNA, 17 nt, Chlamydophila pneumoniae J138
aucccuagggaaagcau

SEQ ID NO: 2558190 - RNA, 17 nt, Chlamydophila pneumoniae J138
aucccugcacucuuuca

SEQ ID NO: 2558191 - RNA, 23 nt, Chlamydophila pneumoniae J138
aucccugcacucuuucagaaaga

SEQ ID NO: 2558192 - RNA, 15 nt, Chlamydophila pneumoniae J138
aucccuggauuucuu

SEQ ID NO: 2558193 - RNA, 17 nt, Chlamydophila pneumoniae J138
aucccuggauuucuucu

SEQ ID NO: 2558194 - RNA, 14 nt, Chlamydophila pneumoniae J138
aucccuucuucuuu

SEQ ID NO: 2558195 - RNA, 18 nt, Chlamydophila pneumoniae J138
auccgaagacucaaagaa

SEQ ID NO: 2558196 - RNA, 15 nt, Chlamydophila pneumoniae J138
auccgaucauaauua

SEQ ID NO: 2558197 - RNA, 19 nt, Chlamydophila pneumoniae J138
auccggaaggaguucuuuu

SEQ ID NO: 2558198 - RNA, 22 nt, Chlamydophila pneumoniae J138
auccguagugagguuugcaauu

SEQ ID NO: 2558199 - RNA, 17 nt, Chlamydophila pneumoniae J138
auccuaaauuaaauauc

SEQ ID NO: 2558200 - RNA, 19 nt, Chlamydophila pneumoniae J138
auccuacgagcgcuuucuu

SEQ ID NO: 2558201 - RNA, 17 nt, Chlamydophila pneumoniae J138
auccuauaguaauuucu

SEQ ID NO: 2558202 - RNA, 16 nt, Chlamydophila pneumoniae J138
auccuauuuuagcaua

SEQ ID NO: 2558203 - RNA, 15 nt, Chlamydophila pneumoniae J138
auccucacuagagau

SEQ ID NO: 2558204 - RNA, 18 nt, Chlamydophila pneumoniae J138
auccucaggaccuaaggg

SEQ ID NO: 2558205 - RNA, 14 nt, Chlamydophila pneumoniae J138
auccucagucucuc

SEQ ID NO: 2558206 - RNA, 16 nt, Chlamydophila pneumoniae J138
auccucagucucucua

SEQ ID NO: 2558207 - RNA, 13 nt, Chlamydophila pneumoniae J138
auccucaucauca

SEQ ID NO: 2558208 - RNA, 16 nt, Chlamydophila pneumoniae J138
auccucaucaucagaa

SEQ ID NO: 2558209 - RNA, 15 nt, Chlamydophila pneumoniae J138
auccuccgccuguca

SEQ ID NO: 2558210 - RNA, 22 nt, Chlamydophila pneumoniae J138
aaaaaucccuguucuagcaaau

SEQ ID NO: 2558211 - RNA, 20 nt, Chlamydophila pneumoniae J138
aaaaauccugagagauaggu

SEQ ID NO: 2558212 - RNA, 20 nt, Chlamydophila pneumoniae J138
aaaaaucuaacacagucccu

SEQ ID NO: 2558213 - RNA, 20 nt, Chlamydophila pneumoniae J138
aaaaaucuucuuagccaaaa

SEQ ID NO: 2558214 - RNA, 22 nt, Chlamydophila pneumoniae J138
aaaaaugccugaaaauucgaau

SEQ ID NO: 2558215 - RNA, 16 nt, Chlamydophila pneumoniae J138
aaaaauguaauuuuuu

SEQ ID NO: 2558216 - RNA, 15 nt, Chlamydophila pneumoniae J138
aaaaauuaagaaccc

SEQ ID NO: 2558217 - RNA, 13 nt, Chlamydophila pneumoniae J138
aaaaauucucaua

SEQ ID NO: 2558218 - RNA, 21 nt, Chlamydophila pneumoniae J138
aaaaauucucauaaccuaagg

SEQ ID NO: 2558219 - RNA, 22 nt, Chlamydophila pneumoniae J138
aaaaauucuucgagagcaugca

SEQ ID NO: 2558220 - RNA, 19 nt, Chlamydophila pneumoniae J138
aaaaauuuaaaagauuccu

SEQ ID NO: 2558221 - RNA, 16 nt, Chlamydophila pneumoniae J138
aaaaauuucaugagga

SEQ ID NO: 2558222 - RNA, 23 nt, Chlamydophila pneumoniae J138
aaaaauuugcgaaguccuggauu

SEQ ID NO: 2558223 - RNA, 21 nt, Chlamydophila pneumoniae J138
aaaaauuuuauaggaauaaca

SEQ ID NO: 2558224 - RNA, 11 nt, Chlamydophila pneumoniae J138
aaaacaagaag

SEQ ID NO: 2558225 - RNA, 13 nt, Chlamydophila pneumoniae J138
aaaacaauuuccu

SEQ ID NO: 2558226 - RNA, 17 nt, Chlamydophila pneumoniae J138
aaaacaccugcccauuu

SEQ ID NO: 2558227 - RNA, 13 nt, Chlamydophila pneumoniae J138
aaaacauauccca

SEQ ID NO: 2558228 - RNA, 15 nt, Chlamydophila pneumoniae J138
aaaacauaucccaua

SEQ ID NO: 2558229 - RNA, 20 nt, Chlamydophila pneumoniae J138
aaaaccacagaaugauaaga

SEQ ID NO: 2558230 - RNA, 18 nt, Chlamydophila pneumoniae J138
aaaaccacuucucuguau

SEQ ID NO: 2558231 - RNA, 16 nt, Chlamydophila pneumoniae J138
aaaacccucaaagaau

SEQ ID NO: 2558232 - RNA, 14 nt, Chlamydophila pneumoniae J138
aaaaccuucuccaa

SEQ ID NO: 2558233 - RNA, 17 nt, Chlamydophila pneumoniae J138
aaaacgagcaggguaau

SEQ ID NO: 2558234 - RNA, 19 nt, Chlamydophila pneumoniae J138
aaaacgauccuguuccccu

SEQ ID NO: 2558235 - RNA, 15 nt, Chlamydophila pneumoniae J138
aaaacgccauacuga

SEQ ID NO: 2558236 - RNA, 18 nt, Chlamydophila pneumoniae J138
aaaacgccauacugauau

SEQ ID NO: 2558237 - RNA, 15 nt, Chlamydophila pneumoniae J138
aaaacggauagggcu

SEQ ID NO: 2558238 - RNA, 22 nt, Chlamydophila pneumoniae J138
aaaacggcuguacuuccccaaa

SEQ ID NO: 2558239 - RNA, 15 nt, Chlamydophila pneumoniae J138
aaaacgguaaauauc

SEQ ID NO: 2558240 - RNA, 15 nt, Chlamydophila pneumoniae J138
aaaacuacauucuaa

SEQ ID NO: 2558241 - RNA, 19 nt, Chlamydophila pneumoniae J138
aaaacuccacgccaaagua

SEQ ID NO: 2558242 - RNA, 21 nt, Chlamydophila pneumoniae J138
aaaacuccgcacuugcucuuu

SEQ ID NO: 2558243 - RNA, 16 nt, Chlamydophila pneumoniae J138
aaaacugcaaaaagau

SEQ ID NO: 2558244 - RNA, 19 nt, Chlamydophila pneumoniae J138
aaaacugcgcuaucaucau

SEQ ID NO: 2558245 - RNA, 20 nt, Chlamydophila pneumoniae J138
aaaacugcgcuaucaucauu

SEQ ID NO: 2558246 - RNA, 22 nt, Chlamydophila pneumoniae J138
aaaacuucccaucuuguucuaa

SEQ ID NO: 2558247 - RNA, 23 nt, Chlamydophila pneumoniae J138
aaaacuucuugugauccuugcaa

SEQ ID NO: 2558248 - RNA, 18 nt, Chlamydophila pneumoniae J138
aaaacuuucgaagcgcuc

SEQ ID NO: 2558249 - RNA, 20 nt, Chlamydophila pneumoniae J138
aaaagaaagaagccuuccuu

SEQ ID NO: 2558250 - RNA, 21 nt, Chlamydophila pneumoniae J138
aaaagaaagaagccuuccuug

SEQ ID NO: 2558251 - RNA, 12 nt, Chlamydophila pneumoniae J138
aaaagaaagaau

SEQ ID NO: 2558252 - RNA, 20 nt, Chlamydophila pneumoniae J138
aaaagaaagaauaucuuuug

SEQ ID NO: 2558253 - RNA, 21 nt, Chlamydophila pneumoniae J138
aaaagaacauuaagaggaaag

SEQ ID NO: 2558254 - RNA, 18 nt, Chlamydophila pneumoniae J138
aaaagaauuccuaaaacg

SEQ ID NO: 2558255 - RNA, 13 nt, Chlamydophila pneumoniae J138
aaaagacaagaga

SEQ ID NO: 2558256 - RNA, 13 nt, Chlamydophila pneumoniae J138
aaaagaccaaaua

SEQ ID NO: 2558257 - RNA, 20 nt, Chlamydophila pneumoniae J138
aaaagagaacauguuucuaa

SEQ ID NO: 2558258 - RNA, 13 nt, Chlamydophila pneumoniae J138
aaaagagcucaaa

SEQ ID NO: 2558259 - RNA, 15 nt, Chlamydophila pneumoniae J138
aaaagagcucaaaaa

SEQ ID NO: 2558260 - RNA, 20 nt, Chlamydophila pneumoniae J138
aaaagagcucaaaaaguucc

SEQ ID NO: 2558261 - RNA, 18 nt, Chlamydophila pneumoniae J138
aaaagauaaaacauucuc

SEQ ID NO: 2558262 - RNA, 12 nt, Chlamydophila pneumoniae J138
aaaagauaguga

SEQ ID NO: 2558263 - RNA, 20 nt, Chlamydophila pneumoniae J138
aaaagaucggaguuaucaaa

SEQ ID NO: 2558264 - RNA, 23 nt, Chlamydophila pneumoniae J138
aaaagaucggaguuaucaaaagg

SEQ ID NO: 2558265 - RNA, 13 nt, Chlamydophila pneumoniae J138
aaaagaucuaagu

SEQ ID NO: 2558266 - RNA, 23 nt, Chlamydophila pneumoniae J138
aaaagauuugcgaaucuaagaug

SEQ ID NO: 2558267 - RNA, 23 nt, Chlamydophila pneumoniae J138
aaaagcaaucguguuuuccugag

SEQ ID NO: 2558268 - RNA, 15 nt, Chlamydophila pneumoniae J138
aaaagcacuuaaaaa

SEQ ID NO: 2558269 - RNA, 22 nt, Chlamydophila pneumoniae J138
aaaagcacuuaaaaaacuuccu

SEQ ID NO: 2558270 - RNA, 23 nt, Chlamydophila pneumoniae J138
aaaagcauagucgucuuuuaaag

SEQ ID NO: 2558271 - RNA, 15 nt, Chlamydophila pneumoniae J138
aaaagcuaaacaacu

SEQ ID NO: 2558272 - RNA, 20 nt, Chlamydophila pneumoniae J138
aaagauuugcgaaucuaaga

SEQ ID NO: 2558273 - RNA, 14 nt, Chlamydophila pneumoniae J138
aaagcaaaaauucu

SEQ ID NO: 2558274 - RNA, 11 nt, Chlamydophila pneumoniae J138
aaagcaaagag

SEQ ID NO: 2558275 - RNA, 21 nt, Chlamydophila pneumoniae J138
aaagcacauaagaugaaguuu

SEQ ID NO: 2558276 - RNA, 15 nt, Chlamydophila pneumoniae J138
aaagcagauccugcu

SEQ ID NO: 2558277 - RNA, 22 nt, Chlamydophila pneumoniae J138
aaagcagcgaagauuuagggaa

SEQ ID NO: 2558278 - RNA, 17 nt, Chlamydophila pneumoniae J138
aaagcaggagcaucauu

SEQ ID NO: 2558279 - RNA, 22 nt, Chlamydophila pneumoniae J138
aaagcagugugccaauuuuugu

SEQ ID NO: 2558280 - RNA, 22 nt, Chlamydophila pneumoniae J138
aaagcauagucgucuuuuaaag

SEQ ID NO: 2558281 - RNA, 22 nt, Chlamydophila pneumoniae J138
aaagcauaguguauaucagcaa

SEQ ID NO: 2558282 - RNA, 18 nt, Chlamydophila pneumoniae J138
aaagcaucuuguauugcu

SEQ ID NO: 2558283 - RNA, 16 nt, Chlamydophila pneumoniae J138
aaagcaugaugccauu

SEQ ID NO: 2558284 - RNA, 14 nt, Chlamydophila pneumoniae J138
aaagcauugcaaau

SEQ ID NO: 2558285 - RNA, 18 nt, Chlamydophila pneumoniae J138
aaagccaagaagauguag

SEQ ID NO: 2558286 - RNA, 20 nt, Chlamydophila pneumoniae J138
aaagccauuccauauccaug

SEQ ID NO: 2558287 - RNA, 14 nt, Chlamydophila pneumoniae J138
aaagcccauuccug

SEQ ID NO: 2558288 - RNA, 22 nt, Chlamydophila pneumoniae J138
aaagcccccucccccaccaaag

SEQ ID NO: 2558289 - RNA, 23 nt, Chlamydophila pneumoniae J138
aaagcccucauccccucagaaag

SEQ ID NO: 2558290 - RNA, 22 nt, Chlamydophila pneumoniae J138
aaagccgauacccaucuagaaa

SEQ ID NO: 2558291 - RNA, 15 nt, Chlamydophila pneumoniae J138
aaagccuaugggagg

SEQ ID NO: 2558292 - RNA, 14 nt, Chlamydophila pneumoniae J138
aaagccuuucuuau

SEQ ID NO: 2558293 - RNA, 16 nt, Chlamydophila pneumoniae J138
aaagccuuugcucacu

SEQ ID NO: 2558294 - RNA, 12 nt, Chlamydophila pneumoniae J138
aaagcuaaaaug

SEQ ID NO: 2558295 - RNA, 13 nt, Chlamydophila pneumoniae J138
aaagcuaaacaac

SEQ ID NO: 2558296 - RNA, 20 nt, Chlamydophila pneumoniae J138
aaagcuagucuucuuagaaa

SEQ ID NO: 2558297 - RNA, 14 nt, Chlamydophila pneumoniae J138
aaagcuauuucucu

SEQ ID NO: 2558298 - RNA, 23 nt, Chlamydophila pneumoniae J138
aaagcuauuucucuaucaucaau

SEQ ID NO: 2558299 - RNA, 15 nt, Chlamydophila pneumoniae J138
aaagcucuccuucag

SEQ ID NO: 2558300 - RNA, 15 nt, Chlamydophila pneumoniae J138
aaagcucuuucauaa

SEQ ID NO: 2558301 - RNA, 14 nt, Chlamydophila pneumoniae J138
aaagcugaaauucu

SEQ ID NO: 2558302 - RNA, 19 nt, Chlamydophila pneumoniae J138
aaagcugaauccagguugu

SEQ ID NO: 2558303 - RNA, 18 nt, Chlamydophila pneumoniae J138
aaagcugcuuuuucuacu

SEQ ID NO: 2558304 - RNA, 16 nt, Chlamydophila pneumoniae J138
aaagcuguauugggaa

SEQ ID NO: 2558305 - RNA, 17 nt, Chlamydophila pneumoniae J138
aaagcuguauugggaau

SEQ ID NO: 2558306 - RNA, 21 nt, Chlamydophila pneumoniae J138
aaagcugugguaucgauguaa

SEQ ID NO: 2558307 - RNA, 23 nt, Chlamydophila pneumoniae J138
aaagcuuaucccauaaauguaua

SEQ ID NO: 2558308 - RNA, 14 nt, Chlamydophila pneumoniae J138
aaagcuucuuucuu

SEQ ID NO: 2558309 - RNA, 12 nt, Chlamydophila pneumoniae J138
aaagcuugagaa

SEQ ID NO: 2558310 - RNA, 17 nt, Chlamydophila pneumoniae J138
aaagcuuuuuucucuug

SEQ ID NO: 2558311 - RNA, 21 nt, Chlamydophila pneumoniae J138
aaagcuuuuuucucuugcuuc

SEQ ID NO: 2558312 - RNA, 14 nt, Chlamydophila pneumoniae J138
aaaggaaaauaauc

SEQ ID NO: 2558313 - RNA, 23 nt, Chlamydophila pneumoniae J138
aaaggaagggauguuuaauacaa

SEQ ID NO: 2558314 - RNA, 15 nt, Chlamydophila pneumoniae J138
aaaggaauaugcucu

SEQ ID NO: 2558315 - RNA, 19 nt, Chlamydophila pneumoniae J138
aaaggaccacaauuccuaa

SEQ ID NO: 2558316 - RNA, 12 nt, Chlamydophila pneumoniae J138
aaaggauauuga

SEQ ID NO: 2558317 - RNA, 13 nt, Chlamydophila pneumoniae J138
aaaggaugcuuag

SEQ ID NO: 2558318 - RNA, 17 nt, Chlamydophila pneumoniae J138
aaaggauucuaugagga

SEQ ID NO: 2558319 - RNA, 19 nt, Chlamydophila pneumoniae J138
aaaggcaacaacgccuaca

SEQ ID NO: 2558320 - RNA, 15 nt, Chlamydophila pneumoniae J138
aaaggcccaacucuu

SEQ ID NO: 2558321 - RNA, 15 nt, Chlamydophila pneumoniae J138
aaaggcucuuuuaga

SEQ ID NO: 2558322 - RNA, 22 nt, Chlamydophila pneumoniae J138
aaaggcugauugaaagucagca

SEQ ID NO: 2558323 - RNA, 17 nt, Chlamydophila pneumoniae J138
aaagggaauuuucucau

SEQ ID NO: 2558324 - RNA, 22 nt, Chlamydophila pneumoniae J138
aaaggggaacaacaucaugaaa

SEQ ID NO: 2558325 - RNA, 21 nt, Chlamydophila pneumoniae J138
aaagggucuuuaccagaaaug

SEQ ID NO: 2558326 - RNA, 18 nt, Chlamydophila pneumoniae J138
aaaggguuucuuuccauc

SEQ ID NO: 2558327 - RNA, 13 nt, Chlamydophila pneumoniae J138
aaagguaaaacua

SEQ ID NO: 2558328 - RNA, 23 nt, Chlamydophila pneumoniae J138
aaaggucagcccugccucacagc

SEQ ID NO: 2558329 - RNA, 12 nt, Chlamydophila pneumoniae J138
aaagguugcuaa

SEQ ID NO: 2558330 - RNA, 14 nt, Chlamydophila pneumoniae J138
aaagguugcuaaga

SEQ ID NO: 2558331 - RNA, 22 nt, Chlamydophila pneumoniae J138
aaagguugcuaagaucuuuaga

SEQ ID NO: 2558332 - RNA, 17 nt, Chlamydophila pneumoniae J138
aaagguuuuaaauuuag

SEQ ID NO: 2558333 - RNA, 14 nt, Chlamydophila pneumoniae J138
aaagguuuugaagc

SEQ ID NO: 2558334 - RNA, 15 nt, Chlamydophila pneumoniae J138
aaaguaaaaaauaca

SEQ ID NO: 2558335 - RNA, 18 nt, Chlamydophila pneumoniae J138
aaaguacaggcuccauca

SEQ ID NO: 2558336 - RNA, 13 nt, Chlamydophila pneumoniae J138
aaaguaccuuuaa

SEQ ID NO: 2558337 - RNA, 23 nt, Chlamydophila pneumoniae J138
aaaguaccuuuaacccgcuugca

SEQ ID NO: 2558338 - RNA, 15 nt, Chlamydophila pneumoniae J138
aaaguacuacaauaa

SEQ ID NO: 2558339 - RNA, 19 nt, Chlamydophila pneumoniae J138
aaaguagccauuccaugga

SEQ ID NO: 2558340 - RNA, 16 nt, Chlamydophila pneumoniae J138
aaaguaggauugauaa

SEQ ID NO: 2558341 - RNA, 19 nt, Chlamydophila pneumoniae J138
aaaguaggcacaucauuau

SEQ ID NO: 2558342 - RNA, 22 nt, Chlamydophila pneumoniae J138
aaagucaaauacuucuccugaa

SEQ ID NO: 2558343 - RNA, 20 nt, Chlamydophila pneumoniae J138
aaaguccaagaucaaacgaa

SEQ ID NO: 2558344 - RNA, 21 nt, Chlamydophila pneumoniae J138
aaaguccuccauguacaguuu

SEQ ID NO: 2558345 - RNA, 18 nt, Chlamydophila pneumoniae J138
aaagucucuagggaaagg

SEQ ID NO: 2558346 - RNA, 13 nt, Chlamydophila pneumoniae J138
aaagucucucuaa

SEQ ID NO: 2558347 - RNA, 16 nt, Chlamydophila pneumoniae J138
aaagugaaaccauuua

SEQ ID NO: 2558348 - RNA, 14 nt, Chlamydophila pneumoniae J138
aaagugaaagcaac

SEQ ID NO: 2558349 - RNA, 19 nt, Chlamydophila pneumoniae J138
aaagugaugccuggacugc

SEQ ID NO: 2558350 - RNA, 19 nt, Chlamydophila pneumoniae J138
aaaguggcaaucuuuucuu

SEQ ID NO: 2558351 - RNA, 19 nt, Chlamydophila pneumoniae J138
aaaguuaaugcaagcaacu

SEQ ID NO: 2558352 - RNA, 21 nt, Chlamydophila pneumoniae J138
aaaguuaaugcaagcaacucu

SEQ ID NO: 2558353 - RNA, 23 nt, Chlamydophila pneumoniae J138
aaaguuagguagauagaaauucu

SEQ ID NO: 2558354 - RNA, 15 nt, Chlamydophila pneumoniae J138
aaaguucagcaagga

SEQ ID NO: 2558355 - RNA, 15 nt, Chlamydophila pneumoniae J138
aaaguugaggaaagg

SEQ ID NO: 2558356 - RNA, 17 nt, Chlamydophila pneumoniae J138
aaaguugaggaaaggag

SEQ ID NO: 2558357 - RNA, 19 nt, Chlamydophila pneumoniae J138
aaaguugcaacucucuuua

SEQ ID NO: 2558358 - RNA, 15 nt, Chlamydophila pneumoniae J138
aaaguuuaugacaca

SEQ ID NO: 2558359 - RNA, 19 nt, Chlamydophila pneumoniae J138
aaaguuucaaucucuccuu

SEQ ID NO: 2558360 - RNA, 20 nt, Chlamydophila pneumoniae J138
aaaguuuguagcauuucuuu

SEQ ID NO: 2558361 - RNA, 22 nt, Chlamydophila pneumoniae J138
aaaguuuugaggauuucuugca

SEQ ID NO: 2558362 - RNA, 17 nt, Chlamydophila pneumoniae J138
aaauaaaguccuccaug

SEQ ID NO: 2558363 - RNA, 15 nt, Chlamydophila pneumoniae J138
aaauacgcuuuucuu

SEQ ID NO: 2558364 - RNA, 23 nt, Chlamydophila pneumoniae J138
aaauacgugcuugaauauuucca

SEQ ID NO: 2558365 - RNA, 14 nt, Chlamydophila pneumoniae J138
aaauacuccacuuu

SEQ ID NO: 2558366 - RNA, 13 nt, Chlamydophila pneumoniae J138
aaauacuucuccu

SEQ ID NO: 2558367 - RNA, 14 nt, Chlamydophila pneumoniae J138
aaauacuucuccug

SEQ ID NO: 2558368 - RNA, 14 nt, Chlamydophila pneumoniae J138
aaauagaaaucuua

SEQ ID NO: 2558369 - RNA, 12 nt, Chlamydophila pneumoniae J138
aaauagaagcca

SEQ ID NO: 2558370 - RNA, 24 nt, Chlamydophila pneumoniae J138
aaauagauaagucgaaucuaaaaa

SEQ ID NO: 2558371 - RNA, 14 nt, Chlamydophila pneumoniae J138
aaauagauccugaa

SEQ ID NO: 2558372 - RNA, 19 nt, Chlamydophila pneumoniae J138
aaauagccucuccuugaga

SEQ ID NO: 2558373 - RNA, 23 nt, Chlamydophila pneumoniae J138
aaauaggaaaguugcaacucucu

SEQ ID NO: 2558374 - RNA, 15 nt, Chlamydophila pneumoniae J138
aaauaggagaagccc

SEQ ID NO: 2558375 - RNA, 17 nt, Chlamydophila pneumoniae J138
aaauaggaucucucuuu

SEQ ID NO: 2558376 - RNA, 21 nt, Chlamydophila pneumoniae J138
aaauaggaucucucuuuccuu

SEQ ID NO: 2558377 - RNA, 22 nt, Chlamydophila pneumoniae J138
aaauaggcucuacaggagaagc

SEQ ID NO: 2558378 - RNA, 23 nt, Chlamydophila pneumoniae J138
aaauaggcucuacaggagaagcg

SEQ ID NO: 2558379 - RNA, 16 nt, Chlamydophila pneumoniae J138
aaauaguucaucauau

SEQ ID NO: 2558380 - RNA, 14 nt, Chlamydophila pneumoniae J138
aaauauaguuuuca

SEQ ID NO: 2558381 - RNA, 18 nt, Chlamydophila pneumoniae J138
aaauauaguuuucauaau

SEQ ID NO: 2558382 - RNA, 19 nt, Chlamydophila pneumoniae J138
aaauauaguuuucauaauc

SEQ ID NO: 2558383 - RNA, 17 nt, Chlamydophila pneumoniae J138
aaauauaucgcguguaa

SEQ ID NO: 2558384 - RNA, 18 nt, Chlamydophila pneumoniae J138
aaauauaucuucagaauu

SEQ ID NO: 2558385 - RNA, 15 nt, Chlamydophila pneumoniae J138
aaauaucacauucca

SEQ ID NO: 2558386 - RNA, 23 nt, Chlamydophila pneumoniae J138
aaauaucaccuacaucagacuga

SEQ ID NO: 2558387 - RNA, 14 nt, Chlamydophila pneumoniae J138
aaauaucauucacu

SEQ ID NO: 2558388 - RNA, 14 nt, Chlamydophila pneumoniae J138
aaauaucggaagag

SEQ ID NO: 2558389 - RNA, 22 nt, Chlamydophila pneumoniae J138
aaauaucuccguuaccaaaaac

SEQ ID NO: 2558390 - RNA, 11 nt, Chlamydophila pneumoniae J138
aaauaugaauu

SEQ ID NO: 2558391 - RNA, 17 nt, Chlamydophila pneumoniae J138
aaauauucuuggaagau

SEQ ID NO: 2558392 - RNA, 15 nt, Chlamydophila pneumoniae J138
aaaucaaaauuuuua

SEQ ID NO: 2558393 - RNA, 16 nt, Chlamydophila pneumoniae J138
aaaucaacucuccauc

SEQ ID NO: 2558394 - RNA, 21 nt, Chlamydophila pneumoniae J138
aaaucaacucuccauccucag

SEQ ID NO: 2558395 - RNA, 17 nt, Chlamydophila pneumoniae J138
aaaucaagccacagaga

SEQ ID NO: 2558396 - RNA, 18 nt, Chlamydophila pneumoniae J138
aaaucaagccacagagaa

SEQ ID NO: 2558397 - RNA, 13 nt, Chlamydophila pneumoniae J138
aaaucaauaauaa

SEQ ID NO: 2558398 - RNA, 16 nt, Chlamydophila pneumoniae J138
aaaucaaucuugaugg

SEQ ID NO: 2558399 - RNA, 13 nt, Chlamydophila pneumoniae J138
aaaucacacuuaa

SEQ ID NO: 2558400 - RNA, 15 nt, Chlamydophila pneumoniae J138
aaaucagaauccuga

SEQ ID NO: 2558401 - RNA, 20 nt, Chlamydophila pneumoniae J138
aaaucaucgcaaucaaagag

SEQ ID NO: 2558402 - RNA, 21 nt, Chlamydophila pneumoniae J138
aaaucauguccuucaaaaugu

SEQ ID NO: 2558403 - RNA, 19 nt, Chlamydophila pneumoniae J138
aaauccaaaaaaugcuccu

SEQ ID NO: 2558404 - RNA, 20 nt, Chlamydophila pneumoniae J138
aaaucccgaacaaucaacac

SEQ ID NO: 2558405 - RNA, 20 nt, Chlamydophila pneumoniae J138
aaaucccugaugcaguaauu

SEQ ID NO: 2558406 - RNA, 13 nt, Chlamydophila pneumoniae J138
aaauccgauaaga

SEQ ID NO: 2558407 - RNA, 14 nt, Chlamydophila pneumoniae J138
aaauccuaaaaagg

SEQ ID NO: 2558408 - RNA, 23 nt, Chlamydophila pneumoniae J138
aaauccugcucguaaaucuggaa

SEQ ID NO: 2558409 - RNA, 19 nt, Chlamydophila pneumoniae J138
aaaucgugcuuagagccuu

SEQ ID NO: 2558410 - RNA, 15 nt, Chlamydophila pneumoniae J138
aaaucuacauguaaa

SEQ ID NO: 2558411 - RNA, 20 nt, Chlamydophila pneumoniae J138
aaaucuacucuuuaaaaaua

SEQ ID NO: 2558412 - RNA, 20 nt, Chlamydophila pneumoniae J138
aaaucuaucugcacuuucuu

SEQ ID NO: 2558413 - RNA, 21 nt, Chlamydophila pneumoniae J138
aaaucucauuccagcaucuuc

SEQ ID NO: 2558414 - RNA, 17 nt, Chlamydophila pneumoniae J138
aaaucucauuucguaga

SEQ ID NO: 2558415 - RNA, 20 nt, Chlamydophila pneumoniae J138
aaaucuccguuugucccuuu

SEQ ID NO: 2558416 - RNA, 23 nt, Chlamydophila pneumoniae J138
aaaucuccguuugucccuuucag

SEQ ID NO: 2558417 - RNA, 19 nt, Chlamydophila pneumoniae J138
aaaucucgagaagacccua

SEQ ID NO: 2558418 - RNA, 22 nt, Chlamydophila pneumoniae J138
aaaucucgagcuaccuaggguc

SEQ ID NO: 2558419 - RNA, 23 nt, Chlamydophila pneumoniae J138
aaaucucgagcuaccuagggucu

SEQ ID NO: 2558420 - RNA, 23 nt, Chlamydophila pneumoniae J138
aaaucucuaguuuuuacauguaa

SEQ ID NO: 2558421 - RNA, 22 nt, Chlamydophila pneumoniae J138
aaaucuggggcuuccagaaaca

SEQ ID NO: 2558422 - RNA, 14 nt, Chlamydophila pneumoniae J138
aaaucuuacauaaa

SEQ ID NO: 2558423 - RNA, 16 nt, Chlamydophila pneumoniae J138
aaaucuuaguccauga

SEQ ID NO: 2558424 - RNA, 19 nt, Chlamydophila pneumoniae J138
aaaucuuccccuaaaaauu

SEQ ID NO: 2558425 - RNA, 16 nt, Chlamydophila pneumoniae J138
aaaucuuucaauguaa

SEQ ID NO: 2558426 - RNA, 12 nt, Chlamydophila pneumoniae J138
aaaugagagacg

SEQ ID NO: 2558427 - RNA, 12 nt, Chlamydophila pneumoniae J138
aaaugagaggga

SEQ ID NO: 2558428 - RNA, 19 nt, Chlamydophila pneumoniae J138
aaaugaggacacaacucuu

SEQ ID NO: 2558429 - RNA, 16 nt, Chlamydophila pneumoniae J138
aaaugcacuuugaaua

SEQ ID NO: 2558430 - RNA, 16 nt, Chlamydophila pneumoniae J138
aaaugcauuugccccu

SEQ ID NO: 2558431 - RNA, 12 nt, Chlamydophila pneumoniae J138
aaaugccuguac

SEQ ID NO: 2558432 - RNA, 19 nt, Chlamydophila pneumoniae J138
aaaugccuuaaauguauug

SEQ ID NO: 2558433 - RNA, 22 nt, Chlamydophila pneumoniae J138
aaaugcgcacggauucuaaaag

SEQ ID NO: 2558434 - RNA, 19 nt, Chlamydophila pneumoniae J138
aaaugcuuguauaaaugcu

SEQ ID NO: 2558435 - RNA, 15 nt, Chlamydophila pneumoniae J138
aaauguaagaaggca

SEQ ID NO: 2558436 - RNA, 21 nt, Chlamydophila pneumoniae J138
aacauaaugauguaacuagua

SEQ ID NO: 2558437 - RNA, 16 nt, Chlamydophila pneumoniae J138
aacauagauaagguaa

SEQ ID NO: 2558438 - RNA, 20 nt, Chlamydophila pneumoniae J138
aacauauucuccuuaccaau

SEQ ID NO: 2558439 - RNA, 15 nt, Chlamydophila pneumoniae J138
aacaucaaagaauua

SEQ ID NO: 2558440 - RNA, 13 nt, Chlamydophila pneumoniae J138
aacaucaaagaga

SEQ ID NO: 2558441 - RNA, 12 nt, Chlamydophila pneumoniae J138
aacaucaagaau

SEQ ID NO: 2558442 - RNA, 15 nt, Chlamydophila pneumoniae J138
aacaucaagaauuuc

SEQ ID NO: 2558443 - RNA, 18 nt, Chlamydophila pneumoniae J138
aacaucggagaacuuccu

SEQ ID NO: 2558444 - RNA, 22 nt, Chlamydophila pneumoniae J138
aacaucggagaacuuccugauu

SEQ ID NO: 2558445 - RNA, 15 nt, Chlamydophila pneumoniae J138
aacaucuccagcagc

SEQ ID NO: 2558446 - RNA, 12 nt, Chlamydophila pneumoniae J138
aacaucuuugug

SEQ ID NO: 2558447 - RNA, 14 nt, Chlamydophila pneumoniae J138
aacaugaaguuguu

SEQ ID NO: 2558448 - RNA, 23 nt, Chlamydophila pneumoniae J138
aacaugagaaauacgcuuuucuu

SEQ ID NO: 2558449 - RNA, 17 nt, Chlamydophila pneumoniae J138
aacaugccugaaaacaa

SEQ ID NO: 2558450 - RNA, 14 nt, Chlamydophila pneumoniae J138
aacaugcgcagaau

SEQ ID NO: 2558451 - RNA, 14 nt, Chlamydophila pneumoniae J138
aacauggacaauau

SEQ ID NO: 2558452 - RNA, 23 nt, Chlamydophila pneumoniae J138
aacauggcgguguuuccuucgaa

SEQ ID NO: 2558453 - RNA, 17 nt, Chlamydophila pneumoniae J138
aacauucuucugucugu

SEQ ID NO: 2558454 - RNA, 19 nt, Chlamydophila pneumoniae J138
aacauuggagucuaaaaaa

SEQ ID NO: 2558455 - RNA, 20 nt, Chlamydophila pneumoniae J138
aacauuggagucuaaaaaau

SEQ ID NO: 2558456 - RNA, 23 nt, Chlamydophila pneumoniae J138
aacauuggagucuaaaaaauacc

SEQ ID NO: 2558457 - RNA, 20 nt, Chlamydophila pneumoniae J138
aacauuuuuaaggaaaguuc

SEQ ID NO: 2558458 - RNA, 20 nt, Chlamydophila pneumoniae J138
aaccaaaagaauuaagaaga

SEQ ID NO: 2558459 - RNA, 13 nt, Chlamydophila pneumoniae J138
aaccaaaaugagu

SEQ ID NO: 2558460 - RNA, 13 nt, Chlamydophila pneumoniae J138
aaccaacaucaaa

SEQ ID NO: 2558461 - RNA, 16 nt, Chlamydophila pneumoniae J138
aaccaacaucaaagaa

SEQ ID NO: 2558462 - RNA, 23 nt, Chlamydophila pneumoniae J138
aaccaaccuuguugaaaggcuga

SEQ ID NO: 2558463 - RNA, 16 nt, Chlamydophila pneumoniae J138
aaccaauaaacuuugu

SEQ ID NO: 2558464 - RNA, 21 nt, Chlamydophila pneumoniae J138
aaccaauaaacuuuguuggga

SEQ ID NO: 2558465 - RNA, 22 nt, Chlamydophila pneumoniae J138
aaccaaucuugagcauccaaaa

SEQ ID NO: 2558466 - RNA, 23 nt, Chlamydophila pneumoniae J138
aaccaaucuugagcauccaaaau

SEQ ID NO: 2558467 - RNA, 20 nt, Chlamydophila pneumoniae J138
aaccaauugagcucucuagc

SEQ ID NO: 2558468 - RNA, 11 nt, Chlamydophila pneumoniae J138
aaccacagaau

SEQ ID NO: 2558469 - RNA, 19 nt, Chlamydophila pneumoniae J138
aaccacuguccaugcacga

SEQ ID NO: 2558470 - RNA, 19 nt, Chlamydophila pneumoniae J138
aaccagaagacucccaagg

SEQ ID NO: 2558471 - RNA, 17 nt, Chlamydophila pneumoniae J138
aaccagcauaaucagua

SEQ ID NO: 2558472 - RNA, 15 nt, Chlamydophila pneumoniae J138
aaccaggaacaaagg

SEQ ID NO: 2558473 - RNA, 13 nt, Chlamydophila pneumoniae J138
aaccauaaagaau

SEQ ID NO: 2558474 - RNA, 20 nt, Chlamydophila pneumoniae J138
aaccauagagagccuuuccu

SEQ ID NO: 2558475 - RNA, 20 nt, Chlamydophila pneumoniae J138
aaccaucaaucacucuauga

SEQ ID NO: 2558476 - RNA, 13 nt, Chlamydophila pneumoniae J138
aaccaugaggcug

SEQ ID NO: 2558477 - RNA, 14 nt, Chlamydophila pneumoniae J138
aaccaugaugcaau

SEQ ID NO: 2558478 - RNA, 19 nt, Chlamydophila pneumoniae J138
aaccauucaucuaggggag

SEQ ID NO: 2558479 - RNA, 23 nt, Chlamydophila pneumoniae J138
aacccaauucuuaaaaagcuaaa

SEQ ID NO: 2558480 - RNA, 17 nt, Chlamydophila pneumoniae J138
aacccaccagaaggaag

SEQ ID NO: 2558481 - RNA, 18 nt, Chlamydophila pneumoniae J138
aacccgauacauccucac

SEQ ID NO: 2558482 - RNA, 15 nt, Chlamydophila pneumoniae J138
aacccucaaagaaua

SEQ ID NO: 2558483 - RNA, 14 nt, Chlamydophila pneumoniae J138
aacccucagaacac

SEQ ID NO: 2558484 - RNA, 14 nt, Chlamydophila pneumoniae J138
aacccuuuaaugau

SEQ ID NO: 2558485 - RNA, 22 nt, Chlamydophila pneumoniae J138
aacccuuuaaugaucacgugga

SEQ ID NO: 2558486 - RNA, 17 nt, Chlamydophila pneumoniae J138
aaccgaaacuucucaga

SEQ ID NO: 2558487 - RNA, 20 nt, Chlamydophila pneumoniae J138
aaccggguguggcaaaggac

SEQ ID NO: 2558488 - RNA, 21 nt, Chlamydophila pneumoniae J138
aaccgucacuguuuuccagaa

SEQ ID NO: 2558489 - RNA, 22 nt, Chlamydophila pneumoniae J138
aaccgucacuguuuuccagaaa

SEQ ID NO: 2558490 - RNA, 21 nt, Chlamydophila pneumoniae J138
aaccuagaaucacauaaaaua

SEQ ID NO: 2558491 - RNA, 22 nt, Chlamydophila pneumoniae J138
aaccucggucucgcuguuucaa

SEQ ID NO: 2558492 - RNA, 13 nt, Chlamydophila pneumoniae J138
aaccucuaaaaac

SEQ ID NO: 2558493 - RNA, 12 nt, Chlamydophila pneumoniae J138
aaccucuuuucu

SEQ ID NO: 2558494 - RNA, 14 nt, Chlamydophila pneumoniae J138
aaccucuuuucuua

SEQ ID NO: 2558495 - RNA, 17 nt, Chlamydophila pneumoniae J138
aaccugggcaauauuuu

SEQ ID NO: 2558496 - RNA, 13 nt, Chlamydophila pneumoniae J138
aaccuucaaugau

SEQ ID NO: 2558497 - RNA, 14 nt, Chlamydophila pneumoniae J138
aaccuuuccuaaaa

SEQ ID NO: 2558498 - RNA, 16 nt, Chlamydophila pneumoniae J138
aaccuuuccuaaaaua

SEQ ID NO: 2558499 - RNA, 17 nt, Chlamydophila pneumoniae J138
aacgaacaguucauguu

SEQ ID NO: 2558500 - RNA, 22 nt, Chlamydophila pneumoniae J138
aacgaagugaggagaauagcaa

SEQ ID NO: 2558501 - RNA, 17 nt, Chlamydophila pneumoniae J138
aacgacguuuaauuccu

SEQ ID NO: 2558502 - RNA, 22 nt, Chlamydophila pneumoniae J138
aacgagacugcaaaggaaggga

SEQ ID NO: 2558503 - RNA, 14 nt, Chlamydophila pneumoniae J138
aacgauuucuucuu

SEQ ID NO: 2558504 - RNA, 17 nt, Chlamydophila pneumoniae J138
aacgauuucuugaagau

SEQ ID NO: 2558505 - RNA, 14 nt, Chlamydophila pneumoniae J138
aacgcacgccaaga

SEQ ID NO: 2558506 - RNA, 15 nt, Chlamydophila pneumoniae J138
aacgcacgccaagag

SEQ ID NO: 2558507 - RNA, 20 nt, Chlamydophila pneumoniae J138
aacgcaggaagaacaaguuu

SEQ ID NO: 2558508 - RNA, 16 nt, Chlamydophila pneumoniae J138
aacgcauaagagacau

SEQ ID NO: 2558509 - RNA, 21 nt, Chlamydophila pneumoniae J138
aacgcauaagagacauuucuu

SEQ ID NO: 2558510 - RNA, 22 nt, Chlamydophila pneumoniae J138
aacgcaugaaccuauaggcaag

SEQ ID NO: 2558511 - RNA, 14 nt, Chlamydophila pneumoniae J138
aacgccgcucuuga

SEQ ID NO: 2558512 - RNA, 18 nt, Chlamydophila pneumoniae J138
aacgcgagcuauuuuacu

SEQ ID NO: 2558513 - RNA, 19 nt, Chlamydophila pneumoniae J138
aacgcucucuagcaccuaa

SEQ ID NO: 2558514 - RNA, 22 nt, Chlamydophila pneumoniae J138
aacgcucucuagcaccuaauaa

SEQ ID NO: 2558515 - RNA, 15 nt, Chlamydophila pneumoniae J138
aacgcuuagagaauu

SEQ ID NO: 2558516 - RNA, 12 nt, Chlamydophila pneumoniae J138
aacgcuuuucua

SEQ ID NO: 2558517 - RNA, 21 nt, Chlamydophila pneumoniae J138
aacggacauuuucaagcuuuc

SEQ ID NO: 2558518 - RNA, 20 nt, Chlamydophila pneumoniae J138
aacggauuuuguuugcaugc

SEQ ID NO: 2558519 - RNA, 20 nt, Chlamydophila pneumoniae J138
aacggcucuuucuaaaacau

SEQ ID NO: 2558520 - RNA, 22 nt, Chlamydophila pneumoniae J138
aacguaagcuuuuuaccaauaa

SEQ ID NO: 2558521 - RNA, 23 nt, Chlamydophila pneumoniae J138
aacguacucuucuuuuuaucaug

SEQ ID NO: 2558522 - RNA, 15 nt, Chlamydophila pneumoniae J138
aacguacuuagguaa

SEQ ID NO: 2558523 - RNA, 17 nt, Chlamydophila pneumoniae J138
aacguagcuacaaaauu

SEQ ID NO: 2558524 - RNA, 14 nt, Chlamydophila pneumoniae J138
aacguggggaaauu

SEQ ID NO: 2558525 - RNA, 14 nt, Chlamydophila pneumoniae J138
aacuaaaacagccu

SEQ ID NO: 2558526 - RNA, 20 nt, Chlamydophila pneumoniae J138
aacuaaaacagccuagcaaa

SEQ ID NO: 2558527 - RNA, 15 nt, Chlamydophila pneumoniae J138
aacuaaaaguuuuuu

SEQ ID NO: 2558528 - RNA, 14 nt, Chlamydophila pneumoniae J138
aacuaaacucucca

SEQ ID NO: 2558529 - RNA, 18 nt, Chlamydophila pneumoniae J138
aacuaaacucuccaaaag

SEQ ID NO: 2558530 - RNA, 17 nt, Chlamydophila pneumoniae J138
aacuaaaucaacuacau

SEQ ID NO: 2558531 - RNA, 19 nt, Chlamydophila pneumoniae J138
aacuaaauucuuaacaaua

SEQ ID NO: 2558532 - RNA, 20 nt, Chlamydophila pneumoniae J138
aacuaacauagauaagguaa

SEQ ID NO: 2558533 - RNA, 16 nt, Chlamydophila pneumoniae J138
aacuacauaauaagca

SEQ ID NO: 2558534 - RNA, 11 nt, Chlamydophila pneumoniae J138
aacuacauaua

SEQ ID NO: 2558535 - RNA, 15 nt, Chlamydophila pneumoniae J138
aacuaccagaugccu

SEQ ID NO: 2558536 - RNA, 18 nt, Chlamydophila pneumoniae J138
aacuacuuaaauccuaag

SEQ ID NO: 2558537 - RNA, 13 nt, Chlamydophila pneumoniae J138
aacuagaaaaaau

SEQ ID NO: 2558538 - RNA, 15 nt, Chlamydophila pneumoniae J138
aacuagaaucaccaa

SEQ ID NO: 2558539 - RNA, 13 nt, Chlamydophila pneumoniae J138
aacuagaccaaua

SEQ ID NO: 2558540 - RNA, 19 nt, Chlamydophila pneumoniae J138
aacuaguaacuuaaucaau

SEQ ID NO: 2558541 - RNA, 20 nt, Chlamydophila pneumoniae J138
aacuauacucucuguagcac

SEQ ID NO: 2558542 - RNA, 20 nt, Chlamydophila pneumoniae J138
aacuauaggaagcucuucua

SEQ ID NO: 2558543 - RNA, 15 nt, Chlamydophila pneumoniae J138
aacuauccaaagccg

SEQ ID NO: 2558544 - RNA, 14 nt, Chlamydophila pneumoniae J138
aacucaacuuuuuu

SEQ ID NO: 2558545 - RNA, 15 nt, Chlamydophila pneumoniae J138
aacucacaaacaaca

SEQ ID NO: 2558546 - RNA, 17 nt, Chlamydophila pneumoniae J138
aacucagcgcaucacga

SEQ ID NO: 2558547 - RNA, 20 nt, Chlamydophila pneumoniae J138
aacucaucacaauuuuaaaa

SEQ ID NO: 2558548 - RNA, 19 nt, Chlamydophila pneumoniae J138
aacucauccuaaauuaaau

SEQ ID NO: 2558549 - RNA, 12 nt, Chlamydophila pneumoniae J138
aacuccaaaaua

SEQ ID NO: 2558550 - RNA, 13 nt, Chlamydophila pneumoniae J138
aacuccaaaauau

SEQ ID NO: 2558551 - RNA, 18 nt, Chlamydophila pneumoniae J138
aacuccacgaauucuuua

SEQ ID NO: 2558552 - RNA, 23 nt, Chlamydophila pneumoniae J138
aacuccacgaauucuuuaaaauc

SEQ ID NO: 2558553 - RNA, 14 nt, Chlamydophila pneumoniae J138
aacuccacgccaaa

SEQ ID NO: 2558554 - RNA, 22 nt, Chlamydophila pneumoniae J138
aacuccgcacuugcucuuuaau

SEQ ID NO: 2558555 - RNA, 23 nt, Chlamydophila pneumoniae J138
aacuccgcacuugcucuuuaaua

SEQ ID NO: 2558556 - RNA, 20 nt, Chlamydophila pneumoniae J138
aacuccgcccgucuuagaau

SEQ ID NO: 2558557 - RNA, 21 nt, Chlamydophila pneumoniae J138
aacuccuaagucguuaacauc

SEQ ID NO: 2558558 - RNA, 22 nt, Chlamydophila pneumoniae J138
aacuccuaagucguuaacauca

SEQ ID NO: 2558559 - RNA, 14 nt, Chlamydophila pneumoniae J138
aacuccucaaaaga

SEQ ID NO: 2558560 - RNA, 23 nt, Chlamydophila pneumoniae J138
aacuccucuaaggacaaaucucc

SEQ ID NO: 2558561 - RNA, 13 nt, Chlamydophila pneumoniae J138
aacuccuuuuaaa

SEQ ID NO: 2558562 - RNA, 14 nt, Chlamydophila pneumoniae J138
aacucuaucgaaga

SEQ ID NO: 2558563 - RNA, 17 nt, Chlamydophila pneumoniae J138
aacucucuucccccaga

SEQ ID NO: 2558564 - RNA, 13 nt, Chlamydophila pneumoniae J138
aacucucuuuaaa

SEQ ID NO: 2558565 - RNA, 23 nt, Chlamydophila pneumoniae J138
aacucuuaaagguaaagcuucuu

SEQ ID NO: 2558566 - RNA, 16 nt, Chlamydophila pneumoniae J138
aacucuuaagaauaaa

SEQ ID NO: 2558567 - RNA, 19 nt, Chlamydophila pneumoniae J138
aacucuuaagaauaaaaua

SEQ ID NO: 2558568 - RNA, 22 nt, Chlamydophila pneumoniae J138
aacucuuuaauugugcucucua

SEQ ID NO: 2558569 - RNA, 18 nt, Chlamydophila pneumoniae J138
aacucuuuaggucuuguc

SEQ ID NO: 2558570 - RNA, 14 nt, Chlamydophila pneumoniae J138
aacugauuaguuug

SEQ ID NO: 2558571 - RNA, 14 nt, Chlamydophila pneumoniae J138
aacugcauaaucuc

SEQ ID NO: 2558572 - RNA, 22 nt, Chlamydophila pneumoniae J138
aacugcuacuuuaaaguggcaa

SEQ ID NO: 2558573 - RNA, 17 nt, Chlamydophila pneumoniae J138
aacugcuccugaagcug

SEQ ID NO: 2558574 - RNA, 22 nt, Chlamydophila pneumoniae J138
aacugcuccugaagcugagaau

SEQ ID NO: 2558575 - RNA, 19 nt, Chlamydophila pneumoniae J138
aacugcuuggucacaccaa

SEQ ID NO: 2558576 - RNA, 17 nt, Chlamydophila pneumoniae J138
aacuggcuauggaagau

SEQ ID NO: 2558577 - RNA, 23 nt, Chlamydophila pneumoniae J138
aacugggcauaguggcucagugu

SEQ ID NO: 2558578 - RNA, 19 nt, Chlamydophila pneumoniae J138
aacuuaaagacuugcuucc

SEQ ID NO: 2558579 - RNA, 21 nt, Chlamydophila pneumoniae J138
aacuuaguuuugaaaagauuu

SEQ ID NO: 2558580 - RNA, 18 nt, Chlamydophila pneumoniae J138
aacuuaucgaaugcugca

SEQ ID NO: 2558581 - RNA, 19 nt, Chlamydophila pneumoniae J138
aacuucaacuucuccaacu

SEQ ID NO: 2558582 - RNA, 17 nt, Chlamydophila pneumoniae J138
aacuucaaugaagaaaa

SEQ ID NO: 2558583 - RNA, 16 nt, Chlamydophila pneumoniae J138
aacuuccugauucugu

SEQ ID NO: 2558584 - RNA, 21 nt, Chlamydophila pneumoniae J138
aacuucguuucgcuuugauaa

SEQ ID NO: 2558585 - RNA, 20 nt, Chlamydophila pneumoniae J138
aacuucuaucuuacugaaga

SEQ ID NO: 2558586 - RNA, 23 nt, Chlamydophila pneumoniae J138
aacuucuguaucgacuguacaaa

SEQ ID NO: 2558587 - RNA, 20 nt, Chlamydophila pneumoniae J138
aacuucuugugauccuugca

SEQ ID NO: 2558588 - RNA, 17 nt, Chlamydophila pneumoniae J138
aacuugauuuguuuagc

SEQ ID NO: 2558589 - RNA, 20 nt, Chlamydophila pneumoniae J138
aacuugcuuuuuugaaagcu

SEQ ID NO: 2558590 - RNA, 19 nt, Chlamydophila pneumoniae J138
aacuuguuuucguaagaga

SEQ ID NO: 2558591 - RNA, 17 nt, Chlamydophila pneumoniae J138
aacuuuaggauucaguu

SEQ ID NO: 2558592 - RNA, 17 nt, Chlamydophila pneumoniae J138
aacuuuagggaagaaau

SEQ ID NO: 2558593 - RNA, 20 nt, Chlamydophila pneumoniae J138
aacuuuccggguaaguacac

SEQ ID NO: 2558594 - RNA, 23 nt, Chlamydophila pneumoniae J138
aacuuucgaagcgcucuacaaau

SEQ ID NO: 2558595 - RNA, 12 nt, Chlamydophila pneumoniae J138
aacuuucuucuc

SEQ ID NO: 2558596 - RNA, 15 nt, Chlamydophila pneumoniae J138
aacuuuuccaaauuc

SEQ ID NO: 2558597 - RNA, 19 nt, Chlamydophila pneumoniae J138
aacuuuugaagauccugag

SEQ ID NO: 2558598 - RNA, 22 nt, Chlamydophila pneumoniae J138
aacuuuuuuacuaucuccuaga

SEQ ID NO: 2558599 - RNA, 15 nt, Chlamydophila pneumoniae J138
aacuuuuuuucuucu

SEQ ID NO: 2558600 - RNA, 16 nt, Chlamydophila pneumoniae J138
aacuuuuuuucuucuc

SEQ ID NO: 2558601 - RNA, 17 nt, Chlamydophila pneumoniae J138
aacuuuuuuucuucucu

SEQ ID NO: 2558602 - RNA, 23 nt, Chlamydophila pneumoniae J138
aacuuuuuuucuucucuaagaaa

SEQ ID NO: 2558603 - RNA, 20 nt, Chlamydophila pneumoniae J138
aagaaaaaccccuagaacuu

SEQ ID NO: 2558604 - RNA, 21 nt, Chlamydophila pneumoniae J138
aagaaaaagcaucuaugggcu

SEQ ID NO: 2558605 - RNA, 21 nt, Chlamydophila pneumoniae J138
aagaaaaaucgacuaucugcu

SEQ ID NO: 2558606 - RNA, 21 nt, Chlamydophila pneumoniae J138
aagaaaacaaagucacggcga

SEQ ID NO: 2558607 - RNA, 12 nt, Chlamydophila pneumoniae J138
aagaaaagcaau

SEQ ID NO: 2558608 - RNA, 13 nt, Chlamydophila pneumoniae J138
aagaaaagcaauc

SEQ ID NO: 2558609 - RNA, 14 nt, Chlamydophila pneumoniae J138
aagaaaauaaagau

SEQ ID NO: 2558610 - RNA, 22 nt, Chlamydophila pneumoniae J138
aagaaaauaucaccuacaucag

SEQ ID NO: 2558611 - RNA, 19 nt, Chlamydophila pneumoniae J138
aagaaaauccuaacaaaag

SEQ ID NO: 2558612 - RNA, 20 nt, Chlamydophila pneumoniae J138
aagaaaauccuaacaaaagg

SEQ ID NO: 2558613 - RNA, 23 nt, Chlamydophila pneumoniae J138
aagaaaaugaggacacaacucuu

SEQ ID NO: 2558614 - RNA, 21 nt, Chlamydophila pneumoniae J138
aagaaaauucucagauugcuu

SEQ ID NO: 2558615 - RNA, 18 nt, Chlamydophila pneumoniae J138
aagaaacccgcaacucuu

SEQ ID NO: 2558616 - RNA, 19 nt, Chlamydophila pneumoniae J138
aagaaacuuccaaaacgau

SEQ ID NO: 2558617 - RNA, 24 nt, Chlamydophila pneumoniae J138
aagaaaggauuggaugagaauuuc

SEQ ID NO: 2558618 - RNA, 17 nt, Chlamydophila pneumoniae J138
aagaaagugaaaccauu

SEQ ID NO: 2558619 - RNA, 22 nt, Chlamydophila pneumoniae J138
aagaaauauuaacccaccagaa

SEQ ID NO: 2558620 - RNA, 23 nt, Chlamydophila pneumoniae J138
aagaaauauuaacccaccagaag

SEQ ID NO: 2558621 - RNA, 13 nt, Chlamydophila pneumoniae J138
aagaaaucaaaca

SEQ ID NO: 2558622 - RNA, 15 nt, Chlamydophila pneumoniae J138
aagaaaucaaacauu

SEQ ID NO: 2558623 - RNA, 20 nt, Chlamydophila pneumoniae J138
aagaaaucuacucuuuaaaa

SEQ ID NO: 2558624 - RNA, 18 nt, Chlamydophila pneumoniae J138
aagaaaugcaaaccaaaa

SEQ ID NO: 2558625 - RNA, 22 nt, Chlamydophila pneumoniae J138
aagaaaugcaaaccaaaaaagu

SEQ ID NO: 2558626 - RNA, 11 nt, Chlamydophila pneumoniae J138
aagaaaugccc

SEQ ID NO: 2558627 - RNA, 17 nt, Chlamydophila pneumoniae J138
aagaaauguaagaaggc

SEQ ID NO: 2558628 - RNA, 13 nt, Chlamydophila pneumoniae J138
aagaaauuaacaa

SEQ ID NO: 2558629 - RNA, 15 nt, Chlamydophila pneumoniae J138
aagaaauuaacaaca

SEQ ID NO: 2558630 - RNA, 12 nt, Chlamydophila pneumoniae J138
aagaaauucuga

SEQ ID NO: 2558631 - RNA, 16 nt, Chlamydophila pneumoniae J138
aagaacagcacucucu

SEQ ID NO: 2558632 - RNA, 13 nt, Chlamydophila pneumoniae J138
aagaacaguuugc

SEQ ID NO: 2558633 - RNA, 13 nt, Chlamydophila pneumoniae J138
aagaaccauagau

SEQ ID NO: 2558634 - RNA, 13 nt, Chlamydophila pneumoniae J138
aagaacucaacuu

SEQ ID NO: 2558635 - RNA, 13 nt, Chlamydophila pneumoniae J138
aagaacuccuuug

SEQ ID NO: 2558636 - RNA, 22 nt, Chlamydophila pneumoniae J138
aagaacuccuuugagucuuuuu

SEQ ID NO: 2558637 - RNA, 20 nt, Chlamydophila pneumoniae J138
aagaacugcauaaucucacc

SEQ ID NO: 2558638 - RNA, 18 nt, Chlamydophila pneumoniae J138
aagaacuuaaaauucaaa

SEQ ID NO: 2558639 - RNA, 20 nt, Chlamydophila pneumoniae J138
aagaacuuaaaauucaaauc

SEQ ID NO: 2558640 - RNA, 15 nt, Chlamydophila pneumoniae J138
aagaacuuuagggaa

SEQ ID NO: 2558641 - RNA, 12 nt, Chlamydophila pneumoniae J138
aagaagaagaaa

SEQ ID NO: 2558642 - RNA, 15 nt, Chlamydophila pneumoniae J138
aagaagaaggacaac

SEQ ID NO: 2558643 - RNA, 21 nt, Chlamydophila pneumoniae J138
aagaagcagcacucuuuuucu

SEQ ID NO: 2558644 - RNA, 20 nt, Chlamydophila pneumoniae J138
aagaagcucacucuuuaaaa

SEQ ID NO: 2558645 - RNA, 20 nt, Chlamydophila pneumoniae J138
aagaagcucguacuguuccu

SEQ ID NO: 2558646 - RNA, 19 nt, Chlamydophila pneumoniae J138
aagaagcucuaucuuuggu

SEQ ID NO: 2558647 - RNA, 14 nt, Chlamydophila pneumoniae J138
aagaaggcagagaa

SEQ ID NO: 2558648 - RNA, 16 nt, Chlamydophila pneumoniae J138
aagaaguacaagugaa

SEQ ID NO: 2558649 - RNA, 13 nt, Chlamydophila pneumoniae J138
aagaauaaaauag

SEQ ID NO: 2558650 - RNA, 15 nt, Chlamydophila pneumoniae J138
aagaauagcaggaag

SEQ ID NO: 2558651 - RNA, 18 nt, Chlamydophila pneumoniae J138
aagaauagcguagaggac

SEQ ID NO: 2558652 - RNA, 19 nt, Chlamydophila pneumoniae J138
aagaauaucuuuugaaucu

SEQ ID NO: 2558653 - RNA, 22 nt, Chlamydophila pneumoniae J138
aagaaucgccgcuugaggagga

SEQ ID NO: 2558654 - RNA, 17 nt, Chlamydophila pneumoniae J138
aagaaucuauaaauuca

SEQ ID NO: 2558655 - RNA, 18 nt, Chlamydophila pneumoniae J138
aagaaucuauagaacuaa

SEQ ID NO: 2558656 - RNA, 20 nt, Chlamydophila pneumoniae J138
aagaauguagcuguuccaag

SEQ ID NO: 2558657 - RNA, 21 nt, Chlamydophila pneumoniae J138
aagaauguagcuguuccaaga

SEQ ID NO: 2558658 - RNA, 19 nt, Chlamydophila pneumoniae J138
aagaauuaccgcgagccau

SEQ ID NO: 2558659 - RNA, 23 nt, Chlamydophila pneumoniae J138
aagaauuccuaaaacgagcaggg

SEQ ID NO: 2558660 - RNA, 17 nt, Chlamydophila pneumoniae J138
aagaauucuuugccaag

SEQ ID NO: 2558661 - RNA, 20 nt, Chlamydophila pneumoniae J138
aagaauuucuucuuuccaua

SEQ ID NO: 2558662 - RNA, 22 nt, Chlamydophila pneumoniae J138
aagaauuuguaacucuuaagaa

SEQ ID NO: 2558663 - RNA, 16 nt, Chlamydophila pneumoniae J138
aagacaauaaaaaaga

SEQ ID NO: 2558664 - RNA, 16 nt, Chlamydophila pneumoniae J138
aagacaccgaaagaaa

SEQ ID NO: 2558665 - RNA, 19 nt, Chlamydophila pneumoniae J138
aagacaggcucaugaaauu

SEQ ID NO: 2558666 - RNA, 15 nt, Chlamydophila pneumoniae J138
aagacaucuccugca

SEQ ID NO: 2558667 - RNA, 21 nt, Chlamydophila pneumoniae J138
aagacaugagggcaugccuau

SEQ ID NO: 2558668 - RNA, 20 nt, Chlamydophila pneumoniae J138
aagacauucauuuuuuaaua

SEQ ID NO: 2558669 - RNA, 14 nt, Chlamydophila pneumoniae J138
aagacccuucuuuc

SEQ ID NO: 2558670 - RNA, 15 nt, Chlamydophila pneumoniae J138
aagaccuaacgcaac

SEQ ID NO: 2558671 - RNA, 20 nt, Chlamydophila pneumoniae J138
aagaccuaacgcaacaucca

SEQ ID NO: 2558672 - RNA, 16 nt, Chlamydophila pneumoniae J138
aagacgagaacaugac

SEQ ID NO: 2558673 - RNA, 17 nt, Chlamydophila pneumoniae J138
aagacgcggaacucucu

SEQ ID NO: 2558674 - RNA, 13 nt, Chlamydophila pneumoniae J138
aagacuaaaaaag

SEQ ID NO: 2558675 - RNA, 14 nt, Chlamydophila pneumoniae J138
aagacuaaaaaaga

SEQ ID NO: 2558676 - RNA, 15 nt, Chlamydophila pneumoniae J138
aagacuaaaaaagag

SEQ ID NO: 2558677 - RNA, 16 nt, Chlamydophila pneumoniae J138
aagacuaaaaaagaga

SEQ ID NO: 2558678 - RNA, 17 nt, Chlamydophila pneumoniae J138
aagacuacgacagaagu

SEQ ID NO: 2558679 - RNA, 20 nt, Chlamydophila pneumoniae J138
aagacuagcuuuuuuuauga

SEQ ID NO: 2558680 - RNA, 19 nt, Chlamydophila pneumoniae J138
aagacucaugaaauagugu

SEQ ID NO: 2558681 - RNA, 21 nt, Chlamydophila pneumoniae J138
aagacuccaagucagccaaga

SEQ ID NO: 2558682 - RNA, 17 nt, Chlamydophila pneumoniae J138
aagacucccaaggaaau

SEQ ID NO: 2558683 - RNA, 14 nt, Chlamydophila pneumoniae J138
aagacucucaucag

SEQ ID NO: 2558684 - RNA, 19 nt, Chlamydophila pneumoniae J138
aagacucucaucagcaaaa

SEQ ID NO: 2558685 - RNA, 16 nt, Chlamydophila pneumoniae J138
aagacugaaaagaucg

SEQ ID NO: 2558686 - RNA, 15 nt, Chlamydophila pneumoniae J138
aagacugucuaugau

SEQ ID NO: 2558687 - RNA, 15 nt, Chlamydophila pneumoniae J138
aagacuguguuuuau

SEQ ID NO: 2558688 - RNA, 20 nt, Chlamydophila pneumoniae J138
aagacuucgaugucuuucca

SEQ ID NO: 2558689 - RNA, 21 nt, Chlamydophila pneumoniae J138
aagacuucgaugucuuuccag

SEQ ID NO: 2558690 - RNA, 14 nt, Chlamydophila pneumoniae J138
aagagaaaagauag

SEQ ID NO: 2558691 - RNA, 15 nt, Chlamydophila pneumoniae J138
aagagaaucuccuca

SEQ ID NO: 2558692 - RNA, 21 nt, Chlamydophila pneumoniae J138
aagagaaucuccucaucagaa

SEQ ID NO: 2558693 - RNA, 20 nt, Chlamydophila pneumoniae J138
aagagagcuugucacacugc

SEQ ID NO: 2558694 - RNA, 17 nt, Chlamydophila pneumoniae J138
aagagaucacagggaca

SEQ ID NO: 2558695 - RNA, 16 nt, Chlamydophila pneumoniae J138
aagagcaaacaucaaa

SEQ ID NO: 2558696 - RNA, 21 nt, Chlamydophila pneumoniae J138
aagagcaacaguaauuauuuu

SEQ ID NO: 2558697 - RNA, 22 nt, Chlamydophila pneumoniae J138
aagagcaagguaacauccauag

SEQ ID NO: 2558698 - RNA, 20 nt, Chlamydophila pneumoniae J138
aagagcaauuaagaaacuag

SEQ ID NO: 2558699 - RNA, 16 nt, Chlamydophila pneumoniae J138
aagagcaucuuuggga

SEQ ID NO: 2558700 - RNA, 17 nt, Chlamydophila pneumoniae J138
aagagcccccauaggaa

SEQ ID NO: 2558701 - RNA, 14 nt, Chlamydophila pneumoniae J138
aagagcgcauuuua

SEQ ID NO: 2558702 - RNA, 15 nt, Chlamydophila pneumoniae J138
aagagcuaaagaaac

SEQ ID NO: 2558703 - RNA, 16 nt, Chlamydophila pneumoniae J138
aagagcuaaagaaacu

SEQ ID NO: 2558704 - RNA, 17 nt, Chlamydophila pneumoniae J138
aagagcuaaagaaacuu

SEQ ID NO: 2558705 - RNA, 22 nt, Chlamydophila pneumoniae J138
aagagcucaucggaucuuuucu

SEQ ID NO: 2558706 - RNA, 23 nt, Chlamydophila pneumoniae J138
aagagcucaucggaucuuuucuu

SEQ ID NO: 2558707 - RNA, 17 nt, Chlamydophila pneumoniae J138
aagagcucguaauccuu

SEQ ID NO: 2558708 - RNA, 18 nt, Chlamydophila pneumoniae J138
aagagcucuugagaaagc

SEQ ID NO: 2558709 - RNA, 19 nt, Chlamydophila pneumoniae J138
aauagcaagagcuauaccu

SEQ ID NO: 2558710 - RNA, 20 nt, Chlamydophila pneumoniae J138
aauagcaagcgcuagugcaa

SEQ ID NO: 2558711 - RNA, 16 nt, Chlamydophila pneumoniae J138
aauagcaaguagcucu

SEQ ID NO: 2558712 - RNA, 14 nt, Chlamydophila pneumoniae J138
aauagcaauggcuu

SEQ ID NO: 2558713 - RNA, 23 nt, Chlamydophila pneumoniae J138
aauagcaggaaggaauagagaaa

SEQ ID NO: 2558714 - RNA, 21 nt, Chlamydophila pneumoniae J138
aauagcaucccuucuucuuuu

SEQ ID NO: 2558715 - RNA, 20 nt, Chlamydophila pneumoniae J138
aauagcgacaugagaaaucu

SEQ ID NO: 2558716 - RNA, 13 nt, Chlamydophila pneumoniae J138
aauagcuaaagug

SEQ ID NO: 2558717 - RNA, 15 nt, Chlamydophila pneumoniae J138
aauagcucuggagau

SEQ ID NO: 2558718 - RNA, 14 nt, Chlamydophila pneumoniae J138
aauagcucuuuuca

SEQ ID NO: 2558719 - RNA, 17 nt, Chlamydophila pneumoniae J138
aauagcucuuuucauga

SEQ ID NO: 2558720 - RNA, 22 nt, Chlamydophila pneumoniae J138
aauagcuucugacucuguugca

SEQ ID NO: 2558721 - RNA, 16 nt, Chlamydophila pneumoniae J138
aauaggaacaaagcuc

SEQ ID NO: 2558722 - RNA, 14 nt, Chlamydophila pneumoniae J138
aauaggagaagccc

SEQ ID NO: 2558723 - RNA, 16 nt, Chlamydophila pneumoniae J138
aauaggauaagaaauu

SEQ ID NO: 2558724 - RNA, 14 nt, Chlamydophila pneumoniae J138
aauaggcacccaaa

SEQ ID NO: 2558725 - RNA, 22 nt, Chlamydophila pneumoniae J138
aauaggcauuacacaacucuuu

SEQ ID NO: 2558726 - RNA, 17 nt, Chlamydophila pneumoniae J138
aauaggcucuuuagcaa

SEQ ID NO: 2558727 - RNA, 15 nt, Chlamydophila pneumoniae J138
aauagguuucaauag

SEQ ID NO: 2558728 - RNA, 20 nt, Chlamydophila pneumoniae J138
aagauuuuaggggguuuuuc

SEQ ID NO: 2558729 - RNA, 22 nt, Chlamydophila pneumoniae J138
aagauuuuaggggguuuuucua

SEQ ID NO: 2558730 - RNA, 21 nt, Chlamydophila pneumoniae J138
aagauuuuggugagaucaucu

SEQ ID NO: 2558731 - RNA, 18 nt, Chlamydophila pneumoniae J138
aagauuuuguaggaacau

SEQ ID NO: 2558732 - RNA, 15 nt, Chlamydophila pneumoniae J138
aagauuuuuagaaua

SEQ ID NO: 2558733 - RNA, 16 nt, Chlamydophila pneumoniae J138
aagauuuuuagaauag

SEQ ID NO: 2558734 - RNA, 13 nt, Chlamydophila pneumoniae J138
aagcaaaagcaag

SEQ ID NO: 2558735 - RNA, 12 nt, Chlamydophila pneumoniae J138
aagcaaaaguca

SEQ ID NO: 2558736 - RNA, 18 nt, Chlamydophila pneumoniae J138
aagcaaaugccuguacua

SEQ ID NO: 2558737 - RNA, 13 nt, Chlamydophila pneumoniae J138
aagcaacucuuca

SEQ ID NO: 2558738 - RNA, 20 nt, Chlamydophila pneumoniae J138
aagcaauaucuauagaaggc

SEQ ID NO: 2558739 - RNA, 15 nt, Chlamydophila pneumoniae J138
aagcaauauuucugu

SEQ ID NO: 2558740 - RNA, 13 nt, Chlamydophila pneumoniae J138
aagcaauccagua

SEQ ID NO: 2558741 - RNA, 22 nt, Chlamydophila pneumoniae J138
aagcaaucccccagcauucacu

SEQ ID NO: 2558742 - RNA, 22 nt, Chlamydophila pneumoniae J138
aagcacauacaguacgcaaagu

SEQ ID NO: 2558743 - RNA, 17 nt, Chlamydophila pneumoniae J138
aagcaccacgaccuaca

SEQ ID NO: 2558744 - RNA, 14 nt, Chlamydophila pneumoniae J138
aagcacccucuuca

SEQ ID NO: 2558745 - RNA, 18 nt, Chlamydophila pneumoniae J138
aagcacccucuucauccg

SEQ ID NO: 2558746 - RNA, 20 nt, Chlamydophila pneumoniae J138
aagcacccucuucauccgaa

SEQ ID NO: 2558747 - RNA, 22 nt, Chlamydophila pneumoniae J138
aagcacucuuaauuaaaaacug

SEQ ID NO: 2558748 - RNA, 12 nt, Chlamydophila pneumoniae J138
aagcacugauga

SEQ ID NO: 2558749 - RNA, 12 nt, Chlamydophila pneumoniae J138
aagcacuuaaaa

SEQ ID NO: 2558750 - RNA, 20 nt, Chlamydophila pneumoniae J138
aagcacuuguuuuuucuucu

SEQ ID NO: 2558751 - RNA, 19 nt, Chlamydophila pneumoniae J138
aagcagaaacuuuaaaagc

SEQ ID NO: 2558752 - RNA, 14 nt, Chlamydophila pneumoniae J138
aagcagauagagcu

SEQ ID NO: 2558753 - RNA, 18 nt, Chlamydophila pneumoniae J138
aagcagauccugcuucua

SEQ ID NO: 2558754 - RNA, 18 nt, Chlamydophila pneumoniae J138
aagcagccucuucucuac

SEQ ID NO: 2558755 - RNA, 13 nt, Chlamydophila pneumoniae J138
aagcagcgaagau

SEQ ID NO: 2558756 - RNA, 12 nt, Chlamydophila pneumoniae J138
aagcaggagcau

SEQ ID NO: 2558757 - RNA, 21 nt, Chlamydophila pneumoniae J138
aagcaggugugugguaaaaau

SEQ ID NO: 2558758 - RNA, 23 nt, Chlamydophila pneumoniae J138
aagcagugugccaauuuuuguag

SEQ ID NO: 2558759 - RNA, 16 nt, Chlamydophila pneumoniae J138
aagcauagcccgaaau

SEQ ID NO: 2558760 - RNA, 16 nt, Chlamydophila pneumoniae J138
aagcauagucgucuuu

SEQ ID NO: 2558761 - RNA, 20 nt, Chlamydophila pneumoniae J138
aagcaucacggacuccgucu

SEQ ID NO: 2558762 - RNA, 15 nt, Chlamydophila pneumoniae J138
aagcaucauugaaac

SEQ ID NO: 2558763 - RNA, 17 nt, Chlamydophila pneumoniae J138
aagcaucuuucaucaau

SEQ ID NO: 2558764 - RNA, 14 nt, Chlamydophila pneumoniae J138
aagcaugaagcaga

SEQ ID NO: 2558765 - RNA, 20 nt, Chlamydophila pneumoniae J138
aagcauucugcuagagcuuu

SEQ ID NO: 2558766 - RNA, 15 nt, Chlamydophila pneumoniae J138
aagcauugcaaauaa

SEQ ID NO: 2558767 - RNA, 20 nt, Chlamydophila pneumoniae J138
aagcauugcaaauaagccag

SEQ ID NO: 2558768 - RNA, 15 nt, Chlamydophila pneumoniae J138
aagccaaaaggcaca

SEQ ID NO: 2558769 - RNA, 15 nt, Chlamydophila pneumoniae J138
aagccaagaagaugu

SEQ ID NO: 2558770 - RNA, 15 nt, Chlamydophila pneumoniae J138
aagccaguacuaaau

SEQ ID NO: 2558771 - RNA, 18 nt, Chlamydophila pneumoniae J138
aagccagucuucauaaga

SEQ ID NO: 2558772 - RNA, 20 nt, Chlamydophila pneumoniae J138
aagccaugcaaugaaggcgu

SEQ ID NO: 2558773 - RNA, 21 nt, Chlamydophila pneumoniae J138
aagccauuugguaguuuuuca

SEQ ID NO: 2558774 - RNA, 14 nt, Chlamydophila pneumoniae J138
aagccauuuucuaa

SEQ ID NO: 2558775 - RNA, 17 nt, Chlamydophila pneumoniae J138
aagccauuuucuaagag

SEQ ID NO: 2558776 - RNA, 14 nt, Chlamydophila pneumoniae J138
aagcccauuccugc

SEQ ID NO: 2558777 - RNA, 15 nt, Chlamydophila pneumoniae J138
aagcccccuccccca

SEQ ID NO: 2558778 - RNA, 21 nt, Chlamydophila pneumoniae J138
aagcccucauccccucagaaa

SEQ ID NO: 2558779 - RNA, 16 nt, Chlamydophila pneumoniae J138
aagccgauacccaucu

SEQ ID NO: 2558780 - RNA, 20 nt, Chlamydophila pneumoniae J138
aagccgauacccaucuagaa

SEQ ID NO: 2558781 - RNA, 18 nt, Chlamydophila pneumoniae J138
aagccggcccacucaaaa

SEQ ID NO: 2558782 - RNA, 22 nt, Chlamydophila pneumoniae J138
aagccggcccacucaaaagaag

SEQ ID NO: 2558783 - RNA, 23 nt, Chlamydophila pneumoniae J138
aagccugucuuaucuaaagaaau

SEQ ID NO: 2558784 - RNA, 17 nt, Chlamydophila pneumoniae J138
aagccuucauuccauga

SEQ ID NO: 2558785 - RNA, 14 nt, Chlamydophila pneumoniae J138
aagccuuucuuauu

SEQ ID NO: 2558786 - RNA, 19 nt, Chlamydophila pneumoniae J138
aagccuuugcucacuguuu

SEQ ID NO: 2558787 - RNA, 19 nt, Chlamydophila pneumoniae J138
aagcgauuucgacagcagc

SEQ ID NO: 2558788 - RNA, 17 nt, Chlamydophila pneumoniae J138
aagcguagcaaaguuaa

SEQ ID NO: 2558789 - RNA, 17 nt, Chlamydophila pneumoniae J138
aagcguuaacaacuucu

SEQ ID NO: 2558790 - RNA, 19 nt, Chlamydophila pneumoniae J138
aagcguuucgacgagaagg

SEQ ID NO: 2558791 - RNA, 13 nt, Chlamydophila pneumoniae J138
aagcuaaaaugcg

SEQ ID NO: 2558792 - RNA, 17 nt, Chlamydophila pneumoniae J138
aagcuaacaccucuuca

SEQ ID NO: 2558793 - RNA, 20 nt, Chlamydophila pneumoniae J138
aagcuaauaagauccaaaaa

SEQ ID NO: 2558794 - RNA, 16 nt, Chlamydophila pneumoniae J138
aagcuagucuucuuag

SEQ ID NO: 2558795 - RNA, 15 nt, Chlamydophila pneumoniae J138
aagcuagucuuucua

SEQ ID NO: 2558796 - RNA, 15 nt, Chlamydophila pneumoniae J138
aagcuauuguuuuuc

SEQ ID NO: 2558797 - RNA, 14 nt, Chlamydophila pneumoniae J138
aagcucauaagaaa

SEQ ID NO: 2558798 - RNA, 16 nt, Chlamydophila pneumoniae J138
aagcucgaccucuagc

SEQ ID NO: 2558799 - RNA, 17 nt, Chlamydophila pneumoniae J138
aagcucgcguauuuucg

SEQ ID NO: 2558800 - RNA, 14 nt, Chlamydophila pneumoniae J138
aagcucuccuucag

SEQ ID NO: 2558801 - RNA, 14 nt, Chlamydophila pneumoniae J138
aagcucuuaauuuc

SEQ ID NO: 2558802 - RNA, 19 nt, Chlamydophila pneumoniae J138
aagcucuucuacuuuaaga

SEQ ID NO: 2558803 - RNA, 16 nt, Chlamydophila pneumoniae J138
aagcucuuucauaaga

SEQ ID NO: 2558804 - RNA, 22 nt, Chlamydophila pneumoniae J138
aagcugagaauacaacccuuua

SEQ ID NO: 2558805 - RNA, 18 nt, Chlamydophila pneumoniae J138
aagcugagguagcaucuc

SEQ ID NO: 2558806 - RNA, 24 nt, Chlamydophila pneumoniae J138
aagcugagguagcaucucucucca

SEQ ID NO: 2558807 - RNA, 15 nt, Chlamydophila pneumoniae J138
aagcugcaaacugau

SEQ ID NO: 2558808 - RNA, 17 nt, Chlamydophila pneumoniae J138
aagcugcaaacugaucu

SEQ ID NO: 2558809 - RNA, 20 nt, Chlamydophila pneumoniae J138
aagcugcaaucucaaaauca

SEQ ID NO: 2558810 - RNA, 23 nt, Chlamydophila pneumoniae J138
aagcugccagugacauaaucaca

SEQ ID NO: 2558811 - RNA, 21 nt, Chlamydophila pneumoniae J138
aagcugcuucgggaacgugcu

SEQ ID NO: 2558812 - RNA, 18 nt, Chlamydophila pneumoniae J138
aagcuggauucugucuau

SEQ ID NO: 2558813 - RNA, 14 nt, Chlamydophila pneumoniae J138
aagcuguacuugau

SEQ ID NO: 2558814 - RNA, 23 nt, Chlamydophila pneumoniae J138
aagcuguacuugauauuguucuu

SEQ ID NO: 2558815 - RNA, 12 nt, Chlamydophila pneumoniae J138
aagcugugcauu

SEQ ID NO: 2558816 - RNA, 18 nt, Chlamydophila pneumoniae J138
aagcugugguaucgaugu

SEQ ID NO: 2558817 - RNA, 19 nt, Chlamydophila pneumoniae J138
aagcuuaucccauaaaugu

SEQ ID NO: 2558818 - RNA, 15 nt, Chlamydophila pneumoniae J138
aagcuucaaugaugu

SEQ ID NO: 2558819 - RNA, 18 nt, Chlamydophila pneumoniae J138
aagcuucaucaaaacaua

SEQ ID NO: 2558820 - RNA, 20 nt, Chlamydophila pneumoniae J138
aagcuuccaucguuagauuu

SEQ ID NO: 2558821 - RNA, 23 nt, Chlamydophila pneumoniae J138
aagcuuccggcuuguaggaucug

SEQ ID NO: 2558822 - RNA, 22 nt, Chlamydophila pneumoniae J138
aagcuucggggaagcguagcaa

SEQ ID NO: 2558823 - RNA, 21 nt, Chlamydophila pneumoniae J138
aagcuucguccugacacaacu

SEQ ID NO: 2558824 - RNA, 20 nt, Chlamydophila pneumoniae J138
aagcuucuuuaauuccaacu

SEQ ID NO: 2558825 - RNA, 13 nt, Chlamydophila pneumoniae J138
aagcuucuuucuc

SEQ ID NO: 2558826 - RNA, 22 nt, Chlamydophila pneumoniae J138
aagcuuguuccacuugcucuuu

SEQ ID NO: 2558827 - RNA, 17 nt, Chlamydophila pneumoniae J138
aagcuuuuaauguguuc

SEQ ID NO: 2558828 - RNA, 23 nt, Chlamydophila pneumoniae J138
aagcuuuucuuccaaagacugag

SEQ ID NO: 2558829 - RNA, 22 nt, Chlamydophila pneumoniae J138
aaucguucccaucacauaaauc

SEQ ID NO: 2558830 - RNA, 20 nt, Chlamydophila pneumoniae J138
aaucguuucuauagacucua

SEQ ID NO: 2558831 - RNA, 18 nt, Chlamydophila pneumoniae J138
aaucguuuuauuuuagga

SEQ ID NO: 2558832 - RNA, 19 nt, Chlamydophila pneumoniae J138
aaucuaaaaacuucccauc

SEQ ID NO: 2558833 - RNA, 23 nt, Chlamydophila pneumoniae J138
aaucuaaaaacuucccaucuugu

SEQ ID NO: 2558834 - RNA, 14 nt, Chlamydophila pneumoniae J138
aaucuaaaaccuga

SEQ ID NO: 2558835 - RNA, 15 nt, Chlamydophila pneumoniae J138
aaucuaacucuugua

SEQ ID NO: 2558836 - RNA, 13 nt, Chlamydophila pneumoniae J138
aaucuaagaacua

SEQ ID NO: 2558837 - RNA, 13 nt, Chlamydophila pneumoniae J138
aaucuaagaaucu

SEQ ID NO: 2558838 - RNA, 19 nt, Chlamydophila pneumoniae J138
aaucuaauuuuagaacuuc

SEQ ID NO: 2558839 - RNA, 18 nt, Chlamydophila pneumoniae J138
aaucuaccgugaagauuu

SEQ ID NO: 2558840 - RNA, 14 nt, Chlamydophila pneumoniae J138
aaucuauaaauuca

SEQ ID NO: 2558841 - RNA, 17 nt, Chlamydophila pneumoniae J138
aaucuauccuucgaccu

SEQ ID NO: 2558842 - RNA, 21 nt, Chlamydophila pneumoniae J138
aaucuaucugcacuuucuuuu

SEQ ID NO: 2558843 - RNA, 11 nt, Chlamydophila pneumoniae J138
aaucuaugaga

SEQ ID NO: 2558844 - RNA, 19 nt, Chlamydophila pneumoniae J138
aaucucaaaaucaaauaga

SEQ ID NO: 2558845 - RNA, 20 nt, Chlamydophila pneumoniae J138
aaucucaccagaagcaacua

SEQ ID NO: 2558846 - RNA, 18 nt, Chlamydophila pneumoniae J138
aaucucauuccagcaucu

SEQ ID NO: 2558847 - RNA, 16 nt, Chlamydophila pneumoniae J138
aaucuccucaucagaa

SEQ ID NO: 2558848 - RNA, 14 nt, Chlamydophila pneumoniae J138
aaucuccucucuca

SEQ ID NO: 2558849 - RNA, 13 nt, Chlamydophila pneumoniae J138
aaucucuaagaau

SEQ ID NO: 2558850 - RNA, 17 nt, Chlamydophila pneumoniae J138
aaucucuaugcgcucua

SEQ ID NO: 2558851 - RNA, 21 nt, Chlamydophila pneumoniae J138
aaucucuuuaaaaauuaaagu

SEQ ID NO: 2558852 - RNA, 20 nt, Chlamydophila pneumoniae J138
aaucucuuucauaaauucag

SEQ ID NO: 2558853 - RNA, 13 nt, Chlamydophila pneumoniae J138
aaucugaaucuca

SEQ ID NO: 2558854 - RNA, 22 nt, Chlamydophila pneumoniae J138
aaucugacgugcauugaauccu

SEQ ID NO: 2558855 - RNA, 24 nt, Chlamydophila pneumoniae J138
aaucugacgugcauugaauccuuc

SEQ ID NO: 2558856 - RNA, 11 nt, Chlamydophila pneumoniae J138
aaucugauuca

SEQ ID NO: 2558857 - RNA, 17 nt, Chlamydophila pneumoniae J138
aaucugauucaauugag

SEQ ID NO: 2558858 - RNA, 14 nt, Chlamydophila pneumoniae J138
aaucugcaagauua

SEQ ID NO: 2558859 - RNA, 18 nt, Chlamydophila pneumoniae J138
aaucuggggcuuccagaa

SEQ ID NO: 2558860 - RNA, 21 nt, Chlamydophila pneumoniae J138
aaucuguauccgacucuguuu

SEQ ID NO: 2558861 - RNA, 15 nt, Chlamydophila pneumoniae J138
aaucuuacauaaacc

SEQ ID NO: 2558862 - RNA, 23 nt, Chlamydophila pneumoniae J138
aaucuuacauaaaccuuugguuu

SEQ ID NO: 2558863 - RNA, 18 nt, Chlamydophila pneumoniae J138
aaucuuaugggagaagcu

SEQ ID NO: 2558864 - RNA, 13 nt, Chlamydophila pneumoniae J138
aaucuuccccuaa

SEQ ID NO: 2558865 - RNA, 23 nt, Chlamydophila pneumoniae J138
aaucuugagcauccaaaaugucu

SEQ ID NO: 2558866 - RNA, 18 nt, Chlamydophila pneumoniae J138
aaucuugaucagcaauca

SEQ ID NO: 2558867 - RNA, 21 nt, Chlamydophila pneumoniae J138
aaucuugauggggaguuagga

SEQ ID NO: 2558868 - RNA, 14 nt, Chlamydophila pneumoniae J138
aaucuuguaaguua

SEQ ID NO: 2558869 - RNA, 17 nt, Chlamydophila pneumoniae J138
aaucuuucaaaagaaau

SEQ ID NO: 2558870 - RNA, 15 nt, Chlamydophila pneumoniae J138
aaucuuucaauguaa

SEQ ID NO: 2558871 - RNA, 17 nt, Chlamydophila pneumoniae J138
aaucuuugaacaaaaag

SEQ ID NO: 2558872 - RNA, 20 nt, Chlamydophila pneumoniae J138
aaucuuugaagcucgaccuc

SEQ ID NO: 2558873 - RNA, 19 nt, Chlamydophila pneumoniae J138
aaucuuugaucgcuugugc

SEQ ID NO: 2558874 - RNA, 14 nt, Chlamydophila pneumoniae J138
aaucuuuucuugua

SEQ ID NO: 2558875 - RNA, 21 nt, Chlamydophila pneumoniae J138
aaugaaaccuucagaucgaau

SEQ ID NO: 2558876 - RNA, 16 nt, Chlamydophila pneumoniae J138
aaugaaacgaaagcag

SEQ ID NO: 2558877 - RNA, 15 nt, Chlamydophila pneumoniae J138
aaugaagccaaaagg

SEQ ID NO: 2558878 - RNA, 20 nt, Chlamydophila pneumoniae J138
aaugaagccaaaaggcacag

SEQ ID NO: 2558879 - RNA, 16 nt, Chlamydophila pneumoniae J138
aaugaaucgaagaaca

SEQ ID NO: 2558880 - RNA, 17 nt, Chlamydophila pneumoniae J138
aaugaauggguuuuguu

SEQ ID NO: 2558881 - RNA, 13 nt, Chlamydophila pneumoniae J138
aaugacacagaga

SEQ ID NO: 2558882 - RNA, 14 nt, Chlamydophila pneumoniae J138
aaugacacagagaa

SEQ ID NO: 2558883 - RNA, 16 nt, Chlamydophila pneumoniae J138
aaugacagcugagaaa

SEQ ID NO: 2558884 - RNA, 21 nt, Chlamydophila pneumoniae J138
aaugacagcugagaaauuccu

SEQ ID NO: 2558885 - RNA, 22 nt, Chlamydophila pneumoniae J138
aaugacagcugagaaauuccua

SEQ ID NO: 2558886 - RNA, 17 nt, Chlamydophila pneumoniae J138
aaugacuuuagaaauuc

SEQ ID NO: 2558887 - RNA, 17 nt, Chlamydophila pneumoniae J138
aaugacuuuuuuguuaa

SEQ ID NO: 2558888 - RNA, 15 nt, Chlamydophila pneumoniae J138
aaugagcucuauuuc

SEQ ID NO: 2558889 - RNA, 16 nt, Chlamydophila pneumoniae J138
aauugcuguuccauaa

SEQ ID NO: 2558890 - RNA, 22 nt, Chlamydophila pneumoniae J138
aauugcuguuccauaauuuuag

SEQ ID NO: 2558891 - RNA, 12 nt, Chlamydophila pneumoniae J138
aauuguagagag

SEQ ID NO: 2558892 - RNA, 15 nt, Chlamydophila pneumoniae J138
aauugucuucagugc

SEQ ID NO: 2558893 - RNA, 17 nt, Chlamydophila pneumoniae J138
aauuguguguuuucaua

SEQ ID NO: 2558894 - RNA, 14 nt, Chlamydophila pneumoniae J138
aauuuaaaucugca

SEQ ID NO: 2558895 - RNA, 20 nt, Chlamydophila pneumoniae J138
aauuuaucggcuaaagaaaa

SEQ ID NO: 2558896 - RNA, 22 nt, Chlamydophila pneumoniae J138
aauuucaaagaugcagauacua

SEQ ID NO: 2558897 - RNA, 17 nt, Chlamydophila pneumoniae J138
aauuucauguccuccau

SEQ ID NO: 2558898 - RNA, 19 nt, Chlamydophila pneumoniae J138
aauuucauuugaaauauga

SEQ ID NO: 2558899 - RNA, 14 nt, Chlamydophila pneumoniae J138
aauuuccuuagaag

SEQ ID NO: 2558900 - RNA, 18 nt, Chlamydophila pneumoniae J138
aauuucggacgauauuua

SEQ ID NO: 2558901 - RNA, 14 nt, Chlamydophila pneumoniae J138
aauuucgucuucau

SEQ ID NO: 2558902 - RNA, 15 nt, Chlamydophila pneumoniae J138
aauuucuaggacagc

SEQ ID NO: 2558903 - RNA, 15 nt, Chlamydophila pneumoniae J138
aauuucugaaacaau

SEQ ID NO: 2558904 - RNA, 18 nt, Chlamydophila pneumoniae J138
aauuucugaaacaaugca

SEQ ID NO: 2558905 - RNA, 18 nt, Chlamydophila pneumoniae J138
aauuucuuucacaucuuu

SEQ ID NO: 2558906 - RNA, 21 nt, Chlamydophila pneumoniae J138
aauuucuuuuugccaauuuuc

SEQ ID NO: 2558907 - RNA, 21 nt, Chlamydophila pneumoniae J138
aauuugcaagagccggaacuu

SEQ ID NO: 2558908 - RNA, 15 nt, Chlamydophila pneumoniae J138
aauuugccugaaauc

SEQ ID NO: 2558909 - RNA, 23 nt, Chlamydophila pneumoniae J138
aauuugcguugcauguccauuaa

SEQ ID NO: 2558910 - RNA, 14 nt, Chlamydophila pneumoniae J138
aauuugcuccucca

SEQ ID NO: 2558911 - RNA, 15 nt, Chlamydophila pneumoniae J138
aauuugcucuccugc

SEQ ID NO: 2558912 - RNA, 17 nt, Chlamydophila pneumoniae J138
aauuuggauuuauguuu

SEQ ID NO: 2558913 - RNA, 15 nt, Chlamydophila pneumoniae J138
aauuuguuuagaaaa

SEQ ID NO: 2558914 - RNA, 16 nt, Chlamydophila pneumoniae J138
aauuuuagcuucuuuu

SEQ ID NO: 2558915 - RNA, 22 nt, Chlamydophila pneumoniae J138
aauuuuauaggaauaacaccaa

SEQ ID NO: 2558916 - RNA, 22 nt, Chlamydophila pneumoniae J138
aauuuucagccugucuauaaaa

SEQ ID NO: 2558917 - RNA, 12 nt, Chlamydophila pneumoniae J138
aauuuucccauu

SEQ ID NO: 2558918 - RNA, 16 nt, Chlamydophila pneumoniae J138
aauuuucuaaagauuu

SEQ ID NO: 2558919 - RNA, 23 nt, Chlamydophila pneumoniae J138
aauuuucuugcgacauaaccauc

SEQ ID NO: 2558920 - RNA, 17 nt, Chlamydophila pneumoniae J138
aauuuuugcuaaacaau

SEQ ID NO: 2558921 - RNA, 17 nt, Chlamydophila pneumoniae J138
aauuuuuguagacaaua

SEQ ID NO: 2558922 - RNA, 19 nt, Chlamydophila pneumoniae J138
acaaaaaagggaucuccuu

SEQ ID NO: 2558923 - RNA, 17 nt, Chlamydophila pneumoniae J138
acaaaaaauaaaaucaa

SEQ ID NO: 2558924 - RNA, 13 nt, Chlamydophila pneumoniae J138
acaaaaaaucaau

SEQ ID NO: 2558925 - RNA, 15 nt, Chlamydophila pneumoniae J138
acaaaaacugcgcua

SEQ ID NO: 2558926 - RNA, 21 nt, Chlamydophila pneumoniae J138
acaaaaacugcgcuagcucca

SEQ ID NO: 2558927 - RNA, 16 nt, Chlamydophila pneumoniae J138
acaaaacaaaagccau

SEQ ID NO: 2558928 - RNA, 23 nt, Chlamydophila pneumoniae J138
acaaaagguauugcaaauuucau

SEQ ID NO: 2558929 - RNA, 18 nt, Chlamydophila pneumoniae J138
acaaaagucucuagggaa

SEQ ID NO: 2558930 - RNA, 20 nt, Chlamydophila pneumoniae J138
acaaaauccacauccuugua

SEQ ID NO: 2558931 - RNA, 20 nt, Chlamydophila pneumoniae J138
acacgaucuaaggcuuugcc

SEQ ID NO: 2558932 - RNA, 19 nt, Chlamydophila pneumoniae J138
acacgcacuugcuuaucca

SEQ ID NO: 2558933 - RNA, 21 nt, Chlamydophila pneumoniae J138
acacgcuugugguuagaggaa

SEQ ID NO: 2558934 - RNA, 22 nt, Chlamydophila pneumoniae J138
acacgucacuggggcauaagaa

SEQ ID NO: 2558935 - RNA, 14 nt, Chlamydophila pneumoniae J138
acacucaaauucaa

SEQ ID NO: 2558936 - RNA, 12 nt, Chlamydophila pneumoniae J138
acacucuaucau

SEQ ID NO: 2558937 - RNA, 11 nt, Chlamydophila pneumoniae J138
acacucucuac

SEQ ID NO: 2558938 - RNA, 21 nt, Chlamydophila pneumoniae J138
acacugaacgccaucuccaca

SEQ ID NO: 2558939 - RNA, 18 nt, Chlamydophila pneumoniae J138
acacugcgagagaaaguc

SEQ ID NO: 2558940 - RNA, 17 nt, Chlamydophila pneumoniae J138
acacugcgcaaagaacu

SEQ ID NO: 2558941 - RNA, 17 nt, Chlamydophila pneumoniae J138
acacuugcuuaaggaaa

SEQ ID NO: 2558942 - RNA, 23 nt, Chlamydophila pneumoniae J138
acacuuuuaaagauaaggaccag

SEQ ID NO: 2558943 - RNA, 20 nt, Chlamydophila pneumoniae J138
acagaaagagcuaaagaaac

SEQ ID NO: 2558944 - RNA, 20 nt, Chlamydophila pneumoniae J138
acagaaaggcuuuucuuuuu

SEQ ID NO: 2558945 - RNA, 13 nt, Chlamydophila pneumoniae J138
acagaaguacgca

SEQ ID NO: 2558946 - RNA, 20 nt, Chlamydophila pneumoniae J138
acagaaguuccuacuucugc

SEQ ID NO: 2558947 - RNA, 15 nt, Chlamydophila pneumoniae J138
acagaaugauaagaa

SEQ ID NO: 2558948 - RNA, 15 nt, Chlamydophila pneumoniae J138
acagaccaaaucauc

SEQ ID NO: 2558949 - RNA, 14 nt, Chlamydophila pneumoniae J138
acagacuugaggaa

SEQ ID NO: 2558950 - RNA, 19 nt, Chlamydophila pneumoniae J138
acagagaauugcauucuua

SEQ ID NO: 2558951 - RNA, 20 nt, Chlamydophila pneumoniae J138
acagagcgccuccaccugca

SEQ ID NO: 2558952 - RNA, 16 nt, Chlamydophila pneumoniae J138
acagaggaucuagaaa

SEQ ID NO: 2558953 - RNA, 18 nt, Chlamydophila pneumoniae J138
acagagucagaagcuauu

SEQ ID NO: 2558954 - RNA, 21 nt, Chlamydophila pneumoniae J138
acagagucagaagcuauucca

SEQ ID NO: 2558955 - RNA, 12 nt, Chlamydophila pneumoniae J138
acagagucuggg

SEQ ID NO: 2558956 - RNA, 21 nt, Chlamydophila pneumoniae J138
acagaguucgcgaccugugau

SEQ ID NO: 2558957 - RNA, 23 nt, Chlamydophila pneumoniae J138
acagaguucgcgaccugugauuu

SEQ ID NO: 2558958 - RNA, 17 nt, Chlamydophila pneumoniae J138
acagauaagacaauaaa

SEQ ID NO: 2558959 - RNA, 20 nt, Chlamydophila pneumoniae J138
acagauaggguaagauugca

SEQ ID NO: 2558960 - RNA, 23 nt, Chlamydophila pneumoniae J138
acagaucugcauaauuuuucuua

SEQ ID NO: 2558961 - RNA, 15 nt, Chlamydophila pneumoniae J138
acagauuucuucuuc

SEQ ID NO: 2558962 - RNA, 17 nt, Chlamydophila pneumoniae J138
acagauuucuucuucag

SEQ ID NO: 2558963 - RNA, 18 nt, Chlamydophila pneumoniae J138
acagauuucuucuucaga

SEQ ID NO: 2558964 - RNA, 12 nt, Chlamydophila pneumoniae J138
acagauuuuuca

SEQ ID NO: 2558965 - RNA, 13 nt, Chlamydophila pneumoniae J138
acagauuuuucaa

SEQ ID NO: 2558966 - RNA, 18 nt, Chlamydophila pneumoniae J138
acagcaaaguaaugugcg

SEQ ID NO: 2558967 - RNA, 13 nt, Chlamydophila pneumoniae J138
acagcacaggcau

SEQ ID NO: 2558968 - RNA, 14 nt, Chlamydophila pneumoniae J138
acagcaucaggauu

SEQ ID NO: 2558969 - RNA, 13 nt, Chlamydophila pneumoniae J138
acagcaucggcaa

SEQ ID NO: 2558970 - RNA, 19 nt, Chlamydophila pneumoniae J138
acagcaucggcaaccaguu

SEQ ID NO: 2558971 - RNA, 18 nt, Chlamydophila pneumoniae J138
acagcauggacuccaaga

SEQ ID NO: 2558972 - RNA, 13 nt, Chlamydophila pneumoniae J138
acagccggagcuu

SEQ ID NO: 2558973 - RNA, 20 nt, Chlamydophila pneumoniae J138
acagccggagcuucuaagau

SEQ ID NO: 2558974 - RNA, 15 nt, Chlamydophila pneumoniae J138
acagcgguugccuuu

SEQ ID NO: 2558975 - RNA, 14 nt, Chlamydophila pneumoniae J138
acagcguauaggaa

SEQ ID NO: 2558976 - RNA, 20 nt, Chlamydophila pneumoniae J138
acagcuaaucauagccauca

SEQ ID NO: 2558977 - RNA, 18 nt, Chlamydophila pneumoniae J138
acagcuaucgagauaucg

SEQ ID NO: 2558978 - RNA, 12 nt, Chlamydophila pneumoniae J138
acagcuccauuu

SEQ ID NO: 2558979 - RNA, 18 nt, Chlamydophila pneumoniae J138
acagcugggaucuggcuc

SEQ ID NO: 2558980 - RNA, 19 nt, Chlamydophila pneumoniae J138
acagcugggaucuggcuca

SEQ ID NO: 2558981 - RNA, 13 nt, Chlamydophila pneumoniae J138
acagcuucuucgu

SEQ ID NO: 2558982 - RNA, 22 nt, Chlamydophila pneumoniae J138
acagcuucuucguaagcugcaa

SEQ ID NO: 2558983 - RNA, 15 nt, Chlamydophila pneumoniae J138
acagcuucuuuucca

SEQ ID NO: 2558984 - RNA, 21 nt, Chlamydophila pneumoniae J138
acaggaaguaagguuccaaaa

SEQ ID NO: 2558985 - RNA, 18 nt, Chlamydophila pneumoniae J138
acaggaauaggcucuuua

SEQ ID NO: 2558986 - RNA, 15 nt, Chlamydophila pneumoniae J138
acaggagagagaagg

SEQ ID NO: 2558987 - RNA, 17 nt, Chlamydophila pneumoniae J138
acaggagagagaaggcu

SEQ ID NO: 2558988 - RNA, 16 nt, Chlamydophila pneumoniae J138
acaggagcuagaagag

SEQ ID NO: 2558989 - RNA, 19 nt, Chlamydophila pneumoniae J138
acaggcucaugaaauuuca

SEQ ID NO: 2558990 - RNA, 17 nt, Chlamydophila pneumoniae J138
acaggcuccucugcuaa

SEQ ID NO: 2558991 - RNA, 23 nt, Chlamydophila pneumoniae J138
acaggcuccucugcuaagcacaa

SEQ ID NO: 2558992 - RNA, 19 nt, Chlamydophila pneumoniae J138
acaggcuucaucacauuaa

SEQ ID NO: 2558993 - RNA, 21 nt, Chlamydophila pneumoniae J138
acaggggaugugauguucugc

SEQ ID NO: 2558994 - RNA, 13 nt, Chlamydophila pneumoniae J138
acagguucacuuc

SEQ ID NO: 2558995 - RNA, 13 nt, Chlamydophila pneumoniae J138
acaguaauuauuu

SEQ ID NO: 2558996 - RNA, 23 nt, Chlamydophila pneumoniae J138
acaguagaggaauucuggaacau

SEQ ID NO: 2558997 - RNA, 18 nt, Chlamydophila pneumoniae J138
acaguauuccaucacagu

SEQ ID NO: 2558998 - RNA, 16 nt, Chlamydophila pneumoniae J138
acaguucuuucugcuu

SEQ ID NO: 2558999 - RNA, 19 nt, Chlamydophila pneumoniae J138
acaguuggcguuuucuaga

SEQ ID NO: 2559000 - RNA, 19 nt, Chlamydophila pneumoniae J138
acaguuuguaaaaagccua

SEQ ID NO: 2559001 - RNA, 19 nt, Chlamydophila pneumoniae J138
acauaaagacccuucuuuc

SEQ ID NO: 2559002 - RNA, 13 nt, Chlamydophila pneumoniae J138
acauaaagucaaa

SEQ ID NO: 2559003 - RNA, 12 nt, Chlamydophila pneumoniae J138
acauaaaucaac

SEQ ID NO: 2559004 - RNA, 19 nt, Chlamydophila pneumoniae J138
acauaaaucaacaucacaa

SEQ ID NO: 2559005 - RNA, 15 nt, Chlamydophila pneumoniae J138
acauaacacuuuguu

SEQ ID NO: 2559006 - RNA, 14 nt, Chlamydophila pneumoniae J138
acauaacaugagaa

SEQ ID NO: 2559007 - RNA, 19 nt, Chlamydophila pneumoniae J138
acauaaccucggucucgcu

SEQ ID NO: 2559008 - RNA, 18 nt, Chlamydophila pneumoniae J138
acauaacgggguugucuc

SEQ ID NO: 2559009 - RNA, 22 nt, Chlamydophila pneumoniae J138
acauaauaagcaggaaaagcaa

SEQ ID NO: 2559010 - RNA, 12 nt, Chlamydophila pneumoniae J138
acauacaucaaa

SEQ ID NO: 2559011 - RNA, 14 nt, Chlamydophila pneumoniae J138
acauacaucaaaau

SEQ ID NO: 2559012 - RNA, 15 nt, Chlamydophila pneumoniae J138
acauacauucuauuc

SEQ ID NO: 2559013 - RNA, 16 nt, Chlamydophila pneumoniae J138
acauacauucuauucu

SEQ ID NO: 2559014 - RNA, 15 nt, Chlamydophila pneumoniae J138
acauagacuuugagu

SEQ ID NO: 2559015 - RNA, 14 nt, Chlamydophila pneumoniae J138
acauagggaaaguu

SEQ ID NO: 2559016 - RNA, 20 nt, Chlamydophila pneumoniae J138
acauagguaaaaccagcaua

SEQ ID NO: 2559017 - RNA, 21 nt, Chlamydophila pneumoniae J138
acauaguuuuuauuuuuaaau

SEQ ID NO: 2559018 - RNA, 13 nt, Chlamydophila pneumoniae J138
acauauccaauga

SEQ ID NO: 2559019 - RNA, 18 nt, Chlamydophila pneumoniae J138
acauauccaaugagagag

SEQ ID NO: 2559020 - RNA, 20 nt, Chlamydophila pneumoniae J138
acauaucgauaggauucgga

SEQ ID NO: 2559021 - RNA, 22 nt, Chlamydophila pneumoniae J138
acauaucuccuuuaaauaaaau

SEQ ID NO: 2559022 - RNA, 14 nt, Chlamydophila pneumoniae J138
acauauucuccuua

SEQ ID NO: 2559023 - RNA, 15 nt, Chlamydophila pneumoniae J138
acauauugaagauau

SEQ ID NO: 2559024 - RNA, 15 nt, Chlamydophila pneumoniae J138
acaucaaaaugcugc

SEQ ID NO: 2559025 - RNA, 14 nt, Chlamydophila pneumoniae J138
acaucaaagcaauu

SEQ ID NO: 2559026 - RNA, 19 nt, Chlamydophila pneumoniae J138
acaucaaauaguucaucau

SEQ ID NO: 2559027 - RNA, 12 nt, Chlamydophila pneumoniae J138
acaucaagaauu

SEQ ID NO: 2559028 - RNA, 13 nt, Chlamydophila pneumoniae J138
acaucaauuuuac

SEQ ID NO: 2559029 - RNA, 19 nt, Chlamydophila pneumoniae J138
acaucacuuauauuuucua

SEQ ID NO: 2559030 - RNA, 18 nt, Chlamydophila pneumoniae J138
acaucagacugaagagca

SEQ ID NO: 2559031 - RNA, 13 nt, Chlamydophila pneumoniae J138
acaucagcaacau

SEQ ID NO: 2559032 - RNA, 18 nt, Chlamydophila pneumoniae J138
acaucagcaacauaaagu

SEQ ID NO: 2559033 - RNA, 18 nt, Chlamydophila pneumoniae J138
acaucagcuguugcguuu

SEQ ID NO: 2559034 - RNA, 19 nt, Chlamydophila pneumoniae J138
acaucaugauauugcguuu

SEQ ID NO: 2559035 - RNA, 15 nt, Chlamydophila pneumoniae J138
acaucauguagugcu

SEQ ID NO: 2559036 - RNA, 12 nt, Chlamydophila pneumoniae J138
acauccauucuu

SEQ ID NO: 2559037 - RNA, 16 nt, Chlamydophila pneumoniae J138
acauccauucuuaaua

SEQ ID NO: 2559038 - RNA, 23 nt, Chlamydophila pneumoniae J138
acauccauucuuaauauaaaaga

SEQ ID NO: 2559039 - RNA, 12 nt, Chlamydophila pneumoniae J138
acauccucacua

SEQ ID NO: 2559040 - RNA, 17 nt, Chlamydophila pneumoniae J138
acauccuggagcaugag

SEQ ID NO: 2559041 - RNA, 18 nt, Chlamydophila pneumoniae J138
acauccuggagcaugaga

SEQ ID NO: 2559042 - RNA, 13 nt, Chlamydophila pneumoniae J138
acauccuguaguu

SEQ ID NO: 2559043 - RNA, 13 nt, Chlamydophila pneumoniae J138
acauccuucuuua

SEQ ID NO: 2559044 - RNA, 17 nt, Chlamydophila pneumoniae J138
acauccuuguagaacuu

SEQ ID NO: 2559045 - RNA, 21 nt, Chlamydophila pneumoniae J138
acauccuuguagaacuucuca

SEQ ID NO: 2559046 - RNA, 23 nt, Chlamydophila pneumoniae J138
acauccuuguagaacuucucaag

SEQ ID NO: 2559047 - RNA, 10 nt, Chlamydophila pneumoniae J138
acaucuccag

SEQ ID NO: 2559048 - RNA, 12 nt, Chlamydophila pneumoniae J138
acaucuccugca

SEQ ID NO: 2559049 - RNA, 12 nt, Chlamydophila pneumoniae J138
acaucuccuuuc

SEQ ID NO: 2559050 - RNA, 22 nt, Chlamydophila pneumoniae J138
acaucucuuuaacuucuaaaag

SEQ ID NO: 2559051 - RNA, 19 nt, Chlamydophila pneumoniae J138
acaucuguaguaggcacuu

SEQ ID NO: 2559052 - RNA, 15 nt, Chlamydophila pneumoniae J138
acaucuugagcuuca

SEQ ID NO: 2559053 - RNA, 13 nt, Chlamydophila pneumoniae J138
acaugagaaauac

SEQ ID NO: 2559054 - RNA, 12 nt, Chlamydophila pneumoniae J138
acaugagauacg

SEQ ID NO: 2559055 - RNA, 12 nt, Chlamydophila pneumoniae J138
acaugaggauac

SEQ ID NO: 2559056 - RNA, 16 nt, Chlamydophila pneumoniae J138
acaugaggauacacuu

SEQ ID NO: 2559057 - RNA, 20 nt, Chlamydophila pneumoniae J138
acaugaggcacauguaggau

SEQ ID NO: 2559058 - RNA, 22 nt, Chlamydophila pneumoniae J138
acaugagggcaugccuaucuau

SEQ ID NO: 2559059 - RNA, 14 nt, Chlamydophila pneumoniae J138
acaugccaaaaguu

SEQ ID NO: 2559060 - RNA, 17 nt, Chlamydophila pneumoniae J138
acaugccuaaauagcuc

SEQ ID NO: 2559061 - RNA, 22 nt, Chlamydophila pneumoniae J138
acaugccugaaaacaaggcaaa

SEQ ID NO: 2559062 - RNA, 19 nt, Chlamydophila pneumoniae J138
acaugcgaagggaggagaa

SEQ ID NO: 2559063 - RNA, 14 nt, Chlamydophila pneumoniae J138
acauggccaaaaau

SEQ ID NO: 2559064 - RNA, 17 nt, Chlamydophila pneumoniae J138
acauguugguagaggcu

SEQ ID NO: 2559065 - RNA, 13 nt, Chlamydophila pneumoniae J138
acauguuucacuu

SEQ ID NO: 2559066 - RNA, 13 nt, Chlamydophila pneumoniae J138
acauuaagaggaa

SEQ ID NO: 2559067 - RNA, 19 nt, Chlamydophila pneumoniae J138
acauucacccucauuaaga

SEQ ID NO: 2559068 - RNA, 19 nt, Chlamydophila pneumoniae J138
acauucaggauacucugaa

SEQ ID NO: 2559069 - RNA, 14 nt, Chlamydophila pneumoniae J138
acauucauuuuuua

SEQ ID NO: 2559070 - RNA, 21 nt, Chlamydophila pneumoniae J138
acauucauuuuuuaauaaaau

SEQ ID NO: 2559071 - RNA, 16 nt, Chlamydophila pneumoniae J138
acauuccaaugcauga

SEQ ID NO: 2559072 - RNA, 21 nt, Chlamydophila pneumoniae J138
acauucccuaaagcugccagu

SEQ ID NO: 2559073 - RNA, 22 nt, Chlamydophila pneumoniae J138
acauucuccgccagaguuuaaa

SEQ ID NO: 2559074 - RNA, 18 nt, Chlamydophila pneumoniae J138
acauugaagagcuugcug

SEQ ID NO: 2559075 - RNA, 20 nt, Chlamydophila pneumoniae J138
acauugaguugguuuuguaa

SEQ ID NO: 2559076 - RNA, 18 nt, Chlamydophila pneumoniae J138
acauugcgggcucaaaga

SEQ ID NO: 2559077 - RNA, 23 nt, Chlamydophila pneumoniae J138
acauugcugccaggcuuaaauau

SEQ ID NO: 2559078 - RNA, 23 nt, Chlamydophila pneumoniae J138
acauuguuuaaguccuucuuccc

SEQ ID NO: 2559079 - RNA, 16 nt, Chlamydophila pneumoniae J138
acauuuccccaugaaa

SEQ ID NO: 2559080 - RNA, 22 nt, Chlamydophila pneumoniae J138
acauuucucaccacggaagaua

SEQ ID NO: 2559081 - RNA, 23 nt, Chlamydophila pneumoniae J138
acauuucuugauccaucugcucu

SEQ ID NO: 2559082 - RNA, 21 nt, Chlamydophila pneumoniae J138
acauuuguugucagcuuugcu

SEQ ID NO: 2559083 - RNA, 19 nt, Chlamydophila pneumoniae J138
acauuuuucaauaaccaga

SEQ ID NO: 2559084 - RNA, 22 nt, Chlamydophila pneumoniae J138
accaaaaaaguaacuaucuaca

SEQ ID NO: 2559085 - RNA, 22 nt, Chlamydophila pneumoniae J138
accaaaaauuccguuaagaugu

SEQ ID NO: 2559086 - RNA, 18 nt, Chlamydophila pneumoniae J138
accaaaauuauguauaaa

SEQ ID NO: 2559087 - RNA, 21 nt, Chlamydophila pneumoniae J138
accaaacuuucuuuucuauau

SEQ ID NO: 2559088 - RNA, 22 nt, Chlamydophila pneumoniae J138
accaaacuuucuuuucuauauu

SEQ ID NO: 2559089 - RNA, 19 nt, Chlamydophila pneumoniae J138
accaaagucgauacccaaa

SEQ ID NO: 2559090 - RNA, 19 nt, Chlamydophila pneumoniae J138
accaaagugacuuccucca

SEQ ID NO: 2559091 - RNA, 18 nt, Chlamydophila pneumoniae J138
accaaauaauuaaauaua

SEQ ID NO: 2559092 - RNA, 19 nt, Chlamydophila pneumoniae J138
accaaauagagaguaguga

SEQ ID NO: 2559093 - RNA, 14 nt, Chlamydophila pneumoniae J138
accaaauccuccug

SEQ ID NO: 2559094 - RNA, 13 nt, Chlamydophila pneumoniae J138
accaaaucuaucu

SEQ ID NO: 2559095 - RNA, 16 nt, Chlamydophila pneumoniae J138
accaacaucaaagaau

SEQ ID NO: 2559096 - RNA, 13 nt, Chlamydophila pneumoniae J138
accaacuccucaa

SEQ ID NO: 2559097 - RNA, 15 nt, Chlamydophila pneumoniae J138
accaacugagcuauu

SEQ ID NO: 2559098 - RNA, 19 nt, Chlamydophila pneumoniae J138
accaagaugucuccaaaga

SEQ ID NO: 2559099 - RNA, 20 nt, Chlamydophila pneumoniae J138
accaauaaauccaaaaaaug

SEQ ID NO: 2559100 - RNA, 23 nt, Chlamydophila pneumoniae J138
accaauaaccgaaacuucucaga

SEQ ID NO: 2559101 - RNA, 14 nt, Chlamydophila pneumoniae J138
accaauacagcaua

SEQ ID NO: 2559102 - RNA, 15 nt, Chlamydophila pneumoniae J138
accaauaugcucugc

SEQ ID NO: 2559103 - RNA, 20 nt, Chlamydophila pneumoniae J138
accaaucuugagcauccaaa

SEQ ID NO: 2559104 - RNA, 23 nt, Chlamydophila pneumoniae J138
accaaucuugagcauccaaaaug

SEQ ID NO: 2559105 - RNA, 20 nt, Chlamydophila pneumoniae J138
accaaugauaauuucauuau

SEQ ID NO: 2559106 - RNA, 19 nt, Chlamydophila pneumoniae J138
accaaugaucguagcuaaa

SEQ ID NO: 2559107 - RNA, 18 nt, Chlamydophila pneumoniae J138
accaauugagcucucuag

SEQ ID NO: 2559108 - RNA, 18 nt, Chlamydophila pneumoniae J138
accacaauuccuaaaaca

SEQ ID NO: 2559109 - RNA, 19 nt, Chlamydophila pneumoniae J138
accacagaaugauaagaaa

SEQ ID NO: 2559110 - RNA, 21 nt, Chlamydophila pneumoniae J138
accacagaaugauaagaaagc

SEQ ID NO: 2559111 - RNA, 20 nt, Chlamydophila pneumoniae J138
accacagaggucgauuugaa

SEQ ID NO: 2559112 - RNA, 17 nt, Chlamydophila pneumoniae J138
accaccccaaagcagau

SEQ ID NO: 2559113 - RNA, 13 nt, Chlamydophila pneumoniae J138
accaccuaaaaug

SEQ ID NO: 2559114 - RNA, 15 nt, Chlamydophila pneumoniae J138
accacgaaauguuaa

SEQ ID NO: 2559115 - RNA, 16 nt, Chlamydophila pneumoniae J138
accacgaaauguuaaa

SEQ ID NO: 2559116 - RNA, 17 nt, Chlamydophila pneumoniae J138
accacuaccgaauuuuc

SEQ ID NO: 2559117 - RNA, 19 nt, Chlamydophila pneumoniae J138
accacuaccgaauuuucaa

SEQ ID NO: 2559118 - RNA, 21 nt, Chlamydophila pneumoniae J138
accacuacugagcuucuauuu

SEQ ID NO: 2559119 - RNA, 19 nt, Chlamydophila pneumoniae J138
accacuuaggguucucaaa

SEQ ID NO: 2559120 - RNA, 20 nt, Chlamydophila pneumoniae J138
accacuuuagaauuuucuuu

SEQ ID NO: 2559121 - RNA, 12 nt, Chlamydophila pneumoniae J138
accagaagacuc

SEQ ID NO: 2559122 - RNA, 16 nt, Chlamydophila pneumoniae J138
accagaagacucccaa

SEQ ID NO: 2559123 - RNA, 13 nt, Chlamydophila pneumoniae J138
accagaagcaacu

SEQ ID NO: 2559124 - RNA, 17 nt, Chlamydophila pneumoniae J138
accagaagcaugaauga

SEQ ID NO: 2559125 - RNA, 13 nt, Chlamydophila pneumoniae J138
accagaaggaagg

SEQ ID NO: 2559126 - RNA, 21 nt, Chlamydophila pneumoniae J138
accagaaggaagguucucaaa

SEQ ID NO: 2559127 - RNA, 15 nt, Chlamydophila pneumoniae J138
accagauaaagcaaa

SEQ ID NO: 2559128 - RNA, 16 nt, Chlamydophila pneumoniae J138
accagauaaagcaaag

SEQ ID NO: 2559129 - RNA, 23 nt, Chlamydophila pneumoniae J138
accagauaaagcaaagauaaaga

SEQ ID NO: 2559130 - RNA, 18 nt, Chlamydophila pneumoniae J138
accagaugauuuuuugaa

SEQ ID NO: 2559131 - RNA, 15 nt, Chlamydophila pneumoniae J138
accagcauuaagaua

SEQ ID NO: 2559132 - RNA, 16 nt, Chlamydophila pneumoniae J138
accaggagcuccuccu

SEQ ID NO: 2559133 - RNA, 23 nt, Chlamydophila pneumoniae J138
aaaagcuuaucccauaaauguau

SEQ ID NO: 2559134 - RNA, 18 nt, Chlamydophila pneumoniae J138
aaaagcuucuuucuuacu

SEQ ID NO: 2559135 - RNA, 17 nt, Chlamydophila pneumoniae J138
aaaagcuuuuuucucuu

SEQ ID NO: 2559136 - RNA, 18 nt, Chlamydophila pneumoniae J138
aaaagcuuuuuucucuug

SEQ ID NO: 2559137 - RNA, 17 nt, Chlamydophila pneumoniae J138
aaaaggaggauguuccu

SEQ ID NO: 2559138 - RNA, 21 nt, Chlamydophila pneumoniae J138
aaaaggcccccuacagcagaa

SEQ ID NO: 2559139 - RNA, 12 nt, Chlamydophila pneumoniae J138
aaaagggaagcu

SEQ ID NO: 2559140 - RNA, 13 nt, Chlamydophila pneumoniae J138
aaaagguuuugaa

SEQ ID NO: 2559141 - RNA, 21 nt, Chlamydophila pneumoniae J138
aaaaguacgaccaacuccuca

SEQ ID NO: 2559142 - RNA, 23 nt, Chlamydophila pneumoniae J138
aaaaguacgaccaacuccucaaa

SEQ ID NO: 2559143 - RNA, 14 nt, Chlamydophila pneumoniae J138
aaaaguaguuuuaa

SEQ ID NO: 2559144 - RNA, 20 nt, Chlamydophila pneumoniae J138
aaaaguaguuuuaagaaggu

SEQ ID NO: 2559145 - RNA, 15 nt, Chlamydophila pneumoniae J138
aaaagucaugaggac

SEQ ID NO: 2559146 - RNA, 18 nt, Chlamydophila pneumoniae J138
aaaagucaugaggacugu

SEQ ID NO: 2559147 - RNA, 14 nt, Chlamydophila pneumoniae J138
aaaagucucuaggg

SEQ ID NO: 2559148 - RNA, 14 nt, Chlamydophila pneumoniae J138
aaaaguugaggaaa

SEQ ID NO: 2559149 - RNA, 13 nt, Chlamydophila pneumoniae J138
aaaaguuucaauc

SEQ ID NO: 2559150 - RNA, 14 nt, Chlamydophila pneumoniae J138
aaacuaguucuucu

SEQ ID NO: 2559151 - RNA, 16 nt, Chlamydophila pneumoniae J138
aaacuaguucuucuuu

SEQ ID NO: 2559152 - RNA, 18 nt, Chlamydophila pneumoniae J138
aaacuaguucuucuuuac

SEQ ID NO: 2559153 - RNA, 14 nt, Chlamydophila pneumoniae J138
aaacuauacucucu

SEQ ID NO: 2559154 - RNA, 16 nt, Chlamydophila pneumoniae J138
aaacucaaucucuuug

SEQ ID NO: 2559155 - RNA, 20 nt, Chlamydophila pneumoniae J138
aaacuccaaaauauucuuuc

SEQ ID NO: 2559156 - RNA, 20 nt, Chlamydophila pneumoniae J138
aaacuccaaguguugccagc

SEQ ID NO: 2559157 - RNA, 14 nt, Chlamydophila pneumoniae J138
aaacuccauuguug

SEQ ID NO: 2559158 - RNA, 21 nt, Chlamydophila pneumoniae J138
aaacuccgcacuugcucuuua

SEQ ID NO: 2559159 - RNA, 22 nt, Chlamydophila pneumoniae J138
aaacuccgcacuugcucuuuaa

SEQ ID NO: 2559160 - RNA, 17 nt, Chlamydophila pneumoniae J138
aaacuccggauucuuua

SEQ ID NO: 2559161 - RNA, 18 nt, Chlamydophila pneumoniae J138
aaacuccuaggggaauua

SEQ ID NO: 2559162 - RNA, 15 nt, Chlamydophila pneumoniae J138
aaacuccuuuuaaaa

SEQ ID NO: 2559163 - RNA, 11 nt, Chlamydophila pneumoniae J138
aaacucucagg

SEQ ID NO: 2559164 - RNA, 13 nt, Chlamydophila pneumoniae J138
aaacucucuuccu

SEQ ID NO: 2559165 - RNA, 15 nt, Chlamydophila pneumoniae J138
aaacugcaaaaagau

SEQ ID NO: 2559166 - RNA, 13 nt, Chlamydophila pneumoniae J138
aaacugcuccuga

SEQ ID NO: 2559167 - RNA, 17 nt, Chlamydophila pneumoniae J138
aaacuggcggauugcuu

SEQ ID NO: 2559168 - RNA, 15 nt, Chlamydophila pneumoniae J138
aaacugucauguauc

SEQ ID NO: 2559169 - RNA, 16 nt, Chlamydophila pneumoniae J138
aaacuguguuuucuag

SEQ ID NO: 2559170 - RNA, 22 nt, Chlamydophila pneumoniae J138
aaacuguuaacaagauucucag

SEQ ID NO: 2559171 - RNA, 23 nt, Chlamydophila pneumoniae J138
aaacuguuaacaagauucucagc

SEQ ID NO: 2559172 - RNA, 15 nt, Chlamydophila pneumoniae J138
aaacuuaguuuugaa

SEQ ID NO: 2559173 - RNA, 19 nt, Chlamydophila pneumoniae J138
aaacuuaguuuugaaaaga

SEQ ID NO: 2559174 - RNA, 11 nt, Chlamydophila pneumoniae J138
aaacuucaaaa

SEQ ID NO: 2559175 - RNA, 19 nt, Chlamydophila pneumoniae J138
aaacuucccaucuuguucu

SEQ ID NO: 2559176 - RNA, 20 nt, Chlamydophila pneumoniae J138
aaacuucgauuggaagcaaa

SEQ ID NO: 2559177 - RNA, 17 nt, Chlamydophila pneumoniae J138
aaacuucuaacuguaca

SEQ ID NO: 2559178 - RNA, 12 nt, Chlamydophila pneumoniae J138
aaacuucucuag

SEQ ID NO: 2559179 - RNA, 17 nt, Chlamydophila pneumoniae J138
aaacuucuucucgguuu

SEQ ID NO: 2559180 - RNA, 12 nt, Chlamydophila pneumoniae J138
aaacuucuugug

SEQ ID NO: 2559181 - RNA, 23 nt, Chlamydophila pneumoniae J138
aaacuuguuaggaaaauucuuaa

SEQ ID NO: 2559182 - RNA, 22 nt, Chlamydophila pneumoniae J138
aaacuuguuuucguaagagaau

SEQ ID NO: 2559183 - RNA, 21 nt, Chlamydophila pneumoniae J138
aaacuuucgaagcgcucuaca

SEQ ID NO: 2559184 - RNA, 14 nt, Chlamydophila pneumoniae J138
aaacuuucuucucu

SEQ ID NO: 2559185 - RNA, 15 nt, Chlamydophila pneumoniae J138
aaacuuucuucucua

SEQ ID NO: 2559186 - RNA, 19 nt, Chlamydophila pneumoniae J138
aaacuuuuuuucaaaucau

SEQ ID NO: 2559187 - RNA, 22 nt, Chlamydophila pneumoniae J138
aaagaaacuucugacccuguag

SEQ ID NO: 2559188 - RNA, 19 nt, Chlamydophila pneumoniae J138
aaagaaagugaaaccauuu

SEQ ID NO: 2559189 - RNA, 23 nt, Chlamydophila pneumoniae J138
aaagaaauauuaacccaccagaa

SEQ ID NO: 2559190 - RNA, 12 nt, Chlamydophila pneumoniae J138
aaagaacacucc

SEQ ID NO: 2559191 - RNA, 24 nt, Chlamydophila pneumoniae J138
aaagaacagcacucucugcaggga

SEQ ID NO: 2559192 - RNA, 15 nt, Chlamydophila pneumoniae J138
aaagaagacgcucuu

SEQ ID NO: 2559193 - RNA, 22 nt, Chlamydophila pneumoniae J138
aaagaagacgcucuuagccuag

SEQ ID NO: 2559194 - RNA, 12 nt, Chlamydophila pneumoniae J138
aaagaagauuca

SEQ ID NO: 2559195 - RNA, 14 nt, Chlamydophila pneumoniae J138
aaagaagauucaag

SEQ ID NO: 2559196 - RNA, 15 nt, Chlamydophila pneumoniae J138
aaagaagguccaugu

SEQ ID NO: 2559197 - RNA, 21 nt, Chlamydophila pneumoniae J138
aaagaaggucuuccaucucuu

SEQ ID NO: 2559198 - RNA, 23 nt, Chlamydophila pneumoniae J138
aaagaaguuuacaaauaaaauga

SEQ ID NO: 2559199 - RNA, 21 nt, Chlamydophila pneumoniae J138
aaagaauagccgacaugcuuu

SEQ ID NO: 2559200 - RNA, 13 nt, Chlamydophila pneumoniae J138
aaagaaucucuga

SEQ ID NO: 2559201 - RNA, 18 nt, Chlamydophila pneumoniae J138
aaagaaugacacagagaa

SEQ ID NO: 2559202 - RNA, 21 nt, Chlamydophila pneumoniae J138
aaagaauuccuaaaacgagca

SEQ ID NO: 2559203 - RNA, 20 nt, Chlamydophila pneumoniae J138
aaagaauuuguaacucuuaa

SEQ ID NO: 2559204 - RNA, 15 nt, Chlamydophila pneumoniae J138
aaagacaaaaaaucu

SEQ ID NO: 2559205 - RNA, 20 nt, Chlamydophila pneumoniae J138
aaagacaaaaaaucugaucu

SEQ ID NO: 2559206 - RNA, 16 nt, Chlamydophila pneumoniae J138
aaagaccaaaaauaaa

SEQ ID NO: 2559207 - RNA, 21 nt, Chlamydophila pneumoniae J138
aaagacccuucuuuccauaaa

SEQ ID NO: 2559208 - RNA, 14 nt, Chlamydophila pneumoniae J138
aaagacucucuucc

SEQ ID NO: 2559209 - RNA, 14 nt, Chlamydophila pneumoniae J138
aaagacugaaaaga

SEQ ID NO: 2559210 - RNA, 19 nt, Chlamydophila pneumoniae J138
aaagacuucuuuauuauag

SEQ ID NO: 2559211 - RNA, 18 nt, Chlamydophila pneumoniae J138
aaagagacuguagccuuu

SEQ ID NO: 2559212 - RNA, 14 nt, Chlamydophila pneumoniae J138
aaagagcaaggaac

SEQ ID NO: 2559213 - RNA, 14 nt, Chlamydophila pneumoniae J138
aaagagcucaaaaa

SEQ ID NO: 2559214 - RNA, 23 nt, Chlamydophila pneumoniae J138
aaagagcuucuucuaaagcagaa

SEQ ID NO: 2559215 - RNA, 15 nt, Chlamydophila pneumoniae J138
aaagagcuuugauuc

SEQ ID NO: 2559216 - RNA, 13 nt, Chlamydophila pneumoniae J138
aaagaggggagcu

SEQ ID NO: 2559217 - RNA, 17 nt, Chlamydophila pneumoniae J138
aaagagugccaagagca

SEQ ID NO: 2559218 - RNA, 18 nt, Chlamydophila pneumoniae J138
aaagagugccaagagcau

SEQ ID NO: 2559219 - RNA, 23 nt, Chlamydophila pneumoniae J138
aaagagugccaagagcaucacaa

SEQ ID NO: 2559220 - RNA, 21 nt, Chlamydophila pneumoniae J138
aaagaguuuguucacauuuuc

SEQ ID NO: 2559221 - RNA, 20 nt, Chlamydophila pneumoniae J138
aaagaguuuuuuagaggagc

SEQ ID NO: 2559222 - RNA, 13 nt, Chlamydophila pneumoniae J138
aaagauaaagaag

SEQ ID NO: 2559223 - RNA, 20 nt, Chlamydophila pneumoniae J138
aaagauagcgacgucaucau

SEQ ID NO: 2559224 - RNA, 16 nt, Chlamydophila pneumoniae J138
aaagauaugucuugcu

SEQ ID NO: 2559225 - RNA, 13 nt, Chlamydophila pneumoniae J138
aaagaucacugag

SEQ ID NO: 2559226 - RNA, 18 nt, Chlamydophila pneumoniae J138
aaagaucaucuucacuaa

SEQ ID NO: 2559227 - RNA, 20 nt, Chlamydophila pneumoniae J138
aaagaucggaguuaucaaaa

SEQ ID NO: 2559228 - RNA, 12 nt, Chlamydophila pneumoniae J138
aaagaucugaau

SEQ ID NO: 2559229 - RNA, 14 nt, Chlamydophila pneumoniae J138
aaagauuccccaua

SEQ ID NO: 2559230 - RNA, 19 nt, Chlamydophila pneumoniae J138
aaagauuccuuaccuauau

SEQ ID NO: 2559231 - RNA, 13 nt, Chlamydophila pneumoniae J138
aaagauucuaaau

SEQ ID NO: 2559232 - RNA, 15 nt, Chlamydophila pneumoniae J138
aaagauucuaaauca

SEQ ID NO: 2559233 - RNA, 17 nt, Chlamydophila pneumoniae J138
aaagauucuaaaucaac

SEQ ID NO: 2559234 - RNA, 15 nt, Chlamydophila pneumoniae J138
aaagauucugcccaa

SEQ ID NO: 2559235 - RNA, 15 nt, Chlamydophila pneumoniae J138
acaaacaacagaaau

SEQ ID NO: 2559236 - RNA, 17 nt, Chlamydophila pneumoniae J138
acaaacaacagaaaugu

SEQ ID NO: 2559237 - RNA, 13 nt, Chlamydophila pneumoniae J138
acaaacagauuuu

SEQ ID NO: 2559238 - RNA, 18 nt, Chlamydophila pneumoniae J138
acaaacagauuuuucaag

SEQ ID NO: 2559239 - RNA, 23 nt, Chlamydophila pneumoniae J138
acaaacagauuuuucaagaacuc

SEQ ID NO: 2559240 - RNA, 12 nt, Chlamydophila pneumoniae J138
acaaacaucgaa

SEQ ID NO: 2559241 - RNA, 19 nt, Chlamydophila pneumoniae J138
acaaacaucgaaaccacag

SEQ ID NO: 2559242 - RNA, 15 nt, Chlamydophila pneumoniae J138
acaaacccauauuug

SEQ ID NO: 2559243 - RNA, 15 nt, Chlamydophila pneumoniae J138
acaaacuaaaucaac

SEQ ID NO: 2559244 - RNA, 21 nt, Chlamydophila pneumoniae J138
acaaacuaacauagauaaggu

SEQ ID NO: 2559245 - RNA, 15 nt, Chlamydophila pneumoniae J138
acaaagaaccauaga

SEQ ID NO: 2559246 - RNA, 16 nt, Chlamydophila pneumoniae J138
acaaagcgucuaucua

SEQ ID NO: 2559247 - RNA, 15 nt, Chlamydophila pneumoniae J138
acaaaggcauaagau

SEQ ID NO: 2559248 - RNA, 13 nt, Chlamydophila pneumoniae J138
acaaauaaaauga

SEQ ID NO: 2559249 - RNA, 14 nt, Chlamydophila pneumoniae J138
acaaauaaacugac

SEQ ID NO: 2559250 - RNA, 23 nt, Chlamydophila pneumoniae J138
acaaaucacgacgucaucaccau

SEQ ID NO: 2559251 - RNA, 22 nt, Chlamydophila pneumoniae J138
acaaaucauuuaaagcugaaau

SEQ ID NO: 2559252 - RNA, 21 nt, Chlamydophila pneumoniae J138
acaaaugcgguaucuccggaa

SEQ ID NO: 2559253 - RNA, 14 nt, Chlamydophila pneumoniae J138
acaaauggcaugaa

SEQ ID NO: 2559254 - RNA, 21 nt, Chlamydophila pneumoniae J138
acaaaugugacgcaagagaca

SEQ ID NO: 2559255 - RNA, 19 nt, Chlamydophila pneumoniae J138
acaaauuaccuugagacaa

SEQ ID NO: 2559256 - RNA, 21 nt, Chlamydophila pneumoniae J138
acaaauuuaucggcuaaagaa

SEQ ID NO: 2559257 - RNA, 19 nt, Chlamydophila pneumoniae J138
acaaauuuuugcagaguug

SEQ ID NO: 2559258 - RNA, 19 nt, Chlamydophila pneumoniae J138
acaacaacagcuuuaucuu

SEQ ID NO: 2559259 - RNA, 15 nt, Chlamydophila pneumoniae J138
acaacaacauaaaga

SEQ ID NO: 2559260 - RNA, 17 nt, Chlamydophila pneumoniae J138
acaacaacauaaagaag

SEQ ID NO: 2559261 - RNA, 18 nt, Chlamydophila pneumoniae J138
acaacaccacagaggucg

SEQ ID NO: 2559262 - RNA, 14 nt, Chlamydophila pneumoniae J138
acaacagaaauguu

SEQ ID NO: 2559263 - RNA, 15 nt, Chlamydophila pneumoniae J138
acaacaguugcggag

SEQ ID NO: 2559264 - RNA, 15 nt, Chlamydophila pneumoniae J138
acaacauaacagggu

SEQ ID NO: 2559265 - RNA, 14 nt, Chlamydophila pneumoniae J138
acaacaucaugaaa

SEQ ID NO: 2559266 - RNA, 16 nt, Chlamydophila pneumoniae J138
acaacaucaugaaaua

SEQ ID NO: 2559267 - RNA, 19 nt, Chlamydophila pneumoniae J138
acaacgcugcuucucuacu

SEQ ID NO: 2559268 - RNA, 22 nt, Chlamydophila pneumoniae J138
acaacgguguucauaaucagaa

SEQ ID NO: 2559269 - RNA, 22 nt, Chlamydophila pneumoniae J138
acaacuagguuauuaucaaagu

SEQ ID NO: 2559270 - RNA, 13 nt, Chlamydophila pneumoniae J138
acaacuccuaagu

SEQ ID NO: 2559271 - RNA, 22 nt, Chlamydophila pneumoniae J138
acaacuucuaucuuacugaaga

SEQ ID NO: 2559272 - RNA, 16 nt, Chlamydophila pneumoniae J138
acaacuugguaagcaa

SEQ ID NO: 2559273 - RNA, 14 nt, Chlamydophila pneumoniae J138
acaagaaaacaaag

SEQ ID NO: 2559274 - RNA, 19 nt, Chlamydophila pneumoniae J138
acaagaaccuguuuuucua

SEQ ID NO: 2559275 - RNA, 15 nt, Chlamydophila pneumoniae J138
acaagaacugaagag

SEQ ID NO: 2559276 - RNA, 21 nt, Chlamydophila pneumoniae J138
acaagaagaucaaagauuccu

SEQ ID NO: 2559277 - RNA, 23 nt, Chlamydophila pneumoniae J138
acaagacaaugacuguaggaccu

SEQ ID NO: 2559278 - RNA, 18 nt, Chlamydophila pneumoniae J138
acaagacaccgaaagaaa

SEQ ID NO: 2559279 - RNA, 14 nt, Chlamydophila pneumoniae J138
acaagacgaaagca

SEQ ID NO: 2559280 - RNA, 22 nt, Chlamydophila pneumoniae J138
acaagacgaaagcacauaagau

SEQ ID NO: 2559281 - RNA, 22 nt, Chlamydophila pneumoniae J138
acaagagagagcuggacuucug

SEQ ID NO: 2559282 - RNA, 19 nt, Chlamydophila pneumoniae J138
acaagagcgcauuuuacag

SEQ ID NO: 2559283 - RNA, 21 nt, Chlamydophila pneumoniae J138
acaagauggugagauuucuaa

SEQ ID NO: 2559284 - RNA, 23 nt, Chlamydophila pneumoniae J138
acaagauucucagcuucaucaga

SEQ ID NO: 2559285 - RNA, 20 nt, Chlamydophila pneumoniae J138
acaagcaauacuaagaagcu

SEQ ID NO: 2559286 - RNA, 16 nt, Chlamydophila pneumoniae J138
acaagcauaaacuccu

SEQ ID NO: 2559287 - RNA, 20 nt, Chlamydophila pneumoniae J138
acaagcuuccuuggucuuau

SEQ ID NO: 2559288 - RNA, 15 nt, Chlamydophila pneumoniae J138
acaagggaaagaaac

SEQ ID NO: 2559289 - RNA, 19 nt, Chlamydophila pneumoniae J138
acaaguaauuccccuuuaa

SEQ ID NO: 2559290 - RNA, 15 nt, Chlamydophila pneumoniae J138
acaaguaccaagaaa

SEQ ID NO: 2559291 - RNA, 21 nt, Chlamydophila pneumoniae J138
acaaguacgacgaaguuagcu

SEQ ID NO: 2559292 - RNA, 12 nt, Chlamydophila pneumoniae J138
acaagucccccu

SEQ ID NO: 2559293 - RNA, 19 nt, Chlamydophila pneumoniae J138
acaaguugacgcacuucuu

SEQ ID NO: 2559294 - RNA, 15 nt, Chlamydophila pneumoniae J138
acaaguugagagaga

SEQ ID NO: 2559295 - RNA, 19 nt, Chlamydophila pneumoniae J138
acaaguuuuuucaauccuu

SEQ ID NO: 2559296 - RNA, 15 nt, Chlamydophila pneumoniae J138
acaauaaaaaagaga

SEQ ID NO: 2559297 - RNA, 18 nt, Chlamydophila pneumoniae J138
acaauaaacgagacugca

SEQ ID NO: 2559298 - RNA, 13 nt, Chlamydophila pneumoniae J138
acaauaagaaaau

SEQ ID NO: 2559299 - RNA, 17 nt, Chlamydophila pneumoniae J138
acaauaccaucucuuuc

SEQ ID NO: 2559300 - RNA, 23 nt, Chlamydophila pneumoniae J138
acaauaccaucucuuucuauuuc

SEQ ID NO: 2559301 - RNA, 15 nt, Chlamydophila pneumoniae J138
acaauacucucugcu

SEQ ID NO: 2559302 - RNA, 21 nt, Chlamydophila pneumoniae J138
acaauauaagcaccacgaccu

SEQ ID NO: 2559303 - RNA, 16 nt, Chlamydophila pneumoniae J138
acaaucguagccccau

SEQ ID NO: 2559304 - RNA, 22 nt, Chlamydophila pneumoniae J138
acaaucucuagggauaauuaaa

SEQ ID NO: 2559305 - RNA, 16 nt, Chlamydophila pneumoniae J138
acaaucucuuuaaaaa

SEQ ID NO: 2559306 - RNA, 22 nt, Chlamydophila pneumoniae J138
acaaucucuuuaaaaauuaaag

SEQ ID NO: 2559307 - RNA, 22 nt, Chlamydophila pneumoniae J138
acaaugcgauacgaaggaucau

SEQ ID NO: 2559308 - RNA, 15 nt, Chlamydophila pneumoniae J138
acaaugcuaucucca

SEQ ID NO: 2559309 - RNA, 19 nt, Chlamydophila pneumoniae J138
acaaugcuaucuccagaaa

SEQ ID NO: 2559310 - RNA, 17 nt, Chlamydophila pneumoniae J138
acaauggaaauagagaa

SEQ ID NO: 2559311 - RNA, 21 nt, Chlamydophila pneumoniae J138
acaauggaaauagagaaacuu

SEQ ID NO: 2559312 - RNA, 10 nt, Chlamydophila pneumoniae J138
acaauguuua

SEQ ID NO: 2559313 - RNA, 14 nt, Chlamydophila pneumoniae J138
acaauguuuagaau

SEQ ID NO: 2559314 - RNA, 23 nt, Chlamydophila pneumoniae J138
acaauuagagauucauaaaacug

SEQ ID NO: 2559315 - RNA, 22 nt, Chlamydophila pneumoniae J138
acaauuccguacgcuauaaaua

SEQ ID NO: 2559316 - RNA, 20 nt, Chlamydophila pneumoniae J138
acaauucgauguuaaggcuu

SEQ ID NO: 2559317 - RNA, 23 nt, Chlamydophila pneumoniae J138
acaauuuccuugguaucccaauc

SEQ ID NO: 2559318 - RNA, 18 nt, Chlamydophila pneumoniae J138
acaauuugcuccuccaaa

SEQ ID NO: 2559319 - RNA, 17 nt, Chlamydophila pneumoniae J138
acacaaaaagcuuuuuu

SEQ ID NO: 2559320 - RNA, 12 nt, Chlamydophila pneumoniae J138
acacaaauagca

SEQ ID NO: 2559321 - RNA, 19 nt, Chlamydophila pneumoniae J138
acacaaauagcaagagcua

SEQ ID NO: 2559322 - RNA, 19 nt, Chlamydophila pneumoniae J138
acacaacucuuaaaucgcu

SEQ ID NO: 2559323 - RNA, 13 nt, Chlamydophila pneumoniae J138
acacaacucuuua

SEQ ID NO: 2559324 - RNA, 17 nt, Chlamydophila pneumoniae J138
acacacaugacaaauaa

SEQ ID NO: 2559325 - RNA, 23 nt, Chlamydophila pneumoniae J138
acacagacuugaggaaucugaau

SEQ ID NO: 2559326 - RNA, 11 nt, Chlamydophila pneumoniae J138
acacagagaac

SEQ ID NO: 2559327 - RNA, 17 nt, Chlamydophila pneumoniae J138
acacagagaacaauaaa

SEQ ID NO: 2559328 - RNA, 21 nt, Chlamydophila pneumoniae J138
acacaggggaacgcucucuag

SEQ ID NO: 2559329 - RNA, 17 nt, Chlamydophila pneumoniae J138
acacaguagccuucuuc

SEQ ID NO: 2559330 - RNA, 13 nt, Chlamydophila pneumoniae J138
acaccauaaaaca

SEQ ID NO: 2559331 - RNA, 15 nt, Chlamydophila pneumoniae J138
acaccauagaacugc

SEQ ID NO: 2559332 - RNA, 20 nt, Chlamydophila pneumoniae J138
acacccugacagguagugcu

SEQ ID NO: 2559333 - RNA, 21 nt, Chlamydophila pneumoniae J138
acaccugcccauuuuuggaaa

SEQ ID NO: 2559334 - RNA, 21 nt, Chlamydophila pneumoniae J138
acacgaauuucuaacuuaaua

SEQ ID NO: 2559335 - RNA, 14 nt, Chlamydophila pneumoniae J138
accagggagaccua

SEQ ID NO: 2559336 - RNA, 20 nt, Chlamydophila pneumoniae J138
accagguagagugucuuccu

SEQ ID NO: 2559337 - RNA, 12 nt, Chlamydophila pneumoniae J138
accauaaaacaa

SEQ ID NO: 2559338 - RNA, 18 nt, Chlamydophila pneumoniae J138
accauaaggagauuccua

SEQ ID NO: 2559339 - RNA, 14 nt, Chlamydophila pneumoniae J138
accaucaagguauu

SEQ ID NO: 2559340 - RNA, 23 nt, Chlamydophila pneumoniae J138
accaucaugaaucuuaugggaga

SEQ ID NO: 2559341 - RNA, 18 nt, Chlamydophila pneumoniae J138
accauccgacuuuccuca

SEQ ID NO: 2559342 - RNA, 22 nt, Chlamydophila pneumoniae J138
accaucgucuccaaaaauuccc

SEQ ID NO: 2559343 - RNA, 16 nt, Chlamydophila pneumoniae J138
accaucuguugaucuu

SEQ ID NO: 2559344 - RNA, 19 nt, Chlamydophila pneumoniae J138
accaugaagguagccgagg

SEQ ID NO: 2559345 - RNA, 13 nt, Chlamydophila pneumoniae J138
accaugaggcugc

SEQ ID NO: 2559346 - RNA, 14 nt, Chlamydophila pneumoniae J138
accauuaaauugua

SEQ ID NO: 2559347 - RNA, 13 nt, Chlamydophila pneumoniae J138
accauuaagauau

SEQ ID NO: 2559348 - RNA, 14 nt, Chlamydophila pneumoniae J138
accauucuugaaga

SEQ ID NO: 2559349 - RNA, 16 nt, Chlamydophila pneumoniae J138
accauugcucuaaguu

SEQ ID NO: 2559350 - RNA, 23 nt, Chlamydophila pneumoniae J138
accauuuaccccaggaaucacug

SEQ ID NO: 2559351 - RNA, 19 nt, Chlamydophila pneumoniae J138
acccaaacugaugccaaga

SEQ ID NO: 2559352 - RNA, 14 nt, Chlamydophila pneumoniae J138
acccaagagaccca

SEQ ID NO: 2559353 - RNA, 14 nt, Chlamydophila pneumoniae J138
acccaccagaagga

SEQ ID NO: 2559354 - RNA, 21 nt, Chlamydophila pneumoniae J138
acccagagaauguucccaaau

SEQ ID NO: 2559355 - RNA, 11 nt, Chlamydophila pneumoniae J138
acccagcugcg

SEQ ID NO: 2559356 - RNA, 23 nt, Chlamydophila pneumoniae J138
acccaguuguauccagcucaagg

SEQ ID NO: 2559357 - RNA, 14 nt, Chlamydophila pneumoniae J138
acccauaaucccua

SEQ ID NO: 2559358 - RNA, 13 nt, Chlamydophila pneumoniae J138
accccaaagcaga

SEQ ID NO: 2559359 - RNA, 20 nt, Chlamydophila pneumoniae J138
accccaaagcagauccugcu

SEQ ID NO: 2559360 - RNA, 17 nt, Chlamydophila pneumoniae J138
accccaucagcaaugau

SEQ ID NO: 2559361 - RNA, 12 nt, Chlamydophila pneumoniae J138
acccccgcagcu

SEQ ID NO: 2559362 - RNA, 19 nt, Chlamydophila pneumoniae J138
acccccuggcugggcuaca

SEQ ID NO: 2559363 - RNA, 13 nt, Chlamydophila pneumoniae J138
accccuagaacuu

SEQ ID NO: 2559364 - RNA, 20 nt, Chlamydophila pneumoniae J138
acccuagguagcucgagauu

SEQ ID NO: 2559365 - RNA, 15 nt, Chlamydophila pneumoniae J138
acccucaaagaauac

SEQ ID NO: 2559366 - RNA, 16 nt, Chlamydophila pneumoniae J138
acccucaucauccuca

SEQ ID NO: 2559367 - RNA, 14 nt, Chlamydophila pneumoniae J138
acccuccuuuguau

SEQ ID NO: 2559368 - RNA, 15 nt, Chlamydophila pneumoniae J138
acccucgaaccacug

SEQ ID NO: 2559369 - RNA, 16 nt, Chlamydophila pneumoniae J138
acccucggagacucag

SEQ ID NO: 2559370 - RNA, 21 nt, Chlamydophila pneumoniae J138
acccucggagacucagagaaa

SEQ ID NO: 2559371 - RNA, 18 nt, Chlamydophila pneumoniae J138
acccugggcucacucuaa

SEQ ID NO: 2559372 - RNA, 19 nt, Chlamydophila pneumoniae J138
acccugggcucacucuaag

SEQ ID NO: 2559373 - RNA, 21 nt, Chlamydophila pneumoniae J138
acccuuuauacuguuuuucuu

SEQ ID NO: 2559374 - RNA, 13 nt, Chlamydophila pneumoniae J138
accgaaagucccg

SEQ ID NO: 2559375 - RNA, 14 nt, Chlamydophila pneumoniae J138
accgaaucucucca

SEQ ID NO: 2559376 - RNA, 16 nt, Chlamydophila pneumoniae J138
accgaaucucuccagc

SEQ ID NO: 2559377 - RNA, 12 nt, Chlamydophila pneumoniae J138
accgacaagcau

SEQ ID NO: 2559378 - RNA, 21 nt, Chlamydophila pneumoniae J138
accgacauacucgucaaauuc

SEQ ID NO: 2559379 - RNA, 22 nt, Chlamydophila pneumoniae J138
accgagaagcuucaaugaugug

SEQ ID NO: 2559380 - RNA, 17 nt, Chlamydophila pneumoniae J138
accgagaugaacauaau

SEQ ID NO: 2559381 - RNA, 19 nt, Chlamydophila pneumoniae J138
accgagcuuuuugcuuuuc

SEQ ID NO: 2559382 - RNA, 22 nt, Chlamydophila pneumoniae J138
accgaucucaguaggagcagcg

SEQ ID NO: 2559383 - RNA, 20 nt, Chlamydophila pneumoniae J138
accgaugauaccaagaugaa

SEQ ID NO: 2559384 - RNA, 18 nt, Chlamydophila pneumoniae J138
accgcgagugugacugca

SEQ ID NO: 2559385 - RNA, 18 nt, Chlamydophila pneumoniae J138
accgcuaguauuaagaua

SEQ ID NO: 2559386 - RNA, 18 nt, Chlamydophila pneumoniae J138
accggacugacuucuaug

SEQ ID NO: 2559387 - RNA, 14 nt, Chlamydophila pneumoniae J138
accguaaagaaaag

SEQ ID NO: 2559388 - RNA, 16 nt, Chlamydophila pneumoniae J138
accguaaagaaaagca

SEQ ID NO: 2559389 - RNA, 19 nt, Chlamydophila pneumoniae J138
accguaacugaggcaaaga

SEQ ID NO: 2559390 - RNA, 18 nt, Chlamydophila pneumoniae J138
accguuucaggaaacuca

SEQ ID NO: 2559391 - RNA, 14 nt, Chlamydophila pneumoniae J138
accuaauaaagaag

SEQ ID NO: 2559392 - RNA, 22 nt, Chlamydophila pneumoniae J138
accuacagaucaggauucuaaa

SEQ ID NO: 2559393 - RNA, 17 nt, Chlamydophila pneumoniae J138
accuaccugcuaccugu

SEQ ID NO: 2559394 - RNA, 20 nt, Chlamydophila pneumoniae J138
accuacuaaacccuguccaa

SEQ ID NO: 2559395 - RNA, 18 nt, Chlamydophila pneumoniae J138
accuacugggaaaucuaa

SEQ ID NO: 2559396 - RNA, 15 nt, Chlamydophila pneumoniae J138
accuagaaucacaua

SEQ ID NO: 2559397 - RNA, 12 nt, Chlamydophila pneumoniae J138
accuaggaggau

SEQ ID NO: 2559398 - RNA, 16 nt, Chlamydophila pneumoniae J138
accuagggucuucucg

SEQ ID NO: 2559399 - RNA, 13 nt, Chlamydophila pneumoniae J138
accuauaggcaag

SEQ ID NO: 2559400 - RNA, 22 nt, Chlamydophila pneumoniae J138
accuaugacggauccuagaaua

SEQ ID NO: 2559401 - RNA, 13 nt, Chlamydophila pneumoniae J138
accuauuugcaac

SEQ ID NO: 2559402 - RNA, 19 nt, Chlamydophila pneumoniae J138
accuauuugcaacaaucuu

SEQ ID NO: 2559403 - RNA, 19 nt, Chlamydophila pneumoniae J138
accucaagaugcauucuga

SEQ ID NO: 2559404 - RNA, 12 nt, Chlamydophila pneumoniae J138
accucaucagaa

SEQ ID NO: 2559405 - RNA, 23 nt, Chlamydophila pneumoniae J138
accucaucagaaguggccuugcc

SEQ ID NO: 2559406 - RNA, 21 nt, Chlamydophila pneumoniae J138
accuccucuucuucaucuucu

SEQ ID NO: 2559407 - RNA, 14 nt, Chlamydophila pneumoniae J138
accucgaauuccuc

SEQ ID NO: 2559408 - RNA, 18 nt, Chlamydophila pneumoniae J138
accucucaucaaagcaaa

SEQ ID NO: 2559409 - RNA, 15 nt, Chlamydophila pneumoniae J138
accucuucaaagaca

SEQ ID NO: 2559410 - RNA, 12 nt, Chlamydophila pneumoniae J138
accucuuuucuu

SEQ ID NO: 2559411 - RNA, 13 nt, Chlamydophila pneumoniae J138
accucuuuucuua

SEQ ID NO: 2559412 - RNA, 23 nt, Chlamydophila pneumoniae J138
accucuuuucuuaucaugaaaag

SEQ ID NO: 2559413 - RNA, 22 nt, Chlamydophila pneumoniae J138
accugaaagcgcguuccuguag

SEQ ID NO: 2559414 - RNA, 16 nt, Chlamydophila pneumoniae J138
accugagaguguuguu

SEQ ID NO: 2559415 - RNA, 21 nt, Chlamydophila pneumoniae J138
accugggggacuucaaaugaa

SEQ ID NO: 2559416 - RNA, 14 nt, Chlamydophila pneumoniae J138
accuguaaagacca

SEQ ID NO: 2559417 - RNA, 23 nt, Chlamydophila pneumoniae J138
accuguagcuacagauucuugua

SEQ ID NO: 2559418 - RNA, 17 nt, Chlamydophila pneumoniae J138
accugugaaaauuuucu

SEQ ID NO: 2559419 - RNA, 17 nt, Chlamydophila pneumoniae J138
accuguguaaugagcug

SEQ ID NO: 2559420 - RNA, 19 nt, Chlamydophila pneumoniae J138
accuguguaaugagcugga

SEQ ID NO: 2559421 - RNA, 14 nt, Chlamydophila pneumoniae J138
accugugugcuuua

SEQ ID NO: 2559422 - RNA, 20 nt, Chlamydophila pneumoniae J138
accuuacauccaauuuuguu

SEQ ID NO: 2559423 - RNA, 16 nt, Chlamydophila pneumoniae J138
accuuagagugacuca

SEQ ID NO: 2559424 - RNA, 13 nt, Chlamydophila pneumoniae J138
accuucacaagaa

SEQ ID NO: 2559425 - RNA, 16 nt, Chlamydophila pneumoniae J138
accuucacaagaaaac

SEQ ID NO: 2559426 - RNA, 14 nt, Chlamydophila pneumoniae J138
accuuccuuaucuu

SEQ ID NO: 2559427 - RNA, 18 nt, Chlamydophila pneumoniae J138
accuucgauuccaggcuc

SEQ ID NO: 2559428 - RNA, 20 nt, Chlamydophila pneumoniae J138
accuugauacugaaucccgu

SEQ ID NO: 2559429 - RNA, 17 nt, Chlamydophila pneumoniae J138
accuuguauaagagcaa

SEQ ID NO: 2559430 - RNA, 23 nt, Chlamydophila pneumoniae J138
accuuuaacccgcuugcaucuua

SEQ ID NO: 2559431 - RNA, 17 nt, Chlamydophila pneumoniae J138
accuuuaggaagcugua

SEQ ID NO: 2559432 - RNA, 15 nt, Chlamydophila pneumoniae J138
accuuuggauucaga

SEQ ID NO: 2559433 - RNA, 22 nt, Chlamydophila pneumoniae J138
accuuugguagaaagacaaaaa

SEQ ID NO: 2559434 - RNA, 18 nt, Chlamydophila pneumoniae J138
accuuuuucauugaugcu

SEQ ID NO: 2559435 - RNA, 12 nt, Chlamydophila pneumoniae J138
acgaaaaggaga

SEQ ID NO: 2559436 - RNA, 18 nt, Chlamydophila pneumoniae J138
acgaaaaggagaauacaa

SEQ ID NO: 2559437 - RNA, 23 nt, Chlamydophila pneumoniae J138
acgaaaaucuacacgcuauagca

SEQ ID NO: 2559438 - RNA, 15 nt, Chlamydophila pneumoniae J138
acgaaagcagugugc

SEQ ID NO: 2559439 - RNA, 14 nt, Chlamydophila pneumoniae J138
acgaaauguuaaag

SEQ ID NO: 2559440 - RNA, 17 nt, Chlamydophila pneumoniae J138
acgaacaagacgaaagc

SEQ ID NO: 2559441 - RNA, 14 nt, Chlamydophila pneumoniae J138
acgaacuaaaggaa

SEQ ID NO: 2559442 - RNA, 19 nt, Chlamydophila pneumoniae J138
acgaagaaaacgcaccuua

SEQ ID NO: 2559443 - RNA, 15 nt, Chlamydophila pneumoniae J138
acgaaggaaucugau

SEQ ID NO: 2559444 - RNA, 21 nt, Chlamydophila pneumoniae J138
acgaauacuguucgauaagaa

SEQ ID NO: 2559445 - RNA, 16 nt, Chlamydophila pneumoniae J138
acgaauccaaaaaaga

SEQ ID NO: 2559446 - RNA, 16 nt, Chlamydophila pneumoniae J138
acgaaucguuucucug

SEQ ID NO: 2559447 - RNA, 24 nt, Chlamydophila pneumoniae J138
acgaauguguugcucuaccaacug

SEQ ID NO: 2559448 - RNA, 20 nt, Chlamydophila pneumoniae J138
acgaauuucacacagcggua

SEQ ID NO: 2559449 - RNA, 13 nt, Chlamydophila pneumoniae J138
acgacaaaucacg

SEQ ID NO: 2559450 - RNA, 21 nt, Chlamydophila pneumoniae J138
acgacaugccuaaauagcuca

SEQ ID NO: 2559451 - RNA, 13 nt, Chlamydophila pneumoniae J138
acgacauugaaga

SEQ ID NO: 2559452 - RNA, 14 nt, Chlamydophila pneumoniae J138
acgaccaacuccuc

SEQ ID NO: 2559453 - RNA, 16 nt, Chlamydophila pneumoniae J138
acgacgucaucaccau

SEQ ID NO: 2559454 - RNA, 23 nt, Chlamydophila pneumoniae J138
acgacgucuucuuagaagagaaa

SEQ ID NO: 2559455 - RNA, 17 nt, Chlamydophila pneumoniae J138
acgacucugccaugucu

SEQ ID NO: 2559456 - RNA, 21 nt, Chlamydophila pneumoniae J138
acgagaacaugaccuuuagga

SEQ ID NO: 2559457 - RNA, 11 nt, Chlamydophila pneumoniae J138
acgagacugca

SEQ ID NO: 2559458 - RNA, 18 nt, Chlamydophila pneumoniae J138
acgagacugcaaaggaag

SEQ ID NO: 2559459 - RNA, 21 nt, Chlamydophila pneumoniae J138
acgagcaugcuaagcaucaga

SEQ ID NO: 2559460 - RNA, 17 nt, Chlamydophila pneumoniae J138
acgagcccuagauagca

SEQ ID NO: 2559461 - RNA, 14 nt, Chlamydophila pneumoniae J138
acgagcgcuuucuu

SEQ ID NO: 2559462 - RNA, 13 nt, Chlamydophila pneumoniae J138
acgagcuguccag

SEQ ID NO: 2559463 - RNA, 15 nt, Chlamydophila pneumoniae J138
acgagucccuucuuu

SEQ ID NO: 2559464 - RNA, 21 nt, Chlamydophila pneumoniae J138
acgaguucgcggaucuucuuc

SEQ ID NO: 2559465 - RNA, 23 nt, Chlamydophila pneumoniae J138
acgaguucucccgugaacaaaaa

SEQ ID NO: 2559466 - RNA, 18 nt, Chlamydophila pneumoniae J138
acgauacgucguuacagc

SEQ ID NO: 2559467 - RNA, 17 nt, Chlamydophila pneumoniae J138
acgauaguacuuauccu

SEQ ID NO: 2559468 - RNA, 22 nt, Chlamydophila pneumoniae J138
acgauauuugggauauuggaga

SEQ ID NO: 2559469 - RNA, 15 nt, Chlamydophila pneumoniae J138
acgaucaaauuccuu

SEQ ID NO: 2559470 - RNA, 19 nt, Chlamydophila pneumoniae J138
acgaucaaauuccuucuca

SEQ ID NO: 2559471 - RNA, 20 nt, Chlamydophila pneumoniae J138
acgaucacauuccaagaaaa

SEQ ID NO: 2559472 - RNA, 18 nt, Chlamydophila pneumoniae J138
acgauccaucucaucgaa

SEQ ID NO: 2559473 - RNA, 16 nt, Chlamydophila pneumoniae J138
acgaucgcgauaagaa

SEQ ID NO: 2559474 - RNA, 21 nt, Chlamydophila pneumoniae J138
acgaucgucaguaaaacacaa

SEQ ID NO: 2559475 - RNA, 16 nt, Chlamydophila pneumoniae J138
acgaugaacguauagg

SEQ ID NO: 2559476 - RNA, 13 nt, Chlamydophila pneumoniae J138
acgauuucuuuua

SEQ ID NO: 2559477 - RNA, 20 nt, Chlamydophila pneumoniae J138
acgauuucuuuuaguuguga

SEQ ID NO: 2559478 - RNA, 15 nt, Chlamydophila pneumoniae J138
acgcaaguaaagaaa

SEQ ID NO: 2559479 - RNA, 16 nt, Chlamydophila pneumoniae J138
acgcaaguaaagaaau

SEQ ID NO: 2559480 - RNA, 17 nt, Chlamydophila pneumoniae J138
acgcaaugauuucucua

SEQ ID NO: 2559481 - RNA, 13 nt, Chlamydophila pneumoniae J138
acgcacuucuuca

SEQ ID NO: 2559482 - RNA, 16 nt, Chlamydophila pneumoniae J138
acgcacuucuucaaga

SEQ ID NO: 2559483 - RNA, 11 nt, Chlamydophila pneumoniae J138
acgcagagaug

SEQ ID NO: 2559484 - RNA, 14 nt, Chlamydophila pneumoniae J138
acgcaggaagaaca

SEQ ID NO: 2559485 - RNA, 22 nt, Chlamydophila pneumoniae J138
acgcaguaucguaacuuccuuu

SEQ ID NO: 2559486 - RNA, 18 nt, Chlamydophila pneumoniae J138
acgcauagcacuaugaau

SEQ ID NO: 2559487 - RNA, 22 nt, Chlamydophila pneumoniae J138
acgccaaugggaauuugauuuu

SEQ ID NO: 2559488 - RNA, 16 nt, Chlamydophila pneumoniae J138
acgccauacugauaua

SEQ ID NO: 2559489 - RNA, 21 nt, Chlamydophila pneumoniae J138
acgcccacggaaagcacauac

SEQ ID NO: 2559490 - RNA, 13 nt, Chlamydophila pneumoniae J138
acgcccaugucuu

SEQ ID NO: 2559491 - RNA, 13 nt, Chlamydophila pneumoniae J138
acgccuucaaguc

SEQ ID NO: 2559492 - RNA, 19 nt, Chlamydophila pneumoniae J138
acgccuucaagucgagaaa

SEQ ID NO: 2559493 - RNA, 16 nt, Chlamydophila pneumoniae J138
acgcuaaacuaaaaug

SEQ ID NO: 2559494 - RNA, 19 nt, Chlamydophila pneumoniae J138
acgcuacgguacuuuacaa

SEQ ID NO: 2559495 - RNA, 14 nt, Chlamydophila pneumoniae J138
acgcuauccuauug

SEQ ID NO: 2559496 - RNA, 10 nt, Chlamydophila pneumoniae J138
acgcuauucu

SEQ ID NO: 2559497 - RNA, 13 nt, Chlamydophila pneumoniae J138
acgcuauucuuaa

SEQ ID NO: 2559498 - RNA, 17 nt, Chlamydophila pneumoniae J138
acgcucccuaugccagu

SEQ ID NO: 2559499 - RNA, 17 nt, Chlamydophila pneumoniae J138
acgcuccucuaacuuca

SEQ ID NO: 2559500 - RNA, 16 nt, Chlamydophila pneumoniae J138
acgcucuaaacucucu

SEQ ID NO: 2559501 - RNA, 21 nt, Chlamydophila pneumoniae J138
acgcucuaaacucucuuccuu

SEQ ID NO: 2559502 - RNA, 19 nt, Chlamydophila pneumoniae J138
acgcuuuuaucuguuaaaa

SEQ ID NO: 2559503 - RNA, 23 nt, Chlamydophila pneumoniae J138
acgcuuuuaucuguuaaaaacaa

SEQ ID NO: 2559504 - RNA, 12 nt, Chlamydophila pneumoniae J138
acgcuuuucuaa

SEQ ID NO: 2559505 - RNA, 13 nt, Chlamydophila pneumoniae J138
acgcuuuucuaau

SEQ ID NO: 2559506 - RNA, 13 nt, Chlamydophila pneumoniae J138
acgcuuuuucuug

SEQ ID NO: 2559507 - RNA, 18 nt, Chlamydophila pneumoniae J138
acgcuuuuucuugaaaaa

SEQ ID NO: 2559508 - RNA, 14 nt, Chlamydophila pneumoniae J138
acggaaagcacaua

SEQ ID NO: 2559509 - RNA, 15 nt, Chlamydophila pneumoniae J138
acggaaagcacauac

SEQ ID NO: 2559510 - RNA, 18 nt, Chlamydophila pneumoniae J138
acggaacaagucuucaau

SEQ ID NO: 2559511 - RNA, 14 nt, Chlamydophila pneumoniae J138
acggaacuaaagag

SEQ ID NO: 2559512 - RNA, 20 nt, Chlamydophila pneumoniae J138
acggacaaugcuaucuccag

SEQ ID NO: 2559513 - RNA, 20 nt, Chlamydophila pneumoniae J138
acggacuucacaaagaacca

SEQ ID NO: 2559514 - RNA, 20 nt, Chlamydophila pneumoniae J138
acggauauucuuuagggcua

SEQ ID NO: 2559515 - RNA, 20 nt, Chlamydophila pneumoniae J138
acggauccuagaauaggaau

SEQ ID NO: 2559516 - RNA, 17 nt, Chlamydophila pneumoniae J138
acggauucuaaaagagc

SEQ ID NO: 2559517 - RNA, 20 nt, Chlamydophila pneumoniae J138
acggccgacucuacaucuuc

SEQ ID NO: 2559518 - RNA, 17 nt, Chlamydophila pneumoniae J138
acggcugauucucccaa

SEQ ID NO: 2559519 - RNA, 14 nt, Chlamydophila pneumoniae J138
acgggagcucuuuc

SEQ ID NO: 2559520 - RNA, 20 nt, Chlamydophila pneumoniae J138
acgggcaauauauccaggau

SEQ ID NO: 2559521 - RNA, 20 nt, Chlamydophila pneumoniae J138
acgggucaggagguggugga

SEQ ID NO: 2559522 - RNA, 22 nt, Chlamydophila pneumoniae J138
acgguaagaucucguagcucag

SEQ ID NO: 2559523 - RNA, 23 nt, Chlamydophila pneumoniae J138
acgguaaggaggaaucuugauga

SEQ ID NO: 2559524 - RNA, 19 nt, Chlamydophila pneumoniae J138
acgguagucaaaggaucca

SEQ ID NO: 2559525 - RNA, 21 nt, Chlamydophila pneumoniae J138
acgguuucugggaugcacacg

SEQ ID NO: 2559526 - RNA, 22 nt, Chlamydophila pneumoniae J138
acgguuuucugccuuaccacuu

SEQ ID NO: 2559527 - RNA, 14 nt, Chlamydophila pneumoniae J138
acguaacguaguca

SEQ ID NO: 2559528 - RNA, 22 nt, Chlamydophila pneumoniae J138
acguagcauaccuuggaaaggu

SEQ ID NO: 2559529 - RNA, 17 nt, Chlamydophila pneumoniae J138
acguagcuacaaaauua

SEQ ID NO: 2559530 - RNA, 18 nt, Chlamydophila pneumoniae J138
acguagcuacaaaauuau

SEQ ID NO: 2559531 - RNA, 21 nt, Chlamydophila pneumoniae J138
acguauagggaaccuugauac

SEQ ID NO: 2559532 - RNA, 22 nt, Chlamydophila pneumoniae J138
acguauagguugaauaaauuuu

SEQ ID NO: 2559533 - RNA, 23 nt, Chlamydophila pneumoniae J138
acguauccuugauuuuaaaauga

SEQ ID NO: 2559534 - RNA, 22 nt, Chlamydophila pneumoniae J138
acgucacuggggcauaagaacu

SEQ ID NO: 2559535 - RNA, 23 nt, Chlamydophila pneumoniae J138
acgucacuggggcauaagaacuc

SEQ ID NO: 2559536 - RNA, 14 nt, Chlamydophila pneumoniae J138
acgucagcuguccu

SEQ ID NO: 2559537 - RNA, 15 nt, Chlamydophila pneumoniae J138
acgucagcuguccuc

SEQ ID NO: 2559538 - RNA, 19 nt, Chlamydophila pneumoniae J138
acguccucaccuugugaga

SEQ ID NO: 2559539 - RNA, 17 nt, Chlamydophila pneumoniae J138
acguccugaugccuuuu

SEQ ID NO: 2559540 - RNA, 16 nt, Chlamydophila pneumoniae J138
acgucuccaacagucu

SEQ ID NO: 2559541 - RNA, 16 nt, Chlamydophila pneumoniae J138
acgucuuucaccaacu

SEQ ID NO: 2559542 - RNA, 17 nt, Chlamydophila pneumoniae J138
acgucuuucaccaacuc

SEQ ID NO: 2559543 - RNA, 15 nt, Chlamydophila pneumoniae J138
acgugcaucucuuca

SEQ ID NO: 2559544 - RNA, 18 nt, Chlamydophila pneumoniae J138
acgugcucucuacuucug

SEQ ID NO: 2559545 - RNA, 19 nt, Chlamydophila pneumoniae J138
acgugcucucuucuucuca

SEQ ID NO: 2559546 - RNA, 12 nt, Chlamydophila pneumoniae J138
acgugguuuuug

SEQ ID NO: 2559547 - RNA, 13 nt, Chlamydophila pneumoniae J138
acguucugcaaca

SEQ ID NO: 2559548 - RNA, 19 nt, Chlamydophila pneumoniae J138
acguugcgaacagcuccug

SEQ ID NO: 2559549 - RNA, 15 nt, Chlamydophila pneumoniae J138
acguuggacugcaag

SEQ ID NO: 2559550 - RNA, 14 nt, Chlamydophila pneumoniae J138
acguuuaauuccuu

SEQ ID NO: 2559551 - RNA, 19 nt, Chlamydophila pneumoniae J138
acguuuucucuucccuugu

SEQ ID NO: 2559552 - RNA, 14 nt, Chlamydophila pneumoniae J138
acuaaaaaagagac

SEQ ID NO: 2559553 - RNA, 21 nt, Chlamydophila pneumoniae J138
acuaaaagaauaauagcaagc

SEQ ID NO: 2559554 - RNA, 15 nt, Chlamydophila pneumoniae J138
acuaaaaguuuuuua

SEQ ID NO: 2559555 - RNA, 23 nt, Chlamydophila pneumoniae J138
acuaaacuccauuguuguugcau

SEQ ID NO: 2559556 - RNA, 13 nt, Chlamydophila pneumoniae J138
acuaaagauacuu

SEQ ID NO: 2559557 - RNA, 23 nt, Chlamydophila pneumoniae J138
acuaaaucaacuacaucuccaag

SEQ ID NO: 2559558 - RNA, 22 nt, Chlamydophila pneumoniae J138
acuaaaugacgaguugaaguuu

SEQ ID NO: 2559559 - RNA, 16 nt, Chlamydophila pneumoniae J138
acuaacuguaauuuca

SEQ ID NO: 2559560 - RNA, 21 nt, Chlamydophila pneumoniae J138
acuaagaagcucacucuuuaa

SEQ ID NO: 2559561 - RNA, 19 nt, Chlamydophila pneumoniae J138
acuaauaccuuucuaagaa

SEQ ID NO: 2559562 - RNA, 16 nt, Chlamydophila pneumoniae J138
acuacaagauaguggu

SEQ ID NO: 2559563 - RNA, 17 nt, Chlamydophila pneumoniae J138
acuacacgcacuugcuu

SEQ ID NO: 2559564 - RNA, 12 nt, Chlamydophila pneumoniae J138
acuacagaggga

SEQ ID NO: 2559565 - RNA, 17 nt, Chlamydophila pneumoniae J138
acuacaggaauucucau

SEQ ID NO: 2559566 - RNA, 13 nt, Chlamydophila pneumoniae J138
acuacauucagga

SEQ ID NO: 2559567 - RNA, 18 nt, Chlamydophila pneumoniae J138
acuaccgaauuuucaauu

SEQ ID NO: 2559568 - RNA, 16 nt, Chlamydophila pneumoniae J138
acuacucucaucaagg

SEQ ID NO: 2559569 - RNA, 12 nt, Chlamydophila pneumoniae J138
acuacugaaaca

SEQ ID NO: 2559570 - RNA, 13 nt, Chlamydophila pneumoniae J138
acuagaauaccgu

SEQ ID NO: 2559571 - RNA, 13 nt, Chlamydophila pneumoniae J138
acuagagaaaaag

SEQ ID NO: 2559572 - RNA, 14 nt, Chlamydophila pneumoniae J138
acuagagaaaaagc

SEQ ID NO: 2559573 - RNA, 22 nt, Chlamydophila pneumoniae J138
acuagagauucgaaagaacuac

SEQ ID NO: 2559574 - RNA, 17 nt, Chlamydophila pneumoniae J138
acuagauaguucacaag

SEQ ID NO: 2559575 - RNA, 20 nt, Chlamydophila pneumoniae J138
acuagcucucuugcuauacc

SEQ ID NO: 2559576 - RNA, 14 nt, Chlamydophila pneumoniae J138
acuagcuuuucaug

SEQ ID NO: 2559577 - RNA, 14 nt, Chlamydophila pneumoniae J138
acuaggaaaagcau

SEQ ID NO: 2559578 - RNA, 22 nt, Chlamydophila pneumoniae J138
acuaggaaaagcauagucgucu

SEQ ID NO: 2559579 - RNA, 21 nt, Chlamydophila pneumoniae J138
acuagguuauuaucaaaguga

SEQ ID NO: 2559580 - RNA, 20 nt, Chlamydophila pneumoniae J138
acuauaaaagccagggcagc

SEQ ID NO: 2559581 - RNA, 23 nt, Chlamydophila pneumoniae J138
acuauaagagguucucuuaacug

SEQ ID NO: 2559582 - RNA, 17 nt, Chlamydophila pneumoniae J138
acuauagaucucuugaa

SEQ ID NO: 2559583 - RNA, 17 nt, Chlamydophila pneumoniae J138
acuauagcaauccauag

SEQ ID NO: 2559584 - RNA, 20 nt, Chlamydophila pneumoniae J138
acuaucauggacaagcaaaa

SEQ ID NO: 2559585 - RNA, 23 nt, Chlamydophila pneumoniae J138
acuaucauggacaagcaaaagca

SEQ ID NO: 2559586 - RNA, 16 nt, Chlamydophila pneumoniae J138
acuaucgcaaauuucc

SEQ ID NO: 2559587 - RNA, 19 nt, Chlamydophila pneumoniae J138
acuaucgguuuaaacagau

SEQ ID NO: 2559588 - RNA, 15 nt, Chlamydophila pneumoniae J138
acuaugguaagcauu

SEQ ID NO: 2559589 - RNA, 15 nt, Chlamydophila pneumoniae J138
acuauguguuuccuu

SEQ ID NO: 2559590 - RNA, 20 nt, Chlamydophila pneumoniae J138
acuauuaauacuuugccaac

SEQ ID NO: 2559591 - RNA, 16 nt, Chlamydophila pneumoniae J138
acuauuaggcuuuuuu

SEQ ID NO: 2559592 - RNA, 15 nt, Chlamydophila pneumoniae J138
acuauuuucauucca

SEQ ID NO: 2559593 - RNA, 18 nt, Chlamydophila pneumoniae J138
acuauuuuggaaagcucu

SEQ ID NO: 2559594 - RNA, 13 nt, Chlamydophila pneumoniae J138
acucaaaagaaga

SEQ ID NO: 2559595 - RNA, 12 nt, Chlamydophila pneumoniae J138
acucaaagaacu

SEQ ID NO: 2559596 - RNA, 21 nt, Chlamydophila pneumoniae J138
acucaaaucuuucaaggaaca

SEQ ID NO: 2559597 - RNA, 15 nt, Chlamydophila pneumoniae J138
acucaaauucaaaau

SEQ ID NO: 2559598 - RNA, 20 nt, Chlamydophila pneumoniae J138
acucaaauucaaaauagaag

SEQ ID NO: 2559599 - RNA, 13 nt, Chlamydophila pneumoniae J138
acucaacuuuuuu

SEQ ID NO: 2559600 - RNA, 17 nt, Chlamydophila pneumoniae J138
acucaaucucuuugaca

SEQ ID NO: 2559601 - RNA, 19 nt, Chlamydophila pneumoniae J138
acucacaaacaacagaaau

SEQ ID NO: 2559602 - RNA, 14 nt, Chlamydophila pneumoniae J138
acucacauuugcuu

SEQ ID NO: 2559603 - RNA, 18 nt, Chlamydophila pneumoniae J138
acucacauuugcuuuaac

SEQ ID NO: 2559604 - RNA, 19 nt, Chlamydophila pneumoniae J138
acucacauuugcuuuaaca

SEQ ID NO: 2559605 - RNA, 24 nt, Chlamydophila pneumoniae J138
acucacauuugcuuuaacagaagc

SEQ ID NO: 2559606 - RNA, 18 nt, Chlamydophila pneumoniae J138
acucacgcucucgcuaag

SEQ ID NO: 2559607 - RNA, 13 nt, Chlamydophila pneumoniae J138
acucagagaaaau

SEQ ID NO: 2559608 - RNA, 12 nt, Chlamydophila pneumoniae J138
acucagagauug

SEQ ID NO: 2559609 - RNA, 22 nt, Chlamydophila pneumoniae J138
acucagcgcaucacgaaaagga

SEQ ID NO: 2559610 - RNA, 22 nt, Chlamydophila pneumoniae J138
acucagcguucgcucucuuuaa

SEQ ID NO: 2559611 - RNA, 21 nt, Chlamydophila pneumoniae J138
acucagcucccaugugcugaa

SEQ ID NO: 2559612 - RNA, 21 nt, Chlamydophila pneumoniae J138
acucaggauauauagagcaga

SEQ ID NO: 2559613 - RNA, 24 nt, Chlamydophila pneumoniae J138
acucaggcuuuaaguguuucuuca

SEQ ID NO: 2559614 - RNA, 19 nt, Chlamydophila pneumoniae J138
acucaucacaauuuuaaaa

SEQ ID NO: 2559615 - RNA, 15 nt, Chlamydophila pneumoniae J138
acucaugaaagugcu

SEQ ID NO: 2559616 - RNA, 21 nt, Chlamydophila pneumoniae J138
acuccaaaauauucuuucaaa

SEQ ID NO: 2559617 - RNA, 13 nt, Chlamydophila pneumoniae J138
acuccaagaauag

SEQ ID NO: 2559618 - RNA, 21 nt, Chlamydophila pneumoniae J138
acuccaagucagccaagacaa

SEQ ID NO: 2559619 - RNA, 23 nt, Chlamydophila pneumoniae J138
acuccaagucagccaagacaaaa

SEQ ID NO: 2559620 - RNA, 13 nt, Chlamydophila pneumoniae J138
acuccacuuuuuu

SEQ ID NO: 2559621 - RNA, 14 nt, Chlamydophila pneumoniae J138
acuccagaaaguau

SEQ ID NO: 2559622 - RNA, 16 nt, Chlamydophila pneumoniae J138
acuccauucagauggu

SEQ ID NO: 2559623 - RNA, 15 nt, Chlamydophila pneumoniae J138
acucccaaggaaauu

SEQ ID NO: 2559624 - RNA, 14 nt, Chlamydophila pneumoniae J138
acucccguuuuguu

SEQ ID NO: 2559625 - RNA, 22 nt, Chlamydophila pneumoniae J138
acucccuagguuuuaucuuuag

SEQ ID NO: 2559626 - RNA, 23 nt, Chlamydophila pneumoniae J138
acucccuagguuuuaucuuuaga

SEQ ID NO: 2559627 - RNA, 20 nt, Chlamydophila pneumoniae J138
acuccgcacuugcucuuuaa

SEQ ID NO: 2559628 - RNA, 13 nt, Chlamydophila pneumoniae J138
acuccucagaauc

SEQ ID NO: 2559629 - RNA, 18 nt, Chlamydophila pneumoniae J138
acucgaauuguguguuuu

SEQ ID NO: 2559630 - RNA, 19 nt, Chlamydophila pneumoniae J138
acucgccauaauagucucu

SEQ ID NO: 2559631 - RNA, 20 nt, Chlamydophila pneumoniae J138
acucgccauaauagucucug

SEQ ID NO: 2559632 - RNA, 14 nt, Chlamydophila pneumoniae J138
acucgcgucaugca

SEQ ID NO: 2559633 - RNA, 16 nt, Chlamydophila pneumoniae J138
acucggaaaaaauaga

SEQ ID NO: 2559634 - RNA, 16 nt, Chlamydophila pneumoniae J138
acucggugggccucuu

SEQ ID NO: 2559635 - RNA, 14 nt, Chlamydophila pneumoniae J138
acucgucaaauuca

SEQ ID NO: 2559636 - RNA, 19 nt, Chlamydophila pneumoniae J138
acucguguggaucacguaa

SEQ ID NO: 2559637 - RNA, 20 nt, Chlamydophila pneumoniae J138
acucguugccaaucuuucau

SEQ ID NO: 2559638 - RNA, 18 nt, Chlamydophila pneumoniae J138
acucuaaucugauucaau

SEQ ID NO: 2559639 - RNA, 22 nt, Chlamydophila pneumoniae J138
acucuacaguaguaaauaauaa

SEQ ID NO: 2559640 - RNA, 19 nt, Chlamydophila pneumoniae J138
acucuacccccagcuucuu

SEQ ID NO: 2559641 - RNA, 16 nt, Chlamydophila pneumoniae J138
acucuagggucaagaa

SEQ ID NO: 2559642 - RNA, 17 nt, Chlamydophila pneumoniae J138
acucuagguuuucucuu

SEQ ID NO: 2559643 - RNA, 15 nt, Chlamydophila pneumoniae J138
acucuaguuuuucuu

SEQ ID NO: 2559644 - RNA, 21 nt, Chlamydophila pneumoniae J138
acucuaguuuuucuuuagaga

SEQ ID NO: 2559645 - RNA, 17 nt, Chlamydophila pneumoniae J138
acucuaucgaagagccc

SEQ ID NO: 2559646 - RNA, 18 nt, Chlamydophila pneumoniae J138
acucuccauccucagucu

SEQ ID NO: 2559647 - RNA, 20 nt, Chlamydophila pneumoniae J138
acucuccauccucagucucu

SEQ ID NO: 2559648 - RNA, 23 nt, Chlamydophila pneumoniae J138
acucucccauguaguaaauuccu

SEQ ID NO: 2559649 - RNA, 21 nt, Chlamydophila pneumoniae J138
acucucugcagggaauccugu

SEQ ID NO: 2559650 - RNA, 13 nt, Chlamydophila pneumoniae J138
acucucuuccuuc

SEQ ID NO: 2559651 - RNA, 15 nt, Chlamydophila pneumoniae J138
acucucuuccuucuc

SEQ ID NO: 2559652 - RNA, 17 nt, Chlamydophila pneumoniae J138
acucucuuccuucuccu

SEQ ID NO: 2559653 - RNA, 18 nt, Chlamydophila pneumoniae J138
acucucuuccuucuccug

SEQ ID NO: 2559654 - RNA, 18 nt, Chlamydophila pneumoniae J138
acucugaaguacacuaca

SEQ ID NO: 2559655 - RNA, 17 nt, Chlamydophila pneumoniae J138
acucugggaauuguucu

SEQ ID NO: 2559656 - RNA, 16 nt, Chlamydophila pneumoniae J138
acucuuauugcagaau

SEQ ID NO: 2559657 - RNA, 19 nt, Chlamydophila pneumoniae J138
acucuucaucgauaggaug

SEQ ID NO: 2559658 - RNA, 22 nt, Chlamydophila pneumoniae J138
acucuuccaauuguaaaucauu

SEQ ID NO: 2559659 - RNA, 23 nt, Chlamydophila pneumoniae J138
acucuuccaauuguaaaucauug

SEQ ID NO: 2559660 - RNA, 23 nt, Chlamydophila pneumoniae J138
acucuuccacaauguuuagaauu

SEQ ID NO: 2559661 - RNA, 16 nt, Chlamydophila pneumoniae J138
acucuuccuucuacag

SEQ ID NO: 2559662 - RNA, 21 nt, Chlamydophila pneumoniae J138
acucuuccuucuacagauuga

SEQ ID NO: 2559663 - RNA, 13 nt, Chlamydophila pneumoniae J138
acucuugcuugcu

SEQ ID NO: 2559664 - RNA, 22 nt, Chlamydophila pneumoniae J138
acucuuguugucuauggaagcg

SEQ ID NO: 2559665 - RNA, 13 nt, Chlamydophila pneumoniae J138
acucuuuaaaaau

SEQ ID NO: 2559666 - RNA, 14 nt, Chlamydophila pneumoniae J138
acucuuuaaaaaua

SEQ ID NO: 2559667 - RNA, 23 nt, Chlamydophila pneumoniae J138
acucuuuaaaagggcgcuucccu

SEQ ID NO: 2559668 - RNA, 20 nt, Chlamydophila pneumoniae J138
acucuuuaggucuugucuau

SEQ ID NO: 2559669 - RNA, 16 nt, Chlamydophila pneumoniae J138
acucuuuuaagacaau

SEQ ID NO: 2559670 - RNA, 19 nt, Chlamydophila pneumoniae J138
acucuuuuaagacaauaua

SEQ ID NO: 2559671 - RNA, 19 nt, Chlamydophila pneumoniae J138
acucuuuuauuuuaggaag

SEQ ID NO: 2559672 - RNA, 12 nt, Chlamydophila pneumoniae J138
acugaaagaugu

SEQ ID NO: 2559673 - RNA, 15 nt, Chlamydophila pneumoniae J138
acugaauaguagagu

SEQ ID NO: 2559674 - RNA, 21 nt, Chlamydophila pneumoniae J138
acugaauaguagaguugacaa

SEQ ID NO: 2559675 - RNA, 11 nt, Chlamydophila pneumoniae J138
acugaauauca

SEQ ID NO: 2559676 - RNA, 17 nt, Chlamydophila pneumoniae J138
acugacuuuaugaucuc

SEQ ID NO: 2559677 - RNA, 19 nt, Chlamydophila pneumoniae J138
acugagcuucuaucuugaa

SEQ ID NO: 2559678 - RNA, 14 nt, Chlamydophila pneumoniae J138
acugaggcaaagau

SEQ ID NO: 2559679 - RNA, 13 nt, Chlamydophila pneumoniae J138
acugaugaaaaag

SEQ ID NO: 2559680 - RNA, 21 nt, Chlamydophila pneumoniae J138
acugcaaaggaagggauguuu

SEQ ID NO: 2559681 - RNA, 22 nt, Chlamydophila pneumoniae J138
acugcaggaaauuauagaugau

SEQ ID NO: 2559682 - RNA, 16 nt, Chlamydophila pneumoniae J138
acugcauaaucucacc

SEQ ID NO: 2559683 - RNA, 18 nt, Chlamydophila pneumoniae J138
acugccagcgaucacaua

SEQ ID NO: 2559684 - RNA, 20 nt, Chlamydophila pneumoniae J138
acugcgaaggguuguugcca

SEQ ID NO: 2559685 - RNA, 15 nt, Chlamydophila pneumoniae J138
acugcgagagaaagu

SEQ ID NO: 2559686 - RNA, 13 nt, Chlamydophila pneumoniae J138
acugcuagagucc

SEQ ID NO: 2559687 - RNA, 14 nt, Chlamydophila pneumoniae J138
acugcucaaugaca

SEQ ID NO: 2559688 - RNA, 19 nt, Chlamydophila pneumoniae J138
acugcuuacaauugaaaau

SEQ ID NO: 2559689 - RNA, 16 nt, Chlamydophila pneumoniae J138
acugcuucaaaacaua

SEQ ID NO: 2559690 - RNA, 17 nt, Chlamydophila pneumoniae J138
acugcuuuaggcccaag

SEQ ID NO: 2559691 - RNA, 14 nt, Chlamydophila pneumoniae J138
acuggacuucguuu

SEQ ID NO: 2559692 - RNA, 17 nt, Chlamydophila pneumoniae J138
acuggcgacuugccaau

SEQ ID NO: 2559693 - RNA, 15 nt, Chlamydophila pneumoniae J138
acugggaaaucuaaa

SEQ ID NO: 2559694 - RNA, 20 nt, Chlamydophila pneumoniae J138
acugggaaaucuaaacagua

SEQ ID NO: 2559695 - RNA, 22 nt, Chlamydophila pneumoniae J138
acuguaaauuucauuugaaaua

SEQ ID NO: 2559696 - RNA, 13 nt, Chlamydophila pneumoniae J138
acuguacaaaugc

SEQ ID NO: 2559697 - RNA, 15 nt, Chlamydophila pneumoniae J138
acuguauagaaacug

SEQ ID NO: 2559698 - RNA, 18 nt, Chlamydophila pneumoniae J138
acuguauagaaacuguua

SEQ ID NO: 2559699 - RNA, 21 nt, Chlamydophila pneumoniae J138
acugucauguauccgaaaucu

SEQ ID NO: 2559700 - RNA, 14 nt, Chlamydophila pneumoniae J138
acuguccauccaaa

SEQ ID NO: 2559701 - RNA, 19 nt, Chlamydophila pneumoniae J138
acuguccauccaaauagag

SEQ ID NO: 2559702 - RNA, 20 nt, Chlamydophila pneumoniae J138
acugucuagcaguugcaaua

SEQ ID NO: 2559703 - RNA, 17 nt, Chlamydophila pneumoniae J138
acugugccauaacgcau

SEQ ID NO: 2559704 - RNA, 17 nt, Chlamydophila pneumoniae J138
acuguguucaauagcaa

SEQ ID NO: 2559705 - RNA, 18 nt, Chlamydophila pneumoniae J138
acuguuaacaagauucuc

SEQ ID NO: 2559706 - RNA, 15 nt, Chlamydophila pneumoniae J138
acuguucauaaucca

SEQ ID NO: 2559707 - RNA, 18 nt, Chlamydophila pneumoniae J138
acuguucgauaagaacuu

SEQ ID NO: 2559708 - RNA, 22 nt, Chlamydophila pneumoniae J138
acuguucgauaagaacuuuagg

SEQ ID NO: 2559709 - RNA, 19 nt, Chlamydophila pneumoniae J138
acuguugauccuucuuaug

SEQ ID NO: 2559710 - RNA, 19 nt, Chlamydophila pneumoniae J138
acuguuuuuuaucuccuga

SEQ ID NO: 2559711 - RNA, 16 nt, Chlamydophila pneumoniae J138
acuuaaagacuugcuu

SEQ ID NO: 2559712 - RNA, 17 nt, Chlamydophila pneumoniae J138
acuuaaagguaaaacua

SEQ ID NO: 2559713 - RNA, 21 nt, Chlamydophila pneumoniae J138
acuuaagauacuucuccacag

SEQ ID NO: 2559714 - RNA, 22 nt, Chlamydophila pneumoniae J138
acuuaagauacuucuccacagc

SEQ ID NO: 2559715 - RNA, 20 nt, Chlamydophila pneumoniae J138
acuuaaguugaccuuuuuca

SEQ ID NO: 2559716 - RNA, 18 nt, Chlamydophila pneumoniae J138
acuuaauaauguuuuaau

SEQ ID NO: 2559717 - RNA, 14 nt, Chlamydophila pneumoniae J138
acuuacgaaucuua

SEQ ID NO: 2559718 - RNA, 21 nt, Chlamydophila pneumoniae J138
acuuacuaaaggugaaaguac

SEQ ID NO: 2559719 - RNA, 19 nt, Chlamydophila pneumoniae J138
acuuagaacuauaggaagc

SEQ ID NO: 2559720 - RNA, 15 nt, Chlamydophila pneumoniae J138
acuuagagucuucga

SEQ ID NO: 2559721 - RNA, 20 nt, Chlamydophila pneumoniae J138
acuuagagucuucgacaagg

SEQ ID NO: 2559722 - RNA, 15 nt, Chlamydophila pneumoniae J138
acuuaggaauuuuuc

SEQ ID NO: 2559723 - RNA, 17 nt, Chlamydophila pneumoniae J138
acuuaggaauuuuucua

SEQ ID NO: 2559724 - RNA, 24 nt, Chlamydophila pneumoniae J138
acuuaggguucucaaagaucaucu

SEQ ID NO: 2559725 - RNA, 14 nt, Chlamydophila pneumoniae J138
acuuaguuuugaaa

SEQ ID NO: 2559726 - RNA, 16 nt, Chlamydophila pneumoniae J138
acuuaguuuugaaaag

SEQ ID NO: 2559727 - RNA, 14 nt, Chlamydophila pneumoniae J138
acuuauauuuucua

SEQ ID NO: 2559728 - RNA, 22 nt, Chlamydophila pneumoniae J138
acuuauguucuaugagauagga

SEQ ID NO: 2559729 - RNA, 23 nt, Chlamydophila pneumoniae J138
acuuauuguucuugguguauagu

SEQ ID NO: 2559730 - RNA, 21 nt, Chlamydophila pneumoniae J138
acuucaacaaaggcuccaaac

SEQ ID NO: 2559731 - RNA, 17 nt, Chlamydophila pneumoniae J138
acuucaacuucuccaac

SEQ ID NO: 2559732 - RNA, 18 nt, Chlamydophila pneumoniae J138
acuucaacuucuccaacu

SEQ ID NO: 2559733 - RNA, 18 nt, Chlamydophila pneumoniae J138
acuucaagccaaaaccaa

SEQ ID NO: 2559734 - RNA, 19 nt, Chlamydophila pneumoniae J138
acuucaaugaaagcuguau

SEQ ID NO: 2559735 - RNA, 13 nt, Chlamydophila pneumoniae J138
acuucacaaagaa

SEQ ID NO: 2559736 - RNA, 16 nt, Chlamydophila pneumoniae J138
acuucacaaagaacca

SEQ ID NO: 2559737 - RNA, 16 nt, Chlamydophila pneumoniae J138
acuucaccuugaaguu

SEQ ID NO: 2559738 - RNA, 16 nt, Chlamydophila pneumoniae J138
auaucuauaaauguag

SEQ ID NO: 2559739 - RNA, 21 nt, Chlamydophila pneumoniae J138
auaucuccuuuaaauaaaauc

SEQ ID NO: 2559740 - RNA, 17 nt, Chlamydophila pneumoniae J138
auaucucuggcauaauc

SEQ ID NO: 2559741 - RNA, 22 nt, Chlamydophila pneumoniae J138
auaucucuggcauaauccugaa

SEQ ID NO: 2559742 - RNA, 20 nt, Chlamydophila pneumoniae J138
auaucuucuggguucuccac

SEQ ID NO: 2559743 - RNA, 23 nt, Chlamydophila pneumoniae J138
auaucuucuggguucuccacaug

SEQ ID NO: 2559744 - RNA, 13 nt, Chlamydophila pneumoniae J138
auaugaagagacg

SEQ ID NO: 2559745 - RNA, 15 nt, Chlamydophila pneumoniae J138
auaugauuuccacuu

SEQ ID NO: 2559746 - RNA, 23 nt, Chlamydophila pneumoniae J138
auaugcucgugcgacugcucuuu

SEQ ID NO: 2559747 - RNA, 18 nt, Chlamydophila pneumoniae J138
auaugcucugccauuucu

SEQ ID NO: 2559748 - RNA, 16 nt, Chlamydophila pneumoniae J138
auaugcuuuucaaaua

SEQ ID NO: 2559749 - RNA, 19 nt, Chlamydophila pneumoniae J138
auauguccgugagcaacaa

SEQ ID NO: 2559750 - RNA, 15 nt, Chlamydophila pneumoniae J138
auaugucgcuuucau

SEQ ID NO: 2559751 - RNA, 13 nt, Chlamydophila pneumoniae J138
auauucuaaaggg

SEQ ID NO: 2559752 - RNA, 17 nt, Chlamydophila pneumoniae J138
auauucucgaaaaauuu

SEQ ID NO: 2559753 - RNA, 17 nt, Chlamydophila pneumoniae J138
auauucuuucaaaccac

SEQ ID NO: 2559754 - RNA, 16 nt, Chlamydophila pneumoniae J138
auauugacaacacgau

SEQ ID NO: 2559755 - RNA, 13 nt, Chlamydophila pneumoniae J138
auauugaucuuuc

SEQ ID NO: 2559756 - RNA, 19 nt, Chlamydophila pneumoniae J138
auauugcaaagcaucuugu

SEQ ID NO: 2559757 - RNA, 20 nt, Chlamydophila pneumoniae J138
auauugcaaagcaucuugua

SEQ ID NO: 2559758 - RNA, 22 nt, Chlamydophila pneumoniae J138
auauugccuucuucuuguucuu

SEQ ID NO: 2559759 - RNA, 14 nt, Chlamydophila pneumoniae J138
auauugcucuugua

SEQ ID NO: 2559760 - RNA, 17 nt, Chlamydophila pneumoniae J138
auauugucaagaggcug

SEQ ID NO: 2559761 - RNA, 15 nt, Chlamydophila pneumoniae J138
auauuuagagagaaa

SEQ ID NO: 2559762 - RNA, 16 nt, Chlamydophila pneumoniae J138
auauuuuuguccugca

SEQ ID NO: 2559763 - RNA, 21 nt, Chlamydophila pneumoniae J138
auauuuuuugagaaauauaaa

SEQ ID NO: 2559764 - RNA, 20 nt, Chlamydophila pneumoniae J138
aucaaacauuaccguucccu

SEQ ID NO: 2559765 - RNA, 17 nt, Chlamydophila pneumoniae J138
aucaaagaacaauaaaa

SEQ ID NO: 2559766 - RNA, 12 nt, Chlamydophila pneumoniae J138
aucaaagaauua

SEQ ID NO: 2559767 - RNA, 16 nt, Chlamydophila pneumoniae J138
aucaaagauuccuaag

SEQ ID NO: 2559768 - RNA, 17 nt, Chlamydophila pneumoniae J138
aucaaagcaaaagucau

SEQ ID NO: 2559769 - RNA, 21 nt, Chlamydophila pneumoniae J138
aucaaaggcugcuugagacuu

SEQ ID NO: 2559770 - RNA, 18 nt, Chlamydophila pneumoniae J138
aucaaauaaggcugcuau

SEQ ID NO: 2559771 - RNA, 16 nt, Chlamydophila pneumoniae J138
aucaaauagauuuuua

SEQ ID NO: 2559772 - RNA, 20 nt, Chlamydophila pneumoniae J138
aucaaauucaaccaaacguc

SEQ ID NO: 2559773 - RNA, 22 nt, Chlamydophila pneumoniae J138
aucaacauucuucugucuguau

SEQ ID NO: 2559774 - RNA, 13 nt, Chlamydophila pneumoniae J138
aucaaccaaaaug

SEQ ID NO: 2559775 - RNA, 17 nt, Chlamydophila pneumoniae J138
aucaagaagagaaaaga

SEQ ID NO: 2559776 - RNA, 20 nt, Chlamydophila pneumoniae J138
aucaagaagagaaaagauag

SEQ ID NO: 2559777 - RNA, 16 nt, Chlamydophila pneumoniae J138
aucaagagcucguaau

SEQ ID NO: 2559778 - RNA, 21 nt, Chlamydophila pneumoniae J138
aucaagagcucguaauccuuc

SEQ ID NO: 2559779 - RNA, 16 nt, Chlamydophila pneumoniae J138
aucaagaggagugaaa

SEQ ID NO: 2559780 - RNA, 21 nt, Chlamydophila pneumoniae J138
aucaagaguuucgaauucaau

SEQ ID NO: 2559781 - RNA, 13 nt, Chlamydophila pneumoniae J138
aucaagccuaaau

SEQ ID NO: 2559782 - RNA, 15 nt, Chlamydophila pneumoniae J138
aucaaggaguacucu

SEQ ID NO: 2559783 - RNA, 22 nt, Chlamydophila pneumoniae J138
aucaauaaucggccgaguuucu

SEQ ID NO: 2559784 - RNA, 14 nt, Chlamydophila pneumoniae J138
aucaaucacucuau

SEQ ID NO: 2559785 - RNA, 17 nt, Chlamydophila pneumoniae J138
aucaaugagaucugcaa

SEQ ID NO: 2559786 - RNA, 14 nt, Chlamydophila pneumoniae J138
aucaaugguuaaaa

SEQ ID NO: 2559787 - RNA, 14 nt, Chlamydophila pneumoniae J138
aucaauuuuaccac

SEQ ID NO: 2559788 - RNA, 19 nt, Chlamydophila pneumoniae J138
aucacaaauugucugagga

SEQ ID NO: 2559789 - RNA, 15 nt, Chlamydophila pneumoniae J138
aucacaauuuuaaaa

SEQ ID NO: 2559790 - RNA, 21 nt, Chlamydophila pneumoniae J138
aucacaauuuuaaaaucuccu

SEQ ID NO: 2559791 - RNA, 13 nt, Chlamydophila pneumoniae J138
aucacacuuucau

SEQ ID NO: 2559792 - RNA, 16 nt, Chlamydophila pneumoniae J138
aucacacuuucaucca

SEQ ID NO: 2559793 - RNA, 23 nt, Chlamydophila pneumoniae J138
aucacagccaucgguucggucuc

SEQ ID NO: 2559794 - RNA, 18 nt, Chlamydophila pneumoniae J138
aucacaggcuucaucaca

SEQ ID NO: 2559795 - RNA, 21 nt, Chlamydophila pneumoniae J138
aucacaguuaagacgcagaaa

SEQ ID NO: 2559796 - RNA, 14 nt, Chlamydophila pneumoniae J138
aucacauaaaucaa

SEQ ID NO: 2559797 - RNA, 17 nt, Chlamydophila pneumoniae J138
aucacauaaaucaacau

SEQ ID NO: 2559798 - RNA, 15 nt, Chlamydophila pneumoniae J138
aucacauagaaaaca

SEQ ID NO: 2559799 - RNA, 17 nt, Chlamydophila pneumoniae J138
aucacauagaaaacaua

SEQ ID NO: 2559800 - RNA, 12 nt, Chlamydophila pneumoniae J138
aucacaucaguu

SEQ ID NO: 2559801 - RNA, 19 nt, Chlamydophila pneumoniae J138
aucacauuccaagaaaaau

SEQ ID NO: 2559802 - RNA, 19 nt, Chlamydophila pneumoniae J138
aucaccguacuucccucau

SEQ ID NO: 2559803 - RNA, 14 nt, Chlamydophila pneumoniae J138
aucacgaaaaggag

SEQ ID NO: 2559804 - RNA, 16 nt, Chlamydophila pneumoniae J138
aucacgacgucaucac

SEQ ID NO: 2559805 - RNA, 16 nt, Chlamydophila pneumoniae J138
aucacuuauauuuucu

SEQ ID NO: 2559806 - RNA, 17 nt, Chlamydophila pneumoniae J138
aucacuuauauuuucua

SEQ ID NO: 2559807 - RNA, 18 nt, Chlamydophila pneumoniae J138
aucacuuauauuuucuau

SEQ ID NO: 2559808 - RNA, 20 nt, Chlamydophila pneumoniae J138
aucagaaaaaaugcguuuug

SEQ ID NO: 2559809 - RNA, 20 nt, Chlamydophila pneumoniae J138
aucagaaaugaagccaaaag

SEQ ID NO: 2559810 - RNA, 19 nt, Chlamydophila pneumoniae J138
aucagaacaacgcugcuuc

SEQ ID NO: 2559811 - RNA, 19 nt, Chlamydophila pneumoniae J138
aucagaagguaaauuuuua

SEQ ID NO: 2559812 - RNA, 19 nt, Chlamydophila pneumoniae J138
aucagaauccugaguaaaa

SEQ ID NO: 2559813 - RNA, 15 nt, Chlamydophila pneumoniae J138
aucagaaugcaucuu

SEQ ID NO: 2559814 - RNA, 17 nt, Chlamydophila pneumoniae J138
aucagacugaagagcaa

SEQ ID NO: 2559815 - RNA, 16 nt, Chlamydophila pneumoniae J138
aucagagacaaguuca

SEQ ID NO: 2559816 - RNA, 12 nt, Chlamydophila pneumoniae J138
aucagaggagcc

SEQ ID NO: 2559817 - RNA, 16 nt, Chlamydophila pneumoniae J138
aucagaggagccucca

SEQ ID NO: 2559818 - RNA, 13 nt, Chlamydophila pneumoniae J138
auucccuccgcag

SEQ ID NO: 2559819 - RNA, 16 nt, Chlamydophila pneumoniae J138
auucccugacacagag

SEQ ID NO: 2559820 - RNA, 20 nt, Chlamydophila pneumoniae J138
auucccugacacagagcuuc

SEQ ID NO: 2559821 - RNA, 20 nt, Chlamydophila pneumoniae J138
auucccuuuuuccauaccca

SEQ ID NO: 2559822 - RNA, 23 nt, Chlamydophila pneumoniae J138
auuccguacgcuauaaauaauua

SEQ ID NO: 2559823 - RNA, 16 nt, Chlamydophila pneumoniae J138
auuccuaaaacaagaa

SEQ ID NO: 2559824 - RNA, 14 nt, Chlamydophila pneumoniae J138
auuccuaaaccuaa

SEQ ID NO: 2559825 - RNA, 14 nt, Chlamydophila pneumoniae J138
auuccucuugaucu

SEQ ID NO: 2559826 - RNA, 16 nt, Chlamydophila pneumoniae J138
auuccuucucagaaag

SEQ ID NO: 2559827 - RNA, 20 nt, Chlamydophila pneumoniae J138
auuccuucucagaaagauau

SEQ ID NO: 2559828 - RNA, 16 nt, Chlamydophila pneumoniae J138
auucgagauauggaag

SEQ ID NO: 2559829 - RNA, 20 nt, Chlamydophila pneumoniae J138
auucgccaaacgaauuucuu

SEQ ID NO: 2559830 - RNA, 14 nt, Chlamydophila pneumoniae J138
auucgcuacauaaa

SEQ ID NO: 2559831 - RNA, 15 nt, Chlamydophila pneumoniae J138
auucggaccaaugau

SEQ ID NO: 2559832 - RNA, 22 nt, Chlamydophila pneumoniae J138
auucggcagaaggcuuguuucu

SEQ ID NO: 2559833 - RNA, 13 nt, Chlamydophila pneumoniae J138
auucguuauccuc

SEQ ID NO: 2559834 - RNA, 14 nt, Chlamydophila pneumoniae J138
auucguuauccucg

SEQ ID NO: 2559835 - RNA, 11 nt, Chlamydophila pneumoniae J138
auucuaaaaag

SEQ ID NO: 2559836 - RNA, 16 nt, Chlamydophila pneumoniae J138
auucuaaaagagcaag

SEQ ID NO: 2559837 - RNA, 15 nt, Chlamydophila pneumoniae J138
auucuaagagauccu

SEQ ID NO: 2559838 - RNA, 19 nt, Chlamydophila pneumoniae J138
auucuaggccuaaagaauu

SEQ ID NO: 2559839 - RNA, 20 nt, Chlamydophila pneumoniae J138
auucuaggggagguaaaaua

SEQ ID NO: 2559840 - RNA, 22 nt, Chlamydophila pneumoniae J138
auucuaggggagguaaaauaaa

SEQ ID NO: 2559841 - RNA, 17 nt, Chlamydophila pneumoniae J138
auucuauaacuacaaaa

SEQ ID NO: 2559842 - RNA, 23 nt, Chlamydophila pneumoniae J138
auucuauuuauuuuauuaguuuu

SEQ ID NO: 2559843 - RNA, 14 nt, Chlamydophila pneumoniae J138
auucucacucuaug

SEQ ID NO: 2559844 - RNA, 15 nt, Chlamydophila pneumoniae J138
auucucagaaagccu

SEQ ID NO: 2559845 - RNA, 18 nt, Chlamydophila pneumoniae J138
auucucaugucuaaguca

SEQ ID NO: 2559846 - RNA, 15 nt, Chlamydophila pneumoniae J138
auucuccgccagagu

SEQ ID NO: 2559847 - RNA, 20 nt, Chlamydophila pneumoniae J138
auucuccgccagaguuuaaa

SEQ ID NO: 2559848 - RNA, 22 nt, Chlamydophila pneumoniae J138
auucuccgccguggaauagcuu

SEQ ID NO: 2559849 - RNA, 13 nt, Chlamydophila pneumoniae J138
auucucgaaaaau

SEQ ID NO: 2559850 - RNA, 14 nt, Chlamydophila pneumoniae J138
auucucgaaaaauu

SEQ ID NO: 2559851 - RNA, 17 nt, Chlamydophila pneumoniae J138
auucucgagcagcugca

SEQ ID NO: 2559852 - RNA, 13 nt, Chlamydophila pneumoniae J138
auucucugacacu

SEQ ID NO: 2559853 - RNA, 23 nt, Chlamydophila pneumoniae J138
auucucugacacuccucagaauc

SEQ ID NO: 2559854 - RNA, 12 nt, Chlamydophila pneumoniae J138
auucucuucacu

SEQ ID NO: 2559855 - RNA, 15 nt, Chlamydophila pneumoniae J138
auucugaagagagaa

SEQ ID NO: 2559856 - RNA, 16 nt, Chlamydophila pneumoniae J138
auucugaagagagaau

SEQ ID NO: 2559857 - RNA, 23 nt, Chlamydophila pneumoniae J138
auucugaagauauauuuuuaaag

SEQ ID NO: 2559858 - RNA, 12 nt, Chlamydophila pneumoniae J138
auucugaagcug

SEQ ID NO: 2559859 - RNA, 15 nt, Chlamydophila pneumoniae J138
auucugagaaagaag

SEQ ID NO: 2559860 - RNA, 18 nt, Chlamydophila pneumoniae J138
auucugagaaagaagucc

SEQ ID NO: 2559861 - RNA, 21 nt, Chlamydophila pneumoniae J138
auucugagaaagaaguccuag

SEQ ID NO: 2559862 - RNA, 20 nt, Chlamydophila pneumoniae J138
auucugauaaucagaggagc

SEQ ID NO: 2559863 - RNA, 19 nt, Chlamydophila pneumoniae J138
auucugaugaccucaucuc

SEQ ID NO: 2559864 - RNA, 21 nt, Chlamydophila pneumoniae J138
auucugauucuccgucccccg

SEQ ID NO: 2559865 - RNA, 21 nt, Chlamydophila pneumoniae J138
auucugcccaaagcuaaaaug

SEQ ID NO: 2559866 - RNA, 15 nt, Chlamydophila pneumoniae J138
auucugcuagagcuu

SEQ ID NO: 2559867 - RNA, 21 nt, Chlamydophila pneumoniae J138
auucuggagucgagcagaaau

SEQ ID NO: 2559868 - RNA, 20 nt, Chlamydophila pneumoniae J138
auucuguauaaacaauaaga

SEQ ID NO: 2559869 - RNA, 11 nt, Chlamydophila pneumoniae J138
auucugucuau

SEQ ID NO: 2559870 - RNA, 13 nt, Chlamydophila pneumoniae J138
auucuuaaaaagc

SEQ ID NO: 2559871 - RNA, 15 nt, Chlamydophila pneumoniae J138
auucuuaaaaagcua

SEQ ID NO: 2559872 - RNA, 20 nt, Chlamydophila pneumoniae J138
auucuuaaaaagcuaaacaa

SEQ ID NO: 2559873 - RNA, 15 nt, Chlamydophila pneumoniae J138
auucuuaacaauaua

SEQ ID NO: 2559874 - RNA, 19 nt, Chlamydophila pneumoniae J138
auucuuaauauaaaagaag

SEQ ID NO: 2559875 - RNA, 12 nt, Chlamydophila pneumoniae J138
auucuucagaau

SEQ ID NO: 2559876 - RNA, 18 nt, Chlamydophila pneumoniae J138
auucuucagaaucuuugu

SEQ ID NO: 2559877 - RNA, 22 nt, Chlamydophila pneumoniae J138
auucuucauuguagaggucacu

SEQ ID NO: 2559878 - RNA, 14 nt, Chlamydophila pneumoniae J138
auucuucgagagca

SEQ ID NO: 2559879 - RNA, 15 nt, Chlamydophila pneumoniae J138
auucuucgagagcau

SEQ ID NO: 2559880 - RNA, 12 nt, Chlamydophila pneumoniae J138
auucuucugucu

SEQ ID NO: 2559881 - RNA, 15 nt, Chlamydophila pneumoniae J138
auucuuuaaucuauc

SEQ ID NO: 2559882 - RNA, 21 nt, Chlamydophila pneumoniae J138
auucuuuauccccagaucucu

SEQ ID NO: 2559883 - RNA, 13 nt, Chlamydophila pneumoniae J138
auucuuugccaag

SEQ ID NO: 2559884 - RNA, 19 nt, Chlamydophila pneumoniae J138
auugaaaccguaacugagg

SEQ ID NO: 2559885 - RNA, 15 nt, Chlamydophila pneumoniae J138
auugaaacuuuuuuu

SEQ ID NO: 2559886 - RNA, 20 nt, Chlamydophila pneumoniae J138
auugaaagagcuuugauuca

SEQ ID NO: 2559887 - RNA, 14 nt, Chlamydophila pneumoniae J138
auugaagauauuau

SEQ ID NO: 2559888 - RNA, 20 nt, Chlamydophila pneumoniae J138
auugaauaucgaguucuuuu

SEQ ID NO: 2559889 - RNA, 13 nt, Chlamydophila pneumoniae J138
auugaaucagauu

SEQ ID NO: 2559890 - RNA, 18 nt, Chlamydophila pneumoniae J138
auugaaucccaucaaagg

SEQ ID NO: 2559891 - RNA, 20 nt, Chlamydophila pneumoniae J138
auugaccugcuuuuuuucua

SEQ ID NO: 2559892 - RNA, 21 nt, Chlamydophila pneumoniae J138
auugaccugcuuuuuuucuag

SEQ ID NO: 2559893 - RNA, 19 nt, Chlamydophila pneumoniae J138
auugacguagacgauuuuc

SEQ ID NO: 2559894 - RNA, 20 nt, Chlamydophila pneumoniae J138
auugacuagcucucuugcua

SEQ ID NO: 2559895 - RNA, 23 nt, Chlamydophila pneumoniae J138
auugaggacaacagcaacacucg

SEQ ID NO: 2559896 - RNA, 16 nt, Chlamydophila pneumoniae J138
auugaggauaaguucu

SEQ ID NO: 2559897 - RNA, 12 nt, Chlamydophila pneumoniae J138
auugaguguugu

SEQ ID NO: 2559898 - RNA, 13 nt, Chlamydophila pneumoniae J138
auugauaaugauu

SEQ ID NO: 2559899 - RNA, 13 nt, Chlamydophila pneumoniae J138
auugaucagaauc

SEQ ID NO: 2559900 - RNA, 16 nt, Chlamydophila pneumoniae J138
auugaugcuuaagagu

SEQ ID NO: 2559901 - RNA, 17 nt, Chlamydophila pneumoniae J138
auugaugcuuaagaguu

SEQ ID NO: 2559902 - RNA, 13 nt, Chlamydophila pneumoniae J138
auugauuaccuca

SEQ ID NO: 2559903 - RNA, 17 nt, Chlamydophila pneumoniae J138
auugcaaaaaugaaaga

SEQ ID NO: 2559904 - RNA, 14 nt, Chlamydophila pneumoniae J138
auugcaaaauuuaa

SEQ ID NO: 2559905 - RNA, 14 nt, Chlamydophila pneumoniae J138
auugcaaaguacua

SEQ ID NO: 2559906 - RNA, 12 nt, Chlamydophila pneumoniae J138
auugcaauacau

SEQ ID NO: 2559907 - RNA, 20 nt, Chlamydophila pneumoniae J138
auugcaauacaucuuaagag

SEQ ID NO: 2559908 - RNA, 22 nt, Chlamydophila pneumoniae J138
auugcaaucugguuaagcacca

SEQ ID NO: 2559909 - RNA, 17 nt, Chlamydophila pneumoniae J138
auugcaauuuucuaaag

SEQ ID NO: 2559910 - RNA, 19 nt, Chlamydophila pneumoniae J138
auugcaauuuucuaaagau

SEQ ID NO: 2559911 - RNA, 18 nt, Chlamydophila pneumoniae J138
auugcacucaucuugagu

SEQ ID NO: 2559912 - RNA, 19 nt, Chlamydophila pneumoniae J138
auugcauuaagauaaacau

SEQ ID NO: 2559913 - RNA, 14 nt, Chlamydophila pneumoniae J138
auugcauucuuaau

SEQ ID NO: 2559914 - RNA, 22 nt, Chlamydophila pneumoniae J138
auugcauuuaaacuaagaauac

SEQ ID NO: 2559915 - RNA, 20 nt, Chlamydophila pneumoniae J138
auugccaugcccacagacca

SEQ ID NO: 2559916 - RNA, 19 nt, Chlamydophila pneumoniae J138
auugccgugaguugcaauu

SEQ ID NO: 2559917 - RNA, 17 nt, Chlamydophila pneumoniae J138
auugcggaaauugaaua

SEQ ID NO: 2559918 - RNA, 15 nt, Chlamydophila pneumoniae J138
auugcuaagcauuuu

SEQ ID NO: 2559919 - RNA, 18 nt, Chlamydophila pneumoniae J138
aaaaaagaccaaauaauu

SEQ ID NO: 2559920 - RNA, 18 nt, Chlamydophila pneumoniae J138
aaaaaagcuagucuuucu

SEQ ID NO: 2559921 - RNA, 12 nt, Chlamydophila pneumoniae J138
aaaaaauaaaau

SEQ ID NO: 2559922 - RNA, 20 nt, Chlamydophila pneumoniae J138
aaaaaauacaggaaucuccu

SEQ ID NO: 2559923 - RNA, 17 nt, Chlamydophila pneumoniae J138
aaaaacgguaaauaucu

SEQ ID NO: 2559924 - RNA, 17 nt, Chlamydophila pneumoniae J138
aaaaacucuucaucgau

SEQ ID NO: 2559925 - RNA, 21 nt, Chlamydophila pneumoniae J138
aaaaacugcaaaaagaucguu

SEQ ID NO: 2559926 - RNA, 18 nt, Chlamydophila pneumoniae J138
aaaaacuguguuuucuag

SEQ ID NO: 2559927 - RNA, 21 nt, Chlamydophila pneumoniae J138
aaaaacuucccaucuuguucu

SEQ ID NO: 2559928 - RNA, 12 nt, Chlamydophila pneumoniae J138
aaaaagaaaaga

SEQ ID NO: 2559929 - RNA, 17 nt, Chlamydophila pneumoniae J138
aaaaagaacauaagaua

SEQ ID NO: 2559930 - RNA, 14 nt, Chlamydophila pneumoniae J138
aaaaagagcccaaa

SEQ ID NO: 2559931 - RNA, 17 nt, Chlamydophila pneumoniae J138
aaaaagccaagaaaaca

SEQ ID NO: 2559932 - RNA, 18 nt, Chlamydophila pneumoniae J138
aaaaagcccauuccugca

SEQ ID NO: 2559933 - RNA, 12 nt, Chlamydophila pneumoniae J138
aaaaagcuaaac

SEQ ID NO: 2559934 - RNA, 15 nt, Chlamydophila pneumoniae J138
aaaaagcuaaacaac

SEQ ID NO: 2559935 - RNA, 19 nt, Chlamydophila pneumoniae J138
aaaaagcuucuuucuuacu

SEQ ID NO: 2559936 - RNA, 18 nt, Chlamydophila pneumoniae J138
aaaaagcuuuuuucucuu

SEQ ID NO: 2559937 - RNA, 20 nt, Chlamydophila pneumoniae J138
aaaaagcuuuuuucucuugc

SEQ ID NO: 2559938 - RNA, 18 nt, Chlamydophila pneumoniae J138
aaaaaggacucuuucuau

SEQ ID NO: 2559939 - RNA, 18 nt, Chlamydophila pneumoniae J138
aaaaagggaucuccuuca

SEQ ID NO: 2559940 - RNA, 13 nt, Chlamydophila pneumoniae J138
aaaaaguaacuau

SEQ ID NO: 2559941 - RNA, 15 nt, Chlamydophila pneumoniae J138
aaaaaguaacuaucu

SEQ ID NO: 2559942 - RNA, 19 nt, Chlamydophila pneumoniae J138
aaaaaguugaggaaaggag

SEQ ID NO: 2559943 - RNA, 17 nt, Chlamydophila pneumoniae J138
aaaaauaaacauauucu

SEQ ID NO: 2559944 - RNA, 15 nt, Chlamydophila pneumoniae J138
aaaaauagaaauaag

SEQ ID NO: 2559945 - RNA, 14 nt, Chlamydophila pneumoniae J138
aaaaauagauaagu

SEQ ID NO: 2559946 - RNA, 12 nt, Chlamydophila pneumoniae J138
aaaaauauaucu

SEQ ID NO: 2559947 - RNA, 13 nt, Chlamydophila pneumoniae J138
aaaaauaucuccg

SEQ ID NO: 2559948 - RNA, 21 nt, Chlamydophila pneumoniae J138
aaaaaucccagauuacaagag

SEQ ID NO: 2559949 - RNA, 17 nt, Chlamydophila pneumoniae J138
aaaaaucccuguucuag

SEQ ID NO: 2559950 - RNA, 16 nt, Chlamydophila pneumoniae J138
aaaaauccgauaagau

SEQ ID NO: 2559951 - RNA, 17 nt, Chlamydophila pneumoniae J138
aaaaauccgauaagaua

SEQ ID NO: 2559952 - RNA, 15 nt, Chlamydophila pneumoniae J138
aaaaaugcuccugca

SEQ ID NO: 2559953 - RNA, 22 nt, Chlamydophila pneumoniae J138
aaaaauggcacuugagcacauu

SEQ ID NO: 2559954 - RNA, 13 nt, Chlamydophila pneumoniae J138
aaaaauucccaua

SEQ ID NO: 2559955 - RNA, 22 nt, Chlamydophila pneumoniae J138
aaaaauucuagaccugccaaga

SEQ ID NO: 2559956 - RNA, 16 nt, Chlamydophila pneumoniae J138
aaaaauucuuuaggga

SEQ ID NO: 2559957 - RNA, 14 nt, Chlamydophila pneumoniae J138
aaaaauuuaaaaga

SEQ ID NO: 2559958 - RNA, 22 nt, Chlamydophila pneumoniae J138
aaaaauuuuauaggaauaacac

SEQ ID NO: 2559959 - RNA, 17 nt, Chlamydophila pneumoniae J138
aaaacaacauucguuag

SEQ ID NO: 2559960 - RNA, 21 nt, Chlamydophila pneumoniae J138
aaaacaagcuuuuaauguguu

SEQ ID NO: 2559961 - RNA, 15 nt, Chlamydophila pneumoniae J138
aaaacaaggcaaaaa

SEQ ID NO: 2559962 - RNA, 19 nt, Chlamydophila pneumoniae J138
aaaacaaucuaaagguuuu

SEQ ID NO: 2559963 - RNA, 18 nt, Chlamydophila pneumoniae J138
aaaacacugcgcaaagaa

SEQ ID NO: 2559964 - RNA, 20 nt, Chlamydophila pneumoniae J138
aaaacagauaagacaauaaa

SEQ ID NO: 2559965 - RNA, 13 nt, Chlamydophila pneumoniae J138
aaaacaucuguau

SEQ ID NO: 2559966 - RNA, 20 nt, Chlamydophila pneumoniae J138
aaaaccaauuucuccgcuuu

SEQ ID NO: 2559967 - RNA, 13 nt, Chlamydophila pneumoniae J138
aaaaccacagaau

SEQ ID NO: 2559968 - RNA, 15 nt, Chlamydophila pneumoniae J138
aaaacccauguuucu

SEQ ID NO: 2559969 - RNA, 22 nt, Chlamydophila pneumoniae J138
aaaacccauguuucuuccugaa

SEQ ID NO: 2559970 - RNA, 17 nt, Chlamydophila pneumoniae J138
aaaacccucaaagaaua

SEQ ID NO: 2559971 - RNA, 13 nt, Chlamydophila pneumoniae J138
aaaacgcuauugu

SEQ ID NO: 2559972 - RNA, 20 nt, Chlamydophila pneumoniae J138
aaaacgguaaauaucuuaac

SEQ ID NO: 2559973 - RNA, 20 nt, Chlamydophila pneumoniae J138
aaaacuauaaaagccagggc

SEQ ID NO: 2559974 - RNA, 21 nt, Chlamydophila pneumoniae J138
aaaacucaaggaguuuuaacu

SEQ ID NO: 2559975 - RNA, 19 nt, Chlamydophila pneumoniae J138
aaaacuguguucaauagca

SEQ ID NO: 2559976 - RNA, 21 nt, Chlamydophila pneumoniae J138
aaaacuguguucaauagcaaa

SEQ ID NO: 2559977 - RNA, 14 nt, Chlamydophila pneumoniae J138
aaaacuucaaaagu

SEQ ID NO: 2559978 - RNA, 13 nt, Chlamydophila pneumoniae J138
aaaacuucccauc

SEQ ID NO: 2559979 - RNA, 12 nt, Chlamydophila pneumoniae J138
aaaagaaaagac

SEQ ID NO: 2559980 - RNA, 16 nt, Chlamydophila pneumoniae J138
aaaagaaaucaaacau

SEQ ID NO: 2559981 - RNA, 23 nt, Chlamydophila pneumoniae J138
aaaagaaccuaggaaauccuccu

SEQ ID NO: 2559982 - RNA, 14 nt, Chlamydophila pneumoniae J138
aaaagaaucucuga

SEQ ID NO: 2559983 - RNA, 22 nt, Chlamydophila pneumoniae J138
aaaagaauuccuaaaacgagca

SEQ ID NO: 2559984 - RNA, 14 nt, Chlamydophila pneumoniae J138
aaaagacaagagaa

SEQ ID NO: 2559985 - RNA, 13 nt, Chlamydophila pneumoniae J138
aaaagaccaaaaa

SEQ ID NO: 2559986 - RNA, 16 nt, Chlamydophila pneumoniae J138
aaaagacuuaccguuu

SEQ ID NO: 2559987 - RNA, 15 nt, Chlamydophila pneumoniae J138
aaaagagcaagaugg

SEQ ID NO: 2559988 - RNA, 14 nt, Chlamydophila pneumoniae J138
aaaagauaaagcua

SEQ ID NO: 2559989 - RNA, 21 nt, Chlamydophila pneumoniae J138
aaaagauaguuauuaauaaau

SEQ ID NO: 2559990 - RNA, 22 nt, Chlamydophila pneumoniae J138
aaaagaucggaguuaucaaaag

SEQ ID NO: 2559991 - RNA, 13 nt, Chlamydophila pneumoniae J138
aaaagauucuaaa

SEQ ID NO: 2559992 - RNA, 16 nt, Chlamydophila pneumoniae J138
aaaagauucuaaauca

SEQ ID NO: 2559993 - RNA, 22 nt, Chlamydophila pneumoniae J138
aaaagauuugcgaaucuaagau

SEQ ID NO: 2559994 - RNA, 16 nt, Chlamydophila pneumoniae J138
aaaagauuuucccgug

SEQ ID NO: 2559995 - RNA, 18 nt, Chlamydophila pneumoniae J138
aaaagcaaccuuaaagau

SEQ ID NO: 2559996 - RNA, 21 nt, Chlamydophila pneumoniae J138
aaaagcacuuaaaaaacuucc

SEQ ID NO: 2559997 - RNA, 15 nt, Chlamydophila pneumoniae J138
aaaagcagacgaaua

SEQ ID NO: 2559998 - RNA, 12 nt, Chlamydophila pneumoniae J138
aaaagccuuucu

SEQ ID NO: 2559999 - RNA, 13 nt, Chlamydophila pneumoniae J138
aaaagccuuucuu

SEQ ID NO: 2560000 - RNA, 19 nt, Chlamydophila pneumoniae J138
aaaagcgcaaaucuuacau

SEQ ID NO: 2560001 - RNA, 12 nt, Chlamydophila pneumoniae J138
aaaagcuaaaca

SEQ ID NO: 2560002 - RNA, 22 nt, Chlamydophila pneumoniae J138
aaaagcuagucuuucuaagaag

SEQ ID NO: 2560003 - RNA, 16 nt, Chlamydophila pneumoniae J138
aaaagcugaauccagg

SEQ ID NO: 2560004 - RNA, 20 nt, Chlamydophila pneumoniae J138
aaaagcuuaucccauaaaug

SEQ ID NO: 2560005 - RNA, 14 nt, Chlamydophila pneumoniae J138
aaaagcuucuuucu

SEQ ID NO: 2560006 - RNA, 16 nt, Chlamydophila pneumoniae J138
aaaagcuucuuucuua

SEQ ID NO: 2560007 - RNA, 21 nt, Chlamydophila pneumoniae J138
aaaagcuucuuucuuacuaaa

SEQ ID NO: 2560008 - RNA, 22 nt, Chlamydophila pneumoniae J138
aaaagcuucuuucuuacuaaag

SEQ ID NO: 2560009 - RNA, 13 nt, Chlamydophila pneumoniae J138
aaaaggaggagga

SEQ ID NO: 2560010 - RNA, 23 nt, Chlamydophila pneumoniae J138
aaaaggaggaggagcacuaggca

SEQ ID NO: 2560011 - RNA, 21 nt, Chlamydophila pneumoniae J138
aaaaggaugcaucucuuaaaa

SEQ ID NO: 2560012 - RNA, 17 nt, Chlamydophila pneumoniae J138
aaaaggauucuaugagg

SEQ ID NO: 2560013 - RNA, 15 nt, Chlamydophila pneumoniae J138
aaaagguuuugaagc

SEQ ID NO: 2560014 - RNA, 16 nt, Chlamydophila pneumoniae J138
aaaaguaguuuuaaga

SEQ ID NO: 2560015 - RNA, 17 nt, Chlamydophila pneumoniae J138
aaaagucaugaggacug

SEQ ID NO: 2560016 - RNA, 21 nt, Chlamydophila pneumoniae J138
aaaagucucuagggaaaggag

SEQ ID NO: 2560017 - RNA, 18 nt, Chlamydophila pneumoniae J138
aaacccaauucuuaaaaa

SEQ ID NO: 2560018 - RNA, 15 nt, Chlamydophila pneumoniae J138
aaacccgcaacucuu

SEQ ID NO: 2560019 - RNA, 22 nt, Chlamydophila pneumoniae J138
aaacccugggcucacucuaagc

SEQ ID NO: 2560020 - RNA, 23 nt, Chlamydophila pneumoniae J138
aaaccguaacugaggcaaagauu

SEQ ID NO: 2560021 - RNA, 13 nt, Chlamydophila pneumoniae J138
aaaccucuaaaaa

SEQ ID NO: 2560022 - RNA, 17 nt, Chlamydophila pneumoniae J138
aaaccuucaaugauuuc

SEQ ID NO: 2560023 - RNA, 17 nt, Chlamydophila pneumoniae J138
aaaccuucagauccgau

SEQ ID NO: 2560024 - RNA, 15 nt, Chlamydophila pneumoniae J138
aaacgaaagcagugu

SEQ ID NO: 2560025 - RNA, 17 nt, Chlamydophila pneumoniae J138
aaacgaucccuacacug

SEQ ID NO: 2560026 - RNA, 19 nt, Chlamydophila pneumoniae J138
aaacgcaaugauuucucua

SEQ ID NO: 2560027 - RNA, 23 nt, Chlamydophila pneumoniae J138
aaacgcuccguauacugcugcua

SEQ ID NO: 2560028 - RNA, 17 nt, Chlamydophila pneumoniae J138
aaacggcauuugccccu

SEQ ID NO: 2560029 - RNA, 22 nt, Chlamydophila pneumoniae J138
aaacuaaaucaacuacaucucc

SEQ ID NO: 2560030 - RNA, 15 nt, Chlamydophila pneumoniae J138
aaacuaagaauaccu

SEQ ID NO: 2560031 - RNA, 23 nt, Chlamydophila pneumoniae J138
aaacuagagaucuuuuuauuaaa

SEQ ID NO: 2560032 - RNA, 14 nt, Chlamydophila pneumoniae J138
aaacuauaaaagcc

SEQ ID NO: 2560033 - RNA, 12 nt, Chlamydophila pneumoniae J138
aaacuccaaaau

SEQ ID NO: 2560034 - RNA, 18 nt, Chlamydophila pneumoniae J138
aaacuccccaguuuucca

SEQ ID NO: 2560035 - RNA, 16 nt, Chlamydophila pneumoniae J138
aaacuccuuuuaaaau

SEQ ID NO: 2560036 - RNA, 18 nt, Chlamydophila pneumoniae J138
aaacucucuuccuucucc

SEQ ID NO: 2560037 - RNA, 19 nt, Chlamydophila pneumoniae J138
aaacucucuuccuucuccu

SEQ ID NO: 2560038 - RNA, 20 nt, Chlamydophila pneumoniae J138
aaacucugacgucuccaaca

SEQ ID NO: 2560039 - RNA, 15 nt, Chlamydophila pneumoniae J138
aaacucuuugaggau

SEQ ID NO: 2560040 - RNA, 13 nt, Chlamydophila pneumoniae J138
aaacugaugccaa

SEQ ID NO: 2560041 - RNA, 19 nt, Chlamydophila pneumoniae J138
aaacugaugccaagaaaua

SEQ ID NO: 2560042 - RNA, 22 nt, Chlamydophila pneumoniae J138
aaacugauuaguuuguuuuaau

SEQ ID NO: 2560043 - RNA, 15 nt, Chlamydophila pneumoniae J138
aaacugcgcuagcuc

SEQ ID NO: 2560044 - RNA, 14 nt, Chlamydophila pneumoniae J138
aaacugcuccugaa

SEQ ID NO: 2560045 - RNA, 20 nt, Chlamydophila pneumoniae J138
aaacuggcggauugcuuugc

SEQ ID NO: 2560046 - RNA, 14 nt, Chlamydophila pneumoniae J138
aaacugucauccuu

SEQ ID NO: 2560047 - RNA, 15 nt, Chlamydophila pneumoniae J138
aaacuguguuuucua

SEQ ID NO: 2560048 - RNA, 13 nt, Chlamydophila pneumoniae J138
aaacuucaaaagu

SEQ ID NO: 2560049 - RNA, 16 nt, Chlamydophila pneumoniae J138
aaacuucaguuguugc

SEQ ID NO: 2560050 - RNA, 20 nt, Chlamydophila pneumoniae J138
aaacuucccaucuuguucua

SEQ ID NO: 2560051 - RNA, 22 nt, Chlamydophila pneumoniae J138
aaacuuccuaacuaucucuguu

SEQ ID NO: 2560052 - RNA, 13 nt, Chlamydophila pneumoniae J138
aaacuucucagau

SEQ ID NO: 2560053 - RNA, 22 nt, Chlamydophila pneumoniae J138
aaacuugcuuuuuugaaagcug

SEQ ID NO: 2560054 - RNA, 15 nt, Chlamydophila pneumoniae J138
aaacuuuaaaagcau

SEQ ID NO: 2560055 - RNA, 12 nt, Chlamydophila pneumoniae J138
aaacuuucuucu

SEQ ID NO: 2560056 - RNA, 13 nt, Chlamydophila pneumoniae J138
aaacuuucuucuc

SEQ ID NO: 2560057 - RNA, 22 nt, Chlamydophila pneumoniae J138
aaacuuucuucucuaggaagau

SEQ ID NO: 2560058 - RNA, 22 nt, Chlamydophila pneumoniae J138
aaacuuuuuuucaaaucaucaa

SEQ ID NO: 2560059 - RNA, 16 nt, Chlamydophila pneumoniae J138
aaacuuuuuuucuucu

SEQ ID NO: 2560060 - RNA, 17 nt, Chlamydophila pneumoniae J138
aaacuuuuuuucuucuc

SEQ ID NO: 2560061 - RNA, 18 nt, Chlamydophila pneumoniae J138
aaacuuuuuuucuucucu

SEQ ID NO: 2560062 - RNA, 19 nt, Chlamydophila pneumoniae J138
aaacuuuuuuucuucucua

SEQ ID NO: 2560063 - RNA, 13 nt, Chlamydophila pneumoniae J138
aaagaaagaagcc

SEQ ID NO: 2560064 - RNA, 13 nt, Chlamydophila pneumoniae J138
aaagaaagaauau

SEQ ID NO: 2560065 - RNA, 15 nt, Chlamydophila pneumoniae J138
aaagaaauauuaacc

SEQ ID NO: 2560066 - RNA, 16 nt, Chlamydophila pneumoniae J138
aaagaaaucaaacauu

SEQ ID NO: 2560067 - RNA, 12 nt, Chlamydophila pneumoniae J138
aaagaaauguaa

SEQ ID NO: 2560068 - RNA, 16 nt, Chlamydophila pneumoniae J138
aaagaaauguaagaag

SEQ ID NO: 2560069 - RNA, 21 nt, Chlamydophila pneumoniae J138
aaagaaauucuggagucgagc

SEQ ID NO: 2560070 - RNA, 12 nt, Chlamydophila pneumoniae J138
aaagaacagcac

SEQ ID NO: 2560071 - RNA, 19 nt, Chlamydophila pneumoniae J138
aaagaacuuaaaauucaaa

SEQ ID NO: 2560072 - RNA, 11 nt, Chlamydophila pneumoniae J138
aaagaagaaac

SEQ ID NO: 2560073 - RNA, 22 nt, Chlamydophila pneumoniae J138
aaagaagauucaagcaaugccu

SEQ ID NO: 2560074 - RNA, 22 nt, Chlamydophila pneumoniae J138
aaagaagguugagacguaacca

SEQ ID NO: 2560075 - RNA, 14 nt, Chlamydophila pneumoniae J138
aaagaaguccuagg

SEQ ID NO: 2560076 - RNA, 22 nt, Chlamydophila pneumoniae J138
aaagaaguuuacaaauaaaaug

SEQ ID NO: 2560077 - RNA, 16 nt, Chlamydophila pneumoniae J138
aaagaauacucauauu

SEQ ID NO: 2560078 - RNA, 17 nt, Chlamydophila pneumoniae J138
aaagaaugacacagaga

SEQ ID NO: 2560079 - RNA, 13 nt, Chlamydophila pneumoniae J138
aaagaaugccauu

SEQ ID NO: 2560080 - RNA, 22 nt, Chlamydophila pneumoniae J138
aaagaaugccauucuuaucugc

SEQ ID NO: 2560081 - RNA, 17 nt, Chlamydophila pneumoniae J138
aaagaauuaagaagaag

SEQ ID NO: 2560082 - RNA, 19 nt, Chlamydophila pneumoniae J138
aaagaauucagagaaagcc

SEQ ID NO: 2560083 - RNA, 21 nt, Chlamydophila pneumoniae J138
aaagaauuguaguucuuugaa

SEQ ID NO: 2560084 - RNA, 16 nt, Chlamydophila pneumoniae J138
aaagacauccuucuuu

SEQ ID NO: 2560085 - RNA, 18 nt, Chlamydophila pneumoniae J138
aaagacauccuucuuuac

SEQ ID NO: 2560086 - RNA, 22 nt, Chlamydophila pneumoniae J138
aaagacaucuccugcagguuug

SEQ ID NO: 2560087 - RNA, 15 nt, Chlamydophila pneumoniae J138
aaagacaucucuuua

SEQ ID NO: 2560088 - RNA, 12 nt, Chlamydophila pneumoniae J138
aaagacgaucuu

SEQ ID NO: 2560089 - RNA, 23 nt, Chlamydophila pneumoniae J138
aaagacuagcuuuuuuuaugauu

SEQ ID NO: 2560090 - RNA, 22 nt, Chlamydophila pneumoniae J138
aaagacucaugaaauaguguuu

SEQ ID NO: 2560091 - RNA, 19 nt, Chlamydophila pneumoniae J138
aaagacucucuuccaaaag

SEQ ID NO: 2560092 - RNA, 13 nt, Chlamydophila pneumoniae J138
aaagacucuugaa

SEQ ID NO: 2560093 - RNA, 19 nt, Chlamydophila pneumoniae J138
aaagacucuugaauauuua

SEQ ID NO: 2560094 - RNA, 18 nt, Chlamydophila pneumoniae J138
aaagacuucgaugucuuu

SEQ ID NO: 2560095 - RNA, 15 nt, Chlamydophila pneumoniae J138
aaagacuugcuuccg

SEQ ID NO: 2560096 - RNA, 22 nt, Chlamydophila pneumoniae J138
aaagagaaucuccucaucagaa

SEQ ID NO: 2560097 - RNA, 23 nt, Chlamydophila pneumoniae J138
aaagagauuucuuguuguaggua

SEQ ID NO: 2560098 - RNA, 17 nt, Chlamydophila pneumoniae J138
aaagagcccaaaaacac

SEQ ID NO: 2560099 - RNA, 23 nt, Chlamydophila pneumoniae J138
aaagagcccaaaaacacucaaau

SEQ ID NO: 2560100 - RNA, 21 nt, Chlamydophila pneumoniae J138
aaagagcgucuaucgacucuu

SEQ ID NO: 2560101 - RNA, 12 nt, Chlamydophila pneumoniae J138
aaagagcuaaag

SEQ ID NO: 2560102 - RNA, 16 nt, Chlamydophila pneumoniae J138
aaagagcucaaaaagu

SEQ ID NO: 2560103 - RNA, 20 nt, Chlamydophila pneumoniae J138
aaagagcucaaaaaguucca

SEQ ID NO: 2560104 - RNA, 23 nt, Chlamydophila pneumoniae J138
aaagagcuuugauucacguauag

SEQ ID NO: 2560105 - RNA, 20 nt, Chlamydophila pneumoniae J138
aaagaggaagaugauauucu

SEQ ID NO: 2560106 - RNA, 14 nt, Chlamydophila pneumoniae J138
aaagaggaaugaag

SEQ ID NO: 2560107 - RNA, 18 nt, Chlamydophila pneumoniae J138
aaagaguccuuuuuguuc

SEQ ID NO: 2560108 - RNA, 16 nt, Chlamydophila pneumoniae J138
aaagagucucacucuu

SEQ ID NO: 2560109 - RNA, 17 nt, Chlamydophila pneumoniae J138
aaagagucucacucuuu

SEQ ID NO: 2560110 - RNA, 20 nt, Chlamydophila pneumoniae J138
aaagagucucacucuuuucu

SEQ ID NO: 2560111 - RNA, 24 nt, Chlamydophila pneumoniae J138
aaagagucucacucuuuucuagaa

SEQ ID NO: 2560112 - RNA, 23 nt, Chlamydophila pneumoniae J138
aaagagucucuugcuuuuguaga

SEQ ID NO: 2560113 - RNA, 14 nt, Chlamydophila pneumoniae J138
aaagagugccaaga

SEQ ID NO: 2560114 - RNA, 18 nt, Chlamydophila pneumoniae J138
aaagaguuuguucacauu

SEQ ID NO: 2560115 - RNA, 14 nt, Chlamydophila pneumoniae J138
aaagauaaagaagu

SEQ ID NO: 2560116 - RNA, 16 nt, Chlamydophila pneumoniae J138
aaagauaaagaaguuu

SEQ ID NO: 2560117 - RNA, 14 nt, Chlamydophila pneumoniae J138
aaagugugaggaga

SEQ ID NO: 2560118 - RNA, 22 nt, Chlamydophila pneumoniae J138
aaaguuaaugcaagcaacucuu

SEQ ID NO: 2560119 - RNA, 20 nt, Chlamydophila pneumoniae J138
aaaguuagguagauagaaau

SEQ ID NO: 2560120 - RNA, 13 nt, Chlamydophila pneumoniae J138
aaaguugaacuga

SEQ ID NO: 2560121 - RNA, 16 nt, Chlamydophila pneumoniae J138
aaaguugaggaaagga

SEQ ID NO: 2560122 - RNA, 18 nt, Chlamydophila pneumoniae J138
aaaguugaggaaaggagg

SEQ ID NO: 2560123 - RNA, 15 nt, Chlamydophila pneumoniae J138
aaaguuuccaaguga

SEQ ID NO: 2560124 - RNA, 21 nt, Chlamydophila pneumoniae J138
aaauaaaaaaacccucaaaga

SEQ ID NO: 2560125 - RNA, 22 nt, Chlamydophila pneumoniae J138
aaauaaaaaaacccucaaagaa

SEQ ID NO: 2560126 - RNA, 12 nt, Chlamydophila pneumoniae J138
aaauaaaaccac

SEQ ID NO: 2560127 - RNA, 13 nt, Chlamydophila pneumoniae J138
aaauaaaaggagc

SEQ ID NO: 2560128 - RNA, 16 nt, Chlamydophila pneumoniae J138
aaauaaaaucaagcca

SEQ ID NO: 2560129 - RNA, 21 nt, Chlamydophila pneumoniae J138
aaauaaagagcugauccagcu

SEQ ID NO: 2560130 - RNA, 21 nt, Chlamydophila pneumoniae J138
aaauaagauuuuaagaccuuc

SEQ ID NO: 2560131 - RNA, 18 nt, Chlamydophila pneumoniae J138
aaauaagccaguacuaaa

SEQ ID NO: 2560132 - RNA, 20 nt, Chlamydophila pneumoniae J138
aaauaaguccuguuugaaaa

SEQ ID NO: 2560133 - RNA, 22 nt, Chlamydophila pneumoniae J138
aaauaauuuuauuaguuacuga

SEQ ID NO: 2560134 - RNA, 16 nt, Chlamydophila pneumoniae J138
aaauacagccagcaga

SEQ ID NO: 2560135 - RNA, 17 nt, Chlamydophila pneumoniae J138
aaauacagccagcagaa

SEQ ID NO: 2560136 - RNA, 22 nt, Chlamydophila pneumoniae J138
aaauaccacagcuguacagaac

SEQ ID NO: 2560137 - RNA, 22 nt, Chlamydophila pneumoniae J138
aaauacccucggagacucagag

SEQ ID NO: 2560138 - RNA, 14 nt, Chlamydophila pneumoniae J138
aaauacgcuuuucu

SEQ ID NO: 2560139 - RNA, 23 nt, Chlamydophila pneumoniae J138
aaauacguccagccugcaccaga

SEQ ID NO: 2560140 - RNA, 20 nt, Chlamydophila pneumoniae J138
aaauacuuaggaauuuuucu

SEQ ID NO: 2560141 - RNA, 16 nt, Chlamydophila pneumoniae J138
aaauacuucuccugaa

SEQ ID NO: 2560142 - RNA, 14 nt, Chlamydophila pneumoniae J138
aaauagaaaacaua

SEQ ID NO: 2560143 - RNA, 18 nt, Chlamydophila pneumoniae J138
aaauagaaaggaaucccu

SEQ ID NO: 2560144 - RNA, 12 nt, Chlamydophila pneumoniae J138
aaauagaaauaa

SEQ ID NO: 2560145 - RNA, 15 nt, Chlamydophila pneumoniae J138
aaauagaaggccagu

SEQ ID NO: 2560146 - RNA, 15 nt, Chlamydophila pneumoniae J138
aaauagagaaacuuu

SEQ ID NO: 2560147 - RNA, 20 nt, Chlamydophila pneumoniae J138
aaauagauccugaaaguaca

SEQ ID NO: 2560148 - RNA, 19 nt, Chlamydophila pneumoniae J138
aaauagcaucccuucuucu

SEQ ID NO: 2560149 - RNA, 14 nt, Chlamydophila pneumoniae J138
aaauaggagagcac

SEQ ID NO: 2560150 - RNA, 20 nt, Chlamydophila pneumoniae J138
aaauaggagagcacuuuuaa

SEQ ID NO: 2560151 - RNA, 12 nt, Chlamydophila pneumoniae J138
aaauaggaucuc

SEQ ID NO: 2560152 - RNA, 18 nt, Chlamydophila pneumoniae J138
aaauaggaucucucuuuc

SEQ ID NO: 2560153 - RNA, 13 nt, Chlamydophila pneumoniae J138
aaauauaacucuc

SEQ ID NO: 2560154 - RNA, 15 nt, Chlamydophila pneumoniae J138
aaauauacugccagc

SEQ ID NO: 2560155 - RNA, 18 nt, Chlamydophila pneumoniae J138
aaauaucacauuccaaug

SEQ ID NO: 2560156 - RNA, 21 nt, Chlamydophila pneumoniae J138
aaauaucaccuacaucagacu

SEQ ID NO: 2560157 - RNA, 17 nt, Chlamydophila pneumoniae J138
aaauauccuaaauauau

SEQ ID NO: 2560158 - RNA, 21 nt, Chlamydophila pneumoniae J138
aaauaucuccguuaccaaaaa

SEQ ID NO: 2560159 - RNA, 23 nt, Chlamydophila pneumoniae J138
aaauaucuccguuaccaaaaacu

SEQ ID NO: 2560160 - RNA, 21 nt, Chlamydophila pneumoniae J138
aaauaucucuggcauaauccu

SEQ ID NO: 2560161 - RNA, 12 nt, Chlamydophila pneumoniae J138
aaauaucuuaac

SEQ ID NO: 2560162 - RNA, 21 nt, Chlamydophila pneumoniae J138
aaauaugagaucgaaucuuua

SEQ ID NO: 2560163 - RNA, 22 nt, Chlamydophila pneumoniae J138
aaauauuaacccaccagaagga

SEQ ID NO: 2560164 - RNA, 19 nt, Chlamydophila pneumoniae J138
aaauauucuuucaaaccac

SEQ ID NO: 2560165 - RNA, 15 nt, Chlamydophila pneumoniae J138
aaaucaaacauuacc

SEQ ID NO: 2560166 - RNA, 13 nt, Chlamydophila pneumoniae J138
aaaucaacaucac

SEQ ID NO: 2560167 - RNA, 16 nt, Chlamydophila pneumoniae J138
aaaucaacaucacaau

SEQ ID NO: 2560168 - RNA, 14 nt, Chlamydophila pneumoniae J138
aaaucaacuacacu

SEQ ID NO: 2560169 - RNA, 15 nt, Chlamydophila pneumoniae J138
aaaucaagaagagaa

SEQ ID NO: 2560170 - RNA, 19 nt, Chlamydophila pneumoniae J138
aaaucaccagcauuaagau

SEQ ID NO: 2560171 - RNA, 20 nt, Chlamydophila pneumoniae J138
aaaucaccagcauuaagaua

SEQ ID NO: 2560172 - RNA, 19 nt, Chlamydophila pneumoniae J138
aaaucaccauauccaugac

SEQ ID NO: 2560173 - RNA, 14 nt, Chlamydophila pneumoniae J138
aaaucagacuuaaa

SEQ ID NO: 2560174 - RNA, 20 nt, Chlamydophila pneumoniae J138
aaaucauaggcuauaauuaa

SEQ ID NO: 2560175 - RNA, 12 nt, Chlamydophila pneumoniae J138
aaaucaucaaaa

SEQ ID NO: 2560176 - RNA, 19 nt, Chlamydophila pneumoniae J138
aaaucaucgcaaucaaaga

SEQ ID NO: 2560177 - RNA, 21 nt, Chlamydophila pneumoniae J138
aaaucauuggaaccauaggau

SEQ ID NO: 2560178 - RNA, 18 nt, Chlamydophila pneumoniae J138
aaaucauuuaaagcugaa

SEQ ID NO: 2560179 - RNA, 23 nt, Chlamydophila pneumoniae J138
aaauccacauccuuguagaacuu

SEQ ID NO: 2560180 - RNA, 16 nt, Chlamydophila pneumoniae J138
aaauccaccaaugaua

SEQ ID NO: 2560181 - RNA, 20 nt, Chlamydophila pneumoniae J138
aaaucccgagauaugaagag

SEQ ID NO: 2560182 - RNA, 16 nt, Chlamydophila pneumoniae J138
aaaucccgccuuucua

SEQ ID NO: 2560183 - RNA, 18 nt, Chlamydophila pneumoniae J138
aaaucccuguucuagcaa

SEQ ID NO: 2560184 - RNA, 16 nt, Chlamydophila pneumoniae J138
aaauccgauaagauaa

SEQ ID NO: 2560185 - RNA, 12 nt, Chlamydophila pneumoniae J138
aaauccuaaaaa

SEQ ID NO: 2560186 - RNA, 23 nt, Chlamydophila pneumoniae J138
aaauccugggcaaugaucaaaaa

SEQ ID NO: 2560187 - RNA, 15 nt, Chlamydophila pneumoniae J138
aaaucgacaggggag

SEQ ID NO: 2560188 - RNA, 15 nt, Chlamydophila pneumoniae J138
aaaucgcauuacaaa

SEQ ID NO: 2560189 - RNA, 23 nt, Chlamydophila pneumoniae J138
aaaucgguaaccugugaaaauuu

SEQ ID NO: 2560190 - RNA, 17 nt, Chlamydophila pneumoniae J138
aaaucguacuucacuuc

SEQ ID NO: 2560191 - RNA, 19 nt, Chlamydophila pneumoniae J138
aaaucuaccgugaagauuu

SEQ ID NO: 2560192 - RNA, 21 nt, Chlamydophila pneumoniae J138
aaaucuacucuuuaaaaauag

SEQ ID NO: 2560193 - RNA, 22 nt, Chlamydophila pneumoniae J138
aaaucuauacccaguuguaucc

SEQ ID NO: 2560194 - RNA, 13 nt, Chlamydophila pneumoniae J138
aaaucuaucugca

SEQ ID NO: 2560195 - RNA, 12 nt, Chlamydophila pneumoniae J138
aaaucucauuuc

SEQ ID NO: 2560196 - RNA, 18 nt, Chlamydophila pneumoniae J138
aaaucucgagcuaccuag

SEQ ID NO: 2560197 - RNA, 15 nt, Chlamydophila pneumoniae J138
aaaucucuaagaauc

SEQ ID NO: 2560198 - RNA, 21 nt, Chlamydophila pneumoniae J138
aaaucugcaagauuaucuuua

SEQ ID NO: 2560199 - RNA, 18 nt, Chlamydophila pneumoniae J138
aaaucugcucuacuuguc

SEQ ID NO: 2560200 - RNA, 16 nt, Chlamydophila pneumoniae J138
aaaucuuccccuaaaa

SEQ ID NO: 2560201 - RNA, 18 nt, Chlamydophila pneumoniae J138
aaaucuucuggagggagu

SEQ ID NO: 2560202 - RNA, 18 nt, Chlamydophila pneumoniae J138
aaaugaagagcuuccauu

SEQ ID NO: 2560203 - RNA, 13 nt, Chlamydophila pneumoniae J138
aaaugaagccaaa

SEQ ID NO: 2560204 - RNA, 17 nt, Chlamydophila pneumoniae J138
aaaugaauauaauucca

SEQ ID NO: 2560205 - RNA, 21 nt, Chlamydophila pneumoniae J138
aaaugagauuccuaugaucag

SEQ ID NO: 2560206 - RNA, 18 nt, Chlamydophila pneumoniae J138
aaaugaggacacaacucu

SEQ ID NO: 2560207 - RNA, 20 nt, Chlamydophila pneumoniae J138
aaaugauaccaccuaaaaug

SEQ ID NO: 2560208 - RNA, 23 nt, Chlamydophila pneumoniae J138
aaaugauuuggccaacaguguag

SEQ ID NO: 2560209 - RNA, 22 nt, Chlamydophila pneumoniae J138
aaaugcaaaccaaaaaaguaac

SEQ ID NO: 2560210 - RNA, 21 nt, Chlamydophila pneumoniae J138
aaaugcaguucuuguuaaagu

SEQ ID NO: 2560211 - RNA, 21 nt, Chlamydophila pneumoniae J138
aaaugccucuuucauacuaaa

SEQ ID NO: 2560212 - RNA, 13 nt, Chlamydophila pneumoniae J138
aaaugccugaaaa

SEQ ID NO: 2560213 - RNA, 17 nt, Chlamydophila pneumoniae J138
aaaugccuuaaauguau

SEQ ID NO: 2560214 - RNA, 15 nt, Chlamydophila pneumoniae J138
aaaugcgaggaaaaa

SEQ ID NO: 2560215 - RNA, 18 nt, Chlamydophila pneumoniae J138
aaaugcuauuuuccucua

SEQ ID NO: 2560216 - RNA, 14 nt, Chlamydophila pneumoniae J138
aacaggauugauaa

SEQ ID NO: 2560217 - RNA, 16 nt, Chlamydophila pneumoniae J138
aacaggauugauaaau

SEQ ID NO: 2560218 - RNA, 14 nt, Chlamydophila pneumoniae J138
aacagguucacuuc

SEQ ID NO: 2560219 - RNA, 18 nt, Chlamydophila pneumoniae J138
aacaguaauuauuuucua

SEQ ID NO: 2560220 - RNA, 20 nt, Chlamydophila pneumoniae J138
aacaguucgggcuaaucauu

SEQ ID NO: 2560221 - RNA, 22 nt, Chlamydophila pneumoniae J138
aacaguucuuucugcuugucua

SEQ ID NO: 2560222 - RNA, 13 nt, Chlamydophila pneumoniae J138
aacauaaagaagg

SEQ ID NO: 2560223 - RNA, 15 nt, Chlamydophila pneumoniae J138
aacauaaagaagguu

SEQ ID NO: 2560224 - RNA, 19 nt, Chlamydophila pneumoniae J138
aacauaaagacccuucuuu

SEQ ID NO: 2560225 - RNA, 19 nt, Chlamydophila pneumoniae J138
aacauaaccuccucuucuu

SEQ ID NO: 2560226 - RNA, 18 nt, Chlamydophila pneumoniae J138
aacauacaccccaguuuc

SEQ ID NO: 2560227 - RNA, 22 nt, Chlamydophila pneumoniae J138
aacauacaccccaguuucuuga

SEQ ID NO: 2560228 - RNA, 19 nt, Chlamydophila pneumoniae J138
aacauacacgucuaagaau

SEQ ID NO: 2560229 - RNA, 15 nt, Chlamydophila pneumoniae J138
aacauagauaaggua

SEQ ID NO: 2560230 - RNA, 22 nt, Chlamydophila pneumoniae J138
aacauauucuccuuaccaauau

SEQ ID NO: 2560231 - RNA, 13 nt, Chlamydophila pneumoniae J138
aacaucaaagaau

SEQ ID NO: 2560232 - RNA, 14 nt, Chlamydophila pneumoniae J138
aacaucaaagaauu

SEQ ID NO: 2560233 - RNA, 17 nt, Chlamydophila pneumoniae J138
aacaucacucaggauau

SEQ ID NO: 2560234 - RNA, 18 nt, Chlamydophila pneumoniae J138
aacaucacuuauauuuuc

SEQ ID NO: 2560235 - RNA, 16 nt, Chlamydophila pneumoniae J138
aacaucagagaacucu

SEQ ID NO: 2560236 - RNA, 14 nt, Chlamydophila pneumoniae J138
aacaucagcuguug

SEQ ID NO: 2560237 - RNA, 14 nt, Chlamydophila pneumoniae J138
aacaucaugaaaua

SEQ ID NO: 2560238 - RNA, 15 nt, Chlamydophila pneumoniae J138
aacaucaugaaauac

SEQ ID NO: 2560239 - RNA, 15 nt, Chlamydophila pneumoniae J138
aacauccauagagaa

SEQ ID NO: 2560240 - RNA, 21 nt, Chlamydophila pneumoniae J138
aacaucccccgggaagcuguc

SEQ ID NO: 2560241 - RNA, 15 nt, Chlamydophila pneumoniae J138
aacaucgaaaccaca

SEQ ID NO: 2560242 - RNA, 15 nt, Chlamydophila pneumoniae J138
aacaucguuaauaua

SEQ ID NO: 2560243 - RNA, 13 nt, Chlamydophila pneumoniae J138
aacaucuaaaaau

SEQ ID NO: 2560244 - RNA, 20 nt, Chlamydophila pneumoniae J138
aacaugaccuuuaggaacuu

SEQ ID NO: 2560245 - RNA, 21 nt, Chlamydophila pneumoniae J138
aacaugacggugcuguuguaa

SEQ ID NO: 2560246 - RNA, 23 nt, Chlamydophila pneumoniae J138
aacaugacggugcuguuguaaua

SEQ ID NO: 2560247 - RNA, 14 nt, Chlamydophila pneumoniae J138
aacaugagauacgu

SEQ ID NO: 2560248 - RNA, 11 nt, Chlamydophila pneumoniae J138
aacaugaggau

SEQ ID NO: 2560249 - RNA, 15 nt, Chlamydophila pneumoniae J138
aacaugccugaaaac

SEQ ID NO: 2560250 - RNA, 17 nt, Chlamydophila pneumoniae J138
aacaugcgcagaauaaa

SEQ ID NO: 2560251 - RNA, 16 nt, Chlamydophila pneumoniae J138
aacauugaguugguuu

SEQ ID NO: 2560252 - RNA, 17 nt, Chlamydophila pneumoniae J138
aacauuuuuauuuccuu

SEQ ID NO: 2560253 - RNA, 23 nt, Chlamydophila pneumoniae J138
aacauuuuucaauaaccagaaga

SEQ ID NO: 2560254 - RNA, 13 nt, Chlamydophila pneumoniae J138
aaccaaaaugcau

SEQ ID NO: 2560255 - RNA, 21 nt, Chlamydophila pneumoniae J138
aaccaaucuugagcauccaaa

SEQ ID NO: 2560256 - RNA, 17 nt, Chlamydophila pneumoniae J138
aaccaauuucuccgcuu

SEQ ID NO: 2560257 - RNA, 20 nt, Chlamydophila pneumoniae J138
aaccacggauuuucucuaca

SEQ ID NO: 2560258 - RNA, 23 nt, Chlamydophila pneumoniae J138
aaccacuguccaugcacgagauu

SEQ ID NO: 2560259 - RNA, 11 nt, Chlamydophila pneumoniae J138
aaccagagagc

SEQ ID NO: 2560260 - RNA, 23 nt, Chlamydophila pneumoniae J138
aaccagguagagugucuuccuug

SEQ ID NO: 2560261 - RNA, 14 nt, Chlamydophila pneumoniae J138
aaccauagagagcc

SEQ ID NO: 2560262 - RNA, 15 nt, Chlamydophila pneumoniae J138
aaccauagagagccu

SEQ ID NO: 2560263 - RNA, 21 nt, Chlamydophila pneumoniae J138
aaccauagagagccuuuccua

SEQ ID NO: 2560264 - RNA, 13 nt, Chlamydophila pneumoniae J138
aaccauagauuua

SEQ ID NO: 2560265 - RNA, 19 nt, Chlamydophila pneumoniae J138
aaccaucacuuccuguugu

SEQ ID NO: 2560266 - RNA, 18 nt, Chlamydophila pneumoniae J138
aacccaccagaaggaagg

SEQ ID NO: 2560267 - RNA, 13 nt, Chlamydophila pneumoniae J138
aaccccuccaaaa

SEQ ID NO: 2560268 - RNA, 20 nt, Chlamydophila pneumoniae J138
aacccuaguucauuagcuaa

SEQ ID NO: 2560269 - RNA, 13 nt, Chlamydophila pneumoniae J138
aacccuauuuaag

SEQ ID NO: 2560270 - RNA, 14 nt, Chlamydophila pneumoniae J138
aacccuauuuaagg

SEQ ID NO: 2560271 - RNA, 16 nt, Chlamydophila pneumoniae J138
aacccugggcucacuc

SEQ ID NO: 2560272 - RNA, 16 nt, Chlamydophila pneumoniae J138
aacccuuuaaugauca

SEQ ID NO: 2560273 - RNA, 22 nt, Chlamydophila pneumoniae J138
aacccuuuauacuguuuuucuu

SEQ ID NO: 2560274 - RNA, 14 nt, Chlamydophila pneumoniae J138
aaccgaaacuucuc

SEQ ID NO: 2560275 - RNA, 22 nt, Chlamydophila pneumoniae J138
aaccgaaacuucucagauaaaa

SEQ ID NO: 2560276 - RNA, 17 nt, Chlamydophila pneumoniae J138
aaccgagacuauuuugg

SEQ ID NO: 2560277 - RNA, 19 nt, Chlamydophila pneumoniae J138
aaccgagacuauuuuggaa

SEQ ID NO: 2560278 - RNA, 22 nt, Chlamydophila pneumoniae J138
aaccgcaaaaagcuucuuucuu

SEQ ID NO: 2560279 - RNA, 24 nt, Chlamydophila pneumoniae J138
aaccuagaaggaggaguccuucua

SEQ ID NO: 2560280 - RNA, 11 nt, Chlamydophila pneumoniae J138
aaccuccacca

SEQ ID NO: 2560281 - RNA, 23 nt, Chlamydophila pneumoniae J138
aaccuccaccaggagcuccuccu

SEQ ID NO: 2560282 - RNA, 16 nt, Chlamydophila pneumoniae J138
aaccuccgcucuaagc

SEQ ID NO: 2560283 - RNA, 13 nt, Chlamydophila pneumoniae J138
aaccucuuuucuu

SEQ ID NO: 2560284 - RNA, 22 nt, Chlamydophila pneumoniae J138
aaccuggcauugccauaauaaa

SEQ ID NO: 2560285 - RNA, 19 nt, Chlamydophila pneumoniae J138
aaccuucgauuccaggcuc

SEQ ID NO: 2560286 - RNA, 14 nt, Chlamydophila pneumoniae J138
aaccuucucucuua

SEQ ID NO: 2560287 - RNA, 22 nt, Chlamydophila pneumoniae J138
aaccuuugguagaaagacaaaa

SEQ ID NO: 2560288 - RNA, 13 nt, Chlamydophila pneumoniae J138
aacgaauuucaac

SEQ ID NO: 2560289 - RNA, 15 nt, Chlamydophila pneumoniae J138
aacgacauugaagag

SEQ ID NO: 2560290 - RNA, 22 nt, Chlamydophila pneumoniae J138
aacgacguuuaauuccuuggau

SEQ ID NO: 2560291 - RNA, 20 nt, Chlamydophila pneumoniae J138
aacgacuuagaucuuuucua

SEQ ID NO: 2560292 - RNA, 17 nt, Chlamydophila pneumoniae J138
aacgagaaguuugauaa

SEQ ID NO: 2560293 - RNA, 23 nt, Chlamydophila pneumoniae J138
aacgaucgucaguaaaacacaaa

SEQ ID NO: 2560294 - RNA, 23 nt, Chlamydophila pneumoniae J138
aacgauuguaauuucuagcuaau

SEQ ID NO: 2560295 - RNA, 16 nt, Chlamydophila pneumoniae J138
aacgcaacauccauuc

SEQ ID NO: 2560296 - RNA, 16 nt, Chlamydophila pneumoniae J138
aacgcacgccaagaga

SEQ ID NO: 2560297 - RNA, 14 nt, Chlamydophila pneumoniae J138
aacgcagcuuuccu

SEQ ID NO: 2560298 - RNA, 22 nt, Chlamydophila pneumoniae J138
aacgcagcuuuccuuuugauaa

SEQ ID NO: 2560299 - RNA, 15 nt, Chlamydophila pneumoniae J138
aacgcaggaagaaca

SEQ ID NO: 2560300 - RNA, 23 nt, Chlamydophila pneumoniae J138
aacgcaugacgcuuuuccaaagc

SEQ ID NO: 2560301 - RNA, 18 nt, Chlamydophila pneumoniae J138
aacgccaacacgcacaaa

SEQ ID NO: 2560302 - RNA, 21 nt, Chlamydophila pneumoniae J138
aacgcccuucaggacaugccu

SEQ ID NO: 2560303 - RNA, 17 nt, Chlamydophila pneumoniae J138
aacgcccuucuuaguaa

SEQ ID NO: 2560304 - RNA, 20 nt, Chlamydophila pneumoniae J138
aacgcccuucuuaguaaaga

SEQ ID NO: 2560305 - RNA, 15 nt, Chlamydophila pneumoniae J138
aacgcugcuucucua

SEQ ID NO: 2560306 - RNA, 13 nt, Chlamydophila pneumoniae J138
aacgcuuuucuaa

SEQ ID NO: 2560307 - RNA, 23 nt, Chlamydophila pneumoniae J138
aacggaacuaaagagaucacagg

SEQ ID NO: 2560308 - RNA, 20 nt, Chlamydophila pneumoniae J138
aacggauaagacggauaaau

SEQ ID NO: 2560309 - RNA, 19 nt, Chlamydophila pneumoniae J138
aacgggagcguuuuuugaa

SEQ ID NO: 2560310 - RNA, 23 nt, Chlamydophila pneumoniae J138
aacgggagcguuuuuugaaaauu

SEQ ID NO: 2560311 - RNA, 13 nt, Chlamydophila pneumoniae J138
aacgguaaauauc

SEQ ID NO: 2560312 - RNA, 14 nt, Chlamydophila pneumoniae J138
aacgguaaauaucu

SEQ ID NO: 2560313 - RNA, 22 nt, Chlamydophila pneumoniae J138
aacgguugucucgaaacucuuu

SEQ ID NO: 2560314 - RNA, 20 nt, Chlamydophila pneumoniae J138
aacguaagcuuuuuaccaau

SEQ ID NO: 2560315 - RNA, 12 nt, Chlamydophila pneumoniae J138
aacguacuuagg

SEQ ID NO: 2560316 - RNA, 18 nt, Chlamydophila pneumoniae J138
aagaaacuuccaaaacga

SEQ ID NO: 2560317 - RNA, 19 nt, Chlamydophila pneumoniae J138
aagaaagagucucacucuu

SEQ ID NO: 2560318 - RNA, 16 nt, Chlamydophila pneumoniae J138
aagaaagcuugucaua

SEQ ID NO: 2560319 - RNA, 20 nt, Chlamydophila pneumoniae J138
aagaaauauacugccagcga

SEQ ID NO: 2560320 - RNA, 16 nt, Chlamydophila pneumoniae J138
aagaaaucaaacauua

SEQ ID NO: 2560321 - RNA, 15 nt, Chlamydophila pneumoniae J138
aagaaaucucaguga

SEQ ID NO: 2560322 - RNA, 21 nt, Chlamydophila pneumoniae J138
aagaaaugcaaaccaaaaaag

SEQ ID NO: 2560323 - RNA, 19 nt, Chlamydophila pneumoniae J138
aagaaaugcccugucacua

SEQ ID NO: 2560324 - RNA, 17 nt, Chlamydophila pneumoniae J138
aagaaauucugacuaua

SEQ ID NO: 2560325 - RNA, 14 nt, Chlamydophila pneumoniae J138
aagaacagaggauc

SEQ ID NO: 2560326 - RNA, 22 nt, Chlamydophila pneumoniae J138
aagaacagaggaucuagaaaau

SEQ ID NO: 2560327 - RNA, 13 nt, Chlamydophila pneumoniae J138
aagaacagcacuc

SEQ ID NO: 2560328 - RNA, 13 nt, Chlamydophila pneumoniae J138
aagaacagcagaa

SEQ ID NO: 2560329 - RNA, 13 nt, Chlamydophila pneumoniae J138
aagaacauaaccu

SEQ ID NO: 2560330 - RNA, 14 nt, Chlamydophila pneumoniae J138
aagaacaucuuccc

SEQ ID NO: 2560331 - RNA, 17 nt, Chlamydophila pneumoniae J138
aagaacccauugaauuu

SEQ ID NO: 2560332 - RNA, 18 nt, Chlamydophila pneumoniae J138
aagaacccgauacauccu

SEQ ID NO: 2560333 - RNA, 20 nt, Chlamydophila pneumoniae J138
aagaaccucuaauuugauga

SEQ ID NO: 2560334 - RNA, 15 nt, Chlamydophila pneumoniae J138
aagaaccuguuuuuc

SEQ ID NO: 2560335 - RNA, 15 nt, Chlamydophila pneumoniae J138
aagaacgucaccauu

SEQ ID NO: 2560336 - RNA, 18 nt, Chlamydophila pneumoniae J138
aagaacuacuuaaauccu

SEQ ID NO: 2560337 - RNA, 18 nt, Chlamydophila pneumoniae J138
aagaacucaacuuuuuua

SEQ ID NO: 2560338 - RNA, 16 nt, Chlamydophila pneumoniae J138
aagaacuccuuugagu

SEQ ID NO: 2560339 - RNA, 17 nt, Chlamydophila pneumoniae J138
aagaacugaagagucaa

SEQ ID NO: 2560340 - RNA, 19 nt, Chlamydophila pneumoniae J138
aagaacuuaaaauucaaau

SEQ ID NO: 2560341 - RNA, 17 nt, Chlamydophila pneumoniae J138
aagaacuuagcaaugaa

SEQ ID NO: 2560342 - RNA, 19 nt, Chlamydophila pneumoniae J138
aagaacuuuagggaagaaa

SEQ ID NO: 2560343 - RNA, 15 nt, Chlamydophila pneumoniae J138
aagaagaaccucauu

SEQ ID NO: 2560344 - RNA, 13 nt, Chlamydophila pneumoniae J138
aagaagaagaaaa

SEQ ID NO: 2560345 - RNA, 19 nt, Chlamydophila pneumoniae J138
aagaagacuagcuuuucau

SEQ ID NO: 2560346 - RNA, 22 nt, Chlamydophila pneumoniae J138
aagaagacuagcuuuucauguu

SEQ ID NO: 2560347 - RNA, 15 nt, Chlamydophila pneumoniae J138
aagaagagaaaagau

SEQ ID NO: 2560348 - RNA, 21 nt, Chlamydophila pneumoniae J138
aagaagaucaaagauuccuaa

SEQ ID NO: 2560349 - RNA, 14 nt, Chlamydophila pneumoniae J138
aagaagcagcacuc

SEQ ID NO: 2560350 - RNA, 17 nt, Chlamydophila pneumoniae J138
aagaagccuuccuuguu

SEQ ID NO: 2560351 - RNA, 15 nt, Chlamydophila pneumoniae J138
aagaagcucacucuu

SEQ ID NO: 2560352 - RNA, 16 nt, Chlamydophila pneumoniae J138
aagaagcucacucuuu

SEQ ID NO: 2560353 - RNA, 22 nt, Chlamydophila pneumoniae J138
aagaagcucacucuuuaaaaac

SEQ ID NO: 2560354 - RNA, 18 nt, Chlamydophila pneumoniae J138
aagaagguccaugucuaa

SEQ ID NO: 2560355 - RNA, 13 nt, Chlamydophila pneumoniae J138
aagaagguugaga

SEQ ID NO: 2560356 - RNA, 17 nt, Chlamydophila pneumoniae J138
aagaagguuuauuagaa

SEQ ID NO: 2560357 - RNA, 21 nt, Chlamydophila pneumoniae J138
aagaagguuuauuagaaguau

SEQ ID NO: 2560358 - RNA, 14 nt, Chlamydophila pneumoniae J138
aagaaguaggaaau

SEQ ID NO: 2560359 - RNA, 15 nt, Chlamydophila pneumoniae J138
aagaauaaaauagga

SEQ ID NO: 2560360 - RNA, 22 nt, Chlamydophila pneumoniae J138
aagaauaauagcaaguagcucu

SEQ ID NO: 2560361 - RNA, 14 nt, Chlamydophila pneumoniae J138
aagaaucguucuua

SEQ ID NO: 2560362 - RNA, 14 nt, Chlamydophila pneumoniae J138
aagaaugacacaga

SEQ ID NO: 2560363 - RNA, 16 nt, Chlamydophila pneumoniae J138
aagaaugacacagaga

SEQ ID NO: 2560364 - RNA, 17 nt, Chlamydophila pneumoniae J138
aagaaugagaacgucua

SEQ ID NO: 2560365 - RNA, 17 nt, Chlamydophila pneumoniae J138
aagaauguagcuguucc

SEQ ID NO: 2560366 - RNA, 16 nt, Chlamydophila pneumoniae J138
aagaauuaagaagaag

SEQ ID NO: 2560367 - RNA, 15 nt, Chlamydophila pneumoniae J138
aagaauucagagaaa

SEQ ID NO: 2560368 - RNA, 22 nt, Chlamydophila pneumoniae J138
aagaauucuuugccaaggaccu

SEQ ID NO: 2560369 - RNA, 17 nt, Chlamydophila pneumoniae J138
aagaauuucauaagaga

SEQ ID NO: 2560370 - RNA, 13 nt, Chlamydophila pneumoniae J138
aagacaagagaag

SEQ ID NO: 2560371 - RNA, 15 nt, Chlamydophila pneumoniae J138
aagacaauaaaaaag

SEQ ID NO: 2560372 - RNA, 17 nt, Chlamydophila pneumoniae J138
aagacaauaaaaaagag

SEQ ID NO: 2560373 - RNA, 18 nt, Chlamydophila pneumoniae J138
aagacaauaaaaaagaga

SEQ ID NO: 2560374 - RNA, 20 nt, Chlamydophila pneumoniae J138
aagacaauggaaauagagaa

SEQ ID NO: 2560375 - RNA, 20 nt, Chlamydophila pneumoniae J138
aagacaaugucgucucagaa

SEQ ID NO: 2560376 - RNA, 17 nt, Chlamydophila pneumoniae J138
aagacaccgaaagaaau

SEQ ID NO: 2560377 - RNA, 19 nt, Chlamydophila pneumoniae J138
aagacauccuucuuuaccu

SEQ ID NO: 2560378 - RNA, 22 nt, Chlamydophila pneumoniae J138
aagacauccuucuuuaccuaug

SEQ ID NO: 2560379 - RNA, 16 nt, Chlamydophila pneumoniae J138
aagacauuauagaggu

SEQ ID NO: 2560380 - RNA, 17 nt, Chlamydophila pneumoniae J138
aagacauucauuuuuua

SEQ ID NO: 2560381 - RNA, 21 nt, Chlamydophila pneumoniae J138
aagacgacacucaaaucuuuc

SEQ ID NO: 2560382 - RNA, 18 nt, Chlamydophila pneumoniae J138
aagacuacgacagaagua

SEQ ID NO: 2560383 - RNA, 15 nt, Chlamydophila pneumoniae J138
aagacucaaagaacu

SEQ ID NO: 2560384 - RNA, 14 nt, Chlamydophila pneumoniae J138
aagacucaucuuug

SEQ ID NO: 2560385 - RNA, 16 nt, Chlamydophila pneumoniae J138
aagacucucaucagca

SEQ ID NO: 2560386 - RNA, 17 nt, Chlamydophila pneumoniae J138
aagacucuugaauauuu

SEQ ID NO: 2560387 - RNA, 14 nt, Chlamydophila pneumoniae J138
aagacugucuauga

SEQ ID NO: 2560388 - RNA, 13 nt, Chlamydophila pneumoniae J138
aagacuugcucug

SEQ ID NO: 2560389 - RNA, 19 nt, Chlamydophila pneumoniae J138
aagacuuguucuucauuau

SEQ ID NO: 2560390 - RNA, 23 nt, Chlamydophila pneumoniae J138
aagacuuuuuaaauagcaucccu

SEQ ID NO: 2560391 - RNA, 23 nt, Chlamydophila pneumoniae J138
aagacuuuuuaguauacuaagac

SEQ ID NO: 2560392 - RNA, 15 nt, Chlamydophila pneumoniae J138
aagagacaagaaaau

SEQ ID NO: 2560393 - RNA, 16 nt, Chlamydophila pneumoniae J138
aagagacaagaaaaua

SEQ ID NO: 2560394 - RNA, 17 nt, Chlamydophila pneumoniae J138
aagagacaagaaaauau

SEQ ID NO: 2560395 - RNA, 22 nt, Chlamydophila pneumoniae J138
aagagagcuugucacacugcga

SEQ ID NO: 2560396 - RNA, 22 nt, Chlamydophila pneumoniae J138
aagagauguagguaucagcaag

SEQ ID NO: 2560397 - RNA, 23 nt, Chlamydophila pneumoniae J138
aagagauugauuucuugcuuuua

SEQ ID NO: 2560398 - RNA, 21 nt, Chlamydophila pneumoniae J138
aagagcaaacaucaaagagag

SEQ ID NO: 2560399 - RNA, 15 nt, Chlamydophila pneumoniae J138
aagagcccuugaauc

SEQ ID NO: 2560400 - RNA, 17 nt, Chlamydophila pneumoniae J138
aagagccggaacuucag

SEQ ID NO: 2560401 - RNA, 19 nt, Chlamydophila pneumoniae J138
aagagcgcguuucaaauag

SEQ ID NO: 2560402 - RNA, 16 nt, Chlamydophila pneumoniae J138
aagagcuaugaugaga

SEQ ID NO: 2560403 - RNA, 22 nt, Chlamydophila pneumoniae J138
aagagcucguaauccuucuuuc

SEQ ID NO: 2560404 - RNA, 23 nt, Chlamydophila pneumoniae J138
aagagcucguaauccuucuuucu

SEQ ID NO: 2560405 - RNA, 14 nt, Chlamydophila pneumoniae J138
aagagcucuugaga

SEQ ID NO: 2560406 - RNA, 16 nt, Chlamydophila pneumoniae J138
aagagcucuugagaaa

SEQ ID NO: 2560407 - RNA, 22 nt, Chlamydophila pneumoniae J138
aagagcuuccauuggaauccuu

SEQ ID NO: 2560408 - RNA, 21 nt, Chlamydophila pneumoniae J138
aagagcuugucuuccacgaag

SEQ ID NO: 2560409 - RNA, 14 nt, Chlamydophila pneumoniae J138
aagaggaagaugau

SEQ ID NO: 2560410 - RNA, 17 nt, Chlamydophila pneumoniae J138
aagaggaagaugauauu

SEQ ID NO: 2560411 - RNA, 20 nt, Chlamydophila pneumoniae J138
aagaggagugaaagcuucuu

SEQ ID NO: 2560412 - RNA, 17 nt, Chlamydophila pneumoniae J138
aagaggcuuuaaauuuu

SEQ ID NO: 2560413 - RNA, 13 nt, Chlamydophila pneumoniae J138
aagaggucgaaga

SEQ ID NO: 2560414 - RNA, 16 nt, Chlamydophila pneumoniae J138
aagagguucuugcuua

SEQ ID NO: 2560415 - RNA, 16 nt, Chlamydophila pneumoniae J138
aagagucccugauucc

SEQ ID NO: 2560416 - RNA, 15 nt, Chlamydophila pneumoniae J138
aagcgcgcuaaaaaa

SEQ ID NO: 2560417 - RNA, 14 nt, Chlamydophila pneumoniae J138
aagcggagcaucuu

SEQ ID NO: 2560418 - RNA, 16 nt, Chlamydophila pneumoniae J138
aagcggagcaucuuuu

SEQ ID NO: 2560419 - RNA, 18 nt, Chlamydophila pneumoniae J138
aagcggaguccuucuugc

SEQ ID NO: 2560420 - RNA, 22 nt, Chlamydophila pneumoniae J138
aagcguauagaauagaauguau

SEQ ID NO: 2560421 - RNA, 21 nt, Chlamydophila pneumoniae J138
aagcuaacaacuucugacaau

SEQ ID NO: 2560422 - RNA, 21 nt, Chlamydophila pneumoniae J138
aagcuacggaugggcacucuu

SEQ ID NO: 2560423 - RNA, 18 nt, Chlamydophila pneumoniae J138
aagcucaagagcaugcuu

SEQ ID NO: 2560424 - RNA, 16 nt, Chlamydophila pneumoniae J138
aagcucacucuuuaaa

SEQ ID NO: 2560425 - RNA, 12 nt, Chlamydophila pneumoniae J138
aagcucaucagc

SEQ ID NO: 2560426 - RNA, 16 nt, Chlamydophila pneumoniae J138
aagcuccucacaucuc

SEQ ID NO: 2560427 - RNA, 19 nt, Chlamydophila pneumoniae J138
aagcucgaccucuagcuca

SEQ ID NO: 2560428 - RNA, 16 nt, Chlamydophila pneumoniae J138
aagcucguacuguucc

SEQ ID NO: 2560429 - RNA, 13 nt, Chlamydophila pneumoniae J138
aagcucuaagucc

SEQ ID NO: 2560430 - RNA, 15 nt, Chlamydophila pneumoniae J138
aagcucuacaagcuc

SEQ ID NO: 2560431 - RNA, 19 nt, Chlamydophila pneumoniae J138
aagcucugagaaagaauag

SEQ ID NO: 2560432 - RNA, 16 nt, Chlamydophila pneumoniae J138
aagcucuucuacuuua

SEQ ID NO: 2560433 - RNA, 20 nt, Chlamydophila pneumoniae J138
aagcugacaaauagaaagga

SEQ ID NO: 2560434 - RNA, 22 nt, Chlamydophila pneumoniae J138
aagcugagguagcaucucucuc

SEQ ID NO: 2560435 - RNA, 18 nt, Chlamydophila pneumoniae J138
aagcugccagugacauaa

SEQ ID NO: 2560436 - RNA, 11 nt, Chlamydophila pneumoniae J138
aagcugcugcu

SEQ ID NO: 2560437 - RNA, 23 nt, Chlamydophila pneumoniae J138
aagcugcugcuacgacuacaucu

SEQ ID NO: 2560438 - RNA, 18 nt, Chlamydophila pneumoniae J138
aagcugcuucuucagagu

SEQ ID NO: 2560439 - RNA, 14 nt, Chlamydophila pneumoniae J138
aagcugcuuuuucu

SEQ ID NO: 2560440 - RNA, 15 nt, Chlamydophila pneumoniae J138
aagcugcuuuuucua

SEQ ID NO: 2560441 - RNA, 16 nt, Chlamydophila pneumoniae J138
aagcugcuuuuucuac

SEQ ID NO: 2560442 - RNA, 19 nt, Chlamydophila pneumoniae J138
aagcuggauucugucuaua

SEQ ID NO: 2560443 - RNA, 20 nt, Chlamydophila pneumoniae J138
aagcuguaaccaacaucaaa

SEQ ID NO: 2560444 - RNA, 22 nt, Chlamydophila pneumoniae J138
aagcuguacuugauauuguucu

SEQ ID NO: 2560445 - RNA, 19 nt, Chlamydophila pneumoniae J138
aagcuguauugggaaugga

SEQ ID NO: 2560446 - RNA, 17 nt, Chlamydophila pneumoniae J138
aagcugucgcaaaugca

SEQ ID NO: 2560447 - RNA, 11 nt, Chlamydophila pneumoniae J138
aagcugugcau

SEQ ID NO: 2560448 - RNA, 19 nt, Chlamydophila pneumoniae J138
aagcugugcauuuucuucu

SEQ ID NO: 2560449 - RNA, 19 nt, Chlamydophila pneumoniae J138
aagcuguggcgauuuuacu

SEQ ID NO: 2560450 - RNA, 19 nt, Chlamydophila pneumoniae J138
aagcuuauuucuguaguuc

SEQ ID NO: 2560451 - RNA, 15 nt, Chlamydophila pneumoniae J138
aagcuucaucaaaac

SEQ ID NO: 2560452 - RNA, 17 nt, Chlamydophila pneumoniae J138
aagcuucaucaaaacau

SEQ ID NO: 2560453 - RNA, 17 nt, Chlamydophila pneumoniae J138
aagcuuccaucguuaga

SEQ ID NO: 2560454 - RNA, 22 nt, Chlamydophila pneumoniae J138
aagcuucguccugacacaacuc

SEQ ID NO: 2560455 - RNA, 14 nt, Chlamydophila pneumoniae J138
aagcuucuucugcg

SEQ ID NO: 2560456 - RNA, 17 nt, Chlamydophila pneumoniae J138
aagcuucuuuaauucca

SEQ ID NO: 2560457 - RNA, 18 nt, Chlamydophila pneumoniae J138
aagcuucuuuaauuccaa

SEQ ID NO: 2560458 - RNA, 15 nt, Chlamydophila pneumoniae J138
aagcuugagaaaagg

SEQ ID NO: 2560459 - RNA, 15 nt, Chlamydophila pneumoniae J138
aagcuugccagcaga

SEQ ID NO: 2560460 - RNA, 21 nt, Chlamydophila pneumoniae J138
aagcuuuuacgagcuuuuuua

SEQ ID NO: 2560461 - RNA, 14 nt, Chlamydophila pneumoniae J138
aaggaaaucacaga

SEQ ID NO: 2560462 - RNA, 14 nt, Chlamydophila pneumoniae J138
aaggaacugugcca

SEQ ID NO: 2560463 - RNA, 20 nt, Chlamydophila pneumoniae J138
aaggaagaucuugaacagag

SEQ ID NO: 2560464 - RNA, 21 nt, Chlamydophila pneumoniae J138
aaggaagggauguuuaauaca

SEQ ID NO: 2560465 - RNA, 15 nt, Chlamydophila pneumoniae J138
aaggaagguucucaa

SEQ ID NO: 2560466 - RNA, 19 nt, Chlamydophila pneumoniae J138
aaggaauaugcucuccuug

SEQ ID NO: 2560467 - RNA, 21 nt, Chlamydophila pneumoniae J138
aaggaauaugcucuccuugua

SEQ ID NO: 2560468 - RNA, 18 nt, Chlamydophila pneumoniae J138
aaggaaucccaagggaga

SEQ ID NO: 2560469 - RNA, 15 nt, Chlamydophila pneumoniae J138
aaggacaaaucuccc

SEQ ID NO: 2560470 - RNA, 16 nt, Chlamydophila pneumoniae J138
aaggacaaaucuccca

SEQ ID NO: 2560471 - RNA, 13 nt, Chlamydophila pneumoniae J138
aaggacauagacu

SEQ ID NO: 2560472 - RNA, 21 nt, Chlamydophila pneumoniae J138
aaggaccuccucacauguuuc

SEQ ID NO: 2560473 - RNA, 14 nt, Chlamydophila pneumoniae J138
aaggacucuuucua

SEQ ID NO: 2560474 - RNA, 18 nt, Chlamydophila pneumoniae J138
aaggacucuuucuauagc

SEQ ID NO: 2560475 - RNA, 13 nt, Chlamydophila pneumoniae J138
aaggagagaaaau

SEQ ID NO: 2560476 - RNA, 14 nt, Chlamydophila pneumoniae J138
aaggagagcuucuu

SEQ ID NO: 2560477 - RNA, 18 nt, Chlamydophila pneumoniae J138
aaggagucgugcaggaga

SEQ ID NO: 2560478 - RNA, 22 nt, Chlamydophila pneumoniae J138
aaggaucccaucaucgagcuga

SEQ ID NO: 2560479 - RNA, 12 nt, Chlamydophila pneumoniae J138
aaggaucugaua

SEQ ID NO: 2560480 - RNA, 18 nt, Chlamydophila pneumoniae J138
aaggaucugauagaacag

SEQ ID NO: 2560481 - RNA, 24 nt, Chlamydophila pneumoniae J138
aaggaugcaucucuuaaaacauga

SEQ ID NO: 2560482 - RNA, 14 nt, Chlamydophila pneumoniae J138
aaggauucugagaa

SEQ ID NO: 2560483 - RNA, 16 nt, Chlamydophila pneumoniae J138
aaggauuggaugagaa

SEQ ID NO: 2560484 - RNA, 14 nt, Chlamydophila pneumoniae J138
aaggcaaaaaguug

SEQ ID NO: 2560485 - RNA, 19 nt, Chlamydophila pneumoniae J138
aaggcaaaaaguugaggaa

SEQ ID NO: 2560486 - RNA, 23 nt, Chlamydophila pneumoniae J138
aaggcaaaaaguugaggaaagga

SEQ ID NO: 2560487 - RNA, 17 nt, Chlamydophila pneumoniae J138
aaggcaauagcagcagc

SEQ ID NO: 2560488 - RNA, 16 nt, Chlamydophila pneumoniae J138
aaggcaccaacacuuu

SEQ ID NO: 2560489 - RNA, 19 nt, Chlamydophila pneumoniae J138
aaggcacuccaaaacucaa

SEQ ID NO: 2560490 - RNA, 14 nt, Chlamydophila pneumoniae J138
aaggcauagauaca

SEQ ID NO: 2560491 - RNA, 16 nt, Chlamydophila pneumoniae J138
aaggcaucuucuuugc

SEQ ID NO: 2560492 - RNA, 21 nt, Chlamydophila pneumoniae J138
aaggcccccuacagcagaaac

SEQ ID NO: 2560493 - RNA, 13 nt, Chlamydophila pneumoniae J138
aaggccuaaucuu

SEQ ID NO: 2560494 - RNA, 18 nt, Chlamydophila pneumoniae J138
aaggccuaaucuuguagc

SEQ ID NO: 2560495 - RNA, 14 nt, Chlamydophila pneumoniae J138
aaggccuauagauu

SEQ ID NO: 2560496 - RNA, 18 nt, Chlamydophila pneumoniae J138
aaggcgccuaacaacuuu

SEQ ID NO: 2560497 - RNA, 22 nt, Chlamydophila pneumoniae J138
aaggcguuuuuuaauucucuga

SEQ ID NO: 2560498 - RNA, 21 nt, Chlamydophila pneumoniae J138
aaggcucucaaggucacagca

SEQ ID NO: 2560499 - RNA, 17 nt, Chlamydophila pneumoniae J138
aaggcugauugaaaguc

SEQ ID NO: 2560500 - RNA, 19 nt, Chlamydophila pneumoniae J138
aaggcugcugauccaaaag

SEQ ID NO: 2560501 - RNA, 19 nt, Chlamydophila pneumoniae J138
aaggcuuguuucuguuuuc

SEQ ID NO: 2560502 - RNA, 13 nt, Chlamydophila pneumoniae J138
aaggcuuugccuu

SEQ ID NO: 2560503 - RNA, 12 nt, Chlamydophila pneumoniae J138
aaggcuuuucug

SEQ ID NO: 2560504 - RNA, 12 nt, Chlamydophila pneumoniae J138
aaggcuuuucuu

SEQ ID NO: 2560505 - RNA, 17 nt, Chlamydophila pneumoniae J138
aaggcuuuucuuuuucu

SEQ ID NO: 2560506 - RNA, 14 nt, Chlamydophila pneumoniae J138
aagggaagagaaaa

SEQ ID NO: 2560507 - RNA, 18 nt, Chlamydophila pneumoniae J138
aagggacuuguuguuuca

SEQ ID NO: 2560508 - RNA, 15 nt, Chlamydophila pneumoniae J138
aagggaucuccuuca

SEQ ID NO: 2560509 - RNA, 19 nt, Chlamydophila pneumoniae J138
aagggaucuccuucaugca

SEQ ID NO: 2560510 - RNA, 20 nt, Chlamydophila pneumoniae J138
aagggaugcucuagaaaacg

SEQ ID NO: 2560511 - RNA, 14 nt, Chlamydophila pneumoniae J138
aagggauucuuguu

SEQ ID NO: 2560512 - RNA, 14 nt, Chlamydophila pneumoniae J138
aagggccagaaacg

SEQ ID NO: 2560513 - RNA, 19 nt, Chlamydophila pneumoniae J138
aaggggaguuuucuuaacu

SEQ ID NO: 2560514 - RNA, 20 nt, Chlamydophila pneumoniae J138
aagggggaucuucagagaga

SEQ ID NO: 2560515 - RNA, 15 nt, Chlamydophila pneumoniae J138
aaggguuguugccag

SEQ ID NO: 2560516 - RNA, 23 nt, Chlamydophila pneumoniae J138
aauaauagcaaguagcucucucc

SEQ ID NO: 2560517 - RNA, 15 nt, Chlamydophila pneumoniae J138
aauaauaggauaaga

SEQ ID NO: 2560518 - RNA, 19 nt, Chlamydophila pneumoniae J138
aauaauaggauaagaaauu

SEQ ID NO: 2560519 - RNA, 15 nt, Chlamydophila pneumoniae J138
aauaaucaaccaaaa

SEQ ID NO: 2560520 - RNA, 19 nt, Chlamydophila pneumoniae J138
aauaaucaaccaaaaugca

SEQ ID NO: 2560521 - RNA, 14 nt, Chlamydophila pneumoniae J138
aauaauguuuuaau

SEQ ID NO: 2560522 - RNA, 12 nt, Chlamydophila pneumoniae J138
aauaauuaaaua

SEQ ID NO: 2560523 - RNA, 13 nt, Chlamydophila pneumoniae J138
aauaauuaaauau

SEQ ID NO: 2560524 - RNA, 12 nt, Chlamydophila pneumoniae J138
aauaauuaaauc

SEQ ID NO: 2560525 - RNA, 14 nt, Chlamydophila pneumoniae J138
aauaauuaaaucgu

SEQ ID NO: 2560526 - RNA, 12 nt, Chlamydophila pneumoniae J138
aauaauuuuccc

SEQ ID NO: 2560527 - RNA, 12 nt, Chlamydophila pneumoniae J138
aauacaaaaaau

SEQ ID NO: 2560528 - RNA, 14 nt, Chlamydophila pneumoniae J138
aauacaaaaaauaa

SEQ ID NO: 2560529 - RNA, 18 nt, Chlamydophila pneumoniae J138
aauacaaaaaauaaaauc

SEQ ID NO: 2560530 - RNA, 20 nt, Chlamydophila pneumoniae J138
aauacaaaaaauaaaaucaa

SEQ ID NO: 2560531 - RNA, 17 nt, Chlamydophila pneumoniae J138
aauacagacagaugcuu

SEQ ID NO: 2560532 - RNA, 17 nt, Chlamydophila pneumoniae J138
aauacagccagcagaag

SEQ ID NO: 2560533 - RNA, 20 nt, Chlamydophila pneumoniae J138
aauacagccagcagaaggcu

SEQ ID NO: 2560534 - RNA, 22 nt, Chlamydophila pneumoniae J138
aauacauagguaaaaccagcau

SEQ ID NO: 2560535 - RNA, 20 nt, Chlamydophila pneumoniae J138
aauacaucaccacugcucca

SEQ ID NO: 2560536 - RNA, 13 nt, Chlamydophila pneumoniae J138
aauacauuccuag

SEQ ID NO: 2560537 - RNA, 21 nt, Chlamydophila pneumoniae J138
aauaccaauugggcuaggguu

SEQ ID NO: 2560538 - RNA, 18 nt, Chlamydophila pneumoniae J138
aauaccagauaaagcaaa

SEQ ID NO: 2560539 - RNA, 22 nt, Chlamydophila pneumoniae J138
aauaccagauaaagcaaagaua

SEQ ID NO: 2560540 - RNA, 21 nt, Chlamydophila pneumoniae J138
aauaccaucucuuucuauuuc

SEQ ID NO: 2560541 - RNA, 17 nt, Chlamydophila pneumoniae J138
aauaccguuuuaggaag

SEQ ID NO: 2560542 - RNA, 21 nt, Chlamydophila pneumoniae J138
aauaccucaaagccaucuucu

SEQ ID NO: 2560543 - RNA, 19 nt, Chlamydophila pneumoniae J138
aauacguaccguauccucu

SEQ ID NO: 2560544 - RNA, 15 nt, Chlamydophila pneumoniae J138
aauacguccagccug

SEQ ID NO: 2560545 - RNA, 17 nt, Chlamydophila pneumoniae J138
aauacguuuuuaggguu

SEQ ID NO: 2560546 - RNA, 12 nt, Chlamydophila pneumoniae J138
aauacuaagaag

SEQ ID NO: 2560547 - RNA, 14 nt, Chlamydophila pneumoniae J138
aauacuccacuuuu

SEQ ID NO: 2560548 - RNA, 16 nt, Chlamydophila pneumoniae J138
aauacuccacuuuuuu

SEQ ID NO: 2560549 - RNA, 18 nt, Chlamydophila pneumoniae J138
aauacucuagguuuucuc

SEQ ID NO: 2560550 - RNA, 21 nt, Chlamydophila pneumoniae J138
aauacucuagguuuucucuuc

SEQ ID NO: 2560551 - RNA, 15 nt, Chlamydophila pneumoniae J138
aauacugcgcaggga

SEQ ID NO: 2560552 - RNA, 18 nt, Chlamydophila pneumoniae J138
aauacuuaggaauuuuuc

SEQ ID NO: 2560553 - RNA, 20 nt, Chlamydophila pneumoniae J138
aauacuuaggaauuuuucua

SEQ ID NO: 2560554 - RNA, 21 nt, Chlamydophila pneumoniae J138
aauacuuaggaauuuuucuag

SEQ ID NO: 2560555 - RNA, 13 nt, Chlamydophila pneumoniae J138
aauacuucuccuc

SEQ ID NO: 2560556 - RNA, 21 nt, Chlamydophila pneumoniae J138
aauagaacgaauuucaacagc

SEQ ID NO: 2560557 - RNA, 20 nt, Chlamydophila pneumoniae J138
aauagaagccaccaucuguu

SEQ ID NO: 2560558 - RNA, 16 nt, Chlamydophila pneumoniae J138
aauagagaaagagugc

SEQ ID NO: 2560559 - RNA, 20 nt, Chlamydophila pneumoniae J138
aauagaggaccgaaaaaccu

SEQ ID NO: 2560560 - RNA, 15 nt, Chlamydophila pneumoniae J138
aauagagucucuuga

SEQ ID NO: 2560561 - RNA, 13 nt, Chlamydophila pneumoniae J138
aauagauucguua

SEQ ID NO: 2560562 - RNA, 21 nt, Chlamydophila pneumoniae J138
aauagauuuuuacuugcccaa

SEQ ID NO: 2560563 - RNA, 22 nt, Chlamydophila pneumoniae J138
aauagcaaagacaucuccugca

SEQ ID NO: 2560564 - RNA, 14 nt, Chlamydophila pneumoniae J138
aauagcaagcacuu

SEQ ID NO: 2560565 - RNA, 15 nt, Chlamydophila pneumoniae J138
aauagcaaguagcuc

SEQ ID NO: 2560566 - RNA, 17 nt, Chlamydophila pneumoniae J138
aauagcaguauagagaa

SEQ ID NO: 2560567 - RNA, 21 nt, Chlamydophila pneumoniae J138
aauagccaaagacucuugaau

SEQ ID NO: 2560568 - RNA, 20 nt, Chlamydophila pneumoniae J138
aauagccauaauuagaacag

SEQ ID NO: 2560569 - RNA, 16 nt, Chlamydophila pneumoniae J138
aauagccucuccuuga

SEQ ID NO: 2560570 - RNA, 19 nt, Chlamydophila pneumoniae J138
aauagcgacaugagaaauc

SEQ ID NO: 2560571 - RNA, 23 nt, Chlamydophila pneumoniae J138
aauagcgacaugagaaaucuuuu

SEQ ID NO: 2560572 - RNA, 14 nt, Chlamydophila pneumoniae J138
aauagcuaaaguga

SEQ ID NO: 2560573 - RNA, 15 nt, Chlamydophila pneumoniae J138
aauagcuaaagugau

SEQ ID NO: 2560574 - RNA, 21 nt, Chlamydophila pneumoniae J138
aauagcucugcgccaugcaca

SEQ ID NO: 2560575 - RNA, 16 nt, Chlamydophila pneumoniae J138
aauagcucuggagauu

SEQ ID NO: 2560576 - RNA, 15 nt, Chlamydophila pneumoniae J138
aauagcucuuuucau

SEQ ID NO: 2560577 - RNA, 18 nt, Chlamydophila pneumoniae J138
aauagcucuuuucaugau

SEQ ID NO: 2560578 - RNA, 19 nt, Chlamydophila pneumoniae J138
aauagcuuacuuucuuuua

SEQ ID NO: 2560579 - RNA, 21 nt, Chlamydophila pneumoniae J138
aauaggaauuagagaaauuuu

SEQ ID NO: 2560580 - RNA, 15 nt, Chlamydophila pneumoniae J138
aauaggauaagaaau

SEQ ID NO: 2560581 - RNA, 18 nt, Chlamydophila pneumoniae J138
aauaggcacccaaacuga

SEQ ID NO: 2560582 - RNA, 14 nt, Chlamydophila pneumoniae J138
aauaggucucuugc

SEQ ID NO: 2560583 - RNA, 14 nt, Chlamydophila pneumoniae J138
aauaguacgcuuuu

SEQ ID NO: 2560584 - RNA, 22 nt, Chlamydophila pneumoniae J138
aauaguugugagacuuucugag

SEQ ID NO: 2560585 - RNA, 14 nt, Chlamydophila pneumoniae J138
aauauaacucucua

SEQ ID NO: 2560586 - RNA, 23 nt, Chlamydophila pneumoniae J138
aauauaacugcauacaaggcaca

SEQ ID NO: 2560587 - RNA, 21 nt, Chlamydophila pneumoniae J138
aauauaauuccaauugccaug

SEQ ID NO: 2560588 - RNA, 17 nt, Chlamydophila pneumoniae J138
aauauacagauguuuuc

SEQ ID NO: 2560589 - RNA, 17 nt, Chlamydophila pneumoniae J138
aauauacucuugcuugc

SEQ ID NO: 2560590 - RNA, 19 nt, Chlamydophila pneumoniae J138
aauauagguuaagccaauc

SEQ ID NO: 2560591 - RNA, 20 nt, Chlamydophila pneumoniae J138
aauauaguuuucauaaucca

SEQ ID NO: 2560592 - RNA, 12 nt, Chlamydophila pneumoniae J138
aauauauaaaga

SEQ ID NO: 2560593 - RNA, 13 nt, Chlamydophila pneumoniae J138
aauaucacauucc

SEQ ID NO: 2560594 - RNA, 15 nt, Chlamydophila pneumoniae J138
aauaucaggacaaug

SEQ ID NO: 2560595 - RNA, 20 nt, Chlamydophila pneumoniae J138
aauaucaggacaaugaagaa

SEQ ID NO: 2560596 - RNA, 14 nt, Chlamydophila pneumoniae J138
aauauccagaaaua

SEQ ID NO: 2560597 - RNA, 18 nt, Chlamydophila pneumoniae J138
aauaucgaguucuuuuug

SEQ ID NO: 2560598 - RNA, 22 nt, Chlamydophila pneumoniae J138
aauaucuccguuaccaaaaacu

SEQ ID NO: 2560599 - RNA, 14 nt, Chlamydophila pneumoniae J138
aauaucucuggcau

SEQ ID NO: 2560600 - RNA, 21 nt, Chlamydophila pneumoniae J138
aauaucucuggcauaauccug

SEQ ID NO: 2560601 - RNA, 22 nt, Chlamydophila pneumoniae J138
aauaucuguggcguaagcaaua

SEQ ID NO: 2560602 - RNA, 15 nt, Chlamydophila pneumoniae J138
aauaugcucugccau

SEQ ID NO: 2560603 - RNA, 18 nt, Chlamydophila pneumoniae J138
aauauggguguaaauuuu

SEQ ID NO: 2560604 - RNA, 18 nt, Chlamydophila pneumoniae J138
aauauguacugaugugaa

SEQ ID NO: 2560605 - RNA, 20 nt, Chlamydophila pneumoniae J138
aauauuaacccaccagaagg

SEQ ID NO: 2560606 - RNA, 18 nt, Chlamydophila pneumoniae J138
aauauugaucuuuccucu

SEQ ID NO: 2560607 - RNA, 18 nt, Chlamydophila pneumoniae J138
aauauuugagaagauaug

SEQ ID NO: 2560608 - RNA, 19 nt, Chlamydophila pneumoniae J138
aauauuuuaccauugagau

SEQ ID NO: 2560609 - RNA, 23 nt, Chlamydophila pneumoniae J138
aauauuuuaccauugagauccau

SEQ ID NO: 2560610 - RNA, 11 nt, Chlamydophila pneumoniae J138
aaucaaauuca

SEQ ID NO: 2560611 - RNA, 12 nt, Chlamydophila pneumoniae J138
aaucaagaagag

SEQ ID NO: 2560612 - RNA, 17 nt, Chlamydophila pneumoniae J138
aaucaagaguuucgaau

SEQ ID NO: 2560613 - RNA, 13 nt, Chlamydophila pneumoniae J138
aaucaagauaaag

SEQ ID NO: 2560614 - RNA, 16 nt, Chlamydophila pneumoniae J138
aaucaagccacagaga

SEQ ID NO: 2560615 - RNA, 17 nt, Chlamydophila pneumoniae J138
aaucaagccacagagaa

SEQ ID NO: 2560616 - RNA, 19 nt, Chlamydophila pneumoniae J138
aaucuggggcuuccagaaa

SEQ ID NO: 2560617 - RNA, 15 nt, Chlamydophila pneumoniae J138
aaucuguaagaaaau

SEQ ID NO: 2560618 - RNA, 19 nt, Chlamydophila pneumoniae J138
aaucugugaguacccaguc

SEQ ID NO: 2560619 - RNA, 23 nt, Chlamydophila pneumoniae J138
aaucugugaguacccagucaucg

SEQ ID NO: 2560620 - RNA, 17 nt, Chlamydophila pneumoniae J138
aaucuuaugggagaagc

SEQ ID NO: 2560621 - RNA, 17 nt, Chlamydophila pneumoniae J138
aaucuuccccuaaaaau

SEQ ID NO: 2560622 - RNA, 20 nt, Chlamydophila pneumoniae J138
aaucuuccuuaaccuccuca

SEQ ID NO: 2560623 - RNA, 17 nt, Chlamydophila pneumoniae J138
aaucuucgauuguaacu

SEQ ID NO: 2560624 - RNA, 19 nt, Chlamydophila pneumoniae J138
aaucuucuuagccaaaauu

SEQ ID NO: 2560625 - RNA, 19 nt, Chlamydophila pneumoniae J138
aaucuugagcauccaaaau

SEQ ID NO: 2560626 - RNA, 21 nt, Chlamydophila pneumoniae J138
aaucuuguagcaauuaccugc

SEQ ID NO: 2560627 - RNA, 18 nt, Chlamydophila pneumoniae J138
aaucuuuaagguugcuuu

SEQ ID NO: 2560628 - RNA, 14 nt, Chlamydophila pneumoniae J138
aaucuuugaagcuc

SEQ ID NO: 2560629 - RNA, 18 nt, Chlamydophila pneumoniae J138
aaucuuuuagaguacaca

SEQ ID NO: 2560630 - RNA, 18 nt, Chlamydophila pneumoniae J138
aaugaaaagagacuguag

SEQ ID NO: 2560631 - RNA, 18 nt, Chlamydophila pneumoniae J138
aaugaaggccaagauucu

SEQ ID NO: 2560632 - RNA, 13 nt, Chlamydophila pneumoniae J138
aaugaaucgaaga

SEQ ID NO: 2560633 - RNA, 21 nt, Chlamydophila pneumoniae J138
aaugaccgcaaggagucacug

SEQ ID NO: 2560634 - RNA, 16 nt, Chlamydophila pneumoniae J138
aaugacgggagcucuu

SEQ ID NO: 2560635 - RNA, 17 nt, Chlamydophila pneumoniae J138
aaugacuaaaugcgagg

SEQ ID NO: 2560636 - RNA, 19 nt, Chlamydophila pneumoniae J138
aaugacucuagaguacccc

SEQ ID NO: 2560637 - RNA, 20 nt, Chlamydophila pneumoniae J138
aaugacuuuagaaauuccaa

SEQ ID NO: 2560638 - RNA, 13 nt, Chlamydophila pneumoniae J138
aaugagacagaca

SEQ ID NO: 2560639 - RNA, 14 nt, Chlamydophila pneumoniae J138
aaugagaucugcaa

SEQ ID NO: 2560640 - RNA, 23 nt, Chlamydophila pneumoniae J138
aaugagcuucacaucuuucucua

SEQ ID NO: 2560641 - RNA, 16 nt, Chlamydophila pneumoniae J138
aaugauacgugcagug

SEQ ID NO: 2560642 - RNA, 13 nt, Chlamydophila pneumoniae J138
aaugauagggaau

SEQ ID NO: 2560643 - RNA, 14 nt, Chlamydophila pneumoniae J138
aaugauauuacaga

SEQ ID NO: 2560644 - RNA, 17 nt, Chlamydophila pneumoniae J138
aaugaucaaaaaugaua

SEQ ID NO: 2560645 - RNA, 13 nt, Chlamydophila pneumoniae J138
aaugauuucucua

SEQ ID NO: 2560646 - RNA, 14 nt, Chlamydophila pneumoniae J138
aaugauuucucuaa

SEQ ID NO: 2560647 - RNA, 16 nt, Chlamydophila pneumoniae J138
aaugcaagcaacucuu

SEQ ID NO: 2560648 - RNA, 19 nt, Chlamydophila pneumoniae J138
aaugcagauagcuuacaga

SEQ ID NO: 2560649 - RNA, 15 nt, Chlamydophila pneumoniae J138
aaugcaugaaucucu

SEQ ID NO: 2560650 - RNA, 14 nt, Chlamydophila pneumoniae J138
aaugccaagggcuu

SEQ ID NO: 2560651 - RNA, 23 nt, Chlamydophila pneumoniae J138
aaugccucuuucauacuaaaauc

SEQ ID NO: 2560652 - RNA, 21 nt, Chlamydophila pneumoniae J138
aaugccuguacuaucuuuuuu

SEQ ID NO: 2560653 - RNA, 20 nt, Chlamydophila pneumoniae J138
aaugcgaugcggucagaaac

SEQ ID NO: 2560654 - RNA, 19 nt, Chlamydophila pneumoniae J138
aaugcggaccuuaagauga

SEQ ID NO: 2560655 - RNA, 23 nt, Chlamydophila pneumoniae J138
aaugcggaccuuaagaugaggua

SEQ ID NO: 2560656 - RNA, 14 nt, Chlamydophila pneumoniae J138
aaugcucacuucuu

SEQ ID NO: 2560657 - RNA, 15 nt, Chlamydophila pneumoniae J138
aaugcucuucugcag

SEQ ID NO: 2560658 - RNA, 19 nt, Chlamydophila pneumoniae J138
aaugcugagggaucuucuc

SEQ ID NO: 2560659 - RNA, 20 nt, Chlamydophila pneumoniae J138
aauggaaacauagaaucauu

SEQ ID NO: 2560660 - RNA, 16 nt, Chlamydophila pneumoniae J138
aauggaaacuuuucca

SEQ ID NO: 2560661 - RNA, 23 nt, Chlamydophila pneumoniae J138
aauggauuccauaggggaugauu

SEQ ID NO: 2560662 - RNA, 21 nt, Chlamydophila pneumoniae J138
aauggcuuuuuuugucccaac

SEQ ID NO: 2560663 - RNA, 21 nt, Chlamydophila pneumoniae J138
aauggguuuuguuucaucuuc

SEQ ID NO: 2560664 - RNA, 15 nt, Chlamydophila pneumoniae J138
aaugguuccugaagc

SEQ ID NO: 2560665 - RNA, 22 nt, Chlamydophila pneumoniae J138
aauguagcuguuccaagagucu

SEQ ID NO: 2560666 - RNA, 16 nt, Chlamydophila pneumoniae J138
aauguagucaugauuu

SEQ ID NO: 2560667 - RNA, 22 nt, Chlamydophila pneumoniae J138
aauguagucaugauuuuucaau

SEQ ID NO: 2560668 - RNA, 15 nt, Chlamydophila pneumoniae J138
aauguauugcaaaua

SEQ ID NO: 2560669 - RNA, 18 nt, Chlamydophila pneumoniae J138
aaugucgucucagaaaaa

SEQ ID NO: 2560670 - RNA, 16 nt, Chlamydophila pneumoniae J138
aaugugcucggcacuu

SEQ ID NO: 2560671 - RNA, 15 nt, Chlamydophila pneumoniae J138
aaugugcuuuugguu

SEQ ID NO: 2560672 - RNA, 15 nt, Chlamydophila pneumoniae J138
aauguggugauuucu

SEQ ID NO: 2560673 - RNA, 22 nt, Chlamydophila pneumoniae J138
aaugugucuugcugauuuuugc

SEQ ID NO: 2560674 - RNA, 22 nt, Chlamydophila pneumoniae J138
aauguugcuaagcgaaccaaag

SEQ ID NO: 2560675 - RNA, 22 nt, Chlamydophila pneumoniae J138
aauguuuagaauuuguccuuug

SEQ ID NO: 2560676 - RNA, 20 nt, Chlamydophila pneumoniae J138
aauguuuaucgacucuucca

SEQ ID NO: 2560677 - RNA, 19 nt, Chlamydophila pneumoniae J138
aauguuuggccaacagcua

SEQ ID NO: 2560678 - RNA, 19 nt, Chlamydophila pneumoniae J138
aauuaaacuuucuucucua

SEQ ID NO: 2560679 - RNA, 15 nt, Chlamydophila pneumoniae J138
aauuaaauauauaaa

SEQ ID NO: 2560680 - RNA, 13 nt, Chlamydophila pneumoniae J138
aauuaaauaucua

SEQ ID NO: 2560681 - RNA, 14 nt, Chlamydophila pneumoniae J138
aauuaacaacacuu

SEQ ID NO: 2560682 - RNA, 13 nt, Chlamydophila pneumoniae J138
aauuaacagagcg

SEQ ID NO: 2560683 - RNA, 15 nt, Chlamydophila pneumoniae J138
aauuaacagagcgcc

SEQ ID NO: 2560684 - RNA, 13 nt, Chlamydophila pneumoniae J138
aauuaauaaaaga

SEQ ID NO: 2560685 - RNA, 18 nt, Chlamydophila pneumoniae J138
aauuaccuugagacaaag

SEQ ID NO: 2560686 - RNA, 20 nt, Chlamydophila pneumoniae J138
aauuacucgcucugcacgga

SEQ ID NO: 2560687 - RNA, 15 nt, Chlamydophila pneumoniae J138
aauuagaacagcaug

SEQ ID NO: 2560688 - RNA, 19 nt, Chlamydophila pneumoniae J138
aauuagagaaauuuuuaau

SEQ ID NO: 2560689 - RNA, 12 nt, Chlamydophila pneumoniae J138
aauuaguaaaug

SEQ ID NO: 2560690 - RNA, 16 nt, Chlamydophila pneumoniae J138
aauuaguaaaugccuc

SEQ ID NO: 2560691 - RNA, 22 nt, Chlamydophila pneumoniae J138
aauuaguaaaugccucuuucau

SEQ ID NO: 2560692 - RNA, 22 nt, Chlamydophila pneumoniae J138
aauuaguuucacauaguuuaau

SEQ ID NO: 2560693 - RNA, 14 nt, Chlamydophila pneumoniae J138
aauuaucagagaca

SEQ ID NO: 2560694 - RNA, 13 nt, Chlamydophila pneumoniae J138
aauuauuaaacuc

SEQ ID NO: 2560695 - RNA, 16 nt, Chlamydophila pneumoniae J138
aauucaaacuccuuuu

SEQ ID NO: 2560696 - RNA, 13 nt, Chlamydophila pneumoniae J138
aauucagagaaag

SEQ ID NO: 2560697 - RNA, 13 nt, Chlamydophila pneumoniae J138
aauucauauuuac

SEQ ID NO: 2560698 - RNA, 15 nt, Chlamydophila pneumoniae J138
aauucauauuuacga

SEQ ID NO: 2560699 - RNA, 15 nt, Chlamydophila pneumoniae J138
aauucaugcaaaaca

SEQ ID NO: 2560700 - RNA, 18 nt, Chlamydophila pneumoniae J138
aauuccaaaauaaaagga

SEQ ID NO: 2560701 - RNA, 21 nt, Chlamydophila pneumoniae J138
aauuccagaaaaagaacauaa

SEQ ID NO: 2560702 - RNA, 15 nt, Chlamydophila pneumoniae J138
aauuccaucuggaau

SEQ ID NO: 2560703 - RNA, 21 nt, Chlamydophila pneumoniae J138
aauuccccguguuuggagaag

SEQ ID NO: 2560704 - RNA, 15 nt, Chlamydophila pneumoniae J138
aauuccgaagaagaa

SEQ ID NO: 2560705 - RNA, 16 nt, Chlamydophila pneumoniae J138
aauuccuucucagaaa

SEQ ID NO: 2560706 - RNA, 14 nt, Chlamydophila pneumoniae J138
aauuccuuggauuc

SEQ ID NO: 2560707 - RNA, 18 nt, Chlamydophila pneumoniae J138
aauucgaauucucagaaa

SEQ ID NO: 2560708 - RNA, 23 nt, Chlamydophila pneumoniae J138
aauucgauguuaaggcuuccaau

SEQ ID NO: 2560709 - RNA, 16 nt, Chlamydophila pneumoniae J138
aauucggcagaaggcu

SEQ ID NO: 2560710 - RNA, 19 nt, Chlamydophila pneumoniae J138
aauucggcagaaggcuugu

SEQ ID NO: 2560711 - RNA, 15 nt, Chlamydophila pneumoniae J138
aauucgguagagcua

SEQ ID NO: 2560712 - RNA, 23 nt, Chlamydophila pneumoniae J138
aauucuauuuauuuuauuaguuu

SEQ ID NO: 2560713 - RNA, 14 nt, Chlamydophila pneumoniae J138
aauucucagaaagc

SEQ ID NO: 2560714 - RNA, 16 nt, Chlamydophila pneumoniae J138
aauucucagauugcuu

SEQ ID NO: 2560715 - RNA, 19 nt, Chlamydophila pneumoniae J138
aauucucgagcagcugcac

SEQ ID NO: 2560716 - RNA, 21 nt, Chlamydophila pneumoniae J138
acaacgccuacauggaucccu

SEQ ID NO: 2560717 - RNA, 17 nt, Chlamydophila pneumoniae J138
acaacgcugcuucucua

SEQ ID NO: 2560718 - RNA, 22 nt, Chlamydophila pneumoniae J138
acaacgcugcuucucuacuaaa

SEQ ID NO: 2560719 - RNA, 23 nt, Chlamydophila pneumoniae J138
acaacgcugcuucucuacuaaaa

SEQ ID NO: 2560720 - RNA, 15 nt, Chlamydophila pneumoniae J138
acaacuagaccaaua

SEQ ID NO: 2560721 - RNA, 22 nt, Chlamydophila pneumoniae J138
acaacuagaccaauaaauccaa

SEQ ID NO: 2560722 - RNA, 19 nt, Chlamydophila pneumoniae J138
acaacugugguuuuaaaaa

SEQ ID NO: 2560723 - RNA, 15 nt, Chlamydophila pneumoniae J138
acaacuucugacaau

SEQ ID NO: 2560724 - RNA, 17 nt, Chlamydophila pneumoniae J138
acaacuucugacaauaa

SEQ ID NO: 2560725 - RNA, 15 nt, Chlamydophila pneumoniae J138
acaacuuugaggcaa

SEQ ID NO: 2560726 - RNA, 13 nt, Chlamydophila pneumoniae J138
acaagaaaacaaa

SEQ ID NO: 2560727 - RNA, 20 nt, Chlamydophila pneumoniae J138
acaagaaccuguuuuucuaa

SEQ ID NO: 2560728 - RNA, 16 nt, Chlamydophila pneumoniae J138
acaagaagaucaaaga

SEQ ID NO: 2560729 - RNA, 14 nt, Chlamydophila pneumoniae J138
acaagagagagcug

SEQ ID NO: 2560730 - RNA, 13 nt, Chlamydophila pneumoniae J138
acaagauaguggu

SEQ ID NO: 2560731 - RNA, 21 nt, Chlamydophila pneumoniae J138
acaagcaguaacugcaaagag

SEQ ID NO: 2560732 - RNA, 23 nt, Chlamydophila pneumoniae J138
acaagcaguaacugcaaagagaa

SEQ ID NO: 2560733 - RNA, 19 nt, Chlamydophila pneumoniae J138
acaagccucccuaugugaa

SEQ ID NO: 2560734 - RNA, 15 nt, Chlamydophila pneumoniae J138
acaagcuucaucaaa

SEQ ID NO: 2560735 - RNA, 19 nt, Chlamydophila pneumoniae J138
acaagcuucaucaaaacau

SEQ ID NO: 2560736 - RNA, 22 nt, Chlamydophila pneumoniae J138
acaagcuucaucaaaacauaau

SEQ ID NO: 2560737 - RNA, 14 nt, Chlamydophila pneumoniae J138
acaagcuuccuugg

SEQ ID NO: 2560738 - RNA, 23 nt, Chlamydophila pneumoniae J138
acaagcuucguccugacacaacu

SEQ ID NO: 2560739 - RNA, 23 nt, Chlamydophila pneumoniae J138
acaaggauuuugagacgaaagag

SEQ ID NO: 2560740 - RNA, 16 nt, Chlamydophila pneumoniae J138
acaagggaaagaaacu

SEQ ID NO: 2560741 - RNA, 17 nt, Chlamydophila pneumoniae J138
acaagggauucuuguug

SEQ ID NO: 2560742 - RNA, 15 nt, Chlamydophila pneumoniae J138
acaaggucuuuuccu

SEQ ID NO: 2560743 - RNA, 16 nt, Chlamydophila pneumoniae J138
acaaguaccaagaaaa

SEQ ID NO: 2560744 - RNA, 22 nt, Chlamydophila pneumoniae J138
acaaguacgacgaaguuagcua

SEQ ID NO: 2560745 - RNA, 21 nt, Chlamydophila pneumoniae J138
acaagugcauuaucuaagaau

SEQ ID NO: 2560746 - RNA, 15 nt, Chlamydophila pneumoniae J138
acaaguucuaccuau

SEQ ID NO: 2560747 - RNA, 17 nt, Chlamydophila pneumoniae J138
acaaguuuuuucaaucc

SEQ ID NO: 2560748 - RNA, 13 nt, Chlamydophila pneumoniae J138
acaauaaaaaaga

SEQ ID NO: 2560749 - RNA, 22 nt, Chlamydophila pneumoniae J138
acaauaaccaggggcuuuccuu

SEQ ID NO: 2560750 - RNA, 16 nt, Chlamydophila pneumoniae J138
acaauaagaaaauccu

SEQ ID NO: 2560751 - RNA, 16 nt, Chlamydophila pneumoniae J138
acaauaccaucucuuu

SEQ ID NO: 2560752 - RNA, 21 nt, Chlamydophila pneumoniae J138
acaauaggcacccaaacugau

SEQ ID NO: 2560753 - RNA, 14 nt, Chlamydophila pneumoniae J138
acaauauaaaugcu

SEQ ID NO: 2560754 - RNA, 14 nt, Chlamydophila pneumoniae J138
acaauauaagcacc

SEQ ID NO: 2560755 - RNA, 17 nt, Chlamydophila pneumoniae J138
acaauauagagaucuag

SEQ ID NO: 2560756 - RNA, 17 nt, Chlamydophila pneumoniae J138
acaauccucacuauuaa

SEQ ID NO: 2560757 - RNA, 19 nt, Chlamydophila pneumoniae J138
acaauccucacuauuaaua

SEQ ID NO: 2560758 - RNA, 22 nt, Chlamydophila pneumoniae J138
acaauccucacuauuaauacuu

SEQ ID NO: 2560759 - RNA, 20 nt, Chlamydophila pneumoniae J138
acaaucgugauugcugucag

SEQ ID NO: 2560760 - RNA, 21 nt, Chlamydophila pneumoniae J138
acaaucuacggcauaaccuuu

SEQ ID NO: 2560761 - RNA, 19 nt, Chlamydophila pneumoniae J138
acaaucucgcuauuccaua

SEQ ID NO: 2560762 - RNA, 22 nt, Chlamydophila pneumoniae J138
acaaugaagaacuacucucauu

SEQ ID NO: 2560763 - RNA, 16 nt, Chlamydophila pneumoniae J138
acaaugaucuuucgaa

SEQ ID NO: 2560764 - RNA, 14 nt, Chlamydophila pneumoniae J138
acaaugcuaucucc

SEQ ID NO: 2560765 - RNA, 17 nt, Chlamydophila pneumoniae J138
acaaugcuaucuccaga

SEQ ID NO: 2560766 - RNA, 12 nt, Chlamydophila pneumoniae J138
acaauggaaaua

SEQ ID NO: 2560767 - RNA, 12 nt, Chlamydophila pneumoniae J138
acaauguuuaga

SEQ ID NO: 2560768 - RNA, 17 nt, Chlamydophila pneumoniae J138
acaauguuuagaauuug

SEQ ID NO: 2560769 - RNA, 13 nt, Chlamydophila pneumoniae J138
acaauuccuaaaa

SEQ ID NO: 2560770 - RNA, 20 nt, Chlamydophila pneumoniae J138
acaauuccuaaaacaagaag

SEQ ID NO: 2560771 - RNA, 21 nt, Chlamydophila pneumoniae J138
acaauuguaaauacaaaacaa

SEQ ID NO: 2560772 - RNA, 15 nt, Chlamydophila pneumoniae J138
acaauuuaaaucugc

SEQ ID NO: 2560773 - RNA, 19 nt, Chlamydophila pneumoniae J138
acaauuuaaaucugcaaga

SEQ ID NO: 2560774 - RNA, 16 nt, Chlamydophila pneumoniae J138
acaauuugcuccucca

SEQ ID NO: 2560775 - RNA, 12 nt, Chlamydophila pneumoniae J138
acaauuuuaaaa

SEQ ID NO: 2560776 - RNA, 20 nt, Chlamydophila pneumoniae J138
acaauuuuaaaaucuccucu

SEQ ID NO: 2560777 - RNA, 15 nt, Chlamydophila pneumoniae J138
acacaaguucuaccu

SEQ ID NO: 2560778 - RNA, 16 nt, Chlamydophila pneumoniae J138
acacagagaacaauaa

SEQ ID NO: 2560779 - RNA, 20 nt, Chlamydophila pneumoniae J138
acacagagaugcuucuaaac

SEQ ID NO: 2560780 - RNA, 16 nt, Chlamydophila pneumoniae J138
acacauugucucuuuu

SEQ ID NO: 2560781 - RNA, 20 nt, Chlamydophila pneumoniae J138
acacauugucucuuuuaaag

SEQ ID NO: 2560782 - RNA, 16 nt, Chlamydophila pneumoniae J138
acaccaaaagaauacu

SEQ ID NO: 2560783 - RNA, 17 nt, Chlamydophila pneumoniae J138
acaccaaaagaauacuc

SEQ ID NO: 2560784 - RNA, 12 nt, Chlamydophila pneumoniae J138
acaccaaauccu

SEQ ID NO: 2560785 - RNA, 14 nt, Chlamydophila pneumoniae J138
acaccaaauccugc

SEQ ID NO: 2560786 - RNA, 16 nt, Chlamydophila pneumoniae J138
acaccaacaacaauaa

SEQ ID NO: 2560787 - RNA, 17 nt, Chlamydophila pneumoniae J138
acaccagcucgagaucu

SEQ ID NO: 2560788 - RNA, 14 nt, Chlamydophila pneumoniae J138
acaccaggaagucc

SEQ ID NO: 2560789 - RNA, 22 nt, Chlamydophila pneumoniae J138
acaccaggaaguccgauagcaa

SEQ ID NO: 2560790 - RNA, 20 nt, Chlamydophila pneumoniae J138
acaccaggaguuggagaauu

SEQ ID NO: 2560791 - RNA, 14 nt, Chlamydophila pneumoniae J138
acaccauagaacug

SEQ ID NO: 2560792 - RNA, 16 nt, Chlamydophila pneumoniae J138
acaccaucacauccug

SEQ ID NO: 2560793 - RNA, 13 nt, Chlamydophila pneumoniae J138
acaccaucuuuaa

SEQ ID NO: 2560794 - RNA, 15 nt, Chlamydophila pneumoniae J138
acaccauuuuugaau

SEQ ID NO: 2560795 - RNA, 17 nt, Chlamydophila pneumoniae J138
acacccccgcagcuucu

SEQ ID NO: 2560796 - RNA, 21 nt, Chlamydophila pneumoniae J138
acacccucggauaggcuggaa

SEQ ID NO: 2560797 - RNA, 14 nt, Chlamydophila pneumoniae J138
acaccgaaagaaau

SEQ ID NO: 2560798 - RNA, 13 nt, Chlamydophila pneumoniae J138
acacgaauaauua

SEQ ID NO: 2560799 - RNA, 16 nt, Chlamydophila pneumoniae J138
acacgaauaauuaaau

SEQ ID NO: 2560800 - RNA, 14 nt, Chlamydophila pneumoniae J138
acacgaauuucuaa

SEQ ID NO: 2560801 - RNA, 13 nt, Chlamydophila pneumoniae J138
acacgacgaggac

SEQ ID NO: 2560802 - RNA, 15 nt, Chlamydophila pneumoniae J138
acacgaggagccucu

SEQ ID NO: 2560803 - RNA, 19 nt, Chlamydophila pneumoniae J138
acacgccuccuucaaagau

SEQ ID NO: 2560804 - RNA, 16 nt, Chlamydophila pneumoniae J138
acacgcuauagcaaca

SEQ ID NO: 2560805 - RNA, 16 nt, Chlamydophila pneumoniae J138
acacggacacuauuau

SEQ ID NO: 2560806 - RNA, 22 nt, Chlamydophila pneumoniae J138
acacuauguguuuccuuuucuc

SEQ ID NO: 2560807 - RNA, 21 nt, Chlamydophila pneumoniae J138
acacucaaaucuuucaaggaa

SEQ ID NO: 2560808 - RNA, 22 nt, Chlamydophila pneumoniae J138
acacucaaauucaaaauagaag

SEQ ID NO: 2560809 - RNA, 13 nt, Chlamydophila pneumoniae J138
acacucagagaug

SEQ ID NO: 2560810 - RNA, 17 nt, Chlamydophila pneumoniae J138
acacucagcucccaugu

SEQ ID NO: 2560811 - RNA, 14 nt, Chlamydophila pneumoniae J138
acacuccucagaau

SEQ ID NO: 2560812 - RNA, 13 nt, Chlamydophila pneumoniae J138
acacugcgagaga

SEQ ID NO: 2560813 - RNA, 20 nt, Chlamydophila pneumoniae J138
acacugguagcuaaauuuag

SEQ ID NO: 2560814 - RNA, 19 nt, Chlamydophila pneumoniae J138
acacuuaaagguaaaacua

SEQ ID NO: 2560815 - RNA, 20 nt, Chlamydophila pneumoniae J138
acacuuccuacggcaagaau

SEQ ID NO: 2560816 - RNA, 19 nt, Chlamydophila pneumoniae J138
acaucuuguucugcacgug

SEQ ID NO: 2560817 - RNA, 15 nt, Chlamydophila pneumoniae J138
acaucuuuagaauca

SEQ ID NO: 2560818 - RNA, 13 nt, Chlamydophila pneumoniae J138
acaucuuucucua

SEQ ID NO: 2560819 - RNA, 23 nt, Chlamydophila pneumoniae J138
acaucuuuguggggcaguaggua

SEQ ID NO: 2560820 - RNA, 14 nt, Chlamydophila pneumoniae J138
acaugacaaauaaa

SEQ ID NO: 2560821 - RNA, 16 nt, Chlamydophila pneumoniae J138
acaugacaaauaaacu

SEQ ID NO: 2560822 - RNA, 17 nt, Chlamydophila pneumoniae J138
acaugacaaauaaacug

SEQ ID NO: 2560823 - RNA, 19 nt, Chlamydophila pneumoniae J138
acaugacaaauaaacugac

SEQ ID NO: 2560824 - RNA, 20 nt, Chlamydophila pneumoniae J138
acaugaggauucuuuuugau

SEQ ID NO: 2560825 - RNA, 13 nt, Chlamydophila pneumoniae J138
acaugcccaaaca

SEQ ID NO: 2560826 - RNA, 13 nt, Chlamydophila pneumoniae J138
acaugccugaaaa

SEQ ID NO: 2560827 - RNA, 14 nt, Chlamydophila pneumoniae J138
acaugccuuaggcu

SEQ ID NO: 2560828 - RNA, 23 nt, Chlamydophila pneumoniae J138
acaugcgcagaauaaaauggccu

SEQ ID NO: 2560829 - RNA, 16 nt, Chlamydophila pneumoniae J138
acaugcgcguauaagg

SEQ ID NO: 2560830 - RNA, 21 nt, Chlamydophila pneumoniae J138
acaugcuaauccagcaacaac

SEQ ID NO: 2560831 - RNA, 15 nt, Chlamydophila pneumoniae J138
acaugcucaagaaga

SEQ ID NO: 2560832 - RNA, 18 nt, Chlamydophila pneumoniae J138
acaugcucaagaagauga

SEQ ID NO: 2560833 - RNA, 14 nt, Chlamydophila pneumoniae J138
acaugcuuuccuuc

SEQ ID NO: 2560834 - RNA, 19 nt, Chlamydophila pneumoniae J138
acauggccaaaaaucuuau

SEQ ID NO: 2560835 - RNA, 13 nt, Chlamydophila pneumoniae J138
acauguaaacaaa

SEQ ID NO: 2560836 - RNA, 20 nt, Chlamydophila pneumoniae J138
acauguaaacaaaagcagac

SEQ ID NO: 2560837 - RNA, 22 nt, Chlamydophila pneumoniae J138
acauuaagcucaaaauuuccuc

SEQ ID NO: 2560838 - RNA, 22 nt, Chlamydophila pneumoniae J138
acauuaccguucccuaaaguaa

SEQ ID NO: 2560839 - RNA, 13 nt, Chlamydophila pneumoniae J138
acauuagagagug

SEQ ID NO: 2560840 - RNA, 22 nt, Chlamydophila pneumoniae J138
acauuagcgacgacgacgccua

SEQ ID NO: 2560841 - RNA, 23 nt, Chlamydophila pneumoniae J138
acauucauuuuuuaauaaaauuu

SEQ ID NO: 2560842 - RNA, 22 nt, Chlamydophila pneumoniae J138
acauuccaagaaaaauucuucg

SEQ ID NO: 2560843 - RNA, 18 nt, Chlamydophila pneumoniae J138
acauuccuuaauuacucg

SEQ ID NO: 2560844 - RNA, 16 nt, Chlamydophila pneumoniae J138
acauucgcaagaauga

SEQ ID NO: 2560845 - RNA, 20 nt, Chlamydophila pneumoniae J138
acauucuaacgcuuuuucaa

SEQ ID NO: 2560846 - RNA, 15 nt, Chlamydophila pneumoniae J138
acauucuuaauaucu

SEQ ID NO: 2560847 - RNA, 17 nt, Chlamydophila pneumoniae J138
acauucuuaauaucuac

SEQ ID NO: 2560848 - RNA, 13 nt, Chlamydophila pneumoniae J138
acauucuucugau

SEQ ID NO: 2560849 - RNA, 17 nt, Chlamydophila pneumoniae J138
acauucuucugucugua

SEQ ID NO: 2560850 - RNA, 21 nt, Chlamydophila pneumoniae J138
acauucuucugucuguauuuc

SEQ ID NO: 2560851 - RNA, 18 nt, Chlamydophila pneumoniae J138
acauugaccuaaaggaau

SEQ ID NO: 2560852 - RNA, 23 nt, Chlamydophila pneumoniae J138
acauugcgggcucaaagaaaguc

SEQ ID NO: 2560853 - RNA, 21 nt, Chlamydophila pneumoniae J138
acauugcugccaggcuuaaau

SEQ ID NO: 2560854 - RNA, 22 nt, Chlamydophila pneumoniae J138
acauugcugccaggcuuaaaua

SEQ ID NO: 2560855 - RNA, 14 nt, Chlamydophila pneumoniae J138
acauuguuuaaguc

SEQ ID NO: 2560856 - RNA, 20 nt, Chlamydophila pneumoniae J138
acauuuaagucauuagcaag

SEQ ID NO: 2560857 - RNA, 13 nt, Chlamydophila pneumoniae J138
acauuuagaagua

SEQ ID NO: 2560858 - RNA, 15 nt, Chlamydophila pneumoniae J138
acauuuagauaaaga

SEQ ID NO: 2560859 - RNA, 22 nt, Chlamydophila pneumoniae J138
acauuuccccaugaaaauacaa

SEQ ID NO: 2560860 - RNA, 15 nt, Chlamydophila pneumoniae J138
acauuucguuuuuuc

SEQ ID NO: 2560861 - RNA, 18 nt, Chlamydophila pneumoniae J138
acauuugcagacacaaaa

SEQ ID NO: 2560862 - RNA, 19 nt, Chlamydophila pneumoniae J138
acauuuguugucagcuuug

SEQ ID NO: 2560863 - RNA, 20 nt, Chlamydophila pneumoniae J138
acauuuugccuuuagggaaa

SEQ ID NO: 2560864 - RNA, 19 nt, Chlamydophila pneumoniae J138
acauuuuuauuuccuuauc

SEQ ID NO: 2560865 - RNA, 16 nt, Chlamydophila pneumoniae J138
accaaaaauaaacaua

SEQ ID NO: 2560866 - RNA, 19 nt, Chlamydophila pneumoniae J138
accaaaagaauuccuaaaa

SEQ ID NO: 2560867 - RNA, 15 nt, Chlamydophila pneumoniae J138
accaaauaauuaaau

SEQ ID NO: 2560868 - RNA, 22 nt, Chlamydophila pneumoniae J138
accaaaucaucgcaaucaaaga

SEQ ID NO: 2560869 - RNA, 17 nt, Chlamydophila pneumoniae J138
accaacacuuuuaaaga

SEQ ID NO: 2560870 - RNA, 15 nt, Chlamydophila pneumoniae J138
accaacaucaaagaa

SEQ ID NO: 2560871 - RNA, 19 nt, Chlamydophila pneumoniae J138
accaaccuuguugaaaggc

SEQ ID NO: 2560872 - RNA, 18 nt, Chlamydophila pneumoniae J138
accaacuccucaaaagau

SEQ ID NO: 2560873 - RNA, 19 nt, Chlamydophila pneumoniae J138
accaacuccucaaaagaua

SEQ ID NO: 2560874 - RNA, 22 nt, Chlamydophila pneumoniae J138
accaacuccucaaaagauaucg

SEQ ID NO: 2560875 - RNA, 16 nt, Chlamydophila pneumoniae J138
accaagaaaucucagu

SEQ ID NO: 2560876 - RNA, 17 nt, Chlamydophila pneumoniae J138
accaagacaauggaaau

SEQ ID NO: 2560877 - RNA, 15 nt, Chlamydophila pneumoniae J138
accaagaugucucca

SEQ ID NO: 2560878 - RNA, 23 nt, Chlamydophila pneumoniae J138
accaagaugucuccaaagauaca

SEQ ID NO: 2560879 - RNA, 21 nt, Chlamydophila pneumoniae J138
accaaggcugcugauccaaaa

SEQ ID NO: 2560880 - RNA, 23 nt, Chlamydophila pneumoniae J138
accaaggggcguucuugaaaaaa

SEQ ID NO: 2560881 - RNA, 16 nt, Chlamydophila pneumoniae J138
accaaguaaaucagac

SEQ ID NO: 2560882 - RNA, 20 nt, Chlamydophila pneumoniae J138
accaaguaaaucagacuuaa

SEQ ID NO: 2560883 - RNA, 22 nt, Chlamydophila pneumoniae J138
accaaguacaguaucgacuuuu

SEQ ID NO: 2560884 - RNA, 21 nt, Chlamydophila pneumoniae J138
accaauaaccgaaacuucuca

SEQ ID NO: 2560885 - RNA, 14 nt, Chlamydophila pneumoniae J138
accaauaugcucug

SEQ ID NO: 2560886 - RNA, 20 nt, Chlamydophila pneumoniae J138
accaauccggcauaaaaaag

SEQ ID NO: 2560887 - RNA, 18 nt, Chlamydophila pneumoniae J138
accaauucucucucugca

SEQ ID NO: 2560888 - RNA, 16 nt, Chlamydophila pneumoniae J138
accaauugcagucacu

SEQ ID NO: 2560889 - RNA, 22 nt, Chlamydophila pneumoniae J138
accacaauuccuaaaacaagaa

SEQ ID NO: 2560890 - RNA, 24 nt, Chlamydophila pneumoniae J138
accacaauuccuaaaacaagaaga

SEQ ID NO: 2560891 - RNA, 19 nt, Chlamydophila pneumoniae J138
accacagcuguacagaaca

SEQ ID NO: 2560892 - RNA, 21 nt, Chlamydophila pneumoniae J138
accacagcuguacagaacaau

SEQ ID NO: 2560893 - RNA, 19 nt, Chlamydophila pneumoniae J138
accacauacucuucauccu

SEQ ID NO: 2560894 - RNA, 22 nt, Chlamydophila pneumoniae J138
accacgaacuucagcaagaaaa

SEQ ID NO: 2560895 - RNA, 17 nt, Chlamydophila pneumoniae J138
accacggauuuucucua

SEQ ID NO: 2560896 - RNA, 15 nt, Chlamydophila pneumoniae J138
accacguccauuuca

SEQ ID NO: 2560897 - RNA, 20 nt, Chlamydophila pneumoniae J138
accacuaccgaauuuucaau

SEQ ID NO: 2560898 - RNA, 22 nt, Chlamydophila pneumoniae J138
accacuguccaugcacgagauu

SEQ ID NO: 2560899 - RNA, 17 nt, Chlamydophila pneumoniae J138
accacuucauauaaaac

SEQ ID NO: 2560900 - RNA, 19 nt, Chlamydophila pneumoniae J138
accacuuuagaauuuucuu

SEQ ID NO: 2560901 - RNA, 14 nt, Chlamydophila pneumoniae J138
accagaagacuccc

SEQ ID NO: 2560902 - RNA, 15 nt, Chlamydophila pneumoniae J138
accagaugauuuuuu

SEQ ID NO: 2560903 - RNA, 15 nt, Chlamydophila pneumoniae J138
accagaugcuaaaga

SEQ ID NO: 2560904 - RNA, 21 nt, Chlamydophila pneumoniae J138
accagcauuaagauaaacagc

SEQ ID NO: 2560905 - RNA, 23 nt, Chlamydophila pneumoniae J138
accagcauuaagauaaacagcac

SEQ ID NO: 2560906 - RNA, 23 nt, Chlamydophila pneumoniae J138
accagcucgagaucuuuuugcca

SEQ ID NO: 2560907 - RNA, 19 nt, Chlamydophila pneumoniae J138
accaggagcuccuccuuga

SEQ ID NO: 2560908 - RNA, 14 nt, Chlamydophila pneumoniae J138
accauaaagaauuc

SEQ ID NO: 2560909 - RNA, 17 nt, Chlamydophila pneumoniae J138
accauaaggagauuccu

SEQ ID NO: 2560910 - RNA, 19 nt, Chlamydophila pneumoniae J138
accauacacaaaucauuua

SEQ ID NO: 2560911 - RNA, 16 nt, Chlamydophila pneumoniae J138
accauauucucaggaa

SEQ ID NO: 2560912 - RNA, 18 nt, Chlamydophila pneumoniae J138
accaucaagguauuggaa

SEQ ID NO: 2560913 - RNA, 13 nt, Chlamydophila pneumoniae J138
accaucaaugaga

SEQ ID NO: 2560914 - RNA, 16 nt, Chlamydophila pneumoniae J138
accauccgacuuuccu

SEQ ID NO: 2560915 - RNA, 22 nt, Chlamydophila pneumoniae J138
acgaauugcuugcgcaucagca

SEQ ID NO: 2560916 - RNA, 19 nt, Chlamydophila pneumoniae J138
acgaauuucaacagcuuca

SEQ ID NO: 2560917 - RNA, 24 nt, Chlamydophila pneumoniae J138
acgaauuucuuguuccaauagagu

SEQ ID NO: 2560918 - RNA, 14 nt, Chlamydophila pneumoniae J138
acgacaaggacagg

SEQ ID NO: 2560919 - RNA, 18 nt, Chlamydophila pneumoniae J138
acgacauacaucaaaaug

SEQ ID NO: 2560920 - RNA, 17 nt, Chlamydophila pneumoniae J138
acgaccaacuccucaaa

SEQ ID NO: 2560921 - RNA, 16 nt, Chlamydophila pneumoniae J138
acgaccucgaauuccu

SEQ ID NO: 2560922 - RNA, 11 nt, Chlamydophila pneumoniae J138
acgacgaggac

SEQ ID NO: 2560923 - RNA, 20 nt, Chlamydophila pneumoniae J138
acgacguuuaauuccuugga

SEQ ID NO: 2560924 - RNA, 16 nt, Chlamydophila pneumoniae J138
acgacguuuugcugug

SEQ ID NO: 2560925 - RNA, 14 nt, Chlamydophila pneumoniae J138
acgacucugccaug

SEQ ID NO: 2560926 - RNA, 18 nt, Chlamydophila pneumoniae J138
acgacucugccaugucua

SEQ ID NO: 2560927 - RNA, 20 nt, Chlamydophila pneumoniae J138
acgagaaccaaagcagugua

SEQ ID NO: 2560928 - RNA, 19 nt, Chlamydophila pneumoniae J138
acgagaaguuugauaagcu

SEQ ID NO: 2560929 - RNA, 21 nt, Chlamydophila pneumoniae J138
acgagaccucaccuggaucua

SEQ ID NO: 2560930 - RNA, 17 nt, Chlamydophila pneumoniae J138
acgagacugcaaaggaa

SEQ ID NO: 2560931 - RNA, 20 nt, Chlamydophila pneumoniae J138
acgaggagaagucgaaagau

SEQ ID NO: 2560932 - RNA, 13 nt, Chlamydophila pneumoniae J138
acgaggagcuuuu

SEQ ID NO: 2560933 - RNA, 18 nt, Chlamydophila pneumoniae J138
acgauauuuagagagaaa

SEQ ID NO: 2560934 - RNA, 22 nt, Chlamydophila pneumoniae J138
acgaucaaauuccuucucagaa

SEQ ID NO: 2560935 - RNA, 21 nt, Chlamydophila pneumoniae J138
acgaucacauuccaagaaaaa

SEQ ID NO: 2560936 - RNA, 14 nt, Chlamydophila pneumoniae J138
acgauccaucucau

SEQ ID NO: 2560937 - RNA, 17 nt, Chlamydophila pneumoniae J138
acgaucgcgauaagaag

SEQ ID NO: 2560938 - RNA, 20 nt, Chlamydophila pneumoniae J138
acgaucgucaguaaaacaca

SEQ ID NO: 2560939 - RNA, 22 nt, Chlamydophila pneumoniae J138
acgaucuacguuggacugcaag

SEQ ID NO: 2560940 - RNA, 21 nt, Chlamydophila pneumoniae J138
acgauucuaggccuaaagaau

SEQ ID NO: 2560941 - RNA, 21 nt, Chlamydophila pneumoniae J138
acgcaaaguacuaauuacaga

SEQ ID NO: 2560942 - RNA, 18 nt, Chlamydophila pneumoniae J138
acgcaagagacaagaaaa

SEQ ID NO: 2560943 - RNA, 15 nt, Chlamydophila pneumoniae J138
acgcacauuuagaag

SEQ ID NO: 2560944 - RNA, 13 nt, Chlamydophila pneumoniae J138
acgcacgccaaga

SEQ ID NO: 2560945 - RNA, 20 nt, Chlamydophila pneumoniae J138
acgcagagaugcuaacaacu

SEQ ID NO: 2560946 - RNA, 21 nt, Chlamydophila pneumoniae J138
acgcauaagagacauuucuug

SEQ ID NO: 2560947 - RNA, 15 nt, Chlamydophila pneumoniae J138
acgcaugacgcuuuu

SEQ ID NO: 2560948 - RNA, 18 nt, Chlamydophila pneumoniae J138
acgcccacggaaagcaca

SEQ ID NO: 2560949 - RNA, 21 nt, Chlamydophila pneumoniae J138
acgccgcucuugauagcuaag

SEQ ID NO: 2560950 - RNA, 18 nt, Chlamydophila pneumoniae J138
acgccuccuucaaagaua

SEQ ID NO: 2560951 - RNA, 13 nt, Chlamydophila pneumoniae J138
acgcuaagcucuu

SEQ ID NO: 2560952 - RNA, 20 nt, Chlamydophila pneumoniae J138
acgcuaagcucuuaauuucu

SEQ ID NO: 2560953 - RNA, 18 nt, Chlamydophila pneumoniae J138
acgcuacgguacuuuaca

SEQ ID NO: 2560954 - RNA, 17 nt, Chlamydophila pneumoniae J138
acgcucuccauggcuuc

SEQ ID NO: 2560955 - RNA, 16 nt, Chlamydophila pneumoniae J138
acgcuguugaaaugca

SEQ ID NO: 2560956 - RNA, 19 nt, Chlamydophila pneumoniae J138
acgcuucuuuuuggauauc

SEQ ID NO: 2560957 - RNA, 22 nt, Chlamydophila pneumoniae J138
acgcuugugguuagaggaagca

SEQ ID NO: 2560958 - RNA, 17 nt, Chlamydophila pneumoniae J138
acgcuuucgucuaaaau

SEQ ID NO: 2560959 - RNA, 18 nt, Chlamydophila pneumoniae J138
acgcuuucgucuaaaaua

SEQ ID NO: 2560960 - RNA, 16 nt, Chlamydophila pneumoniae J138
acgcuuuucuucuuua

SEQ ID NO: 2560961 - RNA, 17 nt, Chlamydophila pneumoniae J138
acgcuuuuucuugaaaa

SEQ ID NO: 2560962 - RNA, 21 nt, Chlamydophila pneumoniae J138
acggaaaauacagccagcaga

SEQ ID NO: 2560963 - RNA, 13 nt, Chlamydophila pneumoniae J138
acggaaaaucaca

SEQ ID NO: 2560964 - RNA, 15 nt, Chlamydophila pneumoniae J138
acggaaaaucacacu

SEQ ID NO: 2560965 - RNA, 21 nt, Chlamydophila pneumoniae J138
acggaacucauuaagaagaac

SEQ ID NO: 2560966 - RNA, 14 nt, Chlamydophila pneumoniae J138
acggagagagauuc

SEQ ID NO: 2560967 - RNA, 21 nt, Chlamydophila pneumoniae J138
acggauaggaucauugaguuc

SEQ ID NO: 2560968 - RNA, 14 nt, Chlamydophila pneumoniae J138
acggauucuaaaag

SEQ ID NO: 2560969 - RNA, 21 nt, Chlamydophila pneumoniae J138
acggcggagaauaucaucuuc

SEQ ID NO: 2560970 - RNA, 16 nt, Chlamydophila pneumoniae J138
acgggcaauauaucca

SEQ ID NO: 2560971 - RNA, 17 nt, Chlamydophila pneumoniae J138
acgguaaugccagcagc

SEQ ID NO: 2560972 - RNA, 21 nt, Chlamydophila pneumoniae J138
acggugcuguuguaauaaaag

SEQ ID NO: 2560973 - RNA, 14 nt, Chlamydophila pneumoniae J138
acguaaaaagaaag

SEQ ID NO: 2560974 - RNA, 12 nt, Chlamydophila pneumoniae J138
acguaagguguc

SEQ ID NO: 2560975 - RNA, 15 nt, Chlamydophila pneumoniae J138
acguaauccagauug

SEQ ID NO: 2560976 - RNA, 19 nt, Chlamydophila pneumoniae J138
acguacgcaaguaaagaaa

SEQ ID NO: 2560977 - RNA, 14 nt, Chlamydophila pneumoniae J138
acguagcagaggca

SEQ ID NO: 2560978 - RNA, 13 nt, Chlamydophila pneumoniae J138
acgucaucaccau

SEQ ID NO: 2560979 - RNA, 21 nt, Chlamydophila pneumoniae J138
acguccauuucauguaagaau

SEQ ID NO: 2560980 - RNA, 16 nt, Chlamydophila pneumoniae J138
acgucuaaagacgaag

SEQ ID NO: 2560981 - RNA, 13 nt, Chlamydophila pneumoniae J138
acgucuuaugaaa

SEQ ID NO: 2560982 - RNA, 18 nt, Chlamydophila pneumoniae J138
acgucuucuuagaagaga

SEQ ID NO: 2560983 - RNA, 14 nt, Chlamydophila pneumoniae J138
acgugaucaaaauu

SEQ ID NO: 2560984 - RNA, 16 nt, Chlamydophila pneumoniae J138
acgugcucucuacuuc

SEQ ID NO: 2560985 - RNA, 23 nt, Chlamydophila pneumoniae J138
acguuaauaaagaggcucccauc

SEQ ID NO: 2560986 - RNA, 20 nt, Chlamydophila pneumoniae J138
acguuaucuaagacuucugg

SEQ ID NO: 2560987 - RNA, 18 nt, Chlamydophila pneumoniae J138
acguucccacgagcacaa

SEQ ID NO: 2560988 - RNA, 21 nt, Chlamydophila pneumoniae J138
acguucgacaacaacauaaag

SEQ ID NO: 2560989 - RNA, 22 nt, Chlamydophila pneumoniae J138
acguucugcaacaaguugcauu

SEQ ID NO: 2560990 - RNA, 12 nt, Chlamydophila pneumoniae J138
acguucuuucaa

SEQ ID NO: 2560991 - RNA, 15 nt, Chlamydophila pneumoniae J138
acguuguugcaauuc

SEQ ID NO: 2560992 - RNA, 20 nt, Chlamydophila pneumoniae J138
acguuuaauuccuuggauuc

SEQ ID NO: 2560993 - RNA, 17 nt, Chlamydophila pneumoniae J138
acguuugacaaauuuau

SEQ ID NO: 2560994 - RNA, 15 nt, Chlamydophila pneumoniae J138
acguuugaucuucuc

SEQ ID NO: 2560995 - RNA, 18 nt, Chlamydophila pneumoniae J138
acguuuuucccuuuaaaa

SEQ ID NO: 2560996 - RNA, 13 nt, Chlamydophila pneumoniae J138
acguuuuuuuccu

SEQ ID NO: 2560997 - RNA, 14 nt, Chlamydophila pneumoniae J138
acuaaaaucucauu

SEQ ID NO: 2560998 - RNA, 17 nt, Chlamydophila pneumoniae J138
acuaaaccuucaaugau

SEQ ID NO: 2560999 - RNA, 16 nt, Chlamydophila pneumoniae J138
acuaaacgaucaaauu

SEQ ID NO: 2561000 - RNA, 18 nt, Chlamydophila pneumoniae J138
acuaaagauacuuaucuu

SEQ ID NO: 2561001 - RNA, 19 nt, Chlamydophila pneumoniae J138
acuaaagauacuuaucuuu

SEQ ID NO: 2561002 - RNA, 12 nt, Chlamydophila pneumoniae J138
acuaaaggugaa

SEQ ID NO: 2561003 - RNA, 13 nt, Chlamydophila pneumoniae J138
acuaaaucucgag

SEQ ID NO: 2561004 - RNA, 17 nt, Chlamydophila pneumoniae J138
acuaaauucuuaacaau

SEQ ID NO: 2561005 - RNA, 12 nt, Chlamydophila pneumoniae J138
acuaacauagau

SEQ ID NO: 2561006 - RNA, 17 nt, Chlamydophila pneumoniae J138
acuaagauaucuccagg

SEQ ID NO: 2561007 - RNA, 19 nt, Chlamydophila pneumoniae J138
acuaaguuuaggcaggaag

SEQ ID NO: 2561008 - RNA, 20 nt, Chlamydophila pneumoniae J138
acuaaucaccuuaggcuuaa

SEQ ID NO: 2561009 - RNA, 15 nt, Chlamydophila pneumoniae J138
acuacaauaaccagg

SEQ ID NO: 2561010 - RNA, 22 nt, Chlamydophila pneumoniae J138
acuacacgcacuugcuuaucca

SEQ ID NO: 2561011 - RNA, 19 nt, Chlamydophila pneumoniae J138
acuacagagggcuucauuc

SEQ ID NO: 2561012 - RNA, 19 nt, Chlamydophila pneumoniae J138
acuacagcugcuagagcag

SEQ ID NO: 2561013 - RNA, 15 nt, Chlamydophila pneumoniae J138
acuacauaauaagca

SEQ ID NO: 2561014 - RNA, 17 nt, Chlamydophila pneumoniae J138
acuacauucgcaagaau

SEQ ID NO: 2561015 - RNA, 22 nt, Chlamydophila pneumoniae J138
acugaugaaaaagcugacacuc

SEQ ID NO: 2561016 - RNA, 16 nt, Chlamydophila pneumoniae J138
acugaugccaagaaau

SEQ ID NO: 2561017 - RNA, 22 nt, Chlamydophila pneumoniae J138
acugaugccaagaaauauacug

SEQ ID NO: 2561018 - RNA, 22 nt, Chlamydophila pneumoniae J138
acugaugugaagccauuuucua

SEQ ID NO: 2561019 - RNA, 15 nt, Chlamydophila pneumoniae J138
acugcagagaaauuc

SEQ ID NO: 2561020 - RNA, 13 nt, Chlamydophila pneumoniae J138
acugcagauugca

SEQ ID NO: 2561021 - RNA, 22 nt, Chlamydophila pneumoniae J138
acugccagcgaucacauagaaa

SEQ ID NO: 2561022 - RNA, 22 nt, Chlamydophila pneumoniae J138
acugcgaaggguuguugccagu

SEQ ID NO: 2561023 - RNA, 21 nt, Chlamydophila pneumoniae J138
acugcuacuuuaaaguggcaa

SEQ ID NO: 2561024 - RNA, 17 nt, Chlamydophila pneumoniae J138
acugcugacaucuccaa

SEQ ID NO: 2561025 - RNA, 19 nt, Chlamydophila pneumoniae J138
acugcuuggucacaccaaa

SEQ ID NO: 2561026 - RNA, 13 nt, Chlamydophila pneumoniae J138
acuggaaugacau

SEQ ID NO: 2561027 - RNA, 15 nt, Chlamydophila pneumoniae J138
acuggagagguaacc

SEQ ID NO: 2561028 - RNA, 22 nt, Chlamydophila pneumoniae J138
acuggagagguaaccagagagc

SEQ ID NO: 2561029 - RNA, 21 nt, Chlamydophila pneumoniae J138
acuggaggcuguguaaaaguu

SEQ ID NO: 2561030 - RNA, 19 nt, Chlamydophila pneumoniae J138
acuggcccagauucugaag

SEQ ID NO: 2561031 - RNA, 13 nt, Chlamydophila pneumoniae J138
acuguaauuggag

SEQ ID NO: 2561032 - RNA, 22 nt, Chlamydophila pneumoniae J138
acuguacaaaugcaucucuagc

SEQ ID NO: 2561033 - RNA, 15 nt, Chlamydophila pneumoniae J138
acuguguaugaauca

SEQ ID NO: 2561034 - RNA, 18 nt, Chlamydophila pneumoniae J138
acuguguucaauagcaaa

SEQ ID NO: 2561035 - RNA, 15 nt, Chlamydophila pneumoniae J138
acuguugauccuucu

SEQ ID NO: 2561036 - RNA, 17 nt, Chlamydophila pneumoniae J138
acuguugauccuucuua

SEQ ID NO: 2561037 - RNA, 18 nt, Chlamydophila pneumoniae J138
acuguugauccuucuuau

SEQ ID NO: 2561038 - RNA, 23 nt, Chlamydophila pneumoniae J138
acuguugauccuucuuaugguca

SEQ ID NO: 2561039 - RNA, 20 nt, Chlamydophila pneumoniae J138
acuguuguaauaaaaucaug

SEQ ID NO: 2561040 - RNA, 19 nt, Chlamydophila pneumoniae J138
acuguuuguuuauuaucua

SEQ ID NO: 2561041 - RNA, 21 nt, Chlamydophila pneumoniae J138
acuguuuguuuauuaucuaca

SEQ ID NO: 2561042 - RNA, 22 nt, Chlamydophila pneumoniae J138
acuguuuguuuauuaucuacag

SEQ ID NO: 2561043 - RNA, 13 nt, Chlamydophila pneumoniae J138
acuguuuuucuuc

SEQ ID NO: 2561044 - RNA, 15 nt, Chlamydophila pneumoniae J138
acuguuuuucuucca

SEQ ID NO: 2561045 - RNA, 13 nt, Chlamydophila pneumoniae J138
acuuaaaaaacuu

SEQ ID NO: 2561046 - RNA, 19 nt, Chlamydophila pneumoniae J138
acuuaaagcuugagaaaag

SEQ ID NO: 2561047 - RNA, 13 nt, Chlamydophila pneumoniae J138
acuuaagauacuu

SEQ ID NO: 2561048 - RNA, 14 nt, Chlamydophila pneumoniae J138
acuuaauccuguag

SEQ ID NO: 2561049 - RNA, 18 nt, Chlamydophila pneumoniae J138
acuuaauccuguagggaa

SEQ ID NO: 2561050 - RNA, 22 nt, Chlamydophila pneumoniae J138
acuuacuaaaggugaaaguaca

SEQ ID NO: 2561051 - RNA, 16 nt, Chlamydophila pneumoniae J138
acuuagaucuuuucua

SEQ ID NO: 2561052 - RNA, 20 nt, Chlamydophila pneumoniae J138
acuuagaucuuuucuacuuc

SEQ ID NO: 2561053 - RNA, 13 nt, Chlamydophila pneumoniae J138
acuuagcaaugaa

SEQ ID NO: 2561054 - RNA, 16 nt, Chlamydophila pneumoniae J138
acuuaggaauuuuucu

SEQ ID NO: 2561055 - RNA, 22 nt, Chlamydophila pneumoniae J138
acuuaggguucucaaagaucau

SEQ ID NO: 2561056 - RNA, 17 nt, Chlamydophila pneumoniae J138
acuuagguaauguaguc

SEQ ID NO: 2561057 - RNA, 15 nt, Chlamydophila pneumoniae J138
acuuaguuuugaaaa

SEQ ID NO: 2561058 - RNA, 20 nt, Chlamydophila pneumoniae J138
acuuauaccaccccaaagca

SEQ ID NO: 2561059 - RNA, 23 nt, Chlamydophila pneumoniae J138
acuuauaccaccccaaagcagau

SEQ ID NO: 2561060 - RNA, 15 nt, Chlamydophila pneumoniae J138
acuuauauuggcuuu

SEQ ID NO: 2561061 - RNA, 18 nt, Chlamydophila pneumoniae J138
acuuaucgaaugcugcac

SEQ ID NO: 2561062 - RNA, 16 nt, Chlamydophila pneumoniae J138
acuuaucuuuaaauuc

SEQ ID NO: 2561063 - RNA, 22 nt, Chlamydophila pneumoniae J138
acuuauguacugagguagcaua

SEQ ID NO: 2561064 - RNA, 14 nt, Chlamydophila pneumoniae J138
acuuauuguucuug

SEQ ID NO: 2561065 - RNA, 14 nt, Chlamydophila pneumoniae J138
acuucaaaugaaau

SEQ ID NO: 2561066 - RNA, 16 nt, Chlamydophila pneumoniae J138
acuucaaaugaaauuc

SEQ ID NO: 2561067 - RNA, 17 nt, Chlamydophila pneumoniae J138
acuucaaaugaaauucu

SEQ ID NO: 2561068 - RNA, 22 nt, Chlamydophila pneumoniae J138
acuucaacaaaggcuccaaacg

SEQ ID NO: 2561069 - RNA, 16 nt, Chlamydophila pneumoniae J138
acuucaacuucuccaa

SEQ ID NO: 2561070 - RNA, 16 nt, Chlamydophila pneumoniae J138
acuucaaugaagaaaa

SEQ ID NO: 2561071 - RNA, 14 nt, Chlamydophila pneumoniae J138
acuucacaaagaac

SEQ ID NO: 2561072 - RNA, 16 nt, Chlamydophila pneumoniae J138
acuucacguugcaaug

SEQ ID NO: 2561073 - RNA, 15 nt, Chlamydophila pneumoniae J138
acuucagcaagaaaa

SEQ ID NO: 2561074 - RNA, 19 nt, Chlamydophila pneumoniae J138
acuucaggaaauaauuugu

SEQ ID NO: 2561075 - RNA, 23 nt, Chlamydophila pneumoniae J138
acuucaggacgcacauuuagaag

SEQ ID NO: 2561076 - RNA, 21 nt, Chlamydophila pneumoniae J138
acuuccaaaacgauccuguuc

SEQ ID NO: 2561077 - RNA, 19 nt, Chlamydophila pneumoniae J138
acuuccuccaauaaucacu

SEQ ID NO: 2561078 - RNA, 13 nt, Chlamydophila pneumoniae J138
acuuccucuucaa

SEQ ID NO: 2561079 - RNA, 13 nt, Chlamydophila pneumoniae J138
acuuccuuuuucu

SEQ ID NO: 2561080 - RNA, 16 nt, Chlamydophila pneumoniae J138
acuucgacacgaacuu

SEQ ID NO: 2561081 - RNA, 14 nt, Chlamydophila pneumoniae J138
acuucgaugucuuu

SEQ ID NO: 2561082 - RNA, 16 nt, Chlamydophila pneumoniae J138
acuucgaugucuuucc

SEQ ID NO: 2561083 - RNA, 21 nt, Chlamydophila pneumoniae J138
acuucgaugucuuuccaggca

SEQ ID NO: 2561084 - RNA, 22 nt, Chlamydophila pneumoniae J138
acuucgauuggaagcaaagaaa

SEQ ID NO: 2561085 - RNA, 17 nt, Chlamydophila pneumoniae J138
acuucgcaaauuuuucg

SEQ ID NO: 2561086 - RNA, 22 nt, Chlamydophila pneumoniae J138
acuucguuucgcuuugauaaua

SEQ ID NO: 2561087 - RNA, 19 nt, Chlamydophila pneumoniae J138
acuucuaugauaucaccag

SEQ ID NO: 2561088 - RNA, 12 nt, Chlamydophila pneumoniae J138
acuucucaaaga

SEQ ID NO: 2561089 - RNA, 12 nt, Chlamydophila pneumoniae J138
acuucucagaua

SEQ ID NO: 2561090 - RNA, 15 nt, Chlamydophila pneumoniae J138
acuucucagauaaaa

SEQ ID NO: 2561091 - RNA, 21 nt, Chlamydophila pneumoniae J138
acuucucagcaucucgaacaa

SEQ ID NO: 2561092 - RNA, 14 nt, Chlamydophila pneumoniae J138
acuucugaaggaaa

SEQ ID NO: 2561093 - RNA, 23 nt, Chlamydophila pneumoniae J138
acuucugcaggacugucuagcag

SEQ ID NO: 2561094 - RNA, 17 nt, Chlamydophila pneumoniae J138
acuucugcuaguccugu

SEQ ID NO: 2561095 - RNA, 20 nt, Chlamydophila pneumoniae J138
acuucugguccaaacccugg

SEQ ID NO: 2561096 - RNA, 11 nt, Chlamydophila pneumoniae J138
acuucugguuu

SEQ ID NO: 2561097 - RNA, 14 nt, Chlamydophila pneumoniae J138
acuucuucaagaaa

SEQ ID NO: 2561098 - RNA, 19 nt, Chlamydophila pneumoniae J138
acuucuucaagaaaugccc

SEQ ID NO: 2561099 - RNA, 16 nt, Chlamydophila pneumoniae J138
acuucuuccacgagau

SEQ ID NO: 2561100 - RNA, 19 nt, Chlamydophila pneumoniae J138
acuucuucguuagagaaga

SEQ ID NO: 2561101 - RNA, 22 nt, Chlamydophila pneumoniae J138
acuucuucguuagagaagaggu

SEQ ID NO: 2561102 - RNA, 17 nt, Chlamydophila pneumoniae J138
acuucuucucgguuuaa

SEQ ID NO: 2561103 - RNA, 13 nt, Chlamydophila pneumoniae J138
acuucuucuuuuc

SEQ ID NO: 2561104 - RNA, 18 nt, Chlamydophila pneumoniae J138
acuucuugugauccuugc

SEQ ID NO: 2561105 - RNA, 23 nt, Chlamydophila pneumoniae J138
acuucuuuaggagcauagacucu

SEQ ID NO: 2561106 - RNA, 13 nt, Chlamydophila pneumoniae J138
acuucuuucuugc

SEQ ID NO: 2561107 - RNA, 15 nt, Chlamydophila pneumoniae J138
acuugcccaaaaguu

SEQ ID NO: 2561108 - RNA, 16 nt, Chlamydophila pneumoniae J138
acuugcucugaagcuc

SEQ ID NO: 2561109 - RNA, 15 nt, Chlamydophila pneumoniae J138
acuugcucuuuaaua

SEQ ID NO: 2561110 - RNA, 13 nt, Chlamydophila pneumoniae J138
acuugcucuuuag

SEQ ID NO: 2561111 - RNA, 14 nt, Chlamydophila pneumoniae J138
acuugggagaugcu

SEQ ID NO: 2561112 - RNA, 23 nt, Chlamydophila pneumoniae J138
acuuguaccguaaagaaaagcaa

SEQ ID NO: 2561113 - RNA, 21 nt, Chlamydophila pneumoniae J138
acuuguuaggaaaauucuuaa

SEQ ID NO: 2561114 - RNA, 18 nt, Chlamydophila pneumoniae J138
acuuguucagcuagagca

SEQ ID NO: 2561115 - RNA, 17 nt, Chlamydophila pneumoniae J138
caaagcucuccuucaga

SEQ ID NO: 2561116 - RNA, 22 nt, Chlamydophila pneumoniae J138
caaaggaagggauguuuaauac

SEQ ID NO: 2561117 - RNA, 19 nt, Chlamydophila pneumoniae J138
caaaggaccacaauuccua

SEQ ID NO: 2561118 - RNA, 14 nt, Chlamydophila pneumoniae J138
caaaggagaaagaa

SEQ ID NO: 2561119 - RNA, 19 nt, Chlamydophila pneumoniae J138
caaaggagcgggauaggca

SEQ ID NO: 2561120 - RNA, 12 nt, Chlamydophila pneumoniae J138
caaaggcaacaa

SEQ ID NO: 2561121 - RNA, 21 nt, Chlamydophila pneumoniae J138
caaaggcaauagcagcagcgu

SEQ ID NO: 2561122 - RNA, 17 nt, Chlamydophila pneumoniae J138
caaaggguuucuuucca

SEQ ID NO: 2561123 - RNA, 23 nt, Chlamydophila pneumoniae J138
caaagguuauggaugcuaaauuu

SEQ ID NO: 2561124 - RNA, 23 nt, Chlamydophila pneumoniae J138
caaaguaaugugcgcacaaggga

SEQ ID NO: 2561125 - RNA, 20 nt, Chlamydophila pneumoniae J138
caaaguacuaauuacagaau

SEQ ID NO: 2561126 - RNA, 22 nt, Chlamydophila pneumoniae J138
caaaguaggauugauaaauuug

SEQ ID NO: 2561127 - RNA, 16 nt, Chlamydophila pneumoniae J138
caaagucaaauacuuc

SEQ ID NO: 2561128 - RNA, 17 nt, Chlamydophila pneumoniae J138
caaagucaaauacuucu

SEQ ID NO: 2561129 - RNA, 20 nt, Chlamydophila pneumoniae J138
caaagucaaauacuucuccu

SEQ ID NO: 2561130 - RNA, 20 nt, Chlamydophila pneumoniae J138
caaaguuaaugcaagcaacu

SEQ ID NO: 2561131 - RNA, 12 nt, Chlamydophila pneumoniae J138
caaauaaaacaa

SEQ ID NO: 2561132 - RNA, 14 nt, Chlamydophila pneumoniae J138
caaauaaagcaacu

SEQ ID NO: 2561133 - RNA, 16 nt, Chlamydophila pneumoniae J138
caaauaaagcaacugu

SEQ ID NO: 2561134 - RNA, 19 nt, Chlamydophila pneumoniae J138
caaauaaguccuguuugaa

SEQ ID NO: 2561135 - RNA, 21 nt, Chlamydophila pneumoniae J138
caaauaaguccuguuugaaaa

SEQ ID NO: 2561136 - RNA, 12 nt, Chlamydophila pneumoniae J138
caaauaauuaaa

SEQ ID NO: 2561137 - RNA, 14 nt, Chlamydophila pneumoniae J138
caaauagauuuuua

SEQ ID NO: 2561138 - RNA, 19 nt, Chlamydophila pneumoniae J138
caaauagauuuuuacuugc

SEQ ID NO: 2561139 - RNA, 15 nt, Chlamydophila pneumoniae J138
caaauaggagagcac

SEQ ID NO: 2561140 - RNA, 17 nt, Chlamydophila pneumoniae J138
caaauaguucaucauau

SEQ ID NO: 2561141 - RNA, 21 nt, Chlamydophila pneumoniae J138
caaaucauuuaaagcugaaau

SEQ ID NO: 2561142 - RNA, 21 nt, Chlamydophila pneumoniae J138
caaauccugcauacccuucuu

SEQ ID NO: 2561143 - RNA, 15 nt, Chlamydophila pneumoniae J138
caaaucuaaaaccug

SEQ ID NO: 2561144 - RNA, 21 nt, Chlamydophila pneumoniae J138
caaaucucauuccagcaucuu

SEQ ID NO: 2561145 - RNA, 19 nt, Chlamydophila pneumoniae J138
caaaucuuccccuaaaaau

SEQ ID NO: 2561146 - RNA, 19 nt, Chlamydophila pneumoniae J138
caaaugcagucucaggaaa

SEQ ID NO: 2561147 - RNA, 15 nt, Chlamydophila pneumoniae J138
caaauguucucucca

SEQ ID NO: 2561148 - RNA, 22 nt, Chlamydophila pneumoniae J138
caaauguucucuccagcugugg

SEQ ID NO: 2561149 - RNA, 15 nt, Chlamydophila pneumoniae J138
caaauucaaaauaga

SEQ ID NO: 2561150 - RNA, 16 nt, Chlamydophila pneumoniae J138
caaauuccagaaaaag

SEQ ID NO: 2561151 - RNA, 14 nt, Chlamydophila pneumoniae J138
caaauuccuucuca

SEQ ID NO: 2561152 - RNA, 22 nt, Chlamydophila pneumoniae J138
caaauuccuucucagaaagaua

SEQ ID NO: 2561153 - RNA, 23 nt, Chlamydophila pneumoniae J138
caaauuccuucucagaaagauau

SEQ ID NO: 2561154 - RNA, 12 nt, Chlamydophila pneumoniae J138
caaauugagaaa

SEQ ID NO: 2561155 - RNA, 23 nt, Chlamydophila pneumoniae J138
caaauugcaauuuucuaaagauu

SEQ ID NO: 2561156 - RNA, 19 nt, Chlamydophila pneumoniae J138
caaauuuaucggcuaaaga

SEQ ID NO: 2561157 - RNA, 19 nt, Chlamydophila pneumoniae J138
caaauuucauuuagacaau

SEQ ID NO: 2561158 - RNA, 18 nt, Chlamydophila pneumoniae J138
caaauuuccauaggaucu

SEQ ID NO: 2561159 - RNA, 17 nt, Chlamydophila pneumoniae J138
caacaaaagcuauauag

SEQ ID NO: 2561160 - RNA, 14 nt, Chlamydophila pneumoniae J138
caacaaaagggcau

SEQ ID NO: 2561161 - RNA, 22 nt, Chlamydophila pneumoniae J138
caacaaaugugacgcaagagac

SEQ ID NO: 2561162 - RNA, 21 nt, Chlamydophila pneumoniae J138
caacaagcugcugagcagcaa

SEQ ID NO: 2561163 - RNA, 18 nt, Chlamydophila pneumoniae J138
caacaagggaaagaaacu

SEQ ID NO: 2561164 - RNA, 17 nt, Chlamydophila pneumoniae J138
caacaaucuuucuucua

SEQ ID NO: 2561165 - RNA, 22 nt, Chlamydophila pneumoniae J138
caacacggacacuauuaucugc

SEQ ID NO: 2561166 - RNA, 24 nt, Chlamydophila pneumoniae J138
caacacgucacuggggcauaagaa

SEQ ID NO: 2561167 - RNA, 14 nt, Chlamydophila pneumoniae J138
caacagaaauguug

SEQ ID NO: 2561168 - RNA, 16 nt, Chlamydophila pneumoniae J138
caaggaacauuugagc

SEQ ID NO: 2561169 - RNA, 23 nt, Chlamydophila pneumoniae J138
caaggaagccugcggcaaguauc

SEQ ID NO: 2561170 - RNA, 19 nt, Chlamydophila pneumoniae J138
caaggacaggaccugugag

SEQ ID NO: 2561171 - RNA, 16 nt, Chlamydophila pneumoniae J138
caaggagagaaaauau

SEQ ID NO: 2561172 - RNA, 22 nt, Chlamydophila pneumoniae J138
caaggagagcuucuucuguaaa

SEQ ID NO: 2561173 - RNA, 18 nt, Chlamydophila pneumoniae J138
caaggagcuuuucguaua

SEQ ID NO: 2561174 - RNA, 21 nt, Chlamydophila pneumoniae J138
caaggaguccaugcuaaaacu

SEQ ID NO: 2561175 - RNA, 14 nt, Chlamydophila pneumoniae J138
caaggcaaaaaguu

SEQ ID NO: 2561176 - RNA, 22 nt, Chlamydophila pneumoniae J138
caaggcaucuucuuugccaaug

SEQ ID NO: 2561177 - RNA, 17 nt, Chlamydophila pneumoniae J138
caaggccuaaucuugua

SEQ ID NO: 2561178 - RNA, 15 nt, Chlamydophila pneumoniae J138
caagggaagagaaaa

SEQ ID NO: 2561179 - RNA, 18 nt, Chlamydophila pneumoniae J138
caagggagaggucugcuc

SEQ ID NO: 2561180 - RNA, 15 nt, Chlamydophila pneumoniae J138
caaguaaagaaauuc

SEQ ID NO: 2561181 - RNA, 19 nt, Chlamydophila pneumoniae J138
caaguaaucaugauaaaaa

SEQ ID NO: 2561182 - RNA, 17 nt, Chlamydophila pneumoniae J138
caaguaugguccauaau

SEQ ID NO: 2561183 - RNA, 19 nt, Chlamydophila pneumoniae J138
caagucagccaagacaaaa

SEQ ID NO: 2561184 - RNA, 20 nt, Chlamydophila pneumoniae J138
caaguccugcguuaaacccu

SEQ ID NO: 2561185 - RNA, 18 nt, Chlamydophila pneumoniae J138
caagucgagaaacaaaau

SEQ ID NO: 2561186 - RNA, 20 nt, Chlamydophila pneumoniae J138
caagucgagaaacaaaaucu

SEQ ID NO: 2561187 - RNA, 12 nt, Chlamydophila pneumoniae J138
caagucuguaag

SEQ ID NO: 2561188 - RNA, 18 nt, Chlamydophila pneumoniae J138
caagugcucaguaaauau

SEQ ID NO: 2561189 - RNA, 21 nt, Chlamydophila pneumoniae J138
caagugugcggucucauguaa

SEQ ID NO: 2561190 - RNA, 21 nt, Chlamydophila pneumoniae J138
caaguguucgaguucuuuagc

SEQ ID NO: 2561191 - RNA, 13 nt, Chlamydophila pneumoniae J138
caaguucaucaaa

SEQ ID NO: 2561192 - RNA, 20 nt, Chlamydophila pneumoniae J138
caaguucaucaaauaaggcu

SEQ ID NO: 2561193 - RNA, 21 nt, Chlamydophila pneumoniae J138
caaguuguugauaauuacaga

SEQ ID NO: 2561194 - RNA, 13 nt, Chlamydophila pneumoniae J138
caaguuucuuuug

SEQ ID NO: 2561195 - RNA, 16 nt, Chlamydophila pneumoniae J138
caaguuuuuucaaucc

SEQ ID NO: 2561196 - RNA, 13 nt, Chlamydophila pneumoniae J138
caauaaaaaagag

SEQ ID NO: 2561197 - RNA, 23 nt, Chlamydophila pneumoniae J138
caauaaaaggguagcgaaugaaa

SEQ ID NO: 2561198 - RNA, 22 nt, Chlamydophila pneumoniae J138
caauaaacgagacugcaaagga

SEQ ID NO: 2561199 - RNA, 14 nt, Chlamydophila pneumoniae J138
caauaaauccaaaa

SEQ ID NO: 2561200 - RNA, 22 nt, Chlamydophila pneumoniae J138
caauaacaaacgccgcucuuga

SEQ ID NO: 2561201 - RNA, 22 nt, Chlamydophila pneumoniae J138
caauaacaugcgcagaauaaaa

SEQ ID NO: 2561202 - RNA, 19 nt, Chlamydophila pneumoniae J138
caauaaccgaaacuucuca

SEQ ID NO: 2561203 - RNA, 21 nt, Chlamydophila pneumoniae J138
caauaaccgaaacuucucaga

SEQ ID NO: 2561204 - RNA, 13 nt, Chlamydophila pneumoniae J138
caauaagaaaauc

SEQ ID NO: 2561205 - RNA, 17 nt, Chlamydophila pneumoniae J138
caauaagaaaauccuaa

SEQ ID NO: 2561206 - RNA, 19 nt, Chlamydophila pneumoniae J138
caauaagcuugccagcaga

SEQ ID NO: 2561207 - RNA, 21 nt, Chlamydophila pneumoniae J138
caauaagcuugccagcagaag

SEQ ID NO: 2561208 - RNA, 24 nt, Chlamydophila pneumoniae J138
caauaauaucgguuccuauaugaa

SEQ ID NO: 2561209 - RNA, 17 nt, Chlamydophila pneumoniae J138
caauacagauaucaaag

SEQ ID NO: 2561210 - RNA, 15 nt, Chlamydophila pneumoniae J138
caauacagauguaaa

SEQ ID NO: 2561211 - RNA, 16 nt, Chlamydophila pneumoniae J138
caauacagauguaaau

SEQ ID NO: 2561212 - RNA, 17 nt, Chlamydophila pneumoniae J138
caauacagauguaaaug

SEQ ID NO: 2561213 - RNA, 17 nt, Chlamydophila pneumoniae J138
caauacagcauaaaaau

SEQ ID NO: 2561214 - RNA, 18 nt, Chlamydophila pneumoniae J138
caauacagcauaaaaauu

SEQ ID NO: 2561215 - RNA, 15 nt, Chlamydophila pneumoniae J138
caauaccagauaaag

SEQ ID NO: 2561216 - RNA, 23 nt, Chlamydophila pneumoniae J138
caauaccagauaaagcaaagaua

SEQ ID NO: 2561217 - RNA, 16 nt, Chlamydophila pneumoniae J138
caauacccuaucuauu

SEQ ID NO: 2561218 - RNA, 22 nt, Chlamydophila pneumoniae J138
caauaccuguacgguaaaucca

SEQ ID NO: 2561219 - RNA, 18 nt, Chlamydophila pneumoniae J138
caauacgcuagcucuuaa

SEQ ID NO: 2561220 - RNA, 17 nt, Chlamydophila pneumoniae J138
caauacuaaaacuacaa

SEQ ID NO: 2561221 - RNA, 17 nt, Chlamydophila pneumoniae J138
caauacuaagaagcuca

SEQ ID NO: 2561222 - RNA, 19 nt, Chlamydophila pneumoniae J138
caauacucuguuuguaguc

SEQ ID NO: 2561223 - RNA, 23 nt, Chlamydophila pneumoniae J138
caauacuucaggacgcacauuua

SEQ ID NO: 2561224 - RNA, 18 nt, Chlamydophila pneumoniae J138
caauagaagcuuguugag

SEQ ID NO: 2561225 - RNA, 16 nt, Chlamydophila pneumoniae J138
caauagcaaagauuuc

SEQ ID NO: 2561226 - RNA, 19 nt, Chlamydophila pneumoniae J138
caauagcaaagauuucugc

SEQ ID NO: 2561227 - RNA, 13 nt, Chlamydophila pneumoniae J138
caauaggcaccca

SEQ ID NO: 2561228 - RNA, 21 nt, Chlamydophila pneumoniae J138
caauaggccagaauguacaua

SEQ ID NO: 2561229 - RNA, 15 nt, Chlamydophila pneumoniae J138
caauaguaaagcauu

SEQ ID NO: 2561230 - RNA, 19 nt, Chlamydophila pneumoniae J138
caauaguguaacauugacc

SEQ ID NO: 2561231 - RNA, 14 nt, Chlamydophila pneumoniae J138
caauauaagcacca

SEQ ID NO: 2561232 - RNA, 14 nt, Chlamydophila pneumoniae J138
caauauagaaaucg

SEQ ID NO: 2561233 - RNA, 16 nt, Chlamydophila pneumoniae J138
caauauagaagcugcu

SEQ ID NO: 2561234 - RNA, 20 nt, Chlamydophila pneumoniae J138
caauauagaagcugcugcua

SEQ ID NO: 2561235 - RNA, 21 nt, Chlamydophila pneumoniae J138
caauauagaagcugcugcuac

SEQ ID NO: 2561236 - RNA, 22 nt, Chlamydophila pneumoniae J138
caauauuaaaccguaggauucu

SEQ ID NO: 2561237 - RNA, 18 nt, Chlamydophila pneumoniae J138
caaucaacauucuucugu

SEQ ID NO: 2561238 - RNA, 13 nt, Chlamydophila pneumoniae J138
caaucagugcugc

SEQ ID NO: 2561239 - RNA, 16 nt, Chlamydophila pneumoniae J138
caauccaacaaagaug

SEQ ID NO: 2561240 - RNA, 18 nt, Chlamydophila pneumoniae J138
caauccaacaaagaugac

SEQ ID NO: 2561241 - RNA, 16 nt, Chlamydophila pneumoniae J138
caauccacgcuccucu

SEQ ID NO: 2561242 - RNA, 19 nt, Chlamydophila pneumoniae J138
caauccaguagaucuucug

SEQ ID NO: 2561243 - RNA, 17 nt, Chlamydophila pneumoniae J138
caauccggcauaaaaaa

SEQ ID NO: 2561244 - RNA, 19 nt, Chlamydophila pneumoniae J138
caauccuauggcagcagga

SEQ ID NO: 2561245 - RNA, 13 nt, Chlamydophila pneumoniae J138
caauccuuccuua

SEQ ID NO: 2561246 - RNA, 13 nt, Chlamydophila pneumoniae J138
caaucuaaaauca

SEQ ID NO: 2561247 - RNA, 14 nt, Chlamydophila pneumoniae J138
caaucuaaauaaga

SEQ ID NO: 2561248 - RNA, 22 nt, Chlamydophila pneumoniae J138
caaucucaaaaucaaauagauu

SEQ ID NO: 2561249 - RNA, 19 nt, Chlamydophila pneumoniae J138
caaucucgcuauuccauaa

SEQ ID NO: 2561250 - RNA, 20 nt, Chlamydophila pneumoniae J138
caaucucgcuauuccauaaa

SEQ ID NO: 2561251 - RNA, 15 nt, Chlamydophila pneumoniae J138
caaucucuagggaua

SEQ ID NO: 2561252 - RNA, 17 nt, Chlamydophila pneumoniae J138
caaucucuuucacaaag

SEQ ID NO: 2561253 - RNA, 20 nt, Chlamydophila pneumoniae J138
caaucuuccuuaaccuccuc

SEQ ID NO: 2561254 - RNA, 20 nt, Chlamydophila pneumoniae J138
caaucuuucuucuagagcuu

SEQ ID NO: 2561255 - RNA, 23 nt, Chlamydophila pneumoniae J138
caaucuuugaucgcuugugcaug

SEQ ID NO: 2561256 - RNA, 12 nt, Chlamydophila pneumoniae J138
caaugaagaaaa

SEQ ID NO: 2561257 - RNA, 14 nt, Chlamydophila pneumoniae J138
caaugaagaaaaau

SEQ ID NO: 2561258 - RNA, 21 nt, Chlamydophila pneumoniae J138
caaugacaauccgcauauuga

SEQ ID NO: 2561259 - RNA, 18 nt, Chlamydophila pneumoniae J138
caaugagcaucugaguca

SEQ ID NO: 2561260 - RNA, 14 nt, Chlamydophila pneumoniae J138
caaugauaauuuca

SEQ ID NO: 2561261 - RNA, 15 nt, Chlamydophila pneumoniae J138
caaugauaauuucau

SEQ ID NO: 2561262 - RNA, 20 nt, Chlamydophila pneumoniae J138
caaugauaauuucauuauag

SEQ ID NO: 2561263 - RNA, 16 nt, Chlamydophila pneumoniae J138
caaugauauaaaagcu

SEQ ID NO: 2561264 - RNA, 20 nt, Chlamydophila pneumoniae J138
caaugauauaaaagcugaau

SEQ ID NO: 2561265 - RNA, 15 nt, Chlamydophila pneumoniae J138
caaugauguuuuuua

SEQ ID NO: 2561266 - RNA, 22 nt, Chlamydophila pneumoniae J138
caaugauuucuuuagcuuuauu

SEQ ID NO: 2561267 - RNA, 14 nt, Chlamydophila pneumoniae J138
caccagaaggaagg

SEQ ID NO: 2561268 - RNA, 22 nt, Chlamydophila pneumoniae J138
caccagacccucgaguaccgac

SEQ ID NO: 2561269 - RNA, 21 nt, Chlamydophila pneumoniae J138
caccaggaguuggagaauuga

SEQ ID NO: 2561270 - RNA, 16 nt, Chlamydophila pneumoniae J138
caccagggguuucuaa

SEQ ID NO: 2561271 - RNA, 16 nt, Chlamydophila pneumoniae J138
caccagguccuucugg

SEQ ID NO: 2561272 - RNA, 22 nt, Chlamydophila pneumoniae J138
caccauauccaugacuuuuguu

SEQ ID NO: 2561273 - RNA, 14 nt, Chlamydophila pneumoniae J138
cacccacuccagaa

SEQ ID NO: 2561274 - RNA, 15 nt, Chlamydophila pneumoniae J138
cacccgcaagcacuu

SEQ ID NO: 2561275 - RNA, 12 nt, Chlamydophila pneumoniae J138
cacccugacagg

SEQ ID NO: 2561276 - RNA, 22 nt, Chlamydophila pneumoniae J138
caccuaauaaagaagguugaga

SEQ ID NO: 2561277 - RNA, 18 nt, Chlamydophila pneumoniae J138
caccucaauacggacaua

SEQ ID NO: 2561278 - RNA, 15 nt, Chlamydophila pneumoniae J138
caccucuucaaagac

SEQ ID NO: 2561279 - RNA, 20 nt, Chlamydophila pneumoniae J138
caccuuaauggcuccuacuc

SEQ ID NO: 2561280 - RNA, 23 nt, Chlamydophila pneumoniae J138
caccuuaauggcuccuacuccua

SEQ ID NO: 2561281 - RNA, 15 nt, Chlamydophila pneumoniae J138
caccuuacauccaau

SEQ ID NO: 2561282 - RNA, 19 nt, Chlamydophila pneumoniae J138
caccuugaaguuuuuucuc

SEQ ID NO: 2561283 - RNA, 21 nt, Chlamydophila pneumoniae J138
caccuugaaguuuuuucucuc

SEQ ID NO: 2561284 - RNA, 13 nt, Chlamydophila pneumoniae J138
cacgaaaaggaga

SEQ ID NO: 2561285 - RNA, 18 nt, Chlamydophila pneumoniae J138
cacgaacuucagcaagaa

SEQ ID NO: 2561286 - RNA, 15 nt, Chlamydophila pneumoniae J138
cacgacauacaucaa

SEQ ID NO: 2561287 - RNA, 14 nt, Chlamydophila pneumoniae J138
cacgacgucaucac

SEQ ID NO: 2561288 - RNA, 23 nt, Chlamydophila pneumoniae J138
cacgaguucgcggaucuucuucu

SEQ ID NO: 2561289 - RNA, 17 nt, Chlamydophila pneumoniae J138
cacgaucuagaagauga

SEQ ID NO: 2561290 - RNA, 21 nt, Chlamydophila pneumoniae J138
cacgcacaaacuaacauagau

SEQ ID NO: 2561291 - RNA, 14 nt, Chlamydophila pneumoniae J138
cacgccaaaguacu

SEQ ID NO: 2561292 - RNA, 18 nt, Chlamydophila pneumoniae J138
cacgccuccuucaaagau

SEQ ID NO: 2561293 - RNA, 19 nt, Chlamydophila pneumoniae J138
cacgccuccuucaaagaua

SEQ ID NO: 2561294 - RNA, 23 nt, Chlamydophila pneumoniae J138
cacgcuugugguuagaggaagca

SEQ ID NO: 2561295 - RNA, 19 nt, Chlamydophila pneumoniae J138
cacgcuuucgucuaaaaua

SEQ ID NO: 2561296 - RNA, 13 nt, Chlamydophila pneumoniae J138
cacggauucuaaa

SEQ ID NO: 2561297 - RNA, 20 nt, Chlamydophila pneumoniae J138
cacgggauagccgagaucuu

SEQ ID NO: 2561298 - RNA, 21 nt, Chlamydophila pneumoniae J138
cacgggucaggagguggugga

SEQ ID NO: 2561299 - RNA, 13 nt, Chlamydophila pneumoniae J138
cacguaagguguc

SEQ ID NO: 2561300 - RNA, 16 nt, Chlamydophila pneumoniae J138
cacguaggcauacagu

SEQ ID NO: 2561301 - RNA, 21 nt, Chlamydophila pneumoniae J138
cacguaggcauacaguagaaa

SEQ ID NO: 2561302 - RNA, 20 nt, Chlamydophila pneumoniae J138
cacgucuaagaaucguucuu

SEQ ID NO: 2561303 - RNA, 17 nt, Chlamydophila pneumoniae J138
cacguuugacaaauuua

SEQ ID NO: 2561304 - RNA, 14 nt, Chlamydophila pneumoniae J138
cacuaaaagggaag

SEQ ID NO: 2561305 - RNA, 22 nt, Chlamydophila pneumoniae J138
cacuaaagauacuuaucuuuaa

SEQ ID NO: 2561306 - RNA, 17 nt, Chlamydophila pneumoniae J138
cacuaacggcaguaugc

SEQ ID NO: 2561307 - RNA, 17 nt, Chlamydophila pneumoniae J138
cacuaagauaucuccag

SEQ ID NO: 2561308 - RNA, 20 nt, Chlamydophila pneumoniae J138
cacuacagcuucauuaucuu

SEQ ID NO: 2561309 - RNA, 15 nt, Chlamydophila pneumoniae J138
cacuacuuaaagcuu

SEQ ID NO: 2561310 - RNA, 21 nt, Chlamydophila pneumoniae J138
cacuaggcaugguaggagccg

SEQ ID NO: 2561311 - RNA, 13 nt, Chlamydophila pneumoniae J138
cacuaucuguaau

SEQ ID NO: 2561312 - RNA, 20 nt, Chlamydophila pneumoniae J138
cacuauguguuuccuuuucu

SEQ ID NO: 2561313 - RNA, 21 nt, Chlamydophila pneumoniae J138
cacuauguguuuccuuuucuc

SEQ ID NO: 2561314 - RNA, 12 nt, Chlamydophila pneumoniae J138
cacuauuaauac

SEQ ID NO: 2561315 - RNA, 13 nt, Chlamydophila pneumoniae J138
cacuauuaucugc

SEQ ID NO: 2561316 - RNA, 19 nt, Chlamydophila pneumoniae J138
cacuauuaucugcagaaac

SEQ ID NO: 2561317 - RNA, 12 nt, Chlamydophila pneumoniae J138
cacucaaaagaa

SEQ ID NO: 2561318 - RNA, 17 nt, Chlamydophila pneumoniae J138
cacucaaacccucucca

SEQ ID NO: 2561319 - RNA, 19 nt, Chlamydophila pneumoniae J138
cacucaaacccucuccaga

SEQ ID NO: 2561320 - RNA, 13 nt, Chlamydophila pneumoniae J138
cacuccaaaacuc

SEQ ID NO: 2561321 - RNA, 14 nt, Chlamydophila pneumoniae J138
cacuccaaaacuca

SEQ ID NO: 2561322 - RNA, 22 nt, Chlamydophila pneumoniae J138
cacuccagaaaguauuccucuu

SEQ ID NO: 2561323 - RNA, 12 nt, Chlamydophila pneumoniae J138
cacucuuuaaaa

SEQ ID NO: 2561324 - RNA, 17 nt, Chlamydophila pneumoniae J138
cacucuuucagaaagaa

SEQ ID NO: 2561325 - RNA, 13 nt, Chlamydophila pneumoniae J138
cacucuuucugua

SEQ ID NO: 2561326 - RNA, 12 nt, Chlamydophila pneumoniae J138
cacucuuuucua

SEQ ID NO: 2561327 - RNA, 18 nt, Chlamydophila pneumoniae J138
cacugaacgccaucucca

SEQ ID NO: 2561328 - RNA, 22 nt, Chlamydophila pneumoniae J138
cacugaacgccaucuccacagc

SEQ ID NO: 2561329 - RNA, 17 nt, Chlamydophila pneumoniae J138
cacugacuuuaugaucu

SEQ ID NO: 2561330 - RNA, 20 nt, Chlamydophila pneumoniae J138
cacuggggcauaagaacucu

SEQ ID NO: 2561331 - RNA, 18 nt, Chlamydophila pneumoniae J138
cacugguagcuaaauuua

SEQ ID NO: 2561332 - RNA, 18 nt, Chlamydophila pneumoniae J138
cacuguaucagcaagccc

SEQ ID NO: 2561333 - RNA, 15 nt, Chlamydophila pneumoniae J138
cacuguuuugcuucu

SEQ ID NO: 2561334 - RNA, 19 nt, Chlamydophila pneumoniae J138
cacuuaaaaaacuuccuaa

SEQ ID NO: 2561335 - RNA, 14 nt, Chlamydophila pneumoniae J138
cacuuaaagguaaa

SEQ ID NO: 2561336 - RNA, 18 nt, Chlamydophila pneumoniae J138
cacuuaaagguaaaacua

SEQ ID NO: 2561337 - RNA, 16 nt, Chlamydophila pneumoniae J138
cacuuaacccuauggu

SEQ ID NO: 2561338 - RNA, 16 nt, Chlamydophila pneumoniae J138
cacuuaggguucucaa

SEQ ID NO: 2561339 - RNA, 21 nt, Chlamydophila pneumoniae J138
cacuuaguccgguuucuucua

SEQ ID NO: 2561340 - RNA, 18 nt, Chlamydophila pneumoniae J138
cacuucucagcaucucga

SEQ ID NO: 2561341 - RNA, 23 nt, Chlamydophila pneumoniae J138
cacuucuucaagaaaugcccugu

SEQ ID NO: 2561342 - RNA, 17 nt, Chlamydophila pneumoniae J138
cacuucuuuaggagcau

SEQ ID NO: 2561343 - RNA, 22 nt, Chlamydophila pneumoniae J138
cacuucuuugccguauagauuu

SEQ ID NO: 2561344 - RNA, 16 nt, Chlamydophila pneumoniae J138
cacuugcuuaaggaaa

SEQ ID NO: 2561345 - RNA, 21 nt, Chlamydophila pneumoniae J138
cacuugguagcgucucuucuu

SEQ ID NO: 2561346 - RNA, 19 nt, Chlamydophila pneumoniae J138
cacuuguuuuuucuucugu

SEQ ID NO: 2561347 - RNA, 15 nt, Chlamydophila pneumoniae J138
cacuuucugauguga

SEQ ID NO: 2561348 - RNA, 13 nt, Chlamydophila pneumoniae J138
cacuuugaauaau

SEQ ID NO: 2561349 - RNA, 18 nt, Chlamydophila pneumoniae J138
cagaaacacugaacgcca

SEQ ID NO: 2561350 - RNA, 18 nt, Chlamydophila pneumoniae J138
cagaaacgcaugaaccua

SEQ ID NO: 2561351 - RNA, 16 nt, Chlamydophila pneumoniae J138
cagaaacuccaaaaua

SEQ ID NO: 2561352 - RNA, 17 nt, Chlamydophila pneumoniae J138
cagaaacuuuaaaagca

SEQ ID NO: 2561353 - RNA, 16 nt, Chlamydophila pneumoniae J138
cagaaagagcuaaaga

SEQ ID NO: 2561354 - RNA, 15 nt, Chlamydophila pneumoniae J138
cagaaaggcuuuucu

SEQ ID NO: 2561355 - RNA, 20 nt, Chlamydophila pneumoniae J138
cagaaauggcauagggauga

SEQ ID NO: 2561356 - RNA, 15 nt, Chlamydophila pneumoniae J138
cagaaaugggcaaca

SEQ ID NO: 2561357 - RNA, 15 nt, Chlamydophila pneumoniae J138
cagaaaugucgugug

SEQ ID NO: 2561358 - RNA, 18 nt, Chlamydophila pneumoniae J138
cagaaauuacugugguau

SEQ ID NO: 2561359 - RNA, 13 nt, Chlamydophila pneumoniae J138
cagaacaacgcug

SEQ ID NO: 2561360 - RNA, 20 nt, Chlamydophila pneumoniae J138
cagaacaacgcugcuucucu

SEQ ID NO: 2561361 - RNA, 21 nt, Chlamydophila pneumoniae J138
cagaacaacgcugcuucucua

SEQ ID NO: 2561362 - RNA, 22 nt, Chlamydophila pneumoniae J138
cagaacaccaucacauccugua

SEQ ID NO: 2561363 - RNA, 16 nt, Chlamydophila pneumoniae J138
cagaagcauugaggac

SEQ ID NO: 2561364 - RNA, 20 nt, Chlamydophila pneumoniae J138
cagaagcauugaggacaaca

SEQ ID NO: 2561365 - RNA, 15 nt, Chlamydophila pneumoniae J138
cagaagcuccugagu

SEQ ID NO: 2561366 - RNA, 15 nt, Chlamydophila pneumoniae J138
cagaaggcuuguuuc

SEQ ID NO: 2561367 - RNA, 12 nt, Chlamydophila pneumoniae J138
cagcccugccuc

SEQ ID NO: 2561368 - RNA, 16 nt, Chlamydophila pneumoniae J138
cagccgcaucaugguc

SEQ ID NO: 2561369 - RNA, 13 nt, Chlamydophila pneumoniae J138
cagccggagcuuc

SEQ ID NO: 2561370 - RNA, 20 nt, Chlamydophila pneumoniae J138
cagccggagcuucuaagauc

SEQ ID NO: 2561371 - RNA, 15 nt, Chlamydophila pneumoniae J138
cagccugcaccagac

SEQ ID NO: 2561372 - RNA, 17 nt, Chlamydophila pneumoniae J138
cagccuggaaagcuucu

SEQ ID NO: 2561373 - RNA, 22 nt, Chlamydophila pneumoniae J138
cagccuguaaagaaggaggucc

SEQ ID NO: 2561374 - RNA, 13 nt, Chlamydophila pneumoniae J138
cagcgaggagaag

SEQ ID NO: 2561375 - RNA, 16 nt, Chlamydophila pneumoniae J138
cagcgcugugaggaaa

SEQ ID NO: 2561376 - RNA, 12 nt, Chlamydophila pneumoniae J138
cagcggcacccu

SEQ ID NO: 2561377 - RNA, 19 nt, Chlamydophila pneumoniae J138
cagcgguugccuuucucuu

SEQ ID NO: 2561378 - RNA, 18 nt, Chlamydophila pneumoniae J138
cagcguagguuugcugcu

SEQ ID NO: 2561379 - RNA, 13 nt, Chlamydophila pneumoniae J138
cagcguauaggaa

SEQ ID NO: 2561380 - RNA, 16 nt, Chlamydophila pneumoniae J138
cagcguugcuaagcau

SEQ ID NO: 2561381 - RNA, 20 nt, Chlamydophila pneumoniae J138
cagcguugcuaagcauagcc

SEQ ID NO: 2561382 - RNA, 13 nt, Chlamydophila pneumoniae J138
cagcuaaucaauc

SEQ ID NO: 2561383 - RNA, 19 nt, Chlamydophila pneumoniae J138
cagcuaaucaauccaagaa

SEQ ID NO: 2561384 - RNA, 20 nt, Chlamydophila pneumoniae J138
cagcuaaucaauccaagaau

SEQ ID NO: 2561385 - RNA, 19 nt, Chlamydophila pneumoniae J138
cagcuaaucauagccauca

SEQ ID NO: 2561386 - RNA, 22 nt, Chlamydophila pneumoniae J138
cagcuaauuuaaaugccuuaaa

SEQ ID NO: 2561387 - RNA, 19 nt, Chlamydophila pneumoniae J138
cagcuccauaagcuuuucu

SEQ ID NO: 2561388 - RNA, 16 nt, Chlamydophila pneumoniae J138
cagcuccauuuaaaug

SEQ ID NO: 2561389 - RNA, 14 nt, Chlamydophila pneumoniae J138
cagcucccaugugc

SEQ ID NO: 2561390 - RNA, 18 nt, Chlamydophila pneumoniae J138
cagcucccaugugcugaa

SEQ ID NO: 2561391 - RNA, 20 nt, Chlamydophila pneumoniae J138
cagcucccaugugcugaaga

SEQ ID NO: 2561392 - RNA, 13 nt, Chlamydophila pneumoniae J138
cagcuccuggaua

SEQ ID NO: 2561393 - RNA, 14 nt, Chlamydophila pneumoniae J138
cagcucgagaucuu

SEQ ID NO: 2561394 - RNA, 14 nt, Chlamydophila pneumoniae J138
cagcucggaaugcu

SEQ ID NO: 2561395 - RNA, 17 nt, Chlamydophila pneumoniae J138
cagcugauauccuugcu

SEQ ID NO: 2561396 - RNA, 18 nt, Chlamydophila pneumoniae J138
cagcuggguaaguccaca

SEQ ID NO: 2561397 - RNA, 13 nt, Chlamydophila pneumoniae J138
cagcuguacagaa

SEQ ID NO: 2561398 - RNA, 19 nt, Chlamydophila pneumoniae J138
cagcugucaauccaacaaa

SEQ ID NO: 2561399 - RNA, 17 nt, Chlamydophila pneumoniae J138
cagcuucaggauuagua

SEQ ID NO: 2561400 - RNA, 14 nt, Chlamydophila pneumoniae J138
cagcuucaucagaa

SEQ ID NO: 2561401 - RNA, 13 nt, Chlamydophila pneumoniae J138
cagcuucccaagc

SEQ ID NO: 2561402 - RNA, 16 nt, Chlamydophila pneumoniae J138
cagcuucgcaaucuuu

SEQ ID NO: 2561403 - RNA, 15 nt, Chlamydophila pneumoniae J138
cagcuucuacagcau

SEQ ID NO: 2561404 - RNA, 21 nt, Chlamydophila pneumoniae J138
cagcuucucuaguuguaauuu

SEQ ID NO: 2561405 - RNA, 17 nt, Chlamydophila pneumoniae J138
cagcuucuggagaaaaa

SEQ ID NO: 2561406 - RNA, 22 nt, Chlamydophila pneumoniae J138
cagcuucuggagaaaaaauauc

SEQ ID NO: 2561407 - RNA, 20 nt, Chlamydophila pneumoniae J138
cagcuucuugauguacagua

SEQ ID NO: 2561408 - RNA, 14 nt, Chlamydophila pneumoniae J138
cagcuucuuuucca

SEQ ID NO: 2561409 - RNA, 15 nt, Chlamydophila pneumoniae J138
cagcuucuuuuccag

SEQ ID NO: 2561410 - RNA, 17 nt, Chlamydophila pneumoniae J138
cagcuuuaucaggaucu

SEQ ID NO: 2561411 - RNA, 19 nt, Chlamydophila pneumoniae J138
cagcuuugcuuauuucccc

SEQ ID NO: 2561412 - RNA, 14 nt, Chlamydophila pneumoniae J138
caggaaaagcaaaa

SEQ ID NO: 2561413 - RNA, 21 nt, Chlamydophila pneumoniae J138
caggaaauaauuuguuuagaa

SEQ ID NO: 2561414 - RNA, 23 nt, Chlamydophila pneumoniae J138
caggaaauaauuuguuuagaaaa

SEQ ID NO: 2561415 - RNA, 12 nt, Chlamydophila pneumoniae J138
caggaaauuccg

SEQ ID NO: 2561416 - RNA, 13 nt, Chlamydophila pneumoniae J138
caggaacaaaggu

SEQ ID NO: 2561417 - RNA, 14 nt, Chlamydophila pneumoniae J138
caggaagaaaggau

SEQ ID NO: 2561418 - RNA, 13 nt, Chlamydophila pneumoniae J138
caggaagaacaag

SEQ ID NO: 2561419 - RNA, 17 nt, Chlamydophila pneumoniae J138
caggaaggaauagagaa

SEQ ID NO: 2561420 - RNA, 21 nt, Chlamydophila pneumoniae J138
caggaaguaagguuccaaaaa

SEQ ID NO: 2561421 - RNA, 17 nt, Chlamydophila pneumoniae J138
caggaaguccauguaca

SEQ ID NO: 2561422 - RNA, 16 nt, Chlamydophila pneumoniae J138
caggaauaaucaacca

SEQ ID NO: 2561423 - RNA, 15 nt, Chlamydophila pneumoniae J138
caggacaugccuuag

SEQ ID NO: 2561424 - RNA, 20 nt, Chlamydophila pneumoniae J138
caggaccuaagggcucuccu

SEQ ID NO: 2561425 - RNA, 16 nt, Chlamydophila pneumoniae J138
caggacgcacauuuag

SEQ ID NO: 2561426 - RNA, 23 nt, Chlamydophila pneumoniae J138
caggacuguuuguuuauuaucua

SEQ ID NO: 2561427 - RNA, 14 nt, Chlamydophila pneumoniae J138
caggacuucgcaaa

SEQ ID NO: 2561428 - RNA, 20 nt, Chlamydophila pneumoniae J138
caggagaacaauaucagcag

SEQ ID NO: 2561429 - RNA, 16 nt, Chlamydophila pneumoniae J138
caggagagagaaggcu

SEQ ID NO: 2561430 - RNA, 23 nt, Chlamydophila pneumoniae J138
caggagagagaaggcucucaagg

SEQ ID NO: 2561431 - RNA, 15 nt, Chlamydophila pneumoniae J138
caggagcuccuccuu

SEQ ID NO: 2561432 - RNA, 20 nt, Chlamydophila pneumoniae J138
caggaggugguggagcuugu

SEQ ID NO: 2561433 - RNA, 22 nt, Chlamydophila pneumoniae J138
caggaguuccgcggccaucauu

SEQ ID NO: 2561434 - RNA, 16 nt, Chlamydophila pneumoniae J138
caggaguucuugauuc

SEQ ID NO: 2561435 - RNA, 17 nt, Chlamydophila pneumoniae J138
caggauaccauaaggag

SEQ ID NO: 2561436 - RNA, 22 nt, Chlamydophila pneumoniae J138
caggaucccaaguaugguccau

SEQ ID NO: 2561437 - RNA, 19 nt, Chlamydophila pneumoniae J138
caggauuacggaaaauaca

SEQ ID NO: 2561438 - RNA, 23 nt, Chlamydophila pneumoniae J138
caggauuaguaacuaaauucuua

SEQ ID NO: 2561439 - RNA, 18 nt, Chlamydophila pneumoniae J138
caggauucuaaaaagaaa

SEQ ID NO: 2561440 - RNA, 15 nt, Chlamydophila pneumoniae J138
caggauugauaaaua

SEQ ID NO: 2561441 - RNA, 13 nt, Chlamydophila pneumoniae J138
caggauuuuccau

SEQ ID NO: 2561442 - RNA, 15 nt, Chlamydophila pneumoniae J138
caggauuuuccauua

SEQ ID NO: 2561443 - RNA, 14 nt, Chlamydophila pneumoniae J138
caggcucaugaaau

SEQ ID NO: 2561444 - RNA, 13 nt, Chlamydophila pneumoniae J138
caggcuucaccau

SEQ ID NO: 2561445 - RNA, 17 nt, Chlamydophila pneumoniae J138
cagggaaagaacagcag

SEQ ID NO: 2561446 - RNA, 14 nt, Chlamydophila pneumoniae J138
cagggaauagguag

SEQ ID NO: 2561447 - RNA, 19 nt, Chlamydophila pneumoniae J138
cagggacucuuuccauagc

SEQ ID NO: 2561448 - RNA, 23 nt, Chlamydophila pneumoniae J138
cagggagaucuacgccuucaagu

SEQ ID NO: 2561449 - RNA, 12 nt, Chlamydophila pneumoniae J138
cagggauauuuu

SEQ ID NO: 2561450 - RNA, 24 nt, Chlamydophila pneumoniae J138
cagggauauuuugagcuacaagaa

SEQ ID NO: 2561451 - RNA, 14 nt, Chlamydophila pneumoniae J138
cagggaucuucauc

SEQ ID NO: 2561452 - RNA, 14 nt, Chlamydophila pneumoniae J138
caggggauaaaacu

SEQ ID NO: 2561453 - RNA, 22 nt, Chlamydophila pneumoniae J138
caggguuucucggauccuccaa

SEQ ID NO: 2561454 - RNA, 17 nt, Chlamydophila pneumoniae J138
cagguaagggaugcucu

SEQ ID NO: 2561455 - RNA, 21 nt, Chlamydophila pneumoniae J138
cagguagauccuauaguaauu

SEQ ID NO: 2561456 - RNA, 14 nt, Chlamydophila pneumoniae J138
cagguaguaggaca

SEQ ID NO: 2561457 - RNA, 13 nt, Chlamydophila pneumoniae J138
cagguagucccuu

SEQ ID NO: 2561458 - RNA, 16 nt, Chlamydophila pneumoniae J138
cagguagucccuuucu

SEQ ID NO: 2561459 - RNA, 15 nt, Chlamydophila pneumoniae J138
caggucugcugagga

SEQ ID NO: 2561460 - RNA, 18 nt, Chlamydophila pneumoniae J138
caggucugcugaggagag

SEQ ID NO: 2561461 - RNA, 19 nt, Chlamydophila pneumoniae J138
caggugcggaacucaucac

SEQ ID NO: 2561462 - RNA, 21 nt, Chlamydophila pneumoniae J138
cagguucugaaauugucuuca

SEQ ID NO: 2561463 - RNA, 16 nt, Chlamydophila pneumoniae J138
caguaaaacacaaaua

SEQ ID NO: 2561464 - RNA, 19 nt, Chlamydophila pneumoniae J138
caguaaaaggucugcgucu

SEQ ID NO: 2561465 - RNA, 14 nt, Chlamydophila pneumoniae J138
caguaauuccaaaa

SEQ ID NO: 2561466 - RNA, 16 nt, Chlamydophila pneumoniae J138
caguaauuccaaaaua

SEQ ID NO: 2561467 - RNA, 16 nt, Chlamydophila pneumoniae J138
cauagguuagaaauga

SEQ ID NO: 2561468 - RNA, 15 nt, Chlamydophila pneumoniae J138
cauaguauggcauuc

SEQ ID NO: 2561469 - RNA, 20 nt, Chlamydophila pneumoniae J138
cauaguauggcauucuuuuu

SEQ ID NO: 2561470 - RNA, 18 nt, Chlamydophila pneumoniae J138
cauagucgucuuuuaaag

SEQ ID NO: 2561471 - RNA, 17 nt, Chlamydophila pneumoniae J138
cauagucguuuucucga

SEQ ID NO: 2561472 - RNA, 15 nt, Chlamydophila pneumoniae J138
cauaguuuuuauuuu

SEQ ID NO: 2561473 - RNA, 18 nt, Chlamydophila pneumoniae J138
cauaguuuuuauuuuuaa

SEQ ID NO: 2561474 - RNA, 22 nt, Chlamydophila pneumoniae J138
cauaguuuuuauuuuuaaauaa

SEQ ID NO: 2561475 - RNA, 20 nt, Chlamydophila pneumoniae J138
cauauacguggcuuccauaa

SEQ ID NO: 2561476 - RNA, 21 nt, Chlamydophila pneumoniae J138
cauauacguggcuuccauaac

SEQ ID NO: 2561477 - RNA, 18 nt, Chlamydophila pneumoniae J138
cauauacuguuaacaagu

SEQ ID NO: 2561478 - RNA, 20 nt, Chlamydophila pneumoniae J138
cauauagcucguuauauuuu

SEQ ID NO: 2561479 - RNA, 21 nt, Chlamydophila pneumoniae J138
cauauccaaugagagagagac

SEQ ID NO: 2561480 - RNA, 17 nt, Chlamydophila pneumoniae J138
cauauccauggaauggc

SEQ ID NO: 2561481 - RNA, 15 nt, Chlamydophila pneumoniae J138
cauaucggcagcagc

SEQ ID NO: 2561482 - RNA, 19 nt, Chlamydophila pneumoniae J138
cauaucuccuuuaaauaaa

SEQ ID NO: 2561483 - RNA, 14 nt, Chlamydophila pneumoniae J138
cauaugcucucccg

SEQ ID NO: 2561484 - RNA, 22 nt, Chlamydophila pneumoniae J138
cauauggauugucgaugaggga

SEQ ID NO: 2561485 - RNA, 17 nt, Chlamydophila pneumoniae J138
cauaugggacuucaagc

SEQ ID NO: 2561486 - RNA, 16 nt, Chlamydophila pneumoniae J138
cauauucucaggaacc

SEQ ID NO: 2561487 - RNA, 13 nt, Chlamydophila pneumoniae J138
cauauucuccuua

SEQ ID NO: 2561488 - RNA, 16 nt, Chlamydophila pneumoniae J138
cauauuuauuuaaacc

SEQ ID NO: 2561489 - RNA, 16 nt, Chlamydophila pneumoniae J138
cauauuugaauaaagg

SEQ ID NO: 2561490 - RNA, 15 nt, Chlamydophila pneumoniae J138
cauauuuugucuuca

SEQ ID NO: 2561491 - RNA, 17 nt, Chlamydophila pneumoniae J138
cauauuuugucuucauc

SEQ ID NO: 2561492 - RNA, 13 nt, Chlamydophila pneumoniae J138
caucaaaacauaa

SEQ ID NO: 2561493 - RNA, 21 nt, Chlamydophila pneumoniae J138
caucaaaagauaugucuugcu

SEQ ID NO: 2561494 - RNA, 14 nt, Chlamydophila pneumoniae J138
caucaaagaauuau

SEQ ID NO: 2561495 - RNA, 20 nt, Chlamydophila pneumoniae J138
caucaaauaguucaucauau

SEQ ID NO: 2561496 - RNA, 21 nt, Chlamydophila pneumoniae J138
caucaaccgaagauccuagag

SEQ ID NO: 2561497 - RNA, 12 nt, Chlamydophila pneumoniae J138
caucaagagaua

SEQ ID NO: 2561498 - RNA, 15 nt, Chlamydophila pneumoniae J138
caucaaucacucuau

SEQ ID NO: 2561499 - RNA, 22 nt, Chlamydophila pneumoniae J138
caucaaugagaucugcaaacgc

SEQ ID NO: 2561500 - RNA, 23 nt, Chlamydophila pneumoniae J138
caucaaugauaucgccuuccuua

SEQ ID NO: 2561501 - RNA, 19 nt, Chlamydophila pneumoniae J138
caucacaaacuaaaucaac

SEQ ID NO: 2561502 - RNA, 16 nt, Chlamydophila pneumoniae J138
caucacaauuuuaaaa

SEQ ID NO: 2561503 - RNA, 22 nt, Chlamydophila pneumoniae J138
caucaccauccaaagcuauuuc

SEQ ID NO: 2561504 - RNA, 18 nt, Chlamydophila pneumoniae J138
caucacgaaaaggagaau

SEQ ID NO: 2561505 - RNA, 14 nt, Chlamydophila pneumoniae J138
caucacgaggagcu

SEQ ID NO: 2561506 - RNA, 18 nt, Chlamydophila pneumoniae J138
caucagaagccaccaaaa

SEQ ID NO: 2561507 - RNA, 21 nt, Chlamydophila pneumoniae J138
caucagaaguggccuugccag

SEQ ID NO: 2561508 - RNA, 18 nt, Chlamydophila pneumoniae J138
caucagagaacucuuaaa

SEQ ID NO: 2561509 - RNA, 19 nt, Chlamydophila pneumoniae J138
caucagcaaaacucccgac

SEQ ID NO: 2561510 - RNA, 21 nt, Chlamydophila pneumoniae J138
caucagcagcugucaauccaa

SEQ ID NO: 2561511 - RNA, 16 nt, Chlamydophila pneumoniae J138
caucaggauucucucu

SEQ ID NO: 2561512 - RNA, 18 nt, Chlamydophila pneumoniae J138
caucaggcggaugaccuu

SEQ ID NO: 2561513 - RNA, 13 nt, Chlamydophila pneumoniae J138
caucaguaaaaga

SEQ ID NO: 2561514 - RNA, 19 nt, Chlamydophila pneumoniae J138
caucaguggauucgugcuu

SEQ ID NO: 2561515 - RNA, 20 nt, Chlamydophila pneumoniae J138
caucaguggcgacugcaaca

SEQ ID NO: 2561516 - RNA, 14 nt, Chlamydophila pneumoniae J138
caucaucagaagcu

SEQ ID NO: 2561517 - RNA, 17 nt, Chlamydophila pneumoniae J138
caucaucagaagcuccu

SEQ ID NO: 2561518 - RNA, 17 nt, Chlamydophila pneumoniae J138
caucauccucaggaccu

SEQ ID NO: 2561519 - RNA, 12 nt, Chlamydophila pneumoniae J138
caucaucgagcu

SEQ ID NO: 2561520 - RNA, 18 nt, Chlamydophila pneumoniae J138
caucaucuccugaagcca

SEQ ID NO: 2561521 - RNA, 20 nt, Chlamydophila pneumoniae J138
caucaugaaauacccgcacc

SEQ ID NO: 2561522 - RNA, 12 nt, Chlamydophila pneumoniae J138
cauccagaagua

SEQ ID NO: 2561523 - RNA, 18 nt, Chlamydophila pneumoniae J138
cauccauucuuaauauaa

SEQ ID NO: 2561524 - RNA, 21 nt, Chlamydophila pneumoniae J138
caucccgaacgcuagggaaac

SEQ ID NO: 2561525 - RNA, 21 nt, Chlamydophila pneumoniae J138
cauccugaacggcucuuucua

SEQ ID NO: 2561526 - RNA, 14 nt, Chlamydophila pneumoniae J138
cauccugaucuucu

SEQ ID NO: 2561527 - RNA, 19 nt, Chlamydophila pneumoniae J138
cauccugucuauuucuuaa

SEQ ID NO: 2561528 - RNA, 12 nt, Chlamydophila pneumoniae J138
cauccuucuuua

SEQ ID NO: 2561529 - RNA, 18 nt, Chlamydophila pneumoniae J138
cauccuucuuuaccuaug

SEQ ID NO: 2561530 - RNA, 18 nt, Chlamydophila pneumoniae J138
cauccuuguagaacuucu

SEQ ID NO: 2561531 - RNA, 21 nt, Chlamydophila pneumoniae J138
cauccuuuagcuguuucucug

SEQ ID NO: 2561532 - RNA, 21 nt, Chlamydophila pneumoniae J138
caucgaaaccacagcaaagac

SEQ ID NO: 2561533 - RNA, 23 nt, Chlamydophila pneumoniae J138
caucgagaaaugcucuucugcag

SEQ ID NO: 2561534 - RNA, 18 nt, Chlamydophila pneumoniae J138
caucggagaacuuccuga

SEQ ID NO: 2561535 - RNA, 22 nt, Chlamydophila pneumoniae J138
caucggcauuucuccacaugcc

SEQ ID NO: 2561536 - RNA, 23 nt, Chlamydophila pneumoniae J138
caucgguucggucucuucucugu

SEQ ID NO: 2561537 - RNA, 20 nt, Chlamydophila pneumoniae J138
caucuaauuuuaaauuuugu

SEQ ID NO: 2561538 - RNA, 17 nt, Chlamydophila pneumoniae J138
caucuacgauguuuucu

SEQ ID NO: 2561539 - RNA, 17 nt, Chlamydophila pneumoniae J138
caucuagaaagauuuau

SEQ ID NO: 2561540 - RNA, 22 nt, Chlamydophila pneumoniae J138
caucuagaagcauucucaauuc

SEQ ID NO: 2561541 - RNA, 17 nt, Chlamydophila pneumoniae J138
caucucacaagcauccu

SEQ ID NO: 2561542 - RNA, 15 nt, Chlamydophila pneumoniae J138
caucuccaagauaau

SEQ ID NO: 2561543 - RNA, 18 nt, Chlamydophila pneumoniae J138
caucucgcaguccaaaga

SEQ ID NO: 2561544 - RNA, 11 nt, Chlamydophila pneumoniae J138
caucucucucc

SEQ ID NO: 2561545 - RNA, 12 nt, Chlamydophila pneumoniae J138
caucucuggaau

SEQ ID NO: 2561546 - RNA, 18 nt, Chlamydophila pneumoniae J138
caucugauacuguuuuuu

SEQ ID NO: 2561547 - RNA, 18 nt, Chlamydophila pneumoniae J138
caucugcguuuaaggguu

SEQ ID NO: 2561548 - RNA, 17 nt, Chlamydophila pneumoniae J138
caucuucacuaaaugac

SEQ ID NO: 2561549 - RNA, 22 nt, Chlamydophila pneumoniae J138
caucuucacuaaaugacgcaca

SEQ ID NO: 2561550 - RNA, 12 nt, Chlamydophila pneumoniae J138
caucuuccucuu

SEQ ID NO: 2561551 - RNA, 19 nt, Chlamydophila pneumoniae J138
caucuucuuggcuuucccc

SEQ ID NO: 2561552 - RNA, 15 nt, Chlamydophila pneumoniae J138
caucuuuggcacaau

SEQ ID NO: 2561553 - RNA, 13 nt, Chlamydophila pneumoniae J138
caugaaaauacaa

SEQ ID NO: 2561554 - RNA, 23 nt, Chlamydophila pneumoniae J138
caugaaagauaaugucuccaucg

SEQ ID NO: 2561555 - RNA, 19 nt, Chlamydophila pneumoniae J138
caugaaauaguguuucuuu

SEQ ID NO: 2561556 - RNA, 21 nt, Chlamydophila pneumoniae J138
caugaaauaguguuucuuuau

SEQ ID NO: 2561557 - RNA, 16 nt, Chlamydophila pneumoniae J138
caugaacgugcaucuc

SEQ ID NO: 2561558 - RNA, 21 nt, Chlamydophila pneumoniae J138
caugaacgugcaucucuucag

SEQ ID NO: 2561559 - RNA, 18 nt, Chlamydophila pneumoniae J138
caugaagcagaaacuuua

SEQ ID NO: 2561560 - RNA, 15 nt, Chlamydophila pneumoniae J138
caugaaucucuucug

SEQ ID NO: 2561561 - RNA, 18 nt, Chlamydophila pneumoniae J138
caugaaucugguuccuua

SEQ ID NO: 2561562 - RNA, 19 nt, Chlamydophila pneumoniae J138
caugacauaggcaaauccu

SEQ ID NO: 2561563 - RNA, 20 nt, Chlamydophila pneumoniae J138
caugaccuuuagcugcugaa

SEQ ID NO: 2561564 - RNA, 21 nt, Chlamydophila pneumoniae J138
caugaccuuuaggaacuugaa

SEQ ID NO: 2561565 - RNA, 18 nt, Chlamydophila pneumoniae J138
caugacuugacacaggag

SEQ ID NO: 2561566 - RNA, 14 nt, Chlamydophila pneumoniae J138
cauuuuuccuccuc

SEQ ID NO: 2561567 - RNA, 20 nt, Chlamydophila pneumoniae J138
cauuuuugggaaaagaaaag

SEQ ID NO: 2561568 - RNA, 21 nt, Chlamydophila pneumoniae J138
ccaaaaaagagcccaaaaaca

SEQ ID NO: 2561569 - RNA, 20 nt, Chlamydophila pneumoniae J138
ccaaaagaauuaagaagaag

SEQ ID NO: 2561570 - RNA, 23 nt, Chlamydophila pneumoniae J138
ccaaaagaauuaagaagaagcug

SEQ ID NO: 2561571 - RNA, 23 nt, Chlamydophila pneumoniae J138
ccaaaagaauuccuaaaacgagc

SEQ ID NO: 2561572 - RNA, 12 nt, Chlamydophila pneumoniae J138
ccaaaauaaucu

SEQ ID NO: 2561573 - RNA, 22 nt, Chlamydophila pneumoniae J138
ccaaaauuaccguuuccuccuc

SEQ ID NO: 2561574 - RNA, 23 nt, Chlamydophila pneumoniae J138
ccaaaauuaccguuuccuccucu

SEQ ID NO: 2561575 - RNA, 21 nt, Chlamydophila pneumoniae J138
ccaaacauggacaauauagag

SEQ ID NO: 2561576 - RNA, 16 nt, Chlamydophila pneumoniae J138
ccaaaccaugaggcug

SEQ ID NO: 2561577 - RNA, 22 nt, Chlamydophila pneumoniae J138
ccaaacccugggcucacucuaa

SEQ ID NO: 2561578 - RNA, 20 nt, Chlamydophila pneumoniae J138
ccaaacggcugauucuccca

SEQ ID NO: 2561579 - RNA, 21 nt, Chlamydophila pneumoniae J138
ccaaacgucaggcuccugacg

SEQ ID NO: 2561580 - RNA, 19 nt, Chlamydophila pneumoniae J138
ccaaacuuggucauuauag

SEQ ID NO: 2561581 - RNA, 11 nt, Chlamydophila pneumoniae J138
ccaaagaacag

SEQ ID NO: 2561582 - RNA, 15 nt, Chlamydophila pneumoniae J138
ccaaagaacagcacu

SEQ ID NO: 2561583 - RNA, 17 nt, Chlamydophila pneumoniae J138
ccaaagcagauccugcu

SEQ ID NO: 2561584 - RNA, 19 nt, Chlamydophila pneumoniae J138
ccaaagcaguguauaacgu

SEQ ID NO: 2561585 - RNA, 16 nt, Chlamydophila pneumoniae J138
ccaaagcauauacugu

SEQ ID NO: 2561586 - RNA, 17 nt, Chlamydophila pneumoniae J138
ccaaagcuauuucucua

SEQ ID NO: 2561587 - RNA, 20 nt, Chlamydophila pneumoniae J138
ccaaagcuauuucucuauca

SEQ ID NO: 2561588 - RNA, 18 nt, Chlamydophila pneumoniae J138
ccaaagucacucaaaccc

SEQ ID NO: 2561589 - RNA, 20 nt, Chlamydophila pneumoniae J138
ccaaagucacucaaacccuc

SEQ ID NO: 2561590 - RNA, 17 nt, Chlamydophila pneumoniae J138
ccaaagugacuuccucc

SEQ ID NO: 2561591 - RNA, 23 nt, Chlamydophila pneumoniae J138
ccaaagugacuuccuccaaaauu

SEQ ID NO: 2561592 - RNA, 14 nt, Chlamydophila pneumoniae J138
ccaaaguuuguagc

SEQ ID NO: 2561593 - RNA, 22 nt, Chlamydophila pneumoniae J138
ccaaauagagugaccauagcau

SEQ ID NO: 2561594 - RNA, 12 nt, Chlamydophila pneumoniae J138
ccaaauccuccg

SEQ ID NO: 2561595 - RNA, 14 nt, Chlamydophila pneumoniae J138
ccaaauguucucuc

SEQ ID NO: 2561596 - RNA, 16 nt, Chlamydophila pneumoniae J138
ccaaauguucucucca

SEQ ID NO: 2561597 - RNA, 21 nt, Chlamydophila pneumoniae J138
ccaaauguucucuccagcugu

SEQ ID NO: 2561598 - RNA, 16 nt, Chlamydophila pneumoniae J138
ccaaauuccuucauac

SEQ ID NO: 2561599 - RNA, 23 nt, Chlamydophila pneumoniae J138
ccaacacgcacaaacuaacauag

SEQ ID NO: 2561600 - RNA, 13 nt, Chlamydophila pneumoniae J138
ccaacccuauuua

SEQ ID NO: 2561601 - RNA, 21 nt, Chlamydophila pneumoniae J138
ccaacuaaaacagccuagcaa

SEQ ID NO: 2561602 - RNA, 22 nt, Chlamydophila pneumoniae J138
ccaacucccgcuagaucaaaac

SEQ ID NO: 2561603 - RNA, 15 nt, Chlamydophila pneumoniae J138
ccaacugagcuauuu

SEQ ID NO: 2561604 - RNA, 22 nt, Chlamydophila pneumoniae J138
ccaacuuuugaagauccugagu

SEQ ID NO: 2561605 - RNA, 16 nt, Chlamydophila pneumoniae J138
ccaagaaauauacugc

SEQ ID NO: 2561606 - RNA, 13 nt, Chlamydophila pneumoniae J138
ccaagacaaaaaa

SEQ ID NO: 2561607 - RNA, 16 nt, Chlamydophila pneumoniae J138
ccaagacaauggaaau

SEQ ID NO: 2561608 - RNA, 22 nt, Chlamydophila pneumoniae J138
ccaagacaauggaaauagagaa

SEQ ID NO: 2561609 - RNA, 13 nt, Chlamydophila pneumoniae J138
ccaagacgcggaa

SEQ ID NO: 2561610 - RNA, 22 nt, Chlamydophila pneumoniae J138
ccaagagucuuugaugcuaaac

SEQ ID NO: 2561611 - RNA, 14 nt, Chlamydophila pneumoniae J138
ccaagcaagaagug

SEQ ID NO: 2561612 - RNA, 22 nt, Chlamydophila pneumoniae J138
ccaagcaggugugugguaaaaa

SEQ ID NO: 2561613 - RNA, 17 nt, Chlamydophila pneumoniae J138
ccaagcuuccaacuuuu

SEQ ID NO: 2561614 - RNA, 20 nt, Chlamydophila pneumoniae J138
ccaagcuuccaacuuuugaa

SEQ ID NO: 2561615 - RNA, 17 nt, Chlamydophila pneumoniae J138
ccaaggaaauuauggag

SEQ ID NO: 2561616 - RNA, 19 nt, Chlamydophila pneumoniae J138
ccaagggagaggucugcuc

SEQ ID NO: 2561617 - RNA, 14 nt, Chlamydophila pneumoniae J138
ccaaguacaguauc

SEQ ID NO: 2561618 - RNA, 19 nt, Chlamydophila pneumoniae J138
ccaagucagccaagacaaa

SEQ ID NO: 2561619 - RNA, 22 nt, Chlamydophila pneumoniae J138
ccaaguguugccagcccauguc

SEQ ID NO: 2561620 - RNA, 18 nt, Chlamydophila pneumoniae J138
ccaaguuguagugaauga

SEQ ID NO: 2561621 - RNA, 15 nt, Chlamydophila pneumoniae J138
ccaauaaauccaaaa

SEQ ID NO: 2561622 - RNA, 18 nt, Chlamydophila pneumoniae J138
ccaauaaauccaaaaaau

SEQ ID NO: 2561623 - RNA, 20 nt, Chlamydophila pneumoniae J138
ccaauaaccgaaacuucuca

SEQ ID NO: 2561624 - RNA, 18 nt, Chlamydophila pneumoniae J138
ccaauacagcauaaaaau

SEQ ID NO: 2561625 - RNA, 15 nt, Chlamydophila pneumoniae J138
ccaauauagaagcug

SEQ ID NO: 2561626 - RNA, 20 nt, Chlamydophila pneumoniae J138
ccaauauagaagcugcugcu

SEQ ID NO: 2561627 - RNA, 21 nt, Chlamydophila pneumoniae J138
ccaauaugcucugccauuucu

SEQ ID NO: 2561628 - RNA, 18 nt, Chlamydophila pneumoniae J138
ccaaugagcucuauuucu

SEQ ID NO: 2561629 - RNA, 21 nt, Chlamydophila pneumoniae J138
ccaaugcaugaaucucuucug

SEQ ID NO: 2561630 - RNA, 22 nt, Chlamydophila pneumoniae J138
ccaaugggaauuugauuuuuca

SEQ ID NO: 2561631 - RNA, 19 nt, Chlamydophila pneumoniae J138
ccaauguggugauuucuuu

SEQ ID NO: 2561632 - RNA, 20 nt, Chlamydophila pneumoniae J138
ccaauugcagucacuacugu

SEQ ID NO: 2561633 - RNA, 23 nt, Chlamydophila pneumoniae J138
ccaauuguaucuguauccuuccu

SEQ ID NO: 2561634 - RNA, 14 nt, Chlamydophila pneumoniae J138
ccacaagcuuuucg

SEQ ID NO: 2561635 - RNA, 13 nt, Chlamydophila pneumoniae J138
ccacaauuccuaa

SEQ ID NO: 2561636 - RNA, 19 nt, Chlamydophila pneumoniae J138
ccacaauuccuaaaacaag

SEQ ID NO: 2561637 - RNA, 21 nt, Chlamydophila pneumoniae J138
ccacagagaccuucucuucag

SEQ ID NO: 2561638 - RNA, 23 nt, Chlamydophila pneumoniae J138
ccacagccaaguucguuggccca

SEQ ID NO: 2561639 - RNA, 14 nt, Chlamydophila pneumoniae J138
ccacagggucuagu

SEQ ID NO: 2561640 - RNA, 15 nt, Chlamydophila pneumoniae J138
ccacaugaaguccug

SEQ ID NO: 2561641 - RNA, 20 nt, Chlamydophila pneumoniae J138
ccacauugcgggcucaaaga

SEQ ID NO: 2561642 - RNA, 19 nt, Chlamydophila pneumoniae J138
ccaccaaagugacuuccuc

SEQ ID NO: 2561643 - RNA, 22 nt, Chlamydophila pneumoniae J138
ccaccaaagugacuuccuccaa

SEQ ID NO: 2561644 - RNA, 16 nt, Chlamydophila pneumoniae J138
ccaccaacaaugcgau

SEQ ID NO: 2561645 - RNA, 15 nt, Chlamydophila pneumoniae J138
ccaccaacaguccug

SEQ ID NO: 2561646 - RNA, 12 nt, Chlamydophila pneumoniae J138
ccaccaggagcu

SEQ ID NO: 2561647 - RNA, 18 nt, Chlamydophila pneumoniae J138
ccaccaggagcuccuccu

SEQ ID NO: 2561648 - RNA, 19 nt, Chlamydophila pneumoniae J138
ccaccaggagcuccuccuu

SEQ ID NO: 2561649 - RNA, 21 nt, Chlamydophila pneumoniae J138
ccaccagggguuucuaaauac

SEQ ID NO: 2561650 - RNA, 18 nt, Chlamydophila pneumoniae J138
ccacccuuggcagagccg

SEQ ID NO: 2561651 - RNA, 13 nt, Chlamydophila pneumoniae J138
ccacgaaauguua

SEQ ID NO: 2561652 - RNA, 14 nt, Chlamydophila pneumoniae J138
ccacgaauucuuua

SEQ ID NO: 2561653 - RNA, 16 nt, Chlamydophila pneumoniae J138
ccacgaauucuuuaaa

SEQ ID NO: 2561654 - RNA, 15 nt, Chlamydophila pneumoniae J138
ccacgaccuacacca

SEQ ID NO: 2561655 - RNA, 22 nt, Chlamydophila pneumoniae J138
ccacgaccugcaaacuccccag

SEQ ID NO: 2561656 - RNA, 22 nt, Chlamydophila pneumoniae J138
ccacgaguucgcggaucuucuu

SEQ ID NO: 2561657 - RNA, 23 nt, Chlamydophila pneumoniae J138
ccacgaguucgcggaucuucuuc

SEQ ID NO: 2561658 - RNA, 15 nt, Chlamydophila pneumoniae J138
ccacggauuuucucu

SEQ ID NO: 2561659 - RNA, 15 nt, Chlamydophila pneumoniae J138
ccacgggucaggagg

SEQ ID NO: 2561660 - RNA, 21 nt, Chlamydophila pneumoniae J138
ccacgggucaggagguggugg

SEQ ID NO: 2561661 - RNA, 18 nt, Chlamydophila pneumoniae J138
ccacucaaaagaagaguu

SEQ ID NO: 2561662 - RNA, 12 nt, Chlamydophila pneumoniae J138
ccacugcuuuag

SEQ ID NO: 2561663 - RNA, 16 nt, Chlamydophila pneumoniae J138
ccacuuuuuucccucc

SEQ ID NO: 2561664 - RNA, 23 nt, Chlamydophila pneumoniae J138
ccagaaagauucugcccaaagcu

SEQ ID NO: 2561665 - RNA, 12 nt, Chlamydophila pneumoniae J138
cccauguuucuu

SEQ ID NO: 2561666 - RNA, 11 nt, Chlamydophila pneumoniae J138
cccauuacagc

SEQ ID NO: 2561667 - RNA, 22 nt, Chlamydophila pneumoniae J138
ccccaaucaguucaucuagaug

SEQ ID NO: 2561668 - RNA, 22 nt, Chlamydophila pneumoniae J138
ccccaccaaagugacuuccucc

SEQ ID NO: 2561669 - RNA, 14 nt, Chlamydophila pneumoniae J138
ccccacccacucca

SEQ ID NO: 2561670 - RNA, 14 nt, Chlamydophila pneumoniae J138
ccccacgcuaaacu

SEQ ID NO: 2561671 - RNA, 19 nt, Chlamydophila pneumoniae J138
ccccacgcuaaacuaaaau

SEQ ID NO: 2561672 - RNA, 22 nt, Chlamydophila pneumoniae J138
ccccaguuucuugauauuuguc

SEQ ID NO: 2561673 - RNA, 13 nt, Chlamydophila pneumoniae J138
ccccauaaaaauu

SEQ ID NO: 2561674 - RNA, 20 nt, Chlamydophila pneumoniae J138
ccccguucguggagcaucau

SEQ ID NO: 2561675 - RNA, 10 nt, Chlamydophila pneumoniae J138
ccccucucuc

SEQ ID NO: 2561676 - RNA, 22 nt, Chlamydophila pneumoniae J138
cccgaguccuaaaauuucuagg

SEQ ID NO: 2561677 - RNA, 12 nt, Chlamydophila pneumoniae J138
cccgcagcuucu

SEQ ID NO: 2561678 - RNA, 13 nt, Chlamydophila pneumoniae J138
cccgugacugcgu

SEQ ID NO: 2561679 - RNA, 13 nt, Chlamydophila pneumoniae J138
cccgugagcaugc

SEQ ID NO: 2561680 - RNA, 19 nt, Chlamydophila pneumoniae J138
cccuaaaaugagauuccua

SEQ ID NO: 2561681 - RNA, 20 nt, Chlamydophila pneumoniae J138
cccuaagguagaguccacag

SEQ ID NO: 2561682 - RNA, 19 nt, Chlamydophila pneumoniae J138
cccucaagcgauuucgaaa

SEQ ID NO: 2561683 - RNA, 15 nt, Chlamydophila pneumoniae J138
cccucagaaaggaga

SEQ ID NO: 2561684 - RNA, 20 nt, Chlamydophila pneumoniae J138
cccucauaagauuuccccaa

SEQ ID NO: 2561685 - RNA, 13 nt, Chlamydophila pneumoniae J138
cccucgaaccacu

SEQ ID NO: 2561686 - RNA, 23 nt, Chlamydophila pneumoniae J138
cccucgguuauuuuuccagaaau

SEQ ID NO: 2561687 - RNA, 11 nt, Chlamydophila pneumoniae J138
cccucuccuug

SEQ ID NO: 2561688 - RNA, 18 nt, Chlamydophila pneumoniae J138
cccucugauuauuucuaa

SEQ ID NO: 2561689 - RNA, 21 nt, Chlamydophila pneumoniae J138
cccugauuccauccugucuau

SEQ ID NO: 2561690 - RNA, 18 nt, Chlamydophila pneumoniae J138
cccugcaccaauugcagu

SEQ ID NO: 2561691 - RNA, 16 nt, Chlamydophila pneumoniae J138
cccugcaucucugcau

SEQ ID NO: 2561692 - RNA, 17 nt, Chlamydophila pneumoniae J138
cccuggucuguauuuuc

SEQ ID NO: 2561693 - RNA, 23 nt, Chlamydophila pneumoniae J138
cccuuaaagagaaucuccucauc

SEQ ID NO: 2561694 - RNA, 19 nt, Chlamydophila pneumoniae J138
cccuuacgguaauccccaa

SEQ ID NO: 2561695 - RNA, 12 nt, Chlamydophila pneumoniae J138
cccuucuuagua

SEQ ID NO: 2561696 - RNA, 16 nt, Chlamydophila pneumoniae J138
cccuugggauuccuua

SEQ ID NO: 2561697 - RNA, 23 nt, Chlamydophila pneumoniae J138
cccuuuauacuguuuuucuucca

SEQ ID NO: 2561698 - RNA, 15 nt, Chlamydophila pneumoniae J138
ccgaaaguaucuuca

SEQ ID NO: 2561699 - RNA, 12 nt, Chlamydophila pneumoniae J138
ccgaacagagcg

SEQ ID NO: 2561700 - RNA, 22 nt, Chlamydophila pneumoniae J138
ccgaagacaaugucgucucaga

SEQ ID NO: 2561701 - RNA, 15 nt, Chlamydophila pneumoniae J138
ccgaagacuaccaau

SEQ ID NO: 2561702 - RNA, 13 nt, Chlamydophila pneumoniae J138
ccgaagcauuccc

SEQ ID NO: 2561703 - RNA, 15 nt, Chlamydophila pneumoniae J138
ccgaauaggcauuac

SEQ ID NO: 2561704 - RNA, 22 nt, Chlamydophila pneumoniae J138
ccgacaagcuucguccugacac

SEQ ID NO: 2561705 - RNA, 15 nt, Chlamydophila pneumoniae J138
ccgagcuuuuugcuu

SEQ ID NO: 2561706 - RNA, 16 nt, Chlamydophila pneumoniae J138
ccgaucauuuuugcua

SEQ ID NO: 2561707 - RNA, 18 nt, Chlamydophila pneumoniae J138
ccgcaaauacagacagau

SEQ ID NO: 2561708 - RNA, 19 nt, Chlamydophila pneumoniae J138
ccgcacucauaggguaguu

SEQ ID NO: 2561709 - RNA, 13 nt, Chlamydophila pneumoniae J138
ccgcagcuucucu

SEQ ID NO: 2561710 - RNA, 13 nt, Chlamydophila pneumoniae J138
ccgcauauugauc

SEQ ID NO: 2561711 - RNA, 17 nt, Chlamydophila pneumoniae J138
ccgccauaacacuuugc

SEQ ID NO: 2561712 - RNA, 16 nt, Chlamydophila pneumoniae J138
ccgccguggaauagcu

SEQ ID NO: 2561713 - RNA, 14 nt, Chlamydophila pneumoniae J138
ccgccuuucuaccc

SEQ ID NO: 2561714 - RNA, 21 nt, Chlamydophila pneumoniae J138
ccgcuguauuuucagcacuga

SEQ ID NO: 2561715 - RNA, 19 nt, Chlamydophila pneumoniae J138
ccggagcuucuaagaucuu

SEQ ID NO: 2561716 - RNA, 18 nt, Chlamydophila pneumoniae J138
ccggauucuuuaucccca

SEQ ID NO: 2561717 - RNA, 17 nt, Chlamydophila pneumoniae J138
ccggcgguggaaaagga

SEQ ID NO: 2561718 - RNA, 17 nt, Chlamydophila pneumoniae J138
ccggcuuguaggaucug

SEQ ID NO: 2561719 - RNA, 14 nt, Chlamydophila pneumoniae J138
ccguaacugaggca

SEQ ID NO: 2561720 - RNA, 16 nt, Chlamydophila pneumoniae J138
ccguauaacuuuaugu

SEQ ID NO: 2561721 - RNA, 14 nt, Chlamydophila pneumoniae J138
ccguauucccaggu

SEQ ID NO: 2561722 - RNA, 15 nt, Chlamydophila pneumoniae J138
ccguccaguucuuca

SEQ ID NO: 2561723 - RNA, 15 nt, Chlamydophila pneumoniae J138
ccgugacuccagaag

SEQ ID NO: 2561724 - RNA, 17 nt, Chlamydophila pneumoniae J138
ccgugagauacuuuaaa

SEQ ID NO: 2561725 - RNA, 16 nt, Chlamydophila pneumoniae J138
ccguggaauagcuucu

SEQ ID NO: 2561726 - RNA, 14 nt, Chlamydophila pneumoniae J138
ccguuaauuuuugc

SEQ ID NO: 2561727 - RNA, 13 nt, Chlamydophila pneumoniae J138
ccguucgagaggu

SEQ ID NO: 2561728 - RNA, 13 nt, Chlamydophila pneumoniae J138
ccguuuccuccuc

SEQ ID NO: 2561729 - RNA, 13 nt, Chlamydophila pneumoniae J138
ccguuugucccuu

SEQ ID NO: 2561730 - RNA, 19 nt, Chlamydophila pneumoniae J138
ccuaaaaaggucagcccug

SEQ ID NO: 2561731 - RNA, 20 nt, Chlamydophila pneumoniae J138
ccuaaaaaggucagcccugc

SEQ ID NO: 2561732 - RNA, 20 nt, Chlamydophila pneumoniae J138
ccuaaaauggugaagaauaa

SEQ ID NO: 2561733 - RNA, 21 nt, Chlamydophila pneumoniae J138
ccuaaaccaucacuuccuguu

SEQ ID NO: 2561734 - RNA, 11 nt, Chlamydophila pneumoniae J138
ccuaaagcauc

SEQ ID NO: 2561735 - RNA, 20 nt, Chlamydophila pneumoniae J138
ccuaaaguaacgauaagaag

SEQ ID NO: 2561736 - RNA, 23 nt, Chlamydophila pneumoniae J138
ccuaaaguuugagcuaagcugaa

SEQ ID NO: 2561737 - RNA, 23 nt, Chlamydophila pneumoniae J138
ccuaagagauuuuccauaggaac

SEQ ID NO: 2561738 - RNA, 17 nt, Chlamydophila pneumoniae J138
ccuaagcucauaagaaa

SEQ ID NO: 2561739 - RNA, 18 nt, Chlamydophila pneumoniae J138
ccuaagcucauaagaaau

SEQ ID NO: 2561740 - RNA, 16 nt, Chlamydophila pneumoniae J138
ccuaagggcucuccua

SEQ ID NO: 2561741 - RNA, 16 nt, Chlamydophila pneumoniae J138
ccuaagugauaaggaa

SEQ ID NO: 2561742 - RNA, 17 nt, Chlamydophila pneumoniae J138
ccuaagugauaaggaag

SEQ ID NO: 2561743 - RNA, 15 nt, Chlamydophila pneumoniae J138
ccuaauucauauuua

SEQ ID NO: 2561744 - RNA, 24 nt, Chlamydophila pneumoniae J138
ccuaauuccuucaaagcuuguucc

SEQ ID NO: 2561745 - RNA, 19 nt, Chlamydophila pneumoniae J138
ccuacaaucgccuuacaau

SEQ ID NO: 2561746 - RNA, 14 nt, Chlamydophila pneumoniae J138
ccuacaucugugau

SEQ ID NO: 2561747 - RNA, 18 nt, Chlamydophila pneumoniae J138
ccuaccucugggaagacu

SEQ ID NO: 2561748 - RNA, 20 nt, Chlamydophila pneumoniae J138
ccuaccucugggaagacucu

SEQ ID NO: 2561749 - RNA, 15 nt, Chlamydophila pneumoniae J138
ccuaccugaggagcg

SEQ ID NO: 2561750 - RNA, 11 nt, Chlamydophila pneumoniae J138
ccuaccugcua

SEQ ID NO: 2561751 - RNA, 15 nt, Chlamydophila pneumoniae J138
ccuacgaauccaaaa

SEQ ID NO: 2561752 - RNA, 14 nt, Chlamydophila pneumoniae J138
ccuacuaaacccug

SEQ ID NO: 2561753 - RNA, 20 nt, Chlamydophila pneumoniae J138
ccuagaaaagcaaccuuaaa

SEQ ID NO: 2561754 - RNA, 23 nt, Chlamydophila pneumoniae J138
ccuagaaggaggaguccuucuag

SEQ ID NO: 2561755 - RNA, 19 nt, Chlamydophila pneumoniae J138
ccuagaauaggaauugcag

SEQ ID NO: 2561756 - RNA, 18 nt, Chlamydophila pneumoniae J138
ccuagaaucacauaaaau

SEQ ID NO: 2561757 - RNA, 19 nt, Chlamydophila pneumoniae J138
ccuagagaguucuuguaau

SEQ ID NO: 2561758 - RNA, 18 nt, Chlamydophila pneumoniae J138
ccuagauagcaaaucaau

SEQ ID NO: 2561759 - RNA, 16 nt, Chlamydophila pneumoniae J138
ccuaggagaaaucaca

SEQ ID NO: 2561760 - RNA, 11 nt, Chlamydophila pneumoniae J138
ccuaggaggau

SEQ ID NO: 2561761 - RNA, 16 nt, Chlamydophila pneumoniae J138
ccuagggucuucucga

SEQ ID NO: 2561762 - RNA, 14 nt, Chlamydophila pneumoniae J138
ccuagguucuuuuc

SEQ ID NO: 2561763 - RNA, 13 nt, Chlamydophila pneumoniae J138
ccuauagcaaaga

SEQ ID NO: 2561764 - RNA, 15 nt, Chlamydophila pneumoniae J138
ccuauaguaauuucu

SEQ ID NO: 2561765 - RNA, 13 nt, Chlamydophila pneumoniae J138
ccuauauuuuuua

SEQ ID NO: 2561766 - RNA, 15 nt, Chlamydophila pneumoniae J138
ccuuaguuuuuucua

SEQ ID NO: 2561767 - RNA, 14 nt, Chlamydophila pneumoniae J138
ccuuauaguccaua

SEQ ID NO: 2561768 - RNA, 17 nt, Chlamydophila pneumoniae J138
ccuuaucuucagaaugc

SEQ ID NO: 2561769 - RNA, 17 nt, Chlamydophila pneumoniae J138
ccuuaucuugcugccca

SEQ ID NO: 2561770 - RNA, 12 nt, Chlamydophila pneumoniae J138
ccuucaacacac

SEQ ID NO: 2561771 - RNA, 24 nt, Chlamydophila pneumoniae J138
ccuucaauacgcuagcucuuaaau

SEQ ID NO: 2561772 - RNA, 18 nt, Chlamydophila pneumoniae J138
ccuucagaauucucaagu

SEQ ID NO: 2561773 - RNA, 11 nt, Chlamydophila pneumoniae J138
ccuucagaucg

SEQ ID NO: 2561774 - RNA, 13 nt, Chlamydophila pneumoniae J138
ccuucauucuuuc

SEQ ID NO: 2561775 - RNA, 12 nt, Chlamydophila pneumoniae J138
ccuuccaauacu

SEQ ID NO: 2561776 - RNA, 23 nt, Chlamydophila pneumoniae J138
ccuuccauacggacaacaacagc

SEQ ID NO: 2561777 - RNA, 14 nt, Chlamydophila pneumoniae J138
ccuucgauuccagg

SEQ ID NO: 2561778 - RNA, 23 nt, Chlamydophila pneumoniae J138
ccuucguaacgcuuuucuaauag

SEQ ID NO: 2561779 - RNA, 13 nt, Chlamydophila pneumoniae J138
ccuucuaaggaaa

SEQ ID NO: 2561780 - RNA, 14 nt, Chlamydophila pneumoniae J138
ccuucucagaaaga

SEQ ID NO: 2561781 - RNA, 11 nt, Chlamydophila pneumoniae J138
ccuucucccuc

SEQ ID NO: 2561782 - RNA, 16 nt, Chlamydophila pneumoniae J138
ccuucucgucauucug

SEQ ID NO: 2561783 - RNA, 15 nt, Chlamydophila pneumoniae J138
ccuucuuaguaaaga

SEQ ID NO: 2561784 - RNA, 12 nt, Chlamydophila pneumoniae J138
ccuucuucuuca

SEQ ID NO: 2561785 - RNA, 23 nt, Chlamydophila pneumoniae J138
ccuucuucuuguucuucuugauu

SEQ ID NO: 2561786 - RNA, 21 nt, Chlamydophila pneumoniae J138
ccuucuugcaaagauaaccau

SEQ ID NO: 2561787 - RNA, 15 nt, Chlamydophila pneumoniae J138
ccuucuuucaauagc

SEQ ID NO: 2561788 - RNA, 20 nt, Chlamydophila pneumoniae J138
ccuucuuucaauagcuucca

SEQ ID NO: 2561789 - RNA, 14 nt, Chlamydophila pneumoniae J138
ccuucuuuccauaa

SEQ ID NO: 2561790 - RNA, 15 nt, Chlamydophila pneumoniae J138
ccuucuuuccauaaa

SEQ ID NO: 2561791 - RNA, 14 nt, Chlamydophila pneumoniae J138
ccuugaaaaucaag

SEQ ID NO: 2561792 - RNA, 21 nt, Chlamydophila pneumoniae J138
ccuugagcuaacgacauugaa

SEQ ID NO: 2561793 - RNA, 21 nt, Chlamydophila pneumoniae J138
ccuugcagcgacaacacgccc

SEQ ID NO: 2561794 - RNA, 20 nt, Chlamydophila pneumoniae J138
ccuugcauuagauucagcac

SEQ ID NO: 2561795 - RNA, 13 nt, Chlamydophila pneumoniae J138
ccuuggcagagcc

SEQ ID NO: 2561796 - RNA, 18 nt, Chlamydophila pneumoniae J138
ccuuggguuugucuccaa

SEQ ID NO: 2561797 - RNA, 14 nt, Chlamydophila pneumoniae J138
ccuugguaucccaa

SEQ ID NO: 2561798 - RNA, 12 nt, Chlamydophila pneumoniae J138
ccuuguuuuccu

SEQ ID NO: 2561799 - RNA, 13 nt, Chlamydophila pneumoniae J138
ccuuguuuuccug

SEQ ID NO: 2561800 - RNA, 18 nt, Chlamydophila pneumoniae J138
ccuuuagggaaaaaguag

SEQ ID NO: 2561801 - RNA, 16 nt, Chlamydophila pneumoniae J138
ccuuuaguuaacuccu

SEQ ID NO: 2561802 - RNA, 22 nt, Chlamydophila pneumoniae J138
ccuuuauacuguuuuucuucca

SEQ ID NO: 2561803 - RNA, 22 nt, Chlamydophila pneumoniae J138
ccuuuauauaaagguuacaagc

SEQ ID NO: 2561804 - RNA, 20 nt, Chlamydophila pneumoniae J138
ccuuucacaaagaauucaga

SEQ ID NO: 2561805 - RNA, 17 nt, Chlamydophila pneumoniae J138
ccuuucuuuugcuuuuc

SEQ ID NO: 2561806 - RNA, 18 nt, Chlamydophila pneumoniae J138
ccuuugagucuuuuucag

SEQ ID NO: 2561807 - RNA, 19 nt, Chlamydophila pneumoniae J138
ccuuugagucuuuuucaga

SEQ ID NO: 2561808 - RNA, 21 nt, Chlamydophila pneumoniae J138
ccuuugcaaaccaaucuugag

SEQ ID NO: 2561809 - RNA, 22 nt, Chlamydophila pneumoniae J138
ccuuuuaaaauuuugauaccuc

SEQ ID NO: 2561810 - RNA, 18 nt, Chlamydophila pneumoniae J138
ccuuuucagauuuuuuaa

SEQ ID NO: 2561811 - RNA, 19 nt, Chlamydophila pneumoniae J138
ccuuuucagauuuuuuaac

SEQ ID NO: 2561812 - RNA, 13 nt, Chlamydophila pneumoniae J138
ccuuuucuccuuc

SEQ ID NO: 2561813 - RNA, 16 nt, Chlamydophila pneumoniae J138
ccuuuucuccuucugg

SEQ ID NO: 2561814 - RNA, 22 nt, Chlamydophila pneumoniae J138
ccuuuugaauucugaugaccuc

SEQ ID NO: 2561815 - RNA, 19 nt, Chlamydophila pneumoniae J138
ccuuuuucauugaugcuua

SEQ ID NO: 2561816 - RNA, 19 nt, Chlamydophila pneumoniae J138
ccuuuuucugcuucuccaa

SEQ ID NO: 2561817 - RNA, 18 nt, Chlamydophila pneumoniae J138
cgaaaaacgguaaauauc

SEQ ID NO: 2561818 - RNA, 15 nt, Chlamydophila pneumoniae J138
cgaaaaauaccucag

SEQ ID NO: 2561819 - RNA, 13 nt, Chlamydophila pneumoniae J138
cgaaaaucuacac

SEQ ID NO: 2561820 - RNA, 21 nt, Chlamydophila pneumoniae J138
cgaaacaacuuuuuucguuug

SEQ ID NO: 2561821 - RNA, 15 nt, Chlamydophila pneumoniae J138
cgaaaccacagcaaa

SEQ ID NO: 2561822 - RNA, 20 nt, Chlamydophila pneumoniae J138
cgaaaccacagcaaagacua

SEQ ID NO: 2561823 - RNA, 19 nt, Chlamydophila pneumoniae J138
cgaaaccggacugacuucu

SEQ ID NO: 2561824 - RNA, 18 nt, Chlamydophila pneumoniae J138
cgaaacucuuugaggaua

SEQ ID NO: 2561825 - RNA, 23 nt, Chlamydophila pneumoniae J138
cgaaagaacuacuuaaauccuaa

SEQ ID NO: 2561826 - RNA, 13 nt, Chlamydophila pneumoniae J138
cgaaagaucagag

SEQ ID NO: 2561827 - RNA, 20 nt, Chlamydophila pneumoniae J138
cgaaagucccgcaacuaaac

SEQ ID NO: 2561828 - RNA, 13 nt, Chlamydophila pneumoniae J138
cgaaauccuaaaa

SEQ ID NO: 2561829 - RNA, 15 nt, Chlamydophila pneumoniae J138
cgaaauccuaaaaag

SEQ ID NO: 2561830 - RNA, 19 nt, Chlamydophila pneumoniae J138
cgaacacgucgaacaugac

SEQ ID NO: 2561831 - RNA, 18 nt, Chlamydophila pneumoniae J138
cgaacaguucauguugcu

SEQ ID NO: 2561832 - RNA, 19 nt, Chlamydophila pneumoniae J138
cgaacuaaaggaacugugc

SEQ ID NO: 2561833 - RNA, 17 nt, Chlamydophila pneumoniae J138
cgaacuguacgaauuuc

SEQ ID NO: 2561834 - RNA, 21 nt, Chlamydophila pneumoniae J138
cgaagacaaugucgucucaga

SEQ ID NO: 2561835 - RNA, 17 nt, Chlamydophila pneumoniae J138
cgaagacucaaagaacu

SEQ ID NO: 2561836 - RNA, 15 nt, Chlamydophila pneumoniae J138
cgaagacuuguucuu

SEQ ID NO: 2561837 - RNA, 17 nt, Chlamydophila pneumoniae J138
cgaagauccuagagaau

SEQ ID NO: 2561838 - RNA, 19 nt, Chlamydophila pneumoniae J138
cgaagauucaaagaagucg

SEQ ID NO: 2561839 - RNA, 19 nt, Chlamydophila pneumoniae J138
cgaagauuuagggaagagu

SEQ ID NO: 2561840 - RNA, 14 nt, Chlamydophila pneumoniae J138
cgaaguccuggauu

SEQ ID NO: 2561841 - RNA, 21 nt, Chlamydophila pneumoniae J138
cgaaguugauuguagagacau

SEQ ID NO: 2561842 - RNA, 21 nt, Chlamydophila pneumoniae J138
cgaauaaguuuugauuuugca

SEQ ID NO: 2561843 - RNA, 17 nt, Chlamydophila pneumoniae J138
cgaauagcucuggagau

SEQ ID NO: 2561844 - RNA, 22 nt, Chlamydophila pneumoniae J138
cgaauaggcauuacacaacucu

SEQ ID NO: 2561845 - RNA, 21 nt, Chlamydophila pneumoniae J138
cgaauccuagagaaccuccua

SEQ ID NO: 2561846 - RNA, 16 nt, Chlamydophila pneumoniae J138
cgaauccugaggaugc

SEQ ID NO: 2561847 - RNA, 12 nt, Chlamydophila pneumoniae J138
cgaaucucucca

SEQ ID NO: 2561848 - RNA, 16 nt, Chlamydophila pneumoniae J138
cgaaucuuuauuucug

SEQ ID NO: 2561849 - RNA, 17 nt, Chlamydophila pneumoniae J138
cgaaucuuucaaaagaa

SEQ ID NO: 2561850 - RNA, 20 nt, Chlamydophila pneumoniae J138
cgaaugcugcacaguucaca

SEQ ID NO: 2561851 - RNA, 21 nt, Chlamydophila pneumoniae J138
cgaauguagccaauccuucca

SEQ ID NO: 2561852 - RNA, 20 nt, Chlamydophila pneumoniae J138
cgaaugucguuaaaaacuau

SEQ ID NO: 2561853 - RNA, 14 nt, Chlamydophila pneumoniae J138
cgaauuucuuguuc

SEQ ID NO: 2561854 - RNA, 13 nt, Chlamydophila pneumoniae J138
cgacacgaauuuc

SEQ ID NO: 2561855 - RNA, 22 nt, Chlamydophila pneumoniae J138
cgacacuauguguuuccuuuuc

SEQ ID NO: 2561856 - RNA, 15 nt, Chlamydophila pneumoniae J138
cgacacucaaaucuu

SEQ ID NO: 2561857 - RNA, 22 nt, Chlamydophila pneumoniae J138
cgacauacaucaaaaugcugcu

SEQ ID NO: 2561858 - RNA, 15 nt, Chlamydophila pneumoniae J138
cgacaugagaaaucu

SEQ ID NO: 2561859 - RNA, 12 nt, Chlamydophila pneumoniae J138
cgacaugccuaa

SEQ ID NO: 2561860 - RNA, 15 nt, Chlamydophila pneumoniae J138
cgaccaacuccucaa

SEQ ID NO: 2561861 - RNA, 22 nt, Chlamydophila pneumoniae J138
cgaccuaggagaaaucacacuu

SEQ ID NO: 2561862 - RNA, 18 nt, Chlamydophila pneumoniae J138
cgaccucgaauuccuccc

SEQ ID NO: 2561863 - RNA, 20 nt, Chlamydophila pneumoniae J138
cgaccucgaauuccucccag

SEQ ID NO: 2561864 - RNA, 22 nt, Chlamydophila pneumoniae J138
cgaccugagguaucaauaauga

SEQ ID NO: 2561865 - RNA, 19 nt, Chlamydophila pneumoniae J138
cgaccugcaaacuccccag

SEQ ID NO: 2561866 - RNA, 21 nt, Chlamydophila pneumoniae J138
cgcuugugguuagaggaagca

SEQ ID NO: 2561867 - RNA, 16 nt, Chlamydophila pneumoniae J138
cgcuuucgggaauaau

SEQ ID NO: 2561868 - RNA, 20 nt, Chlamydophila pneumoniae J138
cgcuuucgggaauaauagga

SEQ ID NO: 2561869 - RNA, 22 nt, Chlamydophila pneumoniae J138
cgcuuucuuuuauuaagggaag

SEQ ID NO: 2561870 - RNA, 22 nt, Chlamydophila pneumoniae J138
cgcuuuuucuugaaaaauccug

SEQ ID NO: 2561871 - RNA, 14 nt, Chlamydophila pneumoniae J138
cgcuuuuuuaaagu

SEQ ID NO: 2561872 - RNA, 23 nt, Chlamydophila pneumoniae J138
cggaaaauacagccagcagaagg

SEQ ID NO: 2561873 - RNA, 17 nt, Chlamydophila pneumoniae J138
cggaaaaucacacuuuc

SEQ ID NO: 2561874 - RNA, 17 nt, Chlamydophila pneumoniae J138
cggaacaacuuugaggc

SEQ ID NO: 2561875 - RNA, 14 nt, Chlamydophila pneumoniae J138
cggaacguauccuu

SEQ ID NO: 2561876 - RNA, 19 nt, Chlamydophila pneumoniae J138
cggaaggaguucuuuuuua

SEQ ID NO: 2561877 - RNA, 14 nt, Chlamydophila pneumoniae J138
cggacaacaacagc

SEQ ID NO: 2561878 - RNA, 19 nt, Chlamydophila pneumoniae J138
cggacaaugcuaucuccag

SEQ ID NO: 2561879 - RNA, 22 nt, Chlamydophila pneumoniae J138
cggacauaccuacuaaacccug

SEQ ID NO: 2561880 - RNA, 15 nt, Chlamydophila pneumoniae J138
cggacgcuagagaca

SEQ ID NO: 2561881 - RNA, 19 nt, Chlamydophila pneumoniae J138
cggagaacuuccugauucu

SEQ ID NO: 2561882 - RNA, 21 nt, Chlamydophila pneumoniae J138
cggaguccuucuugcaaagau

SEQ ID NO: 2561883 - RNA, 23 nt, Chlamydophila pneumoniae J138
cggaguccuucuugcaaagauaa

SEQ ID NO: 2561884 - RNA, 14 nt, Chlamydophila pneumoniae J138
cggaguuaucaaaa

SEQ ID NO: 2561885 - RNA, 12 nt, Chlamydophila pneumoniae J138
cggaucuguaau

SEQ ID NO: 2561886 - RNA, 20 nt, Chlamydophila pneumoniae J138
cggaucuuaggauucuuauc

SEQ ID NO: 2561887 - RNA, 22 nt, Chlamydophila pneumoniae J138
cggaugugccgugacuccagaa

SEQ ID NO: 2561888 - RNA, 20 nt, Chlamydophila pneumoniae J138
cggauuuuacucccugaagu

SEQ ID NO: 2561889 - RNA, 17 nt, Chlamydophila pneumoniae J138
cggauuuucucuacaca

SEQ ID NO: 2561890 - RNA, 19 nt, Chlamydophila pneumoniae J138
cggcaacuacuguagaguu

SEQ ID NO: 2561891 - RNA, 13 nt, Chlamydophila pneumoniae J138
cggcaagaaucgc

SEQ ID NO: 2561892 - RNA, 18 nt, Chlamydophila pneumoniae J138
cggccaucauuaaguacu

SEQ ID NO: 2561893 - RNA, 21 nt, Chlamydophila pneumoniae J138
cggcugcgguagccuggaggc

SEQ ID NO: 2561894 - RNA, 12 nt, Chlamydophila pneumoniae J138
cggcuuuuccag

SEQ ID NO: 2561895 - RNA, 15 nt, Chlamydophila pneumoniae J138
cgggagcucuuucuu

SEQ ID NO: 2561896 - RNA, 19 nt, Chlamydophila pneumoniae J138
cgggaucguagcaggcauc

SEQ ID NO: 2561897 - RNA, 15 nt, Chlamydophila pneumoniae J138
cgggaucuaaaagca

SEQ ID NO: 2561898 - RNA, 16 nt, Chlamydophila pneumoniae J138
cgggguuguauuuccu

SEQ ID NO: 2561899 - RNA, 21 nt, Chlamydophila pneumoniae J138
cgggucaggaggugguggagc

SEQ ID NO: 2561900 - RNA, 17 nt, Chlamydophila pneumoniae J138
cggguguggcaaaggac

SEQ ID NO: 2561901 - RNA, 23 nt, Chlamydophila pneumoniae J138
cggguucauuuccaaauucuugc

SEQ ID NO: 2561902 - RNA, 16 nt, Chlamydophila pneumoniae J138
cgguaaugccagcagc

SEQ ID NO: 2561903 - RNA, 21 nt, Chlamydophila pneumoniae J138
cggucacguucuuagaaagcg

SEQ ID NO: 2561904 - RNA, 21 nt, Chlamydophila pneumoniae J138
cggucgucuuagaauccucua

SEQ ID NO: 2561905 - RNA, 12 nt, Chlamydophila pneumoniae J138
cggucucuucuc

SEQ ID NO: 2561906 - RNA, 11 nt, Chlamydophila pneumoniae J138
cggucuuucuu

SEQ ID NO: 2561907 - RNA, 16 nt, Chlamydophila pneumoniae J138
cggugggccucuuccc

SEQ ID NO: 2561908 - RNA, 17 nt, Chlamydophila pneumoniae J138
cgguucggucucuucuc

SEQ ID NO: 2561909 - RNA, 13 nt, Chlamydophila pneumoniae J138
cgguuucugggau

SEQ ID NO: 2561910 - RNA, 16 nt, Chlamydophila pneumoniae J138
cgguuucuuuuuuuug

SEQ ID NO: 2561911 - RNA, 14 nt, Chlamydophila pneumoniae J138
cguaaaaagaaaga

SEQ ID NO: 2561912 - RNA, 20 nt, Chlamydophila pneumoniae J138
cguaacaauucgauguuaag

SEQ ID NO: 2561913 - RNA, 13 nt, Chlamydophila pneumoniae J138
cguaacugaggca

SEQ ID NO: 2561914 - RNA, 18 nt, Chlamydophila pneumoniae J138
cguaacugaggcaaagau

SEQ ID NO: 2561915 - RNA, 17 nt, Chlamydophila pneumoniae J138
cguaagcugcaaucuca

SEQ ID NO: 2561916 - RNA, 19 nt, Chlamydophila pneumoniae J138
cguaagcugcaaucucaaa

SEQ ID NO: 2561917 - RNA, 23 nt, Chlamydophila pneumoniae J138
cguaauacggacuucacaaagaa

SEQ ID NO: 2561918 - RNA, 23 nt, Chlamydophila pneumoniae J138
cguaauagcgacaugagaaaucu

SEQ ID NO: 2561919 - RNA, 17 nt, Chlamydophila pneumoniae J138
cguaauccuucuuucug

SEQ ID NO: 2561920 - RNA, 15 nt, Chlamydophila pneumoniae J138
cguaaucuuuuuuaa

SEQ ID NO: 2561921 - RNA, 17 nt, Chlamydophila pneumoniae J138
cguaaucuuuuuuaaag

SEQ ID NO: 2561922 - RNA, 23 nt, Chlamydophila pneumoniae J138
cguaaugcccgauauccucgaga

SEQ ID NO: 2561923 - RNA, 19 nt, Chlamydophila pneumoniae J138
cguaaugcuccacggaaau

SEQ ID NO: 2561924 - RNA, 18 nt, Chlamydophila pneumoniae J138
cguaaugcuuagccaugg

SEQ ID NO: 2561925 - RNA, 19 nt, Chlamydophila pneumoniae J138
cguaccagcugauauccuu

SEQ ID NO: 2561926 - RNA, 14 nt, Chlamydophila pneumoniae J138
cguaccguauccuc

SEQ ID NO: 2561927 - RNA, 21 nt, Chlamydophila pneumoniae J138
cguacgagaucagauguaaag

SEQ ID NO: 2561928 - RNA, 20 nt, Chlamydophila pneumoniae J138
cguacgcaaguaaagaaauu

SEQ ID NO: 2561929 - RNA, 12 nt, Chlamydophila pneumoniae J138
cguacucuucuu

SEQ ID NO: 2561930 - RNA, 14 nt, Chlamydophila pneumoniae J138
cguacuucacuucu

SEQ ID NO: 2561931 - RNA, 23 nt, Chlamydophila pneumoniae J138
cguacuuuacacuauaagacauu

SEQ ID NO: 2561932 - RNA, 19 nt, Chlamydophila pneumoniae J138
cguagaggacgugcuccca

SEQ ID NO: 2561933 - RNA, 14 nt, Chlamydophila pneumoniae J138
cguagcagaggcag

SEQ ID NO: 2561934 - RNA, 18 nt, Chlamydophila pneumoniae J138
cguagcaggcaucacuaa

SEQ ID NO: 2561935 - RNA, 21 nt, Chlamydophila pneumoniae J138
cguagcuugcgagcuucuuga

SEQ ID NO: 2561936 - RNA, 19 nt, Chlamydophila pneumoniae J138
cguaggcauacaguagaaa

SEQ ID NO: 2561937 - RNA, 20 nt, Chlamydophila pneumoniae J138
cguaggguagccauccacga

SEQ ID NO: 2561938 - RNA, 18 nt, Chlamydophila pneumoniae J138
cguaggugccugaagaug

SEQ ID NO: 2561939 - RNA, 16 nt, Chlamydophila pneumoniae J138
cguauaaggauguugu

SEQ ID NO: 2561940 - RNA, 17 nt, Chlamydophila pneumoniae J138
cguauacgucccacaaa

SEQ ID NO: 2561941 - RNA, 14 nt, Chlamydophila pneumoniae J138
cguauagaauagaa

SEQ ID NO: 2561942 - RNA, 14 nt, Chlamydophila pneumoniae J138
cguauagauuuucc

SEQ ID NO: 2561943 - RNA, 15 nt, Chlamydophila pneumoniae J138
cguauagauuuuccg

SEQ ID NO: 2561944 - RNA, 14 nt, Chlamydophila pneumoniae J138
cguauccuugauuu

SEQ ID NO: 2561945 - RNA, 16 nt, Chlamydophila pneumoniae J138
cguaugcaucaaugaa

SEQ ID NO: 2561946 - RNA, 19 nt, Chlamydophila pneumoniae J138
cguauggauuucuccagca

SEQ ID NO: 2561947 - RNA, 15 nt, Chlamydophila pneumoniae J138
cgucaaauucauuaa

SEQ ID NO: 2561948 - RNA, 18 nt, Chlamydophila pneumoniae J138
cgucaauaagcuugccag

SEQ ID NO: 2561949 - RNA, 24 nt, Chlamydophila pneumoniae J138
cgucaggaacccuggaugaacauc

SEQ ID NO: 2561950 - RNA, 22 nt, Chlamydophila pneumoniae J138
cgucaguaaaacacaaauagca

SEQ ID NO: 2561951 - RNA, 19 nt, Chlamydophila pneumoniae J138
cgucaucauaggaaacgcc

SEQ ID NO: 2561952 - RNA, 23 nt, Chlamydophila pneumoniae J138
cgucaucgucgcgacugaaguca

SEQ ID NO: 2561953 - RNA, 20 nt, Chlamydophila pneumoniae J138
cgucaugagccgauguugca

SEQ ID NO: 2561954 - RNA, 16 nt, Chlamydophila pneumoniae J138
cguccacaagcuuuuc

SEQ ID NO: 2561955 - RNA, 17 nt, Chlamydophila pneumoniae J138
cguccaguucuucauuc

SEQ ID NO: 2561956 - RNA, 18 nt, Chlamydophila pneumoniae J138
cguccaguucuucauucc

SEQ ID NO: 2561957 - RNA, 16 nt, Chlamydophila pneumoniae J138
cgucgccccaugaauc

SEQ ID NO: 2561958 - RNA, 15 nt, Chlamydophila pneumoniae J138
cgucgcuaaugcuau

SEQ ID NO: 2561959 - RNA, 17 nt, Chlamydophila pneumoniae J138
cgucgcuaaugcuaucc

SEQ ID NO: 2561960 - RNA, 20 nt, Chlamydophila pneumoniae J138
cgucguaaucuuuuuuaaag

SEQ ID NO: 2561961 - RNA, 24 nt, Chlamydophila pneumoniae J138
cgucuaaacgcgagcuauuuuacu

SEQ ID NO: 2561962 - RNA, 18 nt, Chlamydophila pneumoniae J138
cgucuaagaaucguucuu

SEQ ID NO: 2561963 - RNA, 14 nt, Chlamydophila pneumoniae J138
cgucuauuagauuu

SEQ ID NO: 2561964 - RNA, 17 nt, Chlamydophila pneumoniae J138
cgucuauuagauuuccu

SEQ ID NO: 2561965 - RNA, 16 nt, Chlamydophila pneumoniae J138
cuaagcacaagaaucc

SEQ ID NO: 2561966 - RNA, 21 nt, Chlamydophila pneumoniae J138
cuaagcagccucuucucuacc

SEQ ID NO: 2561967 - RNA, 13 nt, Chlamydophila pneumoniae J138
cuaagcauagccc

SEQ ID NO: 2561968 - RNA, 12 nt, Chlamydophila pneumoniae J138
cuaagccaaaua

SEQ ID NO: 2561969 - RNA, 17 nt, Chlamydophila pneumoniae J138
cuaagcuauaucucaac

SEQ ID NO: 2561970 - RNA, 20 nt, Chlamydophila pneumoniae J138
cuaagcugaaagaacacucc

SEQ ID NO: 2561971 - RNA, 15 nt, Chlamydophila pneumoniae J138
cuaagcuuauuucug

SEQ ID NO: 2561972 - RNA, 19 nt, Chlamydophila pneumoniae J138
cuaaggacaaaucucccaa

SEQ ID NO: 2561973 - RNA, 18 nt, Chlamydophila pneumoniae J138
cuaagguagcuagcguuu

SEQ ID NO: 2561974 - RNA, 21 nt, Chlamydophila pneumoniae J138
cuaaguaacaguccucucccu

SEQ ID NO: 2561975 - RNA, 23 nt, Chlamydophila pneumoniae J138
cuaaguaacaguccucucccuua

SEQ ID NO: 2561976 - RNA, 18 nt, Chlamydophila pneumoniae J138
cuaaguccaacaucagcu

SEQ ID NO: 2561977 - RNA, 18 nt, Chlamydophila pneumoniae J138
cuaagucguuaacaucaa

SEQ ID NO: 2561978 - RNA, 20 nt, Chlamydophila pneumoniae J138
cuaagucuccauaauucugc

SEQ ID NO: 2561979 - RNA, 21 nt, Chlamydophila pneumoniae J138
cuaagucuccauaauucugca

SEQ ID NO: 2561980 - RNA, 15 nt, Chlamydophila pneumoniae J138
cuaagugauaaggaa

SEQ ID NO: 2561981 - RNA, 18 nt, Chlamydophila pneumoniae J138
cuaaguuuaggcaggaag

SEQ ID NO: 2561982 - RNA, 16 nt, Chlamydophila pneumoniae J138
cuaauaagauccaaaa

SEQ ID NO: 2561983 - RNA, 17 nt, Chlamydophila pneumoniae J138
cuaauaagauccaaaaa

SEQ ID NO: 2561984 - RNA, 13 nt, Chlamydophila pneumoniae J138
cuaauaauuccug

SEQ ID NO: 2561985 - RNA, 20 nt, Chlamydophila pneumoniae J138
cuaauacacccgcaagcacu

SEQ ID NO: 2561986 - RNA, 17 nt, Chlamydophila pneumoniae J138
cuaauacaucaccacug

SEQ ID NO: 2561987 - RNA, 21 nt, Chlamydophila pneumoniae J138
cuaauaccuuucuaagaauuc

SEQ ID NO: 2561988 - RNA, 15 nt, Chlamydophila pneumoniae J138
cuaauacuuuaggag

SEQ ID NO: 2561989 - RNA, 20 nt, Chlamydophila pneumoniae J138
cuaauaggggaccuaucggg

SEQ ID NO: 2561990 - RNA, 20 nt, Chlamydophila pneumoniae J138
cuaaucacagcgucagggau

SEQ ID NO: 2561991 - RNA, 15 nt, Chlamydophila pneumoniae J138
cuaaucauuagaguu

SEQ ID NO: 2561992 - RNA, 14 nt, Chlamydophila pneumoniae J138
cuaauccagcaaca

SEQ ID NO: 2561993 - RNA, 19 nt, Chlamydophila pneumoniae J138
cuaaucuaugaaguccuga

SEQ ID NO: 2561994 - RNA, 17 nt, Chlamydophila pneumoniae J138
cuaaucucaggcauucu

SEQ ID NO: 2561995 - RNA, 13 nt, Chlamydophila pneumoniae J138
cuaaugacagcug

SEQ ID NO: 2561996 - RNA, 20 nt, Chlamydophila pneumoniae J138
cuaauguugaguagagaagg

SEQ ID NO: 2561997 - RNA, 15 nt, Chlamydophila pneumoniae J138
cuaauucauauuuac

SEQ ID NO: 2561998 - RNA, 16 nt, Chlamydophila pneumoniae J138
cuaauuccuucaaagc

SEQ ID NO: 2561999 - RNA, 12 nt, Chlamydophila pneumoniae J138
cuaauuucaaua

SEQ ID NO: 2562000 - RNA, 22 nt, Chlamydophila pneumoniae J138
cuaauuuuaaauuuuguuuuuc

SEQ ID NO: 2562001 - RNA, 14 nt, Chlamydophila pneumoniae J138
cuaauuuuagaacu

SEQ ID NO: 2562002 - RNA, 15 nt, Chlamydophila pneumoniae J138
cuaauuuuagaacuu

SEQ ID NO: 2562003 - RNA, 22 nt, Chlamydophila pneumoniae J138
cuacaaaauccacauccuugua

SEQ ID NO: 2562004 - RNA, 18 nt, Chlamydophila pneumoniae J138
cuacaaggucuuuuccug

SEQ ID NO: 2562005 - RNA, 13 nt, Chlamydophila pneumoniae J138
cuacaaguugaga

SEQ ID NO: 2562006 - RNA, 13 nt, Chlamydophila pneumoniae J138
cuacaauacucug

SEQ ID NO: 2562007 - RNA, 20 nt, Chlamydophila pneumoniae J138
cuacacacaugacaaauaaa

SEQ ID NO: 2562008 - RNA, 14 nt, Chlamydophila pneumoniae J138
cuacaccauagaac

SEQ ID NO: 2562009 - RNA, 21 nt, Chlamydophila pneumoniae J138
cuacaccaucuuuaaaaggcc

SEQ ID NO: 2562010 - RNA, 19 nt, Chlamydophila pneumoniae J138
cuacacgcuauagcaacag

SEQ ID NO: 2562011 - RNA, 22 nt, Chlamydophila pneumoniae J138
cuacacugguagcuaaauuuag

SEQ ID NO: 2562012 - RNA, 21 nt, Chlamydophila pneumoniae J138
cuacagaaagagcuaaagaaa

SEQ ID NO: 2562013 - RNA, 23 nt, Chlamydophila pneumoniae J138
cuacagaaagagcuaaagaaacu

SEQ ID NO: 2562014 - RNA, 17 nt, Chlamydophila pneumoniae J138
cuacagaauaggaacaa

SEQ ID NO: 2562015 - RNA, 17 nt, Chlamydophila pneumoniae J138
cuacagagggaauuuca

SEQ ID NO: 2562016 - RNA, 18 nt, Chlamydophila pneumoniae J138
cuacagagggaauuucau

SEQ ID NO: 2562017 - RNA, 17 nt, Chlamydophila pneumoniae J138
cuacagagggcuucauu

SEQ ID NO: 2562018 - RNA, 22 nt, Chlamydophila pneumoniae J138
cuacagauaugcugaauuccuc

SEQ ID NO: 2562019 - RNA, 18 nt, Chlamydophila pneumoniae J138
cuacagcuaacgaaguga

SEQ ID NO: 2562020 - RNA, 13 nt, Chlamydophila pneumoniae J138
cuacagcuucauu

SEQ ID NO: 2562021 - RNA, 14 nt, Chlamydophila pneumoniae J138
cuacagcuucuuuu

SEQ ID NO: 2562022 - RNA, 19 nt, Chlamydophila pneumoniae J138
cuacagcuucuuuuccagc

SEQ ID NO: 2562023 - RNA, 14 nt, Chlamydophila pneumoniae J138
cuacaggagaagcg

SEQ ID NO: 2562024 - RNA, 16 nt, Chlamydophila pneumoniae J138
cuacauaaaaugagcu

SEQ ID NO: 2562025 - RNA, 16 nt, Chlamydophila pneumoniae J138
cuacauagauccccuu

SEQ ID NO: 2562026 - RNA, 19 nt, Chlamydophila pneumoniae J138
cuacauaguuguucggaca

SEQ ID NO: 2562027 - RNA, 21 nt, Chlamydophila pneumoniae J138
cuacauauacguggcuuccau

SEQ ID NO: 2562028 - RNA, 20 nt, Chlamydophila pneumoniae J138
cuacauauucguguaaaucu

SEQ ID NO: 2562029 - RNA, 15 nt, Chlamydophila pneumoniae J138
cuacaucuuguucug

SEQ ID NO: 2562030 - RNA, 13 nt, Chlamydophila pneumoniae J138
cuacaugaggaua

SEQ ID NO: 2562031 - RNA, 14 nt, Chlamydophila pneumoniae J138
cuacaugcucaaga

SEQ ID NO: 2562032 - RNA, 15 nt, Chlamydophila pneumoniae J138
cuacauucuaacgcu

SEQ ID NO: 2562033 - RNA, 21 nt, Chlamydophila pneumoniae J138
cuaccaaagucgauacccaaa

SEQ ID NO: 2562034 - RNA, 22 nt, Chlamydophila pneumoniae J138
cuaccaaagucgauacccaaag

SEQ ID NO: 2562035 - RNA, 13 nt, Chlamydophila pneumoniae J138
cuaccagaugccu

SEQ ID NO: 2562036 - RNA, 14 nt, Chlamydophila pneumoniae J138
cuaccaucaugaau

SEQ ID NO: 2562037 - RNA, 14 nt, Chlamydophila pneumoniae J138
cuaccauuaaggaa

SEQ ID NO: 2562038 - RNA, 15 nt, Chlamydophila pneumoniae J138
cuaccauuaaggaau

SEQ ID NO: 2562039 - RNA, 19 nt, Chlamydophila pneumoniae J138
cuaccauuaaggaauccca

SEQ ID NO: 2562040 - RNA, 20 nt, Chlamydophila pneumoniae J138
cuaccccacgcuaaacuaaa

SEQ ID NO: 2562041 - RNA, 21 nt, Chlamydophila pneumoniae J138
cuaccccacgcuaaacuaaaa

SEQ ID NO: 2562042 - RNA, 19 nt, Chlamydophila pneumoniae J138
cuacccccagcuucuucaa

SEQ ID NO: 2562043 - RNA, 19 nt, Chlamydophila pneumoniae J138
cuaccuguagcuacagauu

SEQ ID NO: 2562044 - RNA, 15 nt, Chlamydophila pneumoniae J138
cuacgaauccaaaaa

SEQ ID NO: 2562045 - RNA, 21 nt, Chlamydophila pneumoniae J138
cuacgacuacaucuuguucug

SEQ ID NO: 2562046 - RNA, 16 nt, Chlamydophila pneumoniae J138
cuacgagcgcuuucuu

SEQ ID NO: 2562047 - RNA, 21 nt, Chlamydophila pneumoniae J138
cuacggaugggcacucuucca

SEQ ID NO: 2562048 - RNA, 19 nt, Chlamydophila pneumoniae J138
cuacgguuuucugccuuac

SEQ ID NO: 2562049 - RNA, 16 nt, Chlamydophila pneumoniae J138
cuacgugaucaaaauu

SEQ ID NO: 2562050 - RNA, 17 nt, Chlamydophila pneumoniae J138
cuacgugaucaaaauua

SEQ ID NO: 2562051 - RNA, 17 nt, Chlamydophila pneumoniae J138
cuacuguccauccaaau

SEQ ID NO: 2562052 - RNA, 21 nt, Chlamydophila pneumoniae J138
cuacuuaaagcuugagaaaag

SEQ ID NO: 2562053 - RNA, 18 nt, Chlamydophila pneumoniae J138
cuacuuaaauccuaagca

SEQ ID NO: 2562054 - RNA, 13 nt, Chlamydophila pneumoniae J138
cuacuuacaagaa

SEQ ID NO: 2562055 - RNA, 13 nt, Chlamydophila pneumoniae J138
cuacuuauuguuc

SEQ ID NO: 2562056 - RNA, 19 nt, Chlamydophila pneumoniae J138
cuacuucaggaaauaauuu

SEQ ID NO: 2562057 - RNA, 15 nt, Chlamydophila pneumoniae J138
cuacuucuucuuuuc

SEQ ID NO: 2562058 - RNA, 19 nt, Chlamydophila pneumoniae J138
cuacuugucugauuaguuc

SEQ ID NO: 2562059 - RNA, 20 nt, Chlamydophila pneumoniae J138
cuacuuuaaaguggcaaucu

SEQ ID NO: 2562060 - RNA, 16 nt, Chlamydophila pneumoniae J138
cuagaaaacgcucucc

SEQ ID NO: 2562061 - RNA, 20 nt, Chlamydophila pneumoniae J138
cuagaaaacgcucuccuaga

SEQ ID NO: 2562062 - RNA, 21 nt, Chlamydophila pneumoniae J138
cuagaaaagauucuaaaucaa

SEQ ID NO: 2562063 - RNA, 19 nt, Chlamydophila pneumoniae J138
cuagaaaaucucuaagaau

SEQ ID NO: 2562064 - RNA, 14 nt, Chlamydophila pneumoniae J138
cuagaaaaugaaga

SEQ ID NO: 2562065 - RNA, 19 nt, Chlamydophila pneumoniae J138
cuaugcgcucuaagagccc

SEQ ID NO: 2562066 - RNA, 19 nt, Chlamydophila pneumoniae J138
cuauggaagauaaacauac

SEQ ID NO: 2562067 - RNA, 22 nt, Chlamydophila pneumoniae J138
cuauggcagcaggaauaaucaa

SEQ ID NO: 2562068 - RNA, 18 nt, Chlamydophila pneumoniae J138
cuaugggaggaauuccuc

SEQ ID NO: 2562069 - RNA, 19 nt, Chlamydophila pneumoniae J138
cuaugggaggaauuccucu

SEQ ID NO: 2562070 - RNA, 20 nt, Chlamydophila pneumoniae J138
cuaugggaggaauuccucuc

SEQ ID NO: 2562071 - RNA, 20 nt, Chlamydophila pneumoniae J138
cuaugguaagggauccauga

SEQ ID NO: 2562072 - RNA, 21 nt, Chlamydophila pneumoniae J138
cuauggucucccucacaagaa

SEQ ID NO: 2562073 - RNA, 15 nt, Chlamydophila pneumoniae J138
cuauggugcaugccu

SEQ ID NO: 2562074 - RNA, 15 nt, Chlamydophila pneumoniae J138
cuaugucuguuccca

SEQ ID NO: 2562075 - RNA, 13 nt, Chlamydophila pneumoniae J138
cuauguguucucg

SEQ ID NO: 2562076 - RNA, 15 nt, Chlamydophila pneumoniae J138
cuauguguuuccuuu

SEQ ID NO: 2562077 - RNA, 14 nt, Chlamydophila pneumoniae J138
cuauguuuaaagca

SEQ ID NO: 2562078 - RNA, 18 nt, Chlamydophila pneumoniae J138
cuauuaaggauuccuuga

SEQ ID NO: 2562079 - RNA, 13 nt, Chlamydophila pneumoniae J138
cuauuaagucacc

SEQ ID NO: 2562080 - RNA, 15 nt, Chlamydophila pneumoniae J138
cuauuaauacuuugc

SEQ ID NO: 2562081 - RNA, 15 nt, Chlamydophila pneumoniae J138
cuauuacuagauccc

SEQ ID NO: 2562082 - RNA, 15 nt, Chlamydophila pneumoniae J138
cuauuagauuuccuc

SEQ ID NO: 2562083 - RNA, 16 nt, Chlamydophila pneumoniae J138
cuauuagauuuccucc

SEQ ID NO: 2562084 - RNA, 18 nt, Chlamydophila pneumoniae J138
cuauuagcgcggucacuu

SEQ ID NO: 2562085 - RNA, 20 nt, Chlamydophila pneumoniae J138
cuauuagcgcggucacuuca

SEQ ID NO: 2562086 - RNA, 22 nt, Chlamydophila pneumoniae J138
cuauuagcgcggucacuucaau

SEQ ID NO: 2562087 - RNA, 15 nt, Chlamydophila pneumoniae J138
cuauuauuuuaaagu

SEQ ID NO: 2562088 - RNA, 17 nt, Chlamydophila pneumoniae J138
cuauuauuuuaaaguca

SEQ ID NO: 2562089 - RNA, 22 nt, Chlamydophila pneumoniae J138
cuauuccauaaaaauguaauuu

SEQ ID NO: 2562090 - RNA, 22 nt, Chlamydophila pneumoniae J138
cuauucuauacgcuuaacauga

SEQ ID NO: 2562091 - RNA, 20 nt, Chlamydophila pneumoniae J138
cuauucucaaauuucaauaa

SEQ ID NO: 2562092 - RNA, 22 nt, Chlamydophila pneumoniae J138
cuauucugauuagagccccaac

SEQ ID NO: 2562093 - RNA, 20 nt, Chlamydophila pneumoniae J138
cuauugcugcggccacauua

SEQ ID NO: 2562094 - RNA, 14 nt, Chlamydophila pneumoniae J138
cuauuuaaggacgu

SEQ ID NO: 2562095 - RNA, 17 nt, Chlamydophila pneumoniae J138
cuauuuacugaaacauu

SEQ ID NO: 2562096 - RNA, 15 nt, Chlamydophila pneumoniae J138
cuauuucauauaaag

SEQ ID NO: 2562097 - RNA, 20 nt, Chlamydophila pneumoniae J138
cuauuucugccuuaugcuca

SEQ ID NO: 2562098 - RNA, 20 nt, Chlamydophila pneumoniae J138
cuauuucuuaauuuccuucu

SEQ ID NO: 2562099 - RNA, 23 nt, Chlamydophila pneumoniae J138
cuauuuuugaggaacgcacgcca

SEQ ID NO: 2562100 - RNA, 12 nt, Chlamydophila pneumoniae J138
cuauuuuuuaag

SEQ ID NO: 2562101 - RNA, 17 nt, Chlamydophila pneumoniae J138
cucaaacccucuccaga

SEQ ID NO: 2562102 - RNA, 20 nt, Chlamydophila pneumoniae J138
cucaaagaaagucucucuaa

SEQ ID NO: 2562103 - RNA, 13 nt, Chlamydophila pneumoniae J138
cucaaagaauacu

SEQ ID NO: 2562104 - RNA, 13 nt, Chlamydophila pneumoniae J138
cucaaaucuuuca

SEQ ID NO: 2562105 - RNA, 14 nt, Chlamydophila pneumoniae J138
cucaagagcaugcu

SEQ ID NO: 2562106 - RNA, 17 nt, Chlamydophila pneumoniae J138
cucaagagcaugcuuga

SEQ ID NO: 2562107 - RNA, 22 nt, Chlamydophila pneumoniae J138
cucaagcgauuucgaaaaagcc

SEQ ID NO: 2562108 - RNA, 20 nt, Chlamydophila pneumoniae J138
cucaaggcaucuagagucuc

SEQ ID NO: 2562109 - RNA, 15 nt, Chlamydophila pneumoniae J138
cucaaggucacagca

SEQ ID NO: 2562110 - RNA, 17 nt, Chlamydophila pneumoniae J138
cucaaggucacagcauu

SEQ ID NO: 2562111 - RNA, 22 nt, Chlamydophila pneumoniae J138
cucaaggucacagcauuuucuc

SEQ ID NO: 2562112 - RNA, 21 nt, Chlamydophila pneumoniae J138
cucaaguaagaagucuucagg

SEQ ID NO: 2562113 - RNA, 21 nt, Chlamydophila pneumoniae J138
cucaagucuauuugaaaagaa

SEQ ID NO: 2562114 - RNA, 14 nt, Chlamydophila pneumoniae J138
cucaauacuucagg

SEQ ID NO: 2562115 - RNA, 15 nt, Chlamydophila pneumoniae J138
cucaauacuucagga

SEQ ID NO: 2562116 - RNA, 16 nt, Chlamydophila pneumoniae J138
cucacaaaagucucua

SEQ ID NO: 2562117 - RNA, 20 nt, Chlamydophila pneumoniae J138
cucacacgaauaauuaaauc

SEQ ID NO: 2562118 - RNA, 17 nt, Chlamydophila pneumoniae J138
cucacagcuaaucauag

SEQ ID NO: 2562119 - RNA, 13 nt, Chlamydophila pneumoniae J138
cucacaucuccuu

SEQ ID NO: 2562120 - RNA, 24 nt, Chlamydophila pneumoniae J138
cucacaucuccuuucaagagcagu

SEQ ID NO: 2562121 - RNA, 17 nt, Chlamydophila pneumoniae J138
cucacauguuucacuua

SEQ ID NO: 2562122 - RNA, 16 nt, Chlamydophila pneumoniae J138
cucacucuaugagaac

SEQ ID NO: 2562123 - RNA, 14 nt, Chlamydophila pneumoniae J138
cucacucuuuucua

SEQ ID NO: 2562124 - RNA, 15 nt, Chlamydophila pneumoniae J138
cucacucuuuucuag

SEQ ID NO: 2562125 - RNA, 12 nt, Chlamydophila pneumoniae J138
cucacugagugu

SEQ ID NO: 2562126 - RNA, 18 nt, Chlamydophila pneumoniae J138
cucacugagugucccaug

SEQ ID NO: 2562127 - RNA, 21 nt, Chlamydophila pneumoniae J138
cucagaaaaaucuaacacagu

SEQ ID NO: 2562128 - RNA, 20 nt, Chlamydophila pneumoniae J138
cucagaauccauuuugccca

SEQ ID NO: 2562129 - RNA, 15 nt, Chlamydophila pneumoniae J138
cucagagaaaaucaa

SEQ ID NO: 2562130 - RNA, 15 nt, Chlamydophila pneumoniae J138
cucauaacccaaagg

SEQ ID NO: 2562131 - RNA, 22 nt, Chlamydophila pneumoniae J138
cucauaaccuaaggcauggcac

SEQ ID NO: 2562132 - RNA, 15 nt, Chlamydophila pneumoniae J138
cucauauuuugucuu

SEQ ID NO: 2562133 - RNA, 21 nt, Chlamydophila pneumoniae J138
cucauauuuugucuucaucau

SEQ ID NO: 2562134 - RNA, 19 nt, Chlamydophila pneumoniae J138
cucaucacaauuuuaaaau

SEQ ID NO: 2562135 - RNA, 20 nt, Chlamydophila pneumoniae J138
cucaucacaauuuuaaaauc

SEQ ID NO: 2562136 - RNA, 21 nt, Chlamydophila pneumoniae J138
cucaucagaagccaccaaaaa

SEQ ID NO: 2562137 - RNA, 22 nt, Chlamydophila pneumoniae J138
cucaucagaaguggccuugcca

SEQ ID NO: 2562138 - RNA, 23 nt, Chlamydophila pneumoniae J138
cucaucagaaguggccuugccag

SEQ ID NO: 2562139 - RNA, 17 nt, Chlamydophila pneumoniae J138
cucaucagcaaaacucc

SEQ ID NO: 2562140 - RNA, 21 nt, Chlamydophila pneumoniae J138
cucaucaguaaaagacugaaa

SEQ ID NO: 2562141 - RNA, 22 nt, Chlamydophila pneumoniae J138
cucaucauaaauaggcucuaca

SEQ ID NO: 2562142 - RNA, 16 nt, Chlamydophila pneumoniae J138
cucauccccucagaaa

SEQ ID NO: 2562143 - RNA, 20 nt, Chlamydophila pneumoniae J138
cucauccuaaauuaaauauc

SEQ ID NO: 2562144 - RNA, 16 nt, Chlamydophila pneumoniae J138
cucauccucaucauca

SEQ ID NO: 2562145 - RNA, 19 nt, Chlamydophila pneumoniae J138
cucaucggaucuuuucuuu

SEQ ID NO: 2562146 - RNA, 20 nt, Chlamydophila pneumoniae J138
cucaucggaucuuuucuuuc

SEQ ID NO: 2562147 - RNA, 20 nt, Chlamydophila pneumoniae J138
cucaucuuugaacaacuccu

SEQ ID NO: 2562148 - RNA, 21 nt, Chlamydophila pneumoniae J138
cucaugaaauuucauucucac

SEQ ID NO: 2562149 - RNA, 17 nt, Chlamydophila pneumoniae J138
cucaugaaauuuucuaa

SEQ ID NO: 2562150 - RNA, 19 nt, Chlamydophila pneumoniae J138
cucaugcggacuuuauucu

SEQ ID NO: 2562151 - RNA, 20 nt, Chlamydophila pneumoniae J138
cucaugcggacuuuauucuc

SEQ ID NO: 2562152 - RNA, 20 nt, Chlamydophila pneumoniae J138
cucauggauuacugaagauc

SEQ ID NO: 2562153 - RNA, 19 nt, Chlamydophila pneumoniae J138
cucaugucuaagucagagg

SEQ ID NO: 2562154 - RNA, 16 nt, Chlamydophila pneumoniae J138
cucauuaucaagaaau

SEQ ID NO: 2562155 - RNA, 17 nt, Chlamydophila pneumoniae J138
cucauuccagcaucuuc

SEQ ID NO: 2562156 - RNA, 19 nt, Chlamydophila pneumoniae J138
cucauuccagcaucuucuc

SEQ ID NO: 2562157 - RNA, 15 nt, Chlamydophila pneumoniae J138
cucauugcggcacca

SEQ ID NO: 2562158 - RNA, 23 nt, Chlamydophila pneumoniae J138
cucauuucguagacgcucuaaac

SEQ ID NO: 2562159 - RNA, 16 nt, Chlamydophila pneumoniae J138
cuccaaaaauucccau

SEQ ID NO: 2562160 - RNA, 15 nt, Chlamydophila pneumoniae J138
cuccaaaacucaagg

SEQ ID NO: 2562161 - RNA, 18 nt, Chlamydophila pneumoniae J138
cuccaaaagaccaaaaau

SEQ ID NO: 2562162 - RNA, 19 nt, Chlamydophila pneumoniae J138
cuccaaaagaccaaaaaua

SEQ ID NO: 2562163 - RNA, 17 nt, Chlamydophila pneumoniae J138
cuccaaaauaaucucgc

SEQ ID NO: 2562164 - RNA, 22 nt, Chlamydophila pneumoniae J138
cucgguuuccugaagaugagaa

SEQ ID NO: 2562165 - RNA, 17 nt, Chlamydophila pneumoniae J138
cucguaauccuucuuuc

SEQ ID NO: 2562166 - RNA, 15 nt, Chlamydophila pneumoniae J138
cucgucugauagagg

SEQ ID NO: 2562167 - RNA, 14 nt, Chlamydophila pneumoniae J138
cucgugcauaauga

SEQ ID NO: 2562168 - RNA, 21 nt, Chlamydophila pneumoniae J138
cucguguagaauucacucccu

SEQ ID NO: 2562169 - RNA, 17 nt, Chlamydophila pneumoniae J138
cucguuauauuuuucug

SEQ ID NO: 2562170 - RNA, 21 nt, Chlamydophila pneumoniae J138
cucuaaaaaagauaaagcuac

SEQ ID NO: 2562171 - RNA, 21 nt, Chlamydophila pneumoniae J138
cucuaaaaacccuaguucauu

SEQ ID NO: 2562172 - RNA, 16 nt, Chlamydophila pneumoniae J138
cucuaaacauaaagac

SEQ ID NO: 2562173 - RNA, 16 nt, Chlamydophila pneumoniae J138
cucuaagaaucuauag

SEQ ID NO: 2562174 - RNA, 12 nt, Chlamydophila pneumoniae J138
cucuaagacugu

SEQ ID NO: 2562175 - RNA, 14 nt, Chlamydophila pneumoniae J138
cucuaagaggguuu

SEQ ID NO: 2562176 - RNA, 18 nt, Chlamydophila pneumoniae J138
cucuaagcagccucuucu

SEQ ID NO: 2562177 - RNA, 16 nt, Chlamydophila pneumoniae J138
cucuaagcgaaacauu

SEQ ID NO: 2562178 - RNA, 22 nt, Chlamydophila pneumoniae J138
cucuaaggacaaaucucccaaa

SEQ ID NO: 2562179 - RNA, 18 nt, Chlamydophila pneumoniae J138
cucuaaguccaacaucag

SEQ ID NO: 2562180 - RNA, 21 nt, Chlamydophila pneumoniae J138
cucuacaguaguaaauaauaa

SEQ ID NO: 2562181 - RNA, 16 nt, Chlamydophila pneumoniae J138
cucuaccccacgcuaa

SEQ ID NO: 2562182 - RNA, 19 nt, Chlamydophila pneumoniae J138
cucuaccccacgcuaaacu

SEQ ID NO: 2562183 - RNA, 20 nt, Chlamydophila pneumoniae J138
cucuacccccagcuucuuca

SEQ ID NO: 2562184 - RNA, 22 nt, Chlamydophila pneumoniae J138
cucuacgcuauucuuaagcuac

SEQ ID NO: 2562185 - RNA, 18 nt, Chlamydophila pneumoniae J138
cucuacuaaaaucucauu

SEQ ID NO: 2562186 - RNA, 12 nt, Chlamydophila pneumoniae J138
cucuacucuaca

SEQ ID NO: 2562187 - RNA, 19 nt, Chlamydophila pneumoniae J138
cucuagaaaacgcucuccu

SEQ ID NO: 2562188 - RNA, 20 nt, Chlamydophila pneumoniae J138
cucuagaaaacgcucuccua

SEQ ID NO: 2562189 - RNA, 22 nt, Chlamydophila pneumoniae J138
cucuagaaauauacucuugcuu

SEQ ID NO: 2562190 - RNA, 23 nt, Chlamydophila pneumoniae J138
cucuagcaccuaauaaagaaggu

SEQ ID NO: 2562191 - RNA, 23 nt, Chlamydophila pneumoniae J138
cucuagccaauauagaagcugcu

SEQ ID NO: 2562192 - RNA, 14 nt, Chlamydophila pneumoniae J138
cucuagccaccaac

SEQ ID NO: 2562193 - RNA, 15 nt, Chlamydophila pneumoniae J138
cucuagccaccaaca

SEQ ID NO: 2562194 - RNA, 21 nt, Chlamydophila pneumoniae J138
cucuagccaccaacaguccug

SEQ ID NO: 2562195 - RNA, 17 nt, Chlamydophila pneumoniae J138
cucuagcucaaaucuca

SEQ ID NO: 2562196 - RNA, 19 nt, Chlamydophila pneumoniae J138
cucuagggauaauuaaacu

SEQ ID NO: 2562197 - RNA, 21 nt, Chlamydophila pneumoniae J138
cucuagggauaauuaaacucu

SEQ ID NO: 2562198 - RNA, 15 nt, Chlamydophila pneumoniae J138
cucuagggguuuccc

SEQ ID NO: 2562199 - RNA, 13 nt, Chlamydophila pneumoniae J138
cucuaguaagaaa

SEQ ID NO: 2562200 - RNA, 19 nt, Chlamydophila pneumoniae J138
cucuagucuuucaaccucc

SEQ ID NO: 2562201 - RNA, 13 nt, Chlamydophila pneumoniae J138
cucuaguuuuucu

SEQ ID NO: 2562202 - RNA, 23 nt, Chlamydophila pneumoniae J138
cucuauagugcauaccuuaccau

SEQ ID NO: 2562203 - RNA, 17 nt, Chlamydophila pneumoniae J138
cucuauauauccugagu

SEQ ID NO: 2562204 - RNA, 19 nt, Chlamydophila pneumoniae J138
cucuauauauccugaguga

SEQ ID NO: 2562205 - RNA, 12 nt, Chlamydophila pneumoniae J138
cucuauauuuuu

SEQ ID NO: 2562206 - RNA, 17 nt, Chlamydophila pneumoniae J138
cucuauauuuuuuccca

SEQ ID NO: 2562207 - RNA, 12 nt, Chlamydophila pneumoniae J138
cucuaugagaac

SEQ ID NO: 2562208 - RNA, 13 nt, Chlamydophila pneumoniae J138
cucucacugagug

SEQ ID NO: 2562209 - RNA, 13 nt, Chlamydophila pneumoniae J138
cucucaucagcaa

SEQ ID NO: 2562210 - RNA, 13 nt, Chlamydophila pneumoniae J138
cucucaugaaauu

SEQ ID NO: 2562211 - RNA, 15 nt, Chlamydophila pneumoniae J138
cucuccacagggucu

SEQ ID NO: 2562212 - RNA, 20 nt, Chlamydophila pneumoniae J138
cucuccagcuguggugguga

SEQ ID NO: 2562213 - RNA, 13 nt, Chlamydophila pneumoniae J138
cucuccauggcuu

SEQ ID NO: 2562214 - RNA, 15 nt, Chlamydophila pneumoniae J138
cucucccauguagua

SEQ ID NO: 2562215 - RNA, 15 nt, Chlamydophila pneumoniae J138
cucucccgaccaaga

SEQ ID NO: 2562216 - RNA, 21 nt, Chlamydophila pneumoniae J138
cucuccguccaguucuucauu

SEQ ID NO: 2562217 - RNA, 16 nt, Chlamydophila pneumoniae J138
cucuccuaaaccauca

SEQ ID NO: 2562218 - RNA, 14 nt, Chlamydophila pneumoniae J138
cucuccuccccacu

SEQ ID NO: 2562219 - RNA, 13 nt, Chlamydophila pneumoniae J138
cucucgcuaagca

SEQ ID NO: 2562220 - RNA, 12 nt, Chlamydophila pneumoniae J138
cucucuaaggga

SEQ ID NO: 2562221 - RNA, 20 nt, Chlamydophila pneumoniae J138
cucucuaucuacacacauga

SEQ ID NO: 2562222 - RNA, 23 nt, Chlamydophila pneumoniae J138
cucucucaagucuauuugaaaag

SEQ ID NO: 2562223 - RNA, 16 nt, Chlamydophila pneumoniae J138
cucucuccaugagcuc

SEQ ID NO: 2562224 - RNA, 15 nt, Chlamydophila pneumoniae J138
cucucugccuaccaa

SEQ ID NO: 2562225 - RNA, 14 nt, Chlamydophila pneumoniae J138
cucucuuaaauuua

SEQ ID NO: 2562226 - RNA, 14 nt, Chlamydophila pneumoniae J138
cucucuucccccag

SEQ ID NO: 2562227 - RNA, 19 nt, Chlamydophila pneumoniae J138
cucucuucccccagaccua

SEQ ID NO: 2562228 - RNA, 13 nt, Chlamydophila pneumoniae J138
cucucuuccugcu

SEQ ID NO: 2562229 - RNA, 19 nt, Chlamydophila pneumoniae J138
cucucuuccugcugcuuug

SEQ ID NO: 2562230 - RNA, 11 nt, Chlamydophila pneumoniae J138
cucucuucuuc

SEQ ID NO: 2562231 - RNA, 15 nt, Chlamydophila pneumoniae J138
cucucuugcuauacc

SEQ ID NO: 2562232 - RNA, 21 nt, Chlamydophila pneumoniae J138
cucucuuuaaaccuggcauug

SEQ ID NO: 2562233 - RNA, 18 nt, Chlamydophila pneumoniae J138
cucucuuuauauuuuuug

SEQ ID NO: 2562234 - RNA, 23 nt, Chlamydophila pneumoniae J138
cucugaagaccccucuugcuuuu

SEQ ID NO: 2562235 - RNA, 18 nt, Chlamydophila pneumoniae J138
cucugacaaguguguuuc

SEQ ID NO: 2562236 - RNA, 20 nt, Chlamydophila pneumoniae J138
cucugacacuccucagaauc

SEQ ID NO: 2562237 - RNA, 14 nt, Chlamydophila pneumoniae J138
cucugaccaucaau

SEQ ID NO: 2562238 - RNA, 21 nt, Chlamydophila pneumoniae J138
cucugacuugcaagcuucuug

SEQ ID NO: 2562239 - RNA, 13 nt, Chlamydophila pneumoniae J138
cucugcauauaaa

SEQ ID NO: 2562240 - RNA, 22 nt, Chlamydophila pneumoniae J138
cucugcauguugcaaagcauga

SEQ ID NO: 2562241 - RNA, 19 nt, Chlamydophila pneumoniae J138
cucugccaugucuaaagga

SEQ ID NO: 2562242 - RNA, 15 nt, Chlamydophila pneumoniae J138
cucuggaauacauuc

SEQ ID NO: 2562243 - RNA, 15 nt, Chlamydophila pneumoniae J138
cucugggaauuguuc

SEQ ID NO: 2562244 - RNA, 20 nt, Chlamydophila pneumoniae J138
cucuguaagaacguggggaa

SEQ ID NO: 2562245 - RNA, 18 nt, Chlamydophila pneumoniae J138
cucuguauuggaaaguau

SEQ ID NO: 2562246 - RNA, 20 nt, Chlamydophila pneumoniae J138
cucugugccaucuguagacc

SEQ ID NO: 2562247 - RNA, 20 nt, Chlamydophila pneumoniae J138
cucuguugggagcuuccucc

SEQ ID NO: 2562248 - RNA, 22 nt, Chlamydophila pneumoniae J138
cucuguugggagcuuccuccaa

SEQ ID NO: 2562249 - RNA, 20 nt, Chlamydophila pneumoniae J138
cucuuaaaugugaaaucgua

SEQ ID NO: 2562250 - RNA, 12 nt, Chlamydophila pneumoniae J138
cucuuaacuggc

SEQ ID NO: 2562251 - RNA, 21 nt, Chlamydophila pneumoniae J138
cucuuaucuggagaugcgcuc

SEQ ID NO: 2562252 - RNA, 15 nt, Chlamydophila pneumoniae J138
cucuuauguuaaaaa

SEQ ID NO: 2562253 - RNA, 16 nt, Chlamydophila pneumoniae J138
cucuuauugcagaauc

SEQ ID NO: 2562254 - RNA, 17 nt, Chlamydophila pneumoniae J138
cucuucaaagacaggcu

SEQ ID NO: 2562255 - RNA, 21 nt, Chlamydophila pneumoniae J138
cucuucaauuucuucaucaau

SEQ ID NO: 2562256 - RNA, 22 nt, Chlamydophila pneumoniae J138
cucuucacuauuaggcuuuuuu

SEQ ID NO: 2562257 - RNA, 13 nt, Chlamydophila pneumoniae J138
cucuucauccgaa

SEQ ID NO: 2562258 - RNA, 15 nt, Chlamydophila pneumoniae J138
cucuucauuuucuuu

SEQ ID NO: 2562259 - RNA, 13 nt, Chlamydophila pneumoniae J138
cucuuccuucucc

SEQ ID NO: 2562260 - RNA, 21 nt, Chlamydophila pneumoniae J138
cucuucgcuggcauguuuaau

SEQ ID NO: 2562261 - RNA, 15 nt, Chlamydophila pneumoniae J138
cucuucuacuuuaag

SEQ ID NO: 2562262 - RNA, 23 nt, Chlamydophila pneumoniae J138
cucuucuacuuuaagaagcacuu

SEQ ID NO: 2562263 - RNA, 16 nt, Chlamydophila pneumoniae J138
cucuugaauauuuaaa

SEQ ID NO: 2562264 - RNA, 20 nt, Chlamydophila pneumoniae J138
auaaagaagaaaccccaugu

SEQ ID NO: 2562265 - RNA, 16 nt, Chlamydophila pneumoniae J138
auaaagaagguugaga

SEQ ID NO: 2562266 - RNA, 22 nt, Chlamydophila pneumoniae J138
auaaagaaguuuacaaauaaaa

SEQ ID NO: 2562267 - RNA, 13 nt, Chlamydophila pneumoniae J138
auaaagaauuccc

SEQ ID NO: 2562268 - RNA, 12 nt, Chlamydophila pneumoniae J138
auaaagagcuga

SEQ ID NO: 2562269 - RNA, 21 nt, Chlamydophila pneumoniae J138
auaaagauaaucuguaagaaa

SEQ ID NO: 2562270 - RNA, 14 nt, Chlamydophila pneumoniae J138
auaaagaucuucau

SEQ ID NO: 2562271 - RNA, 22 nt, Chlamydophila pneumoniae J138
auaaagaucuuuauuuuuaaaa

SEQ ID NO: 2562272 - RNA, 15 nt, Chlamydophila pneumoniae J138
auaaagaucuuuuau

SEQ ID NO: 2562273 - RNA, 19 nt, Chlamydophila pneumoniae J138
auaaagcaacuguaaauuu

SEQ ID NO: 2562274 - RNA, 21 nt, Chlamydophila pneumoniae J138
auaaagcccuuuugaauaucc

SEQ ID NO: 2562275 - RNA, 14 nt, Chlamydophila pneumoniae J138
auaaaggcauaacu

SEQ ID NO: 2562276 - RNA, 16 nt, Chlamydophila pneumoniae J138
auaaaggcucuuuuag

SEQ ID NO: 2562277 - RNA, 21 nt, Chlamydophila pneumoniae J138
auaaagggaauuuucucauag

SEQ ID NO: 2562278 - RNA, 17 nt, Chlamydophila pneumoniae J138
auaaagguuacaagcaa

SEQ ID NO: 2562279 - RNA, 22 nt, Chlamydophila pneumoniae J138
auaaagguuacaagcaauacua

SEQ ID NO: 2562280 - RNA, 23 nt, Chlamydophila pneumoniae J138
auaaagguuacaagcaauacuaa

SEQ ID NO: 2562281 - RNA, 11 nt, Chlamydophila pneumoniae J138
auaaaguauau

SEQ ID NO: 2562282 - RNA, 18 nt, Chlamydophila pneumoniae J138
auaaaguuuguaaaaacu

SEQ ID NO: 2562283 - RNA, 23 nt, Chlamydophila pneumoniae J138
auaaauaauuacaauuuuagaua

SEQ ID NO: 2562284 - RNA, 13 nt, Chlamydophila pneumoniae J138
auaaauacaggag

SEQ ID NO: 2562285 - RNA, 22 nt, Chlamydophila pneumoniae J138
auaaauacgugcuugaauauuu

SEQ ID NO: 2562286 - RNA, 15 nt, Chlamydophila pneumoniae J138
auaaauccaaaaaau

SEQ ID NO: 2562287 - RNA, 17 nt, Chlamydophila pneumoniae J138
auaaauccccaccaaca

SEQ ID NO: 2562288 - RNA, 17 nt, Chlamydophila pneumoniae J138
auaaaucccgaacaauc

SEQ ID NO: 2562289 - RNA, 20 nt, Chlamydophila pneumoniae J138
auaaauggaggauacucaca

SEQ ID NO: 2562290 - RNA, 14 nt, Chlamydophila pneumoniae J138
auaaauguagggau

SEQ ID NO: 2562291 - RNA, 19 nt, Chlamydophila pneumoniae J138
auaaauucaagacuauaga

SEQ ID NO: 2562292 - RNA, 19 nt, Chlamydophila pneumoniae J138
auaaauucaggacccuuuu

SEQ ID NO: 2562293 - RNA, 15 nt, Chlamydophila pneumoniae J138
auaaauuuaucugcu

SEQ ID NO: 2562294 - RNA, 16 nt, Chlamydophila pneumoniae J138
auaaauuuaucugcuu

SEQ ID NO: 2562295 - RNA, 17 nt, Chlamydophila pneumoniae J138
auaacaaacgccgcucu

SEQ ID NO: 2562296 - RNA, 16 nt, Chlamydophila pneumoniae J138
auaacaaucagaugag

SEQ ID NO: 2562297 - RNA, 16 nt, Chlamydophila pneumoniae J138
auaacacuucuuucuu

SEQ ID NO: 2562298 - RNA, 12 nt, Chlamydophila pneumoniae J138
auaacaucaaga

SEQ ID NO: 2562299 - RNA, 16 nt, Chlamydophila pneumoniae J138
auaacauugcuugcua

SEQ ID NO: 2562300 - RNA, 17 nt, Chlamydophila pneumoniae J138
auaacauugcuugcuau

SEQ ID NO: 2562301 - RNA, 20 nt, Chlamydophila pneumoniae J138
auaacauuucguuuuuucuu

SEQ ID NO: 2562302 - RNA, 21 nt, Chlamydophila pneumoniae J138
auaaccaaaagaauuaagaag

SEQ ID NO: 2562303 - RNA, 22 nt, Chlamydophila pneumoniae J138
auaaccgaaacuucucagauaa

SEQ ID NO: 2562304 - RNA, 19 nt, Chlamydophila pneumoniae J138
auaacugugcuccauagca

SEQ ID NO: 2562305 - RNA, 20 nt, Chlamydophila pneumoniae J138
auaacuugagccaacagguu

SEQ ID NO: 2562306 - RNA, 13 nt, Chlamydophila pneumoniae J138
auaacuuuaucau

SEQ ID NO: 2562307 - RNA, 16 nt, Chlamydophila pneumoniae J138
auaacuuuaucauaga

SEQ ID NO: 2562308 - RNA, 20 nt, Chlamydophila pneumoniae J138
auaacuuugcaugaggagac

SEQ ID NO: 2562309 - RNA, 18 nt, Chlamydophila pneumoniae J138
auaagaaaauccuaacaa

SEQ ID NO: 2562310 - RNA, 17 nt, Chlamydophila pneumoniae J138
auaagaaccucuaauuu

SEQ ID NO: 2562311 - RNA, 14 nt, Chlamydophila pneumoniae J138
auaagaacucuauu

SEQ ID NO: 2562312 - RNA, 17 nt, Chlamydophila pneumoniae J138
auaagaacuuuagggaa

SEQ ID NO: 2562313 - RNA, 18 nt, Chlamydophila pneumoniae J138
auaagaacuuuagggaag

SEQ ID NO: 2562314 - RNA, 22 nt, Chlamydophila pneumoniae J138
auaagaagcucuaucuuuggua

SEQ ID NO: 2562315 - RNA, 20 nt, Chlamydophila pneumoniae J138
auaagaaugguuauuucuug

SEQ ID NO: 2562316 - RNA, 14 nt, Chlamydophila pneumoniae J138
auaagaccagaaag

SEQ ID NO: 2562317 - RNA, 16 nt, Chlamydophila pneumoniae J138
auaagagacauuucuu

SEQ ID NO: 2562318 - RNA, 17 nt, Chlamydophila pneumoniae J138
auaagauaaagaauucu

SEQ ID NO: 2562319 - RNA, 15 nt, Chlamydophila pneumoniae J138
auaagauauucaaga

SEQ ID NO: 2562320 - RNA, 11 nt, Chlamydophila pneumoniae J138
auaagaucaau

SEQ ID NO: 2562321 - RNA, 14 nt, Chlamydophila pneumoniae J138
auaagauccaaaaa

SEQ ID NO: 2562322 - RNA, 15 nt, Chlamydophila pneumoniae J138
auaagauccaaaaau

SEQ ID NO: 2562323 - RNA, 18 nt, Chlamydophila pneumoniae J138
auaagauccaaaaauucu

SEQ ID NO: 2562324 - RNA, 23 nt, Chlamydophila pneumoniae J138
auaagaucucgugaauuacaggc

SEQ ID NO: 2562325 - RNA, 16 nt, Chlamydophila pneumoniae J138
auaagcaggaaaagca

SEQ ID NO: 2562326 - RNA, 18 nt, Chlamydophila pneumoniae J138
auaagcaggaaaagcaaa

SEQ ID NO: 2562327 - RNA, 16 nt, Chlamydophila pneumoniae J138
auaagccaguacuaaa

SEQ ID NO: 2562328 - RNA, 20 nt, Chlamydophila pneumoniae J138
auaagcuaacaccucuucaa

SEQ ID NO: 2562329 - RNA, 15 nt, Chlamydophila pneumoniae J138
auaagcuugccagca

SEQ ID NO: 2562330 - RNA, 19 nt, Chlamydophila pneumoniae J138
auaagcuugccagcagaag

SEQ ID NO: 2562331 - RNA, 19 nt, Chlamydophila pneumoniae J138
auaaggauucugagaaguu

SEQ ID NO: 2562332 - RNA, 14 nt, Chlamydophila pneumoniae J138
auaaggcuugagga

SEQ ID NO: 2562333 - RNA, 15 nt, Chlamydophila pneumoniae J138
auacuucuccugaac

SEQ ID NO: 2562334 - RNA, 21 nt, Chlamydophila pneumoniae J138
auacuuguaccguaaagaaaa

SEQ ID NO: 2562335 - RNA, 18 nt, Chlamydophila pneumoniae J138
auagaaaacauagagauu

SEQ ID NO: 2562336 - RNA, 16 nt, Chlamydophila pneumoniae J138
auagaaaacauauccc

SEQ ID NO: 2562337 - RNA, 12 nt, Chlamydophila pneumoniae J138
auagaaaaggau

SEQ ID NO: 2562338 - RNA, 15 nt, Chlamydophila pneumoniae J138
auagaaaaucuuguu

SEQ ID NO: 2562339 - RNA, 22 nt, Chlamydophila pneumoniae J138
auagaaggcaucccgaacgcua

SEQ ID NO: 2562340 - RNA, 17 nt, Chlamydophila pneumoniae J138
auagaauacacagcuau

SEQ ID NO: 2562341 - RNA, 12 nt, Chlamydophila pneumoniae J138
auagacaaccua

SEQ ID NO: 2562342 - RNA, 22 nt, Chlamydophila pneumoniae J138
auagacaggauggaaucaggga

SEQ ID NO: 2562343 - RNA, 14 nt, Chlamydophila pneumoniae J138
auagacauucccua

SEQ ID NO: 2562344 - RNA, 20 nt, Chlamydophila pneumoniae J138
auagacauucccuaaagcug

SEQ ID NO: 2562345 - RNA, 23 nt, Chlamydophila pneumoniae J138
auagacauucccuaaagcugcca

SEQ ID NO: 2562346 - RNA, 20 nt, Chlamydophila pneumoniae J138
auagacucucacugaguguc

SEQ ID NO: 2562347 - RNA, 23 nt, Chlamydophila pneumoniae J138
auagacuuguauucuugagaguc

SEQ ID NO: 2562348 - RNA, 15 nt, Chlamydophila pneumoniae J138
auagacuuugaguuc

SEQ ID NO: 2562349 - RNA, 17 nt, Chlamydophila pneumoniae J138
auagagauucuacaaau

SEQ ID NO: 2562350 - RNA, 22 nt, Chlamydophila pneumoniae J138
auagagcgguucuuucuagaau

SEQ ID NO: 2562351 - RNA, 15 nt, Chlamydophila pneumoniae J138
auagagcucuaaaaa

SEQ ID NO: 2562352 - RNA, 20 nt, Chlamydophila pneumoniae J138
auagaguagcucaucuagaa

SEQ ID NO: 2562353 - RNA, 17 nt, Chlamydophila pneumoniae J138
auagaguaucuaaaacu

SEQ ID NO: 2562354 - RNA, 20 nt, Chlamydophila pneumoniae J138
auagaguaucuaaaacuucu

SEQ ID NO: 2562355 - RNA, 19 nt, Chlamydophila pneumoniae J138
auagaguucgcacuaauuu

SEQ ID NO: 2562356 - RNA, 22 nt, Chlamydophila pneumoniae J138
auagauagggccgugaagcaga

SEQ ID NO: 2562357 - RNA, 14 nt, Chlamydophila pneumoniae J138
auagauaugccuca

SEQ ID NO: 2562358 - RNA, 16 nt, Chlamydophila pneumoniae J138
auagaucacaucaaga

SEQ ID NO: 2562359 - RNA, 17 nt, Chlamydophila pneumoniae J138
auagaucacaucaagau

SEQ ID NO: 2562360 - RNA, 13 nt, Chlamydophila pneumoniae J138
auagauccugaaa

SEQ ID NO: 2562361 - RNA, 13 nt, Chlamydophila pneumoniae J138
auagaucucuuga

SEQ ID NO: 2562362 - RNA, 17 nt, Chlamydophila pneumoniae J138
auagauuccccaaacuu

SEQ ID NO: 2562363 - RNA, 23 nt, Chlamydophila pneumoniae J138
auagauucguuauccucgucuuc

SEQ ID NO: 2562364 - RNA, 17 nt, Chlamydophila pneumoniae J138
auagcaaagauuucugc

SEQ ID NO: 2562365 - RNA, 17 nt, Chlamydophila pneumoniae J138
auagcaagcacuuucgc

SEQ ID NO: 2562366 - RNA, 15 nt, Chlamydophila pneumoniae J138
auagcaaugauguuu

SEQ ID NO: 2562367 - RNA, 20 nt, Chlamydophila pneumoniae J138
auagcaauggcuuuuuuugu

SEQ ID NO: 2562368 - RNA, 17 nt, Chlamydophila pneumoniae J138
auagcaguauagagaag

SEQ ID NO: 2562369 - RNA, 15 nt, Chlamydophila pneumoniae J138
auagcauacgacagu

SEQ ID NO: 2562370 - RNA, 17 nt, Chlamydophila pneumoniae J138
auagcaucccuucuucu

SEQ ID NO: 2562371 - RNA, 17 nt, Chlamydophila pneumoniae J138
auagcauggagaauaau

SEQ ID NO: 2562372 - RNA, 20 nt, Chlamydophila pneumoniae J138
auagcauggagaauaaucuc

SEQ ID NO: 2562373 - RNA, 16 nt, Chlamydophila pneumoniae J138
auagcauuauucccua

SEQ ID NO: 2562374 - RNA, 15 nt, Chlamydophila pneumoniae J138
auagcccgaaauuca

SEQ ID NO: 2562375 - RNA, 17 nt, Chlamydophila pneumoniae J138
auagccuccauuuagac

SEQ ID NO: 2562376 - RNA, 21 nt, Chlamydophila pneumoniae J138
auagccucgagcagaaacucc

SEQ ID NO: 2562377 - RNA, 19 nt, Chlamydophila pneumoniae J138
auagccucuucuacaccau

SEQ ID NO: 2562378 - RNA, 20 nt, Chlamydophila pneumoniae J138
auagccucuucuacaccaua

SEQ ID NO: 2562379 - RNA, 23 nt, Chlamydophila pneumoniae J138
auagccuuccauaucuagaaguu

SEQ ID NO: 2562380 - RNA, 13 nt, Chlamydophila pneumoniae J138
auagcgucuguua

SEQ ID NO: 2562381 - RNA, 19 nt, Chlamydophila pneumoniae J138
auagcuaagagcaucuuug

SEQ ID NO: 2562382 - RNA, 13 nt, Chlamydophila pneumoniae J138
auagcucagcucu

SEQ ID NO: 2562383 - RNA, 16 nt, Chlamydophila pneumoniae J138
auagcucagcucuaau

SEQ ID NO: 2562384 - RNA, 20 nt, Chlamydophila pneumoniae J138
auagcucagcucuaauucuu

SEQ ID NO: 2562385 - RNA, 17 nt, Chlamydophila pneumoniae J138
auagcuccuuggcuaug

SEQ ID NO: 2562386 - RNA, 18 nt, Chlamydophila pneumoniae J138
auagcuggaucuucugau

SEQ ID NO: 2562387 - RNA, 19 nt, Chlamydophila pneumoniae J138
auagcuuacuuagaacuau

SEQ ID NO: 2562388 - RNA, 17 nt, Chlamydophila pneumoniae J138
auagcuuccuguaguga

SEQ ID NO: 2562389 - RNA, 16 nt, Chlamydophila pneumoniae J138
auagcuuugaagagca

SEQ ID NO: 2562390 - RNA, 17 nt, Chlamydophila pneumoniae J138
auagcuuuggaacgugc

SEQ ID NO: 2562391 - RNA, 23 nt, Chlamydophila pneumoniae J138
auaggaaacgcccuucuuaguaa

SEQ ID NO: 2562392 - RNA, 23 nt, Chlamydophila pneumoniae J138
auaggaacaaagccaaauucucg

SEQ ID NO: 2562393 - RNA, 23 nt, Chlamydophila pneumoniae J138
auaggaacucacaaacaacagaa

SEQ ID NO: 2562394 - RNA, 21 nt, Chlamydophila pneumoniae J138
auaggaauaacaccaaaagaa

SEQ ID NO: 2562395 - RNA, 15 nt, Chlamydophila pneumoniae J138
auaggauccaggagu

SEQ ID NO: 2562396 - RNA, 23 nt, Chlamydophila pneumoniae J138
auaggcugcacacauccuggagc

SEQ ID NO: 2562397 - RNA, 16 nt, Chlamydophila pneumoniae J138
auagggccauuagcaa

SEQ ID NO: 2562398 - RNA, 22 nt, Chlamydophila pneumoniae J138
auaggguugugucucugaagac

SEQ ID NO: 2562399 - RNA, 21 nt, Chlamydophila pneumoniae J138
auaggguuucacuuucugaug

SEQ ID NO: 2562400 - RNA, 18 nt, Chlamydophila pneumoniae J138
auagguacgcuuuuucuu

SEQ ID NO: 2562401 - RNA, 15 nt, Chlamydophila pneumoniae J138
auaguaaacagaagu

SEQ ID NO: 2562402 - RNA, 21 nt, Chlamydophila pneumoniae J138
auaguagacauauccaaugag

SEQ ID NO: 2562403 - RNA, 18 nt, Chlamydophila pneumoniae J138
auaguaucguaagccggc

SEQ ID NO: 2562404 - RNA, 20 nt, Chlamydophila pneumoniae J138
auaguauuuuugaaaccaag

SEQ ID NO: 2562405 - RNA, 18 nt, Chlamydophila pneumoniae J138
auaguccuagcagagaaa

SEQ ID NO: 2562406 - RNA, 21 nt, Chlamydophila pneumoniae J138
auagucuguuuuggaaagaag

SEQ ID NO: 2562407 - RNA, 19 nt, Chlamydophila pneumoniae J138
auagucuucuacuaggcgc

SEQ ID NO: 2562408 - RNA, 22 nt, Chlamydophila pneumoniae J138
auaguggcgaauccuagagaac

SEQ ID NO: 2562409 - RNA, 19 nt, Chlamydophila pneumoniae J138
auaguuaaauuuccaaaga

SEQ ID NO: 2562410 - RNA, 19 nt, Chlamydophila pneumoniae J138
auaguuauuaauaaauuua

SEQ ID NO: 2562411 - RNA, 17 nt, Chlamydophila pneumoniae J138
auaguuuuuauuuuuaa

SEQ ID NO: 2562412 - RNA, 19 nt, Chlamydophila pneumoniae J138
auaguuuuuauuuuuaaau

SEQ ID NO: 2562413 - RNA, 22 nt, Chlamydophila pneumoniae J138
auaguuuuugcuguuucuucug

SEQ ID NO: 2562414 - RNA, 13 nt, Chlamydophila pneumoniae J138
auauaaaagaaga

SEQ ID NO: 2562415 - RNA, 19 nt, Chlamydophila pneumoniae J138
auauaaagguuacaagcaa

SEQ ID NO: 2562416 - RNA, 22 nt, Chlamydophila pneumoniae J138
auauaagauaauagagaagaag

SEQ ID NO: 2562417 - RNA, 21 nt, Chlamydophila pneumoniae J138
auauaagggggaucuucagag

SEQ ID NO: 2562418 - RNA, 16 nt, Chlamydophila pneumoniae J138
auauaauuccaauugc

SEQ ID NO: 2562419 - RNA, 13 nt, Chlamydophila pneumoniae J138
auauacaauccag

SEQ ID NO: 2562420 - RNA, 11 nt, Chlamydophila pneumoniae J138
auauaccacua

SEQ ID NO: 2562421 - RNA, 22 nt, Chlamydophila pneumoniae J138
auauacugccagcgaucacaua

SEQ ID NO: 2562422 - RNA, 14 nt, Chlamydophila pneumoniae J138
auauacuuauacca

SEQ ID NO: 2562423 - RNA, 17 nt, Chlamydophila pneumoniae J138
auauacuuauaccaccc

SEQ ID NO: 2562424 - RNA, 17 nt, Chlamydophila pneumoniae J138
auauagaagcugcugcu

SEQ ID NO: 2562425 - RNA, 22 nt, Chlamydophila pneumoniae J138
auauaggguugugucucugaag

SEQ ID NO: 2562426 - RNA, 16 nt, Chlamydophila pneumoniae J138
auauagguuaagccaa

SEQ ID NO: 2562427 - RNA, 22 nt, Chlamydophila pneumoniae J138
auauagguuuagauugccuuug

SEQ ID NO: 2562428 - RNA, 13 nt, Chlamydophila pneumoniae J138
auauauagagcag

SEQ ID NO: 2562429 - RNA, 12 nt, Chlamydophila pneumoniae J138
auauauccugag

SEQ ID NO: 2562430 - RNA, 13 nt, Chlamydophila pneumoniae J138
auauauccugagu

SEQ ID NO: 2562431 - RNA, 14 nt, Chlamydophila pneumoniae J138
auauauuuuuaaag

SEQ ID NO: 2562432 - RNA, 15 nt, Chlamydophila pneumoniae J138
aucacguccuucuau

SEQ ID NO: 2562433 - RNA, 15 nt, Chlamydophila pneumoniae J138
aucacuaucauggac

SEQ ID NO: 2562434 - RNA, 12 nt, Chlamydophila pneumoniae J138
aucagaaaugaa

SEQ ID NO: 2562435 - RNA, 23 nt, Chlamydophila pneumoniae J138
aucagaacaacgcugcuucucua

SEQ ID NO: 2562436 - RNA, 18 nt, Chlamydophila pneumoniae J138
aucagaagccaccaaaaa

SEQ ID NO: 2562437 - RNA, 22 nt, Chlamydophila pneumoniae J138
aucagaagccaccaaaaauucc

SEQ ID NO: 2562438 - RNA, 21 nt, Chlamydophila pneumoniae J138
aucagaagguaaauuuuuaaa

SEQ ID NO: 2562439 - RNA, 21 nt, Chlamydophila pneumoniae J138
aucagaauccugaguaaaauc

SEQ ID NO: 2562440 - RNA, 17 nt, Chlamydophila pneumoniae J138
aucagaaucguucccau

SEQ ID NO: 2562441 - RNA, 23 nt, Chlamydophila pneumoniae J138
aucagaaucguucccaucacaua

SEQ ID NO: 2562442 - RNA, 16 nt, Chlamydophila pneumoniae J138
aucagaaucuaaguaa

SEQ ID NO: 2562443 - RNA, 18 nt, Chlamydophila pneumoniae J138
aucagaaucuaaguaaaa

SEQ ID NO: 2562444 - RNA, 16 nt, Chlamydophila pneumoniae J138
aucagacugaagagca

SEQ ID NO: 2562445 - RNA, 22 nt, Chlamydophila pneumoniae J138
aucagagggacuccugugauag

SEQ ID NO: 2562446 - RNA, 16 nt, Chlamydophila pneumoniae J138
aucagauccaugaaca

SEQ ID NO: 2562447 - RNA, 19 nt, Chlamydophila pneumoniae J138
aucagauguaaagagcaac

SEQ ID NO: 2562448 - RNA, 15 nt, Chlamydophila pneumoniae J138
aucagcaaaacuccc

SEQ ID NO: 2562449 - RNA, 14 nt, Chlamydophila pneumoniae J138
aucagcaacauaaa

SEQ ID NO: 2562450 - RNA, 23 nt, Chlamydophila pneumoniae J138
aucagcaacaucguuaauauaau

SEQ ID NO: 2562451 - RNA, 17 nt, Chlamydophila pneumoniae J138
aucagcaagaucuaacu

SEQ ID NO: 2562452 - RNA, 18 nt, Chlamydophila pneumoniae J138
aucaggagucucuggaag

SEQ ID NO: 2562453 - RNA, 17 nt, Chlamydophila pneumoniae J138
aucaggauucuaaaaag

SEQ ID NO: 2562454 - RNA, 22 nt, Chlamydophila pneumoniae J138
aucaggauucuaaaaagaaaag

SEQ ID NO: 2562455 - RNA, 16 nt, Chlamydophila pneumoniae J138
aucaguaaaagacuga

SEQ ID NO: 2562456 - RNA, 16 nt, Chlamydophila pneumoniae J138
aucaguuaacugugua

SEQ ID NO: 2562457 - RNA, 19 nt, Chlamydophila pneumoniae J138
aucaguuccauuuucaggc

SEQ ID NO: 2562458 - RNA, 17 nt, Chlamydophila pneumoniae J138
aucauaaccaaaagaau

SEQ ID NO: 2562459 - RNA, 13 nt, Chlamydophila pneumoniae J138
aucauaccgacaa

SEQ ID NO: 2562460 - RNA, 16 nt, Chlamydophila pneumoniae J138
aucauaccgacaagca

SEQ ID NO: 2562461 - RNA, 18 nt, Chlamydophila pneumoniae J138
aucauagccaucauagca

SEQ ID NO: 2562462 - RNA, 20 nt, Chlamydophila pneumoniae J138
aucauagccaucauagcaaa

SEQ ID NO: 2562463 - RNA, 15 nt, Chlamydophila pneumoniae J138
aucauaggcuauaau

SEQ ID NO: 2562464 - RNA, 13 nt, Chlamydophila pneumoniae J138
aucauaucuucaa

SEQ ID NO: 2562465 - RNA, 19 nt, Chlamydophila pneumoniae J138
aucauauuuuuguccugca

SEQ ID NO: 2562466 - RNA, 18 nt, Chlamydophila pneumoniae J138
aucaucaaugguuaaaac

SEQ ID NO: 2562467 - RNA, 15 nt, Chlamydophila pneumoniae J138
aucaucgaagaacuu

SEQ ID NO: 2562468 - RNA, 19 nt, Chlamydophila pneumoniae J138
aucaucucccaaauagcua

SEQ ID NO: 2562469 - RNA, 16 nt, Chlamydophila pneumoniae J138
aucaugagaauuuuca

SEQ ID NO: 2562470 - RNA, 17 nt, Chlamydophila pneumoniae J138
aucaugagaauuuucau

SEQ ID NO: 2562471 - RNA, 14 nt, Chlamydophila pneumoniae J138
aucaugauaaaaau

SEQ ID NO: 2562472 - RNA, 15 nt, Chlamydophila pneumoniae J138
aucaugauaaaaauu

SEQ ID NO: 2562473 - RNA, 20 nt, Chlamydophila pneumoniae J138
aucaugauaaaaauuuucag

SEQ ID NO: 2562474 - RNA, 16 nt, Chlamydophila pneumoniae J138
aucaugauauugcguu

SEQ ID NO: 2562475 - RNA, 16 nt, Chlamydophila pneumoniae J138
aucaugccgagauuuu

SEQ ID NO: 2562476 - RNA, 20 nt, Chlamydophila pneumoniae J138
aucauggacaagcaaaagca

SEQ ID NO: 2562477 - RNA, 14 nt, Chlamydophila pneumoniae J138
aucauguagcagag

SEQ ID NO: 2562478 - RNA, 14 nt, Chlamydophila pneumoniae J138
aucauuaagaagau

SEQ ID NO: 2562479 - RNA, 16 nt, Chlamydophila pneumoniae J138
aucauuaagaagauuc

SEQ ID NO: 2562480 - RNA, 19 nt, Chlamydophila pneumoniae J138
aucauuaaggugugcuccu

SEQ ID NO: 2562481 - RNA, 18 nt, Chlamydophila pneumoniae J138
aucauuagcaucaucucc

SEQ ID NO: 2562482 - RNA, 11 nt, Chlamydophila pneumoniae J138
aucauucuuua

SEQ ID NO: 2562483 - RNA, 21 nt, Chlamydophila pneumoniae J138
aucauugcuauugaaaaaucc

SEQ ID NO: 2562484 - RNA, 22 nt, Chlamydophila pneumoniae J138
aucauuuaaagcugaaauucuu

SEQ ID NO: 2562485 - RNA, 13 nt, Chlamydophila pneumoniae J138
aucauuuuugcua

SEQ ID NO: 2562486 - RNA, 21 nt, Chlamydophila pneumoniae J138
auccaaaaaagagcccaaaaa

SEQ ID NO: 2562487 - RNA, 21 nt, Chlamydophila pneumoniae J138
auccaaaaaaugcuccugcaa

SEQ ID NO: 2562488 - RNA, 23 nt, Chlamydophila pneumoniae J138
auccaaaagcggcccagaucacc

SEQ ID NO: 2562489 - RNA, 18 nt, Chlamydophila pneumoniae J138
auccaaacgguuaaugaa

SEQ ID NO: 2562490 - RNA, 13 nt, Chlamydophila pneumoniae J138
auccaaagccuga

SEQ ID NO: 2562491 - RNA, 19 nt, Chlamydophila pneumoniae J138
auccaaagccugaaaaaua

SEQ ID NO: 2562492 - RNA, 19 nt, Chlamydophila pneumoniae J138
auccaaagcuauuucucua

SEQ ID NO: 2562493 - RNA, 22 nt, Chlamydophila pneumoniae J138
auccaaauugcaauuuucuaaa

SEQ ID NO: 2562494 - RNA, 14 nt, Chlamydophila pneumoniae J138
auccaagaauagcc

SEQ ID NO: 2562495 - RNA, 15 nt, Chlamydophila pneumoniae J138
auccaagaaugaauc

SEQ ID NO: 2562496 - RNA, 14 nt, Chlamydophila pneumoniae J138
auccaagauaccau

SEQ ID NO: 2562497 - RNA, 22 nt, Chlamydophila pneumoniae J138
auccaaguguucgaguucuuua

SEQ ID NO: 2562498 - RNA, 14 nt, Chlamydophila pneumoniae J138
auccaauagccaaa

SEQ ID NO: 2562499 - RNA, 16 nt, Chlamydophila pneumoniae J138
auccaaugacaauccg

SEQ ID NO: 2562500 - RNA, 21 nt, Chlamydophila pneumoniae J138
auccagauuagaaaagauaaa

SEQ ID NO: 2562501 - RNA, 20 nt, Chlamydophila pneumoniae J138
auccagauuguucaaaaaua

SEQ ID NO: 2562502 - RNA, 17 nt, Chlamydophila pneumoniae J138
auccagcaacaaccaaa

SEQ ID NO: 2562503 - RNA, 20 nt, Chlamydophila pneumoniae J138
auccagcaacaaccaaaaga

SEQ ID NO: 2562504 - RNA, 13 nt, Chlamydophila pneumoniae J138
auccagcucaagg

SEQ ID NO: 2562505 - RNA, 15 nt, Chlamydophila pneumoniae J138
auccagguuguccua

SEQ ID NO: 2562506 - RNA, 21 nt, Chlamydophila pneumoniae J138
auccaucggcauuucuccaca

SEQ ID NO: 2562507 - RNA, 15 nt, Chlamydophila pneumoniae J138
auccaugaacagcau

SEQ ID NO: 2562508 - RNA, 16 nt, Chlamydophila pneumoniae J138
auccaugacuugacac

SEQ ID NO: 2562509 - RNA, 22 nt, Chlamydophila pneumoniae J138
aucccagauuuuuuugguugcu

SEQ ID NO: 2562510 - RNA, 21 nt, Chlamydophila pneumoniae J138
aucccaucaaaggcaauagca

SEQ ID NO: 2562511 - RNA, 17 nt, Chlamydophila pneumoniae J138
auccccaccaacaaugc

SEQ ID NO: 2562512 - RNA, 17 nt, Chlamydophila pneumoniae J138
auccccguccuguacca

SEQ ID NO: 2562513 - RNA, 15 nt, Chlamydophila pneumoniae J138
auccccuucauucuu

SEQ ID NO: 2562514 - RNA, 19 nt, Chlamydophila pneumoniae J138
auccccuucauucuuucga

SEQ ID NO: 2562515 - RNA, 18 nt, Chlamydophila pneumoniae J138
aucccuguaguuucuaaa

SEQ ID NO: 2562516 - RNA, 21 nt, Chlamydophila pneumoniae J138
aucccuguaguuucuaaaaca

SEQ ID NO: 2562517 - RNA, 13 nt, Chlamydophila pneumoniae J138
aucccuucuucuu

SEQ ID NO: 2562518 - RNA, 12 nt, Chlamydophila pneumoniae J138
auccgaagacuc

SEQ ID NO: 2562519 - RNA, 17 nt, Chlamydophila pneumoniae J138
auccgaaucuauccaua

SEQ ID NO: 2562520 - RNA, 16 nt, Chlamydophila pneumoniae J138
auccgacuuuccucaa

SEQ ID NO: 2562521 - RNA, 22 nt, Chlamydophila pneumoniae J138
auccgacuuuccucaaagccga

SEQ ID NO: 2562522 - RNA, 14 nt, Chlamydophila pneumoniae J138
auccgauauacuua

SEQ ID NO: 2562523 - RNA, 18 nt, Chlamydophila pneumoniae J138
auccgcacuuacauuggc

SEQ ID NO: 2562524 - RNA, 21 nt, Chlamydophila pneumoniae J138
auccgucagccuuagcagcac

SEQ ID NO: 2562525 - RNA, 24 nt, Chlamydophila pneumoniae J138
auccgucagccuuagcagcaccca

SEQ ID NO: 2562526 - RNA, 12 nt, Chlamydophila pneumoniae J138
auccuaaaaagg

SEQ ID NO: 2562527 - RNA, 18 nt, Chlamydophila pneumoniae J138
auccuaagagauuuucca

SEQ ID NO: 2562528 - RNA, 15 nt, Chlamydophila pneumoniae J138
auccuaauuccuuca

SEQ ID NO: 2562529 - RNA, 22 nt, Chlamydophila pneumoniae J138
auccuagagaaugugcucggca

SEQ ID NO: 2562530 - RNA, 12 nt, Chlamydophila pneumoniae J138
auccucaaagag

SEQ ID NO: 2562531 - RNA, 23 nt, Chlamydophila pneumoniae J138
auccucaaagaguuuuuuagagg

SEQ ID NO: 2562532 - RNA, 18 nt, Chlamydophila pneumoniae J138
aucuauaggauuugcaua

SEQ ID NO: 2562533 - RNA, 20 nt, Chlamydophila pneumoniae J138
aucuauccuuaggugaaaua

SEQ ID NO: 2562534 - RNA, 22 nt, Chlamydophila pneumoniae J138
aucuauccuuaggugaaauauu

SEQ ID NO: 2562535 - RNA, 22 nt, Chlamydophila pneumoniae J138
aucuaucugcaauuccgaagaa

SEQ ID NO: 2562536 - RNA, 13 nt, Chlamydophila pneumoniae J138
aucucaaaaucaa

SEQ ID NO: 2562537 - RNA, 21 nt, Chlamydophila pneumoniae J138
aucucaagaguaggcaauaca

SEQ ID NO: 2562538 - RNA, 17 nt, Chlamydophila pneumoniae J138
aucucacaaaagucucu

SEQ ID NO: 2562539 - RNA, 22 nt, Chlamydophila pneumoniae J138
aucucacaaaagucucuaggga

SEQ ID NO: 2562540 - RNA, 10 nt, Chlamydophila pneumoniae J138
aucucaguag

SEQ ID NO: 2562541 - RNA, 21 nt, Chlamydophila pneumoniae J138
aucucaucacguaaggugucu

SEQ ID NO: 2562542 - RNA, 20 nt, Chlamydophila pneumoniae J138
aucucaugcggacuuuauuc

SEQ ID NO: 2562543 - RNA, 22 nt, Chlamydophila pneumoniae J138
aucucauuucguagacgcucua

SEQ ID NO: 2562544 - RNA, 15 nt, Chlamydophila pneumoniae J138
aucuccaaagaucau

SEQ ID NO: 2562545 - RNA, 19 nt, Chlamydophila pneumoniae J138
aucuccaagccaugcaaug

SEQ ID NO: 2562546 - RNA, 21 nt, Chlamydophila pneumoniae J138
aucuccaagccaugcaaugaa

SEQ ID NO: 2562547 - RNA, 18 nt, Chlamydophila pneumoniae J138
aucuccagaaauuuuuac

SEQ ID NO: 2562548 - RNA, 23 nt, Chlamydophila pneumoniae J138
aucuccagguagcagaguuuuuc

SEQ ID NO: 2562549 - RNA, 17 nt, Chlamydophila pneumoniae J138
aucucccaagacgagaa

SEQ ID NO: 2562550 - RNA, 20 nt, Chlamydophila pneumoniae J138
aucuccccauucacaaaucu

SEQ ID NO: 2562551 - RNA, 17 nt, Chlamydophila pneumoniae J138
aucuccggaacgcagag

SEQ ID NO: 2562552 - RNA, 15 nt, Chlamydophila pneumoniae J138
aucuccucaucagaa

SEQ ID NO: 2562553 - RNA, 15 nt, Chlamydophila pneumoniae J138
aucuccugaagccau

SEQ ID NO: 2562554 - RNA, 21 nt, Chlamydophila pneumoniae J138
aucuccugaagccaugacaaa

SEQ ID NO: 2562555 - RNA, 14 nt, Chlamydophila pneumoniae J138
aucuccuucaugca

SEQ ID NO: 2562556 - RNA, 17 nt, Chlamydophila pneumoniae J138
aucuccuuucaagagca

SEQ ID NO: 2562557 - RNA, 14 nt, Chlamydophila pneumoniae J138
aucucgcaguccuu

SEQ ID NO: 2562558 - RNA, 18 nt, Chlamydophila pneumoniae J138
aucucgcuauuccauaaa

SEQ ID NO: 2562559 - RNA, 15 nt, Chlamydophila pneumoniae J138
aucucgggagaacau

SEQ ID NO: 2562560 - RNA, 15 nt, Chlamydophila pneumoniae J138
aucucuaguucuaga

SEQ ID NO: 2562561 - RNA, 18 nt, Chlamydophila pneumoniae J138
aucucuaguucuagaaag

SEQ ID NO: 2562562 - RNA, 13 nt, Chlamydophila pneumoniae J138
aucucuccagcuu

SEQ ID NO: 2562563 - RNA, 19 nt, Chlamydophila pneumoniae J138
aucucucuuccugcugcuu

SEQ ID NO: 2562564 - RNA, 12 nt, Chlamydophila pneumoniae J138
aucucucuuuaa

SEQ ID NO: 2562565 - RNA, 17 nt, Chlamydophila pneumoniae J138
aucucugaccaucaaug

SEQ ID NO: 2562566 - RNA, 18 nt, Chlamydophila pneumoniae J138
aucucugacuugcaagcu

SEQ ID NO: 2562567 - RNA, 16 nt, Chlamydophila pneumoniae J138
aucucuggaauacauu

SEQ ID NO: 2562568 - RNA, 20 nt, Chlamydophila pneumoniae J138
aucucuggcauaauccugaa

SEQ ID NO: 2562569 - RNA, 15 nt, Chlamydophila pneumoniae J138
aucucuucuguagga

SEQ ID NO: 2562570 - RNA, 16 nt, Chlamydophila pneumoniae J138
aucucuugaagcacuu

SEQ ID NO: 2562571 - RNA, 13 nt, Chlamydophila pneumoniae J138
aucucuuuaacuu

SEQ ID NO: 2562572 - RNA, 18 nt, Chlamydophila pneumoniae J138
aucucuuucauaaauuca

SEQ ID NO: 2562573 - RNA, 16 nt, Chlamydophila pneumoniae J138
aucugaauuuuagcuc

SEQ ID NO: 2562574 - RNA, 19 nt, Chlamydophila pneumoniae J138
aucugagcauaacuugaag

SEQ ID NO: 2562575 - RNA, 13 nt, Chlamydophila pneumoniae J138
aucugaucucgua

SEQ ID NO: 2562576 - RNA, 22 nt, Chlamydophila pneumoniae J138
aucugaucuucagggacaucau

SEQ ID NO: 2562577 - RNA, 18 nt, Chlamydophila pneumoniae J138
aucugaugcaccauaaua

SEQ ID NO: 2562578 - RNA, 21 nt, Chlamydophila pneumoniae J138
aucugaugcaccauaauauaa

SEQ ID NO: 2562579 - RNA, 21 nt, Chlamydophila pneumoniae J138
aucugcagcguuucuagggac

SEQ ID NO: 2562580 - RNA, 19 nt, Chlamydophila pneumoniae J138
aucugcgacaaaaaugccu

SEQ ID NO: 2562581 - RNA, 14 nt, Chlamydophila pneumoniae J138
aucugcguuucuuu

SEQ ID NO: 2562582 - RNA, 19 nt, Chlamydophila pneumoniae J138
aucugcguuucuuucugau

SEQ ID NO: 2562583 - RNA, 12 nt, Chlamydophila pneumoniae J138
aucuggagaugc

SEQ ID NO: 2562584 - RNA, 18 nt, Chlamydophila pneumoniae J138
aucuggggcuuccagaaa

SEQ ID NO: 2562585 - RNA, 17 nt, Chlamydophila pneumoniae J138
aucuguaagaaaaugag

SEQ ID NO: 2562586 - RNA, 17 nt, Chlamydophila pneumoniae J138
aucuguaguaggcacuu

SEQ ID NO: 2562587 - RNA, 18 nt, Chlamydophila pneumoniae J138
aucuguaguaggcacuua

SEQ ID NO: 2562588 - RNA, 17 nt, Chlamydophila pneumoniae J138
aucuguauccuuccuua

SEQ ID NO: 2562589 - RNA, 23 nt, Chlamydophila pneumoniae J138
aucugucauuaaaaauuuaaaag

SEQ ID NO: 2562590 - RNA, 16 nt, Chlamydophila pneumoniae J138
aucuguggcguaagca

SEQ ID NO: 2562591 - RNA, 16 nt, Chlamydophila pneumoniae J138
aucuguugaucuucua

SEQ ID NO: 2562592 - RNA, 12 nt, Chlamydophila pneumoniae J138
aucuuacauaaa

SEQ ID NO: 2562593 - RNA, 17 nt, Chlamydophila pneumoniae J138
aucuuacauaaaccuuu

SEQ ID NO: 2562594 - RNA, 16 nt, Chlamydophila pneumoniae J138
aucuuauagacaggua

SEQ ID NO: 2562595 - RNA, 22 nt, Chlamydophila pneumoniae J138
aucuuaugccuuuguuuuaucu

SEQ ID NO: 2562596 - RNA, 15 nt, Chlamydophila pneumoniae J138
aucuucaagaccacu

SEQ ID NO: 2562597 - RNA, 23 nt, Chlamydophila pneumoniae J138
aucuucaccacaaaccucuaaaa

SEQ ID NO: 2562598 - RNA, 17 nt, Chlamydophila pneumoniae J138
aucuucacgacauacau

SEQ ID NO: 2562599 - RNA, 16 nt, Chlamydophila pneumoniae J138
aucuucagagagaaca

SEQ ID NO: 2562600 - RNA, 21 nt, Chlamydophila pneumoniae J138
aucuucagcauagagagaagg

SEQ ID NO: 2562601 - RNA, 16 nt, Chlamydophila pneumoniae J138
aucuucagggucuaag

SEQ ID NO: 2562602 - RNA, 23 nt, Chlamydophila pneumoniae J138
aucuucaucacaaaauucaugca

SEQ ID NO: 2562603 - RNA, 13 nt, Chlamydophila pneumoniae J138
aucuuccucuuuu

SEQ ID NO: 2562604 - RNA, 14 nt, Chlamydophila pneumoniae J138
aucuucgucccuag

SEQ ID NO: 2562605 - RNA, 14 nt, Chlamydophila pneumoniae J138
aucuucuaaaacac

SEQ ID NO: 2562606 - RNA, 17 nt, Chlamydophila pneumoniae J138
aucuucuaaaacuucag

SEQ ID NO: 2562607 - RNA, 17 nt, Chlamydophila pneumoniae J138
aucuucucuuaugaagu

SEQ ID NO: 2562608 - RNA, 15 nt, Chlamydophila pneumoniae J138
aucuucugaaaucaa

SEQ ID NO: 2562609 - RNA, 16 nt, Chlamydophila pneumoniae J138
aucuucugaaaucaaa

SEQ ID NO: 2562610 - RNA, 15 nt, Chlamydophila pneumoniae J138
aucuucuuagccaaa

SEQ ID NO: 2562611 - RNA, 19 nt, Chlamydophila pneumoniae J138
aucuucuuagccaaaauuu

SEQ ID NO: 2562612 - RNA, 21 nt, Chlamydophila pneumoniae J138
aucuucuuagccaaaauuucc

SEQ ID NO: 2562613 - RNA, 23 nt, Chlamydophila pneumoniae J138
aucuucuuucuaucgauagccau

SEQ ID NO: 2562614 - RNA, 13 nt, Chlamydophila pneumoniae J138
aucuugaaaagau

SEQ ID NO: 2562615 - RNA, 13 nt, Chlamydophila pneumoniae J138
aucuugaacagag

SEQ ID NO: 2562616 - RNA, 16 nt, Chlamydophila pneumoniae J138
aucuugagaaaagaac

SEQ ID NO: 2562617 - RNA, 22 nt, Chlamydophila pneumoniae J138
aucuugaugaccucuauaccua

SEQ ID NO: 2562618 - RNA, 14 nt, Chlamydophila pneumoniae J138
aucuugauuaggaa

SEQ ID NO: 2562619 - RNA, 23 nt, Chlamydophila pneumoniae J138
aucuugcugcccaaauugagaaa

SEQ ID NO: 2562620 - RNA, 19 nt, Chlamydophila pneumoniae J138
aucuuguaaguuacggaac

SEQ ID NO: 2562621 - RNA, 15 nt, Chlamydophila pneumoniae J138
aucuuguucuaaaau

SEQ ID NO: 2562622 - RNA, 23 nt, Chlamydophila pneumoniae J138
aucuuguucuaaaaugaaauacu

SEQ ID NO: 2562623 - RNA, 11 nt, Chlamydophila pneumoniae J138
aucuuguugua

SEQ ID NO: 2562624 - RNA, 17 nt, Chlamydophila pneumoniae J138
aucuuuaaauucgccaa

SEQ ID NO: 2562625 - RNA, 18 nt, Chlamydophila pneumoniae J138
aucuuuaaauucgccaaa

SEQ ID NO: 2562626 - RNA, 23 nt, Chlamydophila pneumoniae J138
aucuuuaaauucgccaaacgaau

SEQ ID NO: 2562627 - RNA, 16 nt, Chlamydophila pneumoniae J138
aucuuuaagauuuuua

SEQ ID NO: 2562628 - RNA, 17 nt, Chlamydophila pneumoniae J138
aucuuuaagauuuuuag

SEQ ID NO: 2562629 - RNA, 21 nt, Chlamydophila pneumoniae J138
aucuuuaagauuuuuagaaua

SEQ ID NO: 2562630 - RNA, 14 nt, Chlamydophila pneumoniae J138
aucuuuagaauaag

SEQ ID NO: 2562631 - RNA, 14 nt, Chlamydophila pneumoniae J138
aucuuuagaaucaa

SEQ ID NO: 2562632 - RNA, 17 nt, Chlamydophila pneumoniae J138
augcauuuguuuggaaa

SEQ ID NO: 2562633 - RNA, 16 nt, Chlamydophila pneumoniae J138
augccaguuccuaaag

SEQ ID NO: 2562634 - RNA, 18 nt, Chlamydophila pneumoniae J138
augccauaaauacaggcc

SEQ ID NO: 2562635 - RNA, 11 nt, Chlamydophila pneumoniae J138
augcccaaaca

SEQ ID NO: 2562636 - RNA, 12 nt, Chlamydophila pneumoniae J138
augcccuguucu

SEQ ID NO: 2562637 - RNA, 15 nt, Chlamydophila pneumoniae J138
augccgcaucuagaa

SEQ ID NO: 2562638 - RNA, 19 nt, Chlamydophila pneumoniae J138
augccucaggucugcugag

SEQ ID NO: 2562639 - RNA, 13 nt, Chlamydophila pneumoniae J138
augccucuuucau

SEQ ID NO: 2562640 - RNA, 19 nt, Chlamydophila pneumoniae J138
augccucuuucauacuaaa

SEQ ID NO: 2562641 - RNA, 22 nt, Chlamydophila pneumoniae J138
augccucuuucauacuaaaauc

SEQ ID NO: 2562642 - RNA, 14 nt, Chlamydophila pneumoniae J138
augccugaaaacaa

SEQ ID NO: 2562643 - RNA, 19 nt, Chlamydophila pneumoniae J138
augccugaaaacaaggcaa

SEQ ID NO: 2562644 - RNA, 21 nt, Chlamydophila pneumoniae J138
augccuggccaucaucaccag

SEQ ID NO: 2562645 - RNA, 17 nt, Chlamydophila pneumoniae J138
augccuuaaauguauug

SEQ ID NO: 2562646 - RNA, 17 nt, Chlamydophila pneumoniae J138
augccuuuggcaaucau

SEQ ID NO: 2562647 - RNA, 17 nt, Chlamydophila pneumoniae J138
augcgaagggaggagaa

SEQ ID NO: 2562648 - RNA, 19 nt, Chlamydophila pneumoniae J138
augcgcacggauucuaaaa

SEQ ID NO: 2562649 - RNA, 18 nt, Chlamydophila pneumoniae J138
augcgcagcucggaugga

SEQ ID NO: 2562650 - RNA, 12 nt, Chlamydophila pneumoniae J138
augcgcucuaag

SEQ ID NO: 2562651 - RNA, 16 nt, Chlamydophila pneumoniae J138
augcggaccuuaagau

SEQ ID NO: 2562652 - RNA, 14 nt, Chlamydophila pneumoniae J138
augcuaaagagucu

SEQ ID NO: 2562653 - RNA, 21 nt, Chlamydophila pneumoniae J138
augcuaaagagucuuccuaga

SEQ ID NO: 2562654 - RNA, 21 nt, Chlamydophila pneumoniae J138
augcuaaauuugucaucacau

SEQ ID NO: 2562655 - RNA, 16 nt, Chlamydophila pneumoniae J138
augcuaagcaucagaa

SEQ ID NO: 2562656 - RNA, 15 nt, Chlamydophila pneumoniae J138
augcuaauaaaaugc

SEQ ID NO: 2562657 - RNA, 15 nt, Chlamydophila pneumoniae J138
augcuacaaacucuu

SEQ ID NO: 2562658 - RNA, 22 nt, Chlamydophila pneumoniae J138
augcucauuaauaauaucuaac

SEQ ID NO: 2562659 - RNA, 20 nt, Chlamydophila pneumoniae J138
augcuccugcaaaaaaccag

SEQ ID NO: 2562660 - RNA, 13 nt, Chlamydophila pneumoniae J138
augcucuagaaaa

SEQ ID NO: 2562661 - RNA, 16 nt, Chlamydophila pneumoniae J138
augcugcacaguucac

SEQ ID NO: 2562662 - RNA, 13 nt, Chlamydophila pneumoniae J138
augcuuaucuauc

SEQ ID NO: 2562663 - RNA, 20 nt, Chlamydophila pneumoniae J138
augcuucaaggcaucuucuu

SEQ ID NO: 2562664 - RNA, 14 nt, Chlamydophila pneumoniae J138
augcuucuuucaaa

SEQ ID NO: 2562665 - RNA, 15 nt, Chlamydophila pneumoniae J138
augcuuggcaauagc

SEQ ID NO: 2562666 - RNA, 21 nt, Chlamydophila pneumoniae J138
augcuuucagugcugcuuucg

SEQ ID NO: 2562667 - RNA, 22 nt, Chlamydophila pneumoniae J138
auggaaagagucccugauucca

SEQ ID NO: 2562668 - RNA, 14 nt, Chlamydophila pneumoniae J138
auggaaauagagaa

SEQ ID NO: 2562669 - RNA, 16 nt, Chlamydophila pneumoniae J138
auggaaauagagaaac

SEQ ID NO: 2562670 - RNA, 16 nt, Chlamydophila pneumoniae J138
auggaagagagcaaga

SEQ ID NO: 2562671 - RNA, 13 nt, Chlamydophila pneumoniae J138
auggacaauauag

SEQ ID NO: 2562672 - RNA, 23 nt, Chlamydophila pneumoniae J138
auggacagcguauaggaaacugu

SEQ ID NO: 2562673 - RNA, 14 nt, Chlamydophila pneumoniae J138
auggagagcuuucg

SEQ ID NO: 2562674 - RNA, 20 nt, Chlamydophila pneumoniae J138
auggauccuucaucagcuuc

SEQ ID NO: 2562675 - RNA, 14 nt, Chlamydophila pneumoniae J138
auggaugcuaaauu

SEQ ID NO: 2562676 - RNA, 23 nt, Chlamydophila pneumoniae J138
auggaugucaccacgaacuucag

SEQ ID NO: 2562677 - RNA, 19 nt, Chlamydophila pneumoniae J138
auggauuaucuuagggaau

SEQ ID NO: 2562678 - RNA, 20 nt, Chlamydophila pneumoniae J138
auggauuucuccagcagcuu

SEQ ID NO: 2562679 - RNA, 15 nt, Chlamydophila pneumoniae J138
auggcacuugagcac

SEQ ID NO: 2562680 - RNA, 19 nt, Chlamydophila pneumoniae J138
auggcagccuggaaagcuu

SEQ ID NO: 2562681 - RNA, 21 nt, Chlamydophila pneumoniae J138
auggcagcuuggaugggaauc

SEQ ID NO: 2562682 - RNA, 20 nt, Chlamydophila pneumoniae J138
auggcauugggaaggaucug

SEQ ID NO: 2562683 - RNA, 15 nt, Chlamydophila pneumoniae J138
auggcccgauacaaa

SEQ ID NO: 2562684 - RNA, 16 nt, Chlamydophila pneumoniae J138
auggcgauaaaugcug

SEQ ID NO: 2562685 - RNA, 17 nt, Chlamydophila pneumoniae J138
auggcgauaaaugcuga

SEQ ID NO: 2562686 - RNA, 18 nt, Chlamydophila pneumoniae J138
auggcuacuuuaagaccu

SEQ ID NO: 2562687 - RNA, 16 nt, Chlamydophila pneumoniae J138
auggcucaacuuaagu

SEQ ID NO: 2562688 - RNA, 22 nt, Chlamydophila pneumoniae J138
auggcucugucacuagagaaaa

SEQ ID NO: 2562689 - RNA, 16 nt, Chlamydophila pneumoniae J138
auggcuggaaagccaa

SEQ ID NO: 2562690 - RNA, 11 nt, Chlamydophila pneumoniae J138
augggaauuug

SEQ ID NO: 2562691 - RNA, 16 nt, Chlamydophila pneumoniae J138
augggagaagcuaagg

SEQ ID NO: 2562692 - RNA, 18 nt, Chlamydophila pneumoniae J138
augggauccugcaaagcc

SEQ ID NO: 2562693 - RNA, 15 nt, Chlamydophila pneumoniae J138
augggaucggucuuu

SEQ ID NO: 2562694 - RNA, 19 nt, Chlamydophila pneumoniae J138
augggcuuugcuaacagaa

SEQ ID NO: 2562695 - RNA, 16 nt, Chlamydophila pneumoniae J138
augggguccauucuga

SEQ ID NO: 2562696 - RNA, 22 nt, Chlamydophila pneumoniae J138
augggugagauuauaaagauaa

SEQ ID NO: 2562697 - RNA, 14 nt, Chlamydophila pneumoniae J138
augguacaauacug

SEQ ID NO: 2562698 - RNA, 15 nt, Chlamydophila pneumoniae J138
augguacaauacugg

SEQ ID NO: 2562699 - RNA, 23 nt, Chlamydophila pneumoniae J138
augguauucccuaacaggaaaga

SEQ ID NO: 2562700 - RNA, 16 nt, Chlamydophila pneumoniae J138
auggucaggaagaaag

SEQ ID NO: 2562701 - RNA, 19 nt, Chlamydophila pneumoniae J138
auggucagucucgugcaua

SEQ ID NO: 2562702 - RNA, 18 nt, Chlamydophila pneumoniae J138
auggucucccucacaaga

SEQ ID NO: 2562703 - RNA, 22 nt, Chlamydophila pneumoniae J138
auggucucgaaauccuaaaaag

SEQ ID NO: 2562704 - RNA, 13 nt, Chlamydophila pneumoniae J138
auggucuuccccc

SEQ ID NO: 2562705 - RNA, 17 nt, Chlamydophila pneumoniae J138
auggugaagaauaauag

SEQ ID NO: 2562706 - RNA, 16 nt, Chlamydophila pneumoniae J138
auggugagauuucuaa

SEQ ID NO: 2562707 - RNA, 12 nt, Chlamydophila pneumoniae J138
augguugcuucu

SEQ ID NO: 2562708 - RNA, 18 nt, Chlamydophila pneumoniae J138
augguugcuucuaagaaa

SEQ ID NO: 2562709 - RNA, 17 nt, Chlamydophila pneumoniae J138
auguaaucccagauuuu

SEQ ID NO: 2562710 - RNA, 18 nt, Chlamydophila pneumoniae J138
auguaaucccagauuuuu

SEQ ID NO: 2562711 - RNA, 19 nt, Chlamydophila pneumoniae J138
auguaaucccagauuuuuu

SEQ ID NO: 2562712 - RNA, 12 nt, Chlamydophila pneumoniae J138
auguaauuuuuu

SEQ ID NO: 2562713 - RNA, 18 nt, Chlamydophila pneumoniae J138
auguacaagcuucaucaa

SEQ ID NO: 2562714 - RNA, 22 nt, Chlamydophila pneumoniae J138
auguagaaggggguucuaagaa

SEQ ID NO: 2562715 - RNA, 11 nt, Chlamydophila pneumoniae J138
auguagagucg

SEQ ID NO: 2562716 - RNA, 13 nt, Chlamydophila pneumoniae J138
auguagcagagcc

SEQ ID NO: 2562717 - RNA, 16 nt, Chlamydophila pneumoniae J138
auguaggaugugaagg

SEQ ID NO: 2562718 - RNA, 23 nt, Chlamydophila pneumoniae J138
auguagguaugacucguguggau

SEQ ID NO: 2562719 - RNA, 12 nt, Chlamydophila pneumoniae J138
auguaguaaauu

SEQ ID NO: 2562720 - RNA, 20 nt, Chlamydophila pneumoniae J138
auguaguaaauuccucuuga

SEQ ID NO: 2562721 - RNA, 15 nt, Chlamydophila pneumoniae J138
auguaguuagagaag

SEQ ID NO: 2562722 - RNA, 22 nt, Chlamydophila pneumoniae J138
auguaucggggauugcaaaauu

SEQ ID NO: 2562723 - RNA, 16 nt, Chlamydophila pneumoniae J138
auguauuguguucccu

SEQ ID NO: 2562724 - RNA, 22 nt, Chlamydophila pneumoniae J138
auguauuguguucccucuucuu

SEQ ID NO: 2562725 - RNA, 17 nt, Chlamydophila pneumoniae J138
auguccuccauggaaag

SEQ ID NO: 2562726 - RNA, 20 nt, Chlamydophila pneumoniae J138
auguccuccauggaaagaaa

SEQ ID NO: 2562727 - RNA, 17 nt, Chlamydophila pneumoniae J138
augucgcuaccauaucu

SEQ ID NO: 2562728 - RNA, 14 nt, Chlamydophila pneumoniae J138
augucgucucagaa

SEQ ID NO: 2562729 - RNA, 13 nt, Chlamydophila pneumoniae J138
augucuccauaca

SEQ ID NO: 2562730 - RNA, 19 nt, Chlamydophila pneumoniae J138
augucuucauaugcucucc

SEQ ID NO: 2562731 - RNA, 15 nt, Chlamydophila pneumoniae J138
augucuuugaauaua

SEQ ID NO: 2562732 - RNA, 19 nt, Chlamydophila pneumoniae J138
auucauuaagauccuuuaa

SEQ ID NO: 2562733 - RNA, 14 nt, Chlamydophila pneumoniae J138
auucauuuuuuaau

SEQ ID NO: 2562734 - RNA, 17 nt, Chlamydophila pneumoniae J138
auucauuuuuuaauaaa

SEQ ID NO: 2562735 - RNA, 17 nt, Chlamydophila pneumoniae J138
auuccaaaauaaaagga

SEQ ID NO: 2562736 - RNA, 14 nt, Chlamydophila pneumoniae J138
auuccaacagggau

SEQ ID NO: 2562737 - RNA, 16 nt, Chlamydophila pneumoniae J138
auuccaacuacauaau

SEQ ID NO: 2562738 - RNA, 23 nt, Chlamydophila pneumoniae J138
auuccaagaucuccgccuacaau

SEQ ID NO: 2562739 - RNA, 22 nt, Chlamydophila pneumoniae J138
auuccaagauugaauucaucca

SEQ ID NO: 2562740 - RNA, 14 nt, Chlamydophila pneumoniae J138
auuccaauuuuugc

SEQ ID NO: 2562741 - RNA, 15 nt, Chlamydophila pneumoniae J138
auuccagaaaaagaa

SEQ ID NO: 2562742 - RNA, 17 nt, Chlamydophila pneumoniae J138
auuccagaaaaagaaca

SEQ ID NO: 2562743 - RNA, 14 nt, Chlamydophila pneumoniae J138
auuccagcaucuuc

SEQ ID NO: 2562744 - RNA, 14 nt, Chlamydophila pneumoniae J138
auuccaggcucuag

SEQ ID NO: 2562745 - RNA, 22 nt, Chlamydophila pneumoniae J138
auuccauagguuagaaaugaaa

SEQ ID NO: 2562746 - RNA, 12 nt, Chlamydophila pneumoniae J138
auuccauccugu

SEQ ID NO: 2562747 - RNA, 12 nt, Chlamydophila pneumoniae J138
auuccauggaua

SEQ ID NO: 2562748 - RNA, 18 nt, Chlamydophila pneumoniae J138
auuccauuauacuuuuuu

SEQ ID NO: 2562749 - RNA, 20 nt, Chlamydophila pneumoniae J138
auucccaagaacuugagcac

SEQ ID NO: 2562750 - RNA, 19 nt, Chlamydophila pneumoniae J138
auuccccuuuaaagccugu

SEQ ID NO: 2562751 - RNA, 20 nt, Chlamydophila pneumoniae J138
auucccggaggcaaagauca

SEQ ID NO: 2562752 - RNA, 22 nt, Chlamydophila pneumoniae J138
auucccggaggcaaagaucagu

SEQ ID NO: 2562753 - RNA, 21 nt, Chlamydophila pneumoniae J138
auuccgaauugcgaauccuga

SEQ ID NO: 2562754 - RNA, 20 nt, Chlamydophila pneumoniae J138
auuccguacgcuauaaauaa

SEQ ID NO: 2562755 - RNA, 13 nt, Chlamydophila pneumoniae J138
auuccuaaaauuu

SEQ ID NO: 2562756 - RNA, 19 nt, Chlamydophila pneumoniae J138
auuccuaaguuagagacac

SEQ ID NO: 2562757 - RNA, 12 nt, Chlamydophila pneumoniae J138
auuccuacaucu

SEQ ID NO: 2562758 - RNA, 21 nt, Chlamydophila pneumoniae J138
auuccuagccaucgcgaagcu

SEQ ID NO: 2562759 - RNA, 14 nt, Chlamydophila pneumoniae J138
auuccuaugaucag

SEQ ID NO: 2562760 - RNA, 19 nt, Chlamydophila pneumoniae J138
auuccuaugaucagagaga

SEQ ID NO: 2562761 - RNA, 17 nt, Chlamydophila pneumoniae J138
auuccucucacauuugc

SEQ ID NO: 2562762 - RNA, 20 nt, Chlamydophila pneumoniae J138
auuccugaggcuauagaaua

SEQ ID NO: 2562763 - RNA, 13 nt, Chlamydophila pneumoniae J138
auuccugagguug

SEQ ID NO: 2562764 - RNA, 15 nt, Chlamydophila pneumoniae J138
auuccugucauuccu

SEQ ID NO: 2562765 - RNA, 17 nt, Chlamydophila pneumoniae J138
auuccuuaaugguagcu

SEQ ID NO: 2562766 - RNA, 18 nt, Chlamydophila pneumoniae J138
auuccuucauacguuuuu

SEQ ID NO: 2562767 - RNA, 23 nt, Chlamydophila pneumoniae J138
auuccuucauacguuuuuuuccu

SEQ ID NO: 2562768 - RNA, 15 nt, Chlamydophila pneumoniae J138
auuccuuggcauacu

SEQ ID NO: 2562769 - RNA, 21 nt, Chlamydophila pneumoniae J138
auucgaaaaacgguaaauauc

SEQ ID NO: 2562770 - RNA, 19 nt, Chlamydophila pneumoniae J138
auucgaauucucagaaagc

SEQ ID NO: 2562771 - RNA, 16 nt, Chlamydophila pneumoniae J138
auucgacucuccacga

SEQ ID NO: 2562772 - RNA, 17 nt, Chlamydophila pneumoniae J138
auucgauguuaaggcuu

SEQ ID NO: 2562773 - RNA, 19 nt, Chlamydophila pneumoniae J138
auucgauuccugaggcuau

SEQ ID NO: 2562774 - RNA, 16 nt, Chlamydophila pneumoniae J138
auucgcuauagccuug

SEQ ID NO: 2562775 - RNA, 12 nt, Chlamydophila pneumoniae J138
auucuaaaaaga

SEQ ID NO: 2562776 - RNA, 15 nt, Chlamydophila pneumoniae J138
auucuaaaaagaaaa

SEQ ID NO: 2562777 - RNA, 12 nt, Chlamydophila pneumoniae J138
auucuaaaucaa

SEQ ID NO: 2562778 - RNA, 22 nt, Chlamydophila pneumoniae J138
auucuaaaucaacuacacuuau

SEQ ID NO: 2562779 - RNA, 22 nt, Chlamydophila pneumoniae J138
auucuaacgcuuuuucaaacug

SEQ ID NO: 2562780 - RNA, 18 nt, Chlamydophila pneumoniae J138
auucuaagcgcucuucaa

SEQ ID NO: 2562781 - RNA, 17 nt, Chlamydophila pneumoniae J138
auucuagaccugccaag

SEQ ID NO: 2562782 - RNA, 20 nt, Chlamydophila pneumoniae J138
auucuagaguugcuuuaugg

SEQ ID NO: 2562783 - RNA, 18 nt, Chlamydophila pneumoniae J138
auucuaggccuaaagaau

SEQ ID NO: 2562784 - RNA, 16 nt, Chlamydophila pneumoniae J138
auucucaauucuguau

SEQ ID NO: 2562785 - RNA, 15 nt, Chlamydophila pneumoniae J138
auucucagauugcuu

SEQ ID NO: 2562786 - RNA, 13 nt, Chlamydophila pneumoniae J138
auucucagcuuca

SEQ ID NO: 2562787 - RNA, 18 nt, Chlamydophila pneumoniae J138
auucucaucggcauaacu

SEQ ID NO: 2562788 - RNA, 19 nt, Chlamydophila pneumoniae J138
auucucccaauauccagaa

SEQ ID NO: 2562789 - RNA, 17 nt, Chlamydophila pneumoniae J138
auucuccgccagaguuu

SEQ ID NO: 2562790 - RNA, 14 nt, Chlamydophila pneumoniae J138
auucucuucauuuu

SEQ ID NO: 2562791 - RNA, 19 nt, Chlamydophila pneumoniae J138
auucugaagauauauuuuu

SEQ ID NO: 2562792 - RNA, 14 nt, Chlamydophila pneumoniae J138
auucugaagcugca

SEQ ID NO: 2562793 - RNA, 21 nt, Chlamydophila pneumoniae J138
auucugaagcugcaaacugau

SEQ ID NO: 2562794 - RNA, 18 nt, Chlamydophila pneumoniae J138
auucugcaaggcaaugau

SEQ ID NO: 2562795 - RNA, 20 nt, Chlamydophila pneumoniae J138
auucugcccaaagcuaaaau

SEQ ID NO: 2562796 - RNA, 22 nt, Chlamydophila pneumoniae J138
auucugcuagagcuuucagaaa

SEQ ID NO: 2562797 - RNA, 18 nt, Chlamydophila pneumoniae J138
auucugcuuuaucucuau

SEQ ID NO: 2562798 - RNA, 14 nt, Chlamydophila pneumoniae J138
auucuguaauuuug

SEQ ID NO: 2562799 - RNA, 16 nt, Chlamydophila pneumoniae J138
auucuguauaaacaau

SEQ ID NO: 2562800 - RNA, 12 nt, Chlamydophila pneumoniae J138
auucuuaauaua

SEQ ID NO: 2562801 - RNA, 22 nt, Chlamydophila pneumoniae J138
auucuucacaaucuaaauaaga

SEQ ID NO: 2562802 - RNA, 22 nt, Chlamydophila pneumoniae J138
auucuucagaaucuuugugaua

SEQ ID NO: 2562803 - RNA, 17 nt, Chlamydophila pneumoniae J138
auucuucugucuguauu

SEQ ID NO: 2562804 - RNA, 21 nt, Chlamydophila pneumoniae J138
auucuugagaguccugggguu

SEQ ID NO: 2562805 - RNA, 23 nt, Chlamydophila pneumoniae J138
auucuugagaguccugggguucu

SEQ ID NO: 2562806 - RNA, 17 nt, Chlamydophila pneumoniae J138
auucuugcauagcggca

SEQ ID NO: 2562807 - RNA, 17 nt, Chlamydophila pneumoniae J138
auucuuguuggauugaa

SEQ ID NO: 2562808 - RNA, 14 nt, Chlamydophila pneumoniae J138
auucuuuauaaaua

SEQ ID NO: 2562809 - RNA, 21 nt, Chlamydophila pneumoniae J138
auucuuuaugagagagcucuu

SEQ ID NO: 2562810 - RNA, 14 nt, Chlamydophila pneumoniae J138
auucuuucgauauc

SEQ ID NO: 2562811 - RNA, 13 nt, Chlamydophila pneumoniae J138
auucuuuuccugc

SEQ ID NO: 2562812 - RNA, 14 nt, Chlamydophila pneumoniae J138
auucuuuuccugca

SEQ ID NO: 2562813 - RNA, 23 nt, Chlamydophila pneumoniae J138
auucuuuuguaaucuaagaaucu

SEQ ID NO: 2562814 - RNA, 20 nt, Chlamydophila pneumoniae J138
auucuuuuucuauuaaaaau

SEQ ID NO: 2562815 - RNA, 23 nt, Chlamydophila pneumoniae J138
auugaaacuuuuuuucuucucua

SEQ ID NO: 2562816 - RNA, 23 nt, Chlamydophila pneumoniae J138
auugaacagucuugcgccagcaa

SEQ ID NO: 2562817 - RNA, 20 nt, Chlamydophila pneumoniae J138
auugaacguagcuacaaaau

SEQ ID NO: 2562818 - RNA, 22 nt, Chlamydophila pneumoniae J138
auugaauaagcuuuccucucca

SEQ ID NO: 2562819 - RNA, 16 nt, Chlamydophila pneumoniae J138
auugaaucccaucaaa

SEQ ID NO: 2562820 - RNA, 21 nt, Chlamydophila pneumoniae J138
auugaaucccaucaaaggcaa

SEQ ID NO: 2562821 - RNA, 19 nt, Chlamydophila pneumoniae J138
auugacaacacgaucuaag

SEQ ID NO: 2562822 - RNA, 21 nt, Chlamydophila pneumoniae J138
auugacgacgacgucuucuua

SEQ ID NO: 2562823 - RNA, 19 nt, Chlamydophila pneumoniae J138
auugacuaucgcaaauuuc

SEQ ID NO: 2562824 - RNA, 15 nt, Chlamydophila pneumoniae J138
auugacugcuagagu

SEQ ID NO: 2562825 - RNA, 20 nt, Chlamydophila pneumoniae J138
auugaggauaaguucuucca

SEQ ID NO: 2562826 - RNA, 14 nt, Chlamydophila pneumoniae J138
auugaucuuuccuc

SEQ ID NO: 2562827 - RNA, 15 nt, Chlamydophila pneumoniae J138
auugauguuccuuga

SEQ ID NO: 2562828 - RNA, 19 nt, Chlamydophila pneumoniae J138
auugcaaaaaugaaagaaa

SEQ ID NO: 2562829 - RNA, 17 nt, Chlamydophila pneumoniae J138
auugcaaaguacuacaa

SEQ ID NO: 2562830 - RNA, 21 nt, Chlamydophila pneumoniae J138
auugcaaauuucauuuagaca

SEQ ID NO: 2562831 - RNA, 23 nt, Chlamydophila pneumoniae J138
auugcaauacaucuuaagagcaa

SEQ ID NO: 2562832 - RNA, 18 nt, Chlamydophila pneumoniae J138
auuuuagcuucuuuuuuu

SEQ ID NO: 2562833 - RNA, 21 nt, Chlamydophila pneumoniae J138
auuuuagggaugguuuccucu

SEQ ID NO: 2562834 - RNA, 13 nt, Chlamydophila pneumoniae J138
auuuuaguuuuca

SEQ ID NO: 2562835 - RNA, 20 nt, Chlamydophila pneumoniae J138
auuuucaggagaccagggau

SEQ ID NO: 2562836 - RNA, 16 nt, Chlamydophila pneumoniae J138
auuuucagucguuuag

SEQ ID NO: 2562837 - RNA, 19 nt, Chlamydophila pneumoniae J138
auuuucaugauauuuuuau

SEQ ID NO: 2562838 - RNA, 16 nt, Chlamydophila pneumoniae J138
auuuuccaggaccaaa

SEQ ID NO: 2562839 - RNA, 18 nt, Chlamydophila pneumoniae J138
auuuucccaauauccucu

SEQ ID NO: 2562840 - RNA, 15 nt, Chlamydophila pneumoniae J138
auuuucuaaagauuu

SEQ ID NO: 2562841 - RNA, 20 nt, Chlamydophila pneumoniae J138
auuuucuagaaacaacugaa

SEQ ID NO: 2562842 - RNA, 21 nt, Chlamydophila pneumoniae J138
auuuucuauucgcugucuaga

SEQ ID NO: 2562843 - RNA, 15 nt, Chlamydophila pneumoniae J138
auuuucucaauagug

SEQ ID NO: 2562844 - RNA, 15 nt, Chlamydophila pneumoniae J138
auuuucucauagcuu

SEQ ID NO: 2562845 - RNA, 21 nt, Chlamydophila pneumoniae J138
auuuucucauagcuuccugua

SEQ ID NO: 2562846 - RNA, 16 nt, Chlamydophila pneumoniae J138
auuuucucuacacaga

SEQ ID NO: 2562847 - RNA, 17 nt, Chlamydophila pneumoniae J138
auuuucucugagcagcu

SEQ ID NO: 2562848 - RNA, 20 nt, Chlamydophila pneumoniae J138
auuuucuggugccuguaauu

SEQ ID NO: 2562849 - RNA, 21 nt, Chlamydophila pneumoniae J138
auuuucuuaugaccaagaaca

SEQ ID NO: 2562850 - RNA, 17 nt, Chlamydophila pneumoniae J138
auuuucuugucucuugc

SEQ ID NO: 2562851 - RNA, 18 nt, Chlamydophila pneumoniae J138
auuuugacguaaugcaga

SEQ ID NO: 2562852 - RNA, 20 nt, Chlamydophila pneumoniae J138
auuuugacguaaugcagaua

SEQ ID NO: 2562853 - RNA, 18 nt, Chlamydophila pneumoniae J138
auuuugagacgaaagaga

SEQ ID NO: 2562854 - RNA, 20 nt, Chlamydophila pneumoniae J138
auuuugagacgaaagagauu

SEQ ID NO: 2562855 - RNA, 14 nt, Chlamydophila pneumoniae J138
auuuugaugcuucu

SEQ ID NO: 2562856 - RNA, 16 nt, Chlamydophila pneumoniae J138
auuuuggugagaucau

SEQ ID NO: 2562857 - RNA, 22 nt, Chlamydophila pneumoniae J138
auuuuggugagaucaucuccca

SEQ ID NO: 2562858 - RNA, 21 nt, Chlamydophila pneumoniae J138
auuuuguaggaacaugccaaa

SEQ ID NO: 2562859 - RNA, 12 nt, Chlamydophila pneumoniae J138
auuuuuaaauac

SEQ ID NO: 2562860 - RNA, 15 nt, Chlamydophila pneumoniae J138
auuuuuaaauacaga

SEQ ID NO: 2562861 - RNA, 15 nt, Chlamydophila pneumoniae J138
auuuuuaauuuuucu

SEQ ID NO: 2562862 - RNA, 20 nt, Chlamydophila pneumoniae J138
auuuuuaauuuuucuaagaa

SEQ ID NO: 2562863 - RNA, 12 nt, Chlamydophila pneumoniae J138
auuuuuagaaua

SEQ ID NO: 2562864 - RNA, 13 nt, Chlamydophila pneumoniae J138
auuuuuauuuccu

SEQ ID NO: 2562865 - RNA, 15 nt, Chlamydophila pneumoniae J138
auuuuucaagaacuc

SEQ ID NO: 2562866 - RNA, 17 nt, Chlamydophila pneumoniae J138
auuuuucaagaacuccu

SEQ ID NO: 2562867 - RNA, 18 nt, Chlamydophila pneumoniae J138
auuuuucaauaaccagaa

SEQ ID NO: 2562868 - RNA, 17 nt, Chlamydophila pneumoniae J138
auuuuuccuucaacaca

SEQ ID NO: 2562869 - RNA, 21 nt, Chlamydophila pneumoniae J138
auuuuucgagaauauacagau

SEQ ID NO: 2562870 - RNA, 18 nt, Chlamydophila pneumoniae J138
auuuuugcuaagagcucu

SEQ ID NO: 2562871 - RNA, 22 nt, Chlamydophila pneumoniae J138
auuuuugcuuuaaaauccagga

SEQ ID NO: 2562872 - RNA, 16 nt, Chlamydophila pneumoniae J138
auuuuugggaaaagaa

SEQ ID NO: 2562873 - RNA, 16 nt, Chlamydophila pneumoniae J138
auuuuuguagacaaua

SEQ ID NO: 2562874 - RNA, 23 nt, Chlamydophila pneumoniae J138
auuuuuuaaccgagcuuuuugcu

SEQ ID NO: 2562875 - RNA, 17 nt, Chlamydophila pneumoniae J138
auuuuuuaauaaaauuu

SEQ ID NO: 2562876 - RNA, 15 nt, Chlamydophila pneumoniae J138
auuuuuugagaaaua

SEQ ID NO: 2562877 - RNA, 21 nt, Chlamydophila pneumoniae J138
auuuuuugagaaauauaaaca

SEQ ID NO: 2562878 - RNA, 12 nt, Chlamydophila pneumoniae J138
caaaaaagagcc

SEQ ID NO: 2562879 - RNA, 19 nt, Chlamydophila pneumoniae J138
caaaaaagagcccaaaaac

SEQ ID NO: 2562880 - RNA, 17 nt, Chlamydophila pneumoniae J138
caaaaaagggaucuccu

SEQ ID NO: 2562881 - RNA, 15 nt, Chlamydophila pneumoniae J138
caaaaaauuuuauag

SEQ ID NO: 2562882 - RNA, 23 nt, Chlamydophila pneumoniae J138
caaaaaauuuuauaggaauaaca

SEQ ID NO: 2562883 - RNA, 19 nt, Chlamydophila pneumoniae J138
caaaaacacugcgcaaaga

SEQ ID NO: 2562884 - RNA, 19 nt, Chlamydophila pneumoniae J138
caaaaacgauucgaaaaac

SEQ ID NO: 2562885 - RNA, 20 nt, Chlamydophila pneumoniae J138
caaaaagcuucuuucuuacu

SEQ ID NO: 2562886 - RNA, 15 nt, Chlamydophila pneumoniae J138
caaaaaggacucuuu

SEQ ID NO: 2562887 - RNA, 21 nt, Chlamydophila pneumoniae J138
caaaaaggacucuuucuauag

SEQ ID NO: 2562888 - RNA, 18 nt, Chlamydophila pneumoniae J138
caaaaaguuccauagagu

SEQ ID NO: 2562889 - RNA, 15 nt, Chlamydophila pneumoniae J138
caaaaaguugaggaa

SEQ ID NO: 2562890 - RNA, 20 nt, Chlamydophila pneumoniae J138
caaaaaguugaggaaaggag

SEQ ID NO: 2562891 - RNA, 16 nt, Chlamydophila pneumoniae J138
caaaaaguuucaaucu

SEQ ID NO: 2562892 - RNA, 21 nt, Chlamydophila pneumoniae J138
caaaaauaaacauauucuccu

SEQ ID NO: 2562893 - RNA, 17 nt, Chlamydophila pneumoniae J138
caaaaauucuucgugag

SEQ ID NO: 2562894 - RNA, 20 nt, Chlamydophila pneumoniae J138
caaaacagcaucaggauucu

SEQ ID NO: 2562895 - RNA, 12 nt, Chlamydophila pneumoniae J138
caaaacaggaau

SEQ ID NO: 2562896 - RNA, 16 nt, Chlamydophila pneumoniae J138
caaaacauaaccuccu

SEQ ID NO: 2562897 - RNA, 21 nt, Chlamydophila pneumoniae J138
caaaacgauccuguuccccug

SEQ ID NO: 2562898 - RNA, 20 nt, Chlamydophila pneumoniae J138
caaaacucaaggaguuuuaa

SEQ ID NO: 2562899 - RNA, 15 nt, Chlamydophila pneumoniae J138
caaaagaauuaagaa

SEQ ID NO: 2562900 - RNA, 23 nt, Chlamydophila pneumoniae J138
caaaagaauuccuaaaacgagca

SEQ ID NO: 2562901 - RNA, 13 nt, Chlamydophila pneumoniae J138
caaaagaccaaaa

SEQ ID NO: 2562902 - RNA, 17 nt, Chlamydophila pneumoniae J138
caaaagaucauaugcac

SEQ ID NO: 2562903 - RNA, 17 nt, Chlamydophila pneumoniae J138
caaaagccauuccauau

SEQ ID NO: 2562904 - RNA, 18 nt, Chlamydophila pneumoniae J138
caaaagcucuacaagcuc

SEQ ID NO: 2562905 - RNA, 17 nt, Chlamydophila pneumoniae J138
caaaaggcccaacucuu

SEQ ID NO: 2562906 - RNA, 18 nt, Chlamydophila pneumoniae J138
caaaaggcccaacucuug

SEQ ID NO: 2562907 - RNA, 12 nt, Chlamydophila pneumoniae J138
caaaauaaaaaa

SEQ ID NO: 2562908 - RNA, 17 nt, Chlamydophila pneumoniae J138
caaaauaaaaaaacccu

SEQ ID NO: 2562909 - RNA, 13 nt, Chlamydophila pneumoniae J138
caaaauaaaagga

SEQ ID NO: 2562910 - RNA, 15 nt, Chlamydophila pneumoniae J138
caaaauaaaaggagc

SEQ ID NO: 2562911 - RNA, 15 nt, Chlamydophila pneumoniae J138
caaaauauucuuuca

SEQ ID NO: 2562912 - RNA, 21 nt, Chlamydophila pneumoniae J138
caaaauccacauccuuguaga

SEQ ID NO: 2562913 - RNA, 14 nt, Chlamydophila pneumoniae J138
caaaaugcauuugc

SEQ ID NO: 2562914 - RNA, 18 nt, Chlamydophila pneumoniae J138
caaaaugggauccugcaa

SEQ ID NO: 2562915 - RNA, 14 nt, Chlamydophila pneumoniae J138
caaaauguuuaucg

SEQ ID NO: 2562916 - RNA, 22 nt, Chlamydophila pneumoniae J138
caaaauguuuaucgacucuucc

SEQ ID NO: 2562917 - RNA, 19 nt, Chlamydophila pneumoniae J138
caaaauucaugcaaaacaa

SEQ ID NO: 2562918 - RNA, 13 nt, Chlamydophila pneumoniae J138
caaacaagaagcg

SEQ ID NO: 2562919 - RNA, 16 nt, Chlamydophila pneumoniae J138
caaacagauuuuucaa

SEQ ID NO: 2562920 - RNA, 21 nt, Chlamydophila pneumoniae J138
caaacagauuuuucaagaacu

SEQ ID NO: 2562921 - RNA, 15 nt, Chlamydophila pneumoniae J138
caaacaucaaagaga

SEQ ID NO: 2562922 - RNA, 19 nt, Chlamydophila pneumoniae J138
caaacauuaccguucccua

SEQ ID NO: 2562923 - RNA, 12 nt, Chlamydophila pneumoniae J138
caaacauuuuua

SEQ ID NO: 2562924 - RNA, 16 nt, Chlamydophila pneumoniae J138
caaacauuuuuaagga

SEQ ID NO: 2562925 - RNA, 15 nt, Chlamydophila pneumoniae J138
caaaccacggauuuu

SEQ ID NO: 2562926 - RNA, 20 nt, Chlamydophila pneumoniae J138
caaaccacggauuuucucua

SEQ ID NO: 2562927 - RNA, 21 nt, Chlamydophila pneumoniae J138
caaaccacggauuuucucuac

SEQ ID NO: 2562928 - RNA, 23 nt, Chlamydophila pneumoniae J138
caaaccaucugcguuuaaggguu

SEQ ID NO: 2562929 - RNA, 16 nt, Chlamydophila pneumoniae J138
caaacccucuccagaa

SEQ ID NO: 2562930 - RNA, 20 nt, Chlamydophila pneumoniae J138
caaacccucuccagaagucg

SEQ ID NO: 2562931 - RNA, 19 nt, Chlamydophila pneumoniae J138
caaacccugggcucacucu

SEQ ID NO: 2562932 - RNA, 23 nt, Chlamydophila pneumoniae J138
acuuucugagccccuugcaaaag

SEQ ID NO: 2562933 - RNA, 12 nt, Chlamydophila pneumoniae J138
acuuucuucucu

SEQ ID NO: 2562934 - RNA, 15 nt, Chlamydophila pneumoniae J138
acuuucuucucuagg

SEQ ID NO: 2562935 - RNA, 16 nt, Chlamydophila pneumoniae J138
acuuugccaacagcug

SEQ ID NO: 2562936 - RNA, 15 nt, Chlamydophila pneumoniae J138
acuuugugauuacag

SEQ ID NO: 2562937 - RNA, 15 nt, Chlamydophila pneumoniae J138
acuuuuacugaaauu

SEQ ID NO: 2562938 - RNA, 21 nt, Chlamydophila pneumoniae J138
acuuuugaagauccugaguau

SEQ ID NO: 2562939 - RNA, 15 nt, Chlamydophila pneumoniae J138
acuuuuguacacaga

SEQ ID NO: 2562940 - RNA, 18 nt, Chlamydophila pneumoniae J138
acuuuuguacacagagau

SEQ ID NO: 2562941 - RNA, 20 nt, Chlamydophila pneumoniae J138
acuuuuugccacaacucauc

SEQ ID NO: 2562942 - RNA, 13 nt, Chlamydophila pneumoniae J138
acuuuuuucccuc

SEQ ID NO: 2562943 - RNA, 21 nt, Chlamydophila pneumoniae J138
acuuuuuucccuccaccagaa

SEQ ID NO: 2562944 - RNA, 16 nt, Chlamydophila pneumoniae J138
acuuuuuuucuucucu

SEQ ID NO: 2562945 - RNA, 18 nt, Chlamydophila pneumoniae J138
acuuuuuuucuucucuaa

SEQ ID NO: 2562946 - RNA, 22 nt, Chlamydophila pneumoniae J138
acuuuuuuucuucucuaagaaa

SEQ ID NO: 2562947 - RNA, 19 nt, Chlamydophila pneumoniae J138
agaaaaaccccuagaacuu

SEQ ID NO: 2562948 - RNA, 14 nt, Chlamydophila pneumoniae J138
agaaaaagaaucuc

SEQ ID NO: 2562949 - RNA, 13 nt, Chlamydophila pneumoniae J138
agaaaaaucuaac

SEQ ID NO: 2562950 - RNA, 20 nt, Chlamydophila pneumoniae J138
agaaaaaucuaacacagucc

SEQ ID NO: 2562951 - RNA, 14 nt, Chlamydophila pneumoniae J138
agaaaacaaaguca

SEQ ID NO: 2562952 - RNA, 13 nt, Chlamydophila pneumoniae J138
agaaaacauagag

SEQ ID NO: 2562953 - RNA, 21 nt, Chlamydophila pneumoniae J138
agaaaacauagagauucuaca

SEQ ID NO: 2562954 - RNA, 17 nt, Chlamydophila pneumoniae J138
agaaaagaaaaguguga

SEQ ID NO: 2562955 - RNA, 18 nt, Chlamydophila pneumoniae J138
agaaaagaaaagugugag

SEQ ID NO: 2562956 - RNA, 16 nt, Chlamydophila pneumoniae J138
agaaaagaacagggga

SEQ ID NO: 2562957 - RNA, 13 nt, Chlamydophila pneumoniae J138
agaaaagauaaaa

SEQ ID NO: 2562958 - RNA, 15 nt, Chlamydophila pneumoniae J138
agaaaagauaaaaca

SEQ ID NO: 2562959 - RNA, 15 nt, Chlamydophila pneumoniae J138
agaaaauaaagaucu

SEQ ID NO: 2562960 - RNA, 19 nt, Chlamydophila pneumoniae J138
agaaaauaaagaucuucau

SEQ ID NO: 2562961 - RNA, 14 nt, Chlamydophila pneumoniae J138
agaaaauaucacau

SEQ ID NO: 2562962 - RNA, 19 nt, Chlamydophila pneumoniae J138
agaaaaucaacucuccauc

SEQ ID NO: 2562963 - RNA, 22 nt, Chlamydophila pneumoniae J138
agaaaaucucuaagaaucuaua

SEQ ID NO: 2562964 - RNA, 23 nt, Chlamydophila pneumoniae J138
agaaaaucucuaagaaucuauag

SEQ ID NO: 2562965 - RNA, 20 nt, Chlamydophila pneumoniae J138
agaaaauucucagauugcuu

SEQ ID NO: 2562966 - RNA, 14 nt, Chlamydophila pneumoniae J138
agaaacaacugaaa

SEQ ID NO: 2562967 - RNA, 12 nt, Chlamydophila pneumoniae J138
agaaacaucgga

SEQ ID NO: 2562968 - RNA, 21 nt, Chlamydophila pneumoniae J138
agaaacccgcaacucuuuagg

SEQ ID NO: 2562969 - RNA, 15 nt, Chlamydophila pneumoniae J138
agaaacgcagcuuuc

SEQ ID NO: 2562970 - RNA, 17 nt, Chlamydophila pneumoniae J138
agaaacuaguucuucuu

SEQ ID NO: 2562971 - RNA, 15 nt, Chlamydophila pneumoniae J138
agaaacuccaaaaua

SEQ ID NO: 2562972 - RNA, 19 nt, Chlamydophila pneumoniae J138
agaaacugcuccugaagcu

SEQ ID NO: 2562973 - RNA, 18 nt, Chlamydophila pneumoniae J138
agaaacuuaguuuugaaa

SEQ ID NO: 2562974 - RNA, 13 nt, Chlamydophila pneumoniae J138
agaaacuucucua

SEQ ID NO: 2562975 - RNA, 23 nt, Chlamydophila pneumoniae J138
agaaacuucugacccuguagcga

SEQ ID NO: 2562976 - RNA, 11 nt, Chlamydophila pneumoniae J138
agaaagaagcc

SEQ ID NO: 2562977 - RNA, 20 nt, Chlamydophila pneumoniae J138
agaaagaaguccuagggagu

SEQ ID NO: 2562978 - RNA, 22 nt, Chlamydophila pneumoniae J138
agaaagaaugacacagagaaca

SEQ ID NO: 2562979 - RNA, 22 nt, Chlamydophila pneumoniae J138
agaaagaauuguaguucuuuga

SEQ ID NO: 2562980 - RNA, 15 nt, Chlamydophila pneumoniae J138
agaaagacaaaaaau

SEQ ID NO: 2562981 - RNA, 14 nt, Chlamydophila pneumoniae J138
agaaagacauccuu

SEQ ID NO: 2562982 - RNA, 20 nt, Chlamydophila pneumoniae J138
agaaagagcuaaagaaacuu

SEQ ID NO: 2562983 - RNA, 21 nt, Chlamydophila pneumoniae J138
agaaagagucucacucuuuuc

SEQ ID NO: 2562984 - RNA, 23 nt, Chlamydophila pneumoniae J138
agaaagagucucacucuuuucua

SEQ ID NO: 2562985 - RNA, 11 nt, Chlamydophila pneumoniae J138
agaaagauauc

SEQ ID NO: 2562986 - RNA, 19 nt, Chlamydophila pneumoniae J138
agaaagauaucccaaagcu

SEQ ID NO: 2562987 - RNA, 22 nt, Chlamydophila pneumoniae J138
agaaagauucugcccaaagcua

SEQ ID NO: 2562988 - RNA, 20 nt, Chlamydophila pneumoniae J138
agaaagauuuauuuugucuu

SEQ ID NO: 2562989 - RNA, 23 nt, Chlamydophila pneumoniae J138
agaaagccuuugcucacuguuuu

SEQ ID NO: 2562990 - RNA, 20 nt, Chlamydophila pneumoniae J138
agaaaggagauccacagacu

SEQ ID NO: 2562991 - RNA, 18 nt, Chlamydophila pneumoniae J138
agaaaggauuggaugaga

SEQ ID NO: 2562992 - RNA, 22 nt, Chlamydophila pneumoniae J138
agaaaggcuuuucuuuuucuag

SEQ ID NO: 2562993 - RNA, 19 nt, Chlamydophila pneumoniae J138
agaaaggcuuuuuccaaaa

SEQ ID NO: 2562994 - RNA, 18 nt, Chlamydophila pneumoniae J138
agaaaguauuccucuuag

SEQ ID NO: 2562995 - RNA, 17 nt, Chlamydophila pneumoniae J138
agaaauacgcuuuucuu

SEQ ID NO: 2562996 - RNA, 21 nt, Chlamydophila pneumoniae J138
agaaauacgcuuuucuucuuu

SEQ ID NO: 2562997 - RNA, 16 nt, Chlamydophila pneumoniae J138
agaaauauacugccag

SEQ ID NO: 2562998 - RNA, 19 nt, Chlamydophila pneumoniae J138
agaaaucugcauuccagga

SEQ ID NO: 2562999 - RNA, 18 nt, Chlamydophila pneumoniae J138
agaaaugaaacgaaagca

SEQ ID NO: 2563000 - RNA, 15 nt, Chlamydophila pneumoniae J138
agaaaugaagccaaa

SEQ ID NO: 2563001 - RNA, 13 nt, Chlamydophila pneumoniae J138
agaaaugcucuuc

SEQ ID NO: 2563002 - RNA, 16 nt, Chlamydophila pneumoniae J138
agaaauguugauaggu

SEQ ID NO: 2563003 - RNA, 16 nt, Chlamydophila pneumoniae J138
agaaauuaacagagcg

SEQ ID NO: 2563004 - RNA, 21 nt, Chlamydophila pneumoniae J138
agaaauuagaguaugaggaga

SEQ ID NO: 2563005 - RNA, 17 nt, Chlamydophila pneumoniae J138
agaaauucaugccuuug

SEQ ID NO: 2563006 - RNA, 14 nt, Chlamydophila pneumoniae J138
agaaauuccaauuu

SEQ ID NO: 2563007 - RNA, 19 nt, Chlamydophila pneumoniae J138
agaaauuccaauuuuugca

SEQ ID NO: 2563008 - RNA, 21 nt, Chlamydophila pneumoniae J138
agaaauuccaauuuuugcaua

SEQ ID NO: 2563009 - RNA, 12 nt, Chlamydophila pneumoniae J138
agaaauuccuaa

SEQ ID NO: 2563010 - RNA, 14 nt, Chlamydophila pneumoniae J138
agaaauucuaagag

SEQ ID NO: 2563011 - RNA, 19 nt, Chlamydophila pneumoniae J138
agaaauucuguagauacua

SEQ ID NO: 2563012 - RNA, 21 nt, Chlamydophila pneumoniae J138
agaaauuuuuaauuuuucuaa

SEQ ID NO: 2563013 - RNA, 17 nt, Chlamydophila pneumoniae J138
agaacaaaaaaucaauc

SEQ ID NO: 2563014 - RNA, 22 nt, Chlamydophila pneumoniae J138
agaacaaguuuuuucaauccuu

SEQ ID NO: 2563015 - RNA, 20 nt, Chlamydophila pneumoniae J138
agaauuaagaagaagcugac

SEQ ID NO: 2563016 - RNA, 15 nt, Chlamydophila pneumoniae J138
agaauucagagaaag

SEQ ID NO: 2563017 - RNA, 16 nt, Chlamydophila pneumoniae J138
agaauuccuaaaacga

SEQ ID NO: 2563018 - RNA, 16 nt, Chlamydophila pneumoniae J138
agaauugcaaaguacu

SEQ ID NO: 2563019 - RNA, 16 nt, Chlamydophila pneumoniae J138
agaauuucgucuucau

SEQ ID NO: 2563020 - RNA, 13 nt, Chlamydophila pneumoniae J138
agaauuuguccuu

SEQ ID NO: 2563021 - RNA, 14 nt, Chlamydophila pneumoniae J138
agaauuuguccuuu

SEQ ID NO: 2563022 - RNA, 21 nt, Chlamydophila pneumoniae J138
agaauuuucaugauauuuuua

SEQ ID NO: 2563023 - RNA, 20 nt, Chlamydophila pneumoniae J138
agaauuuucuuuugcagcaa

SEQ ID NO: 2563024 - RNA, 22 nt, Chlamydophila pneumoniae J138
agacaaaaaagggaucuccuuc

SEQ ID NO: 2563025 - RNA, 13 nt, Chlamydophila pneumoniae J138
agacaaaguuguu

SEQ ID NO: 2563026 - RNA, 18 nt, Chlamydophila pneumoniae J138
agacaaccuagaaucaca

SEQ ID NO: 2563027 - RNA, 19 nt, Chlamydophila pneumoniae J138
agacaaccuagaaucacau

SEQ ID NO: 2563028 - RNA, 21 nt, Chlamydophila pneumoniae J138
agacaacuauguuauccauac

SEQ ID NO: 2563029 - RNA, 13 nt, Chlamydophila pneumoniae J138
agacaagaaaaua

SEQ ID NO: 2563030 - RNA, 13 nt, Chlamydophila pneumoniae J138
agacaagagaaga

SEQ ID NO: 2563031 - RNA, 15 nt, Chlamydophila pneumoniae J138
agacaagagagagcu

SEQ ID NO: 2563032 - RNA, 16 nt, Chlamydophila pneumoniae J138
agacaagagagagcug

SEQ ID NO: 2563033 - RNA, 23 nt, Chlamydophila pneumoniae J138
agacaaguaaacagcaaaguaau

SEQ ID NO: 2563034 - RNA, 16 nt, Chlamydophila pneumoniae J138
agacaaguucaucaaa

SEQ ID NO: 2563035 - RNA, 17 nt, Chlamydophila pneumoniae J138
agacaaguucaucaaau

SEQ ID NO: 2563036 - RNA, 17 nt, Chlamydophila pneumoniae J138
agacaauaaaauagccc

SEQ ID NO: 2563037 - RNA, 17 nt, Chlamydophila pneumoniae J138
agacaaugacuguagga

SEQ ID NO: 2563038 - RNA, 21 nt, Chlamydophila pneumoniae J138
agacaaugcgccuuguuuaga

SEQ ID NO: 2563039 - RNA, 23 nt, Chlamydophila pneumoniae J138
agacaaugucgucucagaaaaau

SEQ ID NO: 2563040 - RNA, 19 nt, Chlamydophila pneumoniae J138
agacacaaaaagcuuuuuu

SEQ ID NO: 2563041 - RNA, 16 nt, Chlamydophila pneumoniae J138
agacacgccuccuuca

SEQ ID NO: 2563042 - RNA, 22 nt, Chlamydophila pneumoniae J138
agacacgccuccuucaaagaua

SEQ ID NO: 2563043 - RNA, 23 nt, Chlamydophila pneumoniae J138
agacacgccuccuucaaagauau

SEQ ID NO: 2563044 - RNA, 22 nt, Chlamydophila pneumoniae J138
agacagaugcuucaaggcaucu

SEQ ID NO: 2563045 - RNA, 20 nt, Chlamydophila pneumoniae J138
agacagccuguuuucuucua

SEQ ID NO: 2563046 - RNA, 19 nt, Chlamydophila pneumoniae J138
agacauauccaaugagaga

SEQ ID NO: 2563047 - RNA, 17 nt, Chlamydophila pneumoniae J138
agacaugcgaagggagg

SEQ ID NO: 2563048 - RNA, 12 nt, Chlamydophila pneumoniae J138
agacauuccaca

SEQ ID NO: 2563049 - RNA, 23 nt, Chlamydophila pneumoniae J138
agacauucccuaaagcugccagu

SEQ ID NO: 2563050 - RNA, 20 nt, Chlamydophila pneumoniae J138
agaccaaacuuucuuuucua

SEQ ID NO: 2563051 - RNA, 14 nt, Chlamydophila pneumoniae J138
agaccacgaaaugu

SEQ ID NO: 2563052 - RNA, 19 nt, Chlamydophila pneumoniae J138
agaccacgaaauguuaaag

SEQ ID NO: 2563053 - RNA, 13 nt, Chlamydophila pneumoniae J138
agaccagggaucu

SEQ ID NO: 2563054 - RNA, 23 nt, Chlamydophila pneumoniae J138
agaccauaaaaucaacaaguucu

SEQ ID NO: 2563055 - RNA, 14 nt, Chlamydophila pneumoniae J138
agaccauacacaaa

SEQ ID NO: 2563056 - RNA, 20 nt, Chlamydophila pneumoniae J138
agaccaugaccuuuagcugc

SEQ ID NO: 2563057 - RNA, 21 nt, Chlamydophila pneumoniae J138
agacccuccguggcggauaau

SEQ ID NO: 2563058 - RNA, 19 nt, Chlamydophila pneumoniae J138
agacccuucuuuccauaaa

SEQ ID NO: 2563059 - RNA, 22 nt, Chlamydophila pneumoniae J138
agaccguugccagcuugcccuu

SEQ ID NO: 2563060 - RNA, 14 nt, Chlamydophila pneumoniae J138
agaccuaaaaaggu

SEQ ID NO: 2563061 - RNA, 23 nt, Chlamydophila pneumoniae J138
agacgcuagguugcaugcuugaa

SEQ ID NO: 2563062 - RNA, 19 nt, Chlamydophila pneumoniae J138
agacguaggugccugaaga

SEQ ID NO: 2563063 - RNA, 22 nt, Chlamydophila pneumoniae J138
agacgugcucucuucuucucag

SEQ ID NO: 2563064 - RNA, 22 nt, Chlamydophila pneumoniae J138
agacguuaucuaagacuucugg

SEQ ID NO: 2563065 - RNA, 14 nt, Chlamydophila pneumoniae J138
agacuaaaaaagag

SEQ ID NO: 2563066 - RNA, 15 nt, Chlamydophila pneumoniae J138
agacuaaaaaagaga

SEQ ID NO: 2563067 - RNA, 20 nt, Chlamydophila pneumoniae J138
agacuaaaugacgaguugaa

SEQ ID NO: 2563068 - RNA, 18 nt, Chlamydophila pneumoniae J138
agacuagagucacuagca

SEQ ID NO: 2563069 - RNA, 16 nt, Chlamydophila pneumoniae J138
agacuauagaaaagga

SEQ ID NO: 2563070 - RNA, 21 nt, Chlamydophila pneumoniae J138
agacucacauuugcuuuaaca

SEQ ID NO: 2563071 - RNA, 14 nt, Chlamydophila pneumoniae J138
agacucagagaaaa

SEQ ID NO: 2563072 - RNA, 18 nt, Chlamydophila pneumoniae J138
agacucagagaaaaucaa

SEQ ID NO: 2563073 - RNA, 19 nt, Chlamydophila pneumoniae J138
agacucaugaaauaguguu

SEQ ID NO: 2563074 - RNA, 23 nt, Chlamydophila pneumoniae J138
agacucucacugagugucccaug

SEQ ID NO: 2563075 - RNA, 13 nt, Chlamydophila pneumoniae J138
agacucucaucag

SEQ ID NO: 2563076 - RNA, 14 nt, Chlamydophila pneumoniae J138
agacucucaucagc

SEQ ID NO: 2563077 - RNA, 15 nt, Chlamydophila pneumoniae J138
agacucucaucagca

SEQ ID NO: 2563078 - RNA, 16 nt, Chlamydophila pneumoniae J138
agacucucuuccaaaa

SEQ ID NO: 2563079 - RNA, 19 nt, Chlamydophila pneumoniae J138
agacucucuuccaaaagua

SEQ ID NO: 2563080 - RNA, 13 nt, Chlamydophila pneumoniae J138
agacugaaaagau

SEQ ID NO: 2563081 - RNA, 23 nt, Chlamydophila pneumoniae J138
agacuggucuaacuuagagcgaa

SEQ ID NO: 2563082 - RNA, 22 nt, Chlamydophila pneumoniae J138
agacuguguuuuauccaccaag

SEQ ID NO: 2563083 - RNA, 19 nt, Chlamydophila pneumoniae J138
agacuuccucuucaauuuc

SEQ ID NO: 2563084 - RNA, 20 nt, Chlamydophila pneumoniae J138
agacuucgaugucuuuccag

SEQ ID NO: 2563085 - RNA, 22 nt, Chlamydophila pneumoniae J138
agacuugaucuacaaaaacuag

SEQ ID NO: 2563086 - RNA, 14 nt, Chlamydophila pneumoniae J138
agacuuguauucuu

SEQ ID NO: 2563087 - RNA, 18 nt, Chlamydophila pneumoniae J138
agacuuguauucuugaga

SEQ ID NO: 2563088 - RNA, 17 nt, Chlamydophila pneumoniae J138
agacuuguucagcuaga

SEQ ID NO: 2563089 - RNA, 23 nt, Chlamydophila pneumoniae J138
agacuuguucagcuagagcacau

SEQ ID NO: 2563090 - RNA, 13 nt, Chlamydophila pneumoniae J138
agacuuuccucuc

SEQ ID NO: 2563091 - RNA, 17 nt, Chlamydophila pneumoniae J138
agacuuuccucucuuua

SEQ ID NO: 2563092 - RNA, 19 nt, Chlamydophila pneumoniae J138
agagaaaauaucacauucc

SEQ ID NO: 2563093 - RNA, 11 nt, Chlamydophila pneumoniae J138
agagaaaauca

SEQ ID NO: 2563094 - RNA, 15 nt, Chlamydophila pneumoniae J138
agagaacgaacaguu

SEQ ID NO: 2563095 - RNA, 17 nt, Chlamydophila pneumoniae J138
agagaacuuucgucuuu

SEQ ID NO: 2563096 - RNA, 14 nt, Chlamydophila pneumoniae J138
agagaagacaggag

SEQ ID NO: 2563097 - RNA, 21 nt, Chlamydophila pneumoniae J138
agagaagagguguccauaaug

SEQ ID NO: 2563098 - RNA, 17 nt, Chlamydophila pneumoniae J138
agagaagauuucuauag

SEQ ID NO: 2563099 - RNA, 15 nt, Chlamydophila pneumoniae J138
agagaagcagaaucu

SEQ ID NO: 2563100 - RNA, 13 nt, Chlamydophila pneumoniae J138
agagaaggaaaag

SEQ ID NO: 2563101 - RNA, 23 nt, Chlamydophila pneumoniae J138
agagaauacauugcugccaggcu

SEQ ID NO: 2563102 - RNA, 19 nt, Chlamydophila pneumoniae J138
agagaaucuccucaucaga

SEQ ID NO: 2563103 - RNA, 14 nt, Chlamydophila pneumoniae J138
agagacaaagccac

SEQ ID NO: 2563104 - RNA, 17 nt, Chlamydophila pneumoniae J138
agagacaaagccacagc

SEQ ID NO: 2563105 - RNA, 18 nt, Chlamydophila pneumoniae J138
agagacaagaaaauauca

SEQ ID NO: 2563106 - RNA, 14 nt, Chlamydophila pneumoniae J138
agagacacagaagg

SEQ ID NO: 2563107 - RNA, 15 nt, Chlamydophila pneumoniae J138
agagacacagaagga

SEQ ID NO: 2563108 - RNA, 20 nt, Chlamydophila pneumoniae J138
agagacagccuguuuucuuc

SEQ ID NO: 2563109 - RNA, 12 nt, Chlamydophila pneumoniae J138
agagaccuucuc

SEQ ID NO: 2563110 - RNA, 19 nt, Chlamydophila pneumoniae J138
agagagagucggcuuuaga

SEQ ID NO: 2563111 - RNA, 18 nt, Chlamydophila pneumoniae J138
agagagaucacuguauuu

SEQ ID NO: 2563112 - RNA, 14 nt, Chlamydophila pneumoniae J138
agagagcaagauaa

SEQ ID NO: 2563113 - RNA, 22 nt, Chlamydophila pneumoniae J138
agagagcuugucacacugcgag

SEQ ID NO: 2563114 - RNA, 15 nt, Chlamydophila pneumoniae J138
agaucaauauagaga

SEQ ID NO: 2563115 - RNA, 14 nt, Chlamydophila pneumoniae J138
agaucacaucaaga

SEQ ID NO: 2563116 - RNA, 19 nt, Chlamydophila pneumoniae J138
agaucagaggaaucuaaga

SEQ ID NO: 2563117 - RNA, 20 nt, Chlamydophila pneumoniae J138
agaucagaggaaucuaagaa

SEQ ID NO: 2563118 - RNA, 17 nt, Chlamydophila pneumoniae J138
agaucaggauucuaaaa

SEQ ID NO: 2563119 - RNA, 15 nt, Chlamydophila pneumoniae J138
agaucauaaacagca

SEQ ID NO: 2563120 - RNA, 22 nt, Chlamydophila pneumoniae J138
agaucaucuacgauguuuucuu

SEQ ID NO: 2563121 - RNA, 16 nt, Chlamydophila pneumoniae J138
agaucauuagcaucau

SEQ ID NO: 2563122 - RNA, 18 nt, Chlamydophila pneumoniae J138
agaucauuagcaucaucu

SEQ ID NO: 2563123 - RNA, 19 nt, Chlamydophila pneumoniae J138
agaucauuagcaucaucuc

SEQ ID NO: 2563124 - RNA, 14 nt, Chlamydophila pneumoniae J138
agauccaaagccug

SEQ ID NO: 2563125 - RNA, 17 nt, Chlamydophila pneumoniae J138
agauccaugaacagcau

SEQ ID NO: 2563126 - RNA, 19 nt, Chlamydophila pneumoniae J138
agauccuaagagauuuucc

SEQ ID NO: 2563127 - RNA, 21 nt, Chlamydophila pneumoniae J138
agauccuauaguaauuucucc

SEQ ID NO: 2563128 - RNA, 21 nt, Chlamydophila pneumoniae J138
agauccucuauagauugguaa

SEQ ID NO: 2563129 - RNA, 17 nt, Chlamydophila pneumoniae J138
agauccugaaaguacag

SEQ ID NO: 2563130 - RNA, 22 nt, Chlamydophila pneumoniae J138
agauccugagaccauacacaaa

SEQ ID NO: 2563131 - RNA, 23 nt, Chlamydophila pneumoniae J138
agauccuuuaaagauuccccaua

SEQ ID NO: 2563132 - RNA, 18 nt, Chlamydophila pneumoniae J138
agaucgagaucauuagca

SEQ ID NO: 2563133 - RNA, 22 nt, Chlamydophila pneumoniae J138
agaucgaucucugugguuccug

SEQ ID NO: 2563134 - RNA, 20 nt, Chlamydophila pneumoniae J138
agaucgggucuacaacaguu

SEQ ID NO: 2563135 - RNA, 17 nt, Chlamydophila pneumoniae J138
agaucguuagagaccca

SEQ ID NO: 2563136 - RNA, 14 nt, Chlamydophila pneumoniae J138
agaucuacaagacu

SEQ ID NO: 2563137 - RNA, 18 nt, Chlamydophila pneumoniae J138
agaucuccgccuacaaua

SEQ ID NO: 2563138 - RNA, 20 nt, Chlamydophila pneumoniae J138
agaucucuguguuuugagga

SEQ ID NO: 2563139 - RNA, 13 nt, Chlamydophila pneumoniae J138
agaucucuuuagc

SEQ ID NO: 2563140 - RNA, 21 nt, Chlamydophila pneumoniae J138
agaucucuuuagcaaucucuu

SEQ ID NO: 2563141 - RNA, 22 nt, Chlamydophila pneumoniae J138
agaucugcaaacgcaaugauuu

SEQ ID NO: 2563142 - RNA, 21 nt, Chlamydophila pneumoniae J138
agaucuucaucacaaaauuca

SEQ ID NO: 2563143 - RNA, 18 nt, Chlamydophila pneumoniae J138
agaucuucugaaaucaaa

SEQ ID NO: 2563144 - RNA, 11 nt, Chlamydophila pneumoniae J138
agaucuugaac

SEQ ID NO: 2563145 - RNA, 15 nt, Chlamydophila pneumoniae J138
agaucuugaacagag

SEQ ID NO: 2563146 - RNA, 19 nt, Chlamydophila pneumoniae J138
agaucuuuaucauugcuau

SEQ ID NO: 2563147 - RNA, 21 nt, Chlamydophila pneumoniae J138
agaucuuuauuuuuaaaaaua

SEQ ID NO: 2563148 - RNA, 13 nt, Chlamydophila pneumoniae J138
agaucuuuuguaa

SEQ ID NO: 2563149 - RNA, 14 nt, Chlamydophila pneumoniae J138
agaucuuuuugcca

SEQ ID NO: 2563150 - RNA, 20 nt, Chlamydophila pneumoniae J138
agaugaacgucuaaacgcga

SEQ ID NO: 2563151 - RNA, 12 nt, Chlamydophila pneumoniae J138
agaugaagagug

SEQ ID NO: 2563152 - RNA, 13 nt, Chlamydophila pneumoniae J138
agaugaagagugg

SEQ ID NO: 2563153 - RNA, 18 nt, Chlamydophila pneumoniae J138
agaugaauaccagaagca

SEQ ID NO: 2563154 - RNA, 23 nt, Chlamydophila pneumoniae J138
agaugaauaccagaagcaaaggu

SEQ ID NO: 2563155 - RNA, 20 nt, Chlamydophila pneumoniae J138
agaugagaaaaucugcagca

SEQ ID NO: 2563156 - RNA, 16 nt, Chlamydophila pneumoniae J138
agaugagguaucccac

SEQ ID NO: 2563157 - RNA, 22 nt, Chlamydophila pneumoniae J138
agaugcuauuuacugaaacauu

SEQ ID NO: 2563158 - RNA, 21 nt, Chlamydophila pneumoniae J138
agauggcaaggaaaauucagu

SEQ ID NO: 2563159 - RNA, 22 nt, Chlamydophila pneumoniae J138
agauggucgagaaccuccacca

SEQ ID NO: 2563160 - RNA, 22 nt, Chlamydophila pneumoniae J138
agauggucuuggguuuuaaaug

SEQ ID NO: 2563161 - RNA, 15 nt, Chlamydophila pneumoniae J138
agauguaaagagcaa

SEQ ID NO: 2563162 - RNA, 17 nt, Chlamydophila pneumoniae J138
agauguaaagagcaaca

SEQ ID NO: 2563163 - RNA, 21 nt, Chlamydophila pneumoniae J138
agauguaaagagcaacaguaa

SEQ ID NO: 2563164 - RNA, 20 nt, Chlamydophila pneumoniae J138
agauguagguaucagcaaga

SEQ ID NO: 2563165 - RNA, 21 nt, Chlamydophila pneumoniae J138
agauguagguaucagcaagau

SEQ ID NO: 2563166 - RNA, 21 nt, Chlamydophila pneumoniae J138
agauguguacggguaaccuga

SEQ ID NO: 2563167 - RNA, 18 nt, Chlamydophila pneumoniae J138
agauguuaugaguuuuua

SEQ ID NO: 2563168 - RNA, 20 nt, Chlamydophila pneumoniae J138
agauuaccgaagagccccca

SEQ ID NO: 2563169 - RNA, 17 nt, Chlamydophila pneumoniae J138
agauuaugaugccucau

SEQ ID NO: 2563170 - RNA, 13 nt, Chlamydophila pneumoniae J138
agauucaaagaag

SEQ ID NO: 2563171 - RNA, 15 nt, Chlamydophila pneumoniae J138
agauucaagcaaugc

SEQ ID NO: 2563172 - RNA, 19 nt, Chlamydophila pneumoniae J138
agauucaccaagaacaaua

SEQ ID NO: 2563173 - RNA, 22 nt, Chlamydophila pneumoniae J138
agauucccugcggacagaaacu

SEQ ID NO: 2563174 - RNA, 16 nt, Chlamydophila pneumoniae J138
agauuccuaacuucug

SEQ ID NO: 2563175 - RNA, 21 nt, Chlamydophila pneumoniae J138
agauuccuaugaucagagaga

SEQ ID NO: 2563176 - RNA, 15 nt, Chlamydophila pneumoniae J138
agauucuaaaucaac

SEQ ID NO: 2563177 - RNA, 16 nt, Chlamydophila pneumoniae J138
agauucuaaaucaacu

SEQ ID NO: 2563178 - RNA, 12 nt, Chlamydophila pneumoniae J138
agauucuacaaa

SEQ ID NO: 2563179 - RNA, 12 nt, Chlamydophila pneumoniae J138
agauucugaaga

SEQ ID NO: 2563180 - RNA, 16 nt, Chlamydophila pneumoniae J138
agauucugaagagaga

SEQ ID NO: 2563181 - RNA, 20 nt, Chlamydophila pneumoniae J138
agauucugcuuuaucucuau

SEQ ID NO: 2563182 - RNA, 16 nt, Chlamydophila pneumoniae J138
agauucuucagaaucu

SEQ ID NO: 2563183 - RNA, 21 nt, Chlamydophila pneumoniae J138
agauugaaggcaccaacacuu

SEQ ID NO: 2563184 - RNA, 16 nt, Chlamydophila pneumoniae J138
agauugaaucccauca

SEQ ID NO: 2563185 - RNA, 17 nt, Chlamydophila pneumoniae J138
agauugauuucuugcuu

SEQ ID NO: 2563186 - RNA, 21 nt, Chlamydophila pneumoniae J138
agauuggaauauaaucguuuu

SEQ ID NO: 2563187 - RNA, 15 nt, Chlamydophila pneumoniae J138
agauuguaauuuccu

SEQ ID NO: 2563188 - RNA, 19 nt, Chlamydophila pneumoniae J138
agauugugcucaauacaga

SEQ ID NO: 2563189 - RNA, 17 nt, Chlamydophila pneumoniae J138
agauuguucaaaaauag

SEQ ID NO: 2563190 - RNA, 18 nt, Chlamydophila pneumoniae J138
agauuguuucaggccugg

SEQ ID NO: 2563191 - RNA, 15 nt, Chlamydophila pneumoniae J138
agauuuauuuugucu

SEQ ID NO: 2563192 - RNA, 16 nt, Chlamydophila pneumoniae J138
agauuuauuuugucuu

SEQ ID NO: 2563193 - RNA, 12 nt, Chlamydophila pneumoniae J138
agauuuccuccg

SEQ ID NO: 2563194 - RNA, 17 nt, Chlamydophila pneumoniae J138
agauuuccuuaagcuuc

SEQ ID NO: 2563195 - RNA, 20 nt, Chlamydophila pneumoniae J138
agauuucuauagagcaucau

SEQ ID NO: 2563196 - RNA, 14 nt, Chlamydophila pneumoniae J138
agauuuuaaagccu

SEQ ID NO: 2563197 - RNA, 21 nt, Chlamydophila pneumoniae J138
agauuuuaagaccuucugacg

SEQ ID NO: 2563198 - RNA, 13 nt, Chlamydophila pneumoniae J138
agauuuuucuuuu

SEQ ID NO: 2563199 - RNA, 13 nt, Chlamydophila pneumoniae J138
agcaaaacuagga

SEQ ID NO: 2563200 - RNA, 20 nt, Chlamydophila pneumoniae J138
agcaaaaugcgaggaaaaag

SEQ ID NO: 2563201 - RNA, 18 nt, Chlamydophila pneumoniae J138
agcaaacggaacuaaaga

SEQ ID NO: 2563202 - RNA, 19 nt, Chlamydophila pneumoniae J138
agcaaacggagagcauuua

SEQ ID NO: 2563203 - RNA, 13 nt, Chlamydophila pneumoniae J138
agcaaagaaaauu

SEQ ID NO: 2563204 - RNA, 17 nt, Chlamydophila pneumoniae J138
agcaaagauaaagaagu

SEQ ID NO: 2563205 - RNA, 14 nt, Chlamydophila pneumoniae J138
agcaaagcggcucu

SEQ ID NO: 2563206 - RNA, 20 nt, Chlamydophila pneumoniae J138
agcaaagcggcucuuacuuc

SEQ ID NO: 2563207 - RNA, 17 nt, Chlamydophila pneumoniae J138
agcaaagguaaauugac

SEQ ID NO: 2563208 - RNA, 22 nt, Chlamydophila pneumoniae J138
agcaaaguuaaugcaagcaacu

SEQ ID NO: 2563209 - RNA, 13 nt, Chlamydophila pneumoniae J138
agcaacaaccaaa

SEQ ID NO: 2563210 - RNA, 14 nt, Chlamydophila pneumoniae J138
agcaacaaccaaaa

SEQ ID NO: 2563211 - RNA, 15 nt, Chlamydophila pneumoniae J138
agcaacaaccaaaag

SEQ ID NO: 2563212 - RNA, 19 nt, Chlamydophila pneumoniae J138
agcaacaguaauuauuuuc

SEQ ID NO: 2563213 - RNA, 19 nt, Chlamydophila pneumoniae J138
agcaacaucguuaauauaa

SEQ ID NO: 2563214 - RNA, 13 nt, Chlamydophila pneumoniae J138
agcccuauagaaa

SEQ ID NO: 2563215 - RNA, 20 nt, Chlamydophila pneumoniae J138
agcccuccaguuuuacgaac

SEQ ID NO: 2563216 - RNA, 19 nt, Chlamydophila pneumoniae J138
agcccucgguuauuuuucc

SEQ ID NO: 2563217 - RNA, 22 nt, Chlamydophila pneumoniae J138
agccgaggcgauuuucauggac

SEQ ID NO: 2563218 - RNA, 19 nt, Chlamydophila pneumoniae J138
agccgauacccaucuagaa

SEQ ID NO: 2563219 - RNA, 13 nt, Chlamydophila pneumoniae J138
agccggagcuucu

SEQ ID NO: 2563220 - RNA, 16 nt, Chlamydophila pneumoniae J138
agccuaugauaaagcc

SEQ ID NO: 2563221 - RNA, 19 nt, Chlamydophila pneumoniae J138
agccuccauuuagacaaga

SEQ ID NO: 2563222 - RNA, 22 nt, Chlamydophila pneumoniae J138
agccuccucaagauaaauccca

SEQ ID NO: 2563223 - RNA, 16 nt, Chlamydophila pneumoniae J138
agccuccuccuucugc

SEQ ID NO: 2563224 - RNA, 23 nt, Chlamydophila pneumoniae J138
agccucgagcagaaacuccaaaa

SEQ ID NO: 2563225 - RNA, 21 nt, Chlamydophila pneumoniae J138
agccucgauuugaucuugcuc

SEQ ID NO: 2563226 - RNA, 14 nt, Chlamydophila pneumoniae J138
agccucuucucuac

SEQ ID NO: 2563227 - RNA, 17 nt, Chlamydophila pneumoniae J138
agccugcaccagacccu

SEQ ID NO: 2563228 - RNA, 14 nt, Chlamydophila pneumoniae J138
agccuggaaagcuu

SEQ ID NO: 2563229 - RNA, 12 nt, Chlamydophila pneumoniae J138
agccugucuaua

SEQ ID NO: 2563230 - RNA, 13 nt, Chlamydophila pneumoniae J138
agccuuagcagca

SEQ ID NO: 2563231 - RNA, 20 nt, Chlamydophila pneumoniae J138
agccuuagcagcacccauaa

SEQ ID NO: 2563232 - RNA, 15 nt, Chlamydophila pneumoniae J138
agccuucuucucgaa

SEQ ID NO: 2563233 - RNA, 21 nt, Chlamydophila pneumoniae J138
agccuugauugaacagucuug

SEQ ID NO: 2563234 - RNA, 20 nt, Chlamydophila pneumoniae J138
agccuugcagcauccugaac

SEQ ID NO: 2563235 - RNA, 22 nt, Chlamydophila pneumoniae J138
agccuuggcucuagaaauauac

SEQ ID NO: 2563236 - RNA, 21 nt, Chlamydophila pneumoniae J138
agccuuguaaauaguauacaa

SEQ ID NO: 2563237 - RNA, 11 nt, Chlamydophila pneumoniae J138
agccuuuccua

SEQ ID NO: 2563238 - RNA, 17 nt, Chlamydophila pneumoniae J138
agcgaaagcagcgaaga

SEQ ID NO: 2563239 - RNA, 20 nt, Chlamydophila pneumoniae J138
agcgaaccaaagucaugucc

SEQ ID NO: 2563240 - RNA, 12 nt, Chlamydophila pneumoniae J138
agcgaaugaaaa

SEQ ID NO: 2563241 - RNA, 22 nt, Chlamydophila pneumoniae J138
agcgagaacaccauaaaacaau

SEQ ID NO: 2563242 - RNA, 13 nt, Chlamydophila pneumoniae J138
agcgauagcuaaa

SEQ ID NO: 2563243 - RNA, 14 nt, Chlamydophila pneumoniae J138
agcgauagcuaaac

SEQ ID NO: 2563244 - RNA, 15 nt, Chlamydophila pneumoniae J138
agcgaucacauagaa

SEQ ID NO: 2563245 - RNA, 19 nt, Chlamydophila pneumoniae J138
agcgaucacauagaaaaca

SEQ ID NO: 2563246 - RNA, 17 nt, Chlamydophila pneumoniae J138
agcgaucucucuuccug

SEQ ID NO: 2563247 - RNA, 18 nt, Chlamydophila pneumoniae J138
agcgauuucgacagcagc

SEQ ID NO: 2563248 - RNA, 12 nt, Chlamydophila pneumoniae J138
agcgcaaaucuu

SEQ ID NO: 2563249 - RNA, 14 nt, Chlamydophila pneumoniae J138
agcgcaucacgaaa

SEQ ID NO: 2563250 - RNA, 20 nt, Chlamydophila pneumoniae J138
agcgcaucacgaaaaggaga

SEQ ID NO: 2563251 - RNA, 22 nt, Chlamydophila pneumoniae J138
agcgccuccaccugcagcgcag

SEQ ID NO: 2563252 - RNA, 20 nt, Chlamydophila pneumoniae J138
agcgcucgugggaggaaucc

SEQ ID NO: 2563253 - RNA, 16 nt, Chlamydophila pneumoniae J138
agcgcuuuuuuaaagu

SEQ ID NO: 2563254 - RNA, 21 nt, Chlamydophila pneumoniae J138
agcggaacguauccuugauuu

SEQ ID NO: 2563255 - RNA, 17 nt, Chlamydophila pneumoniae J138
agcggacuuuagcgcua

SEQ ID NO: 2563256 - RNA, 23 nt, Chlamydophila pneumoniae J138
agcggaguccuucuugcaaagau

SEQ ID NO: 2563257 - RNA, 15 nt, Chlamydophila pneumoniae J138
agcggcaacauaauc

SEQ ID NO: 2563258 - RNA, 17 nt, Chlamydophila pneumoniae J138
agcgggauaggcaagau

SEQ ID NO: 2563259 - RNA, 16 nt, Chlamydophila pneumoniae J138
agcguacaggaagucc

SEQ ID NO: 2563260 - RNA, 21 nt, Chlamydophila pneumoniae J138
agcguacuuuacacuauaaga

SEQ ID NO: 2563261 - RNA, 22 nt, Chlamydophila pneumoniae J138
agcguauccgcugcccaugcuu

SEQ ID NO: 2563262 - RNA, 16 nt, Chlamydophila pneumoniae J138
agcgucguguuuucac

SEQ ID NO: 2563263 - RNA, 22 nt, Chlamydophila pneumoniae J138
agcgucuaucgacucuucgccc

SEQ ID NO: 2563264 - RNA, 20 nt, Chlamydophila pneumoniae J138
agcgucucuucuuccucuac

SEQ ID NO: 2563265 - RNA, 15 nt, Chlamydophila pneumoniae J138
agcguguauccaucu

SEQ ID NO: 2563266 - RNA, 12 nt, Chlamydophila pneumoniae J138
agcguuaacaac

SEQ ID NO: 2563267 - RNA, 19 nt, Chlamydophila pneumoniae J138
agcguucgcucucuuuaaa

SEQ ID NO: 2563268 - RNA, 14 nt, Chlamydophila pneumoniae J138
agcguugcuaagca

SEQ ID NO: 2563269 - RNA, 18 nt, Chlamydophila pneumoniae J138
agcguuuuuugaaaauuu

SEQ ID NO: 2563270 - RNA, 14 nt, Chlamydophila pneumoniae J138
agcuaaagaaacuu

SEQ ID NO: 2563271 - RNA, 12 nt, Chlamydophila pneumoniae J138
agcuaaaucaaa

SEQ ID NO: 2563272 - RNA, 13 nt, Chlamydophila pneumoniae J138
agcuaaaucaaaa

SEQ ID NO: 2563273 - RNA, 20 nt, Chlamydophila pneumoniae J138
agcuaaaucaaaauuuuuag

SEQ ID NO: 2563274 - RNA, 17 nt, Chlamydophila pneumoniae J138
agcuaaguaacaguccu

SEQ ID NO: 2563275 - RNA, 19 nt, Chlamydophila pneumoniae J138
agcuaaguaacaguccucu

SEQ ID NO: 2563276 - RNA, 21 nt, Chlamydophila pneumoniae J138
agcuaaguaacaguccucucc

SEQ ID NO: 2563277 - RNA, 18 nt, Chlamydophila pneumoniae J138
agcuaagucuccauaauu

SEQ ID NO: 2563278 - RNA, 17 nt, Chlamydophila pneumoniae J138
agcuaauaagauccaaa

SEQ ID NO: 2563279 - RNA, 19 nt, Chlamydophila pneumoniae J138
agcuaauaagauccaaaaa

SEQ ID NO: 2563280 - RNA, 17 nt, Chlamydophila pneumoniae J138
agcuaauacaucaccac

SEQ ID NO: 2563281 - RNA, 16 nt, Chlamydophila pneumoniae J138
agcuaaucaauccaag

SEQ ID NO: 2563282 - RNA, 21 nt, Chlamydophila pneumoniae J138
agcuaauuuaaaugccuuaaa

SEQ ID NO: 2563283 - RNA, 16 nt, Chlamydophila pneumoniae J138
agcuacagaaagagcu

SEQ ID NO: 2563284 - RNA, 17 nt, Chlamydophila pneumoniae J138
agcuacagaaagagcua

SEQ ID NO: 2563285 - RNA, 20 nt, Chlamydophila pneumoniae J138
agcuaccuagggucuucucg

SEQ ID NO: 2563286 - RNA, 21 nt, Chlamydophila pneumoniae J138
agcuacggagagguuauguac

SEQ ID NO: 2563287 - RNA, 12 nt, Chlamydophila pneumoniae J138
agcuacuucuuc

SEQ ID NO: 2563288 - RNA, 13 nt, Chlamydophila pneumoniae J138
agcuagaagagcg

SEQ ID NO: 2563289 - RNA, 19 nt, Chlamydophila pneumoniae J138
agcuagagauccaaugaca

SEQ ID NO: 2563290 - RNA, 20 nt, Chlamydophila pneumoniae J138
agcuagagcacauagaaaca

SEQ ID NO: 2563291 - RNA, 19 nt, Chlamydophila pneumoniae J138
agcuaggcgauaguaaaca

SEQ ID NO: 2563292 - RNA, 14 nt, Chlamydophila pneumoniae J138
agcuagucuucuua

SEQ ID NO: 2563293 - RNA, 14 nt, Chlamydophila pneumoniae J138
agcuauagaaagag

SEQ ID NO: 2563294 - RNA, 15 nt, Chlamydophila pneumoniae J138
agcuaugaugagaac

SEQ ID NO: 2563295 - RNA, 13 nt, Chlamydophila pneumoniae J138
agcuauuucucua

SEQ ID NO: 2563296 - RNA, 14 nt, Chlamydophila pneumoniae J138
agcuauuugaaaua

SEQ ID NO: 2563297 - RNA, 14 nt, Chlamydophila pneumoniae J138
agcucaaaaaguuc

SEQ ID NO: 2563298 - RNA, 19 nt, Chlamydophila pneumoniae J138
agcucacgcaccauuccuu

SEQ ID NO: 2563299 - RNA, 20 nt, Chlamydophila pneumoniae J138
agcucacgcaccauuccuua

SEQ ID NO: 2563300 - RNA, 18 nt, Chlamydophila pneumoniae J138
agcucaucggaucuuuuc

SEQ ID NO: 2563301 - RNA, 16 nt, Chlamydophila pneumoniae J138
agcucaucuagaaaga

SEQ ID NO: 2563302 - RNA, 17 nt, Chlamydophila pneumoniae J138
agcucaucuagaaagau

SEQ ID NO: 2563303 - RNA, 17 nt, Chlamydophila pneumoniae J138
agcucauuaucaagaaa

SEQ ID NO: 2563304 - RNA, 20 nt, Chlamydophila pneumoniae J138
agcucauuaucaagaaauuc

SEQ ID NO: 2563305 - RNA, 23 nt, Chlamydophila pneumoniae J138
agcuccauaagcuuuucuuccaa

SEQ ID NO: 2563306 - RNA, 18 nt, Chlamydophila pneumoniae J138
agcuccauuuaaauggau

SEQ ID NO: 2563307 - RNA, 14 nt, Chlamydophila pneumoniae J138
agcucccucuagag

SEQ ID NO: 2563308 - RNA, 16 nt, Chlamydophila pneumoniae J138
agcucccucuagagcu

SEQ ID NO: 2563309 - RNA, 18 nt, Chlamydophila pneumoniae J138
agcuccgaggcuucugag

SEQ ID NO: 2563310 - RNA, 14 nt, Chlamydophila pneumoniae J138
agcuccgcuagagg

SEQ ID NO: 2563311 - RNA, 20 nt, Chlamydophila pneumoniae J138
agcuccucacaucuccuuuc

SEQ ID NO: 2563312 - RNA, 13 nt, Chlamydophila pneumoniae J138
agcuccuggauau

SEQ ID NO: 2563313 - RNA, 15 nt, Chlamydophila pneumoniae J138
agcucgaccucuagc

SEQ ID NO: 2563314 - RNA, 21 nt, Chlamydophila pneumoniae J138
aggcugccagagauucuucac

SEQ ID NO: 2563315 - RNA, 15 nt, Chlamydophila pneumoniae J138
aggcuuguuucuguu

SEQ ID NO: 2563316 - RNA, 16 nt, Chlamydophila pneumoniae J138
aggcuuuucuuuuucu

SEQ ID NO: 2563317 - RNA, 10 nt, Chlamydophila pneumoniae J138
agggaaaaag

SEQ ID NO: 2563318 - RNA, 23 nt, Chlamydophila pneumoniae J138
agggaaaaugcgaucuucacgac

SEQ ID NO: 2563319 - RNA, 13 nt, Chlamydophila pneumoniae J138
agggaaacaccgu

SEQ ID NO: 2563320 - RNA, 23 nt, Chlamydophila pneumoniae J138
agggaaaccauauugcaaagcau

SEQ ID NO: 2563321 - RNA, 22 nt, Chlamydophila pneumoniae J138
agggaaaggagcgcuacuguau

SEQ ID NO: 2563322 - RNA, 19 nt, Chlamydophila pneumoniae J138
agggaauccccaauguuuu

SEQ ID NO: 2563323 - RNA, 22 nt, Chlamydophila pneumoniae J138
agggaauuucauguccuccaug

SEQ ID NO: 2563324 - RNA, 23 nt, Chlamydophila pneumoniae J138
agggaauuuucucauagcuuccu

SEQ ID NO: 2563325 - RNA, 17 nt, Chlamydophila pneumoniae J138
agggacguuguaucccu

SEQ ID NO: 2563326 - RNA, 18 nt, Chlamydophila pneumoniae J138
agggacuucucaaagaca

SEQ ID NO: 2563327 - RNA, 17 nt, Chlamydophila pneumoniae J138
agggagaucuacgccuu

SEQ ID NO: 2563328 - RNA, 19 nt, Chlamydophila pneumoniae J138
agggaucauguagcagagc

SEQ ID NO: 2563329 - RNA, 10 nt, Chlamydophila pneumoniae J138
agggauccca

SEQ ID NO: 2563330 - RNA, 20 nt, Chlamydophila pneumoniae J138
agggaucuccuucaugcagu

SEQ ID NO: 2563331 - RNA, 16 nt, Chlamydophila pneumoniae J138
agggaucuucaucccu

SEQ ID NO: 2563332 - RNA, 15 nt, Chlamydophila pneumoniae J138
agggaugcagaucau

SEQ ID NO: 2563333 - RNA, 15 nt, Chlamydophila pneumoniae J138
agggaugcucuagaa

SEQ ID NO: 2563334 - RNA, 12 nt, Chlamydophila pneumoniae J138
agggaugggauc

SEQ ID NO: 2563335 - RNA, 18 nt, Chlamydophila pneumoniae J138
agggauguuuaauacaaa

SEQ ID NO: 2563336 - RNA, 19 nt, Chlamydophila pneumoniae J138
agggauucuuguuggauug

SEQ ID NO: 2563337 - RNA, 17 nt, Chlamydophila pneumoniae J138
agggcauguaguuagag

SEQ ID NO: 2563338 - RNA, 22 nt, Chlamydophila pneumoniae J138
agggcauucuguaauuuugaga

SEQ ID NO: 2563339 - RNA, 17 nt, Chlamydophila pneumoniae J138
agggcgcuucccuauaa

SEQ ID NO: 2563340 - RNA, 14 nt, Chlamydophila pneumoniae J138
agggcggaauacuu

SEQ ID NO: 2563341 - RNA, 16 nt, Chlamydophila pneumoniae J138
agggcugcgucaugag

SEQ ID NO: 2563342 - RNA, 23 nt, Chlamydophila pneumoniae J138
aggggcgcauggcggucuuuguu

SEQ ID NO: 2563343 - RNA, 21 nt, Chlamydophila pneumoniae J138
aggggcucccaagguuccucg

SEQ ID NO: 2563344 - RNA, 14 nt, Chlamydophila pneumoniae J138
aggggcuccuaaag

SEQ ID NO: 2563345 - RNA, 13 nt, Chlamydophila pneumoniae J138
aggggcucgacac

SEQ ID NO: 2563346 - RNA, 13 nt, Chlamydophila pneumoniae J138
aggggcuuuccuu

SEQ ID NO: 2563347 - RNA, 18 nt, Chlamydophila pneumoniae J138
agggggaucuucagagag

SEQ ID NO: 2563348 - RNA, 23 nt, Chlamydophila pneumoniae J138
agggggaucuucagagagaacag

SEQ ID NO: 2563349 - RNA, 14 nt, Chlamydophila pneumoniae J138
agggggccugccau

SEQ ID NO: 2563350 - RNA, 16 nt, Chlamydophila pneumoniae J138
agggggccugccauga

SEQ ID NO: 2563351 - RNA, 19 nt, Chlamydophila pneumoniae J138
agggguucccucuccuuga

SEQ ID NO: 2563352 - RNA, 14 nt, Chlamydophila pneumoniae J138
aggguaaagaaaua

SEQ ID NO: 2563353 - RNA, 20 nt, Chlamydophila pneumoniae J138
aggguagcgcuuuuuuaaag

SEQ ID NO: 2563354 - RNA, 12 nt, Chlamydophila pneumoniae J138
aggguucaucug

SEQ ID NO: 2563355 - RNA, 15 nt, Chlamydophila pneumoniae J138
aggguucucaaagau

SEQ ID NO: 2563356 - RNA, 15 nt, Chlamydophila pneumoniae J138
agguaaaauaaagag

SEQ ID NO: 2563357 - RNA, 16 nt, Chlamydophila pneumoniae J138
agguaaaauaaagagc

SEQ ID NO: 2563358 - RNA, 16 nt, Chlamydophila pneumoniae J138
agguaaauuuuuaaaa

SEQ ID NO: 2563359 - RNA, 19 nt, Chlamydophila pneumoniae J138
agguaaauuuuuaaaacuc

SEQ ID NO: 2563360 - RNA, 21 nt, Chlamydophila pneumoniae J138
agguaaccagagagcuuuuag

SEQ ID NO: 2563361 - RNA, 15 nt, Chlamydophila pneumoniae J138
agguaagaagcuguc

SEQ ID NO: 2563362 - RNA, 16 nt, Chlamydophila pneumoniae J138
agguaaugucguaccc

SEQ ID NO: 2563363 - RNA, 20 nt, Chlamydophila pneumoniae J138
agguacgcuuuuucuugaaa

SEQ ID NO: 2563364 - RNA, 21 nt, Chlamydophila pneumoniae J138
agguacuuuauagaaaguaca

SEQ ID NO: 2563365 - RNA, 14 nt, Chlamydophila pneumoniae J138
agguagagugucuu

SEQ ID NO: 2563366 - RNA, 20 nt, Chlamydophila pneumoniae J138
agguagcagaguuuuucccu

SEQ ID NO: 2563367 - RNA, 17 nt, Chlamydophila pneumoniae J138
agguaguuuucuucuuu

SEQ ID NO: 2563368 - RNA, 14 nt, Chlamydophila pneumoniae J138
agguaucagcaaga

SEQ ID NO: 2563369 - RNA, 16 nt, Chlamydophila pneumoniae J138
agguaucccacgauau

SEQ ID NO: 2563370 - RNA, 22 nt, Chlamydophila pneumoniae J138
agguaucucuccacagggucua

SEQ ID NO: 2563371 - RNA, 20 nt, Chlamydophila pneumoniae J138
agguauugcaaauuucauuu

SEQ ID NO: 2563372 - RNA, 23 nt, Chlamydophila pneumoniae J138
agguauuuccuucuguuuucaca

SEQ ID NO: 2563373 - RNA, 16 nt, Chlamydophila pneumoniae J138
aggucacagcauuuuc

SEQ ID NO: 2563374 - RNA, 20 nt, Chlamydophila pneumoniae J138
aggucacagcauuuucucug

SEQ ID NO: 2563375 - RNA, 21 nt, Chlamydophila pneumoniae J138
aggucagcaaggggaguuuuc

SEQ ID NO: 2563376 - RNA, 20 nt, Chlamydophila pneumoniae J138
aggucgaagauucaaagaag

SEQ ID NO: 2563377 - RNA, 13 nt, Chlamydophila pneumoniae J138
aggucguaaacgg

SEQ ID NO: 2563378 - RNA, 21 nt, Chlamydophila pneumoniae J138
aggucuguuggucucuauuua

SEQ ID NO: 2563379 - RNA, 14 nt, Chlamydophila pneumoniae J138
aggugaaaguacag

SEQ ID NO: 2563380 - RNA, 16 nt, Chlamydophila pneumoniae J138
aggugcaucauuuuca

SEQ ID NO: 2563381 - RNA, 16 nt, Chlamydophila pneumoniae J138
agguggguagccagga

SEQ ID NO: 2563382 - RNA, 17 nt, Chlamydophila pneumoniae J138
agguguagguuccugcu

SEQ ID NO: 2563383 - RNA, 16 nt, Chlamydophila pneumoniae J138
agguuagaagggaggu

SEQ ID NO: 2563384 - RNA, 15 nt, Chlamydophila pneumoniae J138
agguuaucuuuuugg

SEQ ID NO: 2563385 - RNA, 21 nt, Chlamydophila pneumoniae J138
agguuauuuaauccaaaaacu

SEQ ID NO: 2563386 - RNA, 13 nt, Chlamydophila pneumoniae J138
agguucaccagaa

SEQ ID NO: 2563387 - RNA, 12 nt, Chlamydophila pneumoniae J138
agguucacuuca

SEQ ID NO: 2563388 - RNA, 17 nt, Chlamydophila pneumoniae J138
agguuccugcuugauuu

SEQ ID NO: 2563389 - RNA, 21 nt, Chlamydophila pneumoniae J138
agguucuugcuuauugucuua

SEQ ID NO: 2563390 - RNA, 22 nt, Chlamydophila pneumoniae J138
agguucuuuucggaucagaaug

SEQ ID NO: 2563391 - RNA, 22 nt, Chlamydophila pneumoniae J138
agguugggcagaagcuucugaa

SEQ ID NO: 2563392 - RNA, 16 nt, Chlamydophila pneumoniae J138
agguuguccuauagag

SEQ ID NO: 2563393 - RNA, 18 nt, Chlamydophila pneumoniae J138
agguuugcugcucuccaa

SEQ ID NO: 2563394 - RNA, 21 nt, Chlamydophila pneumoniae J138
agguuugggugcuaaguuguu

SEQ ID NO: 2563395 - RNA, 23 nt, Chlamydophila pneumoniae J138
agguuuugaagcuccucacaucu

SEQ ID NO: 2563396 - RNA, 14 nt, Chlamydophila pneumoniae J138
agguuuuuccaacu

SEQ ID NO: 2563397 - RNA, 20 nt, Chlamydophila pneumoniae J138
agguuuuuccaacuucaacu

SEQ ID NO: 2563398 - RNA, 21 nt, Chlamydophila pneumoniae J138
agguuuuuccaacuucaacuu

SEQ ID NO: 2563399 - RNA, 13 nt, Chlamydophila pneumoniae J138
aguaaaacacaaa

SEQ ID NO: 2563400 - RNA, 15 nt, Chlamydophila pneumoniae J138
aguaaaacacaaaua

SEQ ID NO: 2563401 - RNA, 22 nt, Chlamydophila pneumoniae J138
aguaaaagcccuaauucauauu

SEQ ID NO: 2563402 - RNA, 20 nt, Chlamydophila pneumoniae J138
aguaaaaucauaggcuauaa

SEQ ID NO: 2563403 - RNA, 18 nt, Chlamydophila pneumoniae J138
aguaaacccucagaacac

SEQ ID NO: 2563404 - RNA, 20 nt, Chlamydophila pneumoniae J138
aguaaagaaauucuggaguc

SEQ ID NO: 2563405 - RNA, 19 nt, Chlamydophila pneumoniae J138
aguaaagaaucacucucua

SEQ ID NO: 2563406 - RNA, 14 nt, Chlamydophila pneumoniae J138
aguaaagccacauu

SEQ ID NO: 2563407 - RNA, 13 nt, Chlamydophila pneumoniae J138
aguaaaguaugca

SEQ ID NO: 2563408 - RNA, 19 nt, Chlamydophila pneumoniae J138
aguaaauauuuuaccauug

SEQ ID NO: 2563409 - RNA, 23 nt, Chlamydophila pneumoniae J138
aguaaauauuuuaccauugagau

SEQ ID NO: 2563410 - RNA, 13 nt, Chlamydophila pneumoniae J138
aguaacuaucuac

SEQ ID NO: 2563411 - RNA, 15 nt, Chlamydophila pneumoniae J138
aguaacuuaaucaau

SEQ ID NO: 2563412 - RNA, 15 nt, Chlamydophila pneumoniae J138
aguaagaagucuuca

SEQ ID NO: 2563413 - RNA, 17 nt, Chlamydophila pneumoniae J138
aguaaggaacaauguaa

SEQ ID NO: 2563414 - RNA, 16 nt, Chlamydophila pneumoniae J138
agugacuuuucuucuu

SEQ ID NO: 2563415 - RNA, 11 nt, Chlamydophila pneumoniae J138
agugagauacg

SEQ ID NO: 2563416 - RNA, 22 nt, Chlamydophila pneumoniae J138
agugagcucccugauguugccc

SEQ ID NO: 2563417 - RNA, 13 nt, Chlamydophila pneumoniae J138
agugaucagaaau

SEQ ID NO: 2563418 - RNA, 16 nt, Chlamydophila pneumoniae J138
agugaucagaaaugaa

SEQ ID NO: 2563419 - RNA, 19 nt, Chlamydophila pneumoniae J138
agugaucuugagaaaagaa

SEQ ID NO: 2563420 - RNA, 21 nt, Chlamydophila pneumoniae J138
agugauuacggcgugccuuuu

SEQ ID NO: 2563421 - RNA, 16 nt, Chlamydophila pneumoniae J138
agugcguacucuucuu

SEQ ID NO: 2563422 - RNA, 19 nt, Chlamydophila pneumoniae J138
agugcucaguaaauauuuu

SEQ ID NO: 2563423 - RNA, 19 nt, Chlamydophila pneumoniae J138
aguggaaauugugaaaaaa

SEQ ID NO: 2563424 - RNA, 18 nt, Chlamydophila pneumoniae J138
aguggaguaaaagcccua

SEQ ID NO: 2563425 - RNA, 13 nt, Chlamydophila pneumoniae J138
aguggcgacugca

SEQ ID NO: 2563426 - RNA, 14 nt, Chlamydophila pneumoniae J138
agugggaauguugu

SEQ ID NO: 2563427 - RNA, 20 nt, Chlamydophila pneumoniae J138
agugguaugcuuuuccuucu

SEQ ID NO: 2563428 - RNA, 16 nt, Chlamydophila pneumoniae J138
aguggucggcagaaac

SEQ ID NO: 2563429 - RNA, 19 nt, Chlamydophila pneumoniae J138
agugguuccugaaaagcau

SEQ ID NO: 2563430 - RNA, 19 nt, Chlamydophila pneumoniae J138
aguguauaacguagauguc

SEQ ID NO: 2563431 - RNA, 21 nt, Chlamydophila pneumoniae J138
aguguauaacguagaugucuu

SEQ ID NO: 2563432 - RNA, 17 nt, Chlamydophila pneumoniae J138
aguguauaucagcaaaa

SEQ ID NO: 2563433 - RNA, 22 nt, Chlamydophila pneumoniae J138
aguguauuguuugcuauacaga

SEQ ID NO: 2563434 - RNA, 20 nt, Chlamydophila pneumoniae J138
agugucauacgcagcacgca

SEQ ID NO: 2563435 - RNA, 14 nt, Chlamydophila pneumoniae J138
agugucccauggcu

SEQ ID NO: 2563436 - RNA, 19 nt, Chlamydophila pneumoniae J138
aguguccuggcgaugccag

SEQ ID NO: 2563437 - RNA, 22 nt, Chlamydophila pneumoniae J138
agugucuaagauauagagagag

SEQ ID NO: 2563438 - RNA, 23 nt, Chlamydophila pneumoniae J138
agugucuaagauauagagagagu

SEQ ID NO: 2563439 - RNA, 14 nt, Chlamydophila pneumoniae J138
agugugacugcaga

SEQ ID NO: 2563440 - RNA, 17 nt, Chlamydophila pneumoniae J138
agugugacugcagagaa

SEQ ID NO: 2563441 - RNA, 19 nt, Chlamydophila pneumoniae J138
agugugacugcagagaaau

SEQ ID NO: 2563442 - RNA, 15 nt, Chlamydophila pneumoniae J138
agugugaggagacuu

SEQ ID NO: 2563443 - RNA, 14 nt, Chlamydophila pneumoniae J138
agugugcucuguau

SEQ ID NO: 2563444 - RNA, 15 nt, Chlamydophila pneumoniae J138
aguguguaaauguuu

SEQ ID NO: 2563445 - RNA, 16 nt, Chlamydophila pneumoniae J138
aguguguaaauguuuu

SEQ ID NO: 2563446 - RNA, 18 nt, Chlamydophila pneumoniae J138
aguguugccagcccaugu

SEQ ID NO: 2563447 - RNA, 16 nt, Chlamydophila pneumoniae J138
aguuacggaacucauu

SEQ ID NO: 2563448 - RNA, 14 nt, Chlamydophila pneumoniae J138
aguuacgugagaac

SEQ ID NO: 2563449 - RNA, 18 nt, Chlamydophila pneumoniae J138
aguuacugucugcaaaga

SEQ ID NO: 2563450 - RNA, 20 nt, Chlamydophila pneumoniae J138
aguuagaagagucauuauca

SEQ ID NO: 2563451 - RNA, 23 nt, Chlamydophila pneumoniae J138
aguuagccuggcuaaaggaucau

SEQ ID NO: 2563452 - RNA, 15 nt, Chlamydophila pneumoniae J138
aguuaggaucccuga

SEQ ID NO: 2563453 - RNA, 20 nt, Chlamydophila pneumoniae J138
aguuagguagauagaaauuc

SEQ ID NO: 2563454 - RNA, 14 nt, Chlamydophila pneumoniae J138
aguuauuaauaaau

SEQ ID NO: 2563455 - RNA, 16 nt, Chlamydophila pneumoniae J138
aguucagcaaggaagu

SEQ ID NO: 2563456 - RNA, 21 nt, Chlamydophila pneumoniae J138
aguucaucauauuuuucuuga

SEQ ID NO: 2563457 - RNA, 22 nt, Chlamydophila pneumoniae J138
aguucaucauauuuuucuugaa

SEQ ID NO: 2563458 - RNA, 16 nt, Chlamydophila pneumoniae J138
aguucauuagcuaaau

SEQ ID NO: 2563459 - RNA, 17 nt, Chlamydophila pneumoniae J138
aguucauuuuaguuuuc

SEQ ID NO: 2563460 - RNA, 16 nt, Chlamydophila pneumoniae J138
aguuccaagacaauaa

SEQ ID NO: 2563461 - RNA, 21 nt, Chlamydophila pneumoniae J138
aguuccaagacaauaaaaaag

SEQ ID NO: 2563462 - RNA, 18 nt, Chlamydophila pneumoniae J138
aguuccauagaguaucua

SEQ ID NO: 2563463 - RNA, 15 nt, Chlamydophila pneumoniae J138
aguuccgaauaggca

SEQ ID NO: 2563464 - RNA, 14 nt, Chlamydophila pneumoniae J138
aguuccgauaaaga

SEQ ID NO: 2563465 - RNA, 15 nt, Chlamydophila pneumoniae J138
aguuccucauccuca

SEQ ID NO: 2563466 - RNA, 20 nt, Chlamydophila pneumoniae J138
aguuccucauccucaucauc

SEQ ID NO: 2563467 - RNA, 21 nt, Chlamydophila pneumoniae J138
aguuccucauccucaucauca

SEQ ID NO: 2563468 - RNA, 22 nt, Chlamydophila pneumoniae J138
aguuccucauccucaucaucag

SEQ ID NO: 2563469 - RNA, 19 nt, Chlamydophila pneumoniae J138
aguucgcgaccugugauuu

SEQ ID NO: 2563470 - RNA, 20 nt, Chlamydophila pneumoniae J138
aguucgcggaucuucuucug

SEQ ID NO: 2563471 - RNA, 20 nt, Chlamydophila pneumoniae J138
aguucucccgugaacaaaaa

SEQ ID NO: 2563472 - RNA, 22 nt, Chlamydophila pneumoniae J138
aguucucccgugaacaaaaacu

SEQ ID NO: 2563473 - RNA, 17 nt, Chlamydophila pneumoniae J138
aguucucuaagacugug

SEQ ID NO: 2563474 - RNA, 15 nt, Chlamydophila pneumoniae J138
aguucucucuucacu

SEQ ID NO: 2563475 - RNA, 23 nt, Chlamydophila pneumoniae J138
aguucuucauuccaggauucuau

SEQ ID NO: 2563476 - RNA, 15 nt, Chlamydophila pneumoniae J138
aguucuuccaaagcu

SEQ ID NO: 2563477 - RNA, 13 nt, Chlamydophila pneumoniae J138
aguucuuccuucu

SEQ ID NO: 2563478 - RNA, 17 nt, Chlamydophila pneumoniae J138
aguucuuccuucuucuu

SEQ ID NO: 2563479 - RNA, 21 nt, Chlamydophila pneumoniae J138
aguucuucuuuacucaagugu

SEQ ID NO: 2563480 - RNA, 18 nt, Chlamydophila pneumoniae J138
aguucuugauucucuucc

SEQ ID NO: 2563481 - RNA, 18 nt, Chlamydophila pneumoniae J138
aguucuugccaauguggu

SEQ ID NO: 2563482 - RNA, 16 nt, Chlamydophila pneumoniae J138
aguucuuggaaaaaag

SEQ ID NO: 2563483 - RNA, 22 nt, Chlamydophila pneumoniae J138
aguucuuguaauaaaagaacau

SEQ ID NO: 2563484 - RNA, 13 nt, Chlamydophila pneumoniae J138
aguucuuucugcu

SEQ ID NO: 2563485 - RNA, 17 nt, Chlamydophila pneumoniae J138
aguucuuuuguuugucu

SEQ ID NO: 2563486 - RNA, 16 nt, Chlamydophila pneumoniae J138
aguugaccuuuuucau

SEQ ID NO: 2563487 - RNA, 18 nt, Chlamydophila pneumoniae J138
aguugacgcacuucuuca

SEQ ID NO: 2563488 - RNA, 20 nt, Chlamydophila pneumoniae J138
aguugagaaccuucacaaga

SEQ ID NO: 2563489 - RNA, 22 nt, Chlamydophila pneumoniae J138
aguugagaaccuucacaagaaa

SEQ ID NO: 2563490 - RNA, 16 nt, Chlamydophila pneumoniae J138
aguugaggaaaggagg

SEQ ID NO: 2563491 - RNA, 14 nt, Chlamydophila pneumoniae J138
aguugcgcagugga

SEQ ID NO: 2563492 - RNA, 21 nt, Chlamydophila pneumoniae J138
aguugcgcaguggacggggag

SEQ ID NO: 2563493 - RNA, 19 nt, Chlamydophila pneumoniae J138
aguugcgcgcccucuucua

SEQ ID NO: 2563494 - RNA, 15 nt, Chlamydophila pneumoniae J138
aguuggaucauucuu

SEQ ID NO: 2563495 - RNA, 15 nt, Chlamydophila pneumoniae J138
aguuggcguuuucua

SEQ ID NO: 2563496 - RNA, 14 nt, Chlamydophila pneumoniae J138
aguuguaauuucuu

SEQ ID NO: 2563497 - RNA, 22 nt, Chlamydophila pneumoniae J138
aguuguacaauuugcuccucca

SEQ ID NO: 2563498 - RNA, 19 nt, Chlamydophila pneumoniae J138
aguuguauccagcucaagg

SEQ ID NO: 2563499 - RNA, 16 nt, Chlamydophila pneumoniae J138
aguuguuucuagaaaa

SEQ ID NO: 2563500 - RNA, 22 nt, Chlamydophila pneumoniae J138
aguuguuuuuugagauacagcu

SEQ ID NO: 2563501 - RNA, 15 nt, Chlamydophila pneumoniae J138
aguuuacaaauaaaa

SEQ ID NO: 2563502 - RNA, 18 nt, Chlamydophila pneumoniae J138
aguuuacaaauaaaauga

SEQ ID NO: 2563503 - RNA, 18 nt, Chlamydophila pneumoniae J138
aguuuaugacacagcuaa

SEQ ID NO: 2563504 - RNA, 20 nt, Chlamydophila pneumoniae J138
aguuuccaagugaucagaaa

SEQ ID NO: 2563505 - RNA, 23 nt, Chlamydophila pneumoniae J138
aguuucuaaaacagaaauugcuu

SEQ ID NO: 2563506 - RNA, 15 nt, Chlamydophila pneumoniae J138
aguuucuuuugcaaa

SEQ ID NO: 2563507 - RNA, 21 nt, Chlamydophila pneumoniae J138
aguuucuuuugcaaaucuucg

SEQ ID NO: 2563508 - RNA, 18 nt, Chlamydophila pneumoniae J138
aguuugcaugcaacggag

SEQ ID NO: 2563509 - RNA, 23 nt, Chlamydophila pneumoniae J138
aguuugccuucuuaucuucuaaa

SEQ ID NO: 2563510 - RNA, 21 nt, Chlamydophila pneumoniae J138
aguuuguagcauuucuuucuc

SEQ ID NO: 2563511 - RNA, 23 nt, Chlamydophila pneumoniae J138
aguuugucguaauugcugaaaau

SEQ ID NO: 2563512 - RNA, 17 nt, Chlamydophila pneumoniae J138
aguuuguucacauuuuc

SEQ ID NO: 2563513 - RNA, 16 nt, Chlamydophila pneumoniae J138
uauauuggcuuucuac

SEQ ID NO: 2563514 - RNA, 14 nt, Chlamydophila pneumoniae J138
uauauuuuuuccca

SEQ ID NO: 2563515 - RNA, 21 nt, Chlamydophila pneumoniae J138
uaucaaaaggaucguuuugug

SEQ ID NO: 2563516 - RNA, 17 nt, Chlamydophila pneumoniae J138
uaucaaccauaaagaau

SEQ ID NO: 2563517 - RNA, 11 nt, Chlamydophila pneumoniae J138
uaucaauaaug

SEQ ID NO: 2563518 - RNA, 18 nt, Chlamydophila pneumoniae J138
uaucagauccaugaacag

SEQ ID NO: 2563519 - RNA, 15 nt, Chlamydophila pneumoniae J138
uaucagcaaaaaacu

SEQ ID NO: 2563520 - RNA, 22 nt, Chlamydophila pneumoniae J138
uaucagcuggguaaguccacaa

SEQ ID NO: 2563521 - RNA, 22 nt, Chlamydophila pneumoniae J138
uaucagggagcggaauuucuca

SEQ ID NO: 2563522 - RNA, 19 nt, Chlamydophila pneumoniae J138
uaucaguauggcguuuuuu

SEQ ID NO: 2563523 - RNA, 15 nt, Chlamydophila pneumoniae J138
uaucauaucuucaaa

SEQ ID NO: 2563524 - RNA, 14 nt, Chlamydophila pneumoniae J138
uaucaucaaaagau

SEQ ID NO: 2563525 - RNA, 22 nt, Chlamydophila pneumoniae J138
uaucaucaaugguuaaaaccca

SEQ ID NO: 2563526 - RNA, 16 nt, Chlamydophila pneumoniae J138
uaucauggacaagcaa

SEQ ID NO: 2563527 - RNA, 21 nt, Chlamydophila pneumoniae J138
uaucauugcuauugaaaaauc

SEQ ID NO: 2563528 - RNA, 14 nt, Chlamydophila pneumoniae J138
uauccaaugagaga

SEQ ID NO: 2563529 - RNA, 15 nt, Chlamydophila pneumoniae J138
uauccaaugagagag

SEQ ID NO: 2563530 - RNA, 18 nt, Chlamydophila pneumoniae J138
uauccaccaagacugaau

SEQ ID NO: 2563531 - RNA, 22 nt, Chlamydophila pneumoniae J138
uauccagaaauacguccagccu

SEQ ID NO: 2563532 - RNA, 18 nt, Chlamydophila pneumoniae J138
uauccaggguagcgcuuu

SEQ ID NO: 2563533 - RNA, 13 nt, Chlamydophila pneumoniae J138
uauccauacggua

SEQ ID NO: 2563534 - RNA, 22 nt, Chlamydophila pneumoniae J138
uauccauggaauggcuacuuua

SEQ ID NO: 2563535 - RNA, 12 nt, Chlamydophila pneumoniae J138
uaucccacagaa

SEQ ID NO: 2563536 - RNA, 17 nt, Chlamydophila pneumoniae J138
uaucccagauaaagaca

SEQ ID NO: 2563537 - RNA, 19 nt, Chlamydophila pneumoniae J138
uauccccagaucucuuuag

SEQ ID NO: 2563538 - RNA, 21 nt, Chlamydophila pneumoniae J138
uauccgacucuguuuccuugu

SEQ ID NO: 2563539 - RNA, 17 nt, Chlamydophila pneumoniae J138
uauccguauggauuucu

SEQ ID NO: 2563540 - RNA, 14 nt, Chlamydophila pneumoniae J138
uauccuuccuuauu

SEQ ID NO: 2563541 - RNA, 22 nt, Chlamydophila pneumoniae J138
uauccuugaaauugcucuugcu

SEQ ID NO: 2563542 - RNA, 12 nt, Chlamydophila pneumoniae J138
uauccuuuucaa

SEQ ID NO: 2563543 - RNA, 13 nt, Chlamydophila pneumoniae J138
uaucgaagagccc

SEQ ID NO: 2563544 - RNA, 18 nt, Chlamydophila pneumoniae J138
uaucgacuguacaaaugc

SEQ ID NO: 2563545 - RNA, 17 nt, Chlamydophila pneumoniae J138
uaucgauaacgauuucu

SEQ ID NO: 2563546 - RNA, 23 nt, Chlamydophila pneumoniae J138
uaucgccuuccuuaacaacauca

SEQ ID NO: 2563547 - RNA, 20 nt, Chlamydophila pneumoniae J138
uaucggaccuacguuuucuc

SEQ ID NO: 2563548 - RNA, 21 nt, Chlamydophila pneumoniae J138
uaucggaccuacguuuucucu

SEQ ID NO: 2563549 - RNA, 17 nt, Chlamydophila pneumoniae J138
uaucggcaauuguuaaa

SEQ ID NO: 2563550 - RNA, 12 nt, Chlamydophila pneumoniae J138
uaucgugacucu

SEQ ID NO: 2563551 - RNA, 14 nt, Chlamydophila pneumoniae J138
uaucguuucaguuu

SEQ ID NO: 2563552 - RNA, 13 nt, Chlamydophila pneumoniae J138
uaucuaaaacuuc

SEQ ID NO: 2563553 - RNA, 15 nt, Chlamydophila pneumoniae J138
uaucuaaagaaaugu

SEQ ID NO: 2563554 - RNA, 17 nt, Chlamydophila pneumoniae J138
uaucuacacaguagccu

SEQ ID NO: 2563555 - RNA, 18 nt, Chlamydophila pneumoniae J138
uaucuacagagagaaacu

SEQ ID NO: 2563556 - RNA, 21 nt, Chlamydophila pneumoniae J138
uaucuagaaguuuaaacgucu

SEQ ID NO: 2563557 - RNA, 19 nt, Chlamydophila pneumoniae J138
uaucuagggacuucucaaa

SEQ ID NO: 2563558 - RNA, 20 nt, Chlamydophila pneumoniae J138
uaucuauccuuaggugaaau

SEQ ID NO: 2563559 - RNA, 22 nt, Chlamydophila pneumoniae J138
uaucuauccuuaggugaaauau

SEQ ID NO: 2563560 - RNA, 18 nt, Chlamydophila pneumoniae J138
uaucucccaagacgagaa

SEQ ID NO: 2563561 - RNA, 18 nt, Chlamydophila pneumoniae J138
uaucuccguuaccaaaaa

SEQ ID NO: 2563562 - RNA, 18 nt, Chlamydophila pneumoniae J138
uaucucuacgaugaacua

SEQ ID NO: 2563563 - RNA, 19 nt, Chlamydophila pneumoniae J138
uaucucuguuuuuugaaaa

SEQ ID NO: 2563564 - RNA, 21 nt, Chlamydophila pneumoniae J138
uaucucuguuuuuugaaaacu

SEQ ID NO: 2563565 - RNA, 16 nt, Chlamydophila pneumoniae J138
uaucugcacuuucuuu

SEQ ID NO: 2563566 - RNA, 16 nt, Chlamydophila pneumoniae J138
uaucugcgacaaaaau

SEQ ID NO: 2563567 - RNA, 15 nt, Chlamydophila pneumoniae J138
uaucugcguuucuuu

SEQ ID NO: 2563568 - RNA, 15 nt, Chlamydophila pneumoniae J138
uaucugcucccuccu

SEQ ID NO: 2563569 - RNA, 19 nt, Chlamydophila pneumoniae J138
uaucuguauccuuccuuau

SEQ ID NO: 2563570 - RNA, 20 nt, Chlamydophila pneumoniae J138
uaucuguggcguaagcaaua

SEQ ID NO: 2563571 - RNA, 22 nt, Chlamydophila pneumoniae J138
uaucuucagaaugcccuuuagg

SEQ ID NO: 2563572 - RNA, 16 nt, Chlamydophila pneumoniae J138
uaucuucguaauaacu

SEQ ID NO: 2563573 - RNA, 13 nt, Chlamydophila pneumoniae J138
uaucuucuaaaac

SEQ ID NO: 2563574 - RNA, 16 nt, Chlamydophila pneumoniae J138
uaucuugaaaguacag

SEQ ID NO: 2563575 - RNA, 14 nt, Chlamydophila pneumoniae J138
uaucuuuaagauuu

SEQ ID NO: 2563576 - RNA, 20 nt, Chlamydophila pneumoniae J138
uaucuuuaagauuuuuagaa

SEQ ID NO: 2563577 - RNA, 16 nt, Chlamydophila pneumoniae J138
uaucuuuauuuaaaua

SEQ ID NO: 2563578 - RNA, 12 nt, Chlamydophila pneumoniae J138
uaugaaucacau

SEQ ID NO: 2563579 - RNA, 16 nt, Chlamydophila pneumoniae J138
uaugaaucacaucuaa

SEQ ID NO: 2563580 - RNA, 16 nt, Chlamydophila pneumoniae J138
uaugaaugacugcaga

SEQ ID NO: 2563581 - RNA, 15 nt, Chlamydophila pneumoniae J138
uaugaccaagaacau

SEQ ID NO: 2563582 - RNA, 15 nt, Chlamydophila pneumoniae J138
uaugacuucuugucc

SEQ ID NO: 2563583 - RNA, 18 nt, Chlamydophila pneumoniae J138
uaugagauaggaacucac

SEQ ID NO: 2563584 - RNA, 16 nt, Chlamydophila pneumoniae J138
uaugagcuccaaaaua

SEQ ID NO: 2563585 - RNA, 17 nt, Chlamydophila pneumoniae J138
uaugaggagauaaagau

SEQ ID NO: 2563586 - RNA, 22 nt, Chlamydophila pneumoniae J138
uaugauccaauagccaaagacu

SEQ ID NO: 2563587 - RNA, 17 nt, Chlamydophila pneumoniae J138
uaugauccgaaaacucu

SEQ ID NO: 2563588 - RNA, 21 nt, Chlamydophila pneumoniae J138
uaugauccgaaaacucuuaga

SEQ ID NO: 2563589 - RNA, 21 nt, Chlamydophila pneumoniae J138
uaugaugccucauugccgugg

SEQ ID NO: 2563590 - RNA, 15 nt, Chlamydophila pneumoniae J138
uaugauguauaaagu

SEQ ID NO: 2563591 - RNA, 22 nt, Chlamydophila pneumoniae J138
uaugcaaaacaacauucguuag

SEQ ID NO: 2563592 - RNA, 12 nt, Chlamydophila pneumoniae J138
uaugcaucaaug

SEQ ID NO: 2563593 - RNA, 18 nt, Chlamydophila pneumoniae J138
uaugcgcucuaagagccc

SEQ ID NO: 2563594 - RNA, 20 nt, Chlamydophila pneumoniae J138
uaugcucauuaauaauaucu

SEQ ID NO: 2563595 - RNA, 20 nt, Chlamydophila pneumoniae J138
uaugcugaauuccucugauu

SEQ ID NO: 2563596 - RNA, 19 nt, Chlamydophila pneumoniae J138
uaugcuguugcuccaagag

SEQ ID NO: 2563597 - RNA, 21 nt, Chlamydophila pneumoniae J138
uaugcuguugcuccaagaguu

SEQ ID NO: 2563598 - RNA, 21 nt, Chlamydophila pneumoniae J138
uauggaagagagcaagauaau

SEQ ID NO: 2563599 - RNA, 13 nt, Chlamydophila pneumoniae J138
uaugggaggaauu

SEQ ID NO: 2563600 - RNA, 12 nt, Chlamydophila pneumoniae J138
uaugguccuagg

SEQ ID NO: 2563601 - RNA, 20 nt, Chlamydophila pneumoniae J138
uauggucucccucacaagaa

SEQ ID NO: 2563602 - RNA, 24 nt, Chlamydophila pneumoniae J138
uaugugaaagauuauucuagaguu

SEQ ID NO: 2563603 - RNA, 14 nt, Chlamydophila pneumoniae J138
uauguuaaaaauac

SEQ ID NO: 2563604 - RNA, 15 nt, Chlamydophila pneumoniae J138
uauguuuaaagcaua

SEQ ID NO: 2563605 - RNA, 19 nt, Chlamydophila pneumoniae J138
uauguuuucucgaagaaaa

SEQ ID NO: 2563606 - RNA, 23 nt, Chlamydophila pneumoniae J138
uauguuuucucgaagaaaauaaa

SEQ ID NO: 2563607 - RNA, 20 nt, Chlamydophila pneumoniae J138
uauuaaaaauagcuuacuuu

SEQ ID NO: 2563608 - RNA, 15 nt, Chlamydophila pneumoniae J138
uauuaaaaucucuag

SEQ ID NO: 2563609 - RNA, 20 nt, Chlamydophila pneumoniae J138
uauuaaagaugaaguuccca

SEQ ID NO: 2563610 - RNA, 14 nt, Chlamydophila pneumoniae J138
uauuaacccaccag

SEQ ID NO: 2563611 - RNA, 22 nt, Chlamydophila pneumoniae J138
uauuaagggaagaucuugguua

SEQ ID NO: 2563612 - RNA, 15 nt, Chlamydophila pneumoniae J138
uauuacagauuucuu

SEQ ID NO: 2563613 - RNA, 13 nt, Chlamydophila pneumoniae J138
uauuauugaauaa

SEQ ID NO: 2563614 - RNA, 20 nt, Chlamydophila pneumoniae J138
uauucagguucugaaauugu

SEQ ID NO: 2563615 - RNA, 22 nt, Chlamydophila pneumoniae J138
uauucagugucuugaagagauu

SEQ ID NO: 2563616 - RNA, 22 nt, Chlamydophila pneumoniae J138
uauuccauaaaaauguaauuuu

SEQ ID NO: 2563617 - RNA, 13 nt, Chlamydophila pneumoniae J138
uauuccucuuagg

SEQ ID NO: 2563618 - RNA, 17 nt, Chlamydophila pneumoniae J138
uauuccuuggauuucuu

SEQ ID NO: 2563619 - RNA, 18 nt, Chlamydophila pneumoniae J138
uauucuaagcuuauuucu

SEQ ID NO: 2563620 - RNA, 13 nt, Chlamydophila pneumoniae J138
uauucucaggaac

SEQ ID NO: 2563621 - RNA, 19 nt, Chlamydophila pneumoniae J138
uauucugaaauuucugaaa

SEQ ID NO: 2563622 - RNA, 15 nt, Chlamydophila pneumoniae J138
uauucuuuuguaauc

SEQ ID NO: 2563623 - RNA, 20 nt, Chlamydophila pneumoniae J138
uauugaaaaaucccuguucu

SEQ ID NO: 2563624 - RNA, 19 nt, Chlamydophila pneumoniae J138
uauugacuuuggucuucug

SEQ ID NO: 2563625 - RNA, 13 nt, Chlamydophila pneumoniae J138
uauugcaaagcau

SEQ ID NO: 2563626 - RNA, 13 nt, Chlamydophila pneumoniae J138
uauugcagaaucu

SEQ ID NO: 2563627 - RNA, 15 nt, Chlamydophila pneumoniae J138
uauugccuucuucuu

SEQ ID NO: 2563628 - RNA, 20 nt, Chlamydophila pneumoniae J138
uauugcgaacuuuugggccc

SEQ ID NO: 2563629 - RNA, 19 nt, Chlamydophila pneumoniae J138
uauugcggaaauugaauau

SEQ ID NO: 2563630 - RNA, 14 nt, Chlamydophila pneumoniae J138
uauugcucuuguau

SEQ ID NO: 2563631 - RNA, 23 nt, Chlamydophila pneumoniae J138
uauugggaagaaacuucucuagg

SEQ ID NO: 2563632 - RNA, 19 nt, Chlamydophila pneumoniae J138
uauuguguucccucuucuu

SEQ ID NO: 2563633 - RNA, 22 nt, Chlamydophila pneumoniae J138
uauuguguucccucuucuucca

SEQ ID NO: 2563634 - RNA, 14 nt, Chlamydophila pneumoniae J138
uauuguuuuucaau

SEQ ID NO: 2563635 - RNA, 16 nt, Chlamydophila pneumoniae J138
uauuuacgaaaacauc

SEQ ID NO: 2563636 - RNA, 18 nt, Chlamydophila pneumoniae J138
uauuuagagagaaacauc

SEQ ID NO: 2563637 - RNA, 17 nt, Chlamydophila pneumoniae J138
uauuuagcauuucucua

SEQ ID NO: 2563638 - RNA, 12 nt, Chlamydophila pneumoniae J138
uauuucuaaaaa

SEQ ID NO: 2563639 - RNA, 13 nt, Chlamydophila pneumoniae J138
uauuucuauuauu

SEQ ID NO: 2563640 - RNA, 14 nt, Chlamydophila pneumoniae J138
uauuucuauuauuu

SEQ ID NO: 2563641 - RNA, 15 nt, Chlamydophila pneumoniae J138
uauuucucuaucauc

SEQ ID NO: 2563642 - RNA, 17 nt, Chlamydophila pneumoniae J138
uauuucucuaucaucaa

SEQ ID NO: 2563643 - RNA, 12 nt, Chlamydophila pneumoniae J138
uauuugaaauag

SEQ ID NO: 2563644 - RNA, 16 nt, Chlamydophila pneumoniae J138
uauuugaauaaaggac

SEQ ID NO: 2563645 - RNA, 14 nt, Chlamydophila pneumoniae J138
uauuuuaaagucac

SEQ ID NO: 2563646 - RNA, 12 nt, Chlamydophila pneumoniae J138
uauuuuuaaaga

SEQ ID NO: 2563647 - RNA, 13 nt, Chlamydophila pneumoniae J138
uauuuuuaaauaa

SEQ ID NO: 2563648 - RNA, 14 nt, Chlamydophila pneumoniae J138
uauuuuuaaauaca

SEQ ID NO: 2563649 - RNA, 13 nt, Chlamydophila pneumoniae J138
uauuuuuccagaa

SEQ ID NO: 2563650 - RNA, 24 nt, Chlamydophila pneumoniae J138
uauuuuuuacguucuuucuuucua

SEQ ID NO: 2563651 - RNA, 13 nt, Chlamydophila pneumoniae J138
ucaaaaaaaacgc

SEQ ID NO: 2563652 - RNA, 13 nt, Chlamydophila pneumoniae J138
ucaaaaaaaagac

SEQ ID NO: 2563653 - RNA, 12 nt, Chlamydophila pneumoniae J138
ucaaaagaaaag

SEQ ID NO: 2563654 - RNA, 18 nt, Chlamydophila pneumoniae J138
ucaaaagaaaucaaacau

SEQ ID NO: 2563655 - RNA, 16 nt, Chlamydophila pneumoniae J138
ucaaaauagaagccac

SEQ ID NO: 2563656 - RNA, 18 nt, Chlamydophila pneumoniae J138
ucaaaauaucauucacua

SEQ ID NO: 2563657 - RNA, 14 nt, Chlamydophila pneumoniae J138
ucaaaaugcugcuu

SEQ ID NO: 2563658 - RNA, 24 nt, Chlamydophila pneumoniae J138
ucaaaauuuuuaguaauuacagcu

SEQ ID NO: 2563659 - RNA, 17 nt, Chlamydophila pneumoniae J138
ucaaacaucacucagga

SEQ ID NO: 2563660 - RNA, 23 nt, Chlamydophila pneumoniae J138
ucaaaccacggauuuucucuaca

SEQ ID NO: 2563661 - RNA, 17 nt, Chlamydophila pneumoniae J138
ucaaacuccuuuuaaaa

SEQ ID NO: 2563662 - RNA, 18 nt, Chlamydophila pneumoniae J138
ucaaacuccuuuuaaaau

SEQ ID NO: 2563663 - RNA, 16 nt, Chlamydophila pneumoniae J138
ucaaacugauuaguuu

SEQ ID NO: 2563664 - RNA, 19 nt, Chlamydophila pneumoniae J138
ucaaagaacaauaaaaggc

SEQ ID NO: 2563665 - RNA, 20 nt, Chlamydophila pneumoniae J138
ucaaagaacugcauaaucuc

SEQ ID NO: 2563666 - RNA, 11 nt, Chlamydophila pneumoniae J138
ucaaagaaguc

SEQ ID NO: 2563667 - RNA, 16 nt, Chlamydophila pneumoniae J138
ucaaagaauacucuaa

SEQ ID NO: 2563668 - RNA, 15 nt, Chlamydophila pneumoniae J138
ucaaagacucaugaa

SEQ ID NO: 2563669 - RNA, 21 nt, Chlamydophila pneumoniae J138
ucaaagacucaugaaauagug

SEQ ID NO: 2563670 - RNA, 12 nt, Chlamydophila pneumoniae J138
ucaaagauauaa

SEQ ID NO: 2563671 - RNA, 21 nt, Chlamydophila pneumoniae J138
ucaaagauauagauucaugaa

SEQ ID NO: 2563672 - RNA, 22 nt, Chlamydophila pneumoniae J138
ucaaagauauagauucaugaaa

SEQ ID NO: 2563673 - RNA, 17 nt, Chlamydophila pneumoniae J138
ucaaagaugcagauacu

SEQ ID NO: 2563674 - RNA, 14 nt, Chlamydophila pneumoniae J138
ucaaagauuccuaa

SEQ ID NO: 2563675 - RNA, 18 nt, Chlamydophila pneumoniae J138
ucaaagcaaaagucauaa

SEQ ID NO: 2563676 - RNA, 16 nt, Chlamydophila pneumoniae J138
ucaaagcaaagagcaa

SEQ ID NO: 2563677 - RNA, 21 nt, Chlamydophila pneumoniae J138
ucaaaggcaacgcgauuuuca

SEQ ID NO: 2563678 - RNA, 18 nt, Chlamydophila pneumoniae J138
ucaaauacuucuccugaa

SEQ ID NO: 2563679 - RNA, 19 nt, Chlamydophila pneumoniae J138
ucaaauacuucuccugaac

SEQ ID NO: 2563680 - RNA, 23 nt, Chlamydophila pneumoniae J138
ucaaauaggaucucucuuuccuu

SEQ ID NO: 2563681 - RNA, 17 nt, Chlamydophila pneumoniae J138
ucaaauaguucaucaua

SEQ ID NO: 2563682 - RNA, 23 nt, Chlamydophila pneumoniae J138
ucaaauaguucaucauauuuuuc

SEQ ID NO: 2563683 - RNA, 15 nt, Chlamydophila pneumoniae J138
ucaaaucaucaaaaa

SEQ ID NO: 2563684 - RNA, 17 nt, Chlamydophila pneumoniae J138
ucaaauucaaaauagaa

SEQ ID NO: 2563685 - RNA, 19 nt, Chlamydophila pneumoniae J138
ucaaauuccuucucagaaa

SEQ ID NO: 2563686 - RNA, 16 nt, Chlamydophila pneumoniae J138
ucaaauuucaauaaga

SEQ ID NO: 2563687 - RNA, 23 nt, Chlamydophila pneumoniae J138
ucaacaaguucuuggaaaaaagg

SEQ ID NO: 2563688 - RNA, 16 nt, Chlamydophila pneumoniae J138
ucaacacaccauuuuu

SEQ ID NO: 2563689 - RNA, 19 nt, Chlamydophila pneumoniae J138
ucaacacccggcuuuucca

SEQ ID NO: 2563690 - RNA, 13 nt, Chlamydophila pneumoniae J138
ucaacauucuucu

SEQ ID NO: 2563691 - RNA, 20 nt, Chlamydophila pneumoniae J138
ucaaccaaacgucaggcucc

SEQ ID NO: 2563692 - RNA, 16 nt, Chlamydophila pneumoniae J138
ucaaccaagguugcuc

SEQ ID NO: 2563693 - RNA, 13 nt, Chlamydophila pneumoniae J138
ucaacccagcugc

SEQ ID NO: 2563694 - RNA, 23 nt, Chlamydophila pneumoniae J138
ucaacucuccauccucagucucu

SEQ ID NO: 2563695 - RNA, 16 nt, Chlamydophila pneumoniae J138
ucaacugguauagacu

SEQ ID NO: 2563696 - RNA, 21 nt, Chlamydophila pneumoniae J138
ucaacugguauagacuccuua

SEQ ID NO: 2563697 - RNA, 11 nt, Chlamydophila pneumoniae J138
ucaagaaaugc

SEQ ID NO: 2563698 - RNA, 20 nt, Chlamydophila pneumoniae J138
ucaagaaaugcccugucacu

SEQ ID NO: 2563699 - RNA, 13 nt, Chlamydophila pneumoniae J138
ucaagaacaagag

SEQ ID NO: 2563700 - RNA, 21 nt, Chlamydophila pneumoniae J138
ucaagaacaagagcuuguucu

SEQ ID NO: 2563701 - RNA, 17 nt, Chlamydophila pneumoniae J138
ucaagaauaugaacugc

SEQ ID NO: 2563702 - RNA, 22 nt, Chlamydophila pneumoniae J138
ucaagaccuaagcucauaagaa

SEQ ID NO: 2563703 - RNA, 23 nt, Chlamydophila pneumoniae J138
ucaagaccuaagcucauaagaaa

SEQ ID NO: 2563704 - RNA, 17 nt, Chlamydophila pneumoniae J138
ucaagacgacacucaaa

SEQ ID NO: 2563705 - RNA, 20 nt, Chlamydophila pneumoniae J138
ucaagacgacacucaaaucu

SEQ ID NO: 2563706 - RNA, 15 nt, Chlamydophila pneumoniae J138
ucaagacuauagaaa

SEQ ID NO: 2563707 - RNA, 21 nt, Chlamydophila pneumoniae J138
ucaagagauagagauaaguca

SEQ ID NO: 2563708 - RNA, 15 nt, Chlamydophila pneumoniae J138
ucaagagcuuuuaca

SEQ ID NO: 2563709 - RNA, 18 nt, Chlamydophila pneumoniae J138
ucaagaggagugaaagcu

SEQ ID NO: 2563710 - RNA, 23 nt, Chlamydophila pneumoniae J138
ucaagaguuucgaauucaaugag

SEQ ID NO: 2563711 - RNA, 15 nt, Chlamydophila pneumoniae J138
ucaagauaaauccca

SEQ ID NO: 2563712 - RNA, 13 nt, Chlamydophila pneumoniae J138
ucaagaucuucau

SEQ ID NO: 2563713 - RNA, 18 nt, Chlamydophila pneumoniae J138
ucaagaucuucaucacaa

SEQ ID NO: 2563714 - RNA, 14 nt, Chlamydophila pneumoniae J138
ucaagccacagaga

SEQ ID NO: 2563715 - RNA, 23 nt, Chlamydophila pneumoniae J138
cugagcuuuuaguagguaauccc

SEQ ID NO: 2563716 - RNA, 12 nt, Chlamydophila pneumoniae J138
cugaggaaaucg

SEQ ID NO: 2563717 - RNA, 21 nt, Chlamydophila pneumoniae J138
cugaggaaaucgcauuacaaa

SEQ ID NO: 2563718 - RNA, 15 nt, Chlamydophila pneumoniae J138
cugaggacgcagaga

SEQ ID NO: 2563719 - RNA, 17 nt, Chlamydophila pneumoniae J138
cugagggaucuucucua

SEQ ID NO: 2563720 - RNA, 21 nt, Chlamydophila pneumoniae J138
cugagguuauuuaauccaaaa

SEQ ID NO: 2563721 - RNA, 17 nt, Chlamydophila pneumoniae J138
cugaguauuuugcaaau

SEQ ID NO: 2563722 - RNA, 23 nt, Chlamydophila pneumoniae J138
cugagucauaagcucuauuucug

SEQ ID NO: 2563723 - RNA, 13 nt, Chlamydophila pneumoniae J138
cugauaaaauaaa

SEQ ID NO: 2563724 - RNA, 15 nt, Chlamydophila pneumoniae J138
cugauaagaucauag

SEQ ID NO: 2563725 - RNA, 18 nt, Chlamydophila pneumoniae J138
cugauacaucaucagaag

SEQ ID NO: 2563726 - RNA, 21 nt, Chlamydophila pneumoniae J138
cugauagccuccauuuagaca

SEQ ID NO: 2563727 - RNA, 15 nt, Chlamydophila pneumoniae J138
cugaucccuuagaaa

SEQ ID NO: 2563728 - RNA, 21 nt, Chlamydophila pneumoniae J138
cugauccucggcaucuuuggc

SEQ ID NO: 2563729 - RNA, 15 nt, Chlamydophila pneumoniae J138
cugaugaccucaucu

SEQ ID NO: 2563730 - RNA, 16 nt, Chlamydophila pneumoniae J138
cugaugaccucaucuc

SEQ ID NO: 2563731 - RNA, 16 nt, Chlamydophila pneumoniae J138
cugaugccuuuuucuu

SEQ ID NO: 2563732 - RNA, 22 nt, Chlamydophila pneumoniae J138
cugauguugcccuacaauuucc

SEQ ID NO: 2563733 - RNA, 17 nt, Chlamydophila pneumoniae J138
cugauguuuuauagaua

SEQ ID NO: 2563734 - RNA, 20 nt, Chlamydophila pneumoniae J138
cugauuauuucuaaaaaaua

SEQ ID NO: 2563735 - RNA, 14 nt, Chlamydophila pneumoniae J138
cugauucaauugag

SEQ ID NO: 2563736 - RNA, 23 nt, Chlamydophila pneumoniae J138
cugauuccauccugucuauuucu

SEQ ID NO: 2563737 - RNA, 12 nt, Chlamydophila pneumoniae J138
cugauucuccca

SEQ ID NO: 2563738 - RNA, 22 nt, Chlamydophila pneumoniae J138
cugauucucccaauauccagaa

SEQ ID NO: 2563739 - RNA, 23 nt, Chlamydophila pneumoniae J138
cugauucuccgucccccggcucu

SEQ ID NO: 2563740 - RNA, 18 nt, Chlamydophila pneumoniae J138
cugauucuguauaaacaa

SEQ ID NO: 2563741 - RNA, 20 nt, Chlamydophila pneumoniae J138
cugauuuuucaagaccuaag

SEQ ID NO: 2563742 - RNA, 23 nt, Chlamydophila pneumoniae J138
cugcaaacgcaaugauuucucua

SEQ ID NO: 2563743 - RNA, 15 nt, Chlamydophila pneumoniae J138
gauuguaaaaguagc

SEQ ID NO: 2563744 - RNA, 19 nt, Chlamydophila pneumoniae J138
gauuguagagacauagccu

SEQ ID NO: 2563745 - RNA, 17 nt, Chlamydophila pneumoniae J138
gauuguauagcuuacuu

SEQ ID NO: 2563746 - RNA, 18 nt, Chlamydophila pneumoniae J138
gauuguucaaaaauagau

SEQ ID NO: 2563747 - RNA, 19 nt, Chlamydophila pneumoniae J138
gauuuaaaugcaagugcuu

SEQ ID NO: 2563748 - RNA, 15 nt, Chlamydophila pneumoniae J138
gauuuagauuaaaga

SEQ ID NO: 2563749 - RNA, 16 nt, Chlamydophila pneumoniae J138
gauuuagggaagaguu

SEQ ID NO: 2563750 - RNA, 15 nt, Chlamydophila pneumoniae J138
gauuuauguuuucuc

SEQ ID NO: 2563751 - RNA, 16 nt, Chlamydophila pneumoniae J138
gauuuauuuugucuuu

SEQ ID NO: 2563752 - RNA, 15 nt, Chlamydophila pneumoniae J138
gauuuccauagaguu

SEQ ID NO: 2563753 - RNA, 17 nt, Chlamydophila pneumoniae J138
gauuuccccuucagagg

SEQ ID NO: 2563754 - RNA, 18 nt, Chlamydophila pneumoniae J138
gauuuccuuaagcuucug

SEQ ID NO: 2563755 - RNA, 23 nt, Chlamydophila pneumoniae J138
gauuucguauagcuggcaaugau

SEQ ID NO: 2563756 - RNA, 14 nt, Chlamydophila pneumoniae J138
gauuucuucuucag

SEQ ID NO: 2563757 - RNA, 15 nt, Chlamydophila pneumoniae J138
gauuucuucuucaga

SEQ ID NO: 2563758 - RNA, 16 nt, Chlamydophila pneumoniae J138
gauuucuucuucagag

SEQ ID NO: 2563759 - RNA, 20 nt, Chlamydophila pneumoniae J138
gauuucuuuuucagcuucua

SEQ ID NO: 2563760 - RNA, 13 nt, Chlamydophila pneumoniae J138
gauuuuaaaauga

SEQ ID NO: 2563761 - RNA, 20 nt, Chlamydophila pneumoniae J138
gauuuuacucccugaaguug

SEQ ID NO: 2563762 - RNA, 12 nt, Chlamydophila pneumoniae J138
gauuuuccauua

SEQ ID NO: 2563763 - RNA, 17 nt, Chlamydophila pneumoniae J138
gauuuucuagaaacaac

SEQ ID NO: 2563764 - RNA, 11 nt, Chlamydophila pneumoniae J138
gauuuucucua

SEQ ID NO: 2563765 - RNA, 20 nt, Chlamydophila pneumoniae J138
gauuuuuagaauagaagauc

SEQ ID NO: 2563766 - RNA, 14 nt, Chlamydophila pneumoniae J138
gauuuuucaagacc

SEQ ID NO: 2563767 - RNA, 21 nt, Chlamydophila pneumoniae J138
gauuuuuuaaccucuuuucuu

SEQ ID NO: 2563768 - RNA, 13 nt, Chlamydophila pneumoniae J138
gcaaaaagcuucu

SEQ ID NO: 2563769 - RNA, 17 nt, Chlamydophila pneumoniae J138
gcaaaaaguuucaaucu

SEQ ID NO: 2563770 - RNA, 17 nt, Chlamydophila pneumoniae J138
gcaaaaaugaaagaaac

SEQ ID NO: 2563771 - RNA, 21 nt, Chlamydophila pneumoniae J138
gcaaaaugcgaggaaaaagga

SEQ ID NO: 2563772 - RNA, 22 nt, Chlamydophila pneumoniae J138
gcaaaaugguuguuaggacgug

SEQ ID NO: 2563773 - RNA, 20 nt, Chlamydophila pneumoniae J138
gcaaaccgagacuauuuugg

SEQ ID NO: 2563774 - RNA, 21 nt, Chlamydophila pneumoniae J138
gcaaacgcaaugauuucucua

SEQ ID NO: 2563775 - RNA, 21 nt, Chlamydophila pneumoniae J138
gcaaacuccccaguuuuccau

SEQ ID NO: 2563776 - RNA, 23 nt, Chlamydophila pneumoniae J138
gcaaagaacucaacuuuuuuacu

SEQ ID NO: 2563777 - RNA, 19 nt, Chlamydophila pneumoniae J138
gcaaagacauccaagccuc

SEQ ID NO: 2563778 - RNA, 14 nt, Chlamydophila pneumoniae J138
gcaaagauaaagaa

SEQ ID NO: 2563779 - RNA, 14 nt, Chlamydophila pneumoniae J138
gcaaagaucaguuu

SEQ ID NO: 2563780 - RNA, 13 nt, Chlamydophila pneumoniae J138
gcaaagauuucca

SEQ ID NO: 2563781 - RNA, 15 nt, Chlamydophila pneumoniae J138
gcaaaggaaaagaua

SEQ ID NO: 2563782 - RNA, 21 nt, Chlamydophila pneumoniae J138
gcaaaggaccacaauuccuaa

SEQ ID NO: 2563783 - RNA, 22 nt, Chlamydophila pneumoniae J138
gcaaaggaccacaauuccuaaa

SEQ ID NO: 2563784 - RNA, 16 nt, Chlamydophila pneumoniae J138
gcaaaguaucaacguu

SEQ ID NO: 2563785 - RNA, 13 nt, Chlamydophila pneumoniae J138
gcaaauaaaacaa

SEQ ID NO: 2563786 - RNA, 19 nt, Chlamydophila pneumoniae J138
gcaaauccuguagaaacau

SEQ ID NO: 2563787 - RNA, 15 nt, Chlamydophila pneumoniae J138
gcaaaucuaaaaccu

SEQ ID NO: 2563788 - RNA, 18 nt, Chlamydophila pneumoniae J138
gcaaauuucauuuagaca

SEQ ID NO: 2563789 - RNA, 12 nt, Chlamydophila pneumoniae J138
gcaacaaccaaa

SEQ ID NO: 2563790 - RNA, 20 nt, Chlamydophila pneumoniae J138
gcaacaaccaaaagaauucc

SEQ ID NO: 2563791 - RNA, 19 nt, Chlamydophila pneumoniae J138
gcaacaacgccuacaugga

SEQ ID NO: 2563792 - RNA, 15 nt, Chlamydophila pneumoniae J138
gcaacaaucuuucuu

SEQ ID NO: 2563793 - RNA, 16 nt, Chlamydophila pneumoniae J138
gcaacaaucuuucuuc

SEQ ID NO: 2563794 - RNA, 18 nt, Chlamydophila pneumoniae J138
gcaacaaucuuucuucua

SEQ ID NO: 2563795 - RNA, 16 nt, Chlamydophila pneumoniae J138
gcaacagguaagacga

SEQ ID NO: 2563796 - RNA, 17 nt, Chlamydophila pneumoniae J138
gcaacauccauucuuaa

SEQ ID NO: 2563797 - RNA, 19 nt, Chlamydophila pneumoniae J138
gcaaccucugcauguugca

SEQ ID NO: 2563798 - RNA, 16 nt, Chlamydophila pneumoniae J138
gcaacuaaacucucca

SEQ ID NO: 2563799 - RNA, 18 nt, Chlamydophila pneumoniae J138
gcaacuaaacucuccaaa

SEQ ID NO: 2563800 - RNA, 13 nt, Chlamydophila pneumoniae J138
gcaacucuucagc

SEQ ID NO: 2563801 - RNA, 18 nt, Chlamydophila pneumoniae J138
gcaagaaguguauuuaaa

SEQ ID NO: 2563802 - RNA, 12 nt, Chlamydophila pneumoniae J138
gcaagagcuccg

SEQ ID NO: 2563803 - RNA, 17 nt, Chlamydophila pneumoniae J138
gcaagagcucuugagaa

SEQ ID NO: 2563804 - RNA, 15 nt, Chlamydophila pneumoniae J138
gcaagaucuaacuuc

SEQ ID NO: 2563805 - RNA, 18 nt, Chlamydophila pneumoniae J138
gcaagcacuuguuuuuuc

SEQ ID NO: 2563806 - RNA, 23 nt, Chlamydophila pneumoniae J138
gcaagcccuccaguuuuacgaac

SEQ ID NO: 2563807 - RNA, 17 nt, Chlamydophila pneumoniae J138
gcaagcgcuagugcaag

SEQ ID NO: 2563808 - RNA, 21 nt, Chlamydophila pneumoniae J138
gcaagcucuggauugaaagag

SEQ ID NO: 2563809 - RNA, 17 nt, Chlamydophila pneumoniae J138
gcaaggggaguuuucuu

SEQ ID NO: 2563810 - RNA, 18 nt, Chlamydophila pneumoniae J138
gcaaguaaucaugauaaa

SEQ ID NO: 2563811 - RNA, 22 nt, Chlamydophila pneumoniae J138
gcaaguaaucaugauaaaaauu

SEQ ID NO: 2563812 - RNA, 14 nt, Chlamydophila pneumoniae J138
gcaagucauaaaga

SEQ ID NO: 2563813 - RNA, 17 nt, Chlamydophila pneumoniae J138
gcaagucgguaauaccu

SEQ ID NO: 2563814 - RNA, 21 nt, Chlamydophila pneumoniae J138
gcaauacaccaagggaugcca

SEQ ID NO: 2563815 - RNA, 14 nt, Chlamydophila pneumoniae J138
gcaauauauccagg

SEQ ID NO: 2563816 - RNA, 23 nt, Chlamydophila pneumoniae J138
gcaauauuuugacguaaugcaga

SEQ ID NO: 2563817 - RNA, 21 nt, Chlamydophila pneumoniae J138
gcaaucagugcugccaugaca

SEQ ID NO: 2563818 - RNA, 19 nt, Chlamydophila pneumoniae J138
gcaaucguuucuauagacu

SEQ ID NO: 2563819 - RNA, 23 nt, Chlamydophila pneumoniae J138
gcaaucugcagguaagggaugcu

SEQ ID NO: 2563820 - RNA, 18 nt, Chlamydophila pneumoniae J138
gcaaucuuugaagcucga

SEQ ID NO: 2563821 - RNA, 22 nt, Chlamydophila pneumoniae J138
gcaaucuuugaucgcuugugca

SEQ ID NO: 2563822 - RNA, 15 nt, Chlamydophila pneumoniae J138
gcaaugcuucuucag

SEQ ID NO: 2563823 - RNA, 18 nt, Chlamydophila pneumoniae J138
gcaauuguuaaaagaagg

SEQ ID NO: 2563824 - RNA, 18 nt, Chlamydophila pneumoniae J138
gcaauuucuccuaggucu

SEQ ID NO: 2563825 - RNA, 19 nt, Chlamydophila pneumoniae J138
gcaauuucuccuaggucua

SEQ ID NO: 2563826 - RNA, 16 nt, Chlamydophila pneumoniae J138
gcacaaaauaaaaccc

SEQ ID NO: 2563827 - RNA, 17 nt, Chlamydophila pneumoniae J138
gcacaaucgcaucaaaa

SEQ ID NO: 2563828 - RNA, 20 nt, Chlamydophila pneumoniae J138
gcacacugcuuacaauugaa

SEQ ID NO: 2563829 - RNA, 14 nt, Chlamydophila pneumoniae J138
gcacagcaaugaca

SEQ ID NO: 2563830 - RNA, 13 nt, Chlamydophila pneumoniae J138
gcacauaagauga

SEQ ID NO: 2563831 - RNA, 23 nt, Chlamydophila pneumoniae J138
gcacaucgcguauagaugcagca

SEQ ID NO: 2563832 - RNA, 16 nt, Chlamydophila pneumoniae J138
gcacauucaagauucc

SEQ ID NO: 2563833 - RNA, 23 nt, Chlamydophila pneumoniae J138
gcaccaacacuuuuaaagauaag

SEQ ID NO: 2563834 - RNA, 19 nt, Chlamydophila pneumoniae J138
gcaccacgaccuacaccau

SEQ ID NO: 2563835 - RNA, 13 nt, Chlamydophila pneumoniae J138
gcaccauaauaua

SEQ ID NO: 2563836 - RNA, 23 nt, Chlamydophila pneumoniae J138
gcacccaaacugaugccaagaaa

SEQ ID NO: 2563837 - RNA, 17 nt, Chlamydophila pneumoniae J138
gcaccuuuaggaagcug

SEQ ID NO: 2563838 - RNA, 18 nt, Chlamydophila pneumoniae J138
gcaccuuuaggaagcugu

SEQ ID NO: 2563839 - RNA, 15 nt, Chlamydophila pneumoniae J138
gcacgagagccucgg

SEQ ID NO: 2563840 - RNA, 18 nt, Chlamydophila pneumoniae J138
gcacggauauucuuuagg

SEQ ID NO: 2563841 - RNA, 14 nt, Chlamydophila pneumoniae J138
gcacgucugcaccu

SEQ ID NO: 2563842 - RNA, 22 nt, Chlamydophila pneumoniae J138
gcacugacuuuaugaucucccg

SEQ ID NO: 2563843 - RNA, 17 nt, Chlamydophila pneumoniae J138
gccagagauucuucaca

SEQ ID NO: 2563844 - RNA, 21 nt, Chlamydophila pneumoniae J138
gccagcgaucacauagaaaac

SEQ ID NO: 2563845 - RNA, 23 nt, Chlamydophila pneumoniae J138
gccaggagacuaaaagaauaaua

SEQ ID NO: 2563846 - RNA, 20 nt, Chlamydophila pneumoniae J138
gccaggagagcuaacagcac

SEQ ID NO: 2563847 - RNA, 22 nt, Chlamydophila pneumoniae J138
gccaguuacugucugcaaagag

SEQ ID NO: 2563848 - RNA, 15 nt, Chlamydophila pneumoniae J138
gccaguucuugaaac

SEQ ID NO: 2563849 - RNA, 13 nt, Chlamydophila pneumoniae J138
gccauaauaaagg

SEQ ID NO: 2563850 - RNA, 14 nt, Chlamydophila pneumoniae J138
gccaucaucaccag

SEQ ID NO: 2563851 - RNA, 23 nt, Chlamydophila pneumoniae J138
gccauccuuuuuguaguaagauu

SEQ ID NO: 2563852 - RNA, 11 nt, Chlamydophila pneumoniae J138
gccauuagaau

SEQ ID NO: 2563853 - RNA, 15 nt, Chlamydophila pneumoniae J138
gccauucuuaucugc

SEQ ID NO: 2563854 - RNA, 16 nt, Chlamydophila pneumoniae J138
gccauuuucuaagaga

SEQ ID NO: 2563855 - RNA, 14 nt, Chlamydophila pneumoniae J138
gcccaaagcuaaaa

SEQ ID NO: 2563856 - RNA, 18 nt, Chlamydophila pneumoniae J138
gcccagauucugaagaga

SEQ ID NO: 2563857 - RNA, 16 nt, Chlamydophila pneumoniae J138
gcccauaaaggcgucg

SEQ ID NO: 2563858 - RNA, 21 nt, Chlamydophila pneumoniae J138
gccccaugaaucacagcgcug

SEQ ID NO: 2563859 - RNA, 16 nt, Chlamydophila pneumoniae J138
gcccccucccccacca

SEQ ID NO: 2563860 - RNA, 16 nt, Chlamydophila pneumoniae J138
gccccuccgauugcua

SEQ ID NO: 2563861 - RNA, 22 nt, Chlamydophila pneumoniae J138
gccccuuaaagagaaucuccuc

SEQ ID NO: 2563862 - RNA, 23 nt, Chlamydophila pneumoniae J138
gcccgaaucuuucaaaagaaauc

SEQ ID NO: 2563863 - RNA, 15 nt, Chlamydophila pneumoniae J138
gcccuacgaauccaa

SEQ ID NO: 2563864 - RNA, 15 nt, Chlamydophila pneumoniae J138
gcccuagauagcaaa

SEQ ID NO: 2563865 - RNA, 14 nt, Chlamydophila pneumoniae J138
gcccuauaguauaa

SEQ ID NO: 2563866 - RNA, 21 nt, Chlamydophila pneumoniae J138
gcccucauccccucagaaagg

SEQ ID NO: 2563867 - RNA, 12 nt, Chlamydophila pneumoniae J138
gcccucuucacu

SEQ ID NO: 2563868 - RNA, 19 nt, Chlamydophila pneumoniae J138
gcccugucacuaucuucua

SEQ ID NO: 2563869 - RNA, 14 nt, Chlamydophila pneumoniae J138
gcccuucaggacau

SEQ ID NO: 2563870 - RNA, 18 nt, Chlamydophila pneumoniae J138
gcccuugaaucauagaga

SEQ ID NO: 2563871 - RNA, 16 nt, Chlamydophila pneumoniae J138
gccgaaccaaaaugag

SEQ ID NO: 2563872 - RNA, 19 nt, Chlamydophila pneumoniae J138
gccgacucuacaucuucuu

SEQ ID NO: 2563873 - RNA, 14 nt, Chlamydophila pneumoniae J138
gccggcgguggaaa

SEQ ID NO: 2563874 - RNA, 21 nt, Chlamydophila pneumoniae J138
gccguauagauuuuccgcaaa

SEQ ID NO: 2563875 - RNA, 21 nt, Chlamydophila pneumoniae J138
gccgugccuauagaaauuaga

SEQ ID NO: 2563876 - RNA, 16 nt, Chlamydophila pneumoniae J138
gccgugcucuuauguu

SEQ ID NO: 2563877 - RNA, 16 nt, Chlamydophila pneumoniae J138
gccuaaagagauguag

SEQ ID NO: 2563878 - RNA, 19 nt, Chlamydophila pneumoniae J138
gccuaaagcuccgagaaac

SEQ ID NO: 2563879 - RNA, 20 nt, Chlamydophila pneumoniae J138
gccuaaagcuccgagaaaca

SEQ ID NO: 2563880 - RNA, 22 nt, Chlamydophila pneumoniae J138
gccuaaagcuccgagaaacaac

SEQ ID NO: 2563881 - RNA, 12 nt, Chlamydophila pneumoniae J138
gccuacaauacu

SEQ ID NO: 2563882 - RNA, 13 nt, Chlamydophila pneumoniae J138
gccuaccaaaguu

SEQ ID NO: 2563883 - RNA, 14 nt, Chlamydophila pneumoniae J138
gccuagcuuucuug

SEQ ID NO: 2563884 - RNA, 18 nt, Chlamydophila pneumoniae J138
gccuauagaaauuagagu

SEQ ID NO: 2563885 - RNA, 17 nt, Chlamydophila pneumoniae J138
gccuauagauuccccaa

SEQ ID NO: 2563886 - RNA, 12 nt, Chlamydophila pneumoniae J138
gccucauugccg

SEQ ID NO: 2563887 - RNA, 21 nt, Chlamydophila pneumoniae J138
gccuccauuuagacaagacac

SEQ ID NO: 2563888 - RNA, 17 nt, Chlamydophila pneumoniae J138
gccuccucaagauaaau

SEQ ID NO: 2563889 - RNA, 15 nt, Chlamydophila pneumoniae J138
gccuccuucauucac

SEQ ID NO: 2563890 - RNA, 13 nt, Chlamydophila pneumoniae J138
gccugaaauccug

SEQ ID NO: 2563891 - RNA, 22 nt, Chlamydophila pneumoniae J138
gccugacgauaguacuuauccu

SEQ ID NO: 2563892 - RNA, 18 nt, Chlamydophila pneumoniae J138
gccugagaccauaaaauc

SEQ ID NO: 2563893 - RNA, 18 nt, Chlamydophila pneumoniae J138
gccugaugucuccauaca

SEQ ID NO: 2563894 - RNA, 17 nt, Chlamydophila pneumoniae J138
gccuggaaagcuucugg

SEQ ID NO: 2563895 - RNA, 22 nt, Chlamydophila pneumoniae J138
gccuggaggcgguggcaugcca

SEQ ID NO: 2563896 - RNA, 19 nt, Chlamydophila pneumoniae J138
gccuggccaucaucaccag

SEQ ID NO: 2563897 - RNA, 23 nt, Chlamydophila pneumoniae J138
gccuggggaucuuaggaaauuug

SEQ ID NO: 2563898 - RNA, 18 nt, Chlamydophila pneumoniae J138
gccuguaaagaaggaggu

SEQ ID NO: 2563899 - RNA, 20 nt, Chlamydophila pneumoniae J138
gccuguaauugauguuccuu

SEQ ID NO: 2563900 - RNA, 22 nt, Chlamydophila pneumoniae J138
gccugucuauaaaauaaauuuu

SEQ ID NO: 2563901 - RNA, 21 nt, Chlamydophila pneumoniae J138
gccugucuuaucuaaagaaau

SEQ ID NO: 2563902 - RNA, 15 nt, Chlamydophila pneumoniae J138
gccuuacggccccug

SEQ ID NO: 2563903 - RNA, 17 nt, Chlamydophila pneumoniae J138
gccuuagcagcacccau

SEQ ID NO: 2563904 - RNA, 20 nt, Chlamydophila pneumoniae J138
gccuucagcaacuaaagcau

SEQ ID NO: 2563905 - RNA, 17 nt, Chlamydophila pneumoniae J138
gccuugauugaacaguc

SEQ ID NO: 2563906 - RNA, 18 nt, Chlamydophila pneumoniae J138
gccuuuagggaaaaagua

SEQ ID NO: 2563907 - RNA, 13 nt, Chlamydophila pneumoniae J138
gccuuuauauaaa

SEQ ID NO: 2563908 - RNA, 12 nt, Chlamydophila pneumoniae J138
gccuuuucagau

SEQ ID NO: 2563909 - RNA, 11 nt, Chlamydophila pneumoniae J138
gccuuuuucuu

SEQ ID NO: 2563910 - RNA, 15 nt, Chlamydophila pneumoniae J138
gcgaagggaggagaa

SEQ ID NO: 2563911 - RNA, 18 nt, Chlamydophila pneumoniae J138
gcgaauccagaauuuucu

SEQ ID NO: 2563912 - RNA, 15 nt, Chlamydophila pneumoniae J138
gcgaaugucguuaaa

SEQ ID NO: 2563913 - RNA, 17 nt, Chlamydophila pneumoniae J138
gcgaaugucguuaaaaa

SEQ ID NO: 2563914 - RNA, 14 nt, Chlamydophila pneumoniae J138
gcgacaagacaaug

SEQ ID NO: 2563915 - RNA, 23 nt, Chlamydophila pneumoniae J138
gcgagccauagaggaaugauccc

SEQ ID NO: 2563916 - RNA, 16 nt, Chlamydophila pneumoniae J138
gcgaguaccucaucuc

SEQ ID NO: 2563917 - RNA, 16 nt, Chlamydophila pneumoniae J138
gcgauacaauaaacaa

SEQ ID NO: 2563918 - RNA, 18 nt, Chlamydophila pneumoniae J138
gcgcaccccaagcucaag

SEQ ID NO: 2563919 - RNA, 12 nt, Chlamydophila pneumoniae J138
gcgccuccaccu

SEQ ID NO: 2563920 - RNA, 18 nt, Chlamydophila pneumoniae J138
gcgccuccaccugcagcg

SEQ ID NO: 2563921 - RNA, 13 nt, Chlamydophila pneumoniae J138
gcgcuacagugac

SEQ ID NO: 2563922 - RNA, 21 nt, Chlamydophila pneumoniae J138
gcgcuaccuuaguuuuuucua

SEQ ID NO: 2563923 - RNA, 14 nt, Chlamydophila pneumoniae J138
gcgcuaucaucauu

SEQ ID NO: 2563924 - RNA, 14 nt, Chlamydophila pneumoniae J138
gcgcucuacaaaug

SEQ ID NO: 2563925 - RNA, 15 nt, Chlamydophila pneumoniae J138
gcgcugugaggaaaa

SEQ ID NO: 2563926 - RNA, 12 nt, Chlamydophila pneumoniae J138
gcggaacucauc

SEQ ID NO: 2563927 - RNA, 16 nt, Chlamydophila pneumoniae J138
gcggaagcaccgccug

SEQ ID NO: 2563928 - RNA, 20 nt, Chlamydophila pneumoniae J138
gcggaauacuucuccucgca

SEQ ID NO: 2563929 - RNA, 15 nt, Chlamydophila pneumoniae J138
gcggacuuuagcgcu

SEQ ID NO: 2563930 - RNA, 21 nt, Chlamydophila pneumoniae J138
gcggcauggacaauauagaaa

SEQ ID NO: 2563931 - RNA, 15 nt, Chlamydophila pneumoniae J138
gcgggcucaaagaaa

SEQ ID NO: 2563932 - RNA, 23 nt, Chlamydophila pneumoniae J138
gcgguggaaaaggaggaggagca

SEQ ID NO: 2563933 - RNA, 16 nt, Chlamydophila pneumoniae J138
gcgguugccuuucucu

SEQ ID NO: 2563934 - RNA, 16 nt, Chlamydophila pneumoniae J138
gcgguuuuggauagaa

SEQ ID NO: 2563935 - RNA, 19 nt, Chlamydophila pneumoniae J138
gcgucaauaagcuugccag

SEQ ID NO: 2563936 - RNA, 22 nt, Chlamydophila pneumoniae J138
gcgucaauaagcuugccagcag

SEQ ID NO: 2563937 - RNA, 17 nt, Chlamydophila pneumoniae J138
gcgucguaaucuuuuuu

SEQ ID NO: 2563938 - RNA, 13 nt, Chlamydophila pneumoniae J138
gcgugccuuuuuu

SEQ ID NO: 2563939 - RNA, 18 nt, Chlamydophila pneumoniae J138
gcguucuugaaucuucaa

SEQ ID NO: 2563940 - RNA, 22 nt, Chlamydophila pneumoniae J138
gcguugauuccaaugacgggag

SEQ ID NO: 2563941 - RNA, 14 nt, Chlamydophila pneumoniae J138
gcguugcuaagcau

SEQ ID NO: 2563942 - RNA, 21 nt, Chlamydophila pneumoniae J138
gcguuucgacgagaaggaaga

SEQ ID NO: 2563943 - RNA, 18 nt, Chlamydophila pneumoniae J138
gcguuuuuugaaaauuuu

SEQ ID NO: 2563944 - RNA, 22 nt, Chlamydophila pneumoniae J138
gcguuuuuuuugauuucagaag

SEQ ID NO: 2563945 - RNA, 19 nt, Chlamydophila pneumoniae J138
gcuaaacuuuuuuucaaau

SEQ ID NO: 2563946 - RNA, 18 nt, Chlamydophila pneumoniae J138
gcuaaagcaggagcauca

SEQ ID NO: 2563947 - RNA, 22 nt, Chlamydophila pneumoniae J138
gcuaaagcaggagcaucauuaa

SEQ ID NO: 2563948 - RNA, 18 nt, Chlamydophila pneumoniae J138
gcuaaaggaucauuaaag

SEQ ID NO: 2563949 - RNA, 22 nt, Chlamydophila pneumoniae J138
gcuaaaguagaauccuucuccc

SEQ ID NO: 2563950 - RNA, 24 nt, Chlamydophila pneumoniae J138
gcuaaagugaugccuggacugcug

SEQ ID NO: 2563951 - RNA, 17 nt, Chlamydophila pneumoniae J138
gcuaacaccucuucaaa

SEQ ID NO: 2563952 - RNA, 22 nt, Chlamydophila pneumoniae J138
gcuaacagaaucugguuuaaua

SEQ ID NO: 2563953 - RNA, 21 nt, Chlamydophila pneumoniae J138
gcuaacgcagcuuuagcuuuu

SEQ ID NO: 2563954 - RNA, 16 nt, Chlamydophila pneumoniae J138
gcuaagaucuuuagaa

SEQ ID NO: 2563955 - RNA, 21 nt, Chlamydophila pneumoniae J138
gcuaagaucuuuagaauaaga

SEQ ID NO: 2563956 - RNA, 12 nt, Chlamydophila pneumoniae J138
gcuaaggauucc

SEQ ID NO: 2563957 - RNA, 17 nt, Chlamydophila pneumoniae J138
gcuaaucaauccaagaa

SEQ ID NO: 2563958 - RNA, 19 nt, Chlamydophila pneumoniae J138
gcuaaucauagccaucaua

SEQ ID NO: 2563959 - RNA, 14 nt, Chlamydophila pneumoniae J138
gcuaaucauuagag

SEQ ID NO: 2563960 - RNA, 19 nt, Chlamydophila pneumoniae J138
gcuaauuuaaaugccuuaa

SEQ ID NO: 2563961 - RNA, 17 nt, Chlamydophila pneumoniae J138
gcuacaaggucuuuucc

SEQ ID NO: 2563962 - RNA, 19 nt, Chlamydophila pneumoniae J138
gcuacaaggucuuuuccug

SEQ ID NO: 2563963 - RNA, 21 nt, Chlamydophila pneumoniae J138
gcuacauaguuuuuauuuuua

SEQ ID NO: 2563964 - RNA, 22 nt, Chlamydophila pneumoniae J138
gcuaccauuaaggaaucccaag

SEQ ID NO: 2563965 - RNA, 14 nt, Chlamydophila pneumoniae J138
gcuaccuagggucu

SEQ ID NO: 2563966 - RNA, 16 nt, Chlamydophila pneumoniae J138
gcuacguacaauuaaa

SEQ ID NO: 2563967 - RNA, 19 nt, Chlamydophila pneumoniae J138
gcuacgugaucaaaauuau

SEQ ID NO: 2563968 - RNA, 14 nt, Chlamydophila pneumoniae J138
gcuacuuuaagacc

SEQ ID NO: 2563969 - RNA, 15 nt, Chlamydophila pneumoniae J138
gcuagaaaaucauac

SEQ ID NO: 2563970 - RNA, 19 nt, Chlamydophila pneumoniae J138
gcuagagcacauagaaaca

SEQ ID NO: 2563971 - RNA, 16 nt, Chlamydophila pneumoniae J138
gcuagagcagcuguag

SEQ ID NO: 2563972 - RNA, 17 nt, Chlamydophila pneumoniae J138
gcuagaggcaaacaggu

SEQ ID NO: 2563973 - RNA, 22 nt, Chlamydophila pneumoniae J138
gcuagaucacaagaaagaaugg

SEQ ID NO: 2563974 - RNA, 13 nt, Chlamydophila pneumoniae J138
gcuagcuccagca

SEQ ID NO: 2563975 - RNA, 12 nt, Chlamydophila pneumoniae J138
gcuagguagugu

SEQ ID NO: 2563976 - RNA, 16 nt, Chlamydophila pneumoniae J138
gcuagugcgaugggaa

SEQ ID NO: 2563977 - RNA, 14 nt, Chlamydophila pneumoniae J138
gcuaguuuaauagu

SEQ ID NO: 2563978 - RNA, 17 nt, Chlamydophila pneumoniae J138
gcuauaccuauauagag

SEQ ID NO: 2563979 - RNA, 18 nt, Chlamydophila pneumoniae J138
gcuauagauacuuugcaa

SEQ ID NO: 2563980 - RNA, 20 nt, Chlamydophila pneumoniae J138
gcuaucagcuggguaagucc

SEQ ID NO: 2563981 - RNA, 18 nt, Chlamydophila pneumoniae J138
gcuaucccacuaacaaga

SEQ ID NO: 2563982 - RNA, 13 nt, Chlamydophila pneumoniae J138
gcuaucuccagaa

SEQ ID NO: 2563983 - RNA, 13 nt, Chlamydophila pneumoniae J138
gcuaugaugagaa

SEQ ID NO: 2563984 - RNA, 17 nt, Chlamydophila pneumoniae J138
gcuauuccauaaaaaug

SEQ ID NO: 2563985 - RNA, 22 nt, Chlamydophila pneumoniae J138
gcuauuuuccucuauauuuuuu

SEQ ID NO: 2563986 - RNA, 21 nt, Chlamydophila pneumoniae J138
gcucaaaaaguuccauagagu

SEQ ID NO: 2563987 - RNA, 20 nt, Chlamydophila pneumoniae J138
gcucaaaucucauuccagca

SEQ ID NO: 2563988 - RNA, 21 nt, Chlamydophila pneumoniae J138
gcucacgagucccuucuuuca

SEQ ID NO: 2563989 - RNA, 22 nt, Chlamydophila pneumoniae J138
gcucagcuaauuuaaaugccuu

SEQ ID NO: 2563990 - RNA, 16 nt, Chlamydophila pneumoniae J138
gcucaguaaauauuuu

SEQ ID NO: 2563991 - RNA, 14 nt, Chlamydophila pneumoniae J138
gcucauaacccaaa

SEQ ID NO: 2563992 - RNA, 14 nt, Chlamydophila pneumoniae J138
gcucauaagaaauu

SEQ ID NO: 2563993 - RNA, 17 nt, Chlamydophila pneumoniae J138
gcucaucggaucuuuuc

SEQ ID NO: 2563994 - RNA, 18 nt, Chlamydophila pneumoniae J138
gcucaucggaucuuuucu

SEQ ID NO: 2563995 - RNA, 19 nt, Chlamydophila pneumoniae J138
gcucaucggaucuuuucuu

SEQ ID NO: 2563996 - RNA, 14 nt, Chlamydophila pneumoniae J138
gcuccaaaauaauc

SEQ ID NO: 2563997 - RNA, 19 nt, Chlamydophila pneumoniae J138
gcuccaaugggcagguuuc

SEQ ID NO: 2563998 - RNA, 17 nt, Chlamydophila pneumoniae J138
gcuccaauuuucuucag

SEQ ID NO: 2563999 - RNA, 23 nt, Chlamydophila pneumoniae J138
gcuccacggaaauauucuuggaa

SEQ ID NO: 2564000 - RNA, 21 nt, Chlamydophila pneumoniae J138
gcucccaugugcugaagacca

SEQ ID NO: 2564001 - RNA, 18 nt, Chlamydophila pneumoniae J138
gcucccauuucuggagaa

SEQ ID NO: 2564002 - RNA, 16 nt, Chlamydophila pneumoniae J138
gcucccguuccuuuag

SEQ ID NO: 2564003 - RNA, 22 nt, Chlamydophila pneumoniae J138
gcucccuccuccucgucuaaag

SEQ ID NO: 2564004 - RNA, 13 nt, Chlamydophila pneumoniae J138
gcuccuaaagcau

SEQ ID NO: 2564005 - RNA, 17 nt, Chlamydophila pneumoniae J138
gcuccuacaguccuggg

SEQ ID NO: 2564006 - RNA, 14 nt, Chlamydophila pneumoniae J138
gcuccugaauaugc

SEQ ID NO: 2564007 - RNA, 17 nt, Chlamydophila pneumoniae J138
gcuccugcaaaaaacca

SEQ ID NO: 2564008 - RNA, 14 nt, Chlamydophila pneumoniae J138
gcuccuugacuaaa

SEQ ID NO: 2564009 - RNA, 16 nt, Chlamydophila pneumoniae J138
gcucggaaaucaggga

SEQ ID NO: 2564010 - RNA, 21 nt, Chlamydophila pneumoniae J138
gcucgguacgucuuucaccaa

SEQ ID NO: 2564011 - RNA, 16 nt, Chlamydophila pneumoniae J138
gcucguaauccuucuu

SEQ ID NO: 2564012 - RNA, 12 nt, Chlamydophila pneumoniae J138
gcucguacuguu

SEQ ID NO: 2564013 - RNA, 19 nt, Chlamydophila pneumoniae J138
gcucgugcgacugcucuuu

SEQ ID NO: 2564014 - RNA, 19 nt, Chlamydophila pneumoniae J138
gcucuaaacucucuuccuu

SEQ ID NO: 2564015 - RNA, 21 nt, Chlamydophila pneumoniae J138
gcucuaaacucucuuccuucu

SEQ ID NO: 2564016 - RNA, 23 nt, Chlamydophila pneumoniae J138
gcucuaaacucucuuccuucucc

SEQ ID NO: 2564017 - RNA, 18 nt, Chlamydophila pneumoniae J138
gcucuaagcugugcauuu

SEQ ID NO: 2564018 - RNA, 22 nt, Chlamydophila pneumoniae J138
gcucuacaagcucgguacgucu

SEQ ID NO: 2564019 - RNA, 18 nt, Chlamydophila pneumoniae J138
gcucuagauauucugauu

SEQ ID NO: 2564020 - RNA, 17 nt, Chlamydophila pneumoniae J138
gcucuagcuaacauaaa

SEQ ID NO: 2564021 - RNA, 19 nt, Chlamydophila pneumoniae J138
gcucucaaggucacagcau

SEQ ID NO: 2564022 - RNA, 12 nt, Chlamydophila pneumoniae J138
gcucuccauggc

SEQ ID NO: 2564023 - RNA, 18 nt, Chlamydophila pneumoniae J138
gcucuccugcaaaaaguu

SEQ ID NO: 2564024 - RNA, 12 nt, Chlamydophila pneumoniae J138
gcucuccuucag

SEQ ID NO: 2564025 - RNA, 15 nt, Chlamydophila pneumoniae J138
gcucucgcuaagcaa

SEQ ID NO: 2564026 - RNA, 12 nt, Chlamydophila pneumoniae J138
gcucucuagauu

SEQ ID NO: 2564027 - RNA, 15 nt, Chlamydophila pneumoniae J138
gcucucuccaugagc

SEQ ID NO: 2564028 - RNA, 16 nt, Chlamydophila pneumoniae J138
gcucucuucuucucag

SEQ ID NO: 2564029 - RNA, 19 nt, Chlamydophila pneumoniae J138
gcucuggauugaaagagcu

SEQ ID NO: 2564030 - RNA, 15 nt, Chlamydophila pneumoniae J138
gcucuuacuucuggu

SEQ ID NO: 2564031 - RNA, 19 nt, Chlamydophila pneumoniae J138
gcucuucuaugguaaucac

SEQ ID NO: 2564032 - RNA, 20 nt, Chlamydophila pneumoniae J138
gcucuuugggauaaaaaguu

SEQ ID NO: 2564033 - RNA, 23 nt, Chlamydophila pneumoniae J138
gcucuuugggauaaaaaguuuuu

SEQ ID NO: 2564034 - RNA, 17 nt, Chlamydophila pneumoniae J138
gcugaagauuuuuucuu

SEQ ID NO: 2564035 - RNA, 17 nt, Chlamydophila pneumoniae J138
gcugagacauauugaag

SEQ ID NO: 2564036 - RNA, 20 nt, Chlamydophila pneumoniae J138
gcugagacauauugaagaua

SEQ ID NO: 2564037 - RNA, 22 nt, Chlamydophila pneumoniae J138
gcugagacauauugaagauauu

SEQ ID NO: 2564038 - RNA, 15 nt, Chlamydophila pneumoniae J138
gcugaggacgcagag

SEQ ID NO: 2564039 - RNA, 14 nt, Chlamydophila pneumoniae J138
gcugauccaaaagc

SEQ ID NO: 2564040 - RNA, 14 nt, Chlamydophila pneumoniae J138
gcugauucucccaa

SEQ ID NO: 2564041 - RNA, 14 nt, Chlamydophila pneumoniae J138
gcugauuucuuuuu

SEQ ID NO: 2564042 - RNA, 22 nt, Chlamydophila pneumoniae J138
gcugauuucuuuuucagcuucu

SEQ ID NO: 2564043 - RNA, 19 nt, Chlamydophila pneumoniae J138
ggaagcuguacuugauauu

SEQ ID NO: 2564044 - RNA, 23 nt, Chlamydophila pneumoniae J138
ggaagcuguacuugauauuguuc

SEQ ID NO: 2564045 - RNA, 21 nt, Chlamydophila pneumoniae J138
ggaagcuuaucaagaagcuga

SEQ ID NO: 2564046 - RNA, 15 nt, Chlamydophila pneumoniae J138
ggaagcuuuuacgag

SEQ ID NO: 2564047 - RNA, 14 nt, Chlamydophila pneumoniae J138
ggaagguucucaaa

SEQ ID NO: 2564048 - RNA, 22 nt, Chlamydophila pneumoniae J138
ggaaguccauguacagaaaaua

SEQ ID NO: 2564049 - RNA, 10 nt, Chlamydophila pneumoniae J138
ggaaguguag

SEQ ID NO: 2564050 - RNA, 18 nt, Chlamydophila pneumoniae J138
ggaauaggcucuuuagca

SEQ ID NO: 2564051 - RNA, 20 nt, Chlamydophila pneumoniae J138
ggaauauagguuuagauugc

SEQ ID NO: 2564052 - RNA, 15 nt, Chlamydophila pneumoniae J138
ggaaucccuuuuuaa

SEQ ID NO: 2564053 - RNA, 17 nt, Chlamydophila pneumoniae J138
ggaaucucgggagaaca

SEQ ID NO: 2564054 - RNA, 20 nt, Chlamydophila pneumoniae J138
ggaaucucgggagaacaugc

SEQ ID NO: 2564055 - RNA, 22 nt, Chlamydophila pneumoniae J138
ggaauugcagcaaggagagugc

SEQ ID NO: 2564056 - RNA, 22 nt, Chlamydophila pneumoniae J138
ggaauuucccauauagcucguu

SEQ ID NO: 2564057 - RNA, 20 nt, Chlamydophila pneumoniae J138
ggacaacaacagcuuuaucu

SEQ ID NO: 2564058 - RNA, 13 nt, Chlamydophila pneumoniae J138
ggacaacagcaac

SEQ ID NO: 2564059 - RNA, 9 nt, Chlamydophila pneumoniae J138
ggacaacua

SEQ ID NO: 2564060 - RNA, 16 nt, Chlamydophila pneumoniae J138
ggacaaugcuaucucc

SEQ ID NO: 2564061 - RNA, 18 nt, Chlamydophila pneumoniae J138
ggacaaugcuaucuccag

SEQ ID NO: 2564062 - RNA, 17 nt, Chlamydophila pneumoniae J138
ggaccacaauuccuaaa

SEQ ID NO: 2564063 - RNA, 22 nt, Chlamydophila pneumoniae J138
ggaccacaauuccuaaaacaag

SEQ ID NO: 2564064 - RNA, 23 nt, Chlamydophila pneumoniae J138
ggaccagguguagguuccugcuu

SEQ ID NO: 2564065 - RNA, 18 nt, Chlamydophila pneumoniae J138
ggaccuaagggcucuccu

SEQ ID NO: 2564066 - RNA, 13 nt, Chlamydophila pneumoniae J138
ggaccuguuuucu

SEQ ID NO: 2564067 - RNA, 21 nt, Chlamydophila pneumoniae J138
ggaccuguuuucuuuucugaa

SEQ ID NO: 2564068 - RNA, 23 nt, Chlamydophila pneumoniae J138
ggaccuuauacccacaaagauca

SEQ ID NO: 2564069 - RNA, 18 nt, Chlamydophila pneumoniae J138
ggaccuuccuuaucuuca

SEQ ID NO: 2564070 - RNA, 15 nt, Chlamydophila pneumoniae J138
ggacgcacauuuaga

SEQ ID NO: 2564071 - RNA, 18 nt, Chlamydophila pneumoniae J138
ggacgcuaauccuccucg

SEQ ID NO: 2564072 - RNA, 14 nt, Chlamydophila pneumoniae J138
ggacuaaacaagaa

SEQ ID NO: 2564073 - RNA, 22 nt, Chlamydophila pneumoniae J138
ggacugacuucuaugauaucac

SEQ ID NO: 2564074 - RNA, 15 nt, Chlamydophila pneumoniae J138
ggacuucucaaagac

SEQ ID NO: 2564075 - RNA, 16 nt, Chlamydophila pneumoniae J138
ggacuucucaaagaca

SEQ ID NO: 2564076 - RNA, 11 nt, Chlamydophila pneumoniae J138
ggagaagcccc

SEQ ID NO: 2564077 - RNA, 14 nt, Chlamydophila pneumoniae J138
ggagaauagcaagc

SEQ ID NO: 2564078 - RNA, 21 nt, Chlamydophila pneumoniae J138
ggagaccuuuauagauaugcc

SEQ ID NO: 2564079 - RNA, 16 nt, Chlamydophila pneumoniae J138
ggagacucagagaaaa

SEQ ID NO: 2564080 - RNA, 18 nt, Chlamydophila pneumoniae J138
ggagacucagagaaaauc

SEQ ID NO: 2564081 - RNA, 24 nt, Chlamydophila pneumoniae J138
ggagacuugaucuacaaaaacuag

SEQ ID NO: 2564082 - RNA, 19 nt, Chlamydophila pneumoniae J138
ggagagcuucuucuguaaa

SEQ ID NO: 2564083 - RNA, 20 nt, Chlamydophila pneumoniae J138
ggagagcuugguuuucuccu

SEQ ID NO: 2564084 - RNA, 17 nt, Chlamydophila pneumoniae J138
ggagagcuuucgcuccu

SEQ ID NO: 2564085 - RNA, 11 nt, Chlamydophila pneumoniae J138
ggagagguaau

SEQ ID NO: 2564086 - RNA, 22 nt, Chlamydophila pneumoniae J138
ggagauaaagauguagaauaac

SEQ ID NO: 2564087 - RNA, 19 nt, Chlamydophila pneumoniae J138
ggagcauagacucuuccuu

SEQ ID NO: 2564088 - RNA, 23 nt, Chlamydophila pneumoniae J138
ggagcaucuuuucaaaagaaaag

SEQ ID NO: 2564089 - RNA, 15 nt, Chlamydophila pneumoniae J138
ggagcucgcuaaaca

SEQ ID NO: 2564090 - RNA, 17 nt, Chlamydophila pneumoniae J138
ggagcucuuucuuggau

SEQ ID NO: 2564091 - RNA, 16 nt, Chlamydophila pneumoniae J138
ggaggaacaauacucu

SEQ ID NO: 2564092 - RNA, 11 nt, Chlamydophila pneumoniae J138
ggagggaaaca

SEQ ID NO: 2564093 - RNA, 18 nt, Chlamydophila pneumoniae J138
ggaguacuucuuacccua

SEQ ID NO: 2564094 - RNA, 13 nt, Chlamydophila pneumoniae J138
ggagucuuggaua

SEQ ID NO: 2564095 - RNA, 18 nt, Chlamydophila pneumoniae J138
ggaguucuugauucucuu

SEQ ID NO: 2564096 - RNA, 14 nt, Chlamydophila pneumoniae J138
ggaguuuuccuaaa

SEQ ID NO: 2564097 - RNA, 17 nt, Chlamydophila pneumoniae J138
ggauaaaaaguuuuugu

SEQ ID NO: 2564098 - RNA, 14 nt, Chlamydophila pneumoniae J138
ggauaaauggagga

SEQ ID NO: 2564099 - RNA, 20 nt, Chlamydophila pneumoniae J138
ggauaaugcucacuucuuug

SEQ ID NO: 2564100 - RNA, 17 nt, Chlamydophila pneumoniae J138
ggauaccauaaggagau

SEQ ID NO: 2564101 - RNA, 20 nt, Chlamydophila pneumoniae J138
ggauacucugaacaggaaua

SEQ ID NO: 2564102 - RNA, 12 nt, Chlamydophila pneumoniae J138
ggauacuuagca

SEQ ID NO: 2564103 - RNA, 18 nt, Chlamydophila pneumoniae J138
ggauagcauacgacagua

SEQ ID NO: 2564104 - RNA, 24 nt, Chlamydophila pneumoniae J138
ggauaucugagcauaacuugaaga

SEQ ID NO: 2564105 - RNA, 22 nt, Chlamydophila pneumoniae J138
ggauaucuucuggguucuccac

SEQ ID NO: 2564106 - RNA, 17 nt, Chlamydophila pneumoniae J138
ggauauugauaaauccc

SEQ ID NO: 2564107 - RNA, 15 nt, Chlamydophila pneumoniae J138
ggaucauguagcaga

SEQ ID NO: 2564108 - RNA, 17 nt, Chlamydophila pneumoniae J138
ggaucauuaaaguccaa

SEQ ID NO: 2564109 - RNA, 12 nt, Chlamydophila pneumoniae J138
ggauccaggagu

SEQ ID NO: 2564110 - RNA, 18 nt, Chlamydophila pneumoniae J138
ggaucccaaaaaaugccc

SEQ ID NO: 2564111 - RNA, 17 nt, Chlamydophila pneumoniae J138
ggauccuagaauaggaa

SEQ ID NO: 2564112 - RNA, 18 nt, Chlamydophila pneumoniae J138
ggaucggucuuuucuaag

SEQ ID NO: 2564113 - RNA, 15 nt, Chlamydophila pneumoniae J138
ggaucuaaagcauca

SEQ ID NO: 2564114 - RNA, 22 nt, Chlamydophila pneumoniae J138
ggaucucucuuuccuuagcauu

SEQ ID NO: 2564115 - RNA, 16 nt, Chlamydophila pneumoniae J138
ggaucuuaggauucuu

SEQ ID NO: 2564116 - RNA, 18 nt, Chlamydophila pneumoniae J138
ggaucuucagagagaaca

SEQ ID NO: 2564117 - RNA, 20 nt, Chlamydophila pneumoniae J138
ggaucuucaucccuacccuc

SEQ ID NO: 2564118 - RNA, 17 nt, Chlamydophila pneumoniae J138
ggaucuuuucuuucuaa

SEQ ID NO: 2564119 - RNA, 17 nt, Chlamydophila pneumoniae J138
ggaugaggucuuuagca

SEQ ID NO: 2564120 - RNA, 23 nt, Chlamydophila pneumoniae J138
ggaugcagaucauaucggcagca

SEQ ID NO: 2564121 - RNA, 13 nt, Chlamydophila pneumoniae J138
ggaugcuaauaaa

SEQ ID NO: 2564122 - RNA, 15 nt, Chlamydophila pneumoniae J138
ggauggucaggaaga

SEQ ID NO: 2564123 - RNA, 17 nt, Chlamydophila pneumoniae J138
ggauuaucuuagggaau

SEQ ID NO: 2564124 - RNA, 14 nt, Chlamydophila pneumoniae J138
ggauucuaaaaaga

SEQ ID NO: 2564125 - RNA, 15 nt, Chlamydophila pneumoniae J138
ggauucuaaaaagaa

SEQ ID NO: 2564126 - RNA, 20 nt, Chlamydophila pneumoniae J138
ggauucuaaaaagaaaagac

SEQ ID NO: 2564127 - RNA, 23 nt, Chlamydophila pneumoniae J138
ggauucuaaaagagcaagauggc

SEQ ID NO: 2564128 - RNA, 18 nt, Chlamydophila pneumoniae J138
ggauucuuuugcaaugcu

SEQ ID NO: 2564129 - RNA, 16 nt, Chlamydophila pneumoniae J138
ggcaauagcagcagcg

SEQ ID NO: 2564130 - RNA, 20 nt, Chlamydophila pneumoniae J138
ggcaauagcuuugaagagca

SEQ ID NO: 2564131 - RNA, 17 nt, Chlamydophila pneumoniae J138
ggcaaugaucaaaaaug

SEQ ID NO: 2564132 - RNA, 14 nt, Chlamydophila pneumoniae J138
ggcacuggcaugga

SEQ ID NO: 2564133 - RNA, 23 nt, Chlamydophila pneumoniae J138
ggcaggacucuuuaagcaagagc

SEQ ID NO: 2564134 - RNA, 17 nt, Chlamydophila pneumoniae J138
ggcagguaguaggacaa

SEQ ID NO: 2564135 - RNA, 18 nt, Chlamydophila pneumoniae J138
ggcagguagucccuuucu

SEQ ID NO: 2564136 - RNA, 19 nt, Chlamydophila pneumoniae J138
ggcaguagguaagaagcug

SEQ ID NO: 2564137 - RNA, 17 nt, Chlamydophila pneumoniae J138
ggcauaaaaaaguccua

SEQ ID NO: 2564138 - RNA, 18 nt, Chlamydophila pneumoniae J138
ggcauaaaaaaguccuac

SEQ ID NO: 2564139 - RNA, 17 nt, Chlamydophila pneumoniae J138
ggcauacaguagaaaca

SEQ ID NO: 2564140 - RNA, 19 nt, Chlamydophila pneumoniae J138
ggcauacaguagaaacaug

SEQ ID NO: 2564141 - RNA, 15 nt, Chlamydophila pneumoniae J138
ggcauacucuuugca

SEQ ID NO: 2564142 - RNA, 23 nt, Chlamydophila pneumoniae J138
ggcauaguggcucaguguauugu

SEQ ID NO: 2564143 - RNA, 19 nt, Chlamydophila pneumoniae J138
gguguauaguauuuuuaaa

SEQ ID NO: 2564144 - RNA, 23 nt, Chlamydophila pneumoniae J138
gguuaaaacccauguuucuuccu

SEQ ID NO: 2564145 - RNA, 12 nt, Chlamydophila pneumoniae J138
gguuaucuuuuu

SEQ ID NO: 2564146 - RNA, 11 nt, Chlamydophila pneumoniae J138
gguucaaaucc

SEQ ID NO: 2564147 - RNA, 22 nt, Chlamydophila pneumoniae J138
gguucauuuccaaauucuugca

SEQ ID NO: 2564148 - RNA, 20 nt, Chlamydophila pneumoniae J138
gguuccucuuccuuuuugca

SEQ ID NO: 2564149 - RNA, 19 nt, Chlamydophila pneumoniae J138
gguuccuggauuuaggaug

SEQ ID NO: 2564150 - RNA, 19 nt, Chlamydophila pneumoniae J138
gguuccuuaaagaguuugu

SEQ ID NO: 2564151 - RNA, 22 nt, Chlamydophila pneumoniae J138
gguucuccacaugcccaaacau

SEQ ID NO: 2564152 - RNA, 21 nt, Chlamydophila pneumoniae J138
gguucuuccauaagaucaaua

SEQ ID NO: 2564153 - RNA, 13 nt, Chlamydophila pneumoniae J138
gguucuuucuaga

SEQ ID NO: 2564154 - RNA, 12 nt, Chlamydophila pneumoniae J138
gguuucuaaaua

SEQ ID NO: 2564155 - RNA, 18 nt, Chlamydophila pneumoniae J138
gguuucuuuuuuuauaaa

SEQ ID NO: 2564156 - RNA, 23 nt, Chlamydophila pneumoniae J138
gguuucuuuuuuuugaagugcuu

SEQ ID NO: 2564157 - RNA, 19 nt, Chlamydophila pneumoniae J138
gguuugcaugccuauuaag

SEQ ID NO: 2564158 - RNA, 16 nt, Chlamydophila pneumoniae J138
gguuuugaagcuccuc

SEQ ID NO: 2564159 - RNA, 22 nt, Chlamydophila pneumoniae J138
guaaaaaauacaggaaucuccu

SEQ ID NO: 2564160 - RNA, 13 nt, Chlamydophila pneumoniae J138
guaaaaagaaaga

SEQ ID NO: 2564161 - RNA, 12 nt, Chlamydophila pneumoniae J138
guaaaaauauag

SEQ ID NO: 2564162 - RNA, 14 nt, Chlamydophila pneumoniae J138
guaaaaauggcacu

SEQ ID NO: 2564163 - RNA, 21 nt, Chlamydophila pneumoniae J138
guaaaacacaaauagcaagag

SEQ ID NO: 2564164 - RNA, 16 nt, Chlamydophila pneumoniae J138
guaaaacuacaggaaa

SEQ ID NO: 2564165 - RNA, 20 nt, Chlamydophila pneumoniae J138
guaaaacugcgcuaucauca

SEQ ID NO: 2564166 - RNA, 15 nt, Chlamydophila pneumoniae J138
guaaaagcccuaauu

SEQ ID NO: 2564167 - RNA, 21 nt, Chlamydophila pneumoniae J138
guaaaagcccuaauucauauu

SEQ ID NO: 2564168 - RNA, 17 nt, Chlamydophila pneumoniae J138
guaaacagcaaaguaau

SEQ ID NO: 2564169 - RNA, 12 nt, Chlamydophila pneumoniae J138
guaaagaaaagc

SEQ ID NO: 2564170 - RNA, 15 nt, Chlamydophila pneumoniae J138
guaaagaaaagcaau

SEQ ID NO: 2564171 - RNA, 12 nt, Chlamydophila pneumoniae J138
guaaagaaucac

SEQ ID NO: 2564172 - RNA, 14 nt, Chlamydophila pneumoniae J138
guaaagagcuucuu

SEQ ID NO: 2564173 - RNA, 20 nt, Chlamydophila pneumoniae J138
guaaagaguagccccagcaa

SEQ ID NO: 2564174 - RNA, 19 nt, Chlamydophila pneumoniae J138
guaaagcauuggacaacgc

SEQ ID NO: 2564175 - RNA, 18 nt, Chlamydophila pneumoniae J138
guaaagccacauucuucu

SEQ ID NO: 2564176 - RNA, 19 nt, Chlamydophila pneumoniae J138
guaaagguuguaaggacga

SEQ ID NO: 2564177 - RNA, 14 nt, Chlamydophila pneumoniae J138
guaaaguaugcaua

SEQ ID NO: 2564178 - RNA, 13 nt, Chlamydophila pneumoniae J138
guaaauaauaacc

SEQ ID NO: 2564179 - RNA, 17 nt, Chlamydophila pneumoniae J138
guaaauaguauacaagc

SEQ ID NO: 2564180 - RNA, 17 nt, Chlamydophila pneumoniae J138
guaaauauuuuaccauu

SEQ ID NO: 2564181 - RNA, 21 nt, Chlamydophila pneumoniae J138
guaaauauuuuaccauugaga

SEQ ID NO: 2564182 - RNA, 21 nt, Chlamydophila pneumoniae J138
guaaaucauuggaaccauagg

SEQ ID NO: 2564183 - RNA, 21 nt, Chlamydophila pneumoniae J138
guaaaugccucuuucauacua

SEQ ID NO: 2564184 - RNA, 17 nt, Chlamydophila pneumoniae J138
guaaauguuuugcgaua

SEQ ID NO: 2564185 - RNA, 20 nt, Chlamydophila pneumoniae J138
guaaauuuuuccuucaacac

SEQ ID NO: 2564186 - RNA, 19 nt, Chlamydophila pneumoniae J138
guaaccaacaucaaagaau

SEQ ID NO: 2564187 - RNA, 13 nt, Chlamydophila pneumoniae J138
guaaccagagagc

SEQ ID NO: 2564188 - RNA, 14 nt, Chlamydophila pneumoniae J138
guaacgcuuuucua

SEQ ID NO: 2564189 - RNA, 14 nt, Chlamydophila pneumoniae J138
guaacuaaauucuu

SEQ ID NO: 2564190 - RNA, 12 nt, Chlamydophila pneumoniae J138
guaacuaauaau

SEQ ID NO: 2564191 - RNA, 19 nt, Chlamydophila pneumoniae J138
guaacuaauaaucauaucu

SEQ ID NO: 2564192 - RNA, 17 nt, Chlamydophila pneumoniae J138
guaacucuuaagaauaa

SEQ ID NO: 2564193 - RNA, 18 nt, Chlamydophila pneumoniae J138
guaagaaggcagagaacu

SEQ ID NO: 2564194 - RNA, 15 nt, Chlamydophila pneumoniae J138
guaagacuaaaaaag

SEQ ID NO: 2564195 - RNA, 18 nt, Chlamydophila pneumoniae J138
guaagacuaaaaaagaga

SEQ ID NO: 2564196 - RNA, 20 nt, Chlamydophila pneumoniae J138
guaagacuaaaaaagagacc

SEQ ID NO: 2564197 - RNA, 21 nt, Chlamydophila pneumoniae J138
guaagcagugugcugauuuua

SEQ ID NO: 2564198 - RNA, 22 nt, Chlamydophila pneumoniae J138
guaagcagugugcugauuuuaa

SEQ ID NO: 2564199 - RNA, 18 nt, Chlamydophila pneumoniae J138
guaagcugcaaucucaaa

SEQ ID NO: 2564200 - RNA, 17 nt, Chlamydophila pneumoniae J138
guaaggcgaaaucuuca

SEQ ID NO: 2564201 - RNA, 22 nt, Chlamydophila pneumoniae J138
guaaguacacauugucucuuuu

SEQ ID NO: 2564202 - RNA, 22 nt, Chlamydophila pneumoniae J138
guaauagacaacgcaggaagaa

SEQ ID NO: 2564203 - RNA, 19 nt, Chlamydophila pneumoniae J138
guaauagcaggaguuuuca

SEQ ID NO: 2564204 - RNA, 18 nt, Chlamydophila pneumoniae J138
guaauagguuucaauaga

SEQ ID NO: 2564205 - RNA, 21 nt, Chlamydophila pneumoniae J138
guaauagguuucaauagaagc

SEQ ID NO: 2564206 - RNA, 21 nt, Chlamydophila pneumoniae J138
guaaucaugauaaaaauuuuc

SEQ ID NO: 2564207 - RNA, 15 nt, Chlamydophila pneumoniae J138
guaauccuaauuccu

SEQ ID NO: 2564208 - RNA, 14 nt, Chlamydophila pneumoniae J138
guaauccuucuuuc

SEQ ID NO: 2564209 - RNA, 19 nt, Chlamydophila pneumoniae J138
guaauccuucuuucugcuc

SEQ ID NO: 2564210 - RNA, 18 nt, Chlamydophila pneumoniae J138
guaaucgagagaagaaau

SEQ ID NO: 2564211 - RNA, 15 nt, Chlamydophila pneumoniae J138
guaaucuaagaaucu

SEQ ID NO: 2564212 - RNA, 14 nt, Chlamydophila pneumoniae J138
guaaucuguauaug

SEQ ID NO: 2564213 - RNA, 19 nt, Chlamydophila pneumoniae J138
guaaucuuuuuuaaagcua

SEQ ID NO: 2564214 - RNA, 16 nt, Chlamydophila pneumoniae J138
guaaugagcuggaaga

SEQ ID NO: 2564215 - RNA, 15 nt, Chlamydophila pneumoniae J138
guaaugcuuagccau

SEQ ID NO: 2564216 - RNA, 19 nt, Chlamydophila pneumoniae J138
guaaugcuuagccauggca

SEQ ID NO: 2564217 - RNA, 14 nt, Chlamydophila pneumoniae J138
guaauuacagaucu

SEQ ID NO: 2564218 - RNA, 22 nt, Chlamydophila pneumoniae J138
guaauuauuuucuacacuguug

SEQ ID NO: 2564219 - RNA, 20 nt, Chlamydophila pneumoniae J138
guaauuucuagcuaauaaug

SEQ ID NO: 2564220 - RNA, 19 nt, Chlamydophila pneumoniae J138
guacaagcuucaucaaaac

SEQ ID NO: 2564221 - RNA, 18 nt, Chlamydophila pneumoniae J138
guacacuuucaagauugu

SEQ ID NO: 2564222 - RNA, 23 nt, Chlamydophila pneumoniae J138
guacagaccguccuccccauaca

SEQ ID NO: 2564223 - RNA, 23 nt, Chlamydophila pneumoniae J138
guacaguugcgcgcccucuucua

SEQ ID NO: 2564224 - RNA, 15 nt, Chlamydophila pneumoniae J138
guacauagaggagau

SEQ ID NO: 2564225 - RNA, 13 nt, Chlamydophila pneumoniae J138
guaccaagaaaau

SEQ ID NO: 2564226 - RNA, 14 nt, Chlamydophila pneumoniae J138
guaccaagaaaaua

SEQ ID NO: 2564227 - RNA, 20 nt, Chlamydophila pneumoniae J138
guaccguaaagaaaagcaau

SEQ ID NO: 2564228 - RNA, 23 nt, Chlamydophila pneumoniae J138
guaccguagcguacguuuucucu

SEQ ID NO: 2564229 - RNA, 15 nt, Chlamydophila pneumoniae J138
guacgcaaaguacua

SEQ ID NO: 2564230 - RNA, 14 nt, Chlamydophila pneumoniae J138
guacggcuaaauaa

SEQ ID NO: 2564231 - RNA, 13 nt, Chlamydophila pneumoniae J138
guacguuuucucu

SEQ ID NO: 2564232 - RNA, 19 nt, Chlamydophila pneumoniae J138
guacuaauuacagaauccc

SEQ ID NO: 2564233 - RNA, 20 nt, Chlamydophila pneumoniae J138
guacuaucgguuuaaacaga

SEQ ID NO: 2564234 - RNA, 20 nt, Chlamydophila pneumoniae J138
guacucuucuuuuuaucaug

SEQ ID NO: 2564235 - RNA, 21 nt, Chlamydophila pneumoniae J138
guacuuaagcacugaugaaaa

SEQ ID NO: 2564236 - RNA, 21 nt, Chlamydophila pneumoniae J138
guacuucccucaugaagaauu

SEQ ID NO: 2564237 - RNA, 14 nt, Chlamydophila pneumoniae J138
guacuucuuacccu

SEQ ID NO: 2564238 - RNA, 14 nt, Chlamydophila pneumoniae J138
guacuuuacacuau

SEQ ID NO: 2564239 - RNA, 12 nt, Chlamydophila pneumoniae J138
guacuuuuugcc

SEQ ID NO: 2564240 - RNA, 19 nt, Chlamydophila pneumoniae J138
guagaaggggguucuaaga

SEQ ID NO: 2564241 - RNA, 16 nt, Chlamydophila pneumoniae J138
guagaauccuucuccc

SEQ ID NO: 2564242 - RNA, 18 nt, Chlamydophila pneumoniae J138
guagaauccuucucccuc

SEQ ID NO: 2564243 - RNA, 20 nt, Chlamydophila pneumoniae J138
guccuccauguacaguuugu

SEQ ID NO: 2564244 - RNA, 19 nt, Chlamydophila pneumoniae J138
guccugcaggcuucaccau

SEQ ID NO: 2564245 - RNA, 21 nt, Chlamydophila pneumoniae J138
guccuggacgauauaaucacg

SEQ ID NO: 2564246 - RNA, 15 nt, Chlamydophila pneumoniae J138
guccuucuugcaaag

SEQ ID NO: 2564247 - RNA, 19 nt, Chlamydophila pneumoniae J138
guccuugcagcccugcaua

SEQ ID NO: 2564248 - RNA, 12 nt, Chlamydophila pneumoniae J138
gucgaagauuca

SEQ ID NO: 2564249 - RNA, 12 nt, Chlamydophila pneumoniae J138
gucgacaugcag

SEQ ID NO: 2564250 - RNA, 16 nt, Chlamydophila pneumoniae J138
gucgagaaccuccacc

SEQ ID NO: 2564251 - RNA, 17 nt, Chlamydophila pneumoniae J138
gucgagaaccuccacca

SEQ ID NO: 2564252 - RNA, 15 nt, Chlamydophila pneumoniae J138
gucgauaaaaacucc

SEQ ID NO: 2564253 - RNA, 23 nt, Chlamydophila pneumoniae J138
gucgauacccaaagaggggagcu

SEQ ID NO: 2564254 - RNA, 16 nt, Chlamydophila pneumoniae J138
gucgcgacugaaguca

SEQ ID NO: 2564255 - RNA, 20 nt, Chlamydophila pneumoniae J138
gucgcuagaucacaagaaag

SEQ ID NO: 2564256 - RNA, 18 nt, Chlamydophila pneumoniae J138
gucggagguucgaauccu

SEQ ID NO: 2564257 - RNA, 13 nt, Chlamydophila pneumoniae J138
gucggaguuuuuu

SEQ ID NO: 2564258 - RNA, 22 nt, Chlamydophila pneumoniae J138
gucggcuuuagaaaagugcccu

SEQ ID NO: 2564259 - RNA, 21 nt, Chlamydophila pneumoniae J138
gucguaaacggacgcuagaga

SEQ ID NO: 2564260 - RNA, 19 nt, Chlamydophila pneumoniae J138
gucgucuuuuaaagagcgc

SEQ ID NO: 2564261 - RNA, 13 nt, Chlamydophila pneumoniae J138
gucuaaagaagau

SEQ ID NO: 2564262 - RNA, 21 nt, Chlamydophila pneumoniae J138
gucuaaagauuggaauauaau

SEQ ID NO: 2564263 - RNA, 12 nt, Chlamydophila pneumoniae J138
gucuaaaggagu

SEQ ID NO: 2564264 - RNA, 18 nt, Chlamydophila pneumoniae J138
gucuaagaaucguucuua

SEQ ID NO: 2564265 - RNA, 12 nt, Chlamydophila pneumoniae J138
gucuaaucccca

SEQ ID NO: 2564266 - RNA, 22 nt, Chlamydophila pneumoniae J138
gucuacagaggaaucuauccuu

SEQ ID NO: 2564267 - RNA, 20 nt, Chlamydophila pneumoniae J138
gucuagcaguugcaauacca

SEQ ID NO: 2564268 - RNA, 14 nt, Chlamydophila pneumoniae J138
gucuauuugaaaag

SEQ ID NO: 2564269 - RNA, 21 nt, Chlamydophila pneumoniae J138
gucuauuugaaaagaaagaau

SEQ ID NO: 2564270 - RNA, 23 nt, Chlamydophila pneumoniae J138
gucucacucuuuucuagaaacug

SEQ ID NO: 2564271 - RNA, 16 nt, Chlamydophila pneumoniae J138
gucucaugaccuucag

SEQ ID NO: 2564272 - RNA, 15 nt, Chlamydophila pneumoniae J138
gucuccaaagauaca

SEQ ID NO: 2564273 - RNA, 13 nt, Chlamydophila pneumoniae J138
gucucccucacaa

SEQ ID NO: 2564274 - RNA, 11 nt, Chlamydophila pneumoniae J138
gucugaacauu

SEQ ID NO: 2564275 - RNA, 14 nt, Chlamydophila pneumoniae J138
gucugcugaggaga

SEQ ID NO: 2564276 - RNA, 13 nt, Chlamydophila pneumoniae J138
gucugugagaaau

SEQ ID NO: 2564277 - RNA, 17 nt, Chlamydophila pneumoniae J138
gucuguuaacucagaga

SEQ ID NO: 2564278 - RNA, 15 nt, Chlamydophila pneumoniae J138
gucuguuuuggaaag

SEQ ID NO: 2564279 - RNA, 20 nt, Chlamydophila pneumoniae J138
gucuuagaauccaaagacuu

SEQ ID NO: 2564280 - RNA, 17 nt, Chlamydophila pneumoniae J138
gucuuaucuaaagaaau

SEQ ID NO: 2564281 - RNA, 20 nt, Chlamydophila pneumoniae J138
gucuuaucuaaagaaaugua

SEQ ID NO: 2564282 - RNA, 22 nt, Chlamydophila pneumoniae J138
gucuuccauaacaguuuguucu

SEQ ID NO: 2564283 - RNA, 22 nt, Chlamydophila pneumoniae J138
gucuuccccccucacaauauaa

SEQ ID NO: 2564284 - RNA, 16 nt, Chlamydophila pneumoniae J138
gucuucccucuccuug

SEQ ID NO: 2564285 - RNA, 15 nt, Chlamydophila pneumoniae J138
gucuuccguauaagu

SEQ ID NO: 2564286 - RNA, 21 nt, Chlamydophila pneumoniae J138
gucuucuguaauuuuuuucaa

SEQ ID NO: 2564287 - RNA, 17 nt, Chlamydophila pneumoniae J138
gucuucuuagaagagaa

SEQ ID NO: 2564288 - RNA, 12 nt, Chlamydophila pneumoniae J138
gucuucuucgcc

SEQ ID NO: 2564289 - RNA, 19 nt, Chlamydophila pneumoniae J138
gucuugacguugcgaacag

SEQ ID NO: 2564290 - RNA, 15 nt, Chlamydophila pneumoniae J138
gucuugaguucuuuu

SEQ ID NO: 2564291 - RNA, 24 nt, Chlamydophila pneumoniae J138
gucuugcgccagcaaagauuaagg

SEQ ID NO: 2564292 - RNA, 19 nt, Chlamydophila pneumoniae J138
gucuuucuuuuuuuugccg

SEQ ID NO: 2564293 - RNA, 23 nt, Chlamydophila pneumoniae J138
gucuuuucuaagcaauauuucug

SEQ ID NO: 2564294 - RNA, 19 nt, Chlamydophila pneumoniae J138
gugaaaguacaggaguucc

SEQ ID NO: 2564295 - RNA, 13 nt, Chlamydophila pneumoniae J138
gugaaaucugcuc

SEQ ID NO: 2564296 - RNA, 15 nt, Chlamydophila pneumoniae J138
gugaacaaaaacugc

SEQ ID NO: 2564297 - RNA, 13 nt, Chlamydophila pneumoniae J138
gugaacacucucu

SEQ ID NO: 2564298 - RNA, 21 nt, Chlamydophila pneumoniae J138
gugaacuuuuguacacagaga

SEQ ID NO: 2564299 - RNA, 18 nt, Chlamydophila pneumoniae J138
gugaagaaauuaaguagg

SEQ ID NO: 2564300 - RNA, 14 nt, Chlamydophila pneumoniae J138
gugaaugagcuuca

SEQ ID NO: 2564301 - RNA, 20 nt, Chlamydophila pneumoniae J138
gugacucuuaucuggagaug

SEQ ID NO: 2564302 - RNA, 14 nt, Chlamydophila pneumoniae J138
gugaguucuuccuu

SEQ ID NO: 2564303 - RNA, 13 nt, Chlamydophila pneumoniae J138
gugaguugcaauu

SEQ ID NO: 2564304 - RNA, 16 nt, Chlamydophila pneumoniae J138
gugauauccaccuuac

SEQ ID NO: 2564305 - RNA, 20 nt, Chlamydophila pneumoniae J138
gugauauccaccuuaccauc

SEQ ID NO: 2564306 - RNA, 19 nt, Chlamydophila pneumoniae J138
gugaucaaaauuauccaga

SEQ ID NO: 2564307 - RNA, 23 nt, Chlamydophila pneumoniae J138
gugauugcugucagaacaagaag

SEQ ID NO: 2564308 - RNA, 20 nt, Chlamydophila pneumoniae J138
gugauuucuuuauucccuuu

SEQ ID NO: 2564309 - RNA, 17 nt, Chlamydophila pneumoniae J138
gugcaaguucacacgua

SEQ ID NO: 2564310 - RNA, 15 nt, Chlamydophila pneumoniae J138
gugcagugaauccuu

SEQ ID NO: 2564311 - RNA, 14 nt, Chlamydophila pneumoniae J138
gugccaucuguaga

SEQ ID NO: 2564312 - RNA, 13 nt, Chlamydophila pneumoniae J138
gugccuguaauug

SEQ ID NO: 2564313 - RNA, 23 nt, Chlamydophila pneumoniae J138
gugccuucuucaaagcuacuaau

SEQ ID NO: 2564314 - RNA, 18 nt, Chlamydophila pneumoniae J138
gugcgaaagcccaugaga

SEQ ID NO: 2564315 - RNA, 16 nt, Chlamydophila pneumoniae J138
gugcuaggcucucgac

SEQ ID NO: 2564316 - RNA, 20 nt, Chlamydophila pneumoniae J138
gugcuaggcucucgacacua

SEQ ID NO: 2564317 - RNA, 15 nt, Chlamydophila pneumoniae J138
gugcucggcacuuac

SEQ ID NO: 2564318 - RNA, 13 nt, Chlamydophila pneumoniae J138
gugcucuacccca

SEQ ID NO: 2564319 - RNA, 15 nt, Chlamydophila pneumoniae J138
gugcucucuucuucu

SEQ ID NO: 2564320 - RNA, 17 nt, Chlamydophila pneumoniae J138
gugcucucuucuucuca

SEQ ID NO: 2564321 - RNA, 13 nt, Chlamydophila pneumoniae J138
gugcucuguauug

SEQ ID NO: 2564322 - RNA, 13 nt, Chlamydophila pneumoniae J138
gugcugccaugac

SEQ ID NO: 2564323 - RNA, 18 nt, Chlamydophila pneumoniae J138
guggaacgcauaagagac

SEQ ID NO: 2564324 - RNA, 16 nt, Chlamydophila pneumoniae J138
guggaacuuucuggga

SEQ ID NO: 2564325 - RNA, 23 nt, Chlamydophila pneumoniae J138
guggagcuugucuaggagcuucg

SEQ ID NO: 2564326 - RNA, 14 nt, Chlamydophila pneumoniae J138
guggagguuaguau

SEQ ID NO: 2564327 - RNA, 15 nt, Chlamydophila pneumoniae J138
guggaguaucuagcu

SEQ ID NO: 2564328 - RNA, 22 nt, Chlamydophila pneumoniae J138
guggaucagaaaaaaugcguuu

SEQ ID NO: 2564329 - RNA, 20 nt, Chlamydophila pneumoniae J138
gugggaauguuguuuuugau

SEQ ID NO: 2564330 - RNA, 18 nt, Chlamydophila pneumoniae J138
gugggauggucaggaaga

SEQ ID NO: 2564331 - RNA, 23 nt, Chlamydophila pneumoniae J138
gugguaaaaauauaggcugcaca

SEQ ID NO: 2564332 - RNA, 12 nt, Chlamydophila pneumoniae J138
guggucuagaga

SEQ ID NO: 2564333 - RNA, 16 nt, Chlamydophila pneumoniae J138
gugguuggauccaucg

SEQ ID NO: 2564334 - RNA, 14 nt, Chlamydophila pneumoniae J138
guguaaaaguuagg

SEQ ID NO: 2564335 - RNA, 20 nt, Chlamydophila pneumoniae J138
guguaccucucaucaaagca

SEQ ID NO: 2564336 - RNA, 15 nt, Chlamydophila pneumoniae J138
guguagccuuucuuu

SEQ ID NO: 2564337 - RNA, 16 nt, Chlamydophila pneumoniae J138
gugucauacgcagcac

SEQ ID NO: 2564338 - RNA, 13 nt, Chlamydophila pneumoniae J138
gugucuugcugau

SEQ ID NO: 2564339 - RNA, 19 nt, Chlamydophila pneumoniae J138
guguggaucacguaagcuu

SEQ ID NO: 2564340 - RNA, 18 nt, Chlamydophila pneumoniae J138
gugugguaaaaauauagg

SEQ ID NO: 2564341 - RNA, 16 nt, Chlamydophila pneumoniae J138
gugugugguaaaaaua

SEQ ID NO: 2564342 - RNA, 17 nt, Chlamydophila pneumoniae J138
guguucaauagcaaaga

SEQ ID NO: 2564343 - RNA, 19 nt, Chlamydophila pneumoniae J138
guuuccaagacaacaccuc

SEQ ID NO: 2564344 - RNA, 22 nt, Chlamydophila pneumoniae J138
guuuccaagacaacaccuccca

SEQ ID NO: 2564345 - RNA, 22 nt, Chlamydophila pneumoniae J138
guuucccaccauauucucagga

SEQ ID NO: 2564346 - RNA, 13 nt, Chlamydophila pneumoniae J138
guuuccuccucuu

SEQ ID NO: 2564347 - RNA, 16 nt, Chlamydophila pneumoniae J138
guuuccuuuucuccuu

SEQ ID NO: 2564348 - RNA, 17 nt, Chlamydophila pneumoniae J138
guuuccuuuucuccuuc

SEQ ID NO: 2564349 - RNA, 17 nt, Chlamydophila pneumoniae J138
guuucgauaucacggcu

SEQ ID NO: 2564350 - RNA, 21 nt, Chlamydophila pneumoniae J138
guuucgcuuugauaauagucu

SEQ ID NO: 2564351 - RNA, 15 nt, Chlamydophila pneumoniae J138
guuucguacaguuuu

SEQ ID NO: 2564352 - RNA, 14 nt, Chlamydophila pneumoniae J138
guuucuaaaacaga

SEQ ID NO: 2564353 - RNA, 13 nt, Chlamydophila pneumoniae J138
guuucuaaauacu

SEQ ID NO: 2564354 - RNA, 23 nt, Chlamydophila pneumoniae J138
guuucuaaauacuuaggaauuuu

SEQ ID NO: 2564355 - RNA, 19 nt, Chlamydophila pneumoniae J138
guuucuagaaaaucucuaa

SEQ ID NO: 2564356 - RNA, 24 nt, Chlamydophila pneumoniae J138
guuucuagaaaaucucuaagaauc

SEQ ID NO: 2564357 - RNA, 13 nt, Chlamydophila pneumoniae J138
guuucuuccugaa

SEQ ID NO: 2564358 - RNA, 23 nt, Chlamydophila pneumoniae J138
guuucuuuuuuuauaaagaagaa

SEQ ID NO: 2564359 - RNA, 15 nt, Chlamydophila pneumoniae J138
guuugaucuucucua

SEQ ID NO: 2564360 - RNA, 15 nt, Chlamydophila pneumoniae J138
guuuggagaagcuca

SEQ ID NO: 2564361 - RNA, 20 nt, Chlamydophila pneumoniae J138
guuuguccuaggagagcuag

SEQ ID NO: 2564362 - RNA, 17 nt, Chlamydophila pneumoniae J138
guuugucguaauugcug

SEQ ID NO: 2564363 - RNA, 18 nt, Chlamydophila pneumoniae J138
guuuuaacucuagaucuu

SEQ ID NO: 2564364 - RNA, 21 nt, Chlamydophila pneumoniae J138
guuuuaauagcuaaagugaug

SEQ ID NO: 2564365 - RNA, 19 nt, Chlamydophila pneumoniae J138
guuuuacgaacuaaaggaa

SEQ ID NO: 2564366 - RNA, 18 nt, Chlamydophila pneumoniae J138
guuuucauaauccaagaa

SEQ ID NO: 2564367 - RNA, 14 nt, Chlamydophila pneumoniae J138
guuuuccugagcuu

SEQ ID NO: 2564368 - RNA, 21 nt, Chlamydophila pneumoniae J138
guuuucggggucggagauugu

SEQ ID NO: 2564369 - RNA, 22 nt, Chlamydophila pneumoniae J138
guuuucuagaaaagauucuaaa

SEQ ID NO: 2564370 - RNA, 12 nt, Chlamydophila pneumoniae J138
guuuucuuuucu

SEQ ID NO: 2564371 - RNA, 20 nt, Chlamydophila pneumoniae J138
guuuucuuuucugaagauuu

SEQ ID NO: 2564372 - RNA, 20 nt, Chlamydophila pneumoniae J138
guuuugauucccuccuuccu

SEQ ID NO: 2564373 - RNA, 18 nt, Chlamydophila pneumoniae J138
guuuugcuguggaauuuu

SEQ ID NO: 2564374 - RNA, 22 nt, Chlamydophila pneumoniae J138
guuuugcuuuuugaaugaucca

SEQ ID NO: 2564375 - RNA, 15 nt, Chlamydophila pneumoniae J138
guuuuggauagaagc

SEQ ID NO: 2564376 - RNA, 19 nt, Chlamydophila pneumoniae J138
guuuuguggcuuuucuaaa

SEQ ID NO: 2564377 - RNA, 16 nt, Chlamydophila pneumoniae J138
guuuuguuucaucuuc

SEQ ID NO: 2564378 - RNA, 18 nt, Chlamydophila pneumoniae J138
guuuuguuucaucuucuu

SEQ ID NO: 2564379 - RNA, 19 nt, Chlamydophila pneumoniae J138
guuuuucaauuuggauuua

SEQ ID NO: 2564380 - RNA, 15 nt, Chlamydophila pneumoniae J138
guuuuucaguuguuu

SEQ ID NO: 2564381 - RNA, 12 nt, Chlamydophila pneumoniae J138
guuuuucccuuu

SEQ ID NO: 2564382 - RNA, 12 nt, Chlamydophila pneumoniae J138
guuuuucuucca

SEQ ID NO: 2564383 - RNA, 16 nt, Chlamydophila pneumoniae J138
guuuuugcuguuucuu

SEQ ID NO: 2564384 - RNA, 20 nt, Chlamydophila pneumoniae J138
guuuuuugaaaacuucaaaa

SEQ ID NO: 2564385 - RNA, 23 nt, Chlamydophila pneumoniae J138
uaaaaaaaagagaagcaguguca

SEQ ID NO: 2564386 - RNA, 11 nt, Chlamydophila pneumoniae J138
uaaaaaagaga

SEQ ID NO: 2564387 - RNA, 15 nt, Chlamydophila pneumoniae J138
uaaaaaauuaucucc

SEQ ID NO: 2564388 - RNA, 16 nt, Chlamydophila pneumoniae J138
uaaaaaauuaucucca

SEQ ID NO: 2564389 - RNA, 23 nt, Chlamydophila pneumoniae J138
uaaaaaauuaucuccaaagauca

SEQ ID NO: 2564390 - RNA, 18 nt, Chlamydophila pneumoniae J138
uaaaaacccuaguucauu

SEQ ID NO: 2564391 - RNA, 22 nt, Chlamydophila pneumoniae J138
uaaaaacccuaguucauuagcu

SEQ ID NO: 2564392 - RNA, 15 nt, Chlamydophila pneumoniae J138
uaaaaacuucccauc

SEQ ID NO: 2564393 - RNA, 19 nt, Chlamydophila pneumoniae J138
uaaaaacuucccaucuugu

SEQ ID NO: 2564394 - RNA, 12 nt, Chlamydophila pneumoniae J138
uaaaaagaaaag

SEQ ID NO: 2564395 - RNA, 20 nt, Chlamydophila pneumoniae J138
uaaaaaguuuuuguucaucc

SEQ ID NO: 2564396 - RNA, 20 nt, Chlamydophila pneumoniae J138
uaaaaauagaaauaagcauc

SEQ ID NO: 2564397 - RNA, 18 nt, Chlamydophila pneumoniae J138
uaaaaauaggagaagccc

SEQ ID NO: 2564398 - RNA, 22 nt, Chlamydophila pneumoniae J138
uaaaaauggcacuugagcacau

SEQ ID NO: 2564399 - RNA, 23 nt, Chlamydophila pneumoniae J138
uaaaaauggcacuugagcacauu

SEQ ID NO: 2564400 - RNA, 13 nt, Chlamydophila pneumoniae J138
uaaaaauuuaaaa

SEQ ID NO: 2564401 - RNA, 19 nt, Chlamydophila pneumoniae J138
uaaaaauuucaugaggagc

SEQ ID NO: 2564402 - RNA, 17 nt, Chlamydophila pneumoniae J138
uaaaacaauuuccugca

SEQ ID NO: 2564403 - RNA, 16 nt, Chlamydophila pneumoniae J138
uaaaacacaaauagca

SEQ ID NO: 2564404 - RNA, 19 nt, Chlamydophila pneumoniae J138
uaaaacacaaauagcaaga

SEQ ID NO: 2564405 - RNA, 20 nt, Chlamydophila pneumoniae J138
uaaaacacaaauagcaagag

SEQ ID NO: 2564406 - RNA, 20 nt, Chlamydophila pneumoniae J138
uaaaacagccuagcaaaacu

SEQ ID NO: 2564407 - RNA, 20 nt, Chlamydophila pneumoniae J138
uaaaacaucagcaacauaaa

SEQ ID NO: 2564408 - RNA, 21 nt, Chlamydophila pneumoniae J138
uaaaacaucagcaacauaaag

SEQ ID NO: 2564409 - RNA, 20 nt, Chlamydophila pneumoniae J138
uaaaaccagcauaaucagua

SEQ ID NO: 2564410 - RNA, 21 nt, Chlamydophila pneumoniae J138
uaaaacuccacgccaaaguac

SEQ ID NO: 2564411 - RNA, 20 nt, Chlamydophila pneumoniae J138
uaaaacugcgcuaucaucau

SEQ ID NO: 2564412 - RNA, 12 nt, Chlamydophila pneumoniae J138
uaaaagaaagaa

SEQ ID NO: 2564413 - RNA, 22 nt, Chlamydophila pneumoniae J138
uaaaagaaagaaugacacagag

SEQ ID NO: 2564414 - RNA, 24 nt, Chlamydophila pneumoniae J138
uaaaagaaagaaugacacagagaa

SEQ ID NO: 2564415 - RNA, 11 nt, Chlamydophila pneumoniae J138
uaaaagaacgu

SEQ ID NO: 2564416 - RNA, 23 nt, Chlamydophila pneumoniae J138
uaaaagaacgucaccauuaaauu

SEQ ID NO: 2564417 - RNA, 24 nt, Chlamydophila pneumoniae J138
uaaaagcccuaauucauauuuacg

SEQ ID NO: 2564418 - RNA, 20 nt, Chlamydophila pneumoniae J138
uaaaagcuuaucccauaaau

SEQ ID NO: 2564419 - RNA, 18 nt, Chlamydophila pneumoniae J138
uaaaagguauuucucucc

SEQ ID NO: 2564420 - RNA, 19 nt, Chlamydophila pneumoniae J138
uaaaagguauuucucucca

SEQ ID NO: 2564421 - RNA, 16 nt, Chlamydophila pneumoniae J138
uaaaaguacgaccaac

SEQ ID NO: 2564422 - RNA, 17 nt, Chlamydophila pneumoniae J138
uaaaaguagcauccugu

SEQ ID NO: 2564423 - RNA, 21 nt, Chlamydophila pneumoniae J138
uaaaaguuagguagauagaaa

SEQ ID NO: 2564424 - RNA, 17 nt, Chlamydophila pneumoniae J138
uaaaaguucagcaagga

SEQ ID NO: 2564425 - RNA, 15 nt, Chlamydophila pneumoniae J138
uaaaauaaagagcug

SEQ ID NO: 2564426 - RNA, 22 nt, Chlamydophila pneumoniae J138
uaaaauaaccccuccaaaauca

SEQ ID NO: 2564427 - RNA, 12 nt, Chlamydophila pneumoniae J138
uaaaauaagaaa

SEQ ID NO: 2564428 - RNA, 14 nt, Chlamydophila pneumoniae J138
uaaaauaagaaauc

SEQ ID NO: 2564429 - RNA, 16 nt, Chlamydophila pneumoniae J138
uaaaauaauuuuauua

SEQ ID NO: 2564430 - RNA, 13 nt, Chlamydophila pneumoniae J138
uaaaauagcccua

SEQ ID NO: 2564431 - RNA, 18 nt, Chlamydophila pneumoniae J138
uaaaauaucggauuuuac

SEQ ID NO: 2564432 - RNA, 23 nt, Chlamydophila pneumoniae J138
uaaaauaugcucgugcgacugcu

SEQ ID NO: 2564433 - RNA, 14 nt, Chlamydophila pneumoniae J138
uaaaaucaacaagu

SEQ ID NO: 2564434 - RNA, 15 nt, Chlamydophila pneumoniae J138
uaaaaucauaggcua

SEQ ID NO: 2564435 - RNA, 18 nt, Chlamydophila pneumoniae J138
uaaaaucuccucucucaa

SEQ ID NO: 2564436 - RNA, 23 nt, Chlamydophila pneumoniae J138
uaaaauggguuugcuuuucauuu

SEQ ID NO: 2564437 - RNA, 22 nt, Chlamydophila pneumoniae J138
uaaaauuguuuguaucaaagaa

SEQ ID NO: 2564438 - RNA, 15 nt, Chlamydophila pneumoniae J138
uaaaauuuaaaaaaa

SEQ ID NO: 2564439 - RNA, 12 nt, Chlamydophila pneumoniae J138
uaaaauuucuag

SEQ ID NO: 2564440 - RNA, 14 nt, Chlamydophila pneumoniae J138
uaaaauuucuagga

SEQ ID NO: 2564441 - RNA, 23 nt, Chlamydophila pneumoniae J138
uaaaauuucuaggacagcacaua

SEQ ID NO: 2564442 - RNA, 13 nt, Chlamydophila pneumoniae J138
uaaauuaguaaau

SEQ ID NO: 2564443 - RNA, 16 nt, Chlamydophila pneumoniae J138
uaaauuaguaaaugcc

SEQ ID NO: 2564444 - RNA, 12 nt, Chlamydophila pneumoniae J138
uaaauucuggaa

SEQ ID NO: 2564445 - RNA, 13 nt, Chlamydophila pneumoniae J138
uaaauucuggaau

SEQ ID NO: 2564446 - RNA, 16 nt, Chlamydophila pneumoniae J138
uaaauuucauuugaaa

SEQ ID NO: 2564447 - RNA, 16 nt, Chlamydophila pneumoniae J138
uaaauuugucaucaca

SEQ ID NO: 2564448 - RNA, 20 nt, Chlamydophila pneumoniae J138
uaaauuuuuccuucaacaca

SEQ ID NO: 2564449 - RNA, 19 nt, Chlamydophila pneumoniae J138
uaacaacuucugacaauaa

SEQ ID NO: 2564450 - RNA, 18 nt, Chlamydophila pneumoniae J138
uaacaagggaagagaaaa

SEQ ID NO: 2564451 - RNA, 17 nt, Chlamydophila pneumoniae J138
uaacaaguaccaagaaa

SEQ ID NO: 2564452 - RNA, 15 nt, Chlamydophila pneumoniae J138
uaacaccaaaagaau

SEQ ID NO: 2564453 - RNA, 16 nt, Chlamydophila pneumoniae J138
uaacaccaaaagaaua

SEQ ID NO: 2564454 - RNA, 20 nt, Chlamydophila pneumoniae J138
uaacaccaaaagaauacuca

SEQ ID NO: 2564455 - RNA, 15 nt, Chlamydophila pneumoniae J138
uaacacccucccuca

SEQ ID NO: 2564456 - RNA, 13 nt, Chlamydophila pneumoniae J138
uaacacuucuuuc

SEQ ID NO: 2564457 - RNA, 18 nt, Chlamydophila pneumoniae J138
uaacacuucuuucuugcu

SEQ ID NO: 2564458 - RNA, 17 nt, Chlamydophila pneumoniae J138
uaacacuuuguuuuuca

SEQ ID NO: 2564459 - RNA, 14 nt, Chlamydophila pneumoniae J138
uaacagagcgccuc

SEQ ID NO: 2564460 - RNA, 18 nt, Chlamydophila pneumoniae J138
uaacagagcgccuccacc

SEQ ID NO: 2564461 - RNA, 19 nt, Chlamydophila pneumoniae J138
uaacagagcgccuccaccu

SEQ ID NO: 2564462 - RNA, 20 nt, Chlamydophila pneumoniae J138
uaacauaaagucaaacauca

SEQ ID NO: 2564463 - RNA, 13 nt, Chlamydophila pneumoniae J138
uaacaucaagaau

SEQ ID NO: 2564464 - RNA, 17 nt, Chlamydophila pneumoniae J138
uaacaucaagaauuucu

SEQ ID NO: 2564465 - RNA, 17 nt, Chlamydophila pneumoniae J138
uaacauccauagagaac

SEQ ID NO: 2564466 - RNA, 14 nt, Chlamydophila pneumoniae J138
uaacaucuaaaaau

SEQ ID NO: 2564467 - RNA, 19 nt, Chlamydophila pneumoniae J138
uaacaugaaaagcuagucu

SEQ ID NO: 2564468 - RNA, 24 nt, Chlamydophila pneumoniae J138
uaacaugccaaaaguuuugaggau

SEQ ID NO: 2564469 - RNA, 22 nt, Chlamydophila pneumoniae J138
uaacaugcgcagaauaaaaugg

SEQ ID NO: 2564470 - RNA, 22 nt, Chlamydophila pneumoniae J138
uaacauuggagucuaaaaaaua

SEQ ID NO: 2564471 - RNA, 22 nt, Chlamydophila pneumoniae J138
uaacauuuagauaaagaaagcg

SEQ ID NO: 2564472 - RNA, 18 nt, Chlamydophila pneumoniae J138
uaacauuucguuuuuucu

SEQ ID NO: 2564473 - RNA, 20 nt, Chlamydophila pneumoniae J138
uaacauuucguuuuuucuua

SEQ ID NO: 2564474 - RNA, 22 nt, Chlamydophila pneumoniae J138
uaacauuucguuuuuucuuauc

SEQ ID NO: 2564475 - RNA, 14 nt, Chlamydophila pneumoniae J138
uaaccaaaagaauu

SEQ ID NO: 2564476 - RNA, 23 nt, Chlamydophila pneumoniae J138
uaaccaaaagaauuaagaagaag

SEQ ID NO: 2564477 - RNA, 18 nt, Chlamydophila pneumoniae J138
uaaccaaccuuguugaaa

SEQ ID NO: 2564478 - RNA, 13 nt, Chlamydophila pneumoniae J138
uaaccagaagacu

SEQ ID NO: 2564479 - RNA, 17 nt, Chlamydophila pneumoniae J138
uaaccccuccaaaauca

SEQ ID NO: 2564480 - RNA, 24 nt, Chlamydophila pneumoniae J138
uaacccgcuugcaucuuauggaag

SEQ ID NO: 2564481 - RNA, 17 nt, Chlamydophila pneumoniae J138
uaaccgaaacuucucag

SEQ ID NO: 2564482 - RNA, 21 nt, Chlamydophila pneumoniae J138
uaaccguggcuuuguaaaaau

SEQ ID NO: 2564483 - RNA, 17 nt, Chlamydophila pneumoniae J138
uaaccuaaggcauggca

SEQ ID NO: 2564484 - RNA, 16 nt, Chlamydophila pneumoniae J138
uaaccuccucaagaau

SEQ ID NO: 2564485 - RNA, 13 nt, Chlamydophila pneumoniae J138
uaaccucuuuucu

SEQ ID NO: 2564486 - RNA, 20 nt, Chlamydophila pneumoniae J138
uaaccuuugacaacaccaca

SEQ ID NO: 2564487 - RNA, 21 nt, Chlamydophila pneumoniae J138
uaaccuuugacaacaccacag

SEQ ID NO: 2564488 - RNA, 19 nt, Chlamydophila pneumoniae J138
uaacgaagugaggagaaua

SEQ ID NO: 2564489 - RNA, 22 nt, Chlamydophila pneumoniae J138
uaacgauuucuugaagaucucc

SEQ ID NO: 2564490 - RNA, 23 nt, Chlamydophila pneumoniae J138
uaacguacgcaaguaaagaaauu

SEQ ID NO: 2564491 - RNA, 17 nt, Chlamydophila pneumoniae J138
uaacguagucaaaaauu

SEQ ID NO: 2564492 - RNA, 19 nt, Chlamydophila pneumoniae J138
uaacguagucaaaaauucu

SEQ ID NO: 2564493 - RNA, 14 nt, Chlamydophila pneumoniae J138
uaacguugauugga

SEQ ID NO: 2564494 - RNA, 14 nt, Chlamydophila pneumoniae J138
uaacguugccuguu

SEQ ID NO: 2564495 - RNA, 19 nt, Chlamydophila pneumoniae J138
uaacguuucaggucagcaa

SEQ ID NO: 2564496 - RNA, 20 nt, Chlamydophila pneumoniae J138
uaacuaaauucuuaacaaua

SEQ ID NO: 2564497 - RNA, 19 nt, Chlamydophila pneumoniae J138
uaacuaucuacacaguagc

SEQ ID NO: 2564498 - RNA, 22 nt, Chlamydophila pneumoniae J138
uaacuaucucuguuuuuugaaa

SEQ ID NO: 2564499 - RNA, 23 nt, Chlamydophila pneumoniae J138
uaacuaucucuguuuuuugaaaa

SEQ ID NO: 2564500 - RNA, 14 nt, Chlamydophila pneumoniae J138
uaacuccagcgagg

SEQ ID NO: 2564501 - RNA, 19 nt, Chlamydophila pneumoniae J138
uaacuccaggggauaaaac

SEQ ID NO: 2564502 - RNA, 17 nt, Chlamydophila pneumoniae J138
uaacucggaaaaaauag

SEQ ID NO: 2564503 - RNA, 17 nt, Chlamydophila pneumoniae J138
uaacucuuaagaauaaa

SEQ ID NO: 2564504 - RNA, 19 nt, Chlamydophila pneumoniae J138
uaacugagcaacuucuucg

SEQ ID NO: 2564505 - RNA, 16 nt, Chlamydophila pneumoniae J138
uaacugaggcaaagau

SEQ ID NO: 2564506 - RNA, 15 nt, Chlamydophila pneumoniae J138
uaacuggcaaucuaa

SEQ ID NO: 2564507 - RNA, 21 nt, Chlamydophila pneumoniae J138
uaacuugcauuuuuuggaaua

SEQ ID NO: 2564508 - RNA, 21 nt, Chlamydophila pneumoniae J138
uaacuuggugagcagcuuuau

SEQ ID NO: 2564509 - RNA, 22 nt, Chlamydophila pneumoniae J138
uaacuuggugagcagcuuuauc

SEQ ID NO: 2564510 - RNA, 15 nt, Chlamydophila pneumoniae J138
uaacuuuaucauaga

SEQ ID NO: 2564511 - RNA, 16 nt, Chlamydophila pneumoniae J138
uaacuuuauguuuucu

SEQ ID NO: 2564512 - RNA, 13 nt, Chlamydophila pneumoniae J138
uaagaaaauccua

SEQ ID NO: 2564513 - RNA, 18 nt, Chlamydophila pneumoniae J138
uaagaaaaugaggacaca

SEQ ID NO: 2564514 - RNA, 23 nt, Chlamydophila pneumoniae J138
uaagaaacuaguucuucuuuacu

SEQ ID NO: 2564515 - RNA, 14 nt, Chlamydophila pneumoniae J138
uaagaaacuuccaa

SEQ ID NO: 2564516 - RNA, 17 nt, Chlamydophila pneumoniae J138
uaagaaagcuugucaua

SEQ ID NO: 2564517 - RNA, 22 nt, Chlamydophila pneumoniae J138
uaagaaaggcacuccaaaacuc

SEQ ID NO: 2564518 - RNA, 13 nt, Chlamydophila pneumoniae J138
uaagaaaucccag

SEQ ID NO: 2564519 - RNA, 15 nt, Chlamydophila pneumoniae J138
uaagaacguauacgu

SEQ ID NO: 2564520 - RNA, 15 nt, Chlamydophila pneumoniae J138
uaagaacuagaaaaa

SEQ ID NO: 2564521 - RNA, 19 nt, Chlamydophila pneumoniae J138
uaagaagcucacucuuuaa

SEQ ID NO: 2564522 - RNA, 20 nt, Chlamydophila pneumoniae J138
uaagaagguuuauuagaagu

SEQ ID NO: 2564523 - RNA, 18 nt, Chlamydophila pneumoniae J138
uaagaaucuauagaacua

SEQ ID NO: 2564524 - RNA, 16 nt, Chlamydophila pneumoniae J138
uaagaaugagaacguc

SEQ ID NO: 2564525 - RNA, 22 nt, Chlamydophila pneumoniae J138
uaagacauuauagaggucuuug

SEQ ID NO: 2564526 - RNA, 18 nt, Chlamydophila pneumoniae J138
uaagaccaaacuuucuuu

SEQ ID NO: 2564527 - RNA, 12 nt, Chlamydophila pneumoniae J138
uaagaccagaaa

SEQ ID NO: 2564528 - RNA, 16 nt, Chlamydophila pneumoniae J138
uaagacgugcaucgcu

SEQ ID NO: 2564529 - RNA, 15 nt, Chlamydophila pneumoniae J138
uaagacuaaaaaaga

SEQ ID NO: 2564530 - RNA, 18 nt, Chlamydophila pneumoniae J138
uaagacugucuaugaucc

SEQ ID NO: 2564531 - RNA, 17 nt, Chlamydophila pneumoniae J138
uaagagacauuucuuga

SEQ ID NO: 2564532 - RNA, 15 nt, Chlamydophila pneumoniae J138
uaagagcaaacauca

SEQ ID NO: 2564533 - RNA, 17 nt, Chlamydophila pneumoniae J138
uaagagcaaacaucaaa

SEQ ID NO: 2564534 - RNA, 18 nt, Chlamydophila pneumoniae J138
uaagagcaaacaucaaag

SEQ ID NO: 2564535 - RNA, 12 nt, Chlamydophila pneumoniae J138
uaagagcuacaa

SEQ ID NO: 2564536 - RNA, 12 nt, Chlamydophila pneumoniae J138
uaagaggaaagc

SEQ ID NO: 2564537 - RNA, 17 nt, Chlamydophila pneumoniae J138
uaagaggugauacauag

SEQ ID NO: 2564538 - RNA, 16 nt, Chlamydophila pneumoniae J138
uaagagguucucuuaa

SEQ ID NO: 2564539 - RNA, 17 nt, Chlamydophila pneumoniae J138
uaagagguucuugcuua

SEQ ID NO: 2564540 - RNA, 21 nt, Chlamydophila pneumoniae J138
uaagaguuuuacaucaaugau

SEQ ID NO: 2564541 - RNA, 14 nt, Chlamydophila pneumoniae J138
uaagauaaacagca

SEQ ID NO: 2564542 - RNA, 21 nt, Chlamydophila pneumoniae J138
uaauccuucuuucugcucuuc

SEQ ID NO: 2564543 - RNA, 20 nt, Chlamydophila pneumoniae J138
uaauccuuucacaaagaauu

SEQ ID NO: 2564544 - RNA, 18 nt, Chlamydophila pneumoniae J138
uaaucgagagaagaaauu

SEQ ID NO: 2564545 - RNA, 20 nt, Chlamydophila pneumoniae J138
uaaucgagagaagaaauucu

SEQ ID NO: 2564546 - RNA, 22 nt, Chlamydophila pneumoniae J138
uaaucuccaaacauuuuuaagg

SEQ ID NO: 2564547 - RNA, 21 nt, Chlamydophila pneumoniae J138
uaaucucgcaguccuugagcu

SEQ ID NO: 2564548 - RNA, 12 nt, Chlamydophila pneumoniae J138
uaaucuguauau

SEQ ID NO: 2564549 - RNA, 21 nt, Chlamydophila pneumoniae J138
uaaucuugaucagcaaucaca

SEQ ID NO: 2564550 - RNA, 13 nt, Chlamydophila pneumoniae J138
uaaugaacucagg

SEQ ID NO: 2564551 - RNA, 18 nt, Chlamydophila pneumoniae J138
uaaugaaguuugcaugca

SEQ ID NO: 2564552 - RNA, 19 nt, Chlamydophila pneumoniae J138
uaaugacagcugagaaauu

SEQ ID NO: 2564553 - RNA, 15 nt, Chlamydophila pneumoniae J138
uaaugacagugucca

SEQ ID NO: 2564554 - RNA, 16 nt, Chlamydophila pneumoniae J138
uaaugacucuagagua

SEQ ID NO: 2564555 - RNA, 17 nt, Chlamydophila pneumoniae J138
uaaugccaauaugguag

SEQ ID NO: 2564556 - RNA, 22 nt, Chlamydophila pneumoniae J138
uaaugcuaucccacuaacaaga

SEQ ID NO: 2564557 - RNA, 21 nt, Chlamydophila pneumoniae J138
uaauggaccagaugcuaaaga

SEQ ID NO: 2564558 - RNA, 20 nt, Chlamydophila pneumoniae J138
uaauggagagcuuucgcucc

SEQ ID NO: 2564559 - RNA, 20 nt, Chlamydophila pneumoniae J138
uaauggugucuuacaaaccc

SEQ ID NO: 2564560 - RNA, 14 nt, Chlamydophila pneumoniae J138
uaaugucuccaucg

SEQ ID NO: 2564561 - RNA, 23 nt, Chlamydophila pneumoniae J138
uaaugucuccaucggaauuugcc

SEQ ID NO: 2564562 - RNA, 12 nt, Chlamydophila pneumoniae J138
uaauuaaauaua

SEQ ID NO: 2564563 - RNA, 15 nt, Chlamydophila pneumoniae J138
uaauuacagaucugc

SEQ ID NO: 2564564 - RNA, 15 nt, Chlamydophila pneumoniae J138
uaauuauguagaucu

SEQ ID NO: 2564565 - RNA, 13 nt, Chlamydophila pneumoniae J138
uaauucaaaaaga

SEQ ID NO: 2564566 - RNA, 15 nt, Chlamydophila pneumoniae J138
uaauucaaaaagaga

SEQ ID NO: 2564567 - RNA, 17 nt, Chlamydophila pneumoniae J138
uaauucagaaagacgau

SEQ ID NO: 2564568 - RNA, 20 nt, Chlamydophila pneumoniae J138
uaauuccaaaauaaaaggag

SEQ ID NO: 2564569 - RNA, 16 nt, Chlamydophila pneumoniae J138
uaauuccaucuggaau

SEQ ID NO: 2564570 - RNA, 20 nt, Chlamydophila pneumoniae J138
uaauuccaucuggaauggcc

SEQ ID NO: 2564571 - RNA, 15 nt, Chlamydophila pneumoniae J138
uaauuguagagagaa

SEQ ID NO: 2564572 - RNA, 16 nt, Chlamydophila pneumoniae J138
uaauugugcucucuaa

SEQ ID NO: 2564573 - RNA, 22 nt, Chlamydophila pneumoniae J138
uaauuuaaaugccuuaaaugua

SEQ ID NO: 2564574 - RNA, 17 nt, Chlamydophila pneumoniae J138
uaauuucccuaaaauga

SEQ ID NO: 2564575 - RNA, 22 nt, Chlamydophila pneumoniae J138
uaauuuccuucaggauuuucca

SEQ ID NO: 2564576 - RNA, 20 nt, Chlamydophila pneumoniae J138
uaauuucuaaauagaaaaca

SEQ ID NO: 2564577 - RNA, 12 nt, Chlamydophila pneumoniae J138
uaauuucuuaca

SEQ ID NO: 2564578 - RNA, 22 nt, Chlamydophila pneumoniae J138
uaauuucuuucacaucuuuaga

SEQ ID NO: 2564579 - RNA, 17 nt, Chlamydophila pneumoniae J138
uaauuuuaaauuuuguu

SEQ ID NO: 2564580 - RNA, 13 nt, Chlamydophila pneumoniae J138
uaauuuuagcuuc

SEQ ID NO: 2564581 - RNA, 19 nt, Chlamydophila pneumoniae J138
uaauuuucccaauauccuc

SEQ ID NO: 2564582 - RNA, 15 nt, Chlamydophila pneumoniae J138
uaauuuuucuuagua

SEQ ID NO: 2564583 - RNA, 16 nt, Chlamydophila pneumoniae J138
uacaaaaaauaaaauc

SEQ ID NO: 2564584 - RNA, 18 nt, Chlamydophila pneumoniae J138
uacaaaaaauaaaaucaa

SEQ ID NO: 2564585 - RNA, 14 nt, Chlamydophila pneumoniae J138
uacaaaacaaaagc

SEQ ID NO: 2564586 - RNA, 16 nt, Chlamydophila pneumoniae J138
uacaaaacaaaagcca

SEQ ID NO: 2564587 - RNA, 13 nt, Chlamydophila pneumoniae J138
uacaaaauuauua

SEQ ID NO: 2564588 - RNA, 12 nt, Chlamydophila pneumoniae J138
uacaaacaagaa

SEQ ID NO: 2564589 - RNA, 16 nt, Chlamydophila pneumoniae J138
uacaaacaagaagcgu

SEQ ID NO: 2564590 - RNA, 16 nt, Chlamydophila pneumoniae J138
uacaaacccauauuug

SEQ ID NO: 2564591 - RNA, 18 nt, Chlamydophila pneumoniae J138
uacaaacccauauuugaa

SEQ ID NO: 2564592 - RNA, 14 nt, Chlamydophila pneumoniae J138
uacaaacucuucca

SEQ ID NO: 2564593 - RNA, 23 nt, Chlamydophila pneumoniae J138
uacaaauagcucugcgccaugca

SEQ ID NO: 2564594 - RNA, 24 nt, Chlamydophila pneumoniae J138
uacaaauggcaugaaagauaaugu

SEQ ID NO: 2564595 - RNA, 20 nt, Chlamydophila pneumoniae J138
uacaagcaauacuaagaagc

SEQ ID NO: 2564596 - RNA, 15 nt, Chlamydophila pneumoniae J138
uacaagcuuccuugg

SEQ ID NO: 2564597 - RNA, 21 nt, Chlamydophila pneumoniae J138
uacaaguaauuccccuuuaaa

SEQ ID NO: 2564598 - RNA, 12 nt, Chlamydophila pneumoniae J138
uacaaguugaga

SEQ ID NO: 2564599 - RNA, 17 nt, Chlamydophila pneumoniae J138
uacaaguugagagagag

SEQ ID NO: 2564600 - RNA, 13 nt, Chlamydophila pneumoniae J138
uacaauaaacaac

SEQ ID NO: 2564601 - RNA, 23 nt, Chlamydophila pneumoniae J138
uacaauaaccaggggcuuuccuu

SEQ ID NO: 2564602 - RNA, 13 nt, Chlamydophila pneumoniae J138
uacaauacuggag

SEQ ID NO: 2564603 - RNA, 16 nt, Chlamydophila pneumoniae J138
uacaauacuggagagg

SEQ ID NO: 2564604 - RNA, 17 nt, Chlamydophila pneumoniae J138
uacaaucgccuuacaau

SEQ ID NO: 2564605 - RNA, 17 nt, Chlamydophila pneumoniae J138
uacaaugauauaaaagc

SEQ ID NO: 2564606 - RNA, 13 nt, Chlamydophila pneumoniae J138
uacaauuaaaaaa

SEQ ID NO: 2564607 - RNA, 20 nt, Chlamydophila pneumoniae J138
uacaauuagagauucauaaa

SEQ ID NO: 2564608 - RNA, 23 nt, Chlamydophila pneumoniae J138
uacaauuagagauucauaaaacu

SEQ ID NO: 2564609 - RNA, 14 nt, Chlamydophila pneumoniae J138
uacaauuuaaaucu

SEQ ID NO: 2564610 - RNA, 21 nt, Chlamydophila pneumoniae J138
uacaauuuccuugguauccca

SEQ ID NO: 2564611 - RNA, 21 nt, Chlamydophila pneumoniae J138
uacaauuugcuccuccaaaag

SEQ ID NO: 2564612 - RNA, 18 nt, Chlamydophila pneumoniae J138
uacacauugucucuuuua

SEQ ID NO: 2564613 - RNA, 17 nt, Chlamydophila pneumoniae J138
uacacccgcaagcacuu

SEQ ID NO: 2564614 - RNA, 19 nt, Chlamydophila pneumoniae J138
uacaccuacagaucaggau

SEQ ID NO: 2564615 - RNA, 16 nt, Chlamydophila pneumoniae J138
uacacuauaagacauu

SEQ ID NO: 2564616 - RNA, 18 nt, Chlamydophila pneumoniae J138
uacacuccaauaagacga

SEQ ID NO: 2564617 - RNA, 19 nt, Chlamydophila pneumoniae J138
uacacuguuguaauaaaau

SEQ ID NO: 2564618 - RNA, 23 nt, Chlamydophila pneumoniae J138
uacacuguuguaauaaaaucaug

SEQ ID NO: 2564619 - RNA, 21 nt, Chlamydophila pneumoniae J138
uacacuuauguucuaugagau

SEQ ID NO: 2564620 - RNA, 15 nt, Chlamydophila pneumoniae J138
uacacuucuaauaca

SEQ ID NO: 2564621 - RNA, 22 nt, Chlamydophila pneumoniae J138
uacagaaaauaagaagcagcac

SEQ ID NO: 2564622 - RNA, 21 nt, Chlamydophila pneumoniae J138
uacagaaagagcuaaagaaac

SEQ ID NO: 2564623 - RNA, 22 nt, Chlamydophila pneumoniae J138
uacagaaagagcuaaagaaacu

SEQ ID NO: 2564624 - RNA, 23 nt, Chlamydophila pneumoniae J138
uacagaaagagcuaaagaaacuu

SEQ ID NO: 2564625 - RNA, 14 nt, Chlamydophila pneumoniae J138
uacagaacaauggu

SEQ ID NO: 2564626 - RNA, 18 nt, Chlamydophila pneumoniae J138
uacagaccguccucccca

SEQ ID NO: 2564627 - RNA, 22 nt, Chlamydophila pneumoniae J138
uacagagagaaacuuaguuuug

SEQ ID NO: 2564628 - RNA, 18 nt, Chlamydophila pneumoniae J138
uacagaggaaucuauccu

SEQ ID NO: 2564629 - RNA, 19 nt, Chlamydophila pneumoniae J138
uacagagggcuucauuccu

SEQ ID NO: 2564630 - RNA, 21 nt, Chlamydophila pneumoniae J138
uacagagucuguguagccgua

SEQ ID NO: 2564631 - RNA, 23 nt, Chlamydophila pneumoniae J138
uacagaucaggauucuaaaaaga

SEQ ID NO: 2564632 - RNA, 15 nt, Chlamydophila pneumoniae J138
uacagaucugcauaa

SEQ ID NO: 2564633 - RNA, 19 nt, Chlamydophila pneumoniae J138
uacagauucaccaagaaca

SEQ ID NO: 2564634 - RNA, 14 nt, Chlamydophila pneumoniae J138
uacagauuucagau

SEQ ID NO: 2564635 - RNA, 18 nt, Chlamydophila pneumoniae J138
uacagauuucuucuucag

SEQ ID NO: 2564636 - RNA, 15 nt, Chlamydophila pneumoniae J138
uacagcauaaaaauu

SEQ ID NO: 2564637 - RNA, 14 nt, Chlamydophila pneumoniae J138
uacagccagcagaa

SEQ ID NO: 2564638 - RNA, 23 nt, Chlamydophila pneumoniae J138
uacagcgcuuucgggaauaauag

SEQ ID NO: 2564639 - RNA, 20 nt, Chlamydophila pneumoniae J138
uacagcguugcuaagcauag

SEQ ID NO: 2564640 - RNA, 17 nt, Chlamydophila pneumoniae J138
uacagcuucauuaucuu

SEQ ID NO: 2564641 - RNA, 16 nt, Chlamydophila pneumoniae J138
uacuuuuacugaaauu

SEQ ID NO: 2564642 - RNA, 10 nt, Chlamydophila pneumoniae J138
uagaaaagau

SEQ ID NO: 2564643 - RNA, 18 nt, Chlamydophila pneumoniae J138
uagaaaagauaaaacauu

SEQ ID NO: 2564644 - RNA, 20 nt, Chlamydophila pneumoniae J138
uagaaacaacugaaaaacca

SEQ ID NO: 2564645 - RNA, 19 nt, Chlamydophila pneumoniae J138
uagaaacauuuaagucauu

SEQ ID NO: 2564646 - RNA, 19 nt, Chlamydophila pneumoniae J138
uagaaaccaugaugcaaug

SEQ ID NO: 2564647 - RNA, 14 nt, Chlamydophila pneumoniae J138
uagaaagacaaaaa

SEQ ID NO: 2564648 - RNA, 20 nt, Chlamydophila pneumoniae J138
uagaaagacauccuucuuua

SEQ ID NO: 2564649 - RNA, 21 nt, Chlamydophila pneumoniae J138
uagaaagauuuauuuugucuu

SEQ ID NO: 2564650 - RNA, 20 nt, Chlamydophila pneumoniae J138
uagaaauaagcaucuagaau

SEQ ID NO: 2564651 - RNA, 16 nt, Chlamydophila pneumoniae J138
uagaaauauacucuug

SEQ ID NO: 2564652 - RNA, 22 nt, Chlamydophila pneumoniae J138
uagaaauauacucuugcuugcu

SEQ ID NO: 2564653 - RNA, 23 nt, Chlamydophila pneumoniae J138
uagaaauauacucuugcuugcua

SEQ ID NO: 2564654 - RNA, 14 nt, Chlamydophila pneumoniae J138
uagaaauuccaauu

SEQ ID NO: 2564655 - RNA, 21 nt, Chlamydophila pneumoniae J138
uagaaauuccaauuuuugcau

SEQ ID NO: 2564656 - RNA, 14 nt, Chlamydophila pneumoniae J138
uagaaauucuaaga

SEQ ID NO: 2564657 - RNA, 20 nt, Chlamydophila pneumoniae J138
uagaaauucuguagauacua

SEQ ID NO: 2564658 - RNA, 22 nt, Chlamydophila pneumoniae J138
uagaacagcauggacuccaaga

SEQ ID NO: 2564659 - RNA, 20 nt, Chlamydophila pneumoniae J138
uagaacaggauugauaaaua

SEQ ID NO: 2564660 - RNA, 19 nt, Chlamydophila pneumoniae J138
uagaacuucucaagaaucu

SEQ ID NO: 2564661 - RNA, 19 nt, Chlamydophila pneumoniae J138
uagaacuugggaugcuacu

SEQ ID NO: 2564662 - RNA, 18 nt, Chlamydophila pneumoniae J138
uagaagccaccaucuguu

SEQ ID NO: 2564663 - RNA, 14 nt, Chlamydophila pneumoniae J138
uagaagcccgcagu

SEQ ID NO: 2564664 - RNA, 12 nt, Chlamydophila pneumoniae J138
uagaagcugcug

SEQ ID NO: 2564665 - RNA, 15 nt, Chlamydophila pneumoniae J138
uagaagcugcugcua

SEQ ID NO: 2564666 - RNA, 18 nt, Chlamydophila pneumoniae J138
uagaaggggguucuaaga

SEQ ID NO: 2564667 - RNA, 11 nt, Chlamydophila pneumoniae J138
uagaauagaag

SEQ ID NO: 2564668 - RNA, 15 nt, Chlamydophila pneumoniae J138
uagaaucacauaaaa

SEQ ID NO: 2564669 - RNA, 22 nt, Chlamydophila pneumoniae J138
uagaaucagagggacuccugug

SEQ ID NO: 2564670 - RNA, 16 nt, Chlamydophila pneumoniae J138
uagaauccaaagacuu

SEQ ID NO: 2564671 - RNA, 12 nt, Chlamydophila pneumoniae J138
uagaauccucua

SEQ ID NO: 2564672 - RNA, 16 nt, Chlamydophila pneumoniae J138
uagaauccugaucugu

SEQ ID NO: 2564673 - RNA, 18 nt, Chlamydophila pneumoniae J138
uagaauccuucucccucu

SEQ ID NO: 2564674 - RNA, 14 nt, Chlamydophila pneumoniae J138
uagaauuuguccuu

SEQ ID NO: 2564675 - RNA, 21 nt, Chlamydophila pneumoniae J138
uagacaacaagucuucccucu

SEQ ID NO: 2564676 - RNA, 18 nt, Chlamydophila pneumoniae J138
uagacaacgcaggaagaa

SEQ ID NO: 2564677 - RNA, 22 nt, Chlamydophila pneumoniae J138
uagacaacgcaggaagaacaag

SEQ ID NO: 2564678 - RNA, 16 nt, Chlamydophila pneumoniae J138
uagacaagagagagcu

SEQ ID NO: 2564679 - RNA, 23 nt, Chlamydophila pneumoniae J138
uagacacgaccacuacuuaaagc

SEQ ID NO: 2564680 - RNA, 22 nt, Chlamydophila pneumoniae J138
uagacacuugcuuaaggaaaca

SEQ ID NO: 2564681 - RNA, 18 nt, Chlamydophila pneumoniae J138
uagacaggauggaaucag

SEQ ID NO: 2564682 - RNA, 17 nt, Chlamydophila pneumoniae J138
uagacaugcgaagggag

SEQ ID NO: 2564683 - RNA, 20 nt, Chlamydophila pneumoniae J138
uagacaugcgaagggaggag

SEQ ID NO: 2564684 - RNA, 20 nt, Chlamydophila pneumoniae J138
uagaccccccauuccaaagc

SEQ ID NO: 2564685 - RNA, 22 nt, Chlamydophila pneumoniae J138
uagaccggaucccguaaaagaa

SEQ ID NO: 2564686 - RNA, 17 nt, Chlamydophila pneumoniae J138
uagacgaggagaagucg

SEQ ID NO: 2564687 - RNA, 18 nt, Chlamydophila pneumoniae J138
uagacucucacugagugu

SEQ ID NO: 2564688 - RNA, 19 nt, Chlamydophila pneumoniae J138
uagacuuguauucuugaga

SEQ ID NO: 2564689 - RNA, 21 nt, Chlamydophila pneumoniae J138
uagacuuguauucuugagagu

SEQ ID NO: 2564690 - RNA, 22 nt, Chlamydophila pneumoniae J138
uagagaaauuuuuaauuuuucu

SEQ ID NO: 2564691 - RNA, 18 nt, Chlamydophila pneumoniae J138
uagagaacgaacaguuca

SEQ ID NO: 2564692 - RNA, 13 nt, Chlamydophila pneumoniae J138
uagagaagaggug

SEQ ID NO: 2564693 - RNA, 16 nt, Chlamydophila pneumoniae J138
uagagacagccuguuu

SEQ ID NO: 2564694 - RNA, 20 nt, Chlamydophila pneumoniae J138
uagagacagccuguuuucuu

SEQ ID NO: 2564695 - RNA, 13 nt, Chlamydophila pneumoniae J138
uagagacaucgua

SEQ ID NO: 2564696 - RNA, 21 nt, Chlamydophila pneumoniae J138
uagagacgaacgaagaaaacg

SEQ ID NO: 2564697 - RNA, 15 nt, Chlamydophila pneumoniae J138
uagagagaaacaucg

SEQ ID NO: 2564698 - RNA, 19 nt, Chlamydophila pneumoniae J138
uagagagaaggaauuaaaa

SEQ ID NO: 2564699 - RNA, 22 nt, Chlamydophila pneumoniae J138
uagagagagucggcuuuagaaa

SEQ ID NO: 2564700 - RNA, 17 nt, Chlamydophila pneumoniae J138
uagagagcgcagagucu

SEQ ID NO: 2564701 - RNA, 17 nt, Chlamydophila pneumoniae J138
uagagauccaaugacaa

SEQ ID NO: 2564702 - RNA, 22 nt, Chlamydophila pneumoniae J138
uagagauucauaaaacuguaau

SEQ ID NO: 2564703 - RNA, 18 nt, Chlamydophila pneumoniae J138
uagagauuguaauuuccu

SEQ ID NO: 2564704 - RNA, 13 nt, Chlamydophila pneumoniae J138
uagagauuuuucu

SEQ ID NO: 2564705 - RNA, 23 nt, Chlamydophila pneumoniae J138
uagagcaagauucuucagaaucu

SEQ ID NO: 2564706 - RNA, 17 nt, Chlamydophila pneumoniae J138
uagagcacauagaaaca

SEQ ID NO: 2564707 - RNA, 19 nt, Chlamydophila pneumoniae J138
uagagcacauagaaacagu

SEQ ID NO: 2564708 - RNA, 11 nt, Chlamydophila pneumoniae J138
uagagccuaga

SEQ ID NO: 2564709 - RNA, 17 nt, Chlamydophila pneumoniae J138
uagagccucuaagaaaa

SEQ ID NO: 2564710 - RNA, 18 nt, Chlamydophila pneumoniae J138
uagagccucuaagaaaau

SEQ ID NO: 2564711 - RNA, 17 nt, Chlamydophila pneumoniae J138
uagagcgaauguagcca

SEQ ID NO: 2564712 - RNA, 21 nt, Chlamydophila pneumoniae J138
uagagcgcccgaaucuuucaa

SEQ ID NO: 2564713 - RNA, 18 nt, Chlamydophila pneumoniae J138
uagagcuuucagaaaaga

SEQ ID NO: 2564714 - RNA, 16 nt, Chlamydophila pneumoniae J138
uagaggccuuuuagag

SEQ ID NO: 2564715 - RNA, 17 nt, Chlamydophila pneumoniae J138
uagaggguccagggucu

SEQ ID NO: 2564716 - RNA, 20 nt, Chlamydophila pneumoniae J138
uagaguacacagcacaagaa

SEQ ID NO: 2564717 - RNA, 21 nt, Chlamydophila pneumoniae J138
uagaguacacagcacaagaac

SEQ ID NO: 2564718 - RNA, 16 nt, Chlamydophila pneumoniae J138
uagaguccaagguucu

SEQ ID NO: 2564719 - RNA, 16 nt, Chlamydophila pneumoniae J138
uagaguccacagucau

SEQ ID NO: 2564720 - RNA, 21 nt, Chlamydophila pneumoniae J138
uagagucucuuucagcucaag

SEQ ID NO: 2564721 - RNA, 16 nt, Chlamydophila pneumoniae J138
uagagugucuuccuug

SEQ ID NO: 2564722 - RNA, 16 nt, Chlamydophila pneumoniae J138
uagaguugcuuuaugg

SEQ ID NO: 2564723 - RNA, 13 nt, Chlamydophila pneumoniae J138
uagauaagaucuc

SEQ ID NO: 2564724 - RNA, 17 nt, Chlamydophila pneumoniae J138
uagauaagaucucuccg

SEQ ID NO: 2564725 - RNA, 13 nt, Chlamydophila pneumoniae J138
uagaucacaagaa

SEQ ID NO: 2564726 - RNA, 17 nt, Chlamydophila pneumoniae J138
uagaucacaagaaagaa

SEQ ID NO: 2564727 - RNA, 21 nt, Chlamydophila pneumoniae J138
uagauccccuucauucuuucg

SEQ ID NO: 2564728 - RNA, 22 nt, Chlamydophila pneumoniae J138
uagauccuauaguaauuucucc

SEQ ID NO: 2564729 - RNA, 12 nt, Chlamydophila pneumoniae J138
uagaucuucaau

SEQ ID NO: 2564730 - RNA, 15 nt, Chlamydophila pneumoniae J138
uagaucuucugaaau

SEQ ID NO: 2564731 - RNA, 18 nt, Chlamydophila pneumoniae J138
uagaucuucugaaaucaa

SEQ ID NO: 2564732 - RNA, 22 nt, Chlamydophila pneumoniae J138
uagaucuucugaaaucaaaaaa

SEQ ID NO: 2564733 - RNA, 19 nt, Chlamydophila pneumoniae J138
uagaucuuuucuacuucag

SEQ ID NO: 2564734 - RNA, 19 nt, Chlamydophila pneumoniae J138
uagauguaaucauaaaaaa

SEQ ID NO: 2564735 - RNA, 21 nt, Chlamydophila pneumoniae J138
uagauguuaugaguuuuuaau

SEQ ID NO: 2564736 - RNA, 13 nt, Chlamydophila pneumoniae J138
uagauuaaagaga

SEQ ID NO: 2564737 - RNA, 22 nt, Chlamydophila pneumoniae J138
uagauuaaaggcauagauacaa

SEQ ID NO: 2564738 - RNA, 14 nt, Chlamydophila pneumoniae J138
uagauuaggaagau

SEQ ID NO: 2564739 - RNA, 15 nt, Chlamydophila pneumoniae J138
uagauuccccaaacu

SEQ ID NO: 2564740 - RNA, 22 nt, Chlamydophila pneumoniae J138
uagggaaagcaucuuucaucaa

SEQ ID NO: 2564741 - RNA, 21 nt, Chlamydophila pneumoniae J138
uagggacuucucaaagacaau

SEQ ID NO: 2564742 - RNA, 16 nt, Chlamydophila pneumoniae J138
uagggagugaggaauc

SEQ ID NO: 2564743 - RNA, 23 nt, Chlamydophila pneumoniae J138
uagggagugaggaaucauaacca

SEQ ID NO: 2564744 - RNA, 18 nt, Chlamydophila pneumoniae J138
uagggcaggcggaaagga

SEQ ID NO: 2564745 - RNA, 22 nt, Chlamydophila pneumoniae J138
uagggcaggcggaaaggaagga

SEQ ID NO: 2564746 - RNA, 16 nt, Chlamydophila pneumoniae J138
uagggcauucuguaau

SEQ ID NO: 2564747 - RNA, 16 nt, Chlamydophila pneumoniae J138
uaggguagccauccac

SEQ ID NO: 2564748 - RNA, 18 nt, Chlamydophila pneumoniae J138
uaggguuugcaugccuau

SEQ ID NO: 2564749 - RNA, 17 nt, Chlamydophila pneumoniae J138
uagguacgcuuuuucuu

SEQ ID NO: 2564750 - RNA, 14 nt, Chlamydophila pneumoniae J138
uagguagagaaucc

SEQ ID NO: 2564751 - RNA, 17 nt, Chlamydophila pneumoniae J138
uagguagauagaaauuc

SEQ ID NO: 2564752 - RNA, 22 nt, Chlamydophila pneumoniae J138
uagguccguuuuuucagaugau

SEQ ID NO: 2564753 - RNA, 22 nt, Chlamydophila pneumoniae J138
uaggugaaauauugaucuuucc

SEQ ID NO: 2564754 - RNA, 22 nt, Chlamydophila pneumoniae J138
uaggugauauuuucuugucucu

SEQ ID NO: 2564755 - RNA, 18 nt, Chlamydophila pneumoniae J138
uagguuaagccaaucccu

SEQ ID NO: 2564756 - RNA, 22 nt, Chlamydophila pneumoniae J138
uagguucuuuucggaucagaau

SEQ ID NO: 2564757 - RNA, 23 nt, Chlamydophila pneumoniae J138
uagguucuuuucggaucagaaug

SEQ ID NO: 2564758 - RNA, 16 nt, Chlamydophila pneumoniae J138
uagguuucaauagaag

SEQ ID NO: 2564759 - RNA, 12 nt, Chlamydophila pneumoniae J138
uaguaaagaauc

SEQ ID NO: 2564760 - RNA, 22 nt, Chlamydophila pneumoniae J138
uaguaaagcauuggacaacgcu

SEQ ID NO: 2564761 - RNA, 15 nt, Chlamydophila pneumoniae J138
uaguaaggagagacu

SEQ ID NO: 2564762 - RNA, 19 nt, Chlamydophila pneumoniae J138
uaguaaggagagacugugu

SEQ ID NO: 2564763 - RNA, 22 nt, Chlamydophila pneumoniae J138
uaguaauaucuccgccauaaca

SEQ ID NO: 2564764 - RNA, 21 nt, Chlamydophila pneumoniae J138
uaguauggcauucuuuuucua

SEQ ID NO: 2564765 - RNA, 15 nt, Chlamydophila pneumoniae J138
uagucaaaaauucuu

SEQ ID NO: 2564766 - RNA, 16 nt, Chlamydophila pneumoniae J138
uagucaauguauucuc

SEQ ID NO: 2564767 - RNA, 23 nt, Chlamydophila pneumoniae J138
uagucaugauuuuucaaucaaua

SEQ ID NO: 2564768 - RNA, 14 nt, Chlamydophila pneumoniae J138
uaguccaucccugc

SEQ ID NO: 2564769 - RNA, 21 nt, Chlamydophila pneumoniae J138
uagucucgguuuccugaagau

SEQ ID NO: 2564770 - RNA, 13 nt, Chlamydophila pneumoniae J138
uagucuucuuaga

SEQ ID NO: 2564771 - RNA, 21 nt, Chlamydophila pneumoniae J138
uagucuucuuagaaagacuag

SEQ ID NO: 2564772 - RNA, 15 nt, Chlamydophila pneumoniae J138
uagucuuucaaccuc

SEQ ID NO: 2564773 - RNA, 16 nt, Chlamydophila pneumoniae J138
uagucuuucuaagaag

SEQ ID NO: 2564774 - RNA, 22 nt, Chlamydophila pneumoniae J138
uagugaacacucucuaccauca

SEQ ID NO: 2564775 - RNA, 21 nt, Chlamydophila pneumoniae J138
uagugaaugagcuucacaucu

SEQ ID NO: 2564776 - RNA, 15 nt, Chlamydophila pneumoniae J138
uagugacuccugguu

SEQ ID NO: 2564777 - RNA, 14 nt, Chlamydophila pneumoniae J138
uagugagauagucu

SEQ ID NO: 2564778 - RNA, 16 nt, Chlamydophila pneumoniae J138
uagugagauagucuug

SEQ ID NO: 2564779 - RNA, 19 nt, Chlamydophila pneumoniae J138
uagugauacuuuagaaucc

SEQ ID NO: 2564780 - RNA, 17 nt, Chlamydophila pneumoniae J138
uaguggucaucucguug

SEQ ID NO: 2564781 - RNA, 15 nt, Chlamydophila pneumoniae J138
uaguguuagaugaag

SEQ ID NO: 2564782 - RNA, 21 nt, Chlamydophila pneumoniae J138
uaguguucgagcaucucaaga

SEQ ID NO: 2564783 - RNA, 13 nt, Chlamydophila pneumoniae J138
uaguguugaauaa

SEQ ID NO: 2564784 - RNA, 22 nt, Chlamydophila pneumoniae J138
uaguguuucuuuaucuaaccaa

SEQ ID NO: 2564785 - RNA, 14 nt, Chlamydophila pneumoniae J138
uaguuacugaggaa

SEQ ID NO: 2564786 - RNA, 15 nt, Chlamydophila pneumoniae J138
uaguuagcauugcuu

SEQ ID NO: 2564787 - RNA, 14 nt, Chlamydophila pneumoniae J138
uaguuauuaauaaa

SEQ ID NO: 2564788 - RNA, 21 nt, Chlamydophila pneumoniae J138
uaguucaccacuaccgaauuu

SEQ ID NO: 2564789 - RNA, 20 nt, Chlamydophila pneumoniae J138
uaguucaucauauuuuucuu

SEQ ID NO: 2564790 - RNA, 11 nt, Chlamydophila pneumoniae J138
uaguucuucuu

SEQ ID NO: 2564791 - RNA, 15 nt, Chlamydophila pneumoniae J138
uaguucuucuuuacu

SEQ ID NO: 2564792 - RNA, 18 nt, Chlamydophila pneumoniae J138
uaguugcaugacuauuuu

SEQ ID NO: 2564793 - RNA, 21 nt, Chlamydophila pneumoniae J138
uaguuguugcggauuugcauu

SEQ ID NO: 2564794 - RNA, 23 nt, Chlamydophila pneumoniae J138
uaguuucacauaguuuaauaaau

SEQ ID NO: 2564795 - RNA, 18 nt, Chlamydophila pneumoniae J138
uaguuucccacuagcccu

SEQ ID NO: 2564796 - RNA, 22 nt, Chlamydophila pneumoniae J138
uaguuugccuucuuaucuucua

SEQ ID NO: 2564797 - RNA, 14 nt, Chlamydophila pneumoniae J138
uaguuuguuuuaau

SEQ ID NO: 2564798 - RNA, 11 nt, Chlamydophila pneumoniae J138
uaguuuucaua

SEQ ID NO: 2564799 - RNA, 15 nt, Chlamydophila pneumoniae J138
uaguuuucuucuuua

SEQ ID NO: 2564800 - RNA, 17 nt, Chlamydophila pneumoniae J138
uaguuuuuauuuuuaaa

SEQ ID NO: 2564801 - RNA, 20 nt, Chlamydophila pneumoniae J138
uaguuuuuauuuuuaaauaa

SEQ ID NO: 2564802 - RNA, 21 nt, Chlamydophila pneumoniae J138
uauaaacuucaaugaagaaaa

SEQ ID NO: 2564803 - RNA, 23 nt, Chlamydophila pneumoniae J138
uauaaagauaaucuguaagaaaa

SEQ ID NO: 2564804 - RNA, 16 nt, Chlamydophila pneumoniae J138
uauaaagcaaaugccu

SEQ ID NO: 2564805 - RNA, 13 nt, Chlamydophila pneumoniae J138
uauaaagguuaca

SEQ ID NO: 2564806 - RNA, 17 nt, Chlamydophila pneumoniae J138
uauaaaguuuccaagug

SEQ ID NO: 2564807 - RNA, 17 nt, Chlamydophila pneumoniae J138
uauaaauaauuacaauu

SEQ ID NO: 2564808 - RNA, 19 nt, Chlamydophila pneumoniae J138
uauaaaugcuguagauugu

SEQ ID NO: 2564809 - RNA, 21 nt, Chlamydophila pneumoniae J138
uauaacuccaggggauaaaac

SEQ ID NO: 2564810 - RNA, 13 nt, Chlamydophila pneumoniae J138
uauaacucucuag

SEQ ID NO: 2564811 - RNA, 16 nt, Chlamydophila pneumoniae J138
uauaagagcaagguaa

SEQ ID NO: 2564812 - RNA, 15 nt, Chlamydophila pneumoniae J138
uauaagagguucucu

SEQ ID NO: 2564813 - RNA, 17 nt, Chlamydophila pneumoniae J138
uauaagggggaucuuca

SEQ ID NO: 2564814 - RNA, 17 nt, Chlamydophila pneumoniae J138
uauaagugacuuuucuu

SEQ ID NO: 2564815 - RNA, 14 nt, Chlamydophila pneumoniae J138
uauaaucacguccu

SEQ ID NO: 2564816 - RNA, 18 nt, Chlamydophila pneumoniae J138
uauaauugacguagacga

SEQ ID NO: 2564817 - RNA, 16 nt, Chlamydophila pneumoniae J138
uauacaagcgaaagca

SEQ ID NO: 2564818 - RNA, 17 nt, Chlamydophila pneumoniae J138
uauacagaaaagaaugu

SEQ ID NO: 2564819 - RNA, 21 nt, Chlamydophila pneumoniae J138
uauacaguuggcguuuucuag

SEQ ID NO: 2564820 - RNA, 16 nt, Chlamydophila pneumoniae J138
uauacaucccauucaa

SEQ ID NO: 2564821 - RNA, 21 nt, Chlamydophila pneumoniae J138
uauaccaccccaaagcagauc

SEQ ID NO: 2564822 - RNA, 17 nt, Chlamydophila pneumoniae J138
uauaccacuacugagcu

SEQ ID NO: 2564823 - RNA, 15 nt, Chlamydophila pneumoniae J138
uauacgcuuaacaug

SEQ ID NO: 2564824 - RNA, 15 nt, Chlamydophila pneumoniae J138
uauacgguaaugcca

SEQ ID NO: 2564825 - RNA, 16 nt, Chlamydophila pneumoniae J138
uauacgucccacaaaa

SEQ ID NO: 2564826 - RNA, 14 nt, Chlamydophila pneumoniae J138
uauacuaagacugu

SEQ ID NO: 2564827 - RNA, 13 nt, Chlamydophila pneumoniae J138
uauacucucugua

SEQ ID NO: 2564828 - RNA, 15 nt, Chlamydophila pneumoniae J138
uauacuguuuuucuu

SEQ ID NO: 2564829 - RNA, 21 nt, Chlamydophila pneumoniae J138
uauacuguuuuucuuccacac

SEQ ID NO: 2564830 - RNA, 17 nt, Chlamydophila pneumoniae J138
uauagaagcugcugcua

SEQ ID NO: 2564831 - RNA, 13 nt, Chlamydophila pneumoniae J138
uauagacaaugca

SEQ ID NO: 2564832 - RNA, 21 nt, Chlamydophila pneumoniae J138
uauagauuuaagagucuugca

SEQ ID NO: 2564833 - RNA, 16 nt, Chlamydophila pneumoniae J138
uauagauuuugugagg

SEQ ID NO: 2564834 - RNA, 18 nt, Chlamydophila pneumoniae J138
uauagcauuauucccuaa

SEQ ID NO: 2564835 - RNA, 15 nt, Chlamydophila pneumoniae J138
uauagcccucuccaa

SEQ ID NO: 2564836 - RNA, 16 nt, Chlamydophila pneumoniae J138
uauagcguacaggaag

SEQ ID NO: 2564837 - RNA, 17 nt, Chlamydophila pneumoniae J138
uauaggcugcacacauc

SEQ ID NO: 2564838 - RNA, 14 nt, Chlamydophila pneumoniae J138
uauaguagaagaaa

SEQ ID NO: 2564839 - RNA, 20 nt, Chlamydophila pneumoniae J138
uauaguauaauagugagcuc

SEQ ID NO: 2564840 - RNA, 16 nt, Chlamydophila pneumoniae J138
ucaagccacagagaau

SEQ ID NO: 2564841 - RNA, 15 nt, Chlamydophila pneumoniae J138
ucaaggaacauuuga

SEQ ID NO: 2564842 - RNA, 12 nt, Chlamydophila pneumoniae J138
ucaaggcaucua

SEQ ID NO: 2564843 - RNA, 15 nt, Chlamydophila pneumoniae J138
ucaaggccuauagau

SEQ ID NO: 2564844 - RNA, 20 nt, Chlamydophila pneumoniae J138
ucaaggccuauagauuuugu

SEQ ID NO: 2564845 - RNA, 15 nt, Chlamydophila pneumoniae J138
ucaagguacuuuaua

SEQ ID NO: 2564846 - RNA, 23 nt, Chlamydophila pneumoniae J138
ucaagucuauuugaaaagaaaga

SEQ ID NO: 2564847 - RNA, 19 nt, Chlamydophila pneumoniae J138
ucaauaaccagaagacucc

SEQ ID NO: 2564848 - RNA, 13 nt, Chlamydophila pneumoniae J138
ucaauaaguagau

SEQ ID NO: 2564849 - RNA, 23 nt, Chlamydophila pneumoniae J138
ucaauaaucggccgaguuucucc

SEQ ID NO: 2564850 - RNA, 23 nt, Chlamydophila pneumoniae J138
ucaauaauuucaaagaugcagau

SEQ ID NO: 2564851 - RNA, 13 nt, Chlamydophila pneumoniae J138
ucaauacuucagg

SEQ ID NO: 2564852 - RNA, 16 nt, Chlamydophila pneumoniae J138
ucaauagaagcuuguu

SEQ ID NO: 2564853 - RNA, 18 nt, Chlamydophila pneumoniae J138
ucaauagguaaggaaacg

SEQ ID NO: 2564854 - RNA, 13 nt, Chlamydophila pneumoniae J138
ucaauccaagaau

SEQ ID NO: 2564855 - RNA, 19 nt, Chlamydophila pneumoniae J138
ucaauccaagaauagccau

SEQ ID NO: 2564856 - RNA, 13 nt, Chlamydophila pneumoniae J138
ucaaucucuccuu

SEQ ID NO: 2564857 - RNA, 13 nt, Chlamydophila pneumoniae J138
ucaaugaaagcug

SEQ ID NO: 2564858 - RNA, 18 nt, Chlamydophila pneumoniae J138
ucaaugaagaaaaaucua

SEQ ID NO: 2564859 - RNA, 19 nt, Chlamydophila pneumoniae J138
ucaaugaagaaaaaucuac

SEQ ID NO: 2564860 - RNA, 15 nt, Chlamydophila pneumoniae J138
ucaaugagcaucuga

SEQ ID NO: 2564861 - RNA, 14 nt, Chlamydophila pneumoniae J138
ucaaugccuugcgu

SEQ ID NO: 2564862 - RNA, 17 nt, Chlamydophila pneumoniae J138
ucaauggcgauaaaugc

SEQ ID NO: 2564863 - RNA, 18 nt, Chlamydophila pneumoniae J138
ucaauguuaaucuaauuu

SEQ ID NO: 2564864 - RNA, 14 nt, Chlamydophila pneumoniae J138
ucaauugaaucaga

SEQ ID NO: 2564865 - RNA, 13 nt, Chlamydophila pneumoniae J138
ucaauuucuucau

SEQ ID NO: 2564866 - RNA, 19 nt, Chlamydophila pneumoniae J138
ucaauuucuucaucaauac

SEQ ID NO: 2564867 - RNA, 22 nt, Chlamydophila pneumoniae J138
ucaauuugcguugcauguccau

SEQ ID NO: 2564868 - RNA, 16 nt, Chlamydophila pneumoniae J138
ucacaaacaacagaaa

SEQ ID NO: 2564869 - RNA, 20 nt, Chlamydophila pneumoniae J138
ucacaaagaaccauagauuu

SEQ ID NO: 2564870 - RNA, 14 nt, Chlamydophila pneumoniae J138
ucacaagaaagaau

SEQ ID NO: 2564871 - RNA, 22 nt, Chlamydophila pneumoniae J138
ucacaagcugguagacuucuug

SEQ ID NO: 2564872 - RNA, 16 nt, Chlamydophila pneumoniae J138
ucacaaguccugcguu

SEQ ID NO: 2564873 - RNA, 15 nt, Chlamydophila pneumoniae J138
ucacaagugcauuau

SEQ ID NO: 2564874 - RNA, 19 nt, Chlamydophila pneumoniae J138
ucacaauaccaucucuuuc

SEQ ID NO: 2564875 - RNA, 22 nt, Chlamydophila pneumoniae J138
ucacaauaccaucucuuucuau

SEQ ID NO: 2564876 - RNA, 17 nt, Chlamydophila pneumoniae J138
ucacaaucuaaauaaga

SEQ ID NO: 2564877 - RNA, 14 nt, Chlamydophila pneumoniae J138
ucacaaugaucuuu

SEQ ID NO: 2564878 - RNA, 19 nt, Chlamydophila pneumoniae J138
ucacacguaagaaaggaug

SEQ ID NO: 2564879 - RNA, 18 nt, Chlamydophila pneumoniae J138
ucacacuacauucaggau

SEQ ID NO: 2564880 - RNA, 16 nt, Chlamydophila pneumoniae J138
ucacacucguagccuu

SEQ ID NO: 2564881 - RNA, 22 nt, Chlamydophila pneumoniae J138
ucacagagucugggauguucaa

SEQ ID NO: 2564882 - RNA, 23 nt, Chlamydophila pneumoniae J138
ucacagagucugggauguucaaa

SEQ ID NO: 2564883 - RNA, 15 nt, Chlamydophila pneumoniae J138
ucacagauguaaucu

SEQ ID NO: 2564884 - RNA, 16 nt, Chlamydophila pneumoniae J138
ucacagcaaucugcag

SEQ ID NO: 2564885 - RNA, 18 nt, Chlamydophila pneumoniae J138
ucacagcaugcacggcuu

SEQ ID NO: 2564886 - RNA, 22 nt, Chlamydophila pneumoniae J138
ucacagcauuuucucugagcag

SEQ ID NO: 2564887 - RNA, 17 nt, Chlamydophila pneumoniae J138
ucacagggacaauggca

SEQ ID NO: 2564888 - RNA, 23 nt, Chlamydophila pneumoniae J138
ucacaguauuccaucacaguuaa

SEQ ID NO: 2564889 - RNA, 13 nt, Chlamydophila pneumoniae J138
ucacauaaaauaa

SEQ ID NO: 2564890 - RNA, 20 nt, Chlamydophila pneumoniae J138
ucacauacauucuauucuau

SEQ ID NO: 2564891 - RNA, 22 nt, Chlamydophila pneumoniae J138
ucacauacauucuauucuauac

SEQ ID NO: 2564892 - RNA, 20 nt, Chlamydophila pneumoniae J138
ucacauaguuuaauaaaucu

SEQ ID NO: 2564893 - RNA, 19 nt, Chlamydophila pneumoniae J138
ucacaucaguuaacugugu

SEQ ID NO: 2564894 - RNA, 15 nt, Chlamydophila pneumoniae J138
ucacaucuccuuuca

SEQ ID NO: 2564895 - RNA, 14 nt, Chlamydophila pneumoniae J138
ucacaucuuucucu

SEQ ID NO: 2564896 - RNA, 15 nt, Chlamydophila pneumoniae J138
ucacauguuucacuu

SEQ ID NO: 2564897 - RNA, 17 nt, Chlamydophila pneumoniae J138
ucacauuccaagaaaaa

SEQ ID NO: 2564898 - RNA, 18 nt, Chlamydophila pneumoniae J138
ucacauuccaagaaaaau

SEQ ID NO: 2564899 - RNA, 20 nt, Chlamydophila pneumoniae J138
ucacauuugcuuuaacagaa

SEQ ID NO: 2564900 - RNA, 22 nt, Chlamydophila pneumoniae J138
ucacauuugcuuuaacagaagc

SEQ ID NO: 2564901 - RNA, 13 nt, Chlamydophila pneumoniae J138
ucaccaacuccuc

SEQ ID NO: 2564902 - RNA, 15 nt, Chlamydophila pneumoniae J138
ucaccaacuccucua

SEQ ID NO: 2564903 - RNA, 20 nt, Chlamydophila pneumoniae J138
ucaccacaaaccucuaaaaa

SEQ ID NO: 2564904 - RNA, 22 nt, Chlamydophila pneumoniae J138
ucaccacgaacuucagcaagaa

SEQ ID NO: 2564905 - RNA, 20 nt, Chlamydophila pneumoniae J138
ucaccagaagcaacuaaacu

SEQ ID NO: 2564906 - RNA, 22 nt, Chlamydophila pneumoniae J138
ucaccagaagcaacuaaacucu

SEQ ID NO: 2564907 - RNA, 15 nt, Chlamydophila pneumoniae J138
ucaccagaagcauug

SEQ ID NO: 2564908 - RNA, 20 nt, Chlamydophila pneumoniae J138
ucaccauuaagauaucugcu

SEQ ID NO: 2564909 - RNA, 21 nt, Chlamydophila pneumoniae J138
ucaccauuaagauaucugcuc

SEQ ID NO: 2564910 - RNA, 18 nt, Chlamydophila pneumoniae J138
ucaccgcgcauagcaacu

SEQ ID NO: 2564911 - RNA, 22 nt, Chlamydophila pneumoniae J138
ucaccgcgcauagcaacuacag

SEQ ID NO: 2564912 - RNA, 13 nt, Chlamydophila pneumoniae J138
ucaccuuacaucc

SEQ ID NO: 2564913 - RNA, 20 nt, Chlamydophila pneumoniae J138
ucaccuugaaguuuuuucuc

SEQ ID NO: 2564914 - RNA, 13 nt, Chlamydophila pneumoniae J138
ucaccuugugaga

SEQ ID NO: 2564915 - RNA, 17 nt, Chlamydophila pneumoniae J138
ucacgaggagcuuuuac

SEQ ID NO: 2564916 - RNA, 20 nt, Chlamydophila pneumoniae J138
ucacgagucccuucuuucaa

SEQ ID NO: 2564917 - RNA, 14 nt, Chlamydophila pneumoniae J138
ucacgauuucggga

SEQ ID NO: 2564918 - RNA, 16 nt, Chlamydophila pneumoniae J138
ucacgcaccauuccuu

SEQ ID NO: 2564919 - RNA, 14 nt, Chlamydophila pneumoniae J138
ucacguaagguguc

SEQ ID NO: 2564920 - RNA, 21 nt, Chlamydophila pneumoniae J138
ucacguauagguugaauaaau

SEQ ID NO: 2564921 - RNA, 21 nt, Chlamydophila pneumoniae J138
ucacguucugcaacaaguugc

SEQ ID NO: 2564922 - RNA, 15 nt, Chlamydophila pneumoniae J138
ucacuaagauaucuc

SEQ ID NO: 2564923 - RNA, 17 nt, Chlamydophila pneumoniae J138
ucacuagagaaaaagcc

SEQ ID NO: 2564924 - RNA, 16 nt, Chlamydophila pneumoniae J138
ucacuaucuucuaaaa

SEQ ID NO: 2564925 - RNA, 17 nt, Chlamydophila pneumoniae J138
ucacuaucuucuaaaac

SEQ ID NO: 2564926 - RNA, 13 nt, Chlamydophila pneumoniae J138
ucacuauuaauac

SEQ ID NO: 2564927 - RNA, 16 nt, Chlamydophila pneumoniae J138
ucacucaaacccucuc

SEQ ID NO: 2564928 - RNA, 14 nt, Chlamydophila pneumoniae J138
ucacucuuuaaaaa

SEQ ID NO: 2564929 - RNA, 12 nt, Chlamydophila pneumoniae J138
ucacucuuuuau

SEQ ID NO: 2564930 - RNA, 13 nt, Chlamydophila pneumoniae J138
ucacucuuuuauu

SEQ ID NO: 2564931 - RNA, 16 nt, Chlamydophila pneumoniae J138
ucacuuauaagcugcu

SEQ ID NO: 2564932 - RNA, 16 nt, Chlamydophila pneumoniae J138
ucacuucugaugacgu

SEQ ID NO: 2564933 - RNA, 16 nt, Chlamydophila pneumoniae J138
ucagaaagccuuugcu

SEQ ID NO: 2564934 - RNA, 22 nt, Chlamydophila pneumoniae J138
ucagaaaugaagccaaaaggca

SEQ ID NO: 2564935 - RNA, 21 nt, Chlamydophila pneumoniae J138
ucagaaauuccuaaaauuucc

SEQ ID NO: 2564936 - RNA, 18 nt, Chlamydophila pneumoniae J138
ucagaacaacgcugcuuc

SEQ ID NO: 2564937 - RNA, 13 nt, Chlamydophila pneumoniae J138
ucagaacaagaag

SEQ ID NO: 2564938 - RNA, 23 nt, Chlamydophila pneumoniae J138
ucagaaggaucugauagaacagg

SEQ ID NO: 2564939 - RNA, 16 nt, Chlamydophila pneumoniae J138
ucagaagugaucuuga

SEQ ID NO: 2564940 - RNA, 20 nt, Chlamydophila pneumoniae J138
ucagaauccauuuugcccac

SEQ ID NO: 2564941 - RNA, 20 nt, Chlamydophila pneumoniae J138
ucagaauccugaguaaaauc

SEQ ID NO: 2564942 - RNA, 16 nt, Chlamydophila pneumoniae J138
ucagaaucuuugugau

SEQ ID NO: 2564943 - RNA, 16 nt, Chlamydophila pneumoniae J138
ucagaaugcaucuuga

SEQ ID NO: 2564944 - RNA, 19 nt, Chlamydophila pneumoniae J138
ucagaaugcccuuuaggga

SEQ ID NO: 2564945 - RNA, 20 nt, Chlamydophila pneumoniae J138
ucagaauuuuaucagaaacu

SEQ ID NO: 2564946 - RNA, 19 nt, Chlamydophila pneumoniae J138
ucagacgugcucucuacuu

SEQ ID NO: 2564947 - RNA, 15 nt, Chlamydophila pneumoniae J138
ucagacuuaaaguac

SEQ ID NO: 2564948 - RNA, 20 nt, Chlamydophila pneumoniae J138
ucagagacaaguucaucaaa

SEQ ID NO: 2564949 - RNA, 16 nt, Chlamydophila pneumoniae J138
ucagagauugccagga

SEQ ID NO: 2564950 - RNA, 18 nt, Chlamydophila pneumoniae J138
ucagagauugccaggaga

SEQ ID NO: 2564951 - RNA, 19 nt, Chlamydophila pneumoniae J138
ucagagauugccaggagag

SEQ ID NO: 2564952 - RNA, 18 nt, Chlamydophila pneumoniae J138
ucagaggaaucuaagaac

SEQ ID NO: 2564953 - RNA, 21 nt, Chlamydophila pneumoniae J138
ucagaggaaucuaagaacuag

SEQ ID NO: 2564954 - RNA, 20 nt, Chlamydophila pneumoniae J138
ucagaggagccuccauaaug

SEQ ID NO: 2564955 - RNA, 15 nt, Chlamydophila pneumoniae J138
ucagaggcuagaaaa

SEQ ID NO: 2564956 - RNA, 17 nt, Chlamydophila pneumoniae J138
ucagaguugucaaguaa

SEQ ID NO: 2564957 - RNA, 16 nt, Chlamydophila pneumoniae J138
ucagauaaucuucgau

SEQ ID NO: 2564958 - RNA, 17 nt, Chlamydophila pneumoniae J138
ucagauggucagucucg

SEQ ID NO: 2564959 - RNA, 14 nt, Chlamydophila pneumoniae J138
ucagauuagaguua

SEQ ID NO: 2564960 - RNA, 14 nt, Chlamydophila pneumoniae J138
ucagauuuuuuaac

SEQ ID NO: 2564961 - RNA, 17 nt, Chlamydophila pneumoniae J138
ucagcaaacggagagca

SEQ ID NO: 2564962 - RNA, 21 nt, Chlamydophila pneumoniae J138
ucagcaacaucguuaauauaa

SEQ ID NO: 2564963 - RNA, 13 nt, Chlamydophila pneumoniae J138
ucagcaagaaaau

SEQ ID NO: 2564964 - RNA, 14 nt, Chlamydophila pneumoniae J138
ucagcaagcccucc

SEQ ID NO: 2564965 - RNA, 15 nt, Chlamydophila pneumoniae J138
ucagcaagucgguaa

SEQ ID NO: 2564966 - RNA, 15 nt, Chlamydophila pneumoniae J138
ucagcacccaccauu

SEQ ID NO: 2564967 - RNA, 23 nt, Chlamydophila pneumoniae J138
ucagcacccaccauucuugaaga

SEQ ID NO: 2564968 - RNA, 19 nt, Chlamydophila pneumoniae J138
ucagcaccuuguauaagag

SEQ ID NO: 2564969 - RNA, 21 nt, Chlamydophila pneumoniae J138
ucagcaccuuguauaagagca

SEQ ID NO: 2564970 - RNA, 17 nt, Chlamydophila pneumoniae J138
ucagcagcuucuauugc

SEQ ID NO: 2564971 - RNA, 18 nt, Chlamydophila pneumoniae J138
ucagcagcuucuauugcu

SEQ ID NO: 2564972 - RNA, 15 nt, Chlamydophila pneumoniae J138
ucagcauagagagaa

SEQ ID NO: 2564973 - RNA, 18 nt, Chlamydophila pneumoniae J138
ucagcauagagagaagga

SEQ ID NO: 2564974 - RNA, 16 nt, Chlamydophila pneumoniae J138
ucagcccacuguuuug

SEQ ID NO: 2564975 - RNA, 21 nt, Chlamydophila pneumoniae J138
ucagcccugccucacagcuaa

SEQ ID NO: 2564976 - RNA, 13 nt, Chlamydophila pneumoniae J138
ucagccugucuau

SEQ ID NO: 2564977 - RNA, 19 nt, Chlamydophila pneumoniae J138
ucagccugucuauaaaaua

SEQ ID NO: 2564978 - RNA, 20 nt, Chlamydophila pneumoniae J138
ucagcgcaucacgaaaagga

SEQ ID NO: 2564979 - RNA, 21 nt, Chlamydophila pneumoniae J138
ucagcuaauuuaaaugccuua

SEQ ID NO: 2564980 - RNA, 19 nt, Chlamydophila pneumoniae J138
ucagcuagagcacauagaa

SEQ ID NO: 2564981 - RNA, 21 nt, Chlamydophila pneumoniae J138
ucagcucccaugugcugaaga

SEQ ID NO: 2564982 - RNA, 23 nt, Chlamydophila pneumoniae J138
ucagcucuaauucuucuacagaa

SEQ ID NO: 2564983 - RNA, 14 nt, Chlamydophila pneumoniae J138
ucagcuguccuccg

SEQ ID NO: 2564984 - RNA, 20 nt, Chlamydophila pneumoniae J138
ucagcuuaucuauagcauug

SEQ ID NO: 2564985 - RNA, 16 nt, Chlamydophila pneumoniae J138
ucagcuuuaacaugcc

SEQ ID NO: 2564986 - RNA, 18 nt, Chlamydophila pneumoniae J138
ucaggaaaacuuaauaag

SEQ ID NO: 2564987 - RNA, 20 nt, Chlamydophila pneumoniae J138
ucaggaaaacuuaauaagcg

SEQ ID NO: 2564988 - RNA, 21 nt, Chlamydophila pneumoniae J138
ucaggaagaaaggauuggaug

SEQ ID NO: 2564989 - RNA, 16 nt, Chlamydophila pneumoniae J138
ucaggacccuuuuccu

SEQ ID NO: 2564990 - RNA, 12 nt, Chlamydophila pneumoniae J138
ucaggagauaau

SEQ ID NO: 2564991 - RNA, 19 nt, Chlamydophila pneumoniae J138
ucaggagauacaaguaauu

SEQ ID NO: 2564992 - RNA, 20 nt, Chlamydophila pneumoniae J138
ucaggaggugguggagcuug

SEQ ID NO: 2564993 - RNA, 18 nt, Chlamydophila pneumoniae J138
ucaggauuacggaaaaua

SEQ ID NO: 2564994 - RNA, 17 nt, Chlamydophila pneumoniae J138
ucaggauuaguaacuaa

SEQ ID NO: 2564995 - RNA, 22 nt, Chlamydophila pneumoniae J138
ucaggauucuaaaaagaaaaga

SEQ ID NO: 2564996 - RNA, 13 nt, Chlamydophila pneumoniae J138
ucaggauuuucca

SEQ ID NO: 2564997 - RNA, 15 nt, Chlamydophila pneumoniae J138
ucaggauuuuccauu

SEQ ID NO: 2564998 - RNA, 15 nt, Chlamydophila pneumoniae J138
ucaggcauucuucau

SEQ ID NO: 2564999 - RNA, 23 nt, Chlamydophila pneumoniae J138
ucaggcauucuucauuguagagg

SEQ ID NO: 2565000 - RNA, 21 nt, Chlamydophila pneumoniae J138
ucaggcuuuaaguguuucuuc

SEQ ID NO: 2565001 - RNA, 22 nt, Chlamydophila pneumoniae J138
ucaggcuuuaaguguuucuuca

SEQ ID NO: 2565002 - RNA, 19 nt, Chlamydophila pneumoniae J138
ucagggggaaagccaagaa

SEQ ID NO: 2565003 - RNA, 18 nt, Chlamydophila pneumoniae J138
ucaggucugcugaggaga

SEQ ID NO: 2565004 - RNA, 20 nt, Chlamydophila pneumoniae J138
ucaguaaacccucagaacac

SEQ ID NO: 2565005 - RNA, 14 nt, Chlamydophila pneumoniae J138
ucaguaaauauuuu

SEQ ID NO: 2565006 - RNA, 15 nt, Chlamydophila pneumoniae J138
ucagucuuccuuuau

SEQ ID NO: 2565007 - RNA, 21 nt, Chlamydophila pneumoniae J138
ucaguuccucauccucaucau

SEQ ID NO: 2565008 - RNA, 22 nt, Chlamydophila pneumoniae J138
ucaguuguuucuagaaaaucuc

SEQ ID NO: 2565009 - RNA, 15 nt, Chlamydophila pneumoniae J138
ucauaaaaauuucau

SEQ ID NO: 2565010 - RNA, 14 nt, Chlamydophila pneumoniae J138
ucauaaagaggaau

SEQ ID NO: 2565011 - RNA, 18 nt, Chlamydophila pneumoniae J138
ucauaaagaggaaugaag

SEQ ID NO: 2565012 - RNA, 19 nt, Chlamydophila pneumoniae J138
ucauaaagaggaaugaaga

SEQ ID NO: 2565013 - RNA, 23 nt, Chlamydophila pneumoniae J138
ucauaaagugcgagguaugaaua

SEQ ID NO: 2565014 - RNA, 14 nt, Chlamydophila pneumoniae J138
ucauaaauaggcuc

SEQ ID NO: 2565015 - RNA, 16 nt, Chlamydophila pneumoniae J138
ucauaaccaaguaaau

SEQ ID NO: 2565016 - RNA, 15 nt, Chlamydophila pneumoniae J138
ucauaaccuaaggca

SEQ ID NO: 2565017 - RNA, 15 nt, Chlamydophila pneumoniae J138
ucauaaccugggcaa

SEQ ID NO: 2565018 - RNA, 13 nt, Chlamydophila pneumoniae J138
ucauaagaaauuc

SEQ ID NO: 2565019 - RNA, 16 nt, Chlamydophila pneumoniae J138
ucauaagaguagacaa

SEQ ID NO: 2565020 - RNA, 17 nt, Chlamydophila pneumoniae J138
ucauaagauagagcgac

SEQ ID NO: 2565021 - RNA, 13 nt, Chlamydophila pneumoniae J138
ucauaagauuucc

SEQ ID NO: 2565022 - RNA, 17 nt, Chlamydophila pneumoniae J138
ucauaagcucuauuucu

SEQ ID NO: 2565023 - RNA, 23 nt, Chlamydophila pneumoniae J138
ucauagcauguucgauuuucucu

SEQ ID NO: 2565024 - RNA, 23 nt, Chlamydophila pneumoniae J138
ucauaggaaacgcccuucuuagu

SEQ ID NO: 2565025 - RNA, 19 nt, Chlamydophila pneumoniae J138
ucauauaaaacgaucccua

SEQ ID NO: 2565026 - RNA, 15 nt, Chlamydophila pneumoniae J138
ucauauuuaaaaggc

SEQ ID NO: 2565027 - RNA, 22 nt, Chlamydophila pneumoniae J138
ucauauuuugucuucaucauaa

SEQ ID NO: 2565028 - RNA, 14 nt, Chlamydophila pneumoniae J138
ucaucaaaaagauc

SEQ ID NO: 2565029 - RNA, 18 nt, Chlamydophila pneumoniae J138
ucaucaaaacauaaugau

SEQ ID NO: 2565030 - RNA, 17 nt, Chlamydophila pneumoniae J138
ucaucaaugguuaaaac

SEQ ID NO: 2565031 - RNA, 17 nt, Chlamydophila pneumoniae J138
ucaucacaauuuuaaaa

SEQ ID NO: 2565032 - RNA, 18 nt, Chlamydophila pneumoniae J138
ucaucacaauuuuaaaau

SEQ ID NO: 2565033 - RNA, 16 nt, Chlamydophila pneumoniae J138
ucaucacaucaguuaa

SEQ ID NO: 2565034 - RNA, 22 nt, Chlamydophila pneumoniae J138
ucaucaccauccaaagcuauuu

SEQ ID NO: 2565035 - RNA, 16 nt, Chlamydophila pneumoniae J138
ucaucagaagccacca

SEQ ID NO: 2565036 - RNA, 23 nt, Chlamydophila pneumoniae J138
ucaucagaaguggccuugccagu

SEQ ID NO: 2565037 - RNA, 16 nt, Chlamydophila pneumoniae J138
ucaucagcaaccuuuc

SEQ ID NO: 2565038 - RNA, 16 nt, Chlamydophila pneumoniae J138
ucaucaguaaaagacu

SEQ ID NO: 2565039 - RNA, 19 nt, Chlamydophila pneumoniae J138
ucaucauaaauaggcucua

SEQ ID NO: 2565040 - RNA, 18 nt, Chlamydophila pneumoniae J138
ucaucauaacuaggguac

SEQ ID NO: 2565041 - RNA, 14 nt, Chlamydophila pneumoniae J138
ucaucauuucuaca

SEQ ID NO: 2565042 - RNA, 17 nt, Chlamydophila pneumoniae J138
ucauccagauuagaaaa

SEQ ID NO: 2565043 - RNA, 14 nt, Chlamydophila pneumoniae J138
ucauccccucagaa

SEQ ID NO: 2565044 - RNA, 15 nt, Chlamydophila pneumoniae J138
ucauccccucagaaa

SEQ ID NO: 2565045 - RNA, 18 nt, Chlamydophila pneumoniae J138
ucauccccucagaaagga

SEQ ID NO: 2565046 - RNA, 23 nt, Chlamydophila pneumoniae J138
ucauccccucagaaaggagaucc

SEQ ID NO: 2565047 - RNA, 22 nt, Chlamydophila pneumoniae J138
ucaucccuacccucaucauccu

SEQ ID NO: 2565048 - RNA, 15 nt, Chlamydophila pneumoniae J138
ucauccgaagacuca

SEQ ID NO: 2565049 - RNA, 16 nt, Chlamydophila pneumoniae J138
ucauccucaucaucag

SEQ ID NO: 2565050 - RNA, 13 nt, Chlamydophila pneumoniae J138
ucaucgauaggau

SEQ ID NO: 2565051 - RNA, 16 nt, Chlamydophila pneumoniae J138
ucaucgcaaucaaaga

SEQ ID NO: 2565052 - RNA, 21 nt, Chlamydophila pneumoniae J138
ucaucggaucuuuucuuucua

SEQ ID NO: 2565053 - RNA, 18 nt, Chlamydophila pneumoniae J138
ucaucggcauaacuuuau

SEQ ID NO: 2565054 - RNA, 21 nt, Chlamydophila pneumoniae J138
ucaucucacaagcauccuaga

SEQ ID NO: 2565055 - RNA, 23 nt, Chlamydophila pneumoniae J138
ucaucucguugggcucauaaccc

SEQ ID NO: 2565056 - RNA, 19 nt, Chlamydophila pneumoniae J138
ucaucugguauucuaggua

SEQ ID NO: 2565057 - RNA, 14 nt, Chlamydophila pneumoniae J138
ucaucuuccucuuu

SEQ ID NO: 2565058 - RNA, 20 nt, Chlamydophila pneumoniae J138
ucaucuuguacgaaaaucua

SEQ ID NO: 2565059 - RNA, 21 nt, Chlamydophila pneumoniae J138
ucaucuuguacgaaaaucuac

SEQ ID NO: 2565060 - RNA, 15 nt, Chlamydophila pneumoniae J138
ucaucuuugaacaac

SEQ ID NO: 2565061 - RNA, 11 nt, Chlamydophila pneumoniae J138
ucaugaaagug

SEQ ID NO: 2565062 - RNA, 20 nt, Chlamydophila pneumoniae J138
ucaugaaagugcucuuuuaa

SEQ ID NO: 2565063 - RNA, 16 nt, Chlamydophila pneumoniae J138
ucaugagaauuuucau

SEQ ID NO: 2565064 - RNA, 14 nt, Chlamydophila pneumoniae J138
ucaugauaaaaauu

SEQ ID NO: 2565065 - RNA, 16 nt, Chlamydophila pneumoniae J138
ucaugauaaaaauuuu

SEQ ID NO: 2565066 - RNA, 20 nt, Chlamydophila pneumoniae J138
ucaugauauuuuuauuuaaa

SEQ ID NO: 2565067 - RNA, 21 nt, Chlamydophila pneumoniae J138
ucaugcggacuuuauucucuu

SEQ ID NO: 2565068 - RNA, 16 nt, Chlamydophila pneumoniae J138
ucauguagcagagccu

SEQ ID NO: 2565069 - RNA, 12 nt, Chlamydophila pneumoniae J138
ucauuaaaaauu

SEQ ID NO: 2565070 - RNA, 16 nt, Chlamydophila pneumoniae J138
ucauuaagaacaucuu

SEQ ID NO: 2565071 - RNA, 13 nt, Chlamydophila pneumoniae J138
ucauuaaguacug

SEQ ID NO: 2565072 - RNA, 18 nt, Chlamydophila pneumoniae J138
ucauuaauaauaucuaac

SEQ ID NO: 2565073 - RNA, 14 nt, Chlamydophila pneumoniae J138
ucauuaauguugcu

SEQ ID NO: 2565074 - RNA, 12 nt, Chlamydophila pneumoniae J138
ucauuaccugcu

SEQ ID NO: 2565075 - RNA, 19 nt, Chlamydophila pneumoniae J138
ucauuaccugcuaaacuuu

SEQ ID NO: 2565076 - RNA, 22 nt, Chlamydophila pneumoniae J138
ucauuagcaucaucuccugaag

SEQ ID NO: 2565077 - RNA, 15 nt, Chlamydophila pneumoniae J138
ucauuaucaagaaau

SEQ ID NO: 2565078 - RNA, 17 nt, Chlamydophila pneumoniae J138
ucauuaucacagaugua

SEQ ID NO: 2565079 - RNA, 14 nt, Chlamydophila pneumoniae J138
ucauuccagcaucu

SEQ ID NO: 2565080 - RNA, 14 nt, Chlamydophila pneumoniae J138
ucauucccuuuuuc

SEQ ID NO: 2565081 - RNA, 16 nt, Chlamydophila pneumoniae J138
ucauucccuuuuucca

SEQ ID NO: 2565082 - RNA, 20 nt, Chlamydophila pneumoniae J138
ucauugcuauugaaaaaucc

SEQ ID NO: 2565083 - RNA, 23 nt, Chlamydophila pneumoniae J138
ucauuucgauaacacuucuuucu

SEQ ID NO: 2565084 - RNA, 15 nt, Chlamydophila pneumoniae J138
ucauuuuaguuuuca

SEQ ID NO: 2565085 - RNA, 14 nt, Chlamydophila pneumoniae J138
ucauuuucauagca

SEQ ID NO: 2565086 - RNA, 12 nt, Chlamydophila pneumoniae J138
ucauuuuuuaau

SEQ ID NO: 2565087 - RNA, 15 nt, Chlamydophila pneumoniae J138
ucauuuuuuaauaaa

SEQ ID NO: 2565088 - RNA, 14 nt, Chlamydophila pneumoniae J138
uccaaaaaagagcc

SEQ ID NO: 2565089 - RNA, 18 nt, Chlamydophila pneumoniae J138
uccaaaaacgauucgaaa

SEQ ID NO: 2565090 - RNA, 17 nt, Chlamydophila pneumoniae J138
uccaaaaacuucuaacu

SEQ ID NO: 2565091 - RNA, 15 nt, Chlamydophila pneumoniae J138
uccaaaagaccaaaa

SEQ ID NO: 2565092 - RNA, 12 nt, Chlamydophila pneumoniae J138
uccaaaaucucu

SEQ ID NO: 2565093 - RNA, 19 nt, Chlamydophila pneumoniae J138
uccaaaaugucuuuuucaa

SEQ ID NO: 2565094 - RNA, 23 nt, Chlamydophila pneumoniae J138
uccaaaauuaccguuuccuccuc

SEQ ID NO: 2565095 - RNA, 16 nt, Chlamydophila pneumoniae J138
uccaaacauuuuuaag

SEQ ID NO: 2565096 - RNA, 18 nt, Chlamydophila pneumoniae J138
uccaaacauuuuuaagga

SEQ ID NO: 2565097 - RNA, 21 nt, Chlamydophila pneumoniae J138
uccaaacgguuaaugaacuca

SEQ ID NO: 2565098 - RNA, 20 nt, Chlamydophila pneumoniae J138
uccaaacguggucauuagcc

SEQ ID NO: 2565099 - RNA, 15 nt, Chlamydophila pneumoniae J138
uccaaagauacauua

SEQ ID NO: 2565100 - RNA, 18 nt, Chlamydophila pneumoniae J138
uccaaagccugaaaaaua

SEQ ID NO: 2565101 - RNA, 17 nt, Chlamydophila pneumoniae J138
uccaaagcuauuucucu

SEQ ID NO: 2565102 - RNA, 23 nt, Chlamydophila pneumoniae J138
uccaaaggaaaauaaucuucaaa

SEQ ID NO: 2565103 - RNA, 12 nt, Chlamydophila pneumoniae J138
uccaaauaaagc

SEQ ID NO: 2565104 - RNA, 22 nt, Chlamydophila pneumoniae J138
uccaaauagagugaccauagca

SEQ ID NO: 2565105 - RNA, 22 nt, Chlamydophila pneumoniae J138
uccaaauugcaauuuucuaaag

SEQ ID NO: 2565106 - RNA, 15 nt, Chlamydophila pneumoniae J138
uccaacaaacaauuc

SEQ ID NO: 2565107 - RNA, 16 nt, Chlamydophila pneumoniae J138
uccaacggacauuuuc

SEQ ID NO: 2565108 - RNA, 21 nt, Chlamydophila pneumoniae J138
uccaacuaaaccuucaaugau

SEQ ID NO: 2565109 - RNA, 13 nt, Chlamydophila pneumoniae J138
uccaacuucaacu

SEQ ID NO: 2565110 - RNA, 17 nt, Chlamydophila pneumoniae J138
uccaacuuccauaugag

SEQ ID NO: 2565111 - RNA, 22 nt, Chlamydophila pneumoniae J138
uccaacuuuugaagauccugag

SEQ ID NO: 2565112 - RNA, 16 nt, Chlamydophila pneumoniae J138
uccaagaauagccaua

SEQ ID NO: 2565113 - RNA, 20 nt, Chlamydophila pneumoniae J138
uccaagacaacaccucccac

SEQ ID NO: 2565114 - RNA, 15 nt, Chlamydophila pneumoniae J138
uccaagaguucucuu

SEQ ID NO: 2565115 - RNA, 12 nt, Chlamydophila pneumoniae J138
uccaagaucucc

SEQ ID NO: 2565116 - RNA, 22 nt, Chlamydophila pneumoniae J138
uccaagaucuccgccuacaaua

SEQ ID NO: 2565117 - RNA, 19 nt, Chlamydophila pneumoniae J138
uccaagugaucagaaauga

SEQ ID NO: 2565118 - RNA, 23 nt, Chlamydophila pneumoniae J138
uccaagugaucagaaaugaagcc

SEQ ID NO: 2565119 - RNA, 18 nt, Chlamydophila pneumoniae J138
uccaauaauuuucccaau

SEQ ID NO: 2565120 - RNA, 13 nt, Chlamydophila pneumoniae J138
uccaauacuaaaa

SEQ ID NO: 2565121 - RNA, 20 nt, Chlamydophila pneumoniae J138
uccaauagccaaagacucuu

SEQ ID NO: 2565122 - RNA, 17 nt, Chlamydophila pneumoniae J138
uccaauaggccagaaug

SEQ ID NO: 2565123 - RNA, 19 nt, Chlamydophila pneumoniae J138
uccaauccauucugagaaa

SEQ ID NO: 2565124 - RNA, 13 nt, Chlamydophila pneumoniae J138
uccaaucugcuga

SEQ ID NO: 2565125 - RNA, 18 nt, Chlamydophila pneumoniae J138
uccaaucugcugaaggga

SEQ ID NO: 2565126 - RNA, 16 nt, Chlamydophila pneumoniae J138
uccaauuguaaaucau

SEQ ID NO: 2565127 - RNA, 14 nt, Chlamydophila pneumoniae J138
uccacaagccuccc

SEQ ID NO: 2565128 - RNA, 21 nt, Chlamydophila pneumoniae J138
uccacaaucucuuuaaaaauu

SEQ ID NO: 2565129 - RNA, 16 nt, Chlamydophila pneumoniae J138
uccacagacugcagga

SEQ ID NO: 2565130 - RNA, 17 nt, Chlamydophila pneumoniae J138
uccacagagaccuucuc

SEQ ID NO: 2565131 - RNA, 21 nt, Chlamydophila pneumoniae J138
uccacagaucguaaucuguau

SEQ ID NO: 2565132 - RNA, 20 nt, Chlamydophila pneumoniae J138
uccacauccuuguagaacuu

SEQ ID NO: 2565133 - RNA, 17 nt, Chlamydophila pneumoniae J138
uccacaucuugagcuuc

SEQ ID NO: 2565134 - RNA, 13 nt, Chlamydophila pneumoniae J138
uccacaugcccaa

SEQ ID NO: 2565135 - RNA, 18 nt, Chlamydophila pneumoniae J138
uccacaugcccaaacauc

SEQ ID NO: 2565136 - RNA, 15 nt, Chlamydophila pneumoniae J138
uccaccaagacugaa

SEQ ID NO: 2565137 - RNA, 20 nt, Chlamydophila pneumoniae J138
uccaccaaugauaauuucau

SEQ ID NO: 2565138 - RNA, 23 nt, Chlamydophila pneumoniae J138
uccaccaggagcuccuccuugaa

SEQ ID NO: 2565139 - RNA, 22 nt, Chlamydophila pneumoniae J138
uccaccgcucacacgaauaauu

SEQ ID NO: 2565140 - RNA, 15 nt, Chlamydophila pneumoniae J138
uccacgaaggaaucu

SEQ ID NO: 2565141 - RNA, 21 nt, Chlamydophila pneumoniae J138
uccacgaguucgcggaucuuc

SEQ ID NO: 2565142 - RNA, 23 nt, Chlamydophila pneumoniae J138
uccacgaguucgcggaucuucuu

SEQ ID NO: 2565143 - RNA, 15 nt, Chlamydophila pneumoniae J138
uccacgccaaaguac

SEQ ID NO: 2565144 - RNA, 15 nt, Chlamydophila pneumoniae J138
uccacggaaauauuc

SEQ ID NO: 2565145 - RNA, 19 nt, Chlamydophila pneumoniae J138
uccacuguucuucuucagu

SEQ ID NO: 2565146 - RNA, 19 nt, Chlamydophila pneumoniae J138
uccacuuuuuucccuccac

SEQ ID NO: 2565147 - RNA, 17 nt, Chlamydophila pneumoniae J138
uccagaaaaagaacaua

SEQ ID NO: 2565148 - RNA, 15 nt, Chlamydophila pneumoniae J138
uccagaaacgcagcu

SEQ ID NO: 2565149 - RNA, 21 nt, Chlamydophila pneumoniae J138
uccagaaacgcagcuuuccuu

SEQ ID NO: 2565150 - RNA, 17 nt, Chlamydophila pneumoniae J138
uccagaaaguauuccuc

SEQ ID NO: 2565151 - RNA, 19 nt, Chlamydophila pneumoniae J138
uccagaaaguauuccucuu

SEQ ID NO: 2565152 - RNA, 19 nt, Chlamydophila pneumoniae J138
uccagaaauacguccagcc

SEQ ID NO: 2565153 - RNA, 18 nt, Chlamydophila pneumoniae J138
uccagaaauuacuguggu

SEQ ID NO: 2565154 - RNA, 14 nt, Chlamydophila pneumoniae J138
uccagaauuuucug

SEQ ID NO: 2565155 - RNA, 14 nt, Chlamydophila pneumoniae J138
uccagacuuuccuc

SEQ ID NO: 2565156 - RNA, 20 nt, Chlamydophila pneumoniae J138
uccagacuuuccucucuuua

SEQ ID NO: 2565157 - RNA, 16 nt, Chlamydophila pneumoniae J138
uccagagacaaagcca

SEQ ID NO: 2565158 - RNA, 21 nt, Chlamydophila pneumoniae J138
uccagagacaaagccacagcc

SEQ ID NO: 2565159 - RNA, 16 nt, Chlamydophila pneumoniae J138
uccagauuagaaaaga

SEQ ID NO: 2565160 - RNA, 23 nt, Chlamydophila pneumoniae J138
uccagcaccuuuaggaagcugua

SEQ ID NO: 2565161 - RNA, 21 nt, Chlamydophila pneumoniae J138
uccagccugcaccagacccuc

SEQ ID NO: 2565162 - RNA, 20 nt, Chlamydophila pneumoniae J138
uccagcugagcuaucuucaa

SEQ ID NO: 2565163 - RNA, 16 nt, Chlamydophila pneumoniae J138
uccagcuugaucagga

SEQ ID NO: 2565164 - RNA, 15 nt, Chlamydophila pneumoniae J138
uccaggaauagaaag

SEQ ID NO: 2565165 - RNA, 17 nt, Chlamydophila pneumoniae J138
uccaggacguaaaaaga

SEQ ID NO: 2565166 - RNA, 14 nt, Chlamydophila pneumoniae J138
uccaggcucuagga

SEQ ID NO: 2565167 - RNA, 21 nt, Chlamydophila pneumoniae J138
uccagguagcagaguuuuucc

SEQ ID NO: 2565168 - RNA, 23 nt, Chlamydophila pneumoniae J138
uccaguagagccucuaagaaaau

SEQ ID NO: 2565169 - RNA, 19 nt, Chlamydophila pneumoniae J138
uccaguagaucuucugaaa

SEQ ID NO: 2565170 - RNA, 22 nt, Chlamydophila pneumoniae J138
uccaguagaucuucugaaauca

SEQ ID NO: 2565171 - RNA, 17 nt, Chlamydophila pneumoniae J138
uccaguaucuucucuua

SEQ ID NO: 2565172 - RNA, 18 nt, Chlamydophila pneumoniae J138
uccaguuuguugaucucu

SEQ ID NO: 2565173 - RNA, 12 nt, Chlamydophila pneumoniae J138
uccauaaaaaug

SEQ ID NO: 2565174 - RNA, 20 nt, Chlamydophila pneumoniae J138
uccauaaaaauguaauuuuu

SEQ ID NO: 2565175 - RNA, 18 nt, Chlamydophila pneumoniae J138
uccauaacaguuuguucu

SEQ ID NO: 2565176 - RNA, 19 nt, Chlamydophila pneumoniae J138
uccauaagcuuuucuucca

SEQ ID NO: 2565177 - RNA, 20 nt, Chlamydophila pneumoniae J138
uccauaagcuuuucuuccaa

SEQ ID NO: 2565178 - RNA, 20 nt, Chlamydophila pneumoniae J138
uccauaaugcugagaugguc

SEQ ID NO: 2565179 - RNA, 16 nt, Chlamydophila pneumoniae J138
uccauaauuucuuuca

SEQ ID NO: 2565180 - RNA, 12 nt, Chlamydophila pneumoniae J138
uccauacaggcu

SEQ ID NO: 2565181 - RNA, 21 nt, Chlamydophila pneumoniae J138
uccauacccaaauuucuucug

SEQ ID NO: 2565182 - RNA, 15 nt, Chlamydophila pneumoniae J138
uccauagaguaucua

SEQ ID NO: 2565183 - RNA, 21 nt, Chlamydophila pneumoniae J138
uccauagccaaggagcuauag

SEQ ID NO: 2565184 - RNA, 22 nt, Chlamydophila pneumoniae J138
uccauagcgauagcuaaaccuu

SEQ ID NO: 2565185 - RNA, 21 nt, Chlamydophila pneumoniae J138
uccauagcuaaguaacagucc

SEQ ID NO: 2565186 - RNA, 16 nt, Chlamydophila pneumoniae J138
uccauaggaacaaagc

SEQ ID NO: 2565187 - RNA, 16 nt, Chlamydophila pneumoniae J138
uccauaggaucugcau

SEQ ID NO: 2565188 - RNA, 17 nt, Chlamydophila pneumoniae J138
uccauaucuagaaguuu

SEQ ID NO: 2565189 - RNA, 22 nt, Chlamydophila pneumoniae J138
uccauaugggacuucaagccaa

SEQ ID NO: 2565190 - RNA, 23 nt, Chlamydophila pneumoniae J138
uccaucacgaggagcuuuuaccu

SEQ ID NO: 2565191 - RNA, 16 nt, Chlamydophila pneumoniae J138
uccaucggcauuucuc

SEQ ID NO: 2565192 - RNA, 22 nt, Chlamydophila pneumoniae J138
uccaucugcucuuuugcaaguu

SEQ ID NO: 2565193 - RNA, 15 nt, Chlamydophila pneumoniae J138
uccauggaauggcua

SEQ ID NO: 2565194 - RNA, 22 nt, Chlamydophila pneumoniae J138
uccauggauauggaauggcuuu

SEQ ID NO: 2565195 - RNA, 16 nt, Chlamydophila pneumoniae J138
uccauggcuuccuacg

SEQ ID NO: 2565196 - RNA, 20 nt, Chlamydophila pneumoniae J138
uccauguagaaggggguucu

SEQ ID NO: 2565197 - RNA, 21 nt, Chlamydophila pneumoniae J138
uccauuagggcauucuguaau

SEQ ID NO: 2565198 - RNA, 15 nt, Chlamydophila pneumoniae J138
uccauuauacuuuuu

SEQ ID NO: 2565199 - RNA, 17 nt, Chlamydophila pneumoniae J138
uccauucugagaaagaa

SEQ ID NO: 2565200 - RNA, 12 nt, Chlamydophila pneumoniae J138
uccauucuuaau

SEQ ID NO: 2565201 - RNA, 20 nt, Chlamydophila pneumoniae J138
uccauucuuaauauaaaaga

SEQ ID NO: 2565202 - RNA, 16 nt, Chlamydophila pneumoniae J138
uccauuggcauagagc

SEQ ID NO: 2565203 - RNA, 16 nt, Chlamydophila pneumoniae J138
uccauuucuaggaauu

SEQ ID NO: 2565204 - RNA, 16 nt, Chlamydophila pneumoniae J138
uccauuuuuccuccuc

SEQ ID NO: 2565205 - RNA, 12 nt, Chlamydophila pneumoniae J138
ucccaaaaaaug

SEQ ID NO: 2565206 - RNA, 14 nt, Chlamydophila pneumoniae J138
ucccaaaaaaugcc

SEQ ID NO: 2565207 - RNA, 17 nt, Chlamydophila pneumoniae J138
ucccaaacuucuucucg

SEQ ID NO: 2565208 - RNA, 16 nt, Chlamydophila pneumoniae J138
ucccaagcugaaagaa

SEQ ID NO: 2565209 - RNA, 18 nt, Chlamydophila pneumoniae J138
ucccaagcugaaagaaug

SEQ ID NO: 2565210 - RNA, 14 nt, Chlamydophila pneumoniae J138
ucccaagggccaga

SEQ ID NO: 2565211 - RNA, 15 nt, Chlamydophila pneumoniae J138
ucccaagucugcuug

SEQ ID NO: 2565212 - RNA, 15 nt, Chlamydophila pneumoniae J138
ucccaauauccagaa

SEQ ID NO: 2565213 - RNA, 16 nt, Chlamydophila pneumoniae J138
ucccaauauccagaaa

SEQ ID NO: 2565214 - RNA, 18 nt, Chlamydophila pneumoniae J138
ucccaauauccagaaaua

SEQ ID NO: 2565215 - RNA, 11 nt, Chlamydophila pneumoniae J138
ucccacagaaa

SEQ ID NO: 2565216 - RNA, 20 nt, Chlamydophila pneumoniae J138
ucccaccauauucucaggaa

SEQ ID NO: 2565217 - RNA, 15 nt, Chlamydophila pneumoniae J138
ucccacgggucagga

SEQ ID NO: 2565218 - RNA, 20 nt, Chlamydophila pneumoniae J138
ucccacggugccuaggcuaa

SEQ ID NO: 2565219 - RNA, 15 nt, Chlamydophila pneumoniae J138
ucccacuaagaauga

SEQ ID NO: 2565220 - RNA, 20 nt, Chlamydophila pneumoniae J138
ucccagaaggggaauaauau

SEQ ID NO: 2565221 - RNA, 20 nt, Chlamydophila pneumoniae J138
ucccagauuuuuuugguugc

SEQ ID NO: 2565222 - RNA, 16 nt, Chlamydophila pneumoniae J138
ucccagucgugagaag

SEQ ID NO: 2565223 - RNA, 18 nt, Chlamydophila pneumoniae J138
ucccauagcaaugccuac

SEQ ID NO: 2565224 - RNA, 15 nt, Chlamydophila pneumoniae J138
ucccaucacauaaau

SEQ ID NO: 2565225 - RNA, 17 nt, Chlamydophila pneumoniae J138
ucccaucuuguucuaaa

SEQ ID NO: 2565226 - RNA, 18 nt, Chlamydophila pneumoniae J138
ucccaucuuguucuaaaa

SEQ ID NO: 2565227 - RNA, 12 nt, Chlamydophila pneumoniae J138
ucccaugggaua

SEQ ID NO: 2565228 - RNA, 16 nt, Chlamydophila pneumoniae J138
ucccauguaguaaauu

SEQ ID NO: 2565229 - RNA, 21 nt, Chlamydophila pneumoniae J138
ucccaugugcugaagaccaug

SEQ ID NO: 2565230 - RNA, 16 nt, Chlamydophila pneumoniae J138
uccccagggagaucua

SEQ ID NO: 2565231 - RNA, 17 nt, Chlamydophila pneumoniae J138
uccccauaaccaauaaa

SEQ ID NO: 2565232 - RNA, 14 nt, Chlamydophila pneumoniae J138
uccccauucacaaa

SEQ ID NO: 2565233 - RNA, 17 nt, Chlamydophila pneumoniae J138
ucccccagaccuaaaaa

SEQ ID NO: 2565234 - RNA, 14 nt, Chlamydophila pneumoniae J138
ucccccauaaaaau

SEQ ID NO: 2565235 - RNA, 24 nt, Chlamydophila pneumoniae J138
uccccccucacaauauaaaugcua

SEQ ID NO: 2565236 - RNA, 12 nt, Chlamydophila pneumoniae J138
ucccccuaaggg

SEQ ID NO: 2565237 - RNA, 23 nt, Chlamydophila pneumoniae J138
ucccccugaaugcaacagaguca

SEQ ID NO: 2565238 - RNA, 19 nt, Chlamydophila pneumoniae J138
uccccucugauuauuucua

SEQ ID NO: 2565239 - RNA, 16 nt, Chlamydophila pneumoniae J138
uccccugcaucucugc

SEQ ID NO: 2565240 - RNA, 15 nt, Chlamydophila pneumoniae J138
uccccuucauucuuu

SEQ ID NO: 2565241 - RNA, 17 nt, Chlamydophila pneumoniae J138
ucccgacauuuaacauc

SEQ ID NO: 2565242 - RNA, 17 nt, Chlamydophila pneumoniae J138
ucccgagauaugaagag

SEQ ID NO: 2565243 - RNA, 21 nt, Chlamydophila pneumoniae J138
ucccgagggaugaugcccuga

SEQ ID NO: 2565244 - RNA, 18 nt, Chlamydophila pneumoniae J138
ucccgugagcaugcucac

SEQ ID NO: 2565245 - RNA, 13 nt, Chlamydophila pneumoniae J138
ucccguuccuuua

SEQ ID NO: 2565246 - RNA, 17 nt, Chlamydophila pneumoniae J138
ucccuaagguagagucc

SEQ ID NO: 2565247 - RNA, 21 nt, Chlamydophila pneumoniae J138
ucccuacccucaucauccuca

SEQ ID NO: 2565248 - RNA, 16 nt, Chlamydophila pneumoniae J138
ucccuagcauacaucg

SEQ ID NO: 2565249 - RNA, 23 nt, Chlamydophila pneumoniae J138
ucccuauaaagcaaaugccugua

SEQ ID NO: 2565250 - RNA, 21 nt, Chlamydophila pneumoniae J138
ucccuauagaacaugaggcac

SEQ ID NO: 2565251 - RNA, 18 nt, Chlamydophila pneumoniae J138
ucccuccgcaguuguaca

SEQ ID NO: 2565252 - RNA, 23 nt, Chlamydophila pneumoniae J138
ucccuccuccucgucuaaagaag

SEQ ID NO: 2565253 - RNA, 12 nt, Chlamydophila pneumoniae J138
ucccuccuuccu

SEQ ID NO: 2565254 - RNA, 15 nt, Chlamydophila pneumoniae J138
ucccucgcuaaagua

SEQ ID NO: 2565255 - RNA, 12 nt, Chlamydophila pneumoniae J138
ucccucuucuuc

SEQ ID NO: 2565256 - RNA, 14 nt, Chlamydophila pneumoniae J138
ucccucuucuucca

SEQ ID NO: 2565257 - RNA, 15 nt, Chlamydophila pneumoniae J138
ucccucuucuuccaa

SEQ ID NO: 2565258 - RNA, 20 nt, Chlamydophila pneumoniae J138
ucccugauguugcccuacaa

SEQ ID NO: 2565259 - RNA, 18 nt, Chlamydophila pneumoniae J138
ucccugauuccauccugu

SEQ ID NO: 2565260 - RNA, 18 nt, Chlamydophila pneumoniae J138
ucccuggauuucuucugu

SEQ ID NO: 2565261 - RNA, 18 nt, Chlamydophila pneumoniae J138
ucccuguaguuucuaaaa

SEQ ID NO: 2565262 - RNA, 16 nt, Chlamydophila pneumoniae J138
ucccuguauuaaagaa

SEQ ID NO: 2565263 - RNA, 18 nt, Chlamydophila pneumoniae J138
ucccuuagaaauucuaag

SEQ ID NO: 2565264 - RNA, 19 nt, Chlamydophila pneumoniae J138
ucccuuagaaauucuaaga

SEQ ID NO: 2565265 - RNA, 17 nt, Chlamydophila pneumoniae J138
ucccuucuucuuuuaga

SEQ ID NO: 2565266 - RNA, 13 nt, Chlamydophila pneumoniae J138
ucccuucuuucaa

SEQ ID NO: 2565267 - RNA, 14 nt, Chlamydophila pneumoniae J138
uccgaaaacucuua

SEQ ID NO: 2565268 - RNA, 18 nt, Chlamydophila pneumoniae J138
uccgaagacuaccaaucc

SEQ ID NO: 2565269 - RNA, 23 nt, Chlamydophila pneumoniae J138
uccgaagacucaaagaacugcau

SEQ ID NO: 2565270 - RNA, 23 nt, Chlamydophila pneumoniae J138
uccgacucuguuuccuugugucu

SEQ ID NO: 2565271 - RNA, 17 nt, Chlamydophila pneumoniae J138
uccgagaaacaaccauc

SEQ ID NO: 2565272 - RNA, 21 nt, Chlamydophila pneumoniae J138
uccgaucauaauuagagagaa

SEQ ID NO: 2565273 - RNA, 23 nt, Chlamydophila pneumoniae J138
uccgaucauuuuugcuagaucug

SEQ ID NO: 2565274 - RNA, 19 nt, Chlamydophila pneumoniae J138
uccgauuaguaaugaugua

SEQ ID NO: 2565275 - RNA, 17 nt, Chlamydophila pneumoniae J138
uccgcaaguaaucauga

SEQ ID NO: 2565276 - RNA, 22 nt, Chlamydophila pneumoniae J138
uccgcccgucuuagaauccaaa

SEQ ID NO: 2565277 - RNA, 14 nt, Chlamydophila pneumoniae J138
uccggaacgcagag

SEQ ID NO: 2565278 - RNA, 18 nt, Chlamydophila pneumoniae J138
uccggaacgcagaguuuu

SEQ ID NO: 2565279 - RNA, 12 nt, Chlamydophila pneumoniae J138
uccguaaguaac

SEQ ID NO: 2565280 - RNA, 20 nt, Chlamydophila pneumoniae J138
uccgucaagaacaagagcuu

SEQ ID NO: 2565281 - RNA, 16 nt, Chlamydophila pneumoniae J138
uccgucauauuuaaaa

SEQ ID NO: 2565282 - RNA, 14 nt, Chlamydophila pneumoniae J138
uccgugagcaacaa

SEQ ID NO: 2565283 - RNA, 18 nt, Chlamydophila pneumoniae J138
uccguuaccaaaaacugg

SEQ ID NO: 2565284 - RNA, 15 nt, Chlamydophila pneumoniae J138
uccguuuuuucagau

SEQ ID NO: 2565285 - RNA, 19 nt, Chlamydophila pneumoniae J138
uccuaaaaaggguuccucu

SEQ ID NO: 2565286 - RNA, 23 nt, Chlamydophila pneumoniae J138
uccuaaaacaagaagaucaaaga

SEQ ID NO: 2565287 - RNA, 17 nt, Chlamydophila pneumoniae J138
uccuaaaauuucuagga

SEQ ID NO: 2565288 - RNA, 23 nt, Chlamydophila pneumoniae J138
uccuaaauuaaauaucuaauaaa

SEQ ID NO: 2565289 - RNA, 15 nt, Chlamydophila pneumoniae J138
uccuaacaaaaggau

SEQ ID NO: 2565290 - RNA, 18 nt, Chlamydophila pneumoniae J138
uccuaagagauuuuccau

SEQ ID NO: 2565291 - RNA, 19 nt, Chlamydophila pneumoniae J138
uccuaagagauuuuccaua

SEQ ID NO: 2565292 - RNA, 18 nt, Chlamydophila pneumoniae J138
uccuaagucguuaacauc

SEQ ID NO: 2565293 - RNA, 20 nt, Chlamydophila pneumoniae J138
uccuaagucguuaacaucaa

SEQ ID NO: 2565294 - RNA, 21 nt, Chlamydophila pneumoniae J138
uccuaaguuagagacacagaa

SEQ ID NO: 2565295 - RNA, 19 nt, Chlamydophila pneumoniae J138
uccuaccuacguagcauua

SEQ ID NO: 2565296 - RNA, 14 nt, Chlamydophila pneumoniae J138
uccuaccuauauuu

SEQ ID NO: 2565297 - RNA, 21 nt, Chlamydophila pneumoniae J138
uccuaccuauauuuuuuacau

SEQ ID NO: 2565298 - RNA, 18 nt, Chlamydophila pneumoniae J138
uccuacgagcgcuuucuu

SEQ ID NO: 2565299 - RNA, 13 nt, Chlamydophila pneumoniae J138
uccuacggcaaga

SEQ ID NO: 2565300 - RNA, 22 nt, Chlamydophila pneumoniae J138
uccuagaccuaugacggauccu

SEQ ID NO: 2565301 - RNA, 11 nt, Chlamydophila pneumoniae J138
uccuagagaac

SEQ ID NO: 2565302 - RNA, 17 nt, Chlamydophila pneumoniae J138
uccuaggcugagacaua

SEQ ID NO: 2565303 - RNA, 16 nt, Chlamydophila pneumoniae J138
uccuauaguaauuucu

SEQ ID NO: 2565304 - RNA, 19 nt, Chlamydophila pneumoniae J138
uccuaucaaagcaaaaguc

SEQ ID NO: 2565305 - RNA, 16 nt, Chlamydophila pneumoniae J138
uccuaugaucagagag

SEQ ID NO: 2565306 - RNA, 19 nt, Chlamydophila pneumoniae J138
uccuauuuuagcauaaucu

SEQ ID NO: 2565307 - RNA, 14 nt, Chlamydophila pneumoniae J138
uccucaaaagauau

SEQ ID NO: 2565308 - RNA, 23 nt, Chlamydophila pneumoniae J138
uccucaaagccgaggauucgcua

SEQ ID NO: 2565309 - RNA, 17 nt, Chlamydophila pneumoniae J138
uccucaagaauaugaac

SEQ ID NO: 2565310 - RNA, 17 nt, Chlamydophila pneumoniae J138
uccucaagauaaauccc

SEQ ID NO: 2565311 - RNA, 20 nt, Chlamydophila pneumoniae J138
uccucaagauaaaucccacu

SEQ ID NO: 2565312 - RNA, 13 nt, Chlamydophila pneumoniae J138
uccucaauuuguu

SEQ ID NO: 2565313 - RNA, 16 nt, Chlamydophila pneumoniae J138
uccucacaucuccuuu

SEQ ID NO: 2565314 - RNA, 15 nt, Chlamydophila pneumoniae J138
uccucaccgaucuca

SEQ ID NO: 2565315 - RNA, 15 nt, Chlamydophila pneumoniae J138
uccucacuagagauu

SEQ ID NO: 2565316 - RNA, 12 nt, Chlamydophila pneumoniae J138
uccucagucucu

SEQ ID NO: 2565317 - RNA, 13 nt, Chlamydophila pneumoniae J138
uccucaucagaag

SEQ ID NO: 2565318 - RNA, 14 nt, Chlamydophila pneumoniae J138
uccucaucaucaga

SEQ ID NO: 2565319 - RNA, 12 nt, Chlamydophila pneumoniae J138
uccuccaaaauu

SEQ ID NO: 2565320 - RNA, 20 nt, Chlamydophila pneumoniae J138
uccuccaaugagcucuauuu

SEQ ID NO: 2565321 - RNA, 22 nt, Chlamydophila pneumoniae J138
uccuccauggaaagaaacaaau

SEQ ID NO: 2565322 - RNA, 18 nt, Chlamydophila pneumoniae J138
uccuccuagguucuuuuu

SEQ ID NO: 2565323 - RNA, 23 nt, Chlamydophila pneumoniae J138
uccuccuucugcaaucagugcug

SEQ ID NO: 2565324 - RNA, 17 nt, Chlamydophila pneumoniae J138
uccucgauacuguugau

SEQ ID NO: 2565325 - RNA, 17 nt, Chlamydophila pneumoniae J138
uccucgucuaaagaaga

SEQ ID NO: 2565326 - RNA, 14 nt, Chlamydophila pneumoniae J138
uccucgucuucaau

SEQ ID NO: 2565327 - RNA, 22 nt, Chlamydophila pneumoniae J138
uccucuauauuuuuucccacaa

SEQ ID NO: 2565328 - RNA, 14 nt, Chlamydophila pneumoniae J138
uccucuauccauca

SEQ ID NO: 2565329 - RNA, 14 nt, Chlamydophila pneumoniae J138
uccucucuuuauau

SEQ ID NO: 2565330 - RNA, 14 nt, Chlamydophila pneumoniae J138
uccucuuccuuuuu

SEQ ID NO: 2565331 - RNA, 17 nt, Chlamydophila pneumoniae J138
uccucuucuauucugau

SEQ ID NO: 2565332 - RNA, 13 nt, Chlamydophila pneumoniae J138
uccugaaaguaca

SEQ ID NO: 2565333 - RNA, 17 nt, Chlamydophila pneumoniae J138
uccugaaaguacagaaa

SEQ ID NO: 2565334 - RNA, 19 nt, Chlamydophila pneumoniae J138
uccugaacggcucuuucua

SEQ ID NO: 2565335 - RNA, 19 nt, Chlamydophila pneumoniae J138
uccugaagaugagaaaauc

SEQ ID NO: 2565336 - RNA, 22 nt, Chlamydophila pneumoniae J138
uccugaagccaugacaaagggu

SEQ ID NO: 2565337 - RNA, 19 nt, Chlamydophila pneumoniae J138
uccugaagggacaaguacg

SEQ ID NO: 2565338 - RNA, 19 nt, Chlamydophila pneumoniae J138
uccugaauaugcuuuucaa

SEQ ID NO: 2565339 - RNA, 19 nt, Chlamydophila pneumoniae J138
uccugaaucagcuuaucua

SEQ ID NO: 2565340 - RNA, 17 nt, Chlamydophila pneumoniae J138
uccugacuauaaaaugc

SEQ ID NO: 2565341 - RNA, 15 nt, Chlamydophila pneumoniae J138
uccugacucuuuuaa

SEQ ID NO: 2565342 - RNA, 11 nt, Chlamydophila pneumoniae J138
uccugagacca

SEQ ID NO: 2565343 - RNA, 11 nt, Chlamydophila pneumoniae J138
uccugagagcg

SEQ ID NO: 2565344 - RNA, 19 nt, Chlamydophila pneumoniae J138
uccugaggcuauagaauac

SEQ ID NO: 2565345 - RNA, 14 nt, Chlamydophila pneumoniae J138
uccugaguaaaauc

SEQ ID NO: 2565346 - RNA, 23 nt, Chlamydophila pneumoniae J138
uccugaucccuuagaaauucuaa

SEQ ID NO: 2565347 - RNA, 17 nt, Chlamydophila pneumoniae J138
uccugaugccuuuuucu

SEQ ID NO: 2565348 - RNA, 19 nt, Chlamydophila pneumoniae J138
uccugcaagcauuguuugu

SEQ ID NO: 2565349 - RNA, 13 nt, Chlamydophila pneumoniae J138
uccugcagcagcc

SEQ ID NO: 2565350 - RNA, 21 nt, Chlamydophila pneumoniae J138
uccugcagggggcauucccug

SEQ ID NO: 2565351 - RNA, 17 nt, Chlamydophila pneumoniae J138
uccugcaguauuauaaa

SEQ ID NO: 2565352 - RNA, 13 nt, Chlamydophila pneumoniae J138
uccugcauggcuu

SEQ ID NO: 2565353 - RNA, 17 nt, Chlamydophila pneumoniae J138
uccuggaacaguauaau

SEQ ID NO: 2565354 - RNA, 15 nt, Chlamydophila pneumoniae J138
uccuggucuccagaa

SEQ ID NO: 2565355 - RNA, 20 nt, Chlamydophila pneumoniae J138
uccuguacaucgguguugca

SEQ ID NO: 2565356 - RNA, 13 nt, Chlamydophila pneumoniae J138
uccuguagccacu

SEQ ID NO: 2565357 - RNA, 15 nt, Chlamydophila pneumoniae J138
uccuguuccauauca

SEQ ID NO: 2565358 - RNA, 21 nt, Chlamydophila pneumoniae J138
uccuuaaugagaguuucuaau

SEQ ID NO: 2565359 - RNA, 22 nt, Chlamydophila pneumoniae J138
uccuuaccaauaugcucugcca

SEQ ID NO: 2565360 - RNA, 14 nt, Chlamydophila pneumoniae J138
uccuuacucccaug

SEQ ID NO: 2565361 - RNA, 22 nt, Chlamydophila pneumoniae J138
uccuuagcauuaggaaaguacc

SEQ ID NO: 2565362 - RNA, 20 nt, Chlamydophila pneumoniae J138
uccuuaggggcguugagcaa

SEQ ID NO: 2565363 - RNA, 15 nt, Chlamydophila pneumoniae J138
uccuuaucuugcugc

SEQ ID NO: 2565364 - RNA, 16 nt, Chlamydophila pneumoniae J138
uccuuauuguagagag

SEQ ID NO: 2565365 - RNA, 21 nt, Chlamydophila pneumoniae J138
uccuucauacguuuuuuuccu

SEQ ID NO: 2565366 - RNA, 17 nt, Chlamydophila pneumoniae J138
uccuucauucacagcag

SEQ ID NO: 2565367 - RNA, 17 nt, Chlamydophila pneumoniae J138
uccuuccuuaagggaag

SEQ ID NO: 2565368 - RNA, 24 nt, Chlamydophila pneumoniae J138
uccuucgaccuauuugcaacaauc

SEQ ID NO: 2565369 - RNA, 22 nt, Chlamydophila pneumoniae J138
uccuucuacaaugauauaaaag

SEQ ID NO: 2565370 - RNA, 16 nt, Chlamydophila pneumoniae J138
uccuucuauagcaaga

SEQ ID NO: 2565371 - RNA, 12 nt, Chlamydophila pneumoniae J138
uccuucuccugu

SEQ ID NO: 2565372 - RNA, 14 nt, Chlamydophila pneumoniae J138
uccuucugcaauca

SEQ ID NO: 2565373 - RNA, 15 nt, Chlamydophila pneumoniae J138
uccuucuggagugac

SEQ ID NO: 2565374 - RNA, 18 nt, Chlamydophila pneumoniae J138
uccuucuggagugacacc

SEQ ID NO: 2565375 - RNA, 20 nt, Chlamydophila pneumoniae J138
uccuucuggagugacaccaa

SEQ ID NO: 2565376 - RNA, 13 nt, Chlamydophila pneumoniae J138
uccuucuguuuuc

SEQ ID NO: 2565377 - RNA, 15 nt, Chlamydophila pneumoniae J138
uccuucuguuuucac

SEQ ID NO: 2565378 - RNA, 12 nt, Chlamydophila pneumoniae J138
uccuucuucuuc

SEQ ID NO: 2565379 - RNA, 14 nt, Chlamydophila pneumoniae J138
uccuucuucuucaa

SEQ ID NO: 2565380 - RNA, 16 nt, Chlamydophila pneumoniae J138
uccuucuugcaaagau

SEQ ID NO: 2565381 - RNA, 15 nt, Chlamydophila pneumoniae J138
uccuucuuucugcuc

SEQ ID NO: 2565382 - RNA, 18 nt, Chlamydophila pneumoniae J138
uccuugaaauugcucuug

SEQ ID NO: 2565383 - RNA, 15 nt, Chlamydophila pneumoniae J138
uccuugaauuaguuu

SEQ ID NO: 2565384 - RNA, 19 nt, Chlamydophila pneumoniae J138
uccuugacaaauaaguccu

SEQ ID NO: 2565385 - RNA, 17 nt, Chlamydophila pneumoniae J138
uccuugagggcuaucca

SEQ ID NO: 2565386 - RNA, 18 nt, Chlamydophila pneumoniae J138
uccuugauaaaacgcuau

SEQ ID NO: 2565387 - RNA, 15 nt, Chlamydophila pneumoniae J138
uccuugggucuuuuu

SEQ ID NO: 2565388 - RNA, 19 nt, Chlamydophila pneumoniae J138
uccuuguacuguauagaaa

SEQ ID NO: 2565389 - RNA, 14 nt, Chlamydophila pneumoniae J138
uccuuguagaacuu

SEQ ID NO: 2565390 - RNA, 17 nt, Chlamydophila pneumoniae J138
uccuuguagaacuucuc

SEQ ID NO: 2565391 - RNA, 16 nt, Chlamydophila pneumoniae J138
uccuuuaaauaaaauc

SEQ ID NO: 2565392 - RNA, 20 nt, Chlamydophila pneumoniae J138
uccuuucuuuugcuuuuccc

SEQ ID NO: 2565393 - RNA, 22 nt, Chlamydophila pneumoniae J138
uccuuucuuuugcuuuucccac

SEQ ID NO: 2565394 - RNA, 22 nt, Chlamydophila pneumoniae J138
uccuuugcuaagaacuagcaug

SEQ ID NO: 2565395 - RNA, 17 nt, Chlamydophila pneumoniae J138
uccuuuguauucagugu

SEQ ID NO: 2565396 - RNA, 12 nt, Chlamydophila pneumoniae J138
uccuuuuaaaau

SEQ ID NO: 2565397 - RNA, 13 nt, Chlamydophila pneumoniae J138
uccuuuuaaaauu

SEQ ID NO: 2565398 - RNA, 19 nt, Chlamydophila pneumoniae J138
ucgaaacucuuugaggaua

SEQ ID NO: 2565399 - RNA, 22 nt, Chlamydophila pneumoniae J138
ucgaaagaucagaggaaucuaa

SEQ ID NO: 2565400 - RNA, 15 nt, Chlamydophila pneumoniae J138
ucgaaauccuaaaaa

SEQ ID NO: 2565401 - RNA, 21 nt, Chlamydophila pneumoniae J138
ucgaacagagaugcaaauccu

SEQ ID NO: 2565402 - RNA, 15 nt, Chlamydophila pneumoniae J138
ucgaacucugaagua

SEQ ID NO: 2565403 - RNA, 23 nt, Chlamydophila pneumoniae J138
ucgaagaaaauaaagaucuucau

SEQ ID NO: 2565404 - RNA, 19 nt, Chlamydophila pneumoniae J138
ucgaagaacuuagcaauga

SEQ ID NO: 2565405 - RNA, 19 nt, Chlamydophila pneumoniae J138
ucgaagagcccucuucacu

SEQ ID NO: 2565406 - RNA, 22 nt, Chlamydophila pneumoniae J138
ucgaagaucuucgucccuagaa

SEQ ID NO: 2565407 - RNA, 16 nt, Chlamydophila pneumoniae J138
ucgaagcggagcaucu

SEQ ID NO: 2565408 - RNA, 22 nt, Chlamydophila pneumoniae J138
ucgaaguugauuguagagacau

SEQ ID NO: 2565409 - RNA, 14 nt, Chlamydophila pneumoniae J138
ucgaaucuuuauuu

SEQ ID NO: 2565410 - RNA, 16 nt, Chlamydophila pneumoniae J138
ucgaaucuuuauuucu

SEQ ID NO: 2565411 - RNA, 14 nt, Chlamydophila pneumoniae J138
ucgaaugcugcaca

SEQ ID NO: 2565412 - RNA, 19 nt, Chlamydophila pneumoniae J138
ucgaaugcugcacaguuca

SEQ ID NO: 2565413 - RNA, 20 nt, Chlamydophila pneumoniae J138
ucgaaugguuccugaagcag

SEQ ID NO: 2565414 - RNA, 12 nt, Chlamydophila pneumoniae J138
ucgaauuccucc

SEQ ID NO: 2565415 - RNA, 20 nt, Chlamydophila pneumoniae J138
ucgaauuguguguuuucaua

SEQ ID NO: 2565416 - RNA, 23 nt, Chlamydophila pneumoniae J138
ucgaauuuuuguuuuaacucuag

SEQ ID NO: 2565417 - RNA, 17 nt, Chlamydophila pneumoniae J138
ucgacaacaacauaaag

SEQ ID NO: 2565418 - RNA, 20 nt, Chlamydophila pneumoniae J138
ucgacaacaacauaaagaag

SEQ ID NO: 2565419 - RNA, 16 nt, Chlamydophila pneumoniae J138
ucgacaaccaaaacag

SEQ ID NO: 2565420 - RNA, 21 nt, Chlamydophila pneumoniae J138
ucgacacuauguguuuccuuu

SEQ ID NO: 2565421 - RNA, 12 nt, Chlamydophila pneumoniae J138
ucgacagcagca

SEQ ID NO: 2565422 - RNA, 13 nt, Chlamydophila pneumoniae J138
ucgacagcagcau

SEQ ID NO: 2565423 - RNA, 22 nt, Chlamydophila pneumoniae J138
ucgacagcagcauuuucuaaag

SEQ ID NO: 2565424 - RNA, 20 nt, Chlamydophila pneumoniae J138
ucgacuucaccuugaaguuu

SEQ ID NO: 2565425 - RNA, 21 nt, Chlamydophila pneumoniae J138
ucgacuuccuucaaucguaau

SEQ ID NO: 2565426 - RNA, 21 nt, Chlamydophila pneumoniae J138
ucgagaaaugcucuucugcag

SEQ ID NO: 2565427 - RNA, 19 nt, Chlamydophila pneumoniae J138
ucgagagaagaaauucuga

SEQ ID NO: 2565428 - RNA, 15 nt, Chlamydophila pneumoniae J138
ucgagcagaaaugau

SEQ ID NO: 2565429 - RNA, 15 nt, Chlamydophila pneumoniae J138
ucgaggccuaaaauc

SEQ ID NO: 2565430 - RNA, 17 nt, Chlamydophila pneumoniae J138
ucgaguauggcaaauaa

SEQ ID NO: 2565431 - RNA, 21 nt, Chlamydophila pneumoniae J138
ucgaguauggcaaauaaaaca

SEQ ID NO: 2565432 - RNA, 19 nt, Chlamydophila pneumoniae J138
ucgauaacacuucuuucuu

SEQ ID NO: 2565433 - RNA, 20 nt, Chlamydophila pneumoniae J138
ucgauaacacuucuuucuug

SEQ ID NO: 2565434 - RNA, 21 nt, Chlamydophila pneumoniae J138
ucgauaacacuucuuucuugc

SEQ ID NO: 2565435 - RNA, 18 nt, Chlamydophila pneumoniae J138
ucgauaagaacuuuaggg

SEQ ID NO: 2565436 - RNA, 16 nt, Chlamydophila pneumoniae J138
ucgauacgguuuuuau

SEQ ID NO: 2565437 - RNA, 15 nt, Chlamydophila pneumoniae J138
ucgauaucucuaccg

SEQ ID NO: 2565438 - RNA, 22 nt, Chlamydophila pneumoniae J138
ucgauaucucuaccgaacagag

SEQ ID NO: 2565439 - RNA, 22 nt, Chlamydophila pneumoniae J138
ucgaucucugugguuccuggau

SEQ ID NO: 2565440 - RNA, 15 nt, Chlamydophila pneumoniae J138
ucgauuauuucuugu

SEQ ID NO: 2565441 - RNA, 15 nt, Chlamydophila pneumoniae J138
ucgauuggaagcaaa

SEQ ID NO: 2565442 - RNA, 22 nt, Chlamydophila pneumoniae J138
ucgauuguaacuucguuagaaa

SEQ ID NO: 2565443 - RNA, 23 nt, Chlamydophila pneumoniae J138
ucgcaaauuuuucgagaauauac

SEQ ID NO: 2565444 - RNA, 23 nt, Chlamydophila pneumoniae J138
ucgcaacuuaagauacuucucca

SEQ ID NO: 2565445 - RNA, 19 nt, Chlamydophila pneumoniae J138
ucgcacacuccauuucagc

SEQ ID NO: 2565446 - RNA, 14 nt, Chlamydophila pneumoniae J138
ucgcaguaaugcca

SEQ ID NO: 2565447 - RNA, 11 nt, Chlamydophila pneumoniae J138
ucgccaaacca

SEQ ID NO: 2565448 - RNA, 21 nt, Chlamydophila pneumoniae J138
ucgccaaaccaugaggcugcu

SEQ ID NO: 2565449 - RNA, 22 nt, Chlamydophila pneumoniae J138
ucgccaaacgaauuucuuguuc

SEQ ID NO: 2565450 - RNA, 23 nt, Chlamydophila pneumoniae J138
ucgccuuggguuugucuccaaau

SEQ ID NO: 2565451 - RNA, 15 nt, Chlamydophila pneumoniae J138
ucgcgacaagacaau

SEQ ID NO: 2565452 - RNA, 15 nt, Chlamydophila pneumoniae J138
ucgcggaucuucuuc

SEQ ID NO: 2565453 - RNA, 16 nt, Chlamydophila pneumoniae J138
ucgcuacauaaaauga

SEQ ID NO: 2565454 - RNA, 12 nt, Chlamydophila pneumoniae J138
ucgcuaccauau

SEQ ID NO: 2565455 - RNA, 15 nt, Chlamydophila pneumoniae J138
ucgcuagaucacaag

SEQ ID NO: 2565456 - RNA, 13 nt, Chlamydophila pneumoniae J138
ucgcucuccucuc

SEQ ID NO: 2565457 - RNA, 14 nt, Chlamydophila pneumoniae J138
ucgcugauaaaaua

SEQ ID NO: 2565458 - RNA, 18 nt, Chlamydophila pneumoniae J138
ucgcuguaaauucaguga

SEQ ID NO: 2565459 - RNA, 15 nt, Chlamydophila pneumoniae J138
ucgcuuaacaaacuu

SEQ ID NO: 2565460 - RNA, 14 nt, Chlamydophila pneumoniae J138
ucgcuugugcaugc

SEQ ID NO: 2565461 - RNA, 20 nt, Chlamydophila pneumoniae J138
ucgcuugugcaugcaucuua

SEQ ID NO: 2565462 - RNA, 18 nt, Chlamydophila pneumoniae J138
ucggaaaaaauagauccu

SEQ ID NO: 2565463 - RNA, 22 nt, Chlamydophila pneumoniae J138
ucggaaaaaauagauccugaaa

SEQ ID NO: 2565464 - RNA, 21 nt, Chlamydophila pneumoniae J138
ucggaauuugccugaaauccu

SEQ ID NO: 2565465 - RNA, 15 nt, Chlamydophila pneumoniae J138
ucggagauuguuuca

SEQ ID NO: 2565466 - RNA, 15 nt, Chlamydophila pneumoniae J138
ucggaguuaucaaaa

SEQ ID NO: 2565467 - RNA, 18 nt, Chlamydophila pneumoniae J138
ucggaguuuuuuucuuau

SEQ ID NO: 2565468 - RNA, 13 nt, Chlamydophila pneumoniae J138
ucggaucuguaau

SEQ ID NO: 2565469 - RNA, 20 nt, Chlamydophila pneumoniae J138
ucggaucuuuucuuucuaag

SEQ ID NO: 2565470 - RNA, 21 nt, Chlamydophila pneumoniae J138
ucggauuuagauuaaagagac

SEQ ID NO: 2565471 - RNA, 17 nt, Chlamydophila pneumoniae J138
ucggauuucaugauucc

SEQ ID NO: 2565472 - RNA, 14 nt, Chlamydophila pneumoniae J138
ucggcaauuguuaa

SEQ ID NO: 2565473 - RNA, 13 nt, Chlamydophila pneumoniae J138
ucggcuaaagaaa

SEQ ID NO: 2565474 - RNA, 21 nt, Chlamydophila pneumoniae J138
ucgguaaccugugaaaauuuu

SEQ ID NO: 2565475 - RNA, 14 nt, Chlamydophila pneumoniae J138
ucgguagagcuaga

SEQ ID NO: 2565476 - RNA, 22 nt, Chlamydophila pneumoniae J138
ucgguuaagaggugauacauag

SEQ ID NO: 2565477 - RNA, 23 nt, Chlamydophila pneumoniae J138
ucgguuacuuuaaucaagccuaa

SEQ ID NO: 2565478 - RNA, 18 nt, Chlamydophila pneumoniae J138
ucgguuauuuuuccagaa

SEQ ID NO: 2565479 - RNA, 19 nt, Chlamydophila pneumoniae J138
ucgguuauuuuuccagaaa

SEQ ID NO: 2565480 - RNA, 18 nt, Chlamydophila pneumoniae J138
ucgguucggucucuucuc

SEQ ID NO: 2565481 - RNA, 16 nt, Chlamydophila pneumoniae J138
ucguaacgcuuuucua

SEQ ID NO: 2565482 - RNA, 23 nt, Chlamydophila pneumoniae J138
ucguaacgcuuuucuaauaguga

SEQ ID NO: 2565483 - RNA, 21 nt, Chlamydophila pneumoniae J138
ucguaauagcgacaugagaaa

SEQ ID NO: 2565484 - RNA, 17 nt, Chlamydophila pneumoniae J138
ucguaaucuuuuuuaaa

SEQ ID NO: 2565485 - RNA, 19 nt, Chlamydophila pneumoniae J138
ucguaaugcccgauauccu

SEQ ID NO: 2565486 - RNA, 22 nt, Chlamydophila pneumoniae J138
ucguacaaauaauuucccuaaa

SEQ ID NO: 2565487 - RNA, 16 nt, Chlamydophila pneumoniae J138
ucguaccugcugcuuc

SEQ ID NO: 2565488 - RNA, 17 nt, Chlamydophila pneumoniae J138
ucguacguggaaaguag

SEQ ID NO: 2565489 - RNA, 17 nt, Chlamydophila pneumoniae J138
ucguagcaggcaucacu

SEQ ID NO: 2565490 - RNA, 23 nt, Chlamydophila pneumoniae J138
ucguauauaagauaauagagaag

SEQ ID NO: 2565491 - RNA, 15 nt, Chlamydophila pneumoniae J138
ucguaucuuuuugca

SEQ ID NO: 2565492 - RNA, 13 nt, Chlamydophila pneumoniae J138
ucguauuuuccug

SEQ ID NO: 2565493 - RNA, 11 nt, Chlamydophila pneumoniae J138
ucgucaaauuc

SEQ ID NO: 2565494 - RNA, 12 nt, Chlamydophila pneumoniae J138
ucgucaccugag

SEQ ID NO: 2565495 - RNA, 13 nt, Chlamydophila pneumoniae J138
ucgucauucugca

SEQ ID NO: 2565496 - RNA, 14 nt, Chlamydophila pneumoniae J138
ucgucauucugcaa

SEQ ID NO: 2565497 - RNA, 22 nt, Chlamydophila pneumoniae J138
ucguccugacacaacucuuaaa

SEQ ID NO: 2565498 - RNA, 16 nt, Chlamydophila pneumoniae J138
ucgucuaaagaagauu

SEQ ID NO: 2565499 - RNA, 15 nt, Chlamydophila pneumoniae J138
ucgucuccaaaaauu

SEQ ID NO: 2565500 - RNA, 20 nt, Chlamydophila pneumoniae J138
ucgucuuagaauccucuauc

SEQ ID NO: 2565501 - RNA, 14 nt, Chlamydophila pneumoniae J138
ucgucuuggaaugc

SEQ ID NO: 2565502 - RNA, 14 nt, Chlamydophila pneumoniae J138
ucgucuuuuaaaga

SEQ ID NO: 2565503 - RNA, 15 nt, Chlamydophila pneumoniae J138
ucgucuuuuaaagag

SEQ ID NO: 2565504 - RNA, 21 nt, Chlamydophila pneumoniae J138
ucgugacucuuaucuggagau

SEQ ID NO: 2565505 - RNA, 19 nt, Chlamydophila pneumoniae J138
ucgugagcgaguaccucau

SEQ ID NO: 2565506 - RNA, 21 nt, Chlamydophila pneumoniae J138
ucgugcuuagagccuucucau

SEQ ID NO: 2565507 - RNA, 14 nt, Chlamydophila pneumoniae J138
ucguuagagaagag

SEQ ID NO: 2565508 - RNA, 16 nt, Chlamydophila pneumoniae J138
ucguuagagaagaggu

SEQ ID NO: 2565509 - RNA, 19 nt, Chlamydophila pneumoniae J138
ucguuaugaagcuucuuua

SEQ ID NO: 2565510 - RNA, 13 nt, Chlamydophila pneumoniae J138
ucguucaucuguc

SEQ ID NO: 2565511 - RNA, 22 nt, Chlamydophila pneumoniae J138
ucguugccaaucuuucauuccc

SEQ ID NO: 2565512 - RNA, 23 nt, Chlamydophila pneumoniae J138
ucguuucgcuuugauaauagucu

SEQ ID NO: 2565513 - RNA, 17 nt, Chlamydophila pneumoniae J138
ucguuucucuggcaaug

SEQ ID NO: 2565514 - RNA, 19 nt, Chlamydophila pneumoniae J138
ucguuuuuucuuaucugcu

SEQ ID NO: 2565515 - RNA, 14 nt, Chlamydophila pneumoniae J138
ucuaaaaacucuuc

SEQ ID NO: 2565516 - RNA, 20 nt, Chlamydophila pneumoniae J138
ucuaaaaccugacggaucuu

SEQ ID NO: 2565517 - RNA, 20 nt, Chlamydophila pneumoniae J138
ucuaaaagcaaguuguugau

SEQ ID NO: 2565518 - RNA, 21 nt, Chlamydophila pneumoniae J138
ucuaaaauaaccccuccaaaa

SEQ ID NO: 2565519 - RNA, 16 nt, Chlamydophila pneumoniae J138
ucuaaaaugaaauacu

SEQ ID NO: 2565520 - RNA, 19 nt, Chlamydophila pneumoniae J138
ucuaaacauaaagacccuu

SEQ ID NO: 2565521 - RNA, 12 nt, Chlamydophila pneumoniae J138
ucuaaagaaaug

SEQ ID NO: 2565522 - RNA, 13 nt, Chlamydophila pneumoniae J138
ucuaaagaaaugu

SEQ ID NO: 2565523 - RNA, 15 nt, Chlamydophila pneumoniae J138
ucuaaagaaauguaa

SEQ ID NO: 2565524 - RNA, 15 nt, Chlamydophila pneumoniae J138
ucuaaagcagaaucc

SEQ ID NO: 2565525 - RNA, 21 nt, Chlamydophila pneumoniae J138
ucuaaaggaagauauccuuuu

SEQ ID NO: 2565526 - RNA, 17 nt, Chlamydophila pneumoniae J138
ucuaaagguuuuaaauu

SEQ ID NO: 2565527 - RNA, 22 nt, Chlamydophila pneumoniae J138
ucuaaagguuuuaaauuuagag

SEQ ID NO: 2565528 - RNA, 16 nt, Chlamydophila pneumoniae J138
ucuaaauagaaaacau

SEQ ID NO: 2565529 - RNA, 21 nt, Chlamydophila pneumoniae J138
ucuaacgcuuuuucaaacugu

SEQ ID NO: 2565530 - RNA, 14 nt, Chlamydophila pneumoniae J138
ucuaacucuuguag

SEQ ID NO: 2565531 - RNA, 15 nt, Chlamydophila pneumoniae J138
ucuaagaaaaugaau

SEQ ID NO: 2565532 - RNA, 16 nt, Chlamydophila pneumoniae J138
ucuaagacuucuggaa

SEQ ID NO: 2565533 - RNA, 19 nt, Chlamydophila pneumoniae J138
ucuaagagaucuacaaaca

SEQ ID NO: 2565534 - RNA, 21 nt, Chlamydophila pneumoniae J138
ucuaagcugaaagaacacucc

SEQ ID NO: 2565535 - RNA, 20 nt, Chlamydophila pneumoniae J138
ucuaagcugugcauuuucuu

SEQ ID NO: 2565536 - RNA, 23 nt, Chlamydophila pneumoniae J138
ucuaagcugugcauuuucuucuu

SEQ ID NO: 2565537 - RNA, 16 nt, Chlamydophila pneumoniae J138
ucuaagcuuauuucug

SEQ ID NO: 2565538 - RNA, 19 nt, Chlamydophila pneumoniae J138
ucuaagcuuauuucuguag

SEQ ID NO: 2565539 - RNA, 16 nt, Chlamydophila pneumoniae J138
ucuaaggcuuugccuu

SEQ ID NO: 2565540 - RNA, 15 nt, Chlamydophila pneumoniae J138
ucuaauacguuuuua

SEQ ID NO: 2565541 - RNA, 19 nt, Chlamydophila pneumoniae J138
ucuaaugacagcugagaaa

SEQ ID NO: 2565542 - RNA, 16 nt, Chlamydophila pneumoniae J138
ucuaaugguuucccac

SEQ ID NO: 2565543 - RNA, 20 nt, Chlamydophila pneumoniae J138
ucuaauuugaugaucgaucc

SEQ ID NO: 2565544 - RNA, 16 nt, Chlamydophila pneumoniae J138
ucuacaaaaacuagaa

SEQ ID NO: 2565545 - RNA, 19 nt, Chlamydophila pneumoniae J138
ucuacaaacagauuuuuca

SEQ ID NO: 2565546 - RNA, 12 nt, Chlamydophila pneumoniae J138
ucuacaaaugcg

SEQ ID NO: 2565547 - RNA, 23 nt, Chlamydophila pneumoniae J138
ucuacaaugauauaaaagcugaa

SEQ ID NO: 2565548 - RNA, 19 nt, Chlamydophila pneumoniae J138
ucuacaccauagaacugcu

SEQ ID NO: 2565549 - RNA, 20 nt, Chlamydophila pneumoniae J138
ucuacacuguuguaauaaaa

SEQ ID NO: 2565550 - RNA, 17 nt, Chlamydophila pneumoniae J138
ucuacagaggaaucuau

SEQ ID NO: 2565551 - RNA, 20 nt, Chlamydophila pneumoniae J138
ucuacaggauauugcggaaa

SEQ ID NO: 2565552 - RNA, 17 nt, Chlamydophila pneumoniae J138
ucuacaguaguaaauaa

SEQ ID NO: 2565553 - RNA, 17 nt, Chlamydophila pneumoniae J138
ucuacauagauccccuu

SEQ ID NO: 2565554 - RNA, 17 nt, Chlamydophila pneumoniae J138
ucuacaucccaagggcc

SEQ ID NO: 2565555 - RNA, 18 nt, Chlamydophila pneumoniae J138
ucuacaucuucuuggcuu

SEQ ID NO: 2565556 - RNA, 14 nt, Chlamydophila pneumoniae J138
ucuacaugcucaag

SEQ ID NO: 2565557 - RNA, 18 nt, Chlamydophila pneumoniae J138
ucuacaugcucaagaaga

SEQ ID NO: 2565558 - RNA, 18 nt, Chlamydophila pneumoniae J138
ucuaccaauucucucucu

SEQ ID NO: 2565559 - RNA, 20 nt, Chlamydophila pneumoniae J138
ucuaccgaacagagcgucua

SEQ ID NO: 2565560 - RNA, 15 nt, Chlamydophila pneumoniae J138
ucuacgccaucccau

SEQ ID NO: 2565561 - RNA, 17 nt, Chlamydophila pneumoniae J138
ucuacgcggagaaugcu

SEQ ID NO: 2565562 - RNA, 18 nt, Chlamydophila pneumoniae J138
ucuacgcuauucuuaagc

SEQ ID NO: 2565563 - RNA, 17 nt, Chlamydophila pneumoniae J138
ucuacuaaaaucucauu

SEQ ID NO: 2565564 - RNA, 22 nt, Chlamydophila pneumoniae J138
ucuacucuacaguaguaaauaa

SEQ ID NO: 2565565 - RNA, 16 nt, Chlamydophila pneumoniae J138
ucuacucuuuaaaaau

SEQ ID NO: 2565566 - RNA, 23 nt, Chlamydophila pneumoniae J138
ucuacugaaaccuucucucuuaa

SEQ ID NO: 2565567 - RNA, 17 nt, Chlamydophila pneumoniae J138
ucuacuuuugugaagau

SEQ ID NO: 2565568 - RNA, 16 nt, Chlamydophila pneumoniae J138
ucuagaaaaucucuaa

SEQ ID NO: 2565569 - RNA, 23 nt, Chlamydophila pneumoniae J138
ucuagaaaaugaagagcuuccau

SEQ ID NO: 2565570 - RNA, 17 nt, Chlamydophila pneumoniae J138
ucuagaaacaacugaaa

SEQ ID NO: 2565571 - RNA, 17 nt, Chlamydophila pneumoniae J138
ucuagaaagauuuauuu

SEQ ID NO: 2565572 - RNA, 12 nt, Chlamydophila pneumoniae J138
ucuagaagauga

SEQ ID NO: 2565573 - RNA, 14 nt, Chlamydophila pneumoniae J138
ucuagaaguuuaaa

SEQ ID NO: 2565574 - RNA, 17 nt, Chlamydophila pneumoniae J138
ucuagaaugaugcaagc

SEQ ID NO: 2565575 - RNA, 16 nt, Chlamydophila pneumoniae J138
ucuagagauuuuucua

SEQ ID NO: 2565576 - RNA, 17 nt, Chlamydophila pneumoniae J138
ucuagcaaaucuaaaac

SEQ ID NO: 2565577 - RNA, 22 nt, Chlamydophila pneumoniae J138
ucuagcaguugcaauaccaauu

SEQ ID NO: 2565578 - RNA, 23 nt, Chlamydophila pneumoniae J138
ucuagcauaguguuccaaaacag

SEQ ID NO: 2565579 - RNA, 15 nt, Chlamydophila pneumoniae J138
ucuagcuaauaauga

SEQ ID NO: 2565580 - RNA, 13 nt, Chlamydophila pneumoniae J138
ucuagcugcucuu

SEQ ID NO: 2565581 - RNA, 18 nt, Chlamydophila pneumoniae J138
ucuagggacguuguaucc

SEQ ID NO: 2565582 - RNA, 15 nt, Chlamydophila pneumoniae J138
ucuagguuuucucuu

SEQ ID NO: 2565583 - RNA, 19 nt, Chlamydophila pneumoniae J138
ucuagucgugccaaugugc

SEQ ID NO: 2565584 - RNA, 14 nt, Chlamydophila pneumoniae J138
ucuaguucuagaaa

SEQ ID NO: 2565585 - RNA, 13 nt, Chlamydophila pneumoniae J138
ucuauaaauucaa

SEQ ID NO: 2565586 - RNA, 18 nt, Chlamydophila pneumoniae J138
ucuauaauuaauccuuga

SEQ ID NO: 2565587 - RNA, 14 nt, Chlamydophila pneumoniae J138
ucuauagaucuuga

SEQ ID NO: 2565588 - RNA, 13 nt, Chlamydophila pneumoniae J138
ucuauaguucaug

SEQ ID NO: 2565589 - RNA, 18 nt, Chlamydophila pneumoniae J138
ucuauaucauuaagaaga

SEQ ID NO: 2565590 - RNA, 18 nt, Chlamydophila pneumoniae J138
ucuauauccacaaucucu

SEQ ID NO: 2565591 - RNA, 19 nt, Chlamydophila pneumoniae J138
ucuaucagggcuacgguaa

SEQ ID NO: 2565592 - RNA, 14 nt, Chlamydophila pneumoniae J138
ucuauccaucaucg

SEQ ID NO: 2565593 - RNA, 18 nt, Chlamydophila pneumoniae J138
ucuaugagaguaaguuuu

SEQ ID NO: 2565594 - RNA, 19 nt, Chlamydophila pneumoniae J138
ucuaugagaguaaguuuuu

SEQ ID NO: 2565595 - RNA, 17 nt, Chlamydophila pneumoniae J138
ucuaugagauaggaacu

SEQ ID NO: 2565596 - RNA, 22 nt, Chlamydophila pneumoniae J138
ucuaugauaucaccagguccuu

SEQ ID NO: 2565597 - RNA, 19 nt, Chlamydophila pneumoniae J138
ucuaugauccgaaaacucu

SEQ ID NO: 2565598 - RNA, 19 nt, Chlamydophila pneumoniae J138
ucuaugccauaaauacagg

SEQ ID NO: 2565599 - RNA, 22 nt, Chlamydophila pneumoniae J138
ucuauggucucccucacaagaa

SEQ ID NO: 2565600 - RNA, 13 nt, Chlamydophila pneumoniae J138
ucuauuaaaaaua

SEQ ID NO: 2565601 - RNA, 20 nt, Chlamydophila pneumoniae J138
ucuauucucuucauuuucuu

SEQ ID NO: 2565602 - RNA, 14 nt, Chlamydophila pneumoniae J138
ucuauuucugccuu

SEQ ID NO: 2565603 - RNA, 14 nt, Chlamydophila pneumoniae J138
ucuauuuucaggag

SEQ ID NO: 2565604 - RNA, 15 nt, Chlamydophila pneumoniae J138
ucucaacgcaauagg

SEQ ID NO: 2565605 - RNA, 20 nt, Chlamydophila pneumoniae J138
ucucaagaguaggcaauaca

SEQ ID NO: 2565606 - RNA, 14 nt, Chlamydophila pneumoniae J138
ucucaagaucuuca

SEQ ID NO: 2565607 - RNA, 16 nt, Chlamydophila pneumoniae J138
ucucacaagcauccua

SEQ ID NO: 2565608 - RNA, 15 nt, Chlamydophila pneumoniae J138
ucucacucuuuucua

SEQ ID NO: 2565609 - RNA, 11 nt, Chlamydophila pneumoniae J138
ucucacugagu

SEQ ID NO: 2565610 - RNA, 18 nt, Chlamydophila pneumoniae J138
ucucagaaagccuuugcu

SEQ ID NO: 2565611 - RNA, 21 nt, Chlamydophila pneumoniae J138
ucucagaaagccuuugcucac

SEQ ID NO: 2565612 - RNA, 17 nt, Chlamydophila pneumoniae J138
ucucaguaggagcagcg

SEQ ID NO: 2565613 - RNA, 18 nt, Chlamydophila pneumoniae J138
ucucagugaacucuucaa

SEQ ID NO: 2565614 - RNA, 17 nt, Chlamydophila pneumoniae J138
ucucaguuaaagagcau

SEQ ID NO: 2565615 - RNA, 16 nt, Chlamydophila pneumoniae J138
ucucaucagcaaaacu

SEQ ID NO: 2565616 - RNA, 15 nt, Chlamydophila pneumoniae J138
ucucaucggcauaac

SEQ ID NO: 2565617 - RNA, 22 nt, Chlamydophila pneumoniae J138
ucucaugcggacuuuauucucu

SEQ ID NO: 2565618 - RNA, 19 nt, Chlamydophila pneumoniae J138
ucucauuccagcaucuucu

SEQ ID NO: 2565619 - RNA, 16 nt, Chlamydophila pneumoniae J138
ucuccaaaagcucuac

SEQ ID NO: 2565620 - RNA, 18 nt, Chlamydophila pneumoniae J138
ucuccaaaagcucuacaa

SEQ ID NO: 2565621 - RNA, 21 nt, Chlamydophila pneumoniae J138
ucuccaaagagucucuugcuu

SEQ ID NO: 2565622 - RNA, 17 nt, Chlamydophila pneumoniae J138
ucuccaagauaauuaug

SEQ ID NO: 2565623 - RNA, 17 nt, Chlamydophila pneumoniae J138
ucuccacagcuucuucg

SEQ ID NO: 2565624 - RNA, 16 nt, Chlamydophila pneumoniae J138
ucuccagguagcagag

SEQ ID NO: 2565625 - RNA, 17 nt, Chlamydophila pneumoniae J138
ucuccagguagcagagu

SEQ ID NO: 2565626 - RNA, 14 nt, Chlamydophila pneumoniae J138
ucuccauccucagu

SEQ ID NO: 2565627 - RNA, 16 nt, Chlamydophila pneumoniae J138
ucuccauccucagucu

SEQ ID NO: 2565628 - RNA, 18 nt, Chlamydophila pneumoniae J138
ucucccaauauccagaaa

SEQ ID NO: 2565629 - RNA, 18 nt, Chlamydophila pneumoniae J138
ucucccauagcaaugccu

SEQ ID NO: 2565630 - RNA, 21 nt, Chlamydophila pneumoniae J138
ucucccauguaguaaauuccu

SEQ ID NO: 2565631 - RNA, 18 nt, Chlamydophila pneumoniae J138
ucucccgugaacaaaaac

SEQ ID NO: 2565632 - RNA, 18 nt, Chlamydophila pneumoniae J138
ucucccgugagcaugcuc

SEQ ID NO: 2565633 - RNA, 19 nt, Chlamydophila pneumoniae J138
ucucccgugagcaugcuca

SEQ ID NO: 2565634 - RNA, 15 nt, Chlamydophila pneumoniae J138
ucucccucacaagaa

SEQ ID NO: 2565635 - RNA, 19 nt, Chlamydophila pneumoniae J138
ucucccucuaaacauaaag

SEQ ID NO: 2565636 - RNA, 22 nt, Chlamydophila pneumoniae J138
ucucccuggucuguauuuucuu

SEQ ID NO: 2565637 - RNA, 16 nt, Chlamydophila pneumoniae J138
ucucccuguauuaaag

SEQ ID NO: 2565638 - RNA, 15 nt, Chlamydophila pneumoniae J138
ucucccuuaaggaaa

SEQ ID NO: 2565639 - RNA, 15 nt, Chlamydophila pneumoniae J138
ucuccgaagacuacc

SEQ ID NO: 2565640 - RNA, 21 nt, Chlamydophila pneumoniae J138
ucuccgauagagauucuuucu

SEQ ID NO: 2565641 - RNA, 17 nt, Chlamydophila pneumoniae J138
ucuccggaacgcagagu

SEQ ID NO: 2565642 - RNA, 17 nt, Chlamydophila pneumoniae J138
ucuccgucauauuuaaa

SEQ ID NO: 2565643 - RNA, 12 nt, Chlamydophila pneumoniae J138
ucuccguccccc

SEQ ID NO: 2565644 - RNA, 17 nt, Chlamydophila pneumoniae J138
ucuccuaaaccaucacu

SEQ ID NO: 2565645 - RNA, 18 nt, Chlamydophila pneumoniae J138
ucuccuaaaccaucacuu

SEQ ID NO: 2565646 - RNA, 21 nt, Chlamydophila pneumoniae J138
ucuccuaggucuaauccccaa

SEQ ID NO: 2565647 - RNA, 13 nt, Chlamydophila pneumoniae J138
ucuccucaucaga

SEQ ID NO: 2565648 - RNA, 23 nt, Chlamydophila pneumoniae J138
ucuccugcaaaaaguuucaaucu

SEQ ID NO: 2565649 - RNA, 21 nt, Chlamydophila pneumoniae J138
ucuccuggagagcgaaauaga

SEQ ID NO: 2565650 - RNA, 14 nt, Chlamydophila pneumoniae J138
ucuccuuaccaaua

SEQ ID NO: 2565651 - RNA, 13 nt, Chlamydophila pneumoniae J138
ucuccuugacaaa

SEQ ID NO: 2565652 - RNA, 14 nt, Chlamydophila pneumoniae J138
ucuccuuuaaauaa

SEQ ID NO: 2565653 - RNA, 16 nt, Chlamydophila pneumoniae J138
ucucgaaauccuaaaa

SEQ ID NO: 2565654 - RNA, 22 nt, Chlamydophila pneumoniae J138
ucucgaagaaaauaaagaucuu

SEQ ID NO: 2565655 - RNA, 12 nt, Chlamydophila pneumoniae J138
ucucgaagcuug

SEQ ID NO: 2565656 - RNA, 15 nt, Chlamydophila pneumoniae J138
ucucgacacuaugug

SEQ ID NO: 2565657 - RNA, 17 nt, Chlamydophila pneumoniae J138
ucucgacacuauguguu

SEQ ID NO: 2565658 - RNA, 22 nt, Chlamydophila pneumoniae J138
ucucgacacuauguguuuccuu

SEQ ID NO: 2565659 - RNA, 17 nt, Chlamydophila pneumoniae J138
ucucgggagaacaugcc

SEQ ID NO: 2565660 - RNA, 21 nt, Chlamydophila pneumoniae J138
ucucgggagaacaugccccca

SEQ ID NO: 2565661 - RNA, 17 nt, Chlamydophila pneumoniae J138
ucucgguuuaaggcaau

SEQ ID NO: 2565662 - RNA, 17 nt, Chlamydophila pneumoniae J138
ucucguacguggaaagu

SEQ ID NO: 2565663 - RNA, 19 nt, Chlamydophila pneumoniae J138
ucucgucauuaccugcuaa

SEQ ID NO: 2565664 - RNA, 19 nt, Chlamydophila pneumoniae J138
ucucgugaauuacaggccc

SEQ ID NO: 2565665 - RNA, 17 nt, Chlamydophila pneumoniae J138
ucucuaaauggaugauc

SEQ ID NO: 2565666 - RNA, 11 nt, Chlamydophila pneumoniae J138
ucucuaagaaa

SEQ ID NO: 2565667 - RNA, 18 nt, Chlamydophila pneumoniae J138
ucucuaagaaauuuucuc

SEQ ID NO: 2565668 - RNA, 20 nt, Chlamydophila pneumoniae J138
ucucuaagaaucuauagaac

SEQ ID NO: 2565669 - RNA, 16 nt, Chlamydophila pneumoniae J138
ucucuaagcagccucu

SEQ ID NO: 2565670 - RNA, 23 nt, Chlamydophila pneumoniae J138
ucucuaagcagccucuucucuac

SEQ ID NO: 2565671 - RNA, 22 nt, Chlamydophila pneumoniae J138
ucucuaccgaacagagcgucua

SEQ ID NO: 2565672 - RNA, 21 nt, Chlamydophila pneumoniae J138
ucucuagccaauauagaagcu

SEQ ID NO: 2565673 - RNA, 15 nt, Chlamydophila pneumoniae J138
ucucuaggaacucuu

SEQ ID NO: 2565674 - RNA, 16 nt, Chlamydophila pneumoniae J138
ucucuagggaaaggag

SEQ ID NO: 2565675 - RNA, 15 nt, Chlamydophila pneumoniae J138
ucucuaguucuagaa

SEQ ID NO: 2565676 - RNA, 13 nt, Chlamydophila pneumoniae J138
ucucuaguuuuua

SEQ ID NO: 2565677 - RNA, 16 nt, Chlamydophila pneumoniae J138
ucucuaguuuuuacau

SEQ ID NO: 2565678 - RNA, 20 nt, Chlamydophila pneumoniae J138
ucucuaugaacgauuucuuu

SEQ ID NO: 2565679 - RNA, 18 nt, Chlamydophila pneumoniae J138
ucucuaugcacaaaauaa

SEQ ID NO: 2565680 - RNA, 15 nt, Chlamydophila pneumoniae J138
ucucuaugcgcucua

SEQ ID NO: 2565681 - RNA, 18 nt, Chlamydophila pneumoniae J138
ucucuaugcgcucuaaga

SEQ ID NO: 2565682 - RNA, 19 nt, Chlamydophila pneumoniae J138
ucucuaugcgcucuaagag

SEQ ID NO: 2565683 - RNA, 18 nt, Chlamydophila pneumoniae J138
ucucucaagucuauuuga

SEQ ID NO: 2565684 - RNA, 21 nt, Chlamydophila pneumoniae J138
ucucucaagucuauuugaaaa

SEQ ID NO: 2565685 - RNA, 14 nt, Chlamydophila pneumoniae J138
ucucucaauaagau

SEQ ID NO: 2565686 - RNA, 22 nt, Chlamydophila pneumoniae J138
ucucuccguccaguucuucauu

SEQ ID NO: 2565687 - RNA, 19 nt, Chlamydophila pneumoniae J138
ucucucgcauauucuuuug

SEQ ID NO: 2565688 - RNA, 17 nt, Chlamydophila pneumoniae J138
ucucucugccuaccaaa

SEQ ID NO: 2565689 - RNA, 14 nt, Chlamydophila pneumoniae J138
ucucucuuccugcu

SEQ ID NO: 2565690 - RNA, 19 nt, Chlamydophila pneumoniae J138
ucucugaccaucaaugaga

SEQ ID NO: 2565691 - RNA, 19 nt, Chlamydophila pneumoniae J138
ucucugauucucauaaagg

SEQ ID NO: 2565692 - RNA, 18 nt, Chlamydophila pneumoniae J138
ucucugcaacgcaguuua

SEQ ID NO: 2565693 - RNA, 17 nt, Chlamydophila pneumoniae J138
ucucugcauauugcucu

SEQ ID NO: 2565694 - RNA, 19 nt, Chlamydophila pneumoniae J138
ucucugcccccuguuugaa

SEQ ID NO: 2565695 - RNA, 18 nt, Chlamydophila pneumoniae J138
ucucuguauaguuuucaa

SEQ ID NO: 2565696 - RNA, 16 nt, Chlamydophila pneumoniae J138
ucucuguuuuuugaaa

SEQ ID NO: 2565697 - RNA, 21 nt, Chlamydophila pneumoniae J138
ucucuuaacuggcaaucuaaa

SEQ ID NO: 2565698 - RNA, 13 nt, Chlamydophila pneumoniae J138
ucucuuccaaaag

SEQ ID NO: 2565699 - RNA, 19 nt, Chlamydophila pneumoniae J138
ucucuucccuuguuaugaa

SEQ ID NO: 2565700 - RNA, 22 nt, Chlamydophila pneumoniae J138
ucucuucccuuguuaugaaaau

SEQ ID NO: 2565701 - RNA, 14 nt, Chlamydophila pneumoniae J138
ucucuuccuucucc

SEQ ID NO: 2565702 - RNA, 22 nt, Chlamydophila pneumoniae J138
ucucuuccuucuccuguaaagc

SEQ ID NO: 2565703 - RNA, 15 nt, Chlamydophila pneumoniae J138
ucucuucucuguugg

SEQ ID NO: 2565704 - RNA, 22 nt, Chlamydophila pneumoniae J138
ucucuugauuccuuaagucguc

SEQ ID NO: 2565705 - RNA, 12 nt, Chlamydophila pneumoniae J138
ucucuuuaaaaa

SEQ ID NO: 2565706 - RNA, 19 nt, Chlamydophila pneumoniae J138
ucucuuugacaucuaauuu

SEQ ID NO: 2565707 - RNA, 19 nt, Chlamydophila pneumoniae J138
ucucuuugacggauaggau

SEQ ID NO: 2565708 - RNA, 13 nt, Chlamydophila pneumoniae J138
ucugaaacaaugc

SEQ ID NO: 2565709 - RNA, 18 nt, Chlamydophila pneumoniae J138
ucugaacaggaauagaaa

SEQ ID NO: 2565710 - RNA, 20 nt, Chlamydophila pneumoniae J138
ucugaagaccccucuugcuu

SEQ ID NO: 2565711 - RNA, 15 nt, Chlamydophila pneumoniae J138
ucugaagauuuuuua

SEQ ID NO: 2565712 - RNA, 12 nt, Chlamydophila pneumoniae J138
ucugaagcugca

SEQ ID NO: 2565713 - RNA, 22 nt, Chlamydophila pneumoniae J138
ucugaauagcucuuuucaugau

SEQ ID NO: 2565714 - RNA, 19 nt, Chlamydophila pneumoniae J138
ucugaaucucauaaguaua

SEQ ID NO: 2565715 - RNA, 15 nt, Chlamydophila pneumoniae J138
ucugacaaguguguu

SEQ ID NO: 2565716 - RNA, 17 nt, Chlamydophila pneumoniae J138
ucugacaauaacaugcg

SEQ ID NO: 2565717 - RNA, 22 nt, Chlamydophila pneumoniae J138
ucugacaauaacaugcgcagaa

SEQ ID NO: 2565718 - RNA, 21 nt, Chlamydophila pneumoniae J138
ucugagcauaacuugaagaag

SEQ ID NO: 2565719 - RNA, 19 nt, Chlamydophila pneumoniae J138
ucugauaaucagaggagcc

SEQ ID NO: 2565720 - RNA, 17 nt, Chlamydophila pneumoniae J138
ucugaugaccucaucuc

SEQ ID NO: 2565721 - RNA, 18 nt, Chlamydophila pneumoniae J138
ucugaugacguuaauaaa

SEQ ID NO: 2565722 - RNA, 15 nt, Chlamydophila pneumoniae J138
ucugaugcaccauaa

SEQ ID NO: 2565723 - RNA, 20 nt, Chlamydophila pneumoniae J138
ucugauguaggugauauuuu

SEQ ID NO: 2565724 - RNA, 19 nt, Chlamydophila pneumoniae J138
ucugauuaguucucuaaga

SEQ ID NO: 2565725 - RNA, 17 nt, Chlamydophila pneumoniae J138
ucugauuauuucuaaaa

SEQ ID NO: 2565726 - RNA, 18 nt, Chlamydophila pneumoniae J138
ucugauuauuucuaaaaa

SEQ ID NO: 2565727 - RNA, 23 nt, Chlamydophila pneumoniae J138
ucugcaaacgcaaugauuucucu

SEQ ID NO: 2565728 - RNA, 19 nt, Chlamydophila pneumoniae J138
ucugcaauuccgaagaaga

SEQ ID NO: 2565729 - RNA, 21 nt, Chlamydophila pneumoniae J138
ucugcaauuccgaagaagaaa

SEQ ID NO: 2565730 - RNA, 23 nt, Chlamydophila pneumoniae J138
ucugcaauuccgaagaagaaagg

SEQ ID NO: 2565731 - RNA, 22 nt, Chlamydophila pneumoniae J138
ucugcauauaaagacucucuuc

SEQ ID NO: 2565732 - RNA, 19 nt, Chlamydophila pneumoniae J138
ucugccauaggauccagga

SEQ ID NO: 2565733 - RNA, 19 nt, Chlamydophila pneumoniae J138
ucugcccaaagcuaaaaug

SEQ ID NO: 2565734 - RNA, 17 nt, Chlamydophila pneumoniae J138
ucugccuaccaaaguuu

SEQ ID NO: 2565735 - RNA, 17 nt, Chlamydophila pneumoniae J138
ucugccuuaugcucauu

SEQ ID NO: 2565736 - RNA, 20 nt, Chlamydophila pneumoniae J138
ucugcgauugccggcuauga

SEQ ID NO: 2565737 - RNA, 21 nt, Chlamydophila pneumoniae J138
ucugcgcugagguuauuuaau

SEQ ID NO: 2565738 - RNA, 24 nt, Chlamydophila pneumoniae J138
ucugcgugucguugguucaaaucc

SEQ ID NO: 2565739 - RNA, 15 nt, Chlamydophila pneumoniae J138
ucugcguuucuuucu

SEQ ID NO: 2565740 - RNA, 16 nt, Chlamydophila pneumoniae J138
ucugcguuucuuucug

SEQ ID NO: 2565741 - RNA, 17 nt, Chlamydophila pneumoniae J138
ucugcuagagcuuucag

SEQ ID NO: 2565742 - RNA, 12 nt, Chlamydophila pneumoniae J138
ucugcugaaauc

SEQ ID NO: 2565743 - RNA, 16 nt, Chlamydophila pneumoniae J138
ucugcugaggagagua

SEQ ID NO: 2565744 - RNA, 19 nt, Chlamydophila pneumoniae J138
ucugcugcgacacgaauuu

SEQ ID NO: 2565745 - RNA, 22 nt, Chlamydophila pneumoniae J138
ucugcuucuccaaauaaagcaa

SEQ ID NO: 2565746 - RNA, 22 nt, Chlamydophila pneumoniae J138
ucugcuucuguaaagauucuau

SEQ ID NO: 2565747 - RNA, 17 nt, Chlamydophila pneumoniae J138
ucuggauacguuuuucc

SEQ ID NO: 2565748 - RNA, 20 nt, Chlamydophila pneumoniae J138
ucuggauacguuuuucccuu

SEQ ID NO: 2565749 - RNA, 13 nt, Chlamydophila pneumoniae J138
ucuggauguagag

SEQ ID NO: 2565750 - RNA, 14 nt, Chlamydophila pneumoniae J138
ucugggaagacucu

SEQ ID NO: 2565751 - RNA, 23 nt, Chlamydophila pneumoniae J138
ucugggaagacucucaucagcaa

SEQ ID NO: 2565752 - RNA, 19 nt, Chlamydophila pneumoniae J138
ucuggggcuuccagaaaca

SEQ ID NO: 2565753 - RNA, 21 nt, Chlamydophila pneumoniae J138
ucugggugcgucguaaucuuu

SEQ ID NO: 2565754 - RNA, 13 nt, Chlamydophila pneumoniae J138
ucugguagagaac

SEQ ID NO: 2565755 - RNA, 23 nt, Chlamydophila pneumoniae J138
ucugguuuuucgauuuggaagau

SEQ ID NO: 2565756 - RNA, 17 nt, Chlamydophila pneumoniae J138
ucuguacaacaaaauuu

SEQ ID NO: 2565757 - RNA, 14 nt, Chlamydophila pneumoniae J138
ucuguaguaaagcc

SEQ ID NO: 2565758 - RNA, 15 nt, Chlamydophila pneumoniae J138
ucuguaguaaagcca

SEQ ID NO: 2565759 - RNA, 22 nt, Chlamydophila pneumoniae J138
ucuguaguuuguucacuuggua

SEQ ID NO: 2565760 - RNA, 23 nt, Chlamydophila pneumoniae J138
ucuguauccuuccuuauugguaa

SEQ ID NO: 2565761 - RNA, 22 nt, Chlamydophila pneumoniae J138
ucuguaucgauaacgauuucuu

SEQ ID NO: 2565762 - RNA, 22 nt, Chlamydophila pneumoniae J138
ucugucauuaaaaauuuaaaag

SEQ ID NO: 2565763 - RNA, 16 nt, Chlamydophila pneumoniae J138
ucugucuguauuuccg

SEQ ID NO: 2565764 - RNA, 13 nt, Chlamydophila pneumoniae J138
ucugugagaaaua

SEQ ID NO: 2565765 - RNA, 20 nt, Chlamydophila pneumoniae J138
ucugugguuuuuauucuuaa

SEQ ID NO: 2565766 - RNA, 12 nt, Chlamydophila pneumoniae J138
ucuguguagccg

SEQ ID NO: 2565767 - RNA, 20 nt, Chlamydophila pneumoniae J138
ucugugugacgacaaaucac

SEQ ID NO: 2565768 - RNA, 14 nt, Chlamydophila pneumoniae J138
ucuguuaaaaacaa

SEQ ID NO: 2565769 - RNA, 19 nt, Chlamydophila pneumoniae J138
ucuguucugcuucuguaaa

SEQ ID NO: 2565770 - RNA, 12 nt, Chlamydophila pneumoniae J138
ucuguuuucucu

SEQ ID NO: 2565771 - RNA, 13 nt, Chlamydophila pneumoniae J138
ucuguuuuuugaa

SEQ ID NO: 2565772 - RNA, 15 nt, Chlamydophila pneumoniae J138
ucuguuuuuugaaaa

SEQ ID NO: 2565773 - RNA, 12 nt, Chlamydophila pneumoniae J138
ucuuaaaacugc

SEQ ID NO: 2565774 - RNA, 18 nt, Chlamydophila pneumoniae J138
ucuuaacaauauaugcua

SEQ ID NO: 2565775 - RNA, 17 nt, Chlamydophila pneumoniae J138
ucuuaacgcuuagagaa

SEQ ID NO: 2565776 - RNA, 17 nt, Chlamydophila pneumoniae J138
ucuuaagaauaaaauag

SEQ ID NO: 2565777 - RNA, 15 nt, Chlamydophila pneumoniae J138
ucuuaagagcaaaca

SEQ ID NO: 2565778 - RNA, 17 nt, Chlamydophila pneumoniae J138
ucuuaagagcaaacauc

SEQ ID NO: 2565779 - RNA, 24 nt, Chlamydophila pneumoniae J138
ucuuaagcuaccauuaaggaaucc

SEQ ID NO: 2565780 - RNA, 13 nt, Chlamydophila pneumoniae J138
ucuuaauauaaaa

SEQ ID NO: 2565781 - RNA, 18 nt, Chlamydophila pneumoniae J138
ucuuagaagagaaaguag

SEQ ID NO: 2565782 - RNA, 21 nt, Chlamydophila pneumoniae J138
ucuuagccccuccaacaaaca

SEQ ID NO: 2565783 - RNA, 12 nt, Chlamydophila pneumoniae J138
ucuuagccuagg

SEQ ID NO: 2565784 - RNA, 16 nt, Chlamydophila pneumoniae J138
ucuuaguaaagaauca

SEQ ID NO: 2565785 - RNA, 21 nt, Chlamydophila pneumoniae J138
ucuuaguaaagaaucacucuc

SEQ ID NO: 2565786 - RNA, 18 nt, Chlamydophila pneumoniae J138
ucuuauagacagguacau

SEQ ID NO: 2565787 - RNA, 13 nt, Chlamydophila pneumoniae J138
ucuuaucugcuau

SEQ ID NO: 2565788 - RNA, 18 nt, Chlamydophila pneumoniae J138
ucuuaugaaguccagacu

SEQ ID NO: 2565789 - RNA, 14 nt, Chlamydophila pneumoniae J138
ucuuaugaccaaga

SEQ ID NO: 2565790 - RNA, 16 nt, Chlamydophila pneumoniae J138
ucuuaugggagaagcu

SEQ ID NO: 2565791 - RNA, 18 nt, Chlamydophila pneumoniae J138
ucuucaaaaguaaucacu

SEQ ID NO: 2565792 - RNA, 14 nt, Chlamydophila pneumoniae J138
ucuucaaagaacuu

SEQ ID NO: 2565793 - RNA, 22 nt, Chlamydophila pneumoniae J138
ucuucaaagaacuuaaaauuca

SEQ ID NO: 2565794 - RNA, 21 nt, Chlamydophila pneumoniae J138
ucuucaaagcuacuaaucacc

SEQ ID NO: 2565795 - RNA, 23 nt, Chlamydophila pneumoniae J138
ucuucaaagcuacuaaucaccuu

SEQ ID NO: 2565796 - RNA, 13 nt, Chlamydophila pneumoniae J138
ucuucaagaaaug

SEQ ID NO: 2565797 - RNA, 22 nt, Chlamydophila pneumoniae J138
ucuucaagguacugcucaauga

SEQ ID NO: 2565798 - RNA, 19 nt, Chlamydophila pneumoniae J138
ucuucaauagaacgaauuu

SEQ ID NO: 2565799 - RNA, 21 nt, Chlamydophila pneumoniae J138
ucuucaauccccugcaucucu

SEQ ID NO: 2565800 - RNA, 22 nt, Chlamydophila pneumoniae J138
ucuucaaugacuucuggaucuu

SEQ ID NO: 2565801 - RNA, 13 nt, Chlamydophila pneumoniae J138
ucuucaauuucuu

SEQ ID NO: 2565802 - RNA, 19 nt, Chlamydophila pneumoniae J138
ucuucacgacauacaucaa

SEQ ID NO: 2565803 - RNA, 19 nt, Chlamydophila pneumoniae J138
ucuucacuuauaagcugcu

SEQ ID NO: 2565804 - RNA, 17 nt, Chlamydophila pneumoniae J138
ucuucagaaugcccuuu

SEQ ID NO: 2565805 - RNA, 19 nt, Chlamydophila pneumoniae J138
ucuucagaguugucaagua

SEQ ID NO: 2565806 - RNA, 23 nt, Chlamydophila pneumoniae J138
ucuucagucauucuauggucucc

SEQ ID NO: 2565807 - RNA, 22 nt, Chlamydophila pneumoniae J138
ucuucaucaauacgaucuuuug

SEQ ID NO: 2565808 - RNA, 13 nt, Chlamydophila pneumoniae J138
ucuucauccgaag

SEQ ID NO: 2565809 - RNA, 22 nt, Chlamydophila pneumoniae J138
ucuucaugcugcuuugacgacu

SEQ ID NO: 2565810 - RNA, 19 nt, Chlamydophila pneumoniae J138
ucuucauugcaaaaaugaa

SEQ ID NO: 2565811 - RNA, 14 nt, Chlamydophila pneumoniae J138
ucuuccaaagacug

SEQ ID NO: 2565812 - RNA, 16 nt, Chlamydophila pneumoniae J138
ucuuccaaagacugag

SEQ ID NO: 2565813 - RNA, 18 nt, Chlamydophila pneumoniae J138
ucuuccaaagacugagcu

SEQ ID NO: 2565814 - RNA, 12 nt, Chlamydophila pneumoniae J138
ucuuccauacag

SEQ ID NO: 2565815 - RNA, 14 nt, Chlamydophila pneumoniae J138
ucuucccccagacc

SEQ ID NO: 2565816 - RNA, 16 nt, Chlamydophila pneumoniae J138
ucuuccccccucacaa

SEQ ID NO: 2565817 - RNA, 14 nt, Chlamydophila pneumoniae J138
ucuuccgauuaacu

SEQ ID NO: 2565818 - RNA, 14 nt, Chlamydophila pneumoniae J138
ucuuccugcugcuu

SEQ ID NO: 2565819 - RNA, 14 nt, Chlamydophila pneumoniae J138
ucuucgaauuuuug

SEQ ID NO: 2565820 - RNA, 17 nt, Chlamydophila pneumoniae J138
ucuucgauuguaacuuc

SEQ ID NO: 2565821 - RNA, 20 nt, Chlamydophila pneumoniae J138
ucuucgcaaauauaguuuuc

SEQ ID NO: 2565822 - RNA, 22 nt, Chlamydophila pneumoniae J138
ucuucgcaaauauaguuuucau

SEQ ID NO: 2565823 - RNA, 20 nt, Chlamydophila pneumoniae J138
ucuucgcccauuaacuaaga

SEQ ID NO: 2565824 - RNA, 23 nt, Chlamydophila pneumoniae J138
ucuucgcuggcauguuuaauauc

SEQ ID NO: 2565825 - RNA, 16 nt, Chlamydophila pneumoniae J138
ucuucggaucuguaau

SEQ ID NO: 2565826 - RNA, 21 nt, Chlamydophila pneumoniae J138
ucuucguaagcugcaaucuca

SEQ ID NO: 2565827 - RNA, 17 nt, Chlamydophila pneumoniae J138
ucuucguuagagaagag

SEQ ID NO: 2565828 - RNA, 15 nt, Chlamydophila pneumoniae J138
ucuucguuuauaaca

SEQ ID NO: 2565829 - RNA, 16 nt, Chlamydophila pneumoniae J138
ucuucguuuauaacau

SEQ ID NO: 2565830 - RNA, 13 nt, Chlamydophila pneumoniae J138
ucuucuaaaacac

SEQ ID NO: 2565831 - RNA, 16 nt, Chlamydophila pneumoniae J138
ucuucuaaaacuucag

SEQ ID NO: 2565832 - RNA, 16 nt, Chlamydophila pneumoniae J138
ucuucuaaagcagaau

SEQ ID NO: 2565833 - RNA, 15 nt, Chlamydophila pneumoniae J138
ucuucuacagaauag

SEQ ID NO: 2565834 - RNA, 19 nt, Chlamydophila pneumoniae J138
ucuucuacuuuaagaagca

SEQ ID NO: 2565835 - RNA, 21 nt, Chlamydophila pneumoniae J138
ucuucuagagcuucaaguuuc

SEQ ID NO: 2565836 - RNA, 23 nt, Chlamydophila pneumoniae J138
ucuucuagcucauuaucaagaaa

SEQ ID NO: 2565837 - RNA, 14 nt, Chlamydophila pneumoniae J138
ucuucuauuuuuuu

SEQ ID NO: 2565838 - RNA, 21 nt, Chlamydophila pneumoniae J138
ucuucucgaacaggagagaga

SEQ ID NO: 2565839 - RNA, 22 nt, Chlamydophila pneumoniae J138
ucuucucgaacaggagagagaa

SEQ ID NO: 2565840 - RNA, 17 nt, Chlamydophila pneumoniae J138
ucuucucgguuuaaggc

SEQ ID NO: 2565841 - RNA, 14 nt, Chlamydophila pneumoniae J138
ucuucugaaaucaa

SEQ ID NO: 2565842 - RNA, 19 nt, Chlamydophila pneumoniae J138
ucuucugaaaucaaaaaaa

SEQ ID NO: 2565843 - RNA, 20 nt, Chlamydophila pneumoniae J138
ucuucugaauagcucuuuuc

SEQ ID NO: 2565844 - RNA, 21 nt, Chlamydophila pneumoniae J138
ucuucugauacaucaucagaa

SEQ ID NO: 2565845 - RNA, 19 nt, Chlamydophila pneumoniae J138
ucuucugauugaaguucag

SEQ ID NO: 2565846 - RNA, 22 nt, Chlamydophila pneumoniae J138
ucuucuggauacguuuuucccu

SEQ ID NO: 2565847 - RNA, 23 nt, Chlamydophila pneumoniae J138
ucuucuggauacguuuuucccuu

SEQ ID NO: 2565848 - RNA, 15 nt, Chlamydophila pneumoniae J138
ucuucuguuuucucu

SEQ ID NO: 2565849 - RNA, 16 nt, Chlamydophila pneumoniae J138
ucuucuuagaagagaa

SEQ ID NO: 2565850 - RNA, 17 nt, Chlamydophila pneumoniae J138
ucuucuucccuuucaaa

SEQ ID NO: 2565851 - RNA, 22 nt, Chlamydophila pneumoniae J138
ucuucuucgguguagaucuuuu

SEQ ID NO: 2565852 - RNA, 14 nt, Chlamydophila pneumoniae J138
ucuucuugauuaag

SEQ ID NO: 2565853 - RNA, 19 nt, Chlamydophila pneumoniae J138
ucuucuuggcuuucccccu

SEQ ID NO: 2565854 - RNA, 20 nt, Chlamydophila pneumoniae J138
ucuucuuuaagauuuccuua

SEQ ID NO: 2565855 - RNA, 14 nt, Chlamydophila pneumoniae J138
ucuucuuugccaau

SEQ ID NO: 2565856 - RNA, 15 nt, Chlamydophila pneumoniae J138
ucuucuuuggaugcu

SEQ ID NO: 2565857 - RNA, 16 nt, Chlamydophila pneumoniae J138
ucuucuuuggaugcua

SEQ ID NO: 2565858 - RNA, 15 nt, Chlamydophila pneumoniae J138
ucuugaaaaaauucu

SEQ ID NO: 2565859 - RNA, 23 nt, Chlamydophila pneumoniae J138
ucuugaaaguacaggcuccauca

SEQ ID NO: 2565860 - RNA, 13 nt, Chlamydophila pneumoniae J138
ucuugaagagauu

SEQ ID NO: 2565861 - RNA, 14 nt, Chlamydophila pneumoniae J138
ucuugaagaucucc

SEQ ID NO: 2565862 - RNA, 19 nt, Chlamydophila pneumoniae J138
ucuugaaguucuucaagau

SEQ ID NO: 2565863 - RNA, 14 nt, Chlamydophila pneumoniae J138
ucuugacggcagga

SEQ ID NO: 2565864 - RNA, 18 nt, Chlamydophila pneumoniae J138
ucuugacggcaggacucu

SEQ ID NO: 2565865 - RNA, 19 nt, Chlamydophila pneumoniae J138
ucuugacggcaggacucuu

SEQ ID NO: 2565866 - RNA, 22 nt, Chlamydophila pneumoniae J138
ucuugacggcaggacucuuuaa

SEQ ID NO: 2565867 - RNA, 16 nt, Chlamydophila pneumoniae J138
ucuugagcauccaaaa

SEQ ID NO: 2565868 - RNA, 17 nt, Chlamydophila pneumoniae J138
ucuugagcauccaaaau

SEQ ID NO: 2565869 - RNA, 18 nt, Chlamydophila pneumoniae J138
ucuugagccacuuuuaau

SEQ ID NO: 2565870 - RNA, 19 nt, Chlamydophila pneumoniae J138
ucuugagccacuuuuaauu

SEQ ID NO: 2565871 - RNA, 21 nt, Chlamydophila pneumoniae J138
ucuugagcgacgacaaggaca

SEQ ID NO: 2565872 - RNA, 13 nt, Chlamydophila pneumoniae J138
ucuugauaaaaga

SEQ ID NO: 2565873 - RNA, 18 nt, Chlamydophila pneumoniae J138
ucuugauagcuaagagca

SEQ ID NO: 2565874 - RNA, 15 nt, Chlamydophila pneumoniae J138
ucuugauccaucugc

SEQ ID NO: 2565875 - RNA, 20 nt, Chlamydophila pneumoniae J138
ucuugauccaucugcucuuu

SEQ ID NO: 2565876 - RNA, 16 nt, Chlamydophila pneumoniae J138
ucuugaugaccucuau

SEQ ID NO: 2565877 - RNA, 18 nt, Chlamydophila pneumoniae J138
ucuugaugaccucuauac

SEQ ID NO: 2565878 - RNA, 17 nt, Chlamydophila pneumoniae J138
ucuugauguacaguaaa

SEQ ID NO: 2565879 - RNA, 14 nt, Chlamydophila pneumoniae J138
ucuugauuagagaa

SEQ ID NO: 2565880 - RNA, 15 nt, Chlamydophila pneumoniae J138
ucuugauuagagaau

SEQ ID NO: 2565881 - RNA, 15 nt, Chlamydophila pneumoniae J138
ucuugauucucuucc

SEQ ID NO: 2565882 - RNA, 19 nt, Chlamydophila pneumoniae J138
ucuugcucaggagauacaa

SEQ ID NO: 2565883 - RNA, 22 nt, Chlamydophila pneumoniae J138
ucuugcucuagucuuucaaccu

SEQ ID NO: 2565884 - RNA, 15 nt, Chlamydophila pneumoniae J138
ucuugcugauuuuug

SEQ ID NO: 2565885 - RNA, 23 nt, Chlamydophila pneumoniae J138
ucuugcugcccaaauugagaaau

SEQ ID NO: 2565886 - RNA, 16 nt, Chlamydophila pneumoniae J138
ucuugcuuauugucuu

SEQ ID NO: 2565887 - RNA, 19 nt, Chlamydophila pneumoniae J138
ucuugcuuauugucuuaaa

SEQ ID NO: 2565888 - RNA, 14 nt, Chlamydophila pneumoniae J138
ucuugcuuuuccgu

SEQ ID NO: 2565889 - RNA, 14 nt, Chlamydophila pneumoniae J138
ucuugguguauagu

SEQ ID NO: 2565890 - RNA, 16 nt, Chlamydophila pneumoniae J138
ucuugguguauaguau

SEQ ID NO: 2565891 - RNA, 16 nt, Chlamydophila pneumoniae J138
ucuuguaaacgagcuu

SEQ ID NO: 2565892 - RNA, 18 nt, Chlamydophila pneumoniae J138
ucuugugguuuuucuccu

SEQ ID NO: 2565893 - RNA, 15 nt, Chlamydophila pneumoniae J138
ucuuguuaaaguaaa

SEQ ID NO: 2565894 - RNA, 14 nt, Chlamydophila pneumoniae J138
ucuuguucuaaaau

SEQ ID NO: 2565895 - RNA, 15 nt, Chlamydophila pneumoniae J138
ucuuguucuaaaaug

SEQ ID NO: 2565896 - RNA, 14 nt, Chlamydophila pneumoniae J138
ucuuuaaaaauaua

SEQ ID NO: 2565897 - RNA, 16 nt, Chlamydophila pneumoniae J138
ucuuuaaaaucuucug

SEQ ID NO: 2565898 - RNA, 16 nt, Chlamydophila pneumoniae J138
ucuuuaagauuuccuu

SEQ ID NO: 2565899 - RNA, 19 nt, Chlamydophila pneumoniae J138
ucuuuaagguugcuuuucu

SEQ ID NO: 2565900 - RNA, 19 nt, Chlamydophila pneumoniae J138
ucuuuaauugugcucucua

SEQ ID NO: 2565901 - RNA, 13 nt, Chlamydophila pneumoniae J138
ucuuuaccagaaa

SEQ ID NO: 2565902 - RNA, 15 nt, Chlamydophila pneumoniae J138
ucuuuagaauaagag

SEQ ID NO: 2565903 - RNA, 20 nt, Chlamydophila pneumoniae J138
ucuuuagagucugcagcaga

SEQ ID NO: 2565904 - RNA, 18 nt, Chlamydophila pneumoniae J138
ucuuuaggguaaagaaau

SEQ ID NO: 2565905 - RNA, 21 nt, Chlamydophila pneumoniae J138
ucuuuauaaauacaggagaau

SEQ ID NO: 2565906 - RNA, 21 nt, Chlamydophila pneumoniae J138
ucuuuaucuagcucuucaagg

SEQ ID NO: 2565907 - RNA, 14 nt, Chlamydophila pneumoniae J138
ucuuuaugagagag

SEQ ID NO: 2565908 - RNA, 15 nt, Chlamydophila pneumoniae J138
ucuuuauuuuuaaaa

SEQ ID NO: 2565909 - RNA, 12 nt, Chlamydophila pneumoniae J138
ucuuucaaaaga

SEQ ID NO: 2565910 - RNA, 16 nt, Chlamydophila pneumoniae J138
ucuuucaauaacagag

SEQ ID NO: 2565911 - RNA, 23 nt, Chlamydophila pneumoniae J138
ucuuucacauacauucuauucua

SEQ ID NO: 2565912 - RNA, 13 nt, Chlamydophila pneumoniae J138
ucuuucacaucuu

SEQ ID NO: 2565913 - RNA, 19 nt, Chlamydophila pneumoniae J138
ucuuucacaucuuuagaau

SEQ ID NO: 2565914 - RNA, 20 nt, Chlamydophila pneumoniae J138
ucuuucaccaacuccucuaa

SEQ ID NO: 2565915 - RNA, 14 nt, Chlamydophila pneumoniae J138
ucuuucagaaagaa

SEQ ID NO: 2565916 - RNA, 14 nt, Chlamydophila pneumoniae J138
ucuuucauaagauu

SEQ ID NO: 2565917 - RNA, 16 nt, Chlamydophila pneumoniae J138
ucuuucauacuaaaau

SEQ ID NO: 2565918 - RNA, 15 nt, Chlamydophila pneumoniae J138
ucuuucauucccuuu

SEQ ID NO: 2565919 - RNA, 18 nt, Chlamydophila pneumoniae J138
ucuuuccauagccaagga

SEQ ID NO: 2565920 - RNA, 20 nt, Chlamydophila pneumoniae J138
ucuuuccuuagcauuaggaa

SEQ ID NO: 2565921 - RNA, 18 nt, Chlamydophila pneumoniae J138
ucuuucggugucucuaga

SEQ ID NO: 2565922 - RNA, 13 nt, Chlamydophila pneumoniae J138
ucuuucuaaaaca

SEQ ID NO: 2565923 - RNA, 14 nt, Chlamydophila pneumoniae J138
ucuuucuaagaaga

SEQ ID NO: 2565924 - RNA, 11 nt, Chlamydophila pneumoniae J138
ucuuucuagaa

SEQ ID NO: 2565925 - RNA, 19 nt, Chlamydophila pneumoniae J138
ucuuucuagaaugaugcaa

SEQ ID NO: 2565926 - RNA, 11 nt, Chlamydophila pneumoniae J138
ucuuucucuaa

SEQ ID NO: 2565927 - RNA, 12 nt, Chlamydophila pneumoniae J138
ucuuucucuaaa

SEQ ID NO: 2565928 - RNA, 20 nt, Chlamydophila pneumoniae J138
ucuuucugauuuaaaagguu

SEQ ID NO: 2565929 - RNA, 16 nt, Chlamydophila pneumoniae J138
ucuuucugcucuucua

SEQ ID NO: 2565930 - RNA, 14 nt, Chlamydophila pneumoniae J138
ucuuucuuaggaaa

SEQ ID NO: 2565931 - RNA, 21 nt, Chlamydophila pneumoniae J138
ucuuugaacaaaaaggacucu

SEQ ID NO: 2565932 - RNA, 19 nt, Chlamydophila pneumoniae J138
ucuuugaacaacuccuuaa

SEQ ID NO: 2565933 - RNA, 22 nt, Chlamydophila pneumoniae J138
ucuuugaagaacaaaaaaucaa

SEQ ID NO: 2565934 - RNA, 20 nt, Chlamydophila pneumoniae J138
ucuuugagaucuugaaugau

SEQ ID NO: 2565935 - RNA, 18 nt, Chlamydophila pneumoniae J138
ucuuugaggauacgaaua

SEQ ID NO: 2565936 - RNA, 20 nt, Chlamydophila pneumoniae J138
ucuuugaggauacgaauaag

SEQ ID NO: 2565937 - RNA, 22 nt, Chlamydophila pneumoniae J138
ucuuugauuuucaggagaccag

SEQ ID NO: 2565938 - RNA, 19 nt, Chlamydophila pneumoniae J138
ucuuugcgaacgaagacuu

SEQ ID NO: 2565939 - RNA, 19 nt, Chlamydophila pneumoniae J138
ucuuugggauaaaaaguuu

SEQ ID NO: 2565940 - RNA, 16 nt, Chlamydophila pneumoniae J138
ucuuuggguucuucca

SEQ ID NO: 2565941 - RNA, 15 nt, Chlamydophila pneumoniae J138
ucuuuguucgcuccu

SEQ ID NO: 2565942 - RNA, 23 nt, Chlamydophila pneumoniae J138
ucuuuuauauaccacuacugagc

SEQ ID NO: 2565943 - RNA, 17 nt, Chlamydophila pneumoniae J138
ucuuuuauauuaagaau

SEQ ID NO: 2565944 - RNA, 21 nt, Chlamydophila pneumoniae J138
ucuuuuaugauguauaaaguu

SEQ ID NO: 2565945 - RNA, 19 nt, Chlamydophila pneumoniae J138
ucuuuucuaagcaauauuu

SEQ ID NO: 2565946 - RNA, 17 nt, Chlamydophila pneumoniae J138
ucuuuucuacaugcuca

SEQ ID NO: 2565947 - RNA, 17 nt, Chlamydophila pneumoniae J138
ucuuuucugaagauuuu

SEQ ID NO: 2565948 - RNA, 16 nt, Chlamydophila pneumoniae J138
ucuuuucuuuuuagaa

SEQ ID NO: 2565949 - RNA, 16 nt, Chlamydophila pneumoniae J138
ucuuuugauaacuuug

SEQ ID NO: 2565950 - RNA, 22 nt, Chlamydophila pneumoniae J138
ucuuuugcaaaucuucgaauuu

SEQ ID NO: 2565951 - RNA, 23 nt, Chlamydophila pneumoniae J138
ucuuuugguugugucaacccuuu

SEQ ID NO: 2565952 - RNA, 19 nt, Chlamydophila pneumoniae J138
ucuuuuuauugauaaugau

SEQ ID NO: 2565953 - RNA, 13 nt, Chlamydophila pneumoniae J138
ucuuuuucagaaa

SEQ ID NO: 2565954 - RNA, 15 nt, Chlamydophila pneumoniae J138
ucuuuuucagaaagc

SEQ ID NO: 2565955 - RNA, 13 nt, Chlamydophila pneumoniae J138
ucuuuuucuaaga

SEQ ID NO: 2565956 - RNA, 23 nt, Chlamydophila pneumoniae J138
ucuuuuucuauuaaaaauagcuu

SEQ ID NO: 2565957 - RNA, 20 nt, Chlamydophila pneumoniae J138
ugaaaagauuugcgaaucua

SEQ ID NO: 2565958 - RNA, 13 nt, Chlamydophila pneumoniae J138
ugaaaaucuuuaa

SEQ ID NO: 2565959 - RNA, 17 nt, Chlamydophila pneumoniae J138
ugaaaaugauucauaac

SEQ ID NO: 2565960 - RNA, 22 nt, Chlamydophila pneumoniae J138
ugaaaauucgaauucucagaaa

SEQ ID NO: 2565961 - RNA, 15 nt, Chlamydophila pneumoniae J138
ugaaaauugcauuua

SEQ ID NO: 2565962 - RNA, 14 nt, Chlamydophila pneumoniae J138
ugaaaauuuuccca

SEQ ID NO: 2565963 - RNA, 17 nt, Chlamydophila pneumoniae J138
ugaaaccguaacugagg

SEQ ID NO: 2565964 - RNA, 18 nt, Chlamydophila pneumoniae J138
ugaaaccuucucucuuaa

SEQ ID NO: 2565965 - RNA, 18 nt, Chlamydophila pneumoniae J138
ugaaacgcccuucaggac

SEQ ID NO: 2565966 - RNA, 13 nt, Chlamydophila pneumoniae J138
ugaaacuuuagga

SEQ ID NO: 2565967 - RNA, 18 nt, Chlamydophila pneumoniae J138
ugaaacuuuuuuucuucu

SEQ ID NO: 2565968 - RNA, 14 nt, Chlamydophila pneumoniae J138
ugaaagagcuuuga

SEQ ID NO: 2565969 - RNA, 22 nt, Chlamydophila pneumoniae J138
ugaaagauguguuuuaacaacu

SEQ ID NO: 2565970 - RNA, 21 nt, Chlamydophila pneumoniae J138
ugaaagauuauucuagaguug

SEQ ID NO: 2565971 - RNA, 14 nt, Chlamydophila pneumoniae J138
ugaaagcuucuucu

SEQ ID NO: 2565972 - RNA, 20 nt, Chlamydophila pneumoniae J138
ugaaauacuccacuuuuuuc

SEQ ID NO: 2565973 - RNA, 16 nt, Chlamydophila pneumoniae J138
ugaaauaugagaucga

SEQ ID NO: 2565974 - RNA, 12 nt, Chlamydophila pneumoniae J138
ugaaaucaaaaa

SEQ ID NO: 2565975 - RNA, 14 nt, Chlamydophila pneumoniae J138
ugaaaucaaaaaaa

SEQ ID NO: 2565976 - RNA, 16 nt, Chlamydophila pneumoniae J138
ugaaaucguaucuuuu

SEQ ID NO: 2565977 - RNA, 23 nt, Chlamydophila pneumoniae J138
ugaaauugaauggucucgaaauc

SEQ ID NO: 2565978 - RNA, 14 nt, Chlamydophila pneumoniae J138
ugaaauuucugaaa

SEQ ID NO: 2565979 - RNA, 17 nt, Chlamydophila pneumoniae J138
ugaaauuucugaaacaa

SEQ ID NO: 2565980 - RNA, 21 nt, Chlamydophila pneumoniae J138
ugaaauuucugaaacaaugca

SEQ ID NO: 2565981 - RNA, 12 nt, Chlamydophila pneumoniae J138
ugaaauuuucua

SEQ ID NO: 2565982 - RNA, 14 nt, Chlamydophila pneumoniae J138
ugaacaaaaacugc

SEQ ID NO: 2565983 - RNA, 19 nt, Chlamydophila pneumoniae J138
ugaacaaaaaggacucuuu

SEQ ID NO: 2565984 - RNA, 14 nt, Chlamydophila pneumoniae J138
ugaacacucucuac

SEQ ID NO: 2565985 - RNA, 13 nt, Chlamydophila pneumoniae J138
ugaacauaauucg

SEQ ID NO: 2565986 - RNA, 13 nt, Chlamydophila pneumoniae J138
ugaacaucuccag

SEQ ID NO: 2565987 - RNA, 13 nt, Chlamydophila pneumoniae J138
ugaacggcucuuu

SEQ ID NO: 2565988 - RNA, 21 nt, Chlamydophila pneumoniae J138
ugaacguagcuacaaaauuau

SEQ ID NO: 2565989 - RNA, 22 nt, Chlamydophila pneumoniae J138
ugaacuccaggguguuugcaua

SEQ ID NO: 2565990 - RNA, 18 nt, Chlamydophila pneumoniae J138
ugaacuuuuguacacaga

SEQ ID NO: 2565991 - RNA, 18 nt, Chlamydophila pneumoniae J138
ugaagaaguacaagugaa

SEQ ID NO: 2565992 - RNA, 19 nt, Chlamydophila pneumoniae J138
ugaagaaguacaagugaag

SEQ ID NO: 2565993 - RNA, 19 nt, Chlamydophila pneumoniae J138
ugaagacguucgacaacaa

SEQ ID NO: 2565994 - RNA, 15 nt, Chlamydophila pneumoniae J138
ugaagagcauuuaaa

SEQ ID NO: 2565995 - RNA, 17 nt, Chlamydophila pneumoniae J138
ugaagagucaaacuuau

SEQ ID NO: 2565996 - RNA, 23 nt, Chlamydophila pneumoniae J138
ugaagagucaaacuuauacacuc

SEQ ID NO: 2565997 - RNA, 18 nt, Chlamydophila pneumoniae J138
ugaagagugguuccugaa

SEQ ID NO: 2565998 - RNA, 18 nt, Chlamydophila pneumoniae J138
ugaagauggcaaggaaaa

SEQ ID NO: 2565999 - RNA, 15 nt, Chlamydophila pneumoniae J138
ugaagauuuuuucuu

SEQ ID NO: 2566000 - RNA, 14 nt, Chlamydophila pneumoniae J138
ugaagcagaaacuu

SEQ ID NO: 2566001 - RNA, 17 nt, Chlamydophila pneumoniae J138
ugaagcagcuucugcag

SEQ ID NO: 2566002 - RNA, 19 nt, Chlamydophila pneumoniae J138
ugaagcagggaaaaugcga

SEQ ID NO: 2566003 - RNA, 15 nt, Chlamydophila pneumoniae J138
ugaagccauuuucua

SEQ ID NO: 2566004 - RNA, 23 nt, Chlamydophila pneumoniae J138
ugaaggggugacccagagaaugu

SEQ ID NO: 2566005 - RNA, 21 nt, Chlamydophila pneumoniae J138
ugaaguacauuaucacagcaa

SEQ ID NO: 2566006 - RNA, 16 nt, Chlamydophila pneumoniae J138
ugaagucguuuagauu

SEQ ID NO: 2566007 - RNA, 14 nt, Chlamydophila pneumoniae J138
ugaagucuucuugc

SEQ ID NO: 2566008 - RNA, 15 nt, Chlamydophila pneumoniae J138
ugaagucuucuugcu

SEQ ID NO: 2566009 - RNA, 19 nt, Chlamydophila pneumoniae J138
ugaaguugagucgauuucc

SEQ ID NO: 2566010 - RNA, 22 nt, Chlamydophila pneumoniae J138
ugaaguugagucgauuucccag

SEQ ID NO: 2566011 - RNA, 22 nt, Chlamydophila pneumoniae J138
ugaaguuuuuucucucuuuauc

SEQ ID NO: 2566012 - RNA, 12 nt, Chlamydophila pneumoniae J138
ugaauaagcuuu

SEQ ID NO: 2566013 - RNA, 20 nt, Chlamydophila pneumoniae J138
ugaauaagcuuuccucucca

SEQ ID NO: 2566014 - RNA, 14 nt, Chlamydophila pneumoniae J138
ugaauaccaaaauu

SEQ ID NO: 2566015 - RNA, 21 nt, Chlamydophila pneumoniae J138
ugaauaccguuucaggaaacu

SEQ ID NO: 2566016 - RNA, 17 nt, Chlamydophila pneumoniae J138
ugaauaguagaguugac

SEQ ID NO: 2566017 - RNA, 19 nt, Chlamydophila pneumoniae J138
ugaauaguagaguugacaa

SEQ ID NO: 2566018 - RNA, 23 nt, Chlamydophila pneumoniae J138
ugaauaguugugagacuuucuga

SEQ ID NO: 2566019 - RNA, 13 nt, Chlamydophila pneumoniae J138
ugaauauaauucc

SEQ ID NO: 2566020 - RNA, 20 nt, Chlamydophila pneumoniae J138
ugaauaugauuuccacuugu

SEQ ID NO: 2566021 - RNA, 17 nt, Chlamydophila pneumoniae J138
ugaauaugcuuuucaaa

SEQ ID NO: 2566022 - RNA, 15 nt, Chlamydophila pneumoniae J138
ugaaucacaucuaaa

SEQ ID NO: 2566023 - RNA, 13 nt, Chlamydophila pneumoniae J138
ugaaucagcuuau

SEQ ID NO: 2566024 - RNA, 23 nt, Chlamydophila pneumoniae J138
ugaauccaugggaucucaucaua

SEQ ID NO: 2566025 - RNA, 13 nt, Chlamydophila pneumoniae J138
ugaauccuucuau

SEQ ID NO: 2566026 - RNA, 13 nt, Chlamydophila pneumoniae J138
ugaaucucuucug

SEQ ID NO: 2566027 - RNA, 15 nt, Chlamydophila pneumoniae J138
ugaaucucuucugua

SEQ ID NO: 2566028 - RNA, 21 nt, Chlamydophila pneumoniae J138
ugaaucucuucuguaggaaca

SEQ ID NO: 2566029 - RNA, 19 nt, Chlamydophila pneumoniae J138
ugaaugagcuucacaucuu

SEQ ID NO: 2566030 - RNA, 22 nt, Chlamydophila pneumoniae J138
ugaaugaggguggaacuauccu

SEQ ID NO: 2566031 - RNA, 10 nt, Chlamydophila pneumoniae J138
ugaaugaucc

SEQ ID NO: 2566032 - RNA, 15 nt, Chlamydophila pneumoniae J138
ugaaugauuuccaua

SEQ ID NO: 2566033 - RNA, 19 nt, Chlamydophila pneumoniae J138
ugaauuaauaaaagagcuc

SEQ ID NO: 2566034 - RNA, 12 nt, Chlamydophila pneumoniae J138
ugaauuaguuuc

SEQ ID NO: 2566035 - RNA, 14 nt, Chlamydophila pneumoniae J138
ugaauuuaugggug

SEQ ID NO: 2566036 - RNA, 19 nt, Chlamydophila pneumoniae J138
ugaauuuuagcuccgaggc

SEQ ID NO: 2566037 - RNA, 16 nt, Chlamydophila pneumoniae J138
ugacaaauaaacugac

SEQ ID NO: 2566038 - RNA, 16 nt, Chlamydophila pneumoniae J138
ugacaaauaaguccug

SEQ ID NO: 2566039 - RNA, 13 nt, Chlamydophila pneumoniae J138
ugacaaauagaaa

SEQ ID NO: 2566040 - RNA, 13 nt, Chlamydophila pneumoniae J138
ugacaaauuuauc

SEQ ID NO: 2566041 - RNA, 15 nt, Chlamydophila pneumoniae J138
ugacaacagagacaa

SEQ ID NO: 2566042 - RNA, 16 nt, Chlamydophila pneumoniae J138
ugacaauaacaugcgc

SEQ ID NO: 2566043 - RNA, 14 nt, Chlamydophila pneumoniae J138
ugacaauaagaaaa

SEQ ID NO: 2566044 - RNA, 18 nt, Chlamydophila pneumoniae J138
ugacaaucgcuguaaauu

SEQ ID NO: 2566045 - RNA, 11 nt, Chlamydophila pneumoniae J138
ugacacagaga

SEQ ID NO: 2566046 - RNA, 15 nt, Chlamydophila pneumoniae J138
ugacacggcguagag

SEQ ID NO: 2566047 - RNA, 16 nt, Chlamydophila pneumoniae J138
ugacacucagcuccca

SEQ ID NO: 2566048 - RNA, 23 nt, Chlamydophila pneumoniae J138
ugacacucuaucauaucuucaaa

SEQ ID NO: 2566049 - RNA, 23 nt, Chlamydophila pneumoniae J138
ugacagaccuugcauuagauuca

SEQ ID NO: 2566050 - RNA, 15 nt, Chlamydophila pneumoniae J138
ugacagcugagaaau

SEQ ID NO: 2566051 - RNA, 22 nt, Chlamydophila pneumoniae J138
ugacagggaaagaacagcagaa

SEQ ID NO: 2566052 - RNA, 13 nt, Chlamydophila pneumoniae J138
ugacaucuccaag

SEQ ID NO: 2566053 - RNA, 21 nt, Chlamydophila pneumoniae J138
ugacaucuccaagauaauuau

SEQ ID NO: 2566054 - RNA, 23 nt, Chlamydophila pneumoniae J138
ugaccaaacuuggucauuauagu

SEQ ID NO: 2566055 - RNA, 20 nt, Chlamydophila pneumoniae J138
ugaccaucaaugagaucugc

SEQ ID NO: 2566056 - RNA, 21 nt, Chlamydophila pneumoniae J138
ugaccaucaaugagaucugca

SEQ ID NO: 2566057 - RNA, 18 nt, Chlamydophila pneumoniae J138
ugaccugcuuuuuuucua

SEQ ID NO: 2566058 - RNA, 13 nt, Chlamydophila pneumoniae J138
ugaccuucucaag

SEQ ID NO: 2566059 - RNA, 14 nt, Chlamydophila pneumoniae J138
ugaccuuuuucauu

SEQ ID NO: 2566060 - RNA, 21 nt, Chlamydophila pneumoniae J138
ugacgcaagagacaagaaaau

SEQ ID NO: 2566061 - RNA, 22 nt, Chlamydophila pneumoniae J138
ugacgcaagagacaagaaaaua

SEQ ID NO: 2566062 - RNA, 15 nt, Chlamydophila pneumoniae J138
ugacgcacuucuuca

SEQ ID NO: 2566063 - RNA, 21 nt, Chlamydophila pneumoniae J138
ugacgcacuucuucaagaaau

SEQ ID NO: 2566064 - RNA, 17 nt, Chlamydophila pneumoniae J138
ugacgcuuuuccaaagc

SEQ ID NO: 2566065 - RNA, 14 nt, Chlamydophila pneumoniae J138
ugacguaaugcaga

SEQ ID NO: 2566066 - RNA, 18 nt, Chlamydophila pneumoniae J138
ugacgucuccaacagucu

SEQ ID NO: 2566067 - RNA, 21 nt, Chlamydophila pneumoniae J138
ugacgugcauugaauccuucu

SEQ ID NO: 2566068 - RNA, 22 nt, Chlamydophila pneumoniae J138
ugacguuaauaaagaggcuccc

SEQ ID NO: 2566069 - RNA, 22 nt, Chlamydophila pneumoniae J138
ugacuaauaccuuucuaagaau

SEQ ID NO: 2566070 - RNA, 23 nt, Chlamydophila pneumoniae J138
ugacuaugguaagcauuucuguu

SEQ ID NO: 2566071 - RNA, 19 nt, Chlamydophila pneumoniae J138
ugacucuuuuaagacaaua

SEQ ID NO: 2566072 - RNA, 11 nt, Chlamydophila pneumoniae J138
ugacugaaacu

SEQ ID NO: 2566073 - RNA, 12 nt, Chlamydophila pneumoniae J138
ugacugaaacuc

SEQ ID NO: 2566074 - RNA, 13 nt, Chlamydophila pneumoniae J138
ugacugcagagaa

SEQ ID NO: 2566075 - RNA, 23 nt, Chlamydophila pneumoniae J138
ugacugcagagaaauucaugccu

SEQ ID NO: 2566076 - RNA, 13 nt, Chlamydophila pneumoniae J138
ugacuucccgaag

SEQ ID NO: 2566077 - RNA, 15 nt, Chlamydophila pneumoniae J138
ugacuuccuccaaaa

SEQ ID NO: 2566078 - RNA, 15 nt, Chlamydophila pneumoniae J138
ugacuuuucuucuuc

SEQ ID NO: 2566079 - RNA, 13 nt, Chlamydophila pneumoniae J138
ugagaaaaagaau

SEQ ID NO: 2566080 - RNA, 16 nt, Chlamydophila pneumoniae J138
ugagaaaagguaacau

SEQ ID NO: 2566081 - RNA, 15 nt, Chlamydophila pneumoniae J138
ugagaaaaguugccu

SEQ ID NO: 2566082 - RNA, 15 nt, Chlamydophila pneumoniae J138
ugagaaagaaguccu

SEQ ID NO: 2566083 - RNA, 13 nt, Chlamydophila pneumoniae J138
ugagaaauauaaa

SEQ ID NO: 2566084 - RNA, 18 nt, Chlamydophila pneumoniae J138
ugagaaccuucacaagaa

SEQ ID NO: 2566085 - RNA, 20 nt, Chlamydophila pneumoniae J138
ugagaauauggccuagcuuu

SEQ ID NO: 2566086 - RNA, 14 nt, Chlamydophila pneumoniae J138
ugagaauuuucaug

SEQ ID NO: 2566087 - RNA, 18 nt, Chlamydophila pneumoniae J138
ugagagauagguuuuugu

SEQ ID NO: 2566088 - RNA, 19 nt, Chlamydophila pneumoniae J138
ugagagauuuuuucauacu

SEQ ID NO: 2566089 - RNA, 23 nt, Chlamydophila pneumoniae J138
ugagaucaucucccaaauagcua

SEQ ID NO: 2566090 - RNA, 22 nt, Chlamydophila pneumoniae J138
ugagauccaaagccugaaaaau

SEQ ID NO: 2566091 - RNA, 15 nt, Chlamydophila pneumoniae J138
ugagauggucgagaa

SEQ ID NO: 2566092 - RNA, 22 nt, Chlamydophila pneumoniae J138
ugagauggucgagaaccuccac

SEQ ID NO: 2566093 - RNA, 16 nt, Chlamydophila pneumoniae J138
ugagcaacaagcugcu

SEQ ID NO: 2566094 - RNA, 22 nt, Chlamydophila pneumoniae J138
ugagcaacaagcugcugagcag

SEQ ID NO: 2566095 - RNA, 15 nt, Chlamydophila pneumoniae J138
ugagcagcaaaaauu

SEQ ID NO: 2566096 - RNA, 20 nt, Chlamydophila pneumoniae J138
ugagcagcaaaaauuguuuu

SEQ ID NO: 2566097 - RNA, 17 nt, Chlamydophila pneumoniae J138
ugagcagcuuuaucagg

SEQ ID NO: 2566098 - RNA, 20 nt, Chlamydophila pneumoniae J138
ugagcauccaaaaugucuuu

SEQ ID NO: 2566099 - RNA, 12 nt, Chlamydophila pneumoniae J138
ugagcuacaaga

SEQ ID NO: 2566100 - RNA, 17 nt, Chlamydophila pneumoniae J138
ugagcuccaaaauaauc

SEQ ID NO: 2566101 - RNA, 13 nt, Chlamydophila pneumoniae J138
ugagcucucuagc

SEQ ID NO: 2566102 - RNA, 19 nt, Chlamydophila pneumoniae J138
ugagcuucacaucuuucuc

SEQ ID NO: 2566103 - RNA, 20 nt, Chlamydophila pneumoniae J138
ugagcuucacaucuuucucu

SEQ ID NO: 2566104 - RNA, 16 nt, Chlamydophila pneumoniae J138
ugagcuugccuaccca

SEQ ID NO: 2566105 - RNA, 14 nt, Chlamydophila pneumoniae J138
ugaggaaaauuccc

SEQ ID NO: 2566106 - RNA, 13 nt, Chlamydophila pneumoniae J138
ugaggaaaggagg

SEQ ID NO: 2566107 - RNA, 15 nt, Chlamydophila pneumoniae J138
ugaggaaaggagggc

SEQ ID NO: 2566108 - RNA, 22 nt, Chlamydophila pneumoniae J138
ugaggaacgcacgccaagagag

SEQ ID NO: 2566109 - RNA, 18 nt, Chlamydophila pneumoniae J138
ugaggaaucauaaccaaa

SEQ ID NO: 2566110 - RNA, 20 nt, Chlamydophila pneumoniae J138
ugaggacacaacucuuuaau

SEQ ID NO: 2566111 - RNA, 16 nt, Chlamydophila pneumoniae J138
ugaggaccuuccuuau

SEQ ID NO: 2566112 - RNA, 19 nt, Chlamydophila pneumoniae J138
ugaggacgcagagaugcua

SEQ ID NO: 2566113 - RNA, 19 nt, Chlamydophila pneumoniae J138
ugaggauaaguucuuccaa

SEQ ID NO: 2566114 - RNA, 18 nt, Chlamydophila pneumoniae J138
ugaggauacgaauaaguu

SEQ ID NO: 2566115 - RNA, 14 nt, Chlamydophila pneumoniae J138
ugaggcaagucuca

SEQ ID NO: 2566116 - RNA, 14 nt, Chlamydophila pneumoniae J138
ugaggcuauagaau

SEQ ID NO: 2566117 - RNA, 21 nt, Chlamydophila pneumoniae J138
ugagucgcgaccgaaaguccc

SEQ ID NO: 2566118 - RNA, 17 nt, Chlamydophila pneumoniae J138
ugagugucccauggcug

SEQ ID NO: 2566119 - RNA, 20 nt, Chlamydophila pneumoniae J138
ugaguuagcuuuugugauac

SEQ ID NO: 2566120 - RNA, 14 nt, Chlamydophila pneumoniae J138
ugaguucuuccuuc

SEQ ID NO: 2566121 - RNA, 23 nt, Chlamydophila pneumoniae J138
ugaguucuuccuucuucuucaaa

SEQ ID NO: 2566122 - RNA, 21 nt, Chlamydophila pneumoniae J138
ugaguucuuuuguuugucuuc

SEQ ID NO: 2566123 - RNA, 14 nt, Chlamydophila pneumoniae J138
ugauaaaagauagu

SEQ ID NO: 2566124 - RNA, 12 nt, Chlamydophila pneumoniae J138
ugauaaagccug

SEQ ID NO: 2566125 - RNA, 13 nt, Chlamydophila pneumoniae J138
ugauaaggaagaa

SEQ ID NO: 2566126 - RNA, 18 nt, Chlamydophila pneumoniae J138
ugauaaugcaggggcuuu

SEQ ID NO: 2566127 - RNA, 18 nt, Chlamydophila pneumoniae J138
ugauaauuacagaaguuc

SEQ ID NO: 2566128 - RNA, 16 nt, Chlamydophila pneumoniae J138
ugauaauuucauuaua

SEQ ID NO: 2566129 - RNA, 17 nt, Chlamydophila pneumoniae J138
ugauaccaccuaaaaug

SEQ ID NO: 2566130 - RNA, 17 nt, Chlamydophila pneumoniae J138
ugauacgugcagugaau

SEQ ID NO: 2566131 - RNA, 15 nt, Chlamydophila pneumoniae J138
ugauacuguuuuuua

SEQ ID NO: 2566132 - RNA, 22 nt, Chlamydophila pneumoniae J138
ugauagaggaaguguuucuuug

SEQ ID NO: 2566133 - RNA, 19 nt, Chlamydophila pneumoniae J138
ugauaucaccagguccuuc

SEQ ID NO: 2566134 - RNA, 13 nt, Chlamydophila pneumoniae J138
ugauauccaccuu

SEQ ID NO: 2566135 - RNA, 17 nt, Chlamydophila pneumoniae J138
ugauauuugucuaguga

SEQ ID NO: 2566136 - RNA, 12 nt, Chlamydophila pneumoniae J138
ugauauuuucuu

SEQ ID NO: 2566137 - RNA, 19 nt, Chlamydophila pneumoniae J138
ugauauuuuuauuuaaaau

SEQ ID NO: 2566138 - RNA, 21 nt, Chlamydophila pneumoniae J138
ugaucaaaaaugauaccaccu

SEQ ID NO: 2566139 - RNA, 17 nt, Chlamydophila pneumoniae J138
ugaucaaaauuauccag

SEQ ID NO: 2566140 - RNA, 20 nt, Chlamydophila pneumoniae J138
ugaucaagaggagugaaagc

SEQ ID NO: 2566141 - RNA, 20 nt, Chlamydophila pneumoniae J138
ugaucacguggacagcggcc

SEQ ID NO: 2566142 - RNA, 22 nt, Chlamydophila pneumoniae J138
ugaucagaaaugaagccaaaag

SEQ ID NO: 2566143 - RNA, 12 nt, Chlamydophila pneumoniae J138
ugaucagaaucu

SEQ ID NO: 2566144 - RNA, 13 nt, Chlamydophila pneumoniae J138
ugaucagaaucua

SEQ ID NO: 2566145 - RNA, 13 nt, Chlamydophila pneumoniae J138
ugaucaggagucu

SEQ ID NO: 2566146 - RNA, 22 nt, Chlamydophila pneumoniae J138
ugauccaauagccaaagacucu

SEQ ID NO: 2566147 - RNA, 17 nt, Chlamydophila pneumoniae J138
ugauccagcccccaggc

SEQ ID NO: 2566148 - RNA, 21 nt, Chlamydophila pneumoniae J138
ugauccagcccccaggcugca

SEQ ID NO: 2566149 - RNA, 19 nt, Chlamydophila pneumoniae J138
ugauccgaaaacucuuaga

SEQ ID NO: 2566150 - RNA, 20 nt, Chlamydophila pneumoniae J138
ugauccgaaaacucuuagag

SEQ ID NO: 2566151 - RNA, 14 nt, Chlamydophila pneumoniae J138
ugauccuucuuaug

SEQ ID NO: 2566152 - RNA, 21 nt, Chlamydophila pneumoniae J138
ugaucuacaaaaacuagaaua

SEQ ID NO: 2566153 - RNA, 23 nt, Chlamydophila pneumoniae J138
ugaucugaaauagcaaagacauc

SEQ ID NO: 2566154 - RNA, 21 nt, Chlamydophila pneumoniae J138
ugaucugaaguugaaaugagu

SEQ ID NO: 2566155 - RNA, 18 nt, Chlamydophila pneumoniae J138
ugaucuugcucaggagau

SEQ ID NO: 2566156 - RNA, 22 nt, Chlamydophila pneumoniae J138
ugaucuuuccucucaugaaauu

SEQ ID NO: 2566157 - RNA, 14 nt, Chlamydophila pneumoniae J138
ugaugacauugcaa

SEQ ID NO: 2566158 - RNA, 12 nt, Chlamydophila pneumoniae J138
ugaugagaaaaa

SEQ ID NO: 2566159 - RNA, 15 nt, Chlamydophila pneumoniae J138
ugaugcuucuuucaa

SEQ ID NO: 2566160 - RNA, 19 nt, Chlamydophila pneumoniae J138
ugaugcuucuuucaaagcc

SEQ ID NO: 2566161 - RNA, 15 nt, Chlamydophila pneumoniae J138
ugauggggauuaucc

SEQ ID NO: 2566162 - RNA, 15 nt, Chlamydophila pneumoniae J138
ugauguguugauuuc

SEQ ID NO: 2566163 - RNA, 15 nt, Chlamydophila pneumoniae J138
ugauuagagaauccg

SEQ ID NO: 2566164 - RNA, 18 nt, Chlamydophila pneumoniae J138
ugauuagagccccaaccc

SEQ ID NO: 2566165 - RNA, 19 nt, Chlamydophila pneumoniae J138
ugauuaggcuucagagauu

SEQ ID NO: 2566166 - RNA, 17 nt, Chlamydophila pneumoniae J138
ugauuaguucucuaaga

SEQ ID NO: 2566167 - RNA, 17 nt, Chlamydophila pneumoniae J138
ugauucauaaagaggaa

SEQ ID NO: 2566168 - RNA, 14 nt, Chlamydophila pneumoniae J138
ugauuccuuaaguc

SEQ ID NO: 2566169 - RNA, 22 nt, Chlamydophila pneumoniae J138
ugauucucccaauauccagaaa

SEQ ID NO: 2566170 - RNA, 15 nt, Chlamydophila pneumoniae J138
ugauucuccgucccc

SEQ ID NO: 2566171 - RNA, 13 nt, Chlamydophila pneumoniae J138
ugauucuguauaa

SEQ ID NO: 2566172 - RNA, 17 nt, Chlamydophila pneumoniae J138
ugauugaacagucuugc

SEQ ID NO: 2566173 - RNA, 15 nt, Chlamydophila pneumoniae J138
ugauugcugucagaa

SEQ ID NO: 2566174 - RNA, 19 nt, Chlamydophila pneumoniae J138
ugauuuccugacuauaaaa

SEQ ID NO: 2566175 - RNA, 19 nt, Chlamydophila pneumoniae J138
ugauuucgacgcauaguau

SEQ ID NO: 2566176 - RNA, 17 nt, Chlamydophila pneumoniae J138
ugauuucgugaacaaaa

SEQ ID NO: 2566177 - RNA, 15 nt, Chlamydophila pneumoniae J138
ugauuucuuuauucc

SEQ ID NO: 2566178 - RNA, 23 nt, Chlamydophila pneumoniae J138
ugauuuggccaacaguguagccu

SEQ ID NO: 2566179 - RNA, 13 nt, Chlamydophila pneumoniae J138
ugauuugggauga

SEQ ID NO: 2566180 - RNA, 14 nt, Chlamydophila pneumoniae J138
ugauuuuaaaauga

SEQ ID NO: 2566181 - RNA, 13 nt, Chlamydophila pneumoniae J138
ugauuuuucaaau

SEQ ID NO: 2566182 - RNA, 18 nt, Chlamydophila pneumoniae J138
ugauuuuugcuaagagcu

SEQ ID NO: 2566183 - RNA, 19 nt, Chlamydophila pneumoniae J138
ugauuuuugcuaagagcuc

SEQ ID NO: 2566184 - RNA, 21 nt, Chlamydophila pneumoniae J138
ugauuuuugcuaagagcucuu

SEQ ID NO: 2566185 - RNA, 13 nt, Chlamydophila pneumoniae J138
ugcaaaaaaccag

SEQ ID NO: 2566186 - RNA, 23 nt, Chlamydophila pneumoniae J138
ugcaaaaaaccagccaauaacau

SEQ ID NO: 2566187 - RNA, 18 nt, Chlamydophila pneumoniae J138
ugcaaaaaguuucaaucu

SEQ ID NO: 2566188 - RNA, 17 nt, Chlamydophila pneumoniae J138
ugcaaaaaugaaagaaa

SEQ ID NO: 2566189 - RNA, 12 nt, Chlamydophila pneumoniae J138
ugcaaaauuuaa

SEQ ID NO: 2566190 - RNA, 18 nt, Chlamydophila pneumoniae J138
ugcaaacacaauuguaaa

SEQ ID NO: 2566191 - RNA, 15 nt, Chlamydophila pneumoniae J138
ugcaaacgcaaugau

SEQ ID NO: 2566192 - RNA, 17 nt, Chlamydophila pneumoniae J138
ugcaaacugaucugaaa

SEQ ID NO: 2566193 - RNA, 19 nt, Chlamydophila pneumoniae J138
ugcaaagcccccuccccca

SEQ ID NO: 2566194 - RNA, 17 nt, Chlamydophila pneumoniae J138
ugcaaaguacuacaaua

SEQ ID NO: 2566195 - RNA, 19 nt, Chlamydophila pneumoniae J138
ugcaaauaagccaguacua

SEQ ID NO: 2566196 - RNA, 18 nt, Chlamydophila pneumoniae J138
ugcaaaugaagggauggg

SEQ ID NO: 2566197 - RNA, 14 nt, Chlamydophila pneumoniae J138
ugcaaauuccagaa

SEQ ID NO: 2566198 - RNA, 19 nt, Chlamydophila pneumoniae J138
ugcaacggagaaauuugug

SEQ ID NO: 2566199 - RNA, 20 nt, Chlamydophila pneumoniae J138
ugcaagagcccuugugcauc

SEQ ID NO: 2566200 - RNA, 14 nt, Chlamydophila pneumoniae J138
ugcaagcaacucuu

SEQ ID NO: 2566201 - RNA, 19 nt, Chlamydophila pneumoniae J138
ugcaagcagauagagcuuc

SEQ ID NO: 2566202 - RNA, 13 nt, Chlamydophila pneumoniae J138
ugcaaggagcuuu

SEQ ID NO: 2566203 - RNA, 13 nt, Chlamydophila pneumoniae J138
ugcaaggcaagau

SEQ ID NO: 2566204 - RNA, 21 nt, Chlamydophila pneumoniae J138
ugcaaggcaagaugugcucga

SEQ ID NO: 2566205 - RNA, 14 nt, Chlamydophila pneumoniae J138
ugcaaggcaaugau

SEQ ID NO: 2566206 - RNA, 19 nt, Chlamydophila pneumoniae J138
ugcaaggccuaaucuugua

SEQ ID NO: 2566207 - RNA, 22 nt, Chlamydophila pneumoniae J138
ugcaagguucugcgaaacaacu

SEQ ID NO: 2566208 - RNA, 16 nt, Chlamydophila pneumoniae J138
ugcaagugcuuucagg

SEQ ID NO: 2566209 - RNA, 17 nt, Chlamydophila pneumoniae J138
ugcaagugcuuucagga

SEQ ID NO: 2566210 - RNA, 16 nt, Chlamydophila pneumoniae J138
ugcaaguucacacgua

SEQ ID NO: 2566211 - RNA, 13 nt, Chlamydophila pneumoniae J138
ugcaaucagugcu

SEQ ID NO: 2566212 - RNA, 17 nt, Chlamydophila pneumoniae J138
ugcaaugguugucuuua

SEQ ID NO: 2566213 - RNA, 17 nt, Chlamydophila pneumoniae J138
ugcaauuccauagguua

SEQ ID NO: 2566214 - RNA, 17 nt, Chlamydophila pneumoniae J138
ugcaauugccauaucau

SEQ ID NO: 2566215 - RNA, 12 nt, Chlamydophila pneumoniae J138
ugcaauuuucua

SEQ ID NO: 2566216 - RNA, 16 nt, Chlamydophila pneumoniae J138
ugcacaaucgcaucaa

SEQ ID NO: 2566217 - RNA, 21 nt, Chlamydophila pneumoniae J138
ugcacaaucgcaucaaaaaau

SEQ ID NO: 2566218 - RNA, 15 nt, Chlamydophila pneumoniae J138
ugcacacauccugga

SEQ ID NO: 2566219 - RNA, 24 nt, Chlamydophila pneumoniae J138
ugcacccaaucgguaugauagaac

SEQ ID NO: 2566220 - RNA, 14 nt, Chlamydophila pneumoniae J138
ugcacgagagccuc

SEQ ID NO: 2566221 - RNA, 20 nt, Chlamydophila pneumoniae J138
ugcacgaucgcgauaagaag

SEQ ID NO: 2566222 - RNA, 22 nt, Chlamydophila pneumoniae J138
ugcacgaucgcgauaagaagcu

SEQ ID NO: 2566223 - RNA, 18 nt, Chlamydophila pneumoniae J138
ugcacuuucuuuuuuaau

SEQ ID NO: 2566224 - RNA, 13 nt, Chlamydophila pneumoniae J138
ugcagauacuaaa

SEQ ID NO: 2566225 - RNA, 13 nt, Chlamydophila pneumoniae J138
ugcagaucuuuua

SEQ ID NO: 2566226 - RNA, 16 nt, Chlamydophila pneumoniae J138
ugcagcagccuuggcu

SEQ ID NO: 2566227 - RNA, 19 nt, Chlamydophila pneumoniae J138
ugcagcgaucaaaggcugc

SEQ ID NO: 2566228 - RNA, 19 nt, Chlamydophila pneumoniae J138
ugcagcuaacgaagccuca

SEQ ID NO: 2566229 - RNA, 21 nt, Chlamydophila pneumoniae J138
ugcaggacugucuagcaguug

SEQ ID NO: 2566230 - RNA, 16 nt, Chlamydophila pneumoniae J138
ugcaggagaacaauau

SEQ ID NO: 2566231 - RNA, 15 nt, Chlamydophila pneumoniae J138
ugcaggccaggagac

SEQ ID NO: 2566232 - RNA, 16 nt, Chlamydophila pneumoniae J138
ugcaggccaggagacu

SEQ ID NO: 2566233 - RNA, 13 nt, Chlamydophila pneumoniae J138
ugcauaaucucac

SEQ ID NO: 2566234 - RNA, 18 nt, Chlamydophila pneumoniae J138
ugcauaaucucaccagaa

SEQ ID NO: 2566235 - RNA, 17 nt, Chlamydophila pneumoniae J138
ugcauaauuuuucuuag

SEQ ID NO: 2566236 - RNA, 13 nt, Chlamydophila pneumoniae J138
ugcauacccuucu

SEQ ID NO: 2566237 - RNA, 20 nt, Chlamydophila pneumoniae J138
ugcauacuggcccagauucu

SEQ ID NO: 2566238 - RNA, 23 nt, Chlamydophila pneumoniae J138
ugcauaguauggcauucuuuuuc

SEQ ID NO: 2566239 - RNA, 23 nt, Chlamydophila pneumoniae J138
ugcauauugcucuuguauuccuu

SEQ ID NO: 2566240 - RNA, 23 nt, Chlamydophila pneumoniae J138
ugcaucccccgcgccacaucaaa

SEQ ID NO: 2566241 - RNA, 20 nt, Chlamydophila pneumoniae J138
ugcaucccuggauuucuucu

SEQ ID NO: 2566242 - RNA, 16 nt, Chlamydophila pneumoniae J138
ugcaucucuuaaaaca

SEQ ID NO: 2566243 - RNA, 17 nt, Chlamydophila pneumoniae J138
ugcaucucuuaaaacau

SEQ ID NO: 2566244 - RNA, 17 nt, Chlamydophila pneumoniae J138
ugcaucuuauggaagag

SEQ ID NO: 2566245 - RNA, 16 nt, Chlamydophila pneumoniae J138
ugcaugaaucucuucu

SEQ ID NO: 2566246 - RNA, 17 nt, Chlamydophila pneumoniae J138
ugcaugaaucucuucug

SEQ ID NO: 2566247 - RNA, 17 nt, Chlamydophila pneumoniae J138
ugcaugcaucuuaucaa

SEQ ID NO: 2566248 - RNA, 16 nt, Chlamydophila pneumoniae J138
ugcaugccuauuaagu

SEQ ID NO: 2566249 - RNA, 21 nt, Chlamydophila pneumoniae J138
ugcaugccuggccaucaucac

SEQ ID NO: 2566250 - RNA, 22 nt, Chlamydophila pneumoniae J138
ugcaugccuggccaucaucacc

SEQ ID NO: 2566251 - RNA, 16 nt, Chlamydophila pneumoniae J138
ugcauggauccuucau

SEQ ID NO: 2566252 - RNA, 15 nt, Chlamydophila pneumoniae J138
ugcauuuucuucuug

SEQ ID NO: 2566253 - RNA, 18 nt, Chlamydophila pneumoniae J138
ugcauuuucuucuugcaa

SEQ ID NO: 2566254 - RNA, 12 nt, Chlamydophila pneumoniae J138
ugccaaaaaauu

SEQ ID NO: 2566255 - RNA, 21 nt, Chlamydophila pneumoniae J138
ugccaaaaguuuugaggauuu

SEQ ID NO: 2566256 - RNA, 13 nt, Chlamydophila pneumoniae J138
ugccaagagcauc

SEQ ID NO: 2566257 - RNA, 16 nt, Chlamydophila pneumoniae J138
ugccaaucuuccuuaa

SEQ ID NO: 2566258 - RNA, 20 nt, Chlamydophila pneumoniae J138
ugccaauguggugauuucuu

SEQ ID NO: 2566259 - RNA, 16 nt, Chlamydophila pneumoniae J138
ugccaauuuuuguaga

SEQ ID NO: 2566260 - RNA, 16 nt, Chlamydophila pneumoniae J138
ugccacaacucauccu

SEQ ID NO: 2566261 - RNA, 18 nt, Chlamydophila pneumoniae J138
ugccagagauucuucaca

SEQ ID NO: 2566262 - RNA, 13 nt, Chlamydophila pneumoniae J138
ugccagcagaagu

SEQ ID NO: 2566263 - RNA, 15 nt, Chlamydophila pneumoniae J138
ugccagcagcgagga

SEQ ID NO: 2566264 - RNA, 13 nt, Chlamydophila pneumoniae J138
ugccagcccaugu

SEQ ID NO: 2566265 - RNA, 19 nt, Chlamydophila pneumoniae J138
ugccaggagagcuaacagc

SEQ ID NO: 2566266 - RNA, 18 nt, Chlamydophila pneumoniae J138
ugccagugacauaaucac

SEQ ID NO: 2566267 - RNA, 20 nt, Chlamydophila pneumoniae J138
ugccaugaauccaugggauc

SEQ ID NO: 2566268 - RNA, 20 nt, Chlamydophila pneumoniae J138
ugccaugcccacagaccaaa

SEQ ID NO: 2566269 - RNA, 19 nt, Chlamydophila pneumoniae J138
ugccauucuuaucugcugg

SEQ ID NO: 2566270 - RNA, 19 nt, Chlamydophila pneumoniae J138
ugcccacacccuuuaaguu

SEQ ID NO: 2566271 - RNA, 21 nt, Chlamydophila pneumoniae J138
ugcccauugaccugcuuuuuu

SEQ ID NO: 2566272 - RNA, 22 nt, Chlamydophila pneumoniae J138
ugcccugucacuaucuucuaaa

SEQ ID NO: 2566273 - RNA, 21 nt, Chlamydophila pneumoniae J138
ugcccuucguaacgcuuuucu

SEQ ID NO: 2566274 - RNA, 22 nt, Chlamydophila pneumoniae J138
ugcccuucguaacgcuuuucua

SEQ ID NO: 2566275 - RNA, 23 nt, Chlamydophila pneumoniae J138
ugccgugcucuuauguuaaaaau

SEQ ID NO: 2566276 - RNA, 17 nt, Chlamydophila pneumoniae J138
ugccuaaagagauguag

SEQ ID NO: 2566277 - RNA, 18 nt, Chlamydophila pneumoniae J138
ugccucaggucugcugag

SEQ ID NO: 2566278 - RNA, 20 nt, Chlamydophila pneumoniae J138
ugccucauugccguggugag

SEQ ID NO: 2566279 - RNA, 18 nt, Chlamydophila pneumoniae J138
ugccucuuucauacuaaa

SEQ ID NO: 2566280 - RNA, 13 nt, Chlamydophila pneumoniae J138
ugccugaaaacaa

SEQ ID NO: 2566281 - RNA, 16 nt, Chlamydophila pneumoniae J138
ugccugaaauccuggg

SEQ ID NO: 2566282 - RNA, 17 nt, Chlamydophila pneumoniae J138
ugccugaagauggcaag

SEQ ID NO: 2566283 - RNA, 18 nt, Chlamydophila pneumoniae J138
ugccugccaauccaaugg

SEQ ID NO: 2566284 - RNA, 14 nt, Chlamydophila pneumoniae J138
ugccuguuuuauug

SEQ ID NO: 2566285 - RNA, 20 nt, Chlamydophila pneumoniae J138
ugccuuacgaacuauagcaa

SEQ ID NO: 2566286 - RNA, 13 nt, Chlamydophila pneumoniae J138
ugccuuaggcuuu

SEQ ID NO: 2566287 - RNA, 13 nt, Chlamydophila pneumoniae J138
ugccuuaugcuca

SEQ ID NO: 2566288 - RNA, 18 nt, Chlamydophila pneumoniae J138
ugccuucuuaucuucuaa

SEQ ID NO: 2566289 - RNA, 12 nt, Chlamydophila pneumoniae J138
ugccuuucucuu

SEQ ID NO: 2566290 - RNA, 15 nt, Chlamydophila pneumoniae J138
ugccuuugaucagga

SEQ ID NO: 2566291 - RNA, 21 nt, Chlamydophila pneumoniae J138
ugccuuuuucuugauuagaga

SEQ ID NO: 2566292 - RNA, 14 nt, Chlamydophila pneumoniae J138
ugccuuuuuuucua

SEQ ID NO: 2566293 - RNA, 22 nt, Chlamydophila pneumoniae J138
ugcgaacgaagacuuguucuuc

SEQ ID NO: 2566294 - RNA, 20 nt, Chlamydophila pneumoniae J138
ugcgaauccugaggaugcua

SEQ ID NO: 2566295 - RNA, 17 nt, Chlamydophila pneumoniae J138
ugcgacugcucuuucau

SEQ ID NO: 2566296 - RNA, 22 nt, Chlamydophila pneumoniae J138
ugcgagguaugaauaggaauga

SEQ ID NO: 2566297 - RNA, 19 nt, Chlamydophila pneumoniae J138
ugcgauaucuauaaaugua

SEQ ID NO: 2566298 - RNA, 23 nt, Chlamydophila pneumoniae J138
ugcgauuuccccuucagaggcua

SEQ ID NO: 2566299 - RNA, 19 nt, Chlamydophila pneumoniae J138
ugcgcaaagaacucaacuu

SEQ ID NO: 2566300 - RNA, 15 nt, Chlamydophila pneumoniae J138
ugcgcagaauaaaau

SEQ ID NO: 2566301 - RNA, 18 nt, Chlamydophila pneumoniae J138
ugcgcagcuucuggagaa

SEQ ID NO: 2566302 - RNA, 22 nt, Chlamydophila pneumoniae J138
ugcgcagcuucuggagaaaaaa

SEQ ID NO: 2566303 - RNA, 16 nt, Chlamydophila pneumoniae J138
ugcgccagcaaagauu

SEQ ID NO: 2566304 - RNA, 16 nt, Chlamydophila pneumoniae J138
ugcgcucggauuucau

SEQ ID NO: 2566305 - RNA, 14 nt, Chlamydophila pneumoniae J138
ugcggaacucauca

SEQ ID NO: 2566306 - RNA, 17 nt, Chlamydophila pneumoniae J138
ugcggaccuuaagauga

SEQ ID NO: 2566307 - RNA, 20 nt, Chlamydophila pneumoniae J138
ugcggaccuuaagaugaggu

SEQ ID NO: 2566308 - RNA, 15 nt, Chlamydophila pneumoniae J138
ugcggccacauuaag

SEQ ID NO: 2566309 - RNA, 15 nt, Chlamydophila pneumoniae J138
ugcggcuaauuucaa

SEQ ID NO: 2566310 - RNA, 18 nt, Chlamydophila pneumoniae J138
ugcggcuccuacaguccu

SEQ ID NO: 2566311 - RNA, 13 nt, Chlamydophila pneumoniae J138
ugcuaaacaaugc

SEQ ID NO: 2566312 - RNA, 23 nt, Chlamydophila pneumoniae J138
ugcuaaacuuuuuuucaaaucau

SEQ ID NO: 2566313 - RNA, 19 nt, Chlamydophila pneumoniae J138
ugcuaaagagucuuccuag

SEQ ID NO: 2566314 - RNA, 13 nt, Chlamydophila pneumoniae J138
ugcuaacaacucc

SEQ ID NO: 2566315 - RNA, 17 nt, Chlamydophila pneumoniae J138
ugcuaagagcucuuucc

SEQ ID NO: 2566316 - RNA, 19 nt, Chlamydophila pneumoniae J138
ugcuaagaucuuuagaaua

SEQ ID NO: 2566317 - RNA, 12 nt, Chlamydophila pneumoniae J138
ugcuaauaauuc

SEQ ID NO: 2566318 - RNA, 15 nt, Chlamydophila pneumoniae J138
ugcuaauaccucaaa

SEQ ID NO: 2566319 - RNA, 22 nt, Chlamydophila pneumoniae J138
ugcuaauccagcaacaaccaaa

SEQ ID NO: 2566320 - RNA, 13 nt, Chlamydophila pneumoniae J138
ugcuacaaacucu

SEQ ID NO: 2566321 - RNA, 17 nt, Chlamydophila pneumoniae J138
ugcuacaaacucuucca

SEQ ID NO: 2566322 - RNA, 21 nt, Chlamydophila pneumoniae J138
ugcuacagcuucuuuuccagc

SEQ ID NO: 2566323 - RNA, 18 nt, Chlamydophila pneumoniae J138
ugcuagagcuuucagaaa

SEQ ID NO: 2566324 - RNA, 21 nt, Chlamydophila pneumoniae J138
ugcuagaucuggagagggaag

SEQ ID NO: 2566325 - RNA, 14 nt, Chlamydophila pneumoniae J138
ugcuaggaagauga

SEQ ID NO: 2566326 - RNA, 12 nt, Chlamydophila pneumoniae J138
ugcuauacagaa

SEQ ID NO: 2566327 - RNA, 21 nt, Chlamydophila pneumoniae J138
ugcuauagcuggaucuucuga

SEQ ID NO: 2566328 - RNA, 17 nt, Chlamydophila pneumoniae J138
ugcuauagggaucuccu

SEQ ID NO: 2566329 - RNA, 21 nt, Chlamydophila pneumoniae J138
ugcuaucaaagacucaugaaa

SEQ ID NO: 2566330 - RNA, 21 nt, Chlamydophila pneumoniae J138
ugcuaucauaacguauuucac

SEQ ID NO: 2566331 - RNA, 12 nt, Chlamydophila pneumoniae J138
ugcuaucuccag

SEQ ID NO: 2566332 - RNA, 14 nt, Chlamydophila pneumoniae J138
ugcuaucuccagaa

SEQ ID NO: 2566333 - RNA, 20 nt, Chlamydophila pneumoniae J138
ugcucaauacagauaucaaa

SEQ ID NO: 2566334 - RNA, 17 nt, Chlamydophila pneumoniae J138
ugcucacuguuuuucgu

SEQ ID NO: 2566335 - RNA, 18 nt, Chlamydophila pneumoniae J138
ugcucaggagauacaagu

SEQ ID NO: 2566336 - RNA, 15 nt, Chlamydophila pneumoniae J138
ugcucaguaaauauu

SEQ ID NO: 2566337 - RNA, 15 nt, Chlamydophila pneumoniae J138
ugcuccaauuuucuu

SEQ ID NO: 2566338 - RNA, 22 nt, Chlamydophila pneumoniae J138
ugcuccaauuuucuucagcacu

SEQ ID NO: 2566339 - RNA, 21 nt, Chlamydophila pneumoniae J138
ugcucccuccuccucgucuaa

SEQ ID NO: 2566340 - RNA, 14 nt, Chlamydophila pneumoniae J138
ugcuccuccaaaag

SEQ ID NO: 2566341 - RNA, 13 nt, Chlamydophila pneumoniae J138
ugcuccucuucuu

SEQ ID NO: 2566342 - RNA, 15 nt, Chlamydophila pneumoniae J138
ugcuccucuucuucc

SEQ ID NO: 2566343 - RNA, 11 nt, Chlamydophila pneumoniae J138
ugcuccugaag

SEQ ID NO: 2566344 - RNA, 14 nt, Chlamydophila pneumoniae J138
ugcuccugaagcug

SEQ ID NO: 2566345 - RNA, 23 nt, Chlamydophila pneumoniae J138
ugcucguauuagaguuucuuuug

SEQ ID NO: 2566346 - RNA, 21 nt, Chlamydophila pneumoniae J138
ugcucuaaguugauacuugua

SEQ ID NO: 2566347 - RNA, 17 nt, Chlamydophila pneumoniae J138
ugcucuaccaacugagc

SEQ ID NO: 2566348 - RNA, 15 nt, Chlamydophila pneumoniae J138
ugcucucuaaagcuu

SEQ ID NO: 2566349 - RNA, 16 nt, Chlamydophila pneumoniae J138
ugcucucuucuucuca

SEQ ID NO: 2566350 - RNA, 14 nt, Chlamydophila pneumoniae J138
ugcucuuucauuuc

SEQ ID NO: 2566351 - RNA, 20 nt, Chlamydophila pneumoniae J138
ugcugaagauuuuuucuugg

SEQ ID NO: 2566352 - RNA, 22 nt, Chlamydophila pneumoniae J138
ugcugaauauaguuuaaauguc

SEQ ID NO: 2566353 - RNA, 16 nt, Chlamydophila pneumoniae J138
ugcugacaucuccaag

SEQ ID NO: 2566354 - RNA, 15 nt, Chlamydophila pneumoniae J138
ugcugauuucuuuuu

SEQ ID NO: 2566355 - RNA, 22 nt, Chlamydophila pneumoniae J138
ugcugcagcaaaacuaggaaaa

SEQ ID NO: 2566356 - RNA, 17 nt, Chlamydophila pneumoniae J138
ugcugcuaaacagggaa

SEQ ID NO: 2566357 - RNA, 18 nt, Chlamydophila pneumoniae J138
ugcugcucuccaaaggga

SEQ ID NO: 2566358 - RNA, 18 nt, Chlamydophila pneumoniae J138
ugcugggggagcuagaaa

SEQ ID NO: 2566359 - RNA, 12 nt, Chlamydophila pneumoniae J138
ugcugucagaac

SEQ ID NO: 2566360 - RNA, 14 nt, Chlamydophila pneumoniae J138
ugcugucagaacaa

SEQ ID NO: 2566361 - RNA, 17 nt, Chlamydophila pneumoniae J138
ugcuguugauucaaugc

SEQ ID NO: 2566362 - RNA, 16 nt, Chlamydophila pneumoniae J138
ugcuguuucuauuagc

SEQ ID NO: 2566363 - RNA, 13 nt, Chlamydophila pneumoniae J138
ugcuguuucuucu

SEQ ID NO: 2566364 - RNA, 11 nt, Chlamydophila pneumoniae J138
ugcuuaaggaa

SEQ ID NO: 2566365 - RNA, 23 nt, Chlamydophila pneumoniae J138
ugcuuaaggaaacagugguaugc

SEQ ID NO: 2566366 - RNA, 15 nt, Chlamydophila pneumoniae J138
ugcuuagcaaaggca

SEQ ID NO: 2566367 - RNA, 18 nt, Chlamydophila pneumoniae J138
ugcuuagcgaucucucuu

SEQ ID NO: 2566368 - RNA, 22 nt, Chlamydophila pneumoniae J138
ugcuuauuuccccgaacaaauu

SEQ ID NO: 2566369 - RNA, 21 nt, Chlamydophila pneumoniae J138
ugcuuccaacggacauuuuca

SEQ ID NO: 2566370 - RNA, 14 nt, Chlamydophila pneumoniae J138
ugcuucuaaacaau

SEQ ID NO: 2566371 - RNA, 18 nt, Chlamydophila pneumoniae J138
ugcuucuaagaaacuucc

SEQ ID NO: 2566372 - RNA, 15 nt, Chlamydophila pneumoniae J138
ugcuugaauauuucc

SEQ ID NO: 2566373 - RNA, 21 nt, Chlamydophila pneumoniae J138
ugcuugaccucaucagaagug

SEQ ID NO: 2566374 - RNA, 17 nt, Chlamydophila pneumoniae J138
ugcuuguauaaaugcug

SEQ ID NO: 2566375 - RNA, 21 nt, Chlamydophila pneumoniae J138
ugcuugucgcgacaagacaau

SEQ ID NO: 2566376 - RNA, 15 nt, Chlamydophila pneumoniae J138
ugcuugucuacagag

SEQ ID NO: 2566377 - RNA, 14 nt, Chlamydophila pneumoniae J138
ugcuuuaacagaag

SEQ ID NO: 2566378 - RNA, 23 nt, Chlamydophila pneumoniae J138
ugcuuucuagcugcucuuuuaga

SEQ ID NO: 2566379 - RNA, 22 nt, Chlamydophila pneumoniae J138
ugcuuucuguacaacaaaauuu

SEQ ID NO: 2566380 - RNA, 12 nt, Chlamydophila pneumoniae J138
ugcuuuucaaau

SEQ ID NO: 2566381 - RNA, 13 nt, Chlamydophila pneumoniae J138
ugcuuuucauuuu

SEQ ID NO: 2566382 - RNA, 10 nt, Chlamydophila pneumoniae J138
ugcuuuuccc

SEQ ID NO: 2566383 - RNA, 13 nt, Chlamydophila pneumoniae J138
ugcuuuuccuucu

SEQ ID NO: 2566384 - RNA, 19 nt, Chlamydophila pneumoniae J138
ugcuuuuguuguuuuugcu

SEQ ID NO: 2566385 - RNA, 19 nt, Chlamydophila pneumoniae J138
uggaaagcuucuggauuca

SEQ ID NO: 2566386 - RNA, 20 nt, Chlamydophila pneumoniae J138
uggaaauagagaaacuuuug

SEQ ID NO: 2566387 - RNA, 23 nt, Chlamydophila pneumoniae J138
uggaaaucaccagcauuaagaua

SEQ ID NO: 2566388 - RNA, 21 nt, Chlamydophila pneumoniae J138
uggaaauccguaaagguugua

SEQ ID NO: 2566389 - RNA, 16 nt, Chlamydophila pneumoniae J138
uggaaauugugaaaaa

SEQ ID NO: 2566390 - RNA, 15 nt, Chlamydophila pneumoniae J138
uggaagagagcaaga

SEQ ID NO: 2566391 - RNA, 17 nt, Chlamydophila pneumoniae J138
uggaagcaaagaaaauu

SEQ ID NO: 2566392 - RNA, 21 nt, Chlamydophila pneumoniae J138
uggaagcuuuuacgagcuuuu

SEQ ID NO: 2566393 - RNA, 16 nt, Chlamydophila pneumoniae J138
uggaauucaaacuccu

SEQ ID NO: 2566394 - RNA, 23 nt, Chlamydophila pneumoniae J138
uggaauucaaacuccuuuuaaaa

SEQ ID NO: 2566395 - RNA, 13 nt, Chlamydophila pneumoniae J138
uggaauugcauua

SEQ ID NO: 2566396 - RNA, 15 nt, Chlamydophila pneumoniae J138
uggacaauauagaga

SEQ ID NO: 2566397 - RNA, 23 nt, Chlamydophila pneumoniae J138
uggacagcggccacaugaagucc

SEQ ID NO: 2566398 - RNA, 16 nt, Chlamydophila pneumoniae J138
uggaccagaugcuaaa

SEQ ID NO: 2566399 - RNA, 17 nt, Chlamydophila pneumoniae J138
uggacguacuaagauac

SEQ ID NO: 2566400 - RNA, 18 nt, Chlamydophila pneumoniae J138
uggacgugguaagguuau

SEQ ID NO: 2566401 - RNA, 17 nt, Chlamydophila pneumoniae J138
uggacuacugaaacacu

SEQ ID NO: 2566402 - RNA, 16 nt, Chlamydophila pneumoniae J138
uggacucuagggucaa

SEQ ID NO: 2566403 - RNA, 20 nt, Chlamydophila pneumoniae J138
uggacucuagggucaagaac

SEQ ID NO: 2566404 - RNA, 21 nt, Chlamydophila pneumoniae J138
uggacugcugacaucuccaag

SEQ ID NO: 2566405 - RNA, 21 nt, Chlamydophila pneumoniae J138
uggacuucugguuuuucgauu

SEQ ID NO: 2566406 - RNA, 20 nt, Chlamydophila pneumoniae J138
uggagacuaggguaaguccc

SEQ ID NO: 2566407 - RNA, 17 nt, Chlamydophila pneumoniae J138
uggagagggaaggaaua

SEQ ID NO: 2566408 - RNA, 16 nt, Chlamydophila pneumoniae J138
uggagcagaaacucca

SEQ ID NO: 2566409 - RNA, 17 nt, Chlamydophila pneumoniae J138
uggagcaucauuccagc

SEQ ID NO: 2566410 - RNA, 16 nt, Chlamydophila pneumoniae J138
uggaggauaaaugagu

SEQ ID NO: 2566411 - RNA, 19 nt, Chlamydophila pneumoniae J138
uggaggccaaagaacagca

SEQ ID NO: 2566412 - RNA, 21 nt, Chlamydophila pneumoniae J138
uggaggccaaagaacagcacu

SEQ ID NO: 2566413 - RNA, 21 nt, Chlamydophila pneumoniae J138
uggaggcgguggcaugccaua

SEQ ID NO: 2566414 - RNA, 15 nt, Chlamydophila pneumoniae J138
uggagucuaaaaaau

SEQ ID NO: 2566415 - RNA, 16 nt, Chlamydophila pneumoniae J138
uggagugacaccaaca

SEQ ID NO: 2566416 - RNA, 19 nt, Chlamydophila pneumoniae J138
uggauaacacgaguuucga

SEQ ID NO: 2566417 - RNA, 16 nt, Chlamydophila pneumoniae J138
uggauaccggcaaaua

SEQ ID NO: 2566418 - RNA, 16 nt, Chlamydophila pneumoniae J138
uggauacguuuuuccc

SEQ ID NO: 2566419 - RNA, 22 nt, Chlamydophila pneumoniae J138
uggauacguuuuucccuuuaaa

SEQ ID NO: 2566420 - RNA, 18 nt, Chlamydophila pneumoniae J138
uggauaucguagacaaca

SEQ ID NO: 2566421 - RNA, 13 nt, Chlamydophila pneumoniae J138
uggaucauucuuu

SEQ ID NO: 2566422 - RNA, 21 nt, Chlamydophila pneumoniae J138
uggauccaucggcauuucucc

SEQ ID NO: 2566423 - RNA, 15 nt, Chlamydophila pneumoniae J138
uggauccuucaucag

SEQ ID NO: 2566424 - RNA, 12 nt, Chlamydophila pneumoniae J138
uggaucuugaua

SEQ ID NO: 2566425 - RNA, 18 nt, Chlamydophila pneumoniae J138
uggaucuugauaaaagau

SEQ ID NO: 2566426 - RNA, 18 nt, Chlamydophila pneumoniae J138
uggauucgcacguaggca

SEQ ID NO: 2566427 - RNA, 17 nt, Chlamydophila pneumoniae J138
uggauugucgaugaggg

SEQ ID NO: 2566428 - RNA, 13 nt, Chlamydophila pneumoniae J138
uggauuucuccag

SEQ ID NO: 2566429 - RNA, 22 nt, Chlamydophila pneumoniae J138
uggauuucuccagcagcuuccc

SEQ ID NO: 2566430 - RNA, 13 nt, Chlamydophila pneumoniae J138
uggauuucuucug

SEQ ID NO: 2566431 - RNA, 21 nt, Chlamydophila pneumoniae J138
uggauuuuaaagcaaaaauuc

SEQ ID NO: 2566432 - RNA, 23 nt, Chlamydophila pneumoniae J138
uggcaaaggaccacaauuccuaa

SEQ ID NO: 2566433 - RNA, 18 nt, Chlamydophila pneumoniae J138
uggcaaauaaaacaagcu

SEQ ID NO: 2566434 - RNA, 13 nt, Chlamydophila pneumoniae J138
uggcaaggaaaau

SEQ ID NO: 2566435 - RNA, 15 nt, Chlamydophila pneumoniae J138
uggcaaucuaaaauc

SEQ ID NO: 2566436 - RNA, 17 nt, Chlamydophila pneumoniae J138
uggcaaucuuuucuugu

SEQ ID NO: 2566437 - RNA, 15 nt, Chlamydophila pneumoniae J138
uggcaaugauauccu

SEQ ID NO: 2566438 - RNA, 17 nt, Chlamydophila pneumoniae J138
uggcagcaggaauaauc

SEQ ID NO: 2566439 - RNA, 16 nt, Chlamydophila pneumoniae J138
uggcauaauccugaau

SEQ ID NO: 2566440 - RNA, 14 nt, Chlamydophila pneumoniae J138
uggcauagagccua

SEQ ID NO: 2566441 - RNA, 14 nt, Chlamydophila pneumoniae J138
uggcauagcgagaa

SEQ ID NO: 2566442 - RNA, 15 nt, Chlamydophila pneumoniae J138
uggcaugaaagauaa

SEQ ID NO: 2566443 - RNA, 13 nt, Chlamydophila pneumoniae J138
uggcauucuuuuu

SEQ ID NO: 2566444 - RNA, 17 nt, Chlamydophila pneumoniae J138
uggcauucuuuuucuau

SEQ ID NO: 2566445 - RNA, 18 nt, Chlamydophila pneumoniae J138
uggcauugccauaauaaa

SEQ ID NO: 2566446 - RNA, 11 nt, Chlamydophila pneumoniae J138
uggccaaaaau

SEQ ID NO: 2566447 - RNA, 12 nt, Chlamydophila pneumoniae J138
uggccucaacac

SEQ ID NO: 2566448 - RNA, 12 nt, Chlamydophila pneumoniae J138
uggcgauaaaug

SEQ ID NO: 2566449 - RNA, 21 nt, Chlamydophila pneumoniae J138
uggcguuuucuagaaaagauu

SEQ ID NO: 2566450 - RNA, 14 nt, Chlamydophila pneumoniae J138
uggcuaaaggauca

SEQ ID NO: 2566451 - RNA, 17 nt, Chlamydophila pneumoniae J138
uggcucuagaaauauac

SEQ ID NO: 2566452 - RNA, 15 nt, Chlamydophila pneumoniae J138
uggcugagagaagca

SEQ ID NO: 2566453 - RNA, 16 nt, Chlamydophila pneumoniae J138
uggcugagagauaggg

SEQ ID NO: 2566454 - RNA, 17 nt, Chlamydophila pneumoniae J138
uggcuggaaagccaagc

SEQ ID NO: 2566455 - RNA, 16 nt, Chlamydophila pneumoniae J138
uggcugucuugaccaa

SEQ ID NO: 2566456 - RNA, 20 nt, Chlamydophila pneumoniae J138
ugggaaaagaaaagaaagaa

SEQ ID NO: 2566457 - RNA, 12 nt, Chlamydophila pneumoniae J138
ugggaagacucu

SEQ ID NO: 2566458 - RNA, 19 nt, Chlamydophila pneumoniae J138
ugggaagacucucaucagc

SEQ ID NO: 2566459 - RNA, 18 nt, Chlamydophila pneumoniae J138
ugggaagccuggaaauga

SEQ ID NO: 2566460 - RNA, 20 nt, Chlamydophila pneumoniae J138
ugggaauuugauuuuucaaa

SEQ ID NO: 2566461 - RNA, 22 nt, Chlamydophila pneumoniae J138
ugggaauuugauuuuucaaauu

SEQ ID NO: 2566462 - RNA, 23 nt, Chlamydophila pneumoniae J138
ugggaauuugauuuuucaaauuc

SEQ ID NO: 2566463 - RNA, 16 nt, Chlamydophila pneumoniae J138
ugggagcuuccuccaa

SEQ ID NO: 2566464 - RNA, 15 nt, Chlamydophila pneumoniae J138
ugggaugaucucuga

SEQ ID NO: 2566465 - RNA, 21 nt, Chlamydophila pneumoniae J138
ugggcagcgauauaagacucc

SEQ ID NO: 2566466 - RNA, 21 nt, Chlamydophila pneumoniae J138
ugggcauuuaacaacaugcgc

SEQ ID NO: 2566467 - RNA, 15 nt, Chlamydophila pneumoniae J138
ugggcgucuucuucg

SEQ ID NO: 2566468 - RNA, 15 nt, Chlamydophila pneumoniae J138
uggggaaauuaaauu

SEQ ID NO: 2566469 - RNA, 18 nt, Chlamydophila pneumoniae J138
uggggcaguagguaagaa

SEQ ID NO: 2566470 - RNA, 19 nt, Chlamydophila pneumoniae J138
uggggcauaagaacucuau

SEQ ID NO: 2566471 - RNA, 20 nt, Chlamydophila pneumoniae J138
ugggggacuucaaaugaaau

SEQ ID NO: 2566472 - RNA, 13 nt, Chlamydophila pneumoniae J138
uggguaaguccac

SEQ ID NO: 2566473 - RNA, 15 nt, Chlamydophila pneumoniae J138
uggguaaguccacaa

SEQ ID NO: 2566474 - RNA, 17 nt, Chlamydophila pneumoniae J138
uggguucacuccugaag

SEQ ID NO: 2566475 - RNA, 13 nt, Chlamydophila pneumoniae J138
uggguuugucucc

SEQ ID NO: 2566476 - RNA, 19 nt, Chlamydophila pneumoniae J138
ugguaacacgagugccuuc

SEQ ID NO: 2566477 - RNA, 15 nt, Chlamydophila pneumoniae J138
ugguaaggagagucu

SEQ ID NO: 2566478 - RNA, 22 nt, Chlamydophila pneumoniae J138
ugguacaauacuggagagguaa

SEQ ID NO: 2566479 - RNA, 17 nt, Chlamydophila pneumoniae J138
ugguacggcuaaauaaa

SEQ ID NO: 2566480 - RNA, 19 nt, Chlamydophila pneumoniae J138
ugguacggcuaaauaaacc

SEQ ID NO: 2566481 - RNA, 19 nt, Chlamydophila pneumoniae J138
ugguagcgucucuucuucc

SEQ ID NO: 2566482 - RNA, 16 nt, Chlamydophila pneumoniae J138
ugguagcuaaauuuag

SEQ ID NO: 2566483 - RNA, 21 nt, Chlamydophila pneumoniae J138
ugguaggaugucgcuuuugcu

SEQ ID NO: 2566484 - RNA, 20 nt, Chlamydophila pneumoniae J138
ugguaguuugccuucuuauc

SEQ ID NO: 2566485 - RNA, 12 nt, Chlamydophila pneumoniae J138
uggucagucucg

SEQ ID NO: 2566486 - RNA, 23 nt, Chlamydophila pneumoniae J138
uggucauugccuugcugcauacu

SEQ ID NO: 2566487 - RNA, 23 nt, Chlamydophila pneumoniae J138
ugguccauaauuucuuucacauc

SEQ ID NO: 2566488 - RNA, 20 nt, Chlamydophila pneumoniae J138
ugguccaucgagaaaugcuc

SEQ ID NO: 2566489 - RNA, 17 nt, Chlamydophila pneumoniae J138
uggucggaguuuuuuuc

SEQ ID NO: 2566490 - RNA, 16 nt, Chlamydophila pneumoniae J138
uggucuagagauuuuu

SEQ ID NO: 2566491 - RNA, 19 nt, Chlamydophila pneumoniae J138
uggucucuauuuagaccaa

SEQ ID NO: 2566492 - RNA, 21 nt, Chlamydophila pneumoniae J138
uggucuucuguaauuuuuuuc

SEQ ID NO: 2566493 - RNA, 17 nt, Chlamydophila pneumoniae J138
uggucuuggguuuuaaa

SEQ ID NO: 2566494 - RNA, 15 nt, Chlamydophila pneumoniae J138
uggugaagaauaaua

SEQ ID NO: 2566495 - RNA, 17 nt, Chlamydophila pneumoniae J138
uggugaagaauaauagc

SEQ ID NO: 2566496 - RNA, 17 nt, Chlamydophila pneumoniae J138
uggugacucuagccacc

SEQ ID NO: 2566497 - RNA, 21 nt, Chlamydophila pneumoniae J138
uggugacucuagccaccaaca

SEQ ID NO: 2566498 - RNA, 15 nt, Chlamydophila pneumoniae J138
uggugagaucaucuc

SEQ ID NO: 2566499 - RNA, 13 nt, Chlamydophila pneumoniae J138
uggugauuucuuu

SEQ ID NO: 2566500 - RNA, 20 nt, Chlamydophila pneumoniae J138
ugguguauaguauuuuuaaa

SEQ ID NO: 2566501 - RNA, 21 nt, Chlamydophila pneumoniae J138
ugguguauaguauuuuuaaau

SEQ ID NO: 2566502 - RNA, 23 nt, Chlamydophila pneumoniae J138
ugguuaaaacccauguuucuucc

SEQ ID NO: 2566503 - RNA, 18 nt, Chlamydophila pneumoniae J138
ugguuaggguaaggcuua

SEQ ID NO: 2566504 - RNA, 16 nt, Chlamydophila pneumoniae J138
ugguuccugaaaagca

SEQ ID NO: 2566505 - RNA, 21 nt, Chlamydophila pneumoniae J138
ugguugcuucuaagaaacuuc

SEQ ID NO: 2566506 - RNA, 18 nt, Chlamydophila pneumoniae J138
ugguuuaccuuguuuucc

SEQ ID NO: 2566507 - RNA, 21 nt, Chlamydophila pneumoniae J138
ugguuuuucgauuuggaagau

SEQ ID NO: 2566508 - RNA, 16 nt, Chlamydophila pneumoniae J138
ugguuuuucuccucuu

SEQ ID NO: 2566509 - RNA, 23 nt, Chlamydophila pneumoniae J138
uguaaagugaaauugaacucuca

SEQ ID NO: 2566510 - RNA, 21 nt, Chlamydophila pneumoniae J138
uguaaauacaaaacaaaagcc

SEQ ID NO: 2566511 - RNA, 15 nt, Chlamydophila pneumoniae J138
uguaaauuuuuccuu

SEQ ID NO: 2566512 - RNA, 21 nt, Chlamydophila pneumoniae J138
uguaacauugaccuaaaggaa

SEQ ID NO: 2566513 - RNA, 20 nt, Chlamydophila pneumoniae J138
uguaacgggagcguuuuuug

SEQ ID NO: 2566514 - RNA, 22 nt, Chlamydophila pneumoniae J138
uguaacucuuaagaauaaaaua

SEQ ID NO: 2566515 - RNA, 21 nt, Chlamydophila pneumoniae J138
uguaagaaaaugaggacacaa

SEQ ID NO: 2566516 - RNA, 18 nt, Chlamydophila pneumoniae J138
uguaagacuaaaaaagag

SEQ ID NO: 2566517 - RNA, 14 nt, Chlamydophila pneumoniae J138
uguaaguuacggaa

SEQ ID NO: 2566518 - RNA, 19 nt, Chlamydophila pneumoniae J138
uguaaguuacggaacucau

SEQ ID NO: 2566519 - RNA, 13 nt, Chlamydophila pneumoniae J138
uguaauaaaagaa

SEQ ID NO: 2566520 - RNA, 21 nt, Chlamydophila pneumoniae J138
uguaauaaaagaaagaaugac

SEQ ID NO: 2566521 - RNA, 17 nt, Chlamydophila pneumoniae J138
uguaauagcaggaguuu

SEQ ID NO: 2566522 - RNA, 22 nt, Chlamydophila pneumoniae J138
uguaaucccagauuuuuuuggu

SEQ ID NO: 2566523 - RNA, 17 nt, Chlamydophila pneumoniae J138
uguaaucuugaucagca

SEQ ID NO: 2566524 - RNA, 22 nt, Chlamydophila pneumoniae J138
uguaauuuccuuagaagggaaa

SEQ ID NO: 2566525 - RNA, 15 nt, Chlamydophila pneumoniae J138
uguacaaaugcaucu

SEQ ID NO: 2566526 - RNA, 22 nt, Chlamydophila pneumoniae J138
uguacaagcuucaucaaaacau

SEQ ID NO: 2566527 - RNA, 19 nt, Chlamydophila pneumoniae J138
uguacaauuugcuccucca

SEQ ID NO: 2566528 - RNA, 16 nt, Chlamydophila pneumoniae J138
uguacacagagaugcu

SEQ ID NO: 2566529 - RNA, 14 nt, Chlamydophila pneumoniae J138
uguacacuuucaag

SEQ ID NO: 2566530 - RNA, 13 nt, Chlamydophila pneumoniae J138
uguacagaaaaua

SEQ ID NO: 2566531 - RNA, 19 nt, Chlamydophila pneumoniae J138
uguacagaaaauaagaagc

SEQ ID NO: 2566532 - RNA, 13 nt, Chlamydophila pneumoniae J138
uguacagaacaau

SEQ ID NO: 2566533 - RNA, 20 nt, Chlamydophila pneumoniae J138
uguacaguaaaguaugcaua

SEQ ID NO: 2566534 - RNA, 20 nt, Chlamydophila pneumoniae J138
uguacaguuuguaaaaagcc

SEQ ID NO: 2566535 - RNA, 23 nt, Chlamydophila pneumoniae J138
uguacaguuuguaaaaagccuau

SEQ ID NO: 2566536 - RNA, 15 nt, Chlamydophila pneumoniae J138
uguaccguaaagaaa

SEQ ID NO: 2566537 - RNA, 18 nt, Chlamydophila pneumoniae J138
uguaccugcauucauaaa

SEQ ID NO: 2566538 - RNA, 16 nt, Chlamydophila pneumoniae J138
uguacuuuuugccaca

SEQ ID NO: 2566539 - RNA, 19 nt, Chlamydophila pneumoniae J138
uguagagguacuugggaga

SEQ ID NO: 2566540 - RNA, 24 nt, Chlamydophila pneumoniae J138
uguagaggucacuauagaucucuu

SEQ ID NO: 2566541 - RNA, 13 nt, Chlamydophila pneumoniae J138
uguagcacuucuc

SEQ ID NO: 2566542 - RNA, 14 nt, Chlamydophila pneumoniae J138
uguagcagagccuc

SEQ ID NO: 2566543 - RNA, 19 nt, Chlamydophila pneumoniae J138
uguagcauuucuuucucuu

SEQ ID NO: 2566544 - RNA, 14 nt, Chlamydophila pneumoniae J138
uguagccuuucuuu

SEQ ID NO: 2566545 - RNA, 16 nt, Chlamydophila pneumoniae J138
uguagcuacagauucu

SEQ ID NO: 2566546 - RNA, 15 nt, Chlamydophila pneumoniae J138
uguagggaugaucac

SEQ ID NO: 2566547 - RNA, 14 nt, Chlamydophila pneumoniae J138
uguagguuuuucca

SEQ ID NO: 2566548 - RNA, 15 nt, Chlamydophila pneumoniae J138
uguaguaagauuuuc

SEQ ID NO: 2566549 - RNA, 19 nt, Chlamydophila pneumoniae J138
uguagucaugauuuuucaa

SEQ ID NO: 2566550 - RNA, 12 nt, Chlamydophila pneumoniae J138
uguaguucuuug

SEQ ID NO: 2566551 - RNA, 23 nt, Chlamydophila pneumoniae J138
uguaguucuuugaauuuccaaag

SEQ ID NO: 2566552 - RNA, 13 nt, Chlamydophila pneumoniae J138
uguauaaacucca

SEQ ID NO: 2566553 - RNA, 22 nt, Chlamydophila pneumoniae J138
uguauaaacuccacgaauucuu

SEQ ID NO: 2566554 - RNA, 12 nt, Chlamydophila pneumoniae J138
uguauaaaguuu

SEQ ID NO: 2566555 - RNA, 18 nt, Chlamydophila pneumoniae J138
uguauaaaguuuguaaaa

SEQ ID NO: 2566556 - RNA, 19 nt, Chlamydophila pneumoniae J138
uguauagcuuacuuagaac

SEQ ID NO: 2566557 - RNA, 23 nt, Chlamydophila pneumoniae J138
uguauauccacgaucuagaagau

SEQ ID NO: 2566558 - RNA, 16 nt, Chlamydophila pneumoniae J138
uguauauucugaaauu

SEQ ID NO: 2566559 - RNA, 19 nt, Chlamydophila pneumoniae J138
uguauauucugaaauuucu

SEQ ID NO: 2566560 - RNA, 18 nt, Chlamydophila pneumoniae J138
uguauccguagugagguu

SEQ ID NO: 2566561 - RNA, 23 nt, Chlamydophila pneumoniae J138
uguauccguagugagguuugcaa

SEQ ID NO: 2566562 - RNA, 17 nt, Chlamydophila pneumoniae J138
uguaucuagggacuucu

SEQ ID NO: 2566563 - RNA, 18 nt, Chlamydophila pneumoniae J138
uguaucuguauccuuccu

SEQ ID NO: 2566564 - RNA, 16 nt, Chlamydophila pneumoniae J138
uguauggaauucaaac

SEQ ID NO: 2566565 - RNA, 22 nt, Chlamydophila pneumoniae J138
uguauggugcgcgucuccuuga

SEQ ID NO: 2566566 - RNA, 13 nt, Chlamydophila pneumoniae J138
uguauuaaagaau

SEQ ID NO: 2566567 - RNA, 16 nt, Chlamydophila pneumoniae J138
uguauuaaagaaucua

SEQ ID NO: 2566568 - RNA, 22 nt, Chlamydophila pneumoniae J138
uguauucgcuaagcuauaucuc

SEQ ID NO: 2566569 - RNA, 16 nt, Chlamydophila pneumoniae J138
uguauucugaagcugc

SEQ ID NO: 2566570 - RNA, 15 nt, Chlamydophila pneumoniae J138
uguauuguacuuuuu

SEQ ID NO: 2566571 - RNA, 12 nt, Chlamydophila pneumoniae J138
uguauuuaaauu

SEQ ID NO: 2566572 - RNA, 13 nt, Chlamydophila pneumoniae J138
uguauuuccuucu

SEQ ID NO: 2566573 - RNA, 21 nt, Chlamydophila pneumoniae J138
ugucaagaggcuguccuugca

SEQ ID NO: 2566574 - RNA, 18 nt, Chlamydophila pneumoniae J138
ugucacaauaccaucucu

SEQ ID NO: 2566575 - RNA, 19 nt, Chlamydophila pneumoniae J138
ugucacacugcgagagaaa

SEQ ID NO: 2566576 - RNA, 14 nt, Chlamydophila pneumoniae J138
ugucacggaagaac

SEQ ID NO: 2566577 - RNA, 20 nt, Chlamydophila pneumoniae J138
ugucacuaagauaucuccag

SEQ ID NO: 2566578 - RNA, 17 nt, Chlamydophila pneumoniae J138
ugucacuaucuucuaaa

SEQ ID NO: 2566579 - RNA, 15 nt, Chlamydophila pneumoniae J138
ugucaucacaucagu

SEQ ID NO: 2566580 - RNA, 13 nt, Chlamydophila pneumoniae J138
ugucauuaaaaau

SEQ ID NO: 2566581 - RNA, 19 nt, Chlamydophila pneumoniae J138
ugucauuaaaaauuuaaaa

SEQ ID NO: 2566582 - RNA, 15 nt, Chlamydophila pneumoniae J138
uguccaacuaaaaca

SEQ ID NO: 2566583 - RNA, 11 nt, Chlamydophila pneumoniae J138
uguccagagac

SEQ ID NO: 2566584 - RNA, 22 nt, Chlamydophila pneumoniae J138
uguccagucuauagccucuucu

SEQ ID NO: 2566585 - RNA, 17 nt, Chlamydophila pneumoniae J138
uguccauccaaauagag

SEQ ID NO: 2566586 - RNA, 20 nt, Chlamydophila pneumoniae J138
uguccauccaaauagaguga

SEQ ID NO: 2566587 - RNA, 23 nt, Chlamydophila pneumoniae J138
uguccaugcacgagauucuugag

SEQ ID NO: 2566588 - RNA, 16 nt, Chlamydophila pneumoniae J138
uguccuccgagaaaau

SEQ ID NO: 2566589 - RNA, 13 nt, Chlamydophila pneumoniae J138
uguccuugcagcc

SEQ ID NO: 2566590 - RNA, 12 nt, Chlamydophila pneumoniae J138
ugucgcaaaugc

SEQ ID NO: 2566591 - RNA, 13 nt, Chlamydophila pneumoniae J138
ugucgcaaaugca

SEQ ID NO: 2566592 - RNA, 17 nt, Chlamydophila pneumoniae J138
ugucgcuuucauuugua

SEQ ID NO: 2566593 - RNA, 17 nt, Chlamydophila pneumoniae J138
ugucguaauugcugaaa

SEQ ID NO: 2566594 - RNA, 22 nt, Chlamydophila pneumoniae J138
ugucuacagaggaaucuauccu

SEQ ID NO: 2566595 - RNA, 16 nt, Chlamydophila pneumoniae J138
ugucugaguuagcuuu

SEQ ID NO: 2566596 - RNA, 20 nt, Chlamydophila pneumoniae J138
ugucugauuaguucucuaag

SEQ ID NO: 2566597 - RNA, 22 nt, Chlamydophila pneumoniae J138
ugucuuccacgaaggaaucuga

SEQ ID NO: 2566598 - RNA, 23 nt, Chlamydophila pneumoniae J138
ugucuugcuuugugaguucuucc

SEQ ID NO: 2566599 - RNA, 17 nt, Chlamydophila pneumoniae J138
ugugaaaauuuucuugc

SEQ ID NO: 2566600 - RNA, 14 nt, Chlamydophila pneumoniae J138
ugugaguucuuccu

SEQ ID NO: 2566601 - RNA, 19 nt, Chlamydophila pneumoniae J138
ugugauccuugcaaaacag

SEQ ID NO: 2566602 - RNA, 15 nt, Chlamydophila pneumoniae J138
ugugauguucugcug

SEQ ID NO: 2566603 - RNA, 16 nt, Chlamydophila pneumoniae J138
ugugauguucugcugc

SEQ ID NO: 2566604 - RNA, 20 nt, Chlamydophila pneumoniae J138
ugugcagaagguuccacaga

SEQ ID NO: 2566605 - RNA, 20 nt, Chlamydophila pneumoniae J138
ugugcaucuauaauuaaucc

SEQ ID NO: 2566606 - RNA, 13 nt, Chlamydophila pneumoniae J138
ugugcaugcaucu

SEQ ID NO: 2566607 - RNA, 15 nt, Chlamydophila pneumoniae J138
ugugcaugcaucuua

SEQ ID NO: 2566608 - RNA, 23 nt, Chlamydophila pneumoniae J138
ugugcauuuucuucuugcaaucu

SEQ ID NO: 2566609 - RNA, 15 nt, Chlamydophila pneumoniae J138
ugugccaauuuuugu

SEQ ID NO: 2566610 - RNA, 18 nt, Chlamydophila pneumoniae J138
ugugcugaagaccaugaa

SEQ ID NO: 2566611 - RNA, 15 nt, Chlamydophila pneumoniae J138
ugugcuuuugguucu

SEQ ID NO: 2566612 - RNA, 21 nt, Chlamydophila pneumoniae J138
uguggguaaugccaauauggu

SEQ ID NO: 2566613 - RNA, 22 nt, Chlamydophila pneumoniae J138
ugugguaaaaauauaggcugca

SEQ ID NO: 2566614 - RNA, 14 nt, Chlamydophila pneumoniae J138
uguggucuuccgua

SEQ ID NO: 2566615 - RNA, 19 nt, Chlamydophila pneumoniae J138
uguggugaggagcuauuaa

SEQ ID NO: 2566616 - RNA, 15 nt, Chlamydophila pneumoniae J138
ugugguuagaggaag

SEQ ID NO: 2566617 - RNA, 13 nt, Chlamydophila pneumoniae J138
uguguaaugagcu

SEQ ID NO: 2566618 - RNA, 14 nt, Chlamydophila pneumoniae J138
uguguauuugcaga

SEQ ID NO: 2566619 - RNA, 13 nt, Chlamydophila pneumoniae J138
ugugucuuaaagc

SEQ ID NO: 2566620 - RNA, 18 nt, Chlamydophila pneumoniae J138
ugugugacgacaaaucac

SEQ ID NO: 2566621 - RNA, 21 nt, Chlamydophila pneumoniae J138
ugugugacgacaaaucacgac

SEQ ID NO: 2566622 - RNA, 22 nt, Chlamydophila pneumoniae J138
uguguuauggaaaucaccagca

SEQ ID NO: 2566623 - RNA, 23 nt, Chlamydophila pneumoniae J138
uguuaaguucauaaccugggcaa

SEQ ID NO: 2566624 - RNA, 13 nt, Chlamydophila pneumoniae J138
uguuaaucuaauu

SEQ ID NO: 2566625 - RNA, 14 nt, Chlamydophila pneumoniae J138
uguuaaucuaauuu

SEQ ID NO: 2566626 - RNA, 22 nt, Chlamydophila pneumoniae J138
uguuagcaucgcuuaacaaacu

SEQ ID NO: 2566627 - RNA, 20 nt, Chlamydophila pneumoniae J138
uguuagugagaucaaaaaua

SEQ ID NO: 2566628 - RNA, 15 nt, Chlamydophila pneumoniae J138
uguuaugaguuuuua

SEQ ID NO: 2566629 - RNA, 14 nt, Chlamydophila pneumoniae J138
uguuauuguuucua

SEQ ID NO: 2566630 - RNA, 12 nt, Chlamydophila pneumoniae J138
uguucaaagauu

SEQ ID NO: 2566631 - RNA, 13 nt, Chlamydophila pneumoniae J138
uguucagcuagag

SEQ ID NO: 2566632 - RNA, 13 nt, Chlamydophila pneumoniae J138
uguucauaaucag

SEQ ID NO: 2566633 - RNA, 17 nt, Chlamydophila pneumoniae J138
uguucauccagaaguau

SEQ ID NO: 2566634 - RNA, 13 nt, Chlamydophila pneumoniae J138
uguuccacuugcu

SEQ ID NO: 2566635 - RNA, 16 nt, Chlamydophila pneumoniae J138
uguuccauaauuuuag

SEQ ID NO: 2566636 - RNA, 15 nt, Chlamydophila pneumoniae J138
uguucucgcaaugcu

SEQ ID NO: 2566637 - RNA, 11 nt, Chlamydophila pneumoniae J138
uguucugcugc

SEQ ID NO: 2566638 - RNA, 14 nt, Chlamydophila pneumoniae J138
uguugaauaagauu

SEQ ID NO: 2566639 - RNA, 16 nt, Chlamydophila pneumoniae J138
uguugauaauuacaga

SEQ ID NO: 2566640 - RNA, 19 nt, Chlamydophila pneumoniae J138
uguugauccuucuuauggu

SEQ ID NO: 2566641 - RNA, 13 nt, Chlamydophila pneumoniae J138
uguugauuuccaa

SEQ ID NO: 2566642 - RNA, 21 nt, Chlamydophila pneumoniae J138
uguugcaauagcaauggcuuu

SEQ ID NO: 2566643 - RNA, 22 nt, Chlamydophila pneumoniae J138
uguugcaauucuucaugcugcu

SEQ ID NO: 2566644 - RNA, 20 nt, Chlamydophila pneumoniae J138
uguugcccuacaauuuccuu

SEQ ID NO: 2566645 - RNA, 20 nt, Chlamydophila pneumoniae J138
uguuggaauugcauuaagau

SEQ ID NO: 2566646 - RNA, 13 nt, Chlamydophila pneumoniae J138
uguugggagcuuc

SEQ ID NO: 2566647 - RNA, 12 nt, Chlamydophila pneumoniae J138
uguuggguugug

SEQ ID NO: 2566648 - RNA, 22 nt, Chlamydophila pneumoniae J138
uguuguaacgggagcguuuuuu

SEQ ID NO: 2566649 - RNA, 13 nt, Chlamydophila pneumoniae J138
uguuguaauaaaa

SEQ ID NO: 2566650 - RNA, 16 nt, Chlamydophila pneumoniae J138
uguuguaauaaaauca

SEQ ID NO: 2566651 - RNA, 17 nt, Chlamydophila pneumoniae J138
uguuguauggcagccug

SEQ ID NO: 2566652 - RNA, 13 nt, Chlamydophila pneumoniae J138
uguugucacuaag

SEQ ID NO: 2566653 - RNA, 14 nt, Chlamydophila pneumoniae J138
uguuuaaguccuuc

SEQ ID NO: 2566654 - RNA, 19 nt, Chlamydophila pneumoniae J138
uguuuaaguccuucuuccc

SEQ ID NO: 2566655 - RNA, 13 nt, Chlamydophila pneumoniae J138
uguuuacagaugc

SEQ ID NO: 2566656 - RNA, 22 nt, Chlamydophila pneumoniae J138
uguuuagaauuuguccuuugcu

SEQ ID NO: 2566657 - RNA, 17 nt, Chlamydophila pneumoniae J138
uguuuaucgacucuucc

SEQ ID NO: 2566658 - RNA, 12 nt, Chlamydophila pneumoniae J138
uguuuauuuagc

SEQ ID NO: 2566659 - RNA, 20 nt, Chlamydophila pneumoniae J138
uguuuccuucgaagcggagc

SEQ ID NO: 2566660 - RNA, 15 nt, Chlamydophila pneumoniae J138
uguuucgaaaguugg

SEQ ID NO: 2566661 - RNA, 24 nt, Chlamydophila pneumoniae J138
uguuucuagaaaaucucuaagaau

SEQ ID NO: 2566662 - RNA, 23 nt, Chlamydophila pneumoniae J138
uguuucuaugugaugucgcgaaa

SEQ ID NO: 2566663 - RNA, 19 nt, Chlamydophila pneumoniae J138
uguuugaaaauauccuaaa

SEQ ID NO: 2566664 - RNA, 16 nt, Chlamydophila pneumoniae J138
uguuugcaugcggcuc

SEQ ID NO: 2566665 - RNA, 18 nt, Chlamydophila pneumoniae J138
uguuugcaugcggcuccu

SEQ ID NO: 2566666 - RNA, 15 nt, Chlamydophila pneumoniae J138
uguuugcuauacaga

SEQ ID NO: 2566667 - RNA, 13 nt, Chlamydophila pneumoniae J138
uguuuguccuagg

SEQ ID NO: 2566668 - RNA, 17 nt, Chlamydophila pneumoniae J138
uguuuuauccaccaaga

SEQ ID NO: 2566669 - RNA, 22 nt, Chlamydophila pneumoniae J138
uguuuucacauggccaaaaauc

SEQ ID NO: 2566670 - RNA, 16 nt, Chlamydophila pneumoniae J138
uguuuuccagaaaucu

SEQ ID NO: 2566671 - RNA, 12 nt, Chlamydophila pneumoniae J138
uguuuucuucua

SEQ ID NO: 2566672 - RNA, 13 nt, Chlamydophila pneumoniae J138
uguuuuuaggagu

SEQ ID NO: 2566673 - RNA, 13 nt, Chlamydophila pneumoniae J138
uguuuuucaauuu

SEQ ID NO: 2566674 - RNA, 17 nt, Chlamydophila pneumoniae J138
uguuuuucuaaaaugcu

SEQ ID NO: 2566675 - RNA, 14 nt, Chlamydophila pneumoniae J138
uguuuuuucuucug

SEQ ID NO: 2566676 - RNA, 18 nt, Chlamydophila pneumoniae J138
uguuuuuugaaaacuuca

SEQ ID NO: 2566677 - RNA, 13 nt, Chlamydophila pneumoniae J138
uguuuuuugagau

SEQ ID NO: 2566678 - RNA, 22 nt, Chlamydophila pneumoniae J138
uuaaaaaacuuccuaacuaucu

SEQ ID NO: 2566679 - RNA, 19 nt, Chlamydophila pneumoniae J138
uuaaaaauauaucuucaga

SEQ ID NO: 2566680 - RNA, 22 nt, Chlamydophila pneumoniae J138
uuaaaagcauaguguauaucag

SEQ ID NO: 2566681 - RNA, 18 nt, Chlamydophila pneumoniae J138
uuaaaauuucugggcuaa

SEQ ID NO: 2566682 - RNA, 14 nt, Chlamydophila pneumoniae J138
uuaaacagaucuuu

SEQ ID NO: 2566683 - RNA, 17 nt, Chlamydophila pneumoniae J138
uuaaacagaucuuuauc

SEQ ID NO: 2566684 - RNA, 20 nt, Chlamydophila pneumoniae J138
uuaaacccaauucuuaaaaa

SEQ ID NO: 2566685 - RNA, 16 nt, Chlamydophila pneumoniae J138
uuaaacccuucaagca

SEQ ID NO: 2566686 - RNA, 21 nt, Chlamydophila pneumoniae J138
uuaaacucugacgucuccaac

SEQ ID NO: 2566687 - RNA, 22 nt, Chlamydophila pneumoniae J138
uuaaacucugacgucuccaaca

SEQ ID NO: 2566688 - RNA, 23 nt, Chlamydophila pneumoniae J138
uuaaacuuucuucucuaggaaga

SEQ ID NO: 2566689 - RNA, 15 nt, Chlamydophila pneumoniae J138
uuaaaguaaaaaaua

SEQ ID NO: 2566690 - RNA, 19 nt, Chlamydophila pneumoniae J138
uuaaaguaaaaaauacagg

SEQ ID NO: 2566691 - RNA, 14 nt, Chlamydophila pneumoniae J138
uuaaauaaaaccac

SEQ ID NO: 2566692 - RNA, 12 nt, Chlamydophila pneumoniae J138
uuaaauacagau

SEQ ID NO: 2566693 - RNA, 16 nt, Chlamydophila pneumoniae J138
uuaaauauauaaagaa

SEQ ID NO: 2566694 - RNA, 17 nt, Chlamydophila pneumoniae J138
uuaaauaucuaauaaaa

SEQ ID NO: 2566695 - RNA, 16 nt, Chlamydophila pneumoniae J138
uuaaauguauugcaaa

SEQ ID NO: 2566696 - RNA, 13 nt, Chlamydophila pneumoniae J138
uuaacaaacuugu

SEQ ID NO: 2566697 - RNA, 13 nt, Chlamydophila pneumoniae J138
uuaacaacaugcg

SEQ ID NO: 2566698 - RNA, 23 nt, Chlamydophila pneumoniae J138
uuaacaacuagguuauuaucaaa

SEQ ID NO: 2566699 - RNA, 18 nt, Chlamydophila pneumoniae J138
uuaacaaguaccaagaaa

SEQ ID NO: 2566700 - RNA, 18 nt, Chlamydophila pneumoniae J138
uuaacccgcuugcaucuu

SEQ ID NO: 2566701 - RNA, 15 nt, Chlamydophila pneumoniae J138
uuaaccucuuuucuu

SEQ ID NO: 2566702 - RNA, 13 nt, Chlamydophila pneumoniae J138
uuaacguuucuuc

SEQ ID NO: 2566703 - RNA, 21 nt, Chlamydophila pneumoniae J138
uuaacuguguaugaaucacau

SEQ ID NO: 2566704 - RNA, 13 nt, Chlamydophila pneumoniae J138
uuaagaacaucuu

SEQ ID NO: 2566705 - RNA, 16 nt, Chlamydophila pneumoniae J138
uuaagaagaagaaaaa

SEQ ID NO: 2566706 - RNA, 21 nt, Chlamydophila pneumoniae J138
uuaagaagcacuucuuuagga

SEQ ID NO: 2566707 - RNA, 21 nt, Chlamydophila pneumoniae J138
uuaagacucaauacuucagga

SEQ ID NO: 2566708 - RNA, 14 nt, Chlamydophila pneumoniae J138
uuaagaggaaagca

SEQ ID NO: 2566709 - RNA, 15 nt, Chlamydophila pneumoniae J138
uuaagauaaacauua

SEQ ID NO: 2566710 - RNA, 20 nt, Chlamydophila pneumoniae J138
uuaagauaaacauuaaguga

SEQ ID NO: 2566711 - RNA, 18 nt, Chlamydophila pneumoniae J138
uuaagauagacucucacu

SEQ ID NO: 2566712 - RNA, 13 nt, Chlamydophila pneumoniae J138
uuaagaucucuuu

SEQ ID NO: 2566713 - RNA, 22 nt, Chlamydophila pneumoniae J138
uuaagcucuaaguccaacauca

SEQ ID NO: 2566714 - RNA, 16 nt, Chlamydophila pneumoniae J138
uuaaggaucccaucau

SEQ ID NO: 2566715 - RNA, 13 nt, Chlamydophila pneumoniae J138
uuaagguugcuuu

SEQ ID NO: 2566716 - RNA, 17 nt, Chlamydophila pneumoniae J138
uuaagguugcuuuucua

SEQ ID NO: 2566717 - RNA, 17 nt, Chlamydophila pneumoniae J138
uuaagugcuuuuagauc

SEQ ID NO: 2566718 - RNA, 17 nt, Chlamydophila pneumoniae J138
uuaaguguuucuucaua

SEQ ID NO: 2566719 - RNA, 18 nt, Chlamydophila pneumoniae J138
uuaaguugaccuuuuuca

SEQ ID NO: 2566720 - RNA, 13 nt, Chlamydophila pneumoniae J138
uuaauaaaauuua

SEQ ID NO: 2566721 - RNA, 19 nt, Chlamydophila pneumoniae J138
uuaauaagaaccucuaauu

SEQ ID NO: 2566722 - RNA, 14 nt, Chlamydophila pneumoniae J138
uuaauaauguuuua

SEQ ID NO: 2566723 - RNA, 14 nt, Chlamydophila pneumoniae J138
uuaauauaaaagaa

SEQ ID NO: 2566724 - RNA, 16 nt, Chlamydophila pneumoniae J138
uuaauauaaaagaaga

SEQ ID NO: 2566725 - RNA, 16 nt, Chlamydophila pneumoniae J138
uuaauauuugagaaga

SEQ ID NO: 2566726 - RNA, 12 nt, Chlamydophila pneumoniae J138
uuaaucaauccu

SEQ ID NO: 2566727 - RNA, 15 nt, Chlamydophila pneumoniae J138
uuaaugaacucaggc

SEQ ID NO: 2566728 - RNA, 21 nt, Chlamydophila pneumoniae J138
uuaaugcaagcaacucuucag

SEQ ID NO: 2566729 - RNA, 17 nt, Chlamydophila pneumoniae J138
uuaaugguagcuuaaga

SEQ ID NO: 2566730 - RNA, 24 nt, Chlamydophila pneumoniae J138
uuaauuccaacuacauaauaagca

SEQ ID NO: 2566731 - RNA, 13 nt, Chlamydophila pneumoniae J138
uuaauuccuugga

SEQ ID NO: 2566732 - RNA, 14 nt, Chlamydophila pneumoniae J138
uuaauuccuuggau

SEQ ID NO: 2566733 - RNA, 10 nt, Chlamydophila pneumoniae J138
uuaauucucu

SEQ ID NO: 2566734 - RNA, 16 nt, Chlamydophila pneumoniae J138
uuaauuguagagagaa

SEQ ID NO: 2566735 - RNA, 18 nt, Chlamydophila pneumoniae J138
uuaauuuuugcuaaacaa

SEQ ID NO: 2566736 - RNA, 15 nt, Chlamydophila pneumoniae J138
uuacaagcuuccuug

SEQ ID NO: 2566737 - RNA, 18 nt, Chlamydophila pneumoniae J138
uuacaauuuaaaucugca

SEQ ID NO: 2566738 - RNA, 19 nt, Chlamydophila pneumoniae J138
uuacaauuuaaaucugcaa

SEQ ID NO: 2566739 - RNA, 19 nt, Chlamydophila pneumoniae J138
uuacaauuuuagauacgcu

SEQ ID NO: 2566740 - RNA, 14 nt, Chlamydophila pneumoniae J138
uuacacaacucuuu

SEQ ID NO: 2566741 - RNA, 19 nt, Chlamydophila pneumoniae J138
uuacacugcuucaaaacau

SEQ ID NO: 2566742 - RNA, 14 nt, Chlamydophila pneumoniae J138
uuacagaucugcau

SEQ ID NO: 2566743 - RNA, 16 nt, Chlamydophila pneumoniae J138
uuacagaucugcauaa

SEQ ID NO: 2566744 - RNA, 18 nt, Chlamydophila pneumoniae J138
uuacagcaucuauagaau

SEQ ID NO: 2566745 - RNA, 15 nt, Chlamydophila pneumoniae J138
uuacauguaaacaaa

SEQ ID NO: 2566746 - RNA, 13 nt, Chlamydophila pneumoniae J138
uuaccgaagagcc

SEQ ID NO: 2566747 - RNA, 15 nt, Chlamydophila pneumoniae J138
uuacgaaaacaucug

SEQ ID NO: 2566748 - RNA, 19 nt, Chlamydophila pneumoniae J138
uuacgaaaacaucuguaua

SEQ ID NO: 2566749 - RNA, 14 nt, Chlamydophila pneumoniae J138
uuacgaugagguug

SEQ ID NO: 2566750 - RNA, 15 nt, Chlamydophila pneumoniae J138
uuacgguuucuggga

SEQ ID NO: 2566751 - RNA, 15 nt, Chlamydophila pneumoniae J138
uuacgugagaacuca

SEQ ID NO: 2566752 - RNA, 19 nt, Chlamydophila pneumoniae J138
uuacuaaaggugaaaguac

SEQ ID NO: 2566753 - RNA, 16 nt, Chlamydophila pneumoniae J138
uuacuaggaaggaaau

SEQ ID NO: 2566754 - RNA, 17 nt, Chlamydophila pneumoniae J138
uuacuaggaaggaaauc

SEQ ID NO: 2566755 - RNA, 20 nt, Chlamydophila pneumoniae J138
uuacuaggaaggaaaucaca

SEQ ID NO: 2566756 - RNA, 12 nt, Chlamydophila pneumoniae J138
uuacugaggaaa

SEQ ID NO: 2566757 - RNA, 21 nt, Chlamydophila pneumoniae J138
uuacugugguauacaucccau

SEQ ID NO: 2566758 - RNA, 16 nt, Chlamydophila pneumoniae J138
uuacuucaagaaaaac

SEQ ID NO: 2566759 - RNA, 16 nt, Chlamydophila pneumoniae J138
uuacuucacguugcaa

SEQ ID NO: 2566760 - RNA, 22 nt, Chlamydophila pneumoniae J138
uuacuugcgauacaauaaacaa

SEQ ID NO: 2566761 - RNA, 18 nt, Chlamydophila pneumoniae J138
uuacuuuaaucaagccua

SEQ ID NO: 2566762 - RNA, 20 nt, Chlamydophila pneumoniae J138
uuagaaaagauaaaacauuc

SEQ ID NO: 2566763 - RNA, 18 nt, Chlamydophila pneumoniae J138
uuagaaaccaugaugcaa

SEQ ID NO: 2566764 - RNA, 14 nt, Chlamydophila pneumoniae J138
uuagaacuauagga

SEQ ID NO: 2566765 - RNA, 12 nt, Chlamydophila pneumoniae J138
uuagaagagaaa

SEQ ID NO: 2566766 - RNA, 15 nt, Chlamydophila pneumoniae J138
uuagaagggagguuu

SEQ ID NO: 2566767 - RNA, 20 nt, Chlamydophila pneumoniae J138
uuagaauagaagauccucaa

SEQ ID NO: 2566768 - RNA, 22 nt, Chlamydophila pneumoniae J138
uuagaaucaaaagucaugagga

SEQ ID NO: 2566769 - RNA, 12 nt, Chlamydophila pneumoniae J138
uuagaauccucu

SEQ ID NO: 2566770 - RNA, 19 nt, Chlamydophila pneumoniae J138
uuagaauccugaucuguag

SEQ ID NO: 2566771 - RNA, 16 nt, Chlamydophila pneumoniae J138
uuagaaucuuuucuag

SEQ ID NO: 2566772 - RNA, 21 nt, Chlamydophila pneumoniae J138
uuagacaagacaccgaaagaa

SEQ ID NO: 2566773 - RNA, 18 nt, Chlamydophila pneumoniae J138
uuagacgaggagaagucg

SEQ ID NO: 2566774 - RNA, 15 nt, Chlamydophila pneumoniae J138
uuagagaaaucugca

SEQ ID NO: 2566775 - RNA, 17 nt, Chlamydophila pneumoniae J138
uuagagaaauuuuuaau

SEQ ID NO: 2566776 - RNA, 23 nt, Chlamydophila pneumoniae J138
uuagagaagagguguccauaaug

SEQ ID NO: 2566777 - RNA, 14 nt, Chlamydophila pneumoniae J138
uuagaggagacucu

SEQ ID NO: 2566778 - RNA, 13 nt, Chlamydophila pneumoniae J138
uuagagucugcag

SEQ ID NO: 2566779 - RNA, 20 nt, Chlamydophila pneumoniae J138
uuagauacgcuuacaaauaa

SEQ ID NO: 2566780 - RNA, 12 nt, Chlamydophila pneumoniae J138
uuagauuuccuc

SEQ ID NO: 2566781 - RNA, 16 nt, Chlamydophila pneumoniae J138
uuagcaaacauuuuua

SEQ ID NO: 2566782 - RNA, 14 nt, Chlamydophila pneumoniae J138
uuagcaagagcucu

SEQ ID NO: 2566783 - RNA, 15 nt, Chlamydophila pneumoniae J138
uuagcaagagcucuu

SEQ ID NO: 2566784 - RNA, 13 nt, Chlamydophila pneumoniae J138
uuagcaaugaagg

SEQ ID NO: 2566785 - RNA, 14 nt, Chlamydophila pneumoniae J138
uuagcauagagcuc

SEQ ID NO: 2566786 - RNA, 20 nt, Chlamydophila pneumoniae J138
uuagcaucgcuuaacaaacu

SEQ ID NO: 2566787 - RNA, 15 nt, Chlamydophila pneumoniae J138
uuagcauuaggaaag

SEQ ID NO: 2566788 - RNA, 20 nt, Chlamydophila pneumoniae J138
uuagccauggcaucuaagcc

SEQ ID NO: 2566789 - RNA, 18 nt, Chlamydophila pneumoniae J138
uuagccuggcuaaaggau

SEQ ID NO: 2566790 - RNA, 20 nt, Chlamydophila pneumoniae J138
uuagcuucuuuuuuuuucuu

SEQ ID NO: 2566791 - RNA, 17 nt, Chlamydophila pneumoniae J138
uuaggagcauagacucu

SEQ ID NO: 2566792 - RNA, 20 nt, Chlamydophila pneumoniae J138
uuaggaggaguauagcauga

SEQ ID NO: 2566793 - RNA, 19 nt, Chlamydophila pneumoniae J138
uuagggaagacgauaccgc

SEQ ID NO: 2566794 - RNA, 12 nt, Chlamydophila pneumoniae J138
uuaguaaagaau

SEQ ID NO: 2566795 - RNA, 13 nt, Chlamydophila pneumoniae J138
uuaguagcuauuc

SEQ ID NO: 2566796 - RNA, 18 nt, Chlamydophila pneumoniae J138
uuaguagcuauucucaaa

SEQ ID NO: 2566797 - RNA, 19 nt, Chlamydophila pneumoniae J138
uuaguauacuaagacuguc

SEQ ID NO: 2566798 - RNA, 13 nt, Chlamydophila pneumoniae J138
uuagugcuucaga

SEQ ID NO: 2566799 - RNA, 21 nt, Chlamydophila pneumoniae J138
uuaguggaaauugugaaaaaa

SEQ ID NO: 2566800 - RNA, 18 nt, Chlamydophila pneumoniae J138
uuaguuaacuccuucaau

SEQ ID NO: 2566801 - RNA, 19 nt, Chlamydophila pneumoniae J138
uuaguuuaccugaaaaaac

SEQ ID NO: 2566802 - RNA, 19 nt, Chlamydophila pneumoniae J138
uuaguuuuucuagcuuccu

SEQ ID NO: 2566803 - RNA, 14 nt, Chlamydophila pneumoniae J138
uuaguuuuuucuaa

SEQ ID NO: 2566804 - RNA, 14 nt, Chlamydophila pneumoniae J138
uuauaaacuucaau

SEQ ID NO: 2566805 - RNA, 22 nt, Chlamydophila pneumoniae J138
uuauaaacuucaaugaagaaaa

SEQ ID NO: 2566806 - RNA, 22 nt, Chlamydophila pneumoniae J138
uuauaaagaucgggucuacaac

SEQ ID NO: 2566807 - RNA, 18 nt, Chlamydophila pneumoniae J138
uuauaacaucaagaauuu

SEQ ID NO: 2566808 - RNA, 23 nt, Chlamydophila pneumoniae J138
uuauacccacaaagaucacugag

SEQ ID NO: 2566809 - RNA, 16 nt, Chlamydophila pneumoniae J138
uuauacuguuuuucuu

SEQ ID NO: 2566810 - RNA, 18 nt, Chlamydophila pneumoniae J138
uuauacuuuuuuuauaua

SEQ ID NO: 2566811 - RNA, 22 nt, Chlamydophila pneumoniae J138
uuauagauagggccgugaagca

SEQ ID NO: 2566812 - RNA, 17 nt, Chlamydophila pneumoniae J138
uuauaggaauaacacca

SEQ ID NO: 2566813 - RNA, 20 nt, Chlamydophila pneumoniae J138
uuauaggaauaacaccaaaa

SEQ ID NO: 2566814 - RNA, 20 nt, Chlamydophila pneumoniae J138
uuauaguagcgaauccagaa

SEQ ID NO: 2566815 - RNA, 20 nt, Chlamydophila pneumoniae J138
uuauauagacaaugcaaccu

SEQ ID NO: 2566816 - RNA, 20 nt, Chlamydophila pneumoniae J138
uuaucaaaagguuuuauaaa

SEQ ID NO: 2566817 - RNA, 15 nt, Chlamydophila pneumoniae J138
uuaucaaagugaacg

SEQ ID NO: 2566818 - RNA, 20 nt, Chlamydophila pneumoniae J138
uuaucaggaacuaaaaguuu

SEQ ID NO: 2566819 - RNA, 15 nt, Chlamydophila pneumoniae J138
uuaucauagauguca

SEQ ID NO: 2566820 - RNA, 18 nt, Chlamydophila pneumoniae J138
uuaucaugagaauuuuca

SEQ ID NO: 2566821 - RNA, 19 nt, Chlamydophila pneumoniae J138
uuauccuugaaauugcucu

SEQ ID NO: 2566822 - RNA, 23 nt, Chlamydophila pneumoniae J138
uuaucgauaauaaaagcacccuc

SEQ ID NO: 2566823 - RNA, 13 nt, Chlamydophila pneumoniae J138
uuaucuaaagaaa

SEQ ID NO: 2566824 - RNA, 16 nt, Chlamydophila pneumoniae J138
uuaucuaagacuucug

SEQ ID NO: 2566825 - RNA, 19 nt, Chlamydophila pneumoniae J138
uuaucuagcucuucaaggu

SEQ ID NO: 2566826 - RNA, 15 nt, Chlamydophila pneumoniae J138
uuaucuccaaagauc

SEQ ID NO: 2566827 - RNA, 18 nt, Chlamydophila pneumoniae J138
uuaucuuagggaaucucu

SEQ ID NO: 2566828 - RNA, 18 nt, Chlamydophila pneumoniae J138
uuaucuucuaaaacuuca

SEQ ID NO: 2566829 - RNA, 13 nt, Chlamydophila pneumoniae J138
uuaugaccaagaa

SEQ ID NO: 2566830 - RNA, 12 nt, Chlamydophila pneumoniae J138
uuauuacagaaa

SEQ ID NO: 2566831 - RNA, 19 nt, Chlamydophila pneumoniae J138
uuauuauguagaucauaaa

SEQ ID NO: 2566832 - RNA, 14 nt, Chlamydophila pneumoniae J138
uuauuauugaauaa

SEQ ID NO: 2566833 - RNA, 15 nt, Chlamydophila pneumoniae J138
uuauucccaagaacu

SEQ ID NO: 2566834 - RNA, 12 nt, Chlamydophila pneumoniae J138
uuauucuuaaug

SEQ ID NO: 2566835 - RNA, 16 nt, Chlamydophila pneumoniae J138
uuauugaauaagcuuu

SEQ ID NO: 2566836 - RNA, 19 nt, Chlamydophila pneumoniae J138
uuauugaauaagcuuuccu

SEQ ID NO: 2566837 - RNA, 23 nt, Chlamydophila pneumoniae J138
uuauuguagagaguauuuacaag

SEQ ID NO: 2566838 - RNA, 12 nt, Chlamydophila pneumoniae J138
uuauuuaaaauu

SEQ ID NO: 2566839 - RNA, 18 nt, Chlamydophila pneumoniae J138
uuauuuguuucuuccaua

SEQ ID NO: 2566840 - RNA, 22 nt, Chlamydophila pneumoniae J138
uuauuuguuucuuccauacagg

SEQ ID NO: 2566841 - RNA, 15 nt, Chlamydophila pneumoniae J138
uuauuuucuacacug

SEQ ID NO: 2566842 - RNA, 13 nt, Chlamydophila pneumoniae J138
uuauuuucuggug

SEQ ID NO: 2566843 - RNA, 13 nt, Chlamydophila pneumoniae J138
uuauuuuuaaaua

SEQ ID NO: 2566844 - RNA, 15 nt, Chlamydophila pneumoniae J138
uucaaaaagagagcc

SEQ ID NO: 2566845 - RNA, 15 nt, Chlamydophila pneumoniae J138
uucaaaagaaaucaa

SEQ ID NO: 2566846 - RNA, 18 nt, Chlamydophila pneumoniae J138
uucaaaagaaaucaaaca

SEQ ID NO: 2566847 - RNA, 22 nt, Chlamydophila pneumoniae J138
uucaaaagaaaucaaacauuac

SEQ ID NO: 2566848 - RNA, 20 nt, Chlamydophila pneumoniae J138
uucaaacugauuaguuuguu

SEQ ID NO: 2566849 - RNA, 13 nt, Chlamydophila pneumoniae J138
uucaaagaagucg

SEQ ID NO: 2566850 - RNA, 15 nt, Chlamydophila pneumoniae J138
uucaaaucaucaaaa

SEQ ID NO: 2566851 - RNA, 21 nt, Chlamydophila pneumoniae J138
uucaaauuugcucuccugcaa

SEQ ID NO: 2566852 - RNA, 20 nt, Chlamydophila pneumoniae J138
uucaacaaaggcuccaaacg

SEQ ID NO: 2566853 - RNA, 19 nt, Chlamydophila pneumoniae J138
uucaacauaacaugagaaa

SEQ ID NO: 2566854 - RNA, 11 nt, Chlamydophila pneumoniae J138
uucaagaaaaa

SEQ ID NO: 2566855 - RNA, 17 nt, Chlamydophila pneumoniae J138
uucaagaugauccgcau

SEQ ID NO: 2566856 - RNA, 21 nt, Chlamydophila pneumoniae J138
uucaagauugugcucaauaca

SEQ ID NO: 2566857 - RNA, 16 nt, Chlamydophila pneumoniae J138
uucaagcaaaucuccg

SEQ ID NO: 2566858 - RNA, 20 nt, Chlamydophila pneumoniae J138
uucaaggaacauuugagcaa

SEQ ID NO: 2566859 - RNA, 21 nt, Chlamydophila pneumoniae J138
uucaagguacugcucaaugac

SEQ ID NO: 2566860 - RNA, 19 nt, Chlamydophila pneumoniae J138
uucaagguacuuuauagaa

SEQ ID NO: 2566861 - RNA, 17 nt, Chlamydophila pneumoniae J138
uucaagucgagaaacaa

SEQ ID NO: 2566862 - RNA, 14 nt, Chlamydophila pneumoniae J138
uucaagucuguaag

SEQ ID NO: 2566863 - RNA, 13 nt, Chlamydophila pneumoniae J138
uucaaguuucuuu

SEQ ID NO: 2566864 - RNA, 20 nt, Chlamydophila pneumoniae J138
uucaauaaccagaagacucc

SEQ ID NO: 2566865 - RNA, 20 nt, Chlamydophila pneumoniae J138
uucaauagguaaggaaacga

SEQ ID NO: 2566866 - RNA, 23 nt, Chlamydophila pneumoniae J138
uucaauccccugcaucucugcau

SEQ ID NO: 2566867 - RNA, 23 nt, Chlamydophila pneumoniae J138
uucaaucucuccuugacaaauaa

SEQ ID NO: 2566868 - RNA, 13 nt, Chlamydophila pneumoniae J138
uucaaugaagaaa

SEQ ID NO: 2566869 - RNA, 15 nt, Chlamydophila pneumoniae J138
uucaaugaagaaaaa

SEQ ID NO: 2566870 - RNA, 20 nt, Chlamydophila pneumoniae J138
uucaaugacuucuggaucuu

SEQ ID NO: 2566871 - RNA, 15 nt, Chlamydophila pneumoniae J138
uucaaugagcaucug

SEQ ID NO: 2566872 - RNA, 14 nt, Chlamydophila pneumoniae J138
uucaaugauguguu

SEQ ID NO: 2566873 - RNA, 15 nt, Chlamydophila pneumoniae J138
uucaaugauguguug

SEQ ID NO: 2566874 - RNA, 17 nt, Chlamydophila pneumoniae J138
uucaauugagacaaaaa

SEQ ID NO: 2566875 - RNA, 18 nt, Chlamydophila pneumoniae J138
uucaauugagacaaaaaa

SEQ ID NO: 2566876 - RNA, 14 nt, Chlamydophila pneumoniae J138
uucaauuguaagca

SEQ ID NO: 2566877 - RNA, 17 nt, Chlamydophila pneumoniae J138
uucaauuuggauuuaug

SEQ ID NO: 2566878 - RNA, 19 nt, Chlamydophila pneumoniae J138
uucacaaagaauucagaga

SEQ ID NO: 2566879 - RNA, 21 nt, Chlamydophila pneumoniae J138
uucacaagcugguagacuucu

SEQ ID NO: 2566880 - RNA, 16 nt, Chlamydophila pneumoniae J138
uucacaagugcauuau

SEQ ID NO: 2566881 - RNA, 16 nt, Chlamydophila pneumoniae J138
uucacaaucuaaauaa

SEQ ID NO: 2566882 - RNA, 16 nt, Chlamydophila pneumoniae J138
uucacaucuuaaaaac

SEQ ID NO: 2566883 - RNA, 22 nt, Chlamydophila pneumoniae J138
uucacaucuuuagaaucaagag

SEQ ID NO: 2566884 - RNA, 14 nt, Chlamydophila pneumoniae J138
uucacaucuuucuc

SEQ ID NO: 2566885 - RNA, 13 nt, Chlamydophila pneumoniae J138
uucaccagaagca

SEQ ID NO: 2566886 - RNA, 16 nt, Chlamydophila pneumoniae J138
uucaccuugaaguuuu

SEQ ID NO: 2566887 - RNA, 21 nt, Chlamydophila pneumoniae J138
uucacgauaucuaccaaaguc

SEQ ID NO: 2566888 - RNA, 19 nt, Chlamydophila pneumoniae J138
uucacuauuaggcuuuuuu

SEQ ID NO: 2566889 - RNA, 23 nt, Chlamydophila pneumoniae J138
uucacucguugccaaucuuucau

SEQ ID NO: 2566890 - RNA, 11 nt, Chlamydophila pneumoniae J138
uucacuucauc

SEQ ID NO: 2566891 - RNA, 19 nt, Chlamydophila pneumoniae J138
uucagaaugcccuuuaggg

SEQ ID NO: 2566892 - RNA, 13 nt, Chlamydophila pneumoniae J138
uucagaauucuca

SEQ ID NO: 2566893 - RNA, 23 nt, Chlamydophila pneumoniae J138
uucagagagaacaggagguguau

SEQ ID NO: 2566894 - RNA, 17 nt, Chlamydophila pneumoniae J138
uucagaggcuagaaaau

SEQ ID NO: 2566895 - RNA, 15 nt, Chlamydophila pneumoniae J138
uucagaugauuuuau

SEQ ID NO: 2566896 - RNA, 19 nt, Chlamydophila pneumoniae J138
uucagaugauuuuaucugc

SEQ ID NO: 2566897 - RNA, 13 nt, Chlamydophila pneumoniae J138
uucagcacugacu

SEQ ID NO: 2566898 - RNA, 18 nt, Chlamydophila pneumoniae J138
uucagcagguucuugaau

SEQ ID NO: 2566899 - RNA, 15 nt, Chlamydophila pneumoniae J138
uucagccgcaucaug

SEQ ID NO: 2566900 - RNA, 14 nt, Chlamydophila pneumoniae J138
uucagccugucuau

SEQ ID NO: 2566901 - RNA, 16 nt, Chlamydophila pneumoniae J138
uucaggacaugccuua

SEQ ID NO: 2566902 - RNA, 21 nt, Chlamydophila pneumoniae J138
uucaggacgcacauuuagaag

SEQ ID NO: 2566903 - RNA, 14 nt, Chlamydophila pneumoniae J138
uucaggauuuagag

SEQ ID NO: 2566904 - RNA, 20 nt, Chlamydophila pneumoniae J138
uucaguuuuaucggcaauug

SEQ ID NO: 2566905 - RNA, 13 nt, Chlamydophila pneumoniae J138
uucauaaauucag

SEQ ID NO: 2566906 - RNA, 21 nt, Chlamydophila pneumoniae J138
uucauaacacccugacaggua

SEQ ID NO: 2566907 - RNA, 17 nt, Chlamydophila pneumoniae J138
uucauaaccaaguaaau

SEQ ID NO: 2566908 - RNA, 20 nt, Chlamydophila pneumoniae J138
uucauaaccaaguaaaucag

SEQ ID NO: 2566909 - RNA, 16 nt, Chlamydophila pneumoniae J138
uucauagcauguucga

SEQ ID NO: 2566910 - RNA, 20 nt, Chlamydophila pneumoniae J138
uucauaugaaugacugcaga

SEQ ID NO: 2566911 - RNA, 14 nt, Chlamydophila pneumoniae J138
uucaucaaaacaua

SEQ ID NO: 2566912 - RNA, 15 nt, Chlamydophila pneumoniae J138
uucaucaaaacauaa

SEQ ID NO: 2566913 - RNA, 19 nt, Chlamydophila pneumoniae J138
uucaucccuacccucauca

SEQ ID NO: 2566914 - RNA, 14 nt, Chlamydophila pneumoniae J138
uucaucgauaggau

SEQ ID NO: 2566915 - RNA, 20 nt, Chlamydophila pneumoniae J138
uucaucgauaggaugacacu

SEQ ID NO: 2566916 - RNA, 14 nt, Chlamydophila pneumoniae J138
uucaucuagaugau

SEQ ID NO: 2566917 - RNA, 20 nt, Chlamydophila pneumoniae J138
uucaucuaggggagcuauua

SEQ ID NO: 2566918 - RNA, 15 nt, Chlamydophila pneumoniae J138
uucaucugucauuaa

SEQ ID NO: 2566919 - RNA, 20 nt, Chlamydophila pneumoniae J138
uucaucugucauuaaaaauu

SEQ ID NO: 2566920 - RNA, 16 nt, Chlamydophila pneumoniae J138
uucaucuucuuucuau

SEQ ID NO: 2566921 - RNA, 19 nt, Chlamydophila pneumoniae J138
uucaugauuccgcaaguaa

SEQ ID NO: 2566922 - RNA, 22 nt, Chlamydophila pneumoniae J138
uucaugauuccgcaaguaauca

SEQ ID NO: 2566923 - RNA, 18 nt, Chlamydophila pneumoniae J138
uucauuccaggauucuau

SEQ ID NO: 2566924 - RNA, 21 nt, Chlamydophila pneumoniae J138
uucauuguagaggucacuaua

SEQ ID NO: 2566925 - RNA, 21 nt, Chlamydophila pneumoniae J138
uucauuuccaaauucuugcau

SEQ ID NO: 2566926 - RNA, 17 nt, Chlamydophila pneumoniae J138
uuccaaaauaaaaggag

SEQ ID NO: 2566927 - RNA, 13 nt, Chlamydophila pneumoniae J138
uuccaaagacuga

SEQ ID NO: 2566928 - RNA, 23 nt, Chlamydophila pneumoniae J138
uuccaaagcuaggcgauaguaaa

SEQ ID NO: 2566929 - RNA, 13 nt, Chlamydophila pneumoniae J138
uuccaacuucaac

SEQ ID NO: 2566930 - RNA, 21 nt, Chlamydophila pneumoniae J138
uuccaacuuuugaagauccug

SEQ ID NO: 2566931 - RNA, 14 nt, Chlamydophila pneumoniae J138
uuccaagaaaaauu

SEQ ID NO: 2566932 - RNA, 18 nt, Chlamydophila pneumoniae J138
uuccaagacaauaaaaaa

SEQ ID NO: 2566933 - RNA, 13 nt, Chlamydophila pneumoniae J138
uuccaagagucuu

SEQ ID NO: 2566934 - RNA, 17 nt, Chlamydophila pneumoniae J138
uuccaagugaucagaaa

SEQ ID NO: 2566935 - RNA, 17 nt, Chlamydophila pneumoniae J138
uuccaauacuaaaacua

SEQ ID NO: 2566936 - RNA, 17 nt, Chlamydophila pneumoniae J138
uuccaauccauucugag

SEQ ID NO: 2566937 - RNA, 20 nt, Chlamydophila pneumoniae J138
uuccaauccauucugagaaa

SEQ ID NO: 2566938 - RNA, 23 nt, Chlamydophila pneumoniae J138
uuccaauccauucugagaaagaa

SEQ ID NO: 2566939 - RNA, 19 nt, Chlamydophila pneumoniae J138
uuccaaugcaugaaucucu

SEQ ID NO: 2566940 - RNA, 16 nt, Chlamydophila pneumoniae J138
uuccaauuguaaauca

SEQ ID NO: 2566941 - RNA, 18 nt, Chlamydophila pneumoniae J138
uuccacagagaccuucuc

SEQ ID NO: 2566942 - RNA, 13 nt, Chlamydophila pneumoniae J138
uuccagaaaucug

SEQ ID NO: 2566943 - RNA, 19 nt, Chlamydophila pneumoniae J138
uuccaggaccaaacuucga

SEQ ID NO: 2566944 - RNA, 22 nt, Chlamydophila pneumoniae J138
uuccauagaguaucuaaaacuu

SEQ ID NO: 2566945 - RNA, 23 nt, Chlamydophila pneumoniae J138
uuccauagccaaggagcuauaga

SEQ ID NO: 2566946 - RNA, 19 nt, Chlamydophila pneumoniae J138
uuccauagguuagaaauga

SEQ ID NO: 2566947 - RNA, 18 nt, Chlamydophila pneumoniae J138
uuccauaucaaagaucug

SEQ ID NO: 2566948 - RNA, 20 nt, Chlamydophila pneumoniae J138
uuccauccugucuauuucuu

SEQ ID NO: 2566949 - RNA, 20 nt, Chlamydophila pneumoniae J138
uuccaucgccgaccaucaua

SEQ ID NO: 2566950 - RNA, 16 nt, Chlamydophila pneumoniae J138
uuccauuuuuccuccu

SEQ ID NO: 2566951 - RNA, 23 nt, Chlamydophila pneumoniae J138
uucccaagcugaaagaaugccau

SEQ ID NO: 2566952 - RNA, 16 nt, Chlamydophila pneumoniae J138
uucccaccauauucuc

SEQ ID NO: 2566953 - RNA, 22 nt, Chlamydophila pneumoniae J138
uucccaucuuguucuaaaauga

SEQ ID NO: 2566954 - RNA, 17 nt, Chlamydophila pneumoniae J138
uuccccaaacuuagcuc

SEQ ID NO: 2566955 - RNA, 17 nt, Chlamydophila pneumoniae J138
uuccccaugaaaauaca

SEQ ID NO: 2566956 - RNA, 18 nt, Chlamydophila pneumoniae J138
uucccccgcguaauagca

SEQ ID NO: 2566957 - RNA, 16 nt, Chlamydophila pneumoniae J138
uuccccuaauagggga

SEQ ID NO: 2566958 - RNA, 15 nt, Chlamydophila pneumoniae J138
uucccuaacaggaaa

SEQ ID NO: 2566959 - RNA, 17 nt, Chlamydophila pneumoniae J138
uucccuaagaguuccaa

SEQ ID NO: 2566960 - RNA, 15 nt, Chlamydophila pneumoniae J138
uucccuauaaagcaa

SEQ ID NO: 2566961 - RNA, 18 nt, Chlamydophila pneumoniae J138
uucccucaugaagaauua

SEQ ID NO: 2566962 - RNA, 16 nt, Chlamydophila pneumoniae J138
uucccuccuuccuuaa

SEQ ID NO: 2566963 - RNA, 12 nt, Chlamydophila pneumoniae J138
uucccucuucuu

SEQ ID NO: 2566964 - RNA, 22 nt, Chlamydophila pneumoniae J138
uucccucuucuuccaauaauuu

SEQ ID NO: 2566965 - RNA, 15 nt, Chlamydophila pneumoniae J138
uucccugacacagag

SEQ ID NO: 2566966 - RNA, 17 nt, Chlamydophila pneumoniae J138
uucccuggaugaacucc

SEQ ID NO: 2566967 - RNA, 18 nt, Chlamydophila pneumoniae J138
uucccuguccgcaauagu

SEQ ID NO: 2566968 - RNA, 12 nt, Chlamydophila pneumoniae J138
uucccuuuaaaa

SEQ ID NO: 2566969 - RNA, 20 nt, Chlamydophila pneumoniae J138
uuccgacccagucaaaauau

SEQ ID NO: 2566970 - RNA, 15 nt, Chlamydophila pneumoniae J138
uuccgcggccaucau

SEQ ID NO: 2566971 - RNA, 24 nt, Chlamydophila pneumoniae J138
uuccggggugcgaccuaggagaaa

SEQ ID NO: 2566972 - RNA, 23 nt, Chlamydophila pneumoniae J138
uuccgugcgauuuccccuucaga

SEQ ID NO: 2566973 - RNA, 22 nt, Chlamydophila pneumoniae J138
uuccuaaacgacguuuaauucc

SEQ ID NO: 2566974 - RNA, 17 nt, Chlamydophila pneumoniae J138
uuccuaaccauugcucu

SEQ ID NO: 2566975 - RNA, 15 nt, Chlamydophila pneumoniae J138
uuccuaacuaucucu

SEQ ID NO: 2566976 - RNA, 13 nt, Chlamydophila pneumoniae J138
uuccuaacuucug

SEQ ID NO: 2566977 - RNA, 16 nt, Chlamydophila pneumoniae J138
uuccuaacuucugaag

SEQ ID NO: 2566978 - RNA, 15 nt, Chlamydophila pneumoniae J138
uuccuaaguuagaga

SEQ ID NO: 2566979 - RNA, 20 nt, Chlamydophila pneumoniae J138
uuccuacaucugugauuaau

SEQ ID NO: 2566980 - RNA, 16 nt, Chlamydophila pneumoniae J138
uuccuacgacaugccu

SEQ ID NO: 2566981 - RNA, 21 nt, Chlamydophila pneumoniae J138
uuccuacgacaugccuaaaua

SEQ ID NO: 2566982 - RNA, 12 nt, Chlamydophila pneumoniae J138
uuccuagagucg

SEQ ID NO: 2566983 - RNA, 21 nt, Chlamydophila pneumoniae J138
uuccuauaugaaugauuucca

SEQ ID NO: 2566984 - RNA, 22 nt, Chlamydophila pneumoniae J138
uuccuauaugaaugauuuccau

SEQ ID NO: 2566985 - RNA, 19 nt, Chlamydophila pneumoniae J138
uuccucauccucaucauca

SEQ ID NO: 2566986 - RNA, 21 nt, Chlamydophila pneumoniae J138
uuccuccgaggagggaaacac

SEQ ID NO: 2566987 - RNA, 22 nt, Chlamydophila pneumoniae J138
uuccucgaguauggcaaauaaa

SEQ ID NO: 2566988 - RNA, 20 nt, Chlamydophila pneumoniae J138
uuccucuaucagggagcgga

SEQ ID NO: 2566989 - RNA, 17 nt, Chlamydophila pneumoniae J138
uuccucucaugaaauuu

SEQ ID NO: 2566990 - RNA, 13 nt, Chlamydophila pneumoniae J138
uuccucuccaaaa

SEQ ID NO: 2566991 - RNA, 24 nt, Chlamydophila pneumoniae J138
uuccucuucaauuucuucaucaau

SEQ ID NO: 2566992 - RNA, 13 nt, Chlamydophila pneumoniae J138
uuccugaaucagc

SEQ ID NO: 2566993 - RNA, 14 nt, Chlamydophila pneumoniae J138
uuccugagcgucgu

SEQ ID NO: 2566994 - RNA, 23 nt, Chlamydophila pneumoniae J138
uuccuguuguacuaucacagcca

SEQ ID NO: 2566995 - RNA, 15 nt, Chlamydophila pneumoniae J138
uuccuuaagucgucc

SEQ ID NO: 2566996 - RNA, 20 nt, Chlamydophila pneumoniae J138
uuccuuacaagcuuccuugg

SEQ ID NO: 2566997 - RNA, 18 nt, Chlamydophila pneumoniae J138
uuccuuagcauuaggaaa

SEQ ID NO: 2566998 - RNA, 18 nt, Chlamydophila pneumoniae J138
uuccuucaaagcuuguuc

SEQ ID NO: 2566999 - RNA, 20 nt, Chlamydophila pneumoniae J138
uuccuucaggauuacggaaa

SEQ ID NO: 2567000 - RNA, 22 nt, Chlamydophila pneumoniae J138
uuccuucuccagagcaagauuu

SEQ ID NO: 2567001 - RNA, 12 nt, Chlamydophila pneumoniae J138
uuccuuuucucc

SEQ ID NO: 2567002 - RNA, 14 nt, Chlamydophila pneumoniae J138
uuccuuuugauaaa

SEQ ID NO: 2567003 - RNA, 17 nt, Chlamydophila pneumoniae J138
uuccuuuuucugcuucu

SEQ ID NO: 2567004 - RNA, 22 nt, Chlamydophila pneumoniae J138
uuccuuuuucugcuucuccaaa

SEQ ID NO: 2567005 - RNA, 16 nt, Chlamydophila pneumoniae J138
uuccuuuuugcauagc

SEQ ID NO: 2567006 - RNA, 18 nt, Chlamydophila pneumoniae J138
uucgaagcgcucuacaaa

SEQ ID NO: 2567007 - RNA, 20 nt, Chlamydophila pneumoniae J138
uucgaaucguuuuuggaaaa

SEQ ID NO: 2567008 - RNA, 21 nt, Chlamydophila pneumoniae J138
uucgacaacaacauaaagaag

SEQ ID NO: 2567009 - RNA, 18 nt, Chlamydophila pneumoniae J138
uucgacaaccaaaacaga

SEQ ID NO: 2567010 - RNA, 21 nt, Chlamydophila pneumoniae J138
uucgacgagaaggaagaagaa

SEQ ID NO: 2567011 - RNA, 19 nt, Chlamydophila pneumoniae J138
uucgacuauaagagguucu

SEQ ID NO: 2567012 - RNA, 20 nt, Chlamydophila pneumoniae J138
uucgauaacacuucuuucuu

SEQ ID NO: 2567013 - RNA, 18 nt, Chlamydophila pneumoniae J138
uucgaugucuuuccaggc

SEQ ID NO: 2567014 - RNA, 21 nt, Chlamydophila pneumoniae J138
uucgauguuaaggcuuccaau

SEQ ID NO: 2567015 - RNA, 17 nt, Chlamydophila pneumoniae J138
uucgauuccaggcucua

SEQ ID NO: 2567016 - RNA, 13 nt, Chlamydophila pneumoniae J138
uucgauuccugag

SEQ ID NO: 2567017 - RNA, 23 nt, Chlamydophila pneumoniae J138
uucgcaaauauaguuuucauaau

SEQ ID NO: 2567018 - RNA, 15 nt, Chlamydophila pneumoniae J138
uucgcaaauuuuucg

SEQ ID NO: 2567019 - RNA, 16 nt, Chlamydophila pneumoniae J138
uucgcacuaauuuccu

SEQ ID NO: 2567020 - RNA, 20 nt, Chlamydophila pneumoniae J138
uucgcacuaauuuccuucag

SEQ ID NO: 2567021 - RNA, 19 nt, Chlamydophila pneumoniae J138
uucgccuuggguuugucuc

SEQ ID NO: 2567022 - RNA, 19 nt, Chlamydophila pneumoniae J138
uucggaguuggaucaagga

SEQ ID NO: 2567023 - RNA, 19 nt, Chlamydophila pneumoniae J138
uucguaacgcuuuucuaau

SEQ ID NO: 2567024 - RNA, 23 nt, Chlamydophila pneumoniae J138
uucguaagcugagguagcaucuc

SEQ ID NO: 2567025 - RNA, 22 nt, Chlamydophila pneumoniae J138
uucguacaguuuuuuucuaaau

SEQ ID NO: 2567026 - RNA, 22 nt, Chlamydophila pneumoniae J138
uucguagacgcucuaaacucuc

SEQ ID NO: 2567027 - RNA, 23 nt, Chlamydophila pneumoniae J138
uucguauagagcgguucuuucua

SEQ ID NO: 2567028 - RNA, 17 nt, Chlamydophila pneumoniae J138
uucguauagcuggcaau

SEQ ID NO: 2567029 - RNA, 18 nt, Chlamydophila pneumoniae J138
uucguauagcuggcaaug

SEQ ID NO: 2567030 - RNA, 15 nt, Chlamydophila pneumoniae J138
uucgucgucauccca

SEQ ID NO: 2567031 - RNA, 16 nt, Chlamydophila pneumoniae J138
uucgucuaaaauaacc

SEQ ID NO: 2567032 - RNA, 13 nt, Chlamydophila pneumoniae J138
uucgucuucauaa

SEQ ID NO: 2567033 - RNA, 15 nt, Chlamydophila pneumoniae J138
uucgugagagcguug

SEQ ID NO: 2567034 - RNA, 19 nt, Chlamydophila pneumoniae J138
uucgugagcgaguaccuca

SEQ ID NO: 2567035 - RNA, 18 nt, Chlamydophila pneumoniae J138
uucguggaacuuucuggg

SEQ ID NO: 2567036 - RNA, 16 nt, Chlamydophila pneumoniae J138
uucguggagugcucua

SEQ ID NO: 2567037 - RNA, 17 nt, Chlamydophila pneumoniae J138
uucguggagugcucuac

SEQ ID NO: 2567038 - RNA, 22 nt, Chlamydophila pneumoniae J138
uucgugugcacccaaucgguau

SEQ ID NO: 2567039 - RNA, 13 nt, Chlamydophila pneumoniae J138
uucguuacuagga

SEQ ID NO: 2567040 - RNA, 22 nt, Chlamydophila pneumoniae J138
uucguuuccgaucauuuuugcu

SEQ ID NO: 2567041 - RNA, 15 nt, Chlamydophila pneumoniae J138
uucuaaaaacucuuc

SEQ ID NO: 2567042 - RNA, 22 nt, Chlamydophila pneumoniae J138
uucuaaaacagaaauugcuucu

SEQ ID NO: 2567043 - RNA, 16 nt, Chlamydophila pneumoniae J138
uucuaaaagagcaaga

SEQ ID NO: 2567044 - RNA, 12 nt, Chlamydophila pneumoniae J138
uucuaaacaauu

SEQ ID NO: 2567045 - RNA, 21 nt, Chlamydophila pneumoniae J138
uucuaaaucccgccuuucuac

SEQ ID NO: 2567046 - RNA, 19 nt, Chlamydophila pneumoniae J138
uucuaagaaacuuccaaaa

SEQ ID NO: 2567047 - RNA, 19 nt, Chlamydophila pneumoniae J138
uucuaagagguucuugcuu

SEQ ID NO: 2567048 - RNA, 13 nt, Chlamydophila pneumoniae J138
uucuaagauaucu

SEQ ID NO: 2567049 - RNA, 22 nt, Chlamydophila pneumoniae J138
uucuaagauuccuaacuucuga

SEQ ID NO: 2567050 - RNA, 17 nt, Chlamydophila pneumoniae J138
uucuaagcaauauuucu

SEQ ID NO: 2567051 - RNA, 19 nt, Chlamydophila pneumoniae J138
uucuaagcugaaagaacac

SEQ ID NO: 2567052 - RNA, 18 nt, Chlamydophila pneumoniae J138
uucuaagcuuauuucugu

SEQ ID NO: 2567053 - RNA, 12 nt, Chlamydophila pneumoniae J138
uucuaauacacc

SEQ ID NO: 2567054 - RNA, 17 nt, Chlamydophila pneumoniae J138
uucuaauccuccaaacg

SEQ ID NO: 2567055 - RNA, 23 nt, Chlamydophila pneumoniae J138
uucuaauguagggggauugauaa

SEQ ID NO: 2567056 - RNA, 18 nt, Chlamydophila pneumoniae J138
uucuacaccauagaacug

SEQ ID NO: 2567057 - RNA, 22 nt, Chlamydophila pneumoniae J138
uucuacacuguuguaauaaaau

SEQ ID NO: 2567058 - RNA, 18 nt, Chlamydophila pneumoniae J138
uucuacauagauccccuu

SEQ ID NO: 2567059 - RNA, 23 nt, Chlamydophila pneumoniae J138
uucuaccaauaaccgaaacuucu

SEQ ID NO: 2567060 - RNA, 13 nt, Chlamydophila pneumoniae J138
uucuaccaauucu

SEQ ID NO: 2567061 - RNA, 18 nt, Chlamydophila pneumoniae J138
uucuagaaaagauucuaa

SEQ ID NO: 2567062 - RNA, 16 nt, Chlamydophila pneumoniae J138
uucuagaaacugcucc

SEQ ID NO: 2567063 - RNA, 15 nt, Chlamydophila pneumoniae J138
uucuagaaugaugca

SEQ ID NO: 2567064 - RNA, 20 nt, Chlamydophila pneumoniae J138
uucuagagcuucaaguuucu

SEQ ID NO: 2567065 - RNA, 21 nt, Chlamydophila pneumoniae J138
uucuagagcuucaaguuucuu

SEQ ID NO: 2567066 - RNA, 18 nt, Chlamydophila pneumoniae J138
uucuagaguucauuuuag

SEQ ID NO: 2567067 - RNA, 16 nt, Chlamydophila pneumoniae J138
uucuagcaaaucuaaa

SEQ ID NO: 2567068 - RNA, 16 nt, Chlamydophila pneumoniae J138
uucuagcuaauaauga

SEQ ID NO: 2567069 - RNA, 16 nt, Chlamydophila pneumoniae J138
uucuaggaaucuuuua

SEQ ID NO: 2567070 - RNA, 16 nt, Chlamydophila pneumoniae J138
uucuaggaauugcugu

SEQ ID NO: 2567071 - RNA, 23 nt, Chlamydophila pneumoniae J138
uucuagggaucccaaaaaaugcc

SEQ ID NO: 2567072 - RNA, 15 nt, Chlamydophila pneumoniae J138
uucuagguauuuguu

SEQ ID NO: 2567073 - RNA, 16 nt, Chlamydophila pneumoniae J138
uucuagguauuuguuu

SEQ ID NO: 2567074 - RNA, 14 nt, Chlamydophila pneumoniae J138
uucuauaacuacaa

SEQ ID NO: 2567075 - RNA, 17 nt, Chlamydophila pneumoniae J138
uucuauacgaacacaga

SEQ ID NO: 2567076 - RNA, 23 nt, Chlamydophila pneumoniae J138
uucuauacgcuuaacaugaaaag

SEQ ID NO: 2567077 - RNA, 13 nt, Chlamydophila pneumoniae J138
uucuauaguucau

SEQ ID NO: 2567078 - RNA, 17 nt, Chlamydophila pneumoniae J138
uucuauauguaauuucc

SEQ ID NO: 2567079 - RNA, 17 nt, Chlamydophila pneumoniae J138
uucuaucuuacugaaga

SEQ ID NO: 2567080 - RNA, 22 nt, Chlamydophila pneumoniae J138
uucuaugauaucaccagguccu

SEQ ID NO: 2567081 - RNA, 20 nt, Chlamydophila pneumoniae J138
uucuaugccauaaauacagg

SEQ ID NO: 2567082 - RNA, 15 nt, Chlamydophila pneumoniae J138
uucuauuaaaaauag

SEQ ID NO: 2567083 - RNA, 13 nt, Chlamydophila pneumoniae J138
uucuauuucauau

SEQ ID NO: 2567084 - RNA, 17 nt, Chlamydophila pneumoniae J138
uucuauuuucaggaggc

SEQ ID NO: 2567085 - RNA, 18 nt, Chlamydophila pneumoniae J138
uucucaagaucuucauca

SEQ ID NO: 2567086 - RNA, 14 nt, Chlamydophila pneumoniae J138
uucucauagcuucc

SEQ ID NO: 2567087 - RNA, 17 nt, Chlamydophila pneumoniae J138
uucucauagcuuccugu

SEQ ID NO: 2567088 - RNA, 18 nt, Chlamydophila pneumoniae J138
uucucauagcuuccugua

SEQ ID NO: 2567089 - RNA, 19 nt, Chlamydophila pneumoniae J138
uucucauagcuuccuguag

SEQ ID NO: 2567090 - RNA, 16 nt, Chlamydophila pneumoniae J138
uucucauccagacagg

SEQ ID NO: 2567091 - RNA, 13 nt, Chlamydophila pneumoniae J138
uucuccaaauaaa

SEQ ID NO: 2567092 - RNA, 19 nt, Chlamydophila pneumoniae J138
uucuccaacuuccauauga

SEQ ID NO: 2567093 - RNA, 21 nt, Chlamydophila pneumoniae J138
uucuccaguaucuucucuuau

SEQ ID NO: 2567094 - RNA, 18 nt, Chlamydophila pneumoniae J138
uucucccgugaacaaaaa

SEQ ID NO: 2567095 - RNA, 22 nt, Chlamydophila pneumoniae J138
uucuccugacucuuuuaagaca

SEQ ID NO: 2567096 - RNA, 12 nt, Chlamydophila pneumoniae J138
uucucgaaaaau

SEQ ID NO: 2567097 - RNA, 22 nt, Chlamydophila pneumoniae J138
uucucgaacaggagagagaagg

SEQ ID NO: 2567098 - RNA, 21 nt, Chlamydophila pneumoniae J138
uucucgaggggacggaaaauc

SEQ ID NO: 2567099 - RNA, 15 nt, Chlamydophila pneumoniae J138
uucucgggucuugga

SEQ ID NO: 2567100 - RNA, 13 nt, Chlamydophila pneumoniae J138
uucucgguuuaag

SEQ ID NO: 2567101 - RNA, 17 nt, Chlamydophila pneumoniae J138
uucucuaagcagccucu

SEQ ID NO: 2567102 - RNA, 18 nt, Chlamydophila pneumoniae J138
uucucuacuaaaaucuca

SEQ ID NO: 2567103 - RNA, 21 nt, Chlamydophila pneumoniae J138
uucucuaugacuucuuguccu

SEQ ID NO: 2567104 - RNA, 14 nt, Chlamydophila pneumoniae J138
uucucugagcagcu

SEQ ID NO: 2567105 - RNA, 18 nt, Chlamydophila pneumoniae J138
uucucugauucucauaaa

SEQ ID NO: 2567106 - RNA, 22 nt, Chlamydophila pneumoniae J138
uucucugguauagaaacaccgu

SEQ ID NO: 2567107 - RNA, 22 nt, Chlamydophila pneumoniae J138
uucucuguaucgauaacgauuu

SEQ ID NO: 2567108 - RNA, 15 nt, Chlamydophila pneumoniae J138
uucugaaacaaugca

SEQ ID NO: 2567109 - RNA, 16 nt, Chlamydophila pneumoniae J138
uucugaaaucaaaaaa

SEQ ID NO: 2567110 - RNA, 20 nt, Chlamydophila pneumoniae J138
uucugaaauugucuucagug

SEQ ID NO: 2567111 - RNA, 14 nt, Chlamydophila pneumoniae J138
uucugaagauuuuu

SEQ ID NO: 2567112 - RNA, 23 nt, Chlamydophila pneumoniae J138
uucugaaggaaaucccgaaugug

SEQ ID NO: 2567113 - RNA, 14 nt, Chlamydophila pneumoniae J138
uucugaauagcucu

SEQ ID NO: 2567114 - RNA, 14 nt, Chlamydophila pneumoniae J138
uucugagcuugccu

SEQ ID NO: 2567115 - RNA, 19 nt, Chlamydophila pneumoniae J138
uucugauccgaaaagaacc

SEQ ID NO: 2567116 - RNA, 22 nt, Chlamydophila pneumoniae J138
uucugauuagagccccaacccu

SEQ ID NO: 2567117 - RNA, 13 nt, Chlamydophila pneumoniae J138
uucugcaggauuu

SEQ ID NO: 2567118 - RNA, 15 nt, Chlamydophila pneumoniae J138
uucugcuucuguaaa

SEQ ID NO: 2567119 - RNA, 15 nt, Chlamydophila pneumoniae J138
uucuggaauuuccca

SEQ ID NO: 2567120 - RNA, 14 nt, Chlamydophila pneumoniae J138
uucuggagaaaaaa

SEQ ID NO: 2567121 - RNA, 22 nt, Chlamydophila pneumoniae J138
uucuggauacguuuuucccuuu

SEQ ID NO: 2567122 - RNA, 22 nt, Chlamydophila pneumoniae J138
uucuguaaagugaaauugaacu

SEQ ID NO: 2567123 - RNA, 13 nt, Chlamydophila pneumoniae J138
uucuguaacacuu

SEQ ID NO: 2567124 - RNA, 13 nt, Chlamydophila pneumoniae J138
uucuguaguucuu

SEQ ID NO: 2567125 - RNA, 19 nt, Chlamydophila pneumoniae J138
uucuguaguuuguucacuu

SEQ ID NO: 2567126 - RNA, 23 nt, Chlamydophila pneumoniae J138
uucugucuauaagauagcucuug

SEQ ID NO: 2567127 - RNA, 18 nt, Chlamydophila pneumoniae J138
uucuuaauauaaaagaag

SEQ ID NO: 2567128 - RNA, 13 nt, Chlamydophila pneumoniae J138
uucuuaauuuccu

SEQ ID NO: 2567129 - RNA, 22 nt, Chlamydophila pneumoniae J138
uucuuacuaaagaaagagucuc

SEQ ID NO: 2567130 - RNA, 16 nt, Chlamydophila pneumoniae J138
uucuuagaagagaaag

SEQ ID NO: 2567131 - RNA, 19 nt, Chlamydophila pneumoniae J138
uucuuagcgcauguauugu

SEQ ID NO: 2567132 - RNA, 14 nt, Chlamydophila pneumoniae J138
uucuuaguaaagaa

SEQ ID NO: 2567133 - RNA, 20 nt, Chlamydophila pneumoniae J138
uucuuaucaaaauaaaaaaa

SEQ ID NO: 2567134 - RNA, 22 nt, Chlamydophila pneumoniae J138
uucuuauccuugaaauugcucu

SEQ ID NO: 2567135 - RNA, 11 nt, Chlamydophila pneumoniae J138
uucuuaucugc

SEQ ID NO: 2567136 - RNA, 21 nt, Chlamydophila pneumoniae J138
uucuucaaagaacuuaaaauu

SEQ ID NO: 2567137 - RNA, 14 nt, Chlamydophila pneumoniae J138
uucuucaacgagga

SEQ ID NO: 2567138 - RNA, 14 nt, Chlamydophila pneumoniae J138
uucuucaagaaaug

SEQ ID NO: 2567139 - RNA, 23 nt, Chlamydophila pneumoniae J138
uucuucaauaggaauuagagaaa

SEQ ID NO: 2567140 - RNA, 20 nt, Chlamydophila pneumoniae J138
uucuucacaaucuaaauaag

SEQ ID NO: 2567141 - RNA, 14 nt, Chlamydophila pneumoniae J138
uucuucaucaauac

SEQ ID NO: 2567142 - RNA, 23 nt, Chlamydophila pneumoniae J138
uucuucauuauuaaacgaauacu

SEQ ID NO: 2567143 - RNA, 18 nt, Chlamydophila pneumoniae J138
uucuuccaaagcuucuuu

SEQ ID NO: 2567144 - RNA, 12 nt, Chlamydophila pneumoniae J138
uucuuccuucuu

SEQ ID NO: 2567145 - RNA, 15 nt, Chlamydophila pneumoniae J138
uucuuccuucuucuu

SEQ ID NO: 2567146 - RNA, 13 nt, Chlamydophila pneumoniae J138
uucuucgagagca

SEQ ID NO: 2567147 - RNA, 18 nt, Chlamydophila pneumoniae J138
uucuucguuagagaagag

SEQ ID NO: 2567148 - RNA, 19 nt, Chlamydophila pneumoniae J138
uucuucguuuauaacauca

SEQ ID NO: 2567149 - RNA, 22 nt, Chlamydophila pneumoniae J138
uucuucuagcucauuaucaaga

SEQ ID NO: 2567150 - RNA, 17 nt, Chlamydophila pneumoniae J138
uucuucuauagaaucca

SEQ ID NO: 2567151 - RNA, 15 nt, Chlamydophila pneumoniae J138
uucuucucuaagaaa

SEQ ID NO: 2567152 - RNA, 14 nt, Chlamydophila pneumoniae J138
uucuucucuaggaa

SEQ ID NO: 2567153 - RNA, 20 nt, Chlamydophila pneumoniae J138
uucuucugaauagcucuuuu

SEQ ID NO: 2567154 - RNA, 17 nt, Chlamydophila pneumoniae J138
uucuucugauacaucau

SEQ ID NO: 2567155 - RNA, 22 nt, Chlamydophila pneumoniae J138
uucuucuggauacguuuuuccc

SEQ ID NO: 2567156 - RNA, 20 nt, Chlamydophila pneumoniae J138
uucuucuggcugagagaagc

SEQ ID NO: 2567157 - RNA, 17 nt, Chlamydophila pneumoniae J138
uucuucuuguucuucuu

SEQ ID NO: 2567158 - RNA, 20 nt, Chlamydophila pneumoniae J138
uucuucuuguucuucuugau

SEQ ID NO: 2567159 - RNA, 14 nt, Chlamydophila pneumoniae J138
uucuugaagaucuc

SEQ ID NO: 2567160 - RNA, 19 nt, Chlamydophila pneumoniae J138
uucuugaagaucuccgaag

SEQ ID NO: 2567161 - RNA, 19 nt, Chlamydophila pneumoniae J138
uucuugaaguucuucaaga

SEQ ID NO: 2567162 - RNA, 22 nt, Chlamydophila pneumoniae J138
uucuugcgacauaaccaucgau

SEQ ID NO: 2567163 - RNA, 21 nt, Chlamydophila pneumoniae J138
uucuuggaauauagguuuaga

SEQ ID NO: 2567164 - RNA, 20 nt, Chlamydophila pneumoniae J138
uucuuguaauaaaagaacau

SEQ ID NO: 2567165 - RNA, 14 nt, Chlamydophila pneumoniae J138
uucuuguagcuccc

SEQ ID NO: 2567166 - RNA, 17 nt, Chlamydophila pneumoniae J138
uucuuguugcaauagca

SEQ ID NO: 2567167 - RNA, 15 nt, Chlamydophila pneumoniae J138
uucuuuaagauuucc

SEQ ID NO: 2567168 - RNA, 17 nt, Chlamydophila pneumoniae J138
uucuuuagcuacagaaa

SEQ ID NO: 2567169 - RNA, 18 nt, Chlamydophila pneumoniae J138
uucuuuaggguaaagaaa

SEQ ID NO: 2567170 - RNA, 19 nt, Chlamydophila pneumoniae J138
uucuuuaucuagcucuuca

SEQ ID NO: 2567171 - RNA, 13 nt, Chlamydophila pneumoniae J138
uucuuucaaacca

SEQ ID NO: 2567172 - RNA, 23 nt, Chlamydophila pneumoniae J138
uucuuucuaggaucucuaguaag

SEQ ID NO: 2567173 - RNA, 14 nt, Chlamydophila pneumoniae J138
uucuuucugcucuu

SEQ ID NO: 2567174 - RNA, 12 nt, Chlamydophila pneumoniae J138
uucuuucugcuu

SEQ ID NO: 2567175 - RNA, 22 nt, Chlamydophila pneumoniae J138
uucuuugaagaacaaaaaauca

SEQ ID NO: 2567176 - RNA, 20 nt, Chlamydophila pneumoniae J138
uucuuugccguauagauuuu

SEQ ID NO: 2567177 - RNA, 13 nt, Chlamydophila pneumoniae J138
uucuuuuagagaa

SEQ ID NO: 2567178 - RNA, 21 nt, Chlamydophila pneumoniae J138
uucuuuuagcuacuucuucuu

SEQ ID NO: 2567179 - RNA, 11 nt, Chlamydophila pneumoniae J138
uucuuuuccug

SEQ ID NO: 2567180 - RNA, 12 nt, Chlamydophila pneumoniae J138
uucuuuucuaua

SEQ ID NO: 2567181 - RNA, 21 nt, Chlamydophila pneumoniae J138
uugaaaagaaagaauaucuuu

SEQ ID NO: 2567182 - RNA, 19 nt, Chlamydophila pneumoniae J138
uugaaaauauccuaaauau

SEQ ID NO: 2567183 - RNA, 13 nt, Chlamydophila pneumoniae J138
uugaaaucuaccg

SEQ ID NO: 2567184 - RNA, 14 nt, Chlamydophila pneumoniae J138
uugaaauugcucuu

SEQ ID NO: 2567185 - RNA, 23 nt, Chlamydophila pneumoniae J138
uugaacaaaaaggacucuuucua

SEQ ID NO: 2567186 - RNA, 14 nt, Chlamydophila pneumoniae J138
uugaacaugaggau

SEQ ID NO: 2567187 - RNA, 16 nt, Chlamydophila pneumoniae J138
uugaagaacaaaaaau

SEQ ID NO: 2567188 - RNA, 18 nt, Chlamydophila pneumoniae J138
uugaagaaguacaaguga

SEQ ID NO: 2567189 - RNA, 16 nt, Chlamydophila pneumoniae J138
uugaagagcuugcugu

SEQ ID NO: 2567190 - RNA, 18 nt, Chlamydophila pneumoniae J138
uugaagcuccucacaucu

SEQ ID NO: 2567191 - RNA, 14 nt, Chlamydophila pneumoniae J138
uugaaguucucaaa

SEQ ID NO: 2567192 - RNA, 24 nt, Chlamydophila pneumoniae J138
uugaaucauagagauaucaucaaa

SEQ ID NO: 2567193 - RNA, 16 nt, Chlamydophila pneumoniae J138
uugaaucccaucaaag

SEQ ID NO: 2567194 - RNA, 19 nt, Chlamydophila pneumoniae J138
uugaauccuucuauagcaa

SEQ ID NO: 2567195 - RNA, 17 nt, Chlamydophila pneumoniae J138
uugaaucuauagucugu

SEQ ID NO: 2567196 - RNA, 23 nt, Chlamydophila pneumoniae J138
uugaauucauccagauuagaaaa

SEQ ID NO: 2567197 - RNA, 13 nt, Chlamydophila pneumoniae J138
uugaauuuccaaa

SEQ ID NO: 2567198 - RNA, 17 nt, Chlamydophila pneumoniae J138
uugaauuuccaaaggaa

SEQ ID NO: 2567199 - RNA, 22 nt, Chlamydophila pneumoniae J138
uugacaacgguguucauaauca

SEQ ID NO: 2567200 - RNA, 14 nt, Chlamydophila pneumoniae J138
uugaccuuuuucau

SEQ ID NO: 2567201 - RNA, 14 nt, Chlamydophila pneumoniae J138
uugacuagcucucu

SEQ ID NO: 2567202 - RNA, 15 nt, Chlamydophila pneumoniae J138
uugacuauugggagg

SEQ ID NO: 2567203 - RNA, 12 nt, Chlamydophila pneumoniae J138
uugacuuguccc

SEQ ID NO: 2567204 - RNA, 22 nt, Chlamydophila pneumoniae J138
uugacuuucauaugaaugacug

SEQ ID NO: 2567205 - RNA, 19 nt, Chlamydophila pneumoniae J138
uugagaaauauaacucucu

SEQ ID NO: 2567206 - RNA, 14 nt, Chlamydophila pneumoniae J138
uugagacaaagaau

SEQ ID NO: 2567207 - RNA, 15 nt, Chlamydophila pneumoniae J138
uugagacgaaagaga

SEQ ID NO: 2567208 - RNA, 15 nt, Chlamydophila pneumoniae J138
uugagcaucacggag

SEQ ID NO: 2567209 - RNA, 14 nt, Chlamydophila pneumoniae J138
uugaggaaaggagg

SEQ ID NO: 2567210 - RNA, 20 nt, Chlamydophila pneumoniae J138
uugaggaaucugaaucucau

SEQ ID NO: 2567211 - RNA, 17 nt, Chlamydophila pneumoniae J138
uugaggcaagucucaaa

SEQ ID NO: 2567212 - RNA, 16 nt, Chlamydophila pneumoniae J138
uugaguugguuuugua

SEQ ID NO: 2567213 - RNA, 19 nt, Chlamydophila pneumoniae J138
uugauaaauucaucggcau

SEQ ID NO: 2567214 - RNA, 15 nt, Chlamydophila pneumoniae J138
uugauaacaguagcg

SEQ ID NO: 2567215 - RNA, 14 nt, Chlamydophila pneumoniae J138
uugauagaccggau

SEQ ID NO: 2567216 - RNA, 17 nt, Chlamydophila pneumoniae J138
uugauagcuaagagcau

SEQ ID NO: 2567217 - RNA, 14 nt, Chlamydophila pneumoniae J138
uugauccagccccc

SEQ ID NO: 2567218 - RNA, 15 nt, Chlamydophila pneumoniae J138
uugaucgcuugugca

SEQ ID NO: 2567219 - RNA, 14 nt, Chlamydophila pneumoniae J138
uugaucuacaaaaa

SEQ ID NO: 2567220 - RNA, 17 nt, Chlamydophila pneumoniae J138
uugaucuacaaaaacua

SEQ ID NO: 2567221 - RNA, 17 nt, Chlamydophila pneumoniae J138
uugaugagaaaaagaau

SEQ ID NO: 2567222 - RNA, 19 nt, Chlamydophila pneumoniae J138
uugaugagaaaaagaaucu

SEQ ID NO: 2567223 - RNA, 13 nt, Chlamydophila pneumoniae J138
uugauguuccuug

SEQ ID NO: 2567224 - RNA, 12 nt, Chlamydophila pneumoniae J138
uugauucaaugc

SEQ ID NO: 2567225 - RNA, 15 nt, Chlamydophila pneumoniae J138
uugauuccaaugacg

SEQ ID NO: 2567226 - RNA, 16 nt, Chlamydophila pneumoniae J138
uugauuuagaaucuuu

SEQ ID NO: 2567227 - RNA, 19 nt, Chlamydophila pneumoniae J138
uugauuuccaacaccagga

SEQ ID NO: 2567228 - RNA, 12 nt, Chlamydophila pneumoniae J138
uugauuuuaaaa

SEQ ID NO: 2567229 - RNA, 21 nt, Chlamydophila pneumoniae J138
uugauuuugcagugauaaacc

SEQ ID NO: 2567230 - RNA, 12 nt, Chlamydophila pneumoniae J138
uugauuuuucaa

SEQ ID NO: 2567231 - RNA, 13 nt, Chlamydophila pneumoniae J138
uugcaaaugaaaa

SEQ ID NO: 2567232 - RNA, 18 nt, Chlamydophila pneumoniae J138
uugcaacaaucuuucuuc

SEQ ID NO: 2567233 - RNA, 21 nt, Chlamydophila pneumoniae J138
uugcaagagccggaacuucag

SEQ ID NO: 2567234 - RNA, 14 nt, Chlamydophila pneumoniae J138
uugcaaucuuugaa

SEQ ID NO: 2567235 - RNA, 21 nt, Chlamydophila pneumoniae J138
uugcaauucuucaugcugcuu

SEQ ID NO: 2567236 - RNA, 14 nt, Chlamydophila pneumoniae J138
uugcaauugccaua

SEQ ID NO: 2567237 - RNA, 15 nt, Chlamydophila pneumoniae J138
uugcaauuuucuaaa

SEQ ID NO: 2567238 - RNA, 14 nt, Chlamydophila pneumoniae J138
uugcagaagcauug

SEQ ID NO: 2567239 - RNA, 22 nt, Chlamydophila pneumoniae J138
uugcagaguuggaucauucuuu

SEQ ID NO: 2567240 - RNA, 21 nt, Chlamydophila pneumoniae J138
uugcagaucccgggaguuuuc

SEQ ID NO: 2567241 - RNA, 16 nt, Chlamydophila pneumoniae J138
uugcagcucggaaugc

SEQ ID NO: 2567242 - RNA, 13 nt, Chlamydophila pneumoniae J138
uugcaguggcuua

SEQ ID NO: 2567243 - RNA, 18 nt, Chlamydophila pneumoniae J138
uugcaucuuauggaagag

SEQ ID NO: 2567244 - RNA, 22 nt, Chlamydophila pneumoniae J138
uugcauucagggggaaagccaa

SEQ ID NO: 2567245 - RNA, 15 nt, Chlamydophila pneumoniae J138
uugccaaucuuucau

SEQ ID NO: 2567246 - RNA, 22 nt, Chlamydophila pneumoniae J138
uugccaauguggugauuucuuu

SEQ ID NO: 2567247 - RNA, 12 nt, Chlamydophila pneumoniae J138
uugccagcagaa

SEQ ID NO: 2567248 - RNA, 19 nt, Chlamydophila pneumoniae J138
uugcccauugaccugcuuu

SEQ ID NO: 2567249 - RNA, 18 nt, Chlamydophila pneumoniae J138
uugccgugaguugcaauu

SEQ ID NO: 2567250 - RNA, 20 nt, Chlamydophila pneumoniae J138
uugccgugaguugcaauugc

SEQ ID NO: 2567251 - RNA, 19 nt, Chlamydophila pneumoniae J138
uugccuggggaucuuagga

SEQ ID NO: 2567252 - RNA, 14 nt, Chlamydophila pneumoniae J138
uugccuuuagagac

SEQ ID NO: 2567253 - RNA, 12 nt, Chlamydophila pneumoniae J138
uugccuuucucu

SEQ ID NO: 2567254 - RNA, 19 nt, Chlamydophila pneumoniae J138
uugcgaacagcuccuggau

SEQ ID NO: 2567255 - RNA, 23 nt, Chlamydophila pneumoniae J138
uugcgauaucuauaaauguaggg

SEQ ID NO: 2567256 - RNA, 21 nt, Chlamydophila pneumoniae J138
uugcgcggcgcauuuuuuccu

SEQ ID NO: 2567257 - RNA, 19 nt, Chlamydophila pneumoniae J138
uugcggauuugcauuaccu

SEQ ID NO: 2567258 - RNA, 16 nt, Chlamydophila pneumoniae J138
uugcuauacagaaaag

SEQ ID NO: 2567259 - RNA, 23 nt, Chlamydophila pneumoniae J138
uugcuccuccaaaagaccaaaaa

SEQ ID NO: 2567260 - RNA, 23 nt, Chlamydophila pneumoniae J138
uugcucuaccaacugagcuauuu

SEQ ID NO: 2567261 - RNA, 17 nt, Chlamydophila pneumoniae J138
uugcucuagucuuucaa

SEQ ID NO: 2567262 - RNA, 13 nt, Chlamydophila pneumoniae J138
uugcucuuuagga

SEQ ID NO: 2567263 - RNA, 11 nt, Chlamydophila pneumoniae J138
uugcugaagau

SEQ ID NO: 2567264 - RNA, 12 nt, Chlamydophila pneumoniae J138
uugcugaagauu

SEQ ID NO: 2567265 - RNA, 14 nt, Chlamydophila pneumoniae J138
uugcugaagauuuu

SEQ ID NO: 2567266 - RNA, 15 nt, Chlamydophila pneumoniae J138
uugcugaagauuuuu

SEQ ID NO: 2567267 - RNA, 23 nt, Chlamydophila pneumoniae J138
uugcugaagauuuuuucuugguc

SEQ ID NO: 2567268 - RNA, 19 nt, Chlamydophila pneumoniae J138
uugcugauuucuuuuucag

SEQ ID NO: 2567269 - RNA, 23 nt, Chlamydophila pneumoniae J138
uugcugcgaaugucguuaaaaac

SEQ ID NO: 2567270 - RNA, 18 nt, Chlamydophila pneumoniae J138
uugcugcggccacauuaa

SEQ ID NO: 2567271 - RNA, 16 nt, Chlamydophila pneumoniae J138
uugcugcucuccaaag

SEQ ID NO: 2567272 - RNA, 23 nt, Chlamydophila pneumoniae J138
uugcuguggcauacucuuugcag

SEQ ID NO: 2567273 - RNA, 18 nt, Chlamydophila pneumoniae J138
uugcuguuucuucugaau

SEQ ID NO: 2567274 - RNA, 20 nt, Chlamydophila pneumoniae J138
uugcuuauugucuuaaaauu

SEQ ID NO: 2567275 - RNA, 23 nt, Chlamydophila pneumoniae J138
uugcuuccaacggacauuuucaa

SEQ ID NO: 2567276 - RNA, 18 nt, Chlamydophila pneumoniae J138
uugcuucuuccaagcagg

SEQ ID NO: 2567277 - RNA, 16 nt, Chlamydophila pneumoniae J138
uugcuugcgcaucagc

SEQ ID NO: 2567278 - RNA, 22 nt, Chlamydophila pneumoniae J138
uugcuugcuauagggaucuccu

SEQ ID NO: 2567279 - RNA, 11 nt, Chlamydophila pneumoniae J138
uugcuuucuag

SEQ ID NO: 2567280 - RNA, 23 nt, Chlamydophila pneumoniae J138
uugcuuugugaguucuuccuucu

SEQ ID NO: 2567281 - RNA, 14 nt, Chlamydophila pneumoniae J138
uugcuuuucauuuu

SEQ ID NO: 2567282 - RNA, 15 nt, Chlamydophila pneumoniae J138
uugcuuuucuaggau

SEQ ID NO: 2567283 - RNA, 17 nt, Chlamydophila pneumoniae J138
uuggaagauugaaggca

SEQ ID NO: 2567284 - RNA, 18 nt, Chlamydophila pneumoniae J138
uuggacaacgcuucuuuu

SEQ ID NO: 2567285 - RNA, 19 nt, Chlamydophila pneumoniae J138
uuggacguacuaagauacg

SEQ ID NO: 2567286 - RNA, 15 nt, Chlamydophila pneumoniae J138
uuggauaggauagga

SEQ ID NO: 2567287 - RNA, 14 nt, Chlamydophila pneumoniae J138
uuggcacaauccuc

SEQ ID NO: 2567288 - RNA, 16 nt, Chlamydophila pneumoniae J138
uuggcaguucacugag

SEQ ID NO: 2567289 - RNA, 17 nt, Chlamydophila pneumoniae J138
uuggcuuuugagauuca

SEQ ID NO: 2567290 - RNA, 14 nt, Chlamydophila pneumoniae J138
uugggaaaagaaaa

SEQ ID NO: 2567291 - RNA, 15 nt, Chlamydophila pneumoniae J138
uugggaaaagaaaag

SEQ ID NO: 2567292 - RNA, 17 nt, Chlamydophila pneumoniae J138
uugggauaggugcauca

SEQ ID NO: 2567293 - RNA, 23 nt, Chlamydophila pneumoniae J138
uugggaugacuggcgacuugcca

SEQ ID NO: 2567294 - RNA, 19 nt, Chlamydophila pneumoniae J138
uugggcaaauaggagagca

SEQ ID NO: 2567295 - RNA, 20 nt, Chlamydophila pneumoniae J138
uugguaugcagaguuuuaaa

SEQ ID NO: 2567296 - RNA, 13 nt, Chlamydophila pneumoniae J138
uugguucaaaucc

SEQ ID NO: 2567297 - RNA, 23 nt, Chlamydophila pneumoniae J138
uugguucuuggaguuaggaaaau

SEQ ID NO: 2567298 - RNA, 18 nt, Chlamydophila pneumoniae J138
uugguugcagucguauuc

SEQ ID NO: 2567299 - RNA, 16 nt, Chlamydophila pneumoniae J138
uugguuuucuccuucu

SEQ ID NO: 2567300 - RNA, 19 nt, Chlamydophila pneumoniae J138
uuguaacgcugcuaauguu

SEQ ID NO: 2567301 - RNA, 19 nt, Chlamydophila pneumoniae J138
uuguaacucaagguauugu

SEQ ID NO: 2567302 - RNA, 21 nt, Chlamydophila pneumoniae J138
uuguaagcagugugcugauuu

SEQ ID NO: 2567303 - RNA, 18 nt, Chlamydophila pneumoniae J138
uuguacuuuuacugaaau

SEQ ID NO: 2567304 - RNA, 22 nt, Chlamydophila pneumoniae J138
uuguagagagaaucgagaacag

SEQ ID NO: 2567305 - RNA, 15 nt, Chlamydophila pneumoniae J138
uuguauaagagcaag

SEQ ID NO: 2567306 - RNA, 19 nt, Chlamydophila pneumoniae J138
uuguauaagagcaagguaa

SEQ ID NO: 2567307 - RNA, 21 nt, Chlamydophila pneumoniae J138
uuguauauccacgaucuagaa

SEQ ID NO: 2567308 - RNA, 23 nt, Chlamydophila pneumoniae J138
uuguauggaauucaaacuccuuu

SEQ ID NO: 2567309 - RNA, 12 nt, Chlamydophila pneumoniae J138
uuguauucagug

SEQ ID NO: 2567310 - RNA, 16 nt, Chlamydophila pneumoniae J138
uuguauucagugucuu

SEQ ID NO: 2567311 - RNA, 19 nt, Chlamydophila pneumoniae J138
uuguauuccuuggauuucu

SEQ ID NO: 2567312 - RNA, 20 nt, Chlamydophila pneumoniae J138
uuguauuccuuggauuucuu

SEQ ID NO: 2567313 - RNA, 17 nt, Chlamydophila pneumoniae J138
uugucaacaaaagcuau

SEQ ID NO: 2567314 - RNA, 21 nt, Chlamydophila pneumoniae J138
uugucacacugcgagagaaag

SEQ ID NO: 2567315 - RNA, 23 nt, Chlamydophila pneumoniae J138
uugucagcuuugcuuauuucccc

SEQ ID NO: 2567316 - RNA, 14 nt, Chlamydophila pneumoniae J138
uugucccaaucaag

SEQ ID NO: 2567317 - RNA, 18 nt, Chlamydophila pneumoniae J138
uuguccuaggagagcuag

SEQ ID NO: 2567318 - RNA, 19 nt, Chlamydophila pneumoniae J138
uuguccugcaagcauuguu

SEQ ID NO: 2567319 - RNA, 21 nt, Chlamydophila pneumoniae J138
uugucgagcuuuaagaagaag

SEQ ID NO: 2567320 - RNA, 22 nt, Chlamydophila pneumoniae J138
uugucugaggacaguauucccu

SEQ ID NO: 2567321 - RNA, 23 nt, Chlamydophila pneumoniae J138
uugucuuccacgaaggaaucuga

SEQ ID NO: 2567322 - RNA, 21 nt, Chlamydophila pneumoniae J138
uugugaaaaucgcaccuugac

SEQ ID NO: 2567323 - RNA, 13 nt, Chlamydophila pneumoniae J138
uugugagcugcug

SEQ ID NO: 2567324 - RNA, 15 nt, Chlamydophila pneumoniae J138
uugugaguucuuccu

SEQ ID NO: 2567325 - RNA, 15 nt, Chlamydophila pneumoniae J138
uugugcgucaucaac

SEQ ID NO: 2567326 - RNA, 22 nt, Chlamydophila pneumoniae J138
uugugcuaaagcaggagcauca

SEQ ID NO: 2567327 - RNA, 16 nt, Chlamydophila pneumoniae J138
uuguuaaauucccaaa

SEQ ID NO: 2567328 - RNA, 21 nt, Chlamydophila pneumoniae J138
uuguuagugagaucaaaaaua

SEQ ID NO: 2567329 - RNA, 15 nt, Chlamydophila pneumoniae J138
uuguucagcuagagc

SEQ ID NO: 2567330 - RNA, 16 nt, Chlamydophila pneumoniae J138
uuguucagcuagagca

SEQ ID NO: 2567331 - RNA, 20 nt, Chlamydophila pneumoniae J138
uuguucagcuagagcacaua

SEQ ID NO: 2567332 - RNA, 19 nt, Chlamydophila pneumoniae J138
uuguuccaauagagucucu

SEQ ID NO: 2567333 - RNA, 14 nt, Chlamydophila pneumoniae J138
uuguucuaaaauga

SEQ ID NO: 2567334 - RNA, 22 nt, Chlamydophila pneumoniae J138
uuguucuuccaacuucuguauc

SEQ ID NO: 2567335 - RNA, 17 nt, Chlamydophila pneumoniae J138
uuguugcaucgccuuaa

SEQ ID NO: 2567336 - RNA, 13 nt, Chlamydophila pneumoniae J138
uuguuguaacggg

SEQ ID NO: 2567337 - RNA, 14 nt, Chlamydophila pneumoniae J138
uuguuguuuuugcu

SEQ ID NO: 2567338 - RNA, 15 nt, Chlamydophila pneumoniae J138
uuguuuagaaaaaga

SEQ ID NO: 2567339 - RNA, 18 nt, Chlamydophila pneumoniae J138
uuguuuaugcauacguua

SEQ ID NO: 2567340 - RNA, 16 nt, Chlamydophila pneumoniae J138
uuguuugcuauacaga

SEQ ID NO: 2567341 - RNA, 14 nt, Chlamydophila pneumoniae J138
uuguuuguaucaaa

SEQ ID NO: 2567342 - RNA, 14 nt, Chlamydophila pneumoniae J138
uuguuuuaauugua

SEQ ID NO: 2567343 - RNA, 16 nt, Chlamydophila pneumoniae J138
uuuaaaaaauucuaau

SEQ ID NO: 2567344 - RNA, 17 nt, Chlamydophila pneumoniae J138
uuuaaaaauagaaauaa

SEQ ID NO: 2567345 - RNA, 21 nt, Chlamydophila pneumoniae J138
uuuaaaaauaggagaagcccc

SEQ ID NO: 2567346 - RNA, 12 nt, Chlamydophila pneumoniae J138
uuuaaaaauaua

SEQ ID NO: 2567347 - RNA, 22 nt, Chlamydophila pneumoniae J138
uuuaaaacuccacgccaaagua

SEQ ID NO: 2567348 - RNA, 20 nt, Chlamydophila pneumoniae J138
uuuaaaguguguaaauguuu

SEQ ID NO: 2567349 - RNA, 21 nt, Chlamydophila pneumoniae J138
uuuaaauaaaaccacuucucu

SEQ ID NO: 2567350 - RNA, 21 nt, Chlamydophila pneumoniae J138
uuuaaauacagauucaccaag

SEQ ID NO: 2567351 - RNA, 14 nt, Chlamydophila pneumoniae J138
uuuaaauagcaucc

SEQ ID NO: 2567352 - RNA, 18 nt, Chlamydophila pneumoniae J138
uuuaaaugagcaauguuu

SEQ ID NO: 2567353 - RNA, 19 nt, Chlamydophila pneumoniae J138
uuuaaauuuuguuuuucca

SEQ ID NO: 2567354 - RNA, 19 nt, Chlamydophila pneumoniae J138
uuuaacaugccaaaaguuu

SEQ ID NO: 2567355 - RNA, 21 nt, Chlamydophila pneumoniae J138
uuuaaccgagcuuuuugcuuu

SEQ ID NO: 2567356 - RNA, 23 nt, Chlamydophila pneumoniae J138
uuuaaccucuuuucuuaucauga

SEQ ID NO: 2567357 - RNA, 21 nt, Chlamydophila pneumoniae J138
uuuaacgcuaagcucuuaauu

SEQ ID NO: 2567358 - RNA, 21 nt, Chlamydophila pneumoniae J138
uuuaacucuagaucuucaauc

SEQ ID NO: 2567359 - RNA, 15 nt, Chlamydophila pneumoniae J138
uuuaacuuaaagacu

SEQ ID NO: 2567360 - RNA, 17 nt, Chlamydophila pneumoniae J138
uuuaacuucuaaaagca

SEQ ID NO: 2567361 - RNA, 18 nt, Chlamydophila pneumoniae J138
uuuaagaaaugcaaacca

SEQ ID NO: 2567362 - RNA, 18 nt, Chlamydophila pneumoniae J138
uuuaagacaauauaagca

SEQ ID NO: 2567363 - RNA, 14 nt, Chlamydophila pneumoniae J138
uuuaagaccuucug

SEQ ID NO: 2567364 - RNA, 14 nt, Chlamydophila pneumoniae J138
uuuaagauuuccuu

SEQ ID NO: 2567365 - RNA, 20 nt, Chlamydophila pneumoniae J138
uuuaagguucucugaacuug

SEQ ID NO: 2567366 - RNA, 17 nt, Chlamydophila pneumoniae J138
uuuaagucacuaaagau

SEQ ID NO: 2567367 - RNA, 20 nt, Chlamydophila pneumoniae J138
uuuaagucacuaaagauacu

SEQ ID NO: 2567368 - RNA, 13 nt, Chlamydophila pneumoniae J138
uuuaauaaaauuu

SEQ ID NO: 2567369 - RNA, 18 nt, Chlamydophila pneumoniae J138
uuuaauaaaauuuaaaaa

SEQ ID NO: 2567370 - RNA, 19 nt, Chlamydophila pneumoniae J138
uuuaauaaaauuuaaaaaa

SEQ ID NO: 2567371 - RNA, 16 nt, Chlamydophila pneumoniae J138
uuuaauacaaaaaaua

SEQ ID NO: 2567372 - RNA, 13 nt, Chlamydophila pneumoniae J138
uuuaauguguucu

SEQ ID NO: 2567373 - RNA, 15 nt, Chlamydophila pneumoniae J138
uuuaauucaaaaaga

SEQ ID NO: 2567374 - RNA, 16 nt, Chlamydophila pneumoniae J138
uuuacaaauaaaauga

SEQ ID NO: 2567375 - RNA, 16 nt, Chlamydophila pneumoniae J138
uuuacaauuagagauu

SEQ ID NO: 2567376 - RNA, 20 nt, Chlamydophila pneumoniae J138
uuuacacugcuucaaaacau

SEQ ID NO: 2567377 - RNA, 16 nt, Chlamydophila pneumoniae J138
uuuaccuuguuuuccu

SEQ ID NO: 2567378 - RNA, 22 nt, Chlamydophila pneumoniae J138
uuuacgaaaacaucuguauauu

SEQ ID NO: 2567379 - RNA, 15 nt, Chlamydophila pneumoniae J138
uuuacgaugagguug

SEQ ID NO: 2567380 - RNA, 14 nt, Chlamydophila pneumoniae J138
uuuacguucuuucu

SEQ ID NO: 2567381 - RNA, 21 nt, Chlamydophila pneumoniae J138
uuuagaagguguuuuggcugc

SEQ ID NO: 2567382 - RNA, 13 nt, Chlamydophila pneumoniae J138
uuuagaauaagag

SEQ ID NO: 2567383 - RNA, 20 nt, Chlamydophila pneumoniae J138
uuuagaaucuuuucuagaaa

SEQ ID NO: 2567384 - RNA, 19 nt, Chlamydophila pneumoniae J138
uuuagacgaggagaagucg

SEQ ID NO: 2567385 - RNA, 13 nt, Chlamydophila pneumoniae J138
uuuagagaaaucu

SEQ ID NO: 2567386 - RNA, 18 nt, Chlamydophila pneumoniae J138
uuuagcaugacuuuuuca

SEQ ID NO: 2567387 - RNA, 16 nt, Chlamydophila pneumoniae J138
uuuagcgcuacaguga

SEQ ID NO: 2567388 - RNA, 17 nt, Chlamydophila pneumoniae J138
uuuagcuauuugaaaua

SEQ ID NO: 2567389 - RNA, 14 nt, Chlamydophila pneumoniae J138
uuuagcuucuuuuu

SEQ ID NO: 2567390 - RNA, 15 nt, Chlamydophila pneumoniae J138
uuuaguuucccacua

SEQ ID NO: 2567391 - RNA, 21 nt, Chlamydophila pneumoniae J138
uuuauaaagaucgggucuaca

SEQ ID NO: 2567392 - RNA, 16 nt, Chlamydophila pneumoniae J138
uuuauauaaagaucuu

SEQ ID NO: 2567393 - RNA, 14 nt, Chlamydophila pneumoniae J138
uuuauauuaagaau

SEQ ID NO: 2567394 - RNA, 14 nt, Chlamydophila pneumoniae J138
uuuaucaugagaau

SEQ ID NO: 2567395 - RNA, 16 nt, Chlamydophila pneumoniae J138
uuuaucccagauaaag

SEQ ID NO: 2567396 - RNA, 22 nt, Chlamydophila pneumoniae J138
uuuaucuccccauucacaaauc

SEQ ID NO: 2567397 - RNA, 19 nt, Chlamydophila pneumoniae J138
uuuaucugcgacaaaaaug

SEQ ID NO: 2567398 - RNA, 16 nt, Chlamydophila pneumoniae J138
uuuaucugcguuucuu

SEQ ID NO: 2567399 - RNA, 19 nt, Chlamydophila pneumoniae J138
uuuaucugcguuucuuucu

SEQ ID NO: 2567400 - RNA, 21 nt, Chlamydophila pneumoniae J138
uuuaucuguuaaaaacaagau

SEQ ID NO: 2567401 - RNA, 12 nt, Chlamydophila pneumoniae J138
uuuauuaaaauc

SEQ ID NO: 2567402 - RNA, 16 nt, Chlamydophila pneumoniae J138
uuuauuagaaguaucu

SEQ ID NO: 2567403 - RNA, 16 nt, Chlamydophila pneumoniae J138
uuuauuuaaaauuucu

SEQ ID NO: 2567404 - RNA, 21 nt, Chlamydophila pneumoniae J138
uuuauuuaaauaaaaccacuu

SEQ ID NO: 2567405 - RNA, 22 nt, Chlamydophila pneumoniae J138
uuuauuuuaggaagcuuaucaa

SEQ ID NO: 2567406 - RNA, 17 nt, Chlamydophila pneumoniae J138
uuucaaaggagaaagaa

SEQ ID NO: 2567407 - RNA, 22 nt, Chlamydophila pneumoniae J138
uuucaaaggcaacgcgauuuuc

SEQ ID NO: 2567408 - RNA, 16 nt, Chlamydophila pneumoniae J138
uuucaacaccucaaua

SEQ ID NO: 2567409 - RNA, 20 nt, Chlamydophila pneumoniae J138
uuucaacauaacaugagaaa

SEQ ID NO: 2567410 - RNA, 19 nt, Chlamydophila pneumoniae J138
uuucaagauugugcucaau

SEQ ID NO: 2567411 - RNA, 24 nt, Chlamydophila pneumoniae J138
uuucaagauugugcucaauacaga

SEQ ID NO: 2567412 - RNA, 21 nt, Chlamydophila pneumoniae J138
uuucaauaaccagaagacucc

SEQ ID NO: 2567413 - RNA, 11 nt, Chlamydophila pneumoniae J138
uuucaauaaua

SEQ ID NO: 2567414 - RNA, 21 nt, Chlamydophila pneumoniae J138
uuucaauagcaguaucuagaa

SEQ ID NO: 2567415 - RNA, 18 nt, Chlamydophila pneumoniae J138
uuucaauagcuuccaagg

SEQ ID NO: 2567416 - RNA, 15 nt, Chlamydophila pneumoniae J138
uuucaaucucuccuu

SEQ ID NO: 2567417 - RNA, 20 nt, Chlamydophila pneumoniae J138
uuucacaagcauaaacuccu

SEQ ID NO: 2567418 - RNA, 13 nt, Chlamydophila pneumoniae J138
uuucagaagaucu

SEQ ID NO: 2567419 - RNA, 22 nt, Chlamydophila pneumoniae J138
uuucagagccgcuagccauagu

SEQ ID NO: 2567420 - RNA, 12 nt, Chlamydophila pneumoniae J138
uuucagauuuuu

SEQ ID NO: 2567421 - RNA, 18 nt, Chlamydophila pneumoniae J138
uuucagcaugugcagaag

SEQ ID NO: 2567422 - RNA, 16 nt, Chlamydophila pneumoniae J138
uuucaggucagcaagg

SEQ ID NO: 2567423 - RNA, 14 nt, Chlamydophila pneumoniae J138
uuucagucuuccuu

SEQ ID NO: 2567424 - RNA, 16 nt, Chlamydophila pneumoniae J138
uuucagucuuccuuua

SEQ ID NO: 2567425 - RNA, 19 nt, Chlamydophila pneumoniae J138
uuucaguuguuucuagaaa

SEQ ID NO: 2567426 - RNA, 14 nt, Chlamydophila pneumoniae J138
uuucauaaacaauu

SEQ ID NO: 2567427 - RNA, 16 nt, Chlamydophila pneumoniae J138
uuucauaaacaauuca

SEQ ID NO: 2567428 - RNA, 16 nt, Chlamydophila pneumoniae J138
uuucauacuuauccuu

SEQ ID NO: 2567429 - RNA, 21 nt, Chlamydophila pneumoniae J138
uuucauauaaaguuuccaagu

SEQ ID NO: 2567430 - RNA, 15 nt, Chlamydophila pneumoniae J138
uuucaucuucuuucu

SEQ ID NO: 2567431 - RNA, 18 nt, Chlamydophila pneumoniae J138
uuucauucccuuuuucca

SEQ ID NO: 2567432 - RNA, 16 nt, Chlamydophila pneumoniae J138
uuuccaacuucaacuu

SEQ ID NO: 2567433 - RNA, 14 nt, Chlamydophila pneumoniae J138
uuuccaagaaguca

SEQ ID NO: 2567434 - RNA, 22 nt, Chlamydophila pneumoniae J138
uuuccaagacaacaccucccac

SEQ ID NO: 2567435 - RNA, 15 nt, Chlamydophila pneumoniae J138
uuuccaggaccaaac

SEQ ID NO: 2567436 - RNA, 19 nt, Chlamydophila pneumoniae J138
uuuccauacccaaauuucu

SEQ ID NO: 2567437 - RNA, 20 nt, Chlamydophila pneumoniae J138
uuuccauacccaaauuucuu

SEQ ID NO: 2567438 - RNA, 22 nt, Chlamydophila pneumoniae J138
uuuccauacccaaauuucuucu

SEQ ID NO: 2567439 - RNA, 14 nt, Chlamydophila pneumoniae J138
uuuccauaggaucu

SEQ ID NO: 2567440 - RNA, 11 nt, Chlamydophila pneumoniae J138
uuuccauccac

SEQ ID NO: 2567441 - RNA, 12 nt, Chlamydophila pneumoniae J138
uuucccacagcu

SEQ ID NO: 2567442 - RNA, 20 nt, Chlamydophila pneumoniae J138
uuucccaccauauucucagg

SEQ ID NO: 2567443 - RNA, 22 nt, Chlamydophila pneumoniae J138
uuucccccugaaugcaacagag

SEQ ID NO: 2567444 - RNA, 21 nt, Chlamydophila pneumoniae J138
uuucccucgcuaaaguagaau

SEQ ID NO: 2567445 - RNA, 14 nt, Chlamydophila pneumoniae J138
uuucccuuuaaaag

SEQ ID NO: 2567446 - RNA, 21 nt, Chlamydophila pneumoniae J138
uuuccggggagaacuucaaca

SEQ ID NO: 2567447 - RNA, 18 nt, Chlamydophila pneumoniae J138
uuuccuaccuauauuuuu

SEQ ID NO: 2567448 - RNA, 20 nt, Chlamydophila pneumoniae J138
uuuccugacuauaaaaugcc

SEQ ID NO: 2567449 - RNA, 21 nt, Chlamydophila pneumoniae J138
uuuccuucaggauuuuccauu

SEQ ID NO: 2567450 - RNA, 23 nt, Chlamydophila pneumoniae J138
uuuccuucuuuuaaaaacucuuu

SEQ ID NO: 2567451 - RNA, 17 nt, Chlamydophila pneumoniae J138
uuuccuugguaucccaa

SEQ ID NO: 2567452 - RNA, 14 nt, Chlamydophila pneumoniae J138
uuucgaagcgcucu

SEQ ID NO: 2567453 - RNA, 23 nt, Chlamydophila pneumoniae J138
uuucgaagcgcucuacaaaugcg

SEQ ID NO: 2567454 - RNA, 20 nt, Chlamydophila pneumoniae J138
uuucgacgcuguugaaaugc

SEQ ID NO: 2567455 - RNA, 20 nt, Chlamydophila pneumoniae J138
uuucgcagauacuucuucca

SEQ ID NO: 2567456 - RNA, 16 nt, Chlamydophila pneumoniae J138
uuucguagacgcucua

SEQ ID NO: 2567457 - RNA, 22 nt, Chlamydophila pneumoniae J138
uuucgucaaagguuuuaaaaug

SEQ ID NO: 2567458 - RNA, 15 nt, Chlamydophila pneumoniae J138
uuucgugaacaaaau

SEQ ID NO: 2567459 - RNA, 14 nt, Chlamydophila pneumoniae J138
uuucguuuuuucuu

SEQ ID NO: 2567460 - RNA, 14 nt, Chlamydophila pneumoniae J138
uuucuaaauacuua

SEQ ID NO: 2567461 - RNA, 18 nt, Chlamydophila pneumoniae J138
uuucuaagauuccuaacu

SEQ ID NO: 2567462 - RNA, 20 nt, Chlamydophila pneumoniae J138
uuucuaagcaauauuucugu

SEQ ID NO: 2567463 - RNA, 17 nt, Chlamydophila pneumoniae J138
uuucuaauccuccaaac

SEQ ID NO: 2567464 - RNA, 20 nt, Chlamydophila pneumoniae J138
uuucuacugaaaccuucucu

SEQ ID NO: 2567465 - RNA, 19 nt, Chlamydophila pneumoniae J138
uuucuacuucaggaaauaa

SEQ ID NO: 2567466 - RNA, 21 nt, Chlamydophila pneumoniae J138
uuucuagaaaagauucuaaau

SEQ ID NO: 2567467 - RNA, 21 nt, Chlamydophila pneumoniae J138
uuucuagaaacugcuccugaa

SEQ ID NO: 2567468 - RNA, 22 nt, Chlamydophila pneumoniae J138
uuucuagcugcucuuuuagaau

SEQ ID NO: 2567469 - RNA, 22 nt, Chlamydophila pneumoniae J138
uuucuaggacagcacauagagu

SEQ ID NO: 2567470 - RNA, 22 nt, Chlamydophila pneumoniae J138
uuucuaggccgggauuuuaauu

SEQ ID NO: 2567471 - RNA, 17 nt, Chlamydophila pneumoniae J138
uuucuauuauuuuaaag

SEQ ID NO: 2567472 - RNA, 17 nt, Chlamydophila pneumoniae J138
uuucucaauaguguaac

SEQ ID NO: 2567473 - RNA, 20 nt, Chlamydophila pneumoniae J138
uuucucucuuuaucuuuaag

SEQ ID NO: 2567474 - RNA, 16 nt, Chlamydophila pneumoniae J138
uuucugaaacaaugca

SEQ ID NO: 2567475 - RNA, 18 nt, Chlamydophila pneumoniae J138
uuucugaaucuuuuguuu

SEQ ID NO: 2567476 - RNA, 13 nt, Chlamydophila pneumoniae J138
uuucugcucuucu

SEQ ID NO: 2567477 - RNA, 16 nt, Chlamydophila pneumoniae J138
uuucuguacaacaaaa

SEQ ID NO: 2567478 - RNA, 20 nt, Chlamydophila pneumoniae J138
uuucuguacaacaaaauuug

SEQ ID NO: 2567479 - RNA, 16 nt, Chlamydophila pneumoniae J138
uuucuguucugcuucu

SEQ ID NO: 2567480 - RNA, 20 nt, Chlamydophila pneumoniae J138
uuucuguucugcuucuguaa

SEQ ID NO: 2567481 - RNA, 15 nt, Chlamydophila pneumoniae J138
uuucuuaauuuccuu

SEQ ID NO: 2567482 - RNA, 14 nt, Chlamydophila pneumoniae J138
uuucuuccacacaa

SEQ ID NO: 2567483 - RNA, 15 nt, Chlamydophila pneumoniae J138
uuucuuccauacagg

SEQ ID NO: 2567484 - RNA, 20 nt, Chlamydophila pneumoniae J138
uuucuucucuaggaagauuu

SEQ ID NO: 2567485 - RNA, 14 nt, Chlamydophila pneumoniae J138
uuucuucuucuaaa

SEQ ID NO: 2567486 - RNA, 14 nt, Chlamydophila pneumoniae J138
uuucuugaaaaauc

SEQ ID NO: 2567487 - RNA, 13 nt, Chlamydophila pneumoniae J138
uuucuugauuaga

SEQ ID NO: 2567488 - RNA, 20 nt, Chlamydophila pneumoniae J138
uuucuuguaagacuaaaaaa

SEQ ID NO: 2567489 - RNA, 22 nt, Chlamydophila pneumoniae J138
uuucuugugguuuuucuccucu

SEQ ID NO: 2567490 - RNA, 12 nt, Chlamydophila pneumoniae J138
uuucuuuagaga

SEQ ID NO: 2567491 - RNA, 14 nt, Chlamydophila pneumoniae J138
uuucuuuauucccu

SEQ ID NO: 2567492 - RNA, 15 nt, Chlamydophila pneumoniae J138
uuucuuuauucccuu

SEQ ID NO: 2567493 - RNA, 14 nt, Chlamydophila pneumoniae J138
uuucuuuccaucau

SEQ ID NO: 2567494 - RNA, 19 nt, Chlamydophila pneumoniae J138
uuucuuuucugaagauuuu

SEQ ID NO: 2567495 - RNA, 13 nt, Chlamydophila pneumoniae J138
uuucuuuugcaaa

SEQ ID NO: 2567496 - RNA, 15 nt, Chlamydophila pneumoniae J138
uuucuuuugcaaauc

SEQ ID NO: 2567497 - RNA, 14 nt, Chlamydophila pneumoniae J138
uuugaaaagaaaga

SEQ ID NO: 2567498 - RNA, 14 nt, Chlamydophila pneumoniae J138
uuugaaaauauccu

SEQ ID NO: 2567499 - RNA, 23 nt, Chlamydophila pneumoniae J138
uuugaaauaauuuucagucuucc

SEQ ID NO: 2567500 - RNA, 17 nt, Chlamydophila pneumoniae J138
uuugaacaacuccuuaa

SEQ ID NO: 2567501 - RNA, 23 nt, Chlamydophila pneumoniae J138
uuugaagaacaaaaaaucaaucu

SEQ ID NO: 2567502 - RNA, 13 nt, Chlamydophila pneumoniae J138
uuugaagauguau

SEQ ID NO: 2567503 - RNA, 14 nt, Chlamydophila pneumoniae J138
uuugaagcuccuca

SEQ ID NO: 2567504 - RNA, 21 nt, Chlamydophila pneumoniae J138
uuugaauauauugugcauuac

SEQ ID NO: 2567505 - RNA, 23 nt, Chlamydophila pneumoniae J138
uuugaauuuccaaaggaaaauaa

SEQ ID NO: 2567506 - RNA, 13 nt, Chlamydophila pneumoniae J138
uuugacaacacca

SEQ ID NO: 2567507 - RNA, 20 nt, Chlamydophila pneumoniae J138
uuugacaucuaauuuuaaau

SEQ ID NO: 2567508 - RNA, 15 nt, Chlamydophila pneumoniae J138
uuugacuugucccaa

SEQ ID NO: 2567509 - RNA, 13 nt, Chlamydophila pneumoniae J138
uuugaggauuucu

SEQ ID NO: 2567510 - RNA, 14 nt, Chlamydophila pneumoniae J138
uuugaggauuucuu

SEQ ID NO: 2567511 - RNA, 14 nt, Chlamydophila pneumoniae J138
uuugaucgcuugug

SEQ ID NO: 2567512 - RNA, 14 nt, Chlamydophila pneumoniae J138
uuugaucuucucua

SEQ ID NO: 2567513 - RNA, 18 nt, Chlamydophila pneumoniae J138
uuugaucuugcucaggag

SEQ ID NO: 2567514 - RNA, 18 nt, Chlamydophila pneumoniae J138
uuugaugaucgaucccuu

SEQ ID NO: 2567515 - RNA, 18 nt, Chlamydophila pneumoniae J138
uuugaugcuucuuucaaa

SEQ ID NO: 2567516 - RNA, 21 nt, Chlamydophila pneumoniae J138
uuugauuauucccaagaacuu

SEQ ID NO: 2567517 - RNA, 13 nt, Chlamydophila pneumoniae J138
uuugauucauaaa

SEQ ID NO: 2567518 - RNA, 14 nt, Chlamydophila pneumoniae J138
uuugauuucagaag

SEQ ID NO: 2567519 - RNA, 13 nt, Chlamydophila pneumoniae J138
uuugauuuuucaa

SEQ ID NO: 2567520 - RNA, 13 nt, Chlamydophila pneumoniae J138
uuugcaaaucuuc

SEQ ID NO: 2567521 - RNA, 13 nt, Chlamydophila pneumoniae J138
uuugcaaaugaaa

SEQ ID NO: 2567522 - RNA, 18 nt, Chlamydophila pneumoniae J138
uuugcaaaugaaaagaga

SEQ ID NO: 2567523 - RNA, 20 nt, Chlamydophila pneumoniae J138
uuugcaguuccgauaaagau

SEQ ID NO: 2567524 - RNA, 13 nt, Chlamydophila pneumoniae J138
uuugccugaaauc

SEQ ID NO: 2567525 - RNA, 21 nt, Chlamydophila pneumoniae J138
uuugccuuuagggaaaaagua

SEQ ID NO: 2567526 - RNA, 19 nt, Chlamydophila pneumoniae J138
uuugcgauaucuauaaaug

SEQ ID NO: 2567527 - RNA, 14 nt, Chlamydophila pneumoniae J138
uuugcgauuucagc

SEQ ID NO: 2567528 - RNA, 17 nt, Chlamydophila pneumoniae J138
uuugcuacagcuucuuu

SEQ ID NO: 2567529 - RNA, 17 nt, Chlamydophila pneumoniae J138
uuugcuagaucuggaga

SEQ ID NO: 2567530 - RNA, 14 nt, Chlamydophila pneumoniae J138
uuugcuccuccaaa

SEQ ID NO: 2567531 - RNA, 18 nt, Chlamydophila pneumoniae J138
uuugcugaagauuuuuuc

SEQ ID NO: 2567532 - RNA, 18 nt, Chlamydophila pneumoniae J138
uuugcugcagcaaaacua

SEQ ID NO: 2567533 - RNA, 16 nt, Chlamydophila pneumoniae J138
uuugcugcgaaugucg

SEQ ID NO: 2567534 - RNA, 14 nt, Chlamydophila pneumoniae J138
uuugcugcucucca

SEQ ID NO: 2567535 - RNA, 17 nt, Chlamydophila pneumoniae J138
uuugcuggagacaacua

SEQ ID NO: 2567536 - RNA, 14 nt, Chlamydophila pneumoniae J138
uuuggaaagcucuu

SEQ ID NO: 2567537 - RNA, 14 nt, Chlamydophila pneumoniae J138
uuuggagaagcuca

SEQ ID NO: 2567538 - RNA, 22 nt, Chlamydophila pneumoniae J138
uuuggauagaagcaugaagcag

SEQ ID NO: 2567539 - RNA, 17 nt, Chlamydophila pneumoniae J138
uuuggcaguucacugag

SEQ ID NO: 2567540 - RNA, 17 nt, Chlamydophila pneumoniae J138
uuugggauaaaaaguuu

SEQ ID NO: 2567541 - RNA, 23 nt, Chlamydophila pneumoniae J138
uuugggauaaaaaguuuuuguuc

SEQ ID NO: 2567542 - RNA, 13 nt, Chlamydophila pneumoniae J138
uuuguaaaugucg

SEQ ID NO: 2567543 - RNA, 15 nt, Chlamydophila pneumoniae J138
uuuguacacagagau

SEQ ID NO: 2567544 - RNA, 19 nt, Chlamydophila pneumoniae J138
uuuguagcucccauaaguu

SEQ ID NO: 2567545 - RNA, 15 nt, Chlamydophila pneumoniae J138
uuuguccuuugcuaa

SEQ ID NO: 2567546 - RNA, 18 nt, Chlamydophila pneumoniae J138
uuugucguaauugcugaa

SEQ ID NO: 2567547 - RNA, 22 nt, Chlamydophila pneumoniae J138
uuugugauauucuuggaauaua

SEQ ID NO: 2567548 - RNA, 22 nt, Chlamydophila pneumoniae J138
uuugugccccuccgauugcuaa

SEQ ID NO: 2567549 - RNA, 18 nt, Chlamydophila pneumoniae J138
uuuguuaauagaagauca

SEQ ID NO: 2567550 - RNA, 21 nt, Chlamydophila pneumoniae J138
uuuguuucuucugugcaucag

SEQ ID NO: 2567551 - RNA, 16 nt, Chlamydophila pneumoniae J138
uuuuaaaaugugucuu

SEQ ID NO: 2567552 - RNA, 19 nt, Chlamydophila pneumoniae J138
uuuuaaagauaaggaccag

SEQ ID NO: 2567553 - RNA, 16 nt, Chlamydophila pneumoniae J138
uuuuaaagcaaaaauu

SEQ ID NO: 2567554 - RNA, 13 nt, Chlamydophila pneumoniae J138
uuuuaaccucuuu

SEQ ID NO: 2567555 - RNA, 18 nt, Chlamydophila pneumoniae J138
uuuuaagugcuuuuagau

SEQ ID NO: 2567556 - RNA, 19 nt, Chlamydophila pneumoniae J138
uuuuaauauuugagaagau

SEQ ID NO: 2567557 - RNA, 13 nt, Chlamydophila pneumoniae J138
uuuuaauucaaaa

SEQ ID NO: 2567558 - RNA, 17 nt, Chlamydophila pneumoniae J138
uuuuaauucaaaaagag

SEQ ID NO: 2567559 - RNA, 22 nt, Chlamydophila pneumoniae J138
uuuuaccaauaaggauagcauu

SEQ ID NO: 2567560 - RNA, 15 nt, Chlamydophila pneumoniae J138
uuuuacgaaucuuuu

SEQ ID NO: 2567561 - RNA, 14 nt, Chlamydophila pneumoniae J138
uuuuacgaauuuca

SEQ ID NO: 2567562 - RNA, 16 nt, Chlamydophila pneumoniae J138
uuuuacguucuuucuu

SEQ ID NO: 2567563 - RNA, 14 nt, Chlamydophila pneumoniae J138
uuuuacuaucuccu

SEQ ID NO: 2567564 - RNA, 12 nt, Chlamydophila pneumoniae J138
uuuuacucccug

SEQ ID NO: 2567565 - RNA, 16 nt, Chlamydophila pneumoniae J138
uuuuacugaaauuaag

SEQ ID NO: 2567566 - RNA, 20 nt, Chlamydophila pneumoniae J138
uuuuacuugcccaaaaguuu

SEQ ID NO: 2567567 - RNA, 23 nt, Chlamydophila pneumoniae J138
uuuuagacgugcucucuucuucu

SEQ ID NO: 2567568 - RNA, 22 nt, Chlamydophila pneumoniae J138
uuuuagcauaaucuuuaacaaa

SEQ ID NO: 2567569 - RNA, 19 nt, Chlamydophila pneumoniae J138
uuuuagguuugucgagcuu

SEQ ID NO: 2567570 - RNA, 16 nt, Chlamydophila pneumoniae J138
uuuuauaaagaagaaa

SEQ ID NO: 2567571 - RNA, 15 nt, Chlamydophila pneumoniae J138
uuuuauagcaucgua

SEQ ID NO: 2567572 - RNA, 15 nt, Chlamydophila pneumoniae J138
uuuuauauuaagaau

SEQ ID NO: 2567573 - RNA, 17 nt, Chlamydophila pneumoniae J138
uuuuauccaccaagacu

SEQ ID NO: 2567574 - RNA, 17 nt, Chlamydophila pneumoniae J138
uuuuaugauuacaucua

SEQ ID NO: 2567575 - RNA, 13 nt, Chlamydophila pneumoniae J138
uuuuauuuaaaau

SEQ ID NO: 2567576 - RNA, 15 nt, Chlamydophila pneumoniae J138
uuuuauuuaaaauuu

SEQ ID NO: 2567577 - RNA, 16 nt, Chlamydophila pneumoniae J138
uuuuauuuccuuaucc

SEQ ID NO: 2567578 - RNA, 14 nt, Chlamydophila pneumoniae J138
uuuuauuuuuaaau

SEQ ID NO: 2567579 - RNA, 23 nt, Chlamydophila pneumoniae J138
uuuucaaauauugcgaacuuuug

SEQ ID NO: 2567580 - RNA, 22 nt, Chlamydophila pneumoniae J138
uuuucaaaucaucaaaaagauc

SEQ ID NO: 2567581 - RNA, 14 nt, Chlamydophila pneumoniae J138
uuuucaagucugua

SEQ ID NO: 2567582 - RNA, 18 nt, Chlamydophila pneumoniae J138
uuuucaagucuguaagga

SEQ ID NO: 2567583 - RNA, 13 nt, Chlamydophila pneumoniae J138
uuuucaauaacca

SEQ ID NO: 2567584 - RNA, 15 nt, Chlamydophila pneumoniae J138
uuuucagcuuguuuu

SEQ ID NO: 2567585 - RNA, 15 nt, Chlamydophila pneumoniae J138
uuuucaggaacuuua

SEQ ID NO: 2567586 - RNA, 20 nt, Chlamydophila pneumoniae J138
uuuuccaggaccaaacuucg

SEQ ID NO: 2567587 - RNA, 16 nt, Chlamydophila pneumoniae J138
uuuucccuuuuuagaa

SEQ ID NO: 2567588 - RNA, 23 nt, Chlamydophila pneumoniae J138
uuuuccgcaaaggaaaagauaug

SEQ ID NO: 2567589 - RNA, 21 nt, Chlamydophila pneumoniae J138
uuuuccugugugguuggaucc

SEQ ID NO: 2567590 - RNA, 14 nt, Chlamydophila pneumoniae J138
uuuucuaagagauc

SEQ ID NO: 2567591 - RNA, 16 nt, Chlamydophila pneumoniae J138
uuuucuaagagaucua

SEQ ID NO: 2567592 - RNA, 22 nt, Chlamydophila pneumoniae J138
uuuucuacuucaggaaauaauu

SEQ ID NO: 2567593 - RNA, 22 nt, Chlamydophila pneumoniae J138
uuuucuagaaaagauucuaaau

SEQ ID NO: 2567594 - RNA, 23 nt, Chlamydophila pneumoniae J138
uuuucuagaaacugcuccugaag

SEQ ID NO: 2567595 - RNA, 14 nt, Chlamydophila pneumoniae J138
uuuucuccuucucc

SEQ ID NO: 2567596 - RNA, 12 nt, Chlamydophila pneumoniae J138
uuuucugcuccu

SEQ ID NO: 2567597 - RNA, 21 nt, Chlamydophila pneumoniae J138
uuuucuuauagggaauuuuuu

SEQ ID NO: 2567598 - RNA, 22 nt, Chlamydophila pneumoniae J138
uuuucuuauagggaauuuuuuc

SEQ ID NO: 2567599 - RNA, 13 nt, Chlamydophila pneumoniae J138
uuuucuuccaaag

SEQ ID NO: 2567600 - RNA, 17 nt, Chlamydophila pneumoniae J138
uuuucuuccacacaacu

SEQ ID NO: 2567601 - RNA, 13 nt, Chlamydophila pneumoniae J138
uuuucuucucuaa

SEQ ID NO: 2567602 - RNA, 15 nt, Chlamydophila pneumoniae J138
uuuucuucuucggau

SEQ ID NO: 2567603 - RNA, 13 nt, Chlamydophila pneumoniae J138
uuuucuucuugca

SEQ ID NO: 2567604 - RNA, 22 nt, Chlamydophila pneumoniae J138
uuuucuucuuuaagauuuccuu

SEQ ID NO: 2567605 - RNA, 13 nt, Chlamydophila pneumoniae J138
uuuucuucuuuag

SEQ ID NO: 2567606 - RNA, 22 nt, Chlamydophila pneumoniae J138
uuuucuuuugcagcaacuuccc

SEQ ID NO: 2567607 - RNA, 14 nt, Chlamydophila pneumoniae J138
uuuugaagugcuuu

SEQ ID NO: 2567608 - RNA, 14 nt, Chlamydophila pneumoniae J138
uuuugagauucaaa

SEQ ID NO: 2567609 - RNA, 23 nt, Chlamydophila pneumoniae J138
uuuugaggaacuucagcuuugcu

SEQ ID NO: 2567610 - RNA, 19 nt, Chlamydophila pneumoniae J138
uuuugauucccuccuuccu

SEQ ID NO: 2567611 - RNA, 21 nt, Chlamydophila pneumoniae J138
uuuugauucccuccuuccuua

SEQ ID NO: 2567612 - RNA, 20 nt, Chlamydophila pneumoniae J138
uuuugcaaaucuucgaauuu

SEQ ID NO: 2567613 - RNA, 16 nt, Chlamydophila pneumoniae J138
uuuugcuaaacaaugc

SEQ ID NO: 2567614 - RNA, 12 nt, Chlamydophila pneumoniae J138
uuuugcucucua

SEQ ID NO: 2567615 - RNA, 13 nt, Chlamydophila pneumoniae J138
uuuugcugaagau

SEQ ID NO: 2567616 - RNA, 18 nt, Chlamydophila pneumoniae J138
uuuugcugaagauuuuuu

SEQ ID NO: 2567617 - RNA, 16 nt, Chlamydophila pneumoniae J138
uuuugcuuuucccaca

SEQ ID NO: 2567618 - RNA, 15 nt, Chlamydophila pneumoniae J138
uuuugcuuuucccuu

SEQ ID NO: 2567619 - RNA, 20 nt, Chlamydophila pneumoniae J138
uuuugguugugucaacccuu

SEQ ID NO: 2567620 - RNA, 20 nt, Chlamydophila pneumoniae J138
uuuuguaaucuaagaaucua

SEQ ID NO: 2567621 - RNA, 13 nt, Chlamydophila pneumoniae J138
uuuuguacacaga

SEQ ID NO: 2567622 - RNA, 14 nt, Chlamydophila pneumoniae J138
uuuuguaggaacau

SEQ ID NO: 2567623 - RNA, 22 nt, Chlamydophila pneumoniae J138
uuuugucgcaauaacaaacgcc

SEQ ID NO: 2567624 - RNA, 13 nt, Chlamydophila pneumoniae J138
uuuugucuucauc

SEQ ID NO: 2567625 - RNA, 16 nt, Chlamydophila pneumoniae J138
uuuuguggcuuuucua

SEQ ID NO: 2567626 - RNA, 18 nt, Chlamydophila pneumoniae J138
uuuuguggcuuuucuaaa

SEQ ID NO: 2567627 - RNA, 17 nt, Chlamydophila pneumoniae J138
uuuuguuaaauucccaa

SEQ ID NO: 2567628 - RNA, 12 nt, Chlamydophila pneumoniae J138
uuuuuaaaacuc

SEQ ID NO: 2567629 - RNA, 13 nt, Chlamydophila pneumoniae J138
uuuuuauuuaaaa

SEQ ID NO: 2567630 - RNA, 16 nt, Chlamydophila pneumoniae J138
uuuuucaagguucucu

SEQ ID NO: 2567631 - RNA, 15 nt, Chlamydophila pneumoniae J138
uuuuuccaacuucaa

SEQ ID NO: 2567632 - RNA, 20 nt, Chlamydophila pneumoniae J138
uuuuuccauuuuuccuccuc

SEQ ID NO: 2567633 - RNA, 16 nt, Chlamydophila pneumoniae J138
uuuuucccucgcuaaa

SEQ ID NO: 2567634 - RNA, 12 nt, Chlamydophila pneumoniae J138
uuuuugaaaacu

SEQ ID NO: 2567635 - RNA, 14 nt, Chlamydophila pneumoniae J138
uuuuugaaaacuuc

SEQ ID NO: 2567636 - RNA, 13 nt, Chlamydophila pneumoniae J138
uuuuugaaaauuu

SEQ ID NO: 2567637 - RNA, 20 nt, Chlamydophila pneumoniae J138
uuuuugaaaauuuucccauu

SEQ ID NO: 2567638 - RNA, 17 nt, Chlamydophila pneumoniae J138
uuuuugcugaagauuuu

SEQ ID NO: 2567639 - RNA, 21 nt, Chlamydophila pneumoniae J138
uuuuugcuguuucuucugaau

SEQ ID NO: 2567640 - RNA, 13 nt, Chlamydophila pneumoniae J138
uuuuuggaaaacc

SEQ ID NO: 2567641 - RNA, 16 nt, Chlamydophila pneumoniae J138
uuuuuggaaauccgua

SEQ ID NO: 2567642 - RNA, 17 nt, Chlamydophila pneumoniae J138
uuuuuguuaaauuccca

SEQ ID NO: 2567643 - RNA, 19 nt, Chlamydophila pneumoniae J138
uuuuuuaaagcuauuguuu

SEQ ID NO: 2567644 - RNA, 12 nt, Chlamydophila pneumoniae J138
uuuuuuaaccuc

SEQ ID NO: 2567645 - RNA, 12 nt, Chlamydophila pneumoniae J138
uuuuuucuaaau

SEQ ID NO: 2567646 - RNA, 11 nt, Chlamydophila pneumoniae J138
uuuuuucuaua

SEQ ID NO: 2567647 - RNA, 11 nt, Chlamydophila pneumoniae J138
uuuuuucuauu

SEQ ID NO: 2567648 - RNA, 16 nt, Chlamydophila pneumoniae TW-183
aaaucuuccccuaaaa

SEQ ID NO: 2567649 - RNA, 19 nt, Chlamydophila pneumoniae TW-183
aaaucuuccccuaaaaauu

SEQ ID NO: 2567650 - RNA, 11 nt, Chlamydophila pneumoniae TW-183
aaaugauuuuu

SEQ ID NO: 2567651 - RNA, 11 nt, Chlamydophila pneumoniae TW-183
aaauucccaua

SEQ ID NO: 2567652 - RNA, 13 nt, Chlamydophila pneumoniae TW-183
aaauucuaagcgc

SEQ ID NO: 2567653 - RNA, 23 nt, Chlamydophila pneumoniae TW-183
aaauucucauaaccuaaggcaug

SEQ ID NO: 2567654 - RNA, 12 nt, Chlamydophila pneumoniae TW-183
aaauucuguaaa

SEQ ID NO: 2567655 - RNA, 17 nt, Chlamydophila pneumoniae TW-183
aaauugcauuuaaacua

SEQ ID NO: 2567656 - RNA, 12 nt, Chlamydophila pneumoniae TW-183
aaauugcucuug

SEQ ID NO: 2567657 - RNA, 20 nt, Chlamydophila pneumoniae TW-183
aaauuguuaucaggaacuaa

SEQ ID NO: 2567658 - RNA, 22 nt, Chlamydophila pneumoniae TW-183
aaauuuaagauaucgaccuuaa

SEQ ID NO: 2567659 - RNA, 15 nt, Chlamydophila pneumoniae TW-183
aaauuucauuuagac

SEQ ID NO: 2567660 - RNA, 19 nt, Chlamydophila pneumoniae TW-183
aaauuuucuugcgacauaa

SEQ ID NO: 2567661 - RNA, 21 nt, Chlamydophila pneumoniae TW-183
aacaaacuuguuuucguaaga

SEQ ID NO: 2567662 - RNA, 12 nt, Chlamydophila pneumoniae TW-183
aacaaaguuuau

SEQ ID NO: 2567663 - RNA, 11 nt, Chlamydophila pneumoniae TW-183
aacaacaucac

SEQ ID NO: 2567664 - RNA, 23 nt, Chlamydophila pneumoniae TW-183
aacaacaucacuaucauggacaa

SEQ ID NO: 2567665 - RNA, 22 nt, Chlamydophila pneumoniae TW-183
aacaagagcgcauuuuacagcg

SEQ ID NO: 2567666 - RNA, 14 nt, Chlamydophila pneumoniae TW-183
aacaaguaccaaga

SEQ ID NO: 2567667 - RNA, 14 nt, Chlamydophila pneumoniae TW-183
aacaagucggcagg

SEQ ID NO: 2567668 - RNA, 15 nt, Chlamydophila pneumoniae TW-183
aacacaaauagcaag

SEQ ID NO: 2567669 - RNA, 20 nt, Chlamydophila pneumoniae TW-183
aacacaaauagcaagagcua

SEQ ID NO: 2567670 - RNA, 19 nt, Chlamydophila pneumoniae TW-183
aacacaugucucuuaaaaa

SEQ ID NO: 2567671 - RNA, 20 nt, Chlamydophila pneumoniae TW-183
aacaccuucuucuaaaaucu

SEQ ID NO: 2567672 - RNA, 14 nt, Chlamydophila pneumoniae TW-183
aacagaaauugcuu

SEQ ID NO: 2567673 - RNA, 16 nt, Chlamydophila pneumoniae TW-183
aacagaaauugcuucu

SEQ ID NO: 2567674 - RNA, 20 nt, Chlamydophila pneumoniae TW-183
aacagauaagacaauaaaau

SEQ ID NO: 2567675 - RNA, 18 nt, Chlamydophila pneumoniae TW-183
aacagcauggacuccaag

SEQ ID NO: 2567676 - RNA, 14 nt, Chlamydophila pneumoniae TW-183
aacagguucacuuc

SEQ ID NO: 2567677 - RNA, 15 nt, Chlamydophila pneumoniae TW-183
aacauagauaaggua

SEQ ID NO: 2567678 - RNA, 16 nt, Chlamydophila pneumoniae TW-183
aacauagauaagguaa

SEQ ID NO: 2567679 - RNA, 17 nt, Chlamydophila pneumoniae TW-183
aacaucacucaggauau

SEQ ID NO: 2567680 - RNA, 11 nt, Chlamydophila pneumoniae TW-183
aacaugaggau

SEQ ID NO: 2567681 - RNA, 17 nt, Chlamydophila pneumoniae TW-183
aacauucuucugucugu

SEQ ID NO: 2567682 - RNA, 13 nt, Chlamydophila pneumoniae TW-183
aaccagaacacau

SEQ ID NO: 2567683 - RNA, 19 nt, Chlamydophila pneumoniae TW-183
aaccagaacacaugucucu

SEQ ID NO: 2567684 - RNA, 13 nt, Chlamydophila pneumoniae TW-183
aaccauaaagaau

SEQ ID NO: 2567685 - RNA, 16 nt, Chlamydophila pneumoniae TW-183
aaccuccgcucuaagc

SEQ ID NO: 2567686 - RNA, 19 nt, Chlamydophila pneumoniae TW-183
aaccuucgauuccaggcuc

SEQ ID NO: 2567687 - RNA, 23 nt, Chlamydophila pneumoniae TW-183
aacgcaugacgcuuuuccaaagc

SEQ ID NO: 2567688 - RNA, 18 nt, Chlamydophila pneumoniae TW-183
aacgccaacacgcacaaa

SEQ ID NO: 2567689 - RNA, 19 nt, Chlamydophila pneumoniae TW-183
aacgggagcguuuuuugaa

SEQ ID NO: 2567690 - RNA, 12 nt, Chlamydophila pneumoniae TW-183
aacguacuuagg

SEQ ID NO: 2567691 - RNA, 15 nt, Chlamydophila pneumoniae TW-183
aacguacuuagguaa

SEQ ID NO: 2567692 - RNA, 17 nt, Chlamydophila pneumoniae TW-183
aacguagcuacaaaauu

SEQ ID NO: 2567693 - RNA, 18 nt, Chlamydophila pneumoniae TW-183
aacguagcuacaaaauua

SEQ ID NO: 2567694 - RNA, 15 nt, Chlamydophila pneumoniae TW-183
aacgugcugcgaauu

SEQ ID NO: 2567695 - RNA, 22 nt, Chlamydophila pneumoniae TW-183
aacuaaaaugguaaaccuaccu

SEQ ID NO: 2567696 - RNA, 18 nt, Chlamydophila pneumoniae TW-183
aacuaaacucuccaaaag

SEQ ID NO: 2567697 - RNA, 17 nt, Chlamydophila pneumoniae TW-183
aacuaaaucaacuacau

SEQ ID NO: 2567698 - RNA, 20 nt, Chlamydophila pneumoniae TW-183
aacuaacauagauaagguaa

SEQ ID NO: 2567699 - RNA, 12 nt, Chlamydophila pneumoniae TW-183
aacucagagauu

SEQ ID NO: 2567700 - RNA, 18 nt, Chlamydophila pneumoniae TW-183
aacuccccaguuuuccau

SEQ ID NO: 2567701 - RNA, 21 nt, Chlamydophila pneumoniae TW-183
aacuccuaagucguuaacauc

SEQ ID NO: 2567702 - RNA, 22 nt, Chlamydophila pneumoniae TW-183
aacuccuaagucguuaacauca

SEQ ID NO: 2567703 - RNA, 12 nt, Chlamydophila pneumoniae TW-183
aacuccucuaag

SEQ ID NO: 2567704 - RNA, 19 nt, Chlamydophila pneumoniae TW-183
aacuuaaagacuugcuucc

SEQ ID NO: 2567705 - RNA, 20 nt, Chlamydophila pneumoniae TW-183
aacuuagaaaagugaagaaa

SEQ ID NO: 2567706 - RNA, 14 nt, Chlamydophila pneumoniae TW-183
aacuucuaaaagca

SEQ ID NO: 2567707 - RNA, 21 nt, Chlamydophila pneumoniae TW-183
aacuuguuuucguaagagaau

SEQ ID NO: 2567708 - RNA, 18 nt, Chlamydophila pneumoniae TW-183
aacuuugaggcaagucuc

SEQ ID NO: 2567709 - RNA, 20 nt, Chlamydophila pneumoniae TW-183
aagaaaaaccccuagaacuu

SEQ ID NO: 2567710 - RNA, 21 nt, Chlamydophila pneumoniae TW-183
aagaaaacaaagucacggcga

SEQ ID NO: 2567711 - RNA, 20 nt, Chlamydophila pneumoniae TW-183
aagaaauauacugccagcga

SEQ ID NO: 2567712 - RNA, 15 nt, Chlamydophila pneumoniae TW-183
aagaaaucaguccua

SEQ ID NO: 2567713 - RNA, 17 nt, Chlamydophila pneumoniae TW-183
aagaaauucugacuaua

SEQ ID NO: 2567714 - RNA, 22 nt, Chlamydophila pneumoniae TW-183
aagaagacuagcuuuucauguu

SEQ ID NO: 2567715 - RNA, 18 nt, Chlamydophila pneumoniae TW-183
aagaagcuuuccuccuug

SEQ ID NO: 2567716 - RNA, 15 nt, Chlamydophila pneumoniae TW-183
aagaauagcaggaag

SEQ ID NO: 2567717 - RNA, 20 nt, Chlamydophila pneumoniae TW-183
aagaaucgaguucuucauug

SEQ ID NO: 2567718 - RNA, 20 nt, Chlamydophila pneumoniae TW-183
aagaauguagcuguuccaag

SEQ ID NO: 2567719 - RNA, 17 nt, Chlamydophila pneumoniae TW-183
aagaauuucauaagaga

SEQ ID NO: 2567720 - RNA, 13 nt, Chlamydophila pneumoniae TW-183
aagaccagaauac

SEQ ID NO: 2567721 - RNA, 14 nt, Chlamydophila pneumoniae TW-183
aagacucucaucag

SEQ ID NO: 2567722 - RNA, 16 nt, Chlamydophila pneumoniae TW-183
aagacucucaucagca

SEQ ID NO: 2567723 - RNA, 19 nt, Chlamydophila pneumoniae TW-183
aagacucucaucagcaaaa

SEQ ID NO: 2567724 - RNA, 16 nt, Chlamydophila pneumoniae TW-183
aagacugaaaagaucg

SEQ ID NO: 2567725 - RNA, 15 nt, Chlamydophila pneumoniae TW-183
aagagaaucuccuca

SEQ ID NO: 2567726 - RNA, 22 nt, Chlamydophila pneumoniae TW-183
aagagagcuugucacacugcga

SEQ ID NO: 2567727 - RNA, 17 nt, Chlamydophila pneumoniae TW-183
aagagcccccauaggaa

SEQ ID NO: 2567728 - RNA, 14 nt, Chlamydophila pneumoniae TW-183
aagagcgcauuuua

SEQ ID NO: 2567729 - RNA, 19 nt, Chlamydophila pneumoniae TW-183
aagagcucaucaaugagaa

SEQ ID NO: 2567730 - RNA, 17 nt, Chlamydophila pneumoniae TW-183
aagagcucguaauccuu

SEQ ID NO: 2567731 - RNA, 18 nt, Chlamydophila pneumoniae TW-183
aagaguagccccagcaac

SEQ ID NO: 2567732 - RNA, 22 nt, Chlamydophila pneumoniae TW-183
aagagucuuugaugcuaaacga

SEQ ID NO: 2567733 - RNA, 13 nt, Chlamydophila pneumoniae TW-183
aagagugccaaga

SEQ ID NO: 2567734 - RNA, 15 nt, Chlamydophila pneumoniae TW-183
aagauaaagaauucu

SEQ ID NO: 2567735 - RNA, 16 nt, Chlamydophila pneumoniae TW-183
aagauacgaaguccca

SEQ ID NO: 2567736 - RNA, 18 nt, Chlamydophila pneumoniae TW-183
aagauagccgaguccuau

SEQ ID NO: 2567737 - RNA, 19 nt, Chlamydophila pneumoniae TW-183
aagauccuaauauccauaa

SEQ ID NO: 2567738 - RNA, 22 nt, Chlamydophila pneumoniae TW-183
aagaucgaucucugugguuccu

SEQ ID NO: 2567739 - RNA, 20 nt, Chlamydophila pneumoniae TW-183
aagaucucuaaguucuugau

SEQ ID NO: 2567740 - RNA, 22 nt, Chlamydophila pneumoniae TW-183
aagaugcauucugauccgaaaa

SEQ ID NO: 2567741 - RNA, 13 nt, Chlamydophila pneumoniae TW-183
aagauuuuuucuu

SEQ ID NO: 2567742 - RNA, 20 nt, Chlamydophila pneumoniae TW-183
aagcaaggcugccagagauu

SEQ ID NO: 2567743 - RNA, 22 nt, Chlamydophila pneumoniae TW-183
aagcaggugugugguaaaaaua

SEQ ID NO: 2567744 - RNA, 20 nt, Chlamydophila pneumoniae TW-183
aagcuaauaagauccaaaaa

SEQ ID NO: 2567745 - RNA, 16 nt, Chlamydophila pneumoniae TW-183
aagcucgaccucuagc

SEQ ID NO: 2567746 - RNA, 23 nt, Chlamydophila pneumoniae TW-183
aauugaacguagcuacaaaauua

SEQ ID NO: 2567747 - RNA, 16 nt, Chlamydophila pneumoniae TW-183
aauugagcucucuagc

SEQ ID NO: 2567748 - RNA, 20 nt, Chlamydophila pneumoniae TW-183
aauugagcucucuagcuguu

SEQ ID NO: 2567749 - RNA, 17 nt, Chlamydophila pneumoniae TW-183
aauuucauguccuccau

SEQ ID NO: 2567750 - RNA, 20 nt, Chlamydophila pneumoniae TW-183
aauuucuccaguaucuucuc

SEQ ID NO: 2567751 - RNA, 22 nt, Chlamydophila pneumoniae TW-183
aauuucuccaguaucuucucuu

SEQ ID NO: 2567752 - RNA, 22 nt, Chlamydophila pneumoniae TW-183
aauuuucagccugucuauaaaa

SEQ ID NO: 2567753 - RNA, 12 nt, Chlamydophila pneumoniae TW-183
aauuuucccauu

SEQ ID NO: 2567754 - RNA, 15 nt, Chlamydophila pneumoniae TW-183
aauuuucccauuaca

SEQ ID NO: 2567755 - RNA, 16 nt, Chlamydophila pneumoniae TW-183
aauuuucugugacaaa

SEQ ID NO: 2567756 - RNA, 23 nt, Chlamydophila pneumoniae TW-183
aauuuucuugcgacauaaccauc

SEQ ID NO: 2567757 - RNA, 23 nt, Chlamydophila pneumoniae TW-183
acaaaagguauugcaaauuucau

SEQ ID NO: 2567758 - RNA, 20 nt, Chlamydophila pneumoniae TW-183
acaaaauucaugcaaaacaa

SEQ ID NO: 2567759 - RNA, 21 nt, Chlamydophila pneumoniae TW-183
acaaacuaacauagauaaggu

SEQ ID NO: 2567760 - RNA, 19 nt, Chlamydophila pneumoniae TW-183
acaaauuaccuugagacaa

SEQ ID NO: 2567761 - RNA, 18 nt, Chlamydophila pneumoniae TW-183
acaacaccacagaggucg

SEQ ID NO: 2567762 - RNA, 15 nt, Chlamydophila pneumoniae TW-183
acaacaguugcggag

SEQ ID NO: 2567763 - RNA, 22 nt, Chlamydophila pneumoniae TW-183
acaacaguugcggagaugccau

SEQ ID NO: 2567764 - RNA, 13 nt, Chlamydophila pneumoniae TW-183
acaagaaaacaaa

SEQ ID NO: 2567765 - RNA, 14 nt, Chlamydophila pneumoniae TW-183
acaagaaaacaaag

SEQ ID NO: 2567766 - RNA, 23 nt, Chlamydophila pneumoniae TW-183
acaagcuucguccugacacaacu

SEQ ID NO: 2567767 - RNA, 15 nt, Chlamydophila pneumoniae TW-183
acaaguaccaagaaa

SEQ ID NO: 2567768 - RNA, 22 nt, Chlamydophila pneumoniae TW-183
acaaucucuagggauaauuaaa

SEQ ID NO: 2567769 - RNA, 16 nt, Chlamydophila pneumoniae TW-183
acaaugauaucagcau

SEQ ID NO: 2567770 - RNA, 19 nt, Chlamydophila pneumoniae TW-183
acacaaauagcaagagcua

SEQ ID NO: 2567771 - RNA, 19 nt, Chlamydophila pneumoniae TW-183
acacaacucuuaaaucgcu

SEQ ID NO: 2567772 - RNA, 20 nt, Chlamydophila pneumoniae TW-183
acacagagaugcuucuaaac

SEQ ID NO: 2567773 - RNA, 12 nt, Chlamydophila pneumoniae TW-183
acaccuucuucu

SEQ ID NO: 2567774 - RNA, 22 nt, Chlamydophila pneumoniae TW-183
acaccuucuucuaaaaucuucu

SEQ ID NO: 2567775 - RNA, 15 nt, Chlamydophila pneumoniae TW-183
acacgaggagccucu

SEQ ID NO: 2567776 - RNA, 13 nt, Chlamydophila pneumoniae TW-183
acacucagagaug

SEQ ID NO: 2567777 - RNA, 18 nt, Chlamydophila pneumoniae TW-183
acacugcgagagaaaguc

SEQ ID NO: 2567778 - RNA, 19 nt, Chlamydophila pneumoniae TW-183
acacuuaaagguaaaacua

SEQ ID NO: 2567779 - RNA, 20 nt, Chlamydophila pneumoniae TW-183
acagaaauugcuucuuccaa

SEQ ID NO: 2567780 - RNA, 20 nt, Chlamydophila pneumoniae TW-183
acagaaguuccuacuucugc

SEQ ID NO: 2567781 - RNA, 14 nt, Chlamydophila pneumoniae TW-183
acagacuugaggaa

SEQ ID NO: 2567782 - RNA, 16 nt, Chlamydophila pneumoniae TW-183
acagauaggaaccacu

SEQ ID NO: 2567783 - RNA, 14 nt, Chlamydophila pneumoniae TW-183
acagcauaaaaauu

SEQ ID NO: 2567784 - RNA, 22 nt, Chlamydophila pneumoniae TW-183
acagcaucaggauucucucugc

SEQ ID NO: 2567785 - RNA, 16 nt, Chlamydophila pneumoniae TW-183
acagcaucggcaacca

SEQ ID NO: 2567786 - RNA, 18 nt, Chlamydophila pneumoniae TW-183
acagcauggacuccaaga

SEQ ID NO: 2567787 - RNA, 17 nt, Chlamydophila pneumoniae TW-183
acagcguguauccaucu

SEQ ID NO: 2567788 - RNA, 18 nt, Chlamydophila pneumoniae TW-183
acagcuaaucaauccaag

SEQ ID NO: 2567789 - RNA, 22 nt, Chlamydophila pneumoniae TW-183
acagcuaaucaauccaagaaua

SEQ ID NO: 2567790 - RNA, 17 nt, Chlamydophila pneumoniae TW-183
acaggagagagaaggcu

SEQ ID NO: 2567791 - RNA, 21 nt, Chlamydophila pneumoniae TW-183
acaggggaugugauguucugc

SEQ ID NO: 2567792 - RNA, 13 nt, Chlamydophila pneumoniae TW-183
acagguucacuuc

SEQ ID NO: 2567793 - RNA, 13 nt, Chlamydophila pneumoniae TW-183
acauaaagucaaa

SEQ ID NO: 2567794 - RNA, 24 nt, Chlamydophila pneumoniae TW-183
acauagagauucuacaaauuaccu

SEQ ID NO: 2567795 - RNA, 20 nt, Chlamydophila pneumoniae TW-183
acauaucgauaggauucgga

SEQ ID NO: 2567796 - RNA, 16 nt, Chlamydophila pneumoniae TW-183
acaucaaauaguucau

SEQ ID NO: 2567797 - RNA, 19 nt, Chlamydophila pneumoniae TW-183
acaucaaauaguucaucau

SEQ ID NO: 2567798 - RNA, 11 nt, Chlamydophila pneumoniae TW-183
acaucaaugau

SEQ ID NO: 2567799 - RNA, 14 nt, Chlamydophila pneumoniae TW-183
acaucacuaucaug

SEQ ID NO: 2567800 - RNA, 19 nt, Chlamydophila pneumoniae TW-183
acaucacuuauauuuucua

SEQ ID NO: 2567801 - RNA, 17 nt, Chlamydophila pneumoniae TW-183
acauccuggagcaugag

SEQ ID NO: 2567802 - RNA, 18 nt, Chlamydophila pneumoniae TW-183
acauccuggagcaugaga

SEQ ID NO: 2567803 - RNA, 22 nt, Chlamydophila pneumoniae TW-183
acaucucuuuaacuucuaaaag

SEQ ID NO: 2567804 - RNA, 19 nt, Chlamydophila pneumoniae TW-183
acaucuguaguaggcacuu

SEQ ID NO: 2567805 - RNA, 20 nt, Chlamydophila pneumoniae TW-183
acaugaggauucuuuuugau

SEQ ID NO: 2567806 - RNA, 19 nt, Chlamydophila pneumoniae TW-183
acauucacccucauuaaga

SEQ ID NO: 2567807 - RNA, 19 nt, Chlamydophila pneumoniae TW-183
acauucaggauacucugaa

SEQ ID NO: 2567808 - RNA, 18 nt, Chlamydophila pneumoniae TW-183
acauugaccuaaaggaau

SEQ ID NO: 2567809 - RNA, 23 nt, Chlamydophila pneumoniae TW-183
acauuguuuaaguccuucuuccc

SEQ ID NO: 2567810 - RNA, 17 nt, Chlamydophila pneumoniae TW-183
acuucaacuucuccaac

SEQ ID NO: 2567811 - RNA, 19 nt, Chlamydophila pneumoniae TW-183
acuucccgaacagcggcaa

SEQ ID NO: 2567812 - RNA, 15 nt, Chlamydophila pneumoniae TW-183
acuucuaaaagcaag

SEQ ID NO: 2567813 - RNA, 14 nt, Chlamydophila pneumoniae TW-183
acuucucucuuaau

SEQ ID NO: 2567814 - RNA, 17 nt, Chlamydophila pneumoniae TW-183
acuucucucuuaauuuu

SEQ ID NO: 2567815 - RNA, 23 nt, Chlamydophila pneumoniae TW-183
acuucugcaggacugucuagcag

SEQ ID NO: 2567816 - RNA, 18 nt, Chlamydophila pneumoniae TW-183
acuucuugugauccuugc

SEQ ID NO: 2567817 - RNA, 21 nt, Chlamydophila pneumoniae TW-183
acuucuugugauccuugcaaa

SEQ ID NO: 2567818 - RNA, 17 nt, Chlamydophila pneumoniae TW-183
acuugcgauacaauaaa

SEQ ID NO: 2567819 - RNA, 20 nt, Chlamydophila pneumoniae TW-183
acuuuauucucuucacuauu

SEQ ID NO: 2567820 - RNA, 17 nt, Chlamydophila pneumoniae TW-183
acuuuccguagccuuac

SEQ ID NO: 2567821 - RNA, 17 nt, Chlamydophila pneumoniae TW-183
acuuuccucucuuuaua

SEQ ID NO: 2567822 - RNA, 22 nt, Chlamydophila pneumoniae TW-183
acuuugaggcaagucucaaagg

SEQ ID NO: 2567823 - RNA, 17 nt, Chlamydophila pneumoniae TW-183
acuuugcaauacaccaa

SEQ ID NO: 2567824 - RNA, 22 nt, Chlamydophila pneumoniae TW-183
acuuuguuaauagaagaucauu

SEQ ID NO: 2567825 - RNA, 15 nt, Chlamydophila pneumoniae TW-183
acuuuuguacacaga

SEQ ID NO: 2567826 - RNA, 21 nt, Chlamydophila pneumoniae TW-183
agaaaaauucuuuagggaggc

SEQ ID NO: 2567827 - RNA, 13 nt, Chlamydophila pneumoniae TW-183
agaaaacauagag

SEQ ID NO: 2567828 - RNA, 15 nt, Chlamydophila pneumoniae TW-183
agaaaagaacagggg

SEQ ID NO: 2567829 - RNA, 19 nt, Chlamydophila pneumoniae TW-183
agaaaagagcucaucaaug

SEQ ID NO: 2567830 - RNA, 12 nt, Chlamydophila pneumoniae TW-183
agaaaccagaac

SEQ ID NO: 2567831 - RNA, 15 nt, Chlamydophila pneumoniae TW-183
agaaacuccaaaaua

SEQ ID NO: 2567832 - RNA, 16 nt, Chlamydophila pneumoniae TW-183
agaaacuccaaaauau

SEQ ID NO: 2567833 - RNA, 20 nt, Chlamydophila pneumoniae TW-183
agaaagaaguccuagggagu

SEQ ID NO: 2567834 - RNA, 15 nt, Chlamydophila pneumoniae TW-183
agaaaucaguccuaa

SEQ ID NO: 2567835 - RNA, 13 nt, Chlamydophila pneumoniae TW-183
agaaaugcucuuc

SEQ ID NO: 2567836 - RNA, 21 nt, Chlamydophila pneumoniae TW-183
agaaauucuaagcgcucuuca

SEQ ID NO: 2567837 - RNA, 13 nt, Chlamydophila pneumoniae TW-183
agaaauucugacu

SEQ ID NO: 2567838 - RNA, 19 nt, Chlamydophila pneumoniae TW-183
agaaauucuguagauacua

SEQ ID NO: 2567839 - RNA, 22 nt, Chlamydophila pneumoniae TW-183
agaacaaggcuccguugaauua

SEQ ID NO: 2567840 - RNA, 16 nt, Chlamydophila pneumoniae TW-183
agaacacucagagaug

SEQ ID NO: 2567841 - RNA, 17 nt, Chlamydophila pneumoniae TW-183
agaacacucagagaugu

SEQ ID NO: 2567842 - RNA, 21 nt, Chlamydophila pneumoniae TW-183
agaacagcauggacuccaaga

SEQ ID NO: 2567843 - RNA, 15 nt, Chlamydophila pneumoniae TW-183
agaacaugcccccac

SEQ ID NO: 2567844 - RNA, 20 nt, Chlamydophila pneumoniae TW-183
agaacauguuucuaagcuga

SEQ ID NO: 2567845 - RNA, 22 nt, Chlamydophila pneumoniae TW-183
agaaccuaggaaauccuccuag

SEQ ID NO: 2567846 - RNA, 15 nt, Chlamydophila pneumoniae TW-183
agaaccuucacaaga

SEQ ID NO: 2567847 - RNA, 19 nt, Chlamydophila pneumoniae TW-183
agaaccuucacaagaaaac

SEQ ID NO: 2567848 - RNA, 21 nt, Chlamydophila pneumoniae TW-183
agaacguccucaccuugugag

SEQ ID NO: 2567849 - RNA, 12 nt, Chlamydophila pneumoniae TW-183
agaacuucaaca

SEQ ID NO: 2567850 - RNA, 13 nt, Chlamydophila pneumoniae TW-183
agaacuucuccaa

SEQ ID NO: 2567851 - RNA, 21 nt, Chlamydophila pneumoniae TW-183
agaacuuuaacgaagaaggga

SEQ ID NO: 2567852 - RNA, 17 nt, Chlamydophila pneumoniae TW-183
agaagaaauuagaggga

SEQ ID NO: 2567853 - RNA, 18 nt, Chlamydophila pneumoniae TW-183
agaagacuagcuuuucau

SEQ ID NO: 2567854 - RNA, 13 nt, Chlamydophila pneumoniae TW-183
agaagcaaaggua

SEQ ID NO: 2567855 - RNA, 13 nt, Chlamydophila pneumoniae TW-183
agaagccaccaaa

SEQ ID NO: 2567856 - RNA, 15 nt, Chlamydophila pneumoniae TW-183
agaagccaccaaaaa

SEQ ID NO: 2567857 - RNA, 22 nt, Chlamydophila pneumoniae TW-183
agaagcugacaaauagaaagga

SEQ ID NO: 2567858 - RNA, 16 nt, Chlamydophila pneumoniae TW-183
agaaggccaguuacug

SEQ ID NO: 2567859 - RNA, 23 nt, Chlamydophila pneumoniae TW-183
agaagguguuuuggcugcuuuug

SEQ ID NO: 2567860 - RNA, 22 nt, Chlamydophila pneumoniae TW-183
agaaguauucgauuccugaggc

SEQ ID NO: 2567861 - RNA, 19 nt, Chlamydophila pneumoniae TW-183
agaagugaucuugagaaaa

SEQ ID NO: 2567862 - RNA, 16 nt, Chlamydophila pneumoniae TW-183
agaagugcuuuuagag

SEQ ID NO: 2567863 - RNA, 17 nt, Chlamydophila pneumoniae TW-183
agaagugcuuuuagagg

SEQ ID NO: 2567864 - RNA, 24 nt, Chlamydophila pneumoniae TW-183
agaauagccauaauuagaacagca

SEQ ID NO: 2567865 - RNA, 14 nt, Chlamydophila pneumoniae TW-183
agaaucuccucauc

SEQ ID NO: 2567866 - RNA, 16 nt, Chlamydophila pneumoniae TW-183
agaaucuccucaucag

SEQ ID NO: 2567867 - RNA, 12 nt, Chlamydophila pneumoniae TW-183
agaaucuuugug

SEQ ID NO: 2567868 - RNA, 17 nt, Chlamydophila pneumoniae TW-183
agaauguaugugaaaga

SEQ ID NO: 2567869 - RNA, 22 nt, Chlamydophila pneumoniae TW-183
agacaaagaauccccccuucua

SEQ ID NO: 2567870 - RNA, 22 nt, Chlamydophila pneumoniae TW-183
agacacaggggaacgcucucua

SEQ ID NO: 2567871 - RNA, 18 nt, Chlamydophila pneumoniae TW-183
agaccugccaagauacua

SEQ ID NO: 2567872 - RNA, 13 nt, Chlamydophila pneumoniae TW-183
agacguaaccaca

SEQ ID NO: 2567873 - RNA, 22 nt, Chlamydophila pneumoniae TW-183
agacguuaucuaagacuucugg

SEQ ID NO: 2567874 - RNA, 14 nt, Chlamydophila pneumoniae TW-183
agacucucaucagc

SEQ ID NO: 2567875 - RNA, 15 nt, Chlamydophila pneumoniae TW-183
agacucucaucagca

SEQ ID NO: 2567876 - RNA, 13 nt, Chlamydophila pneumoniae TW-183
agacugaaaagau

SEQ ID NO: 2567877 - RNA, 14 nt, Chlamydophila pneumoniae TW-183
agagaacaggaggu

SEQ ID NO: 2567878 - RNA, 12 nt, Chlamydophila pneumoniae TW-183
agagaagaaaag

SEQ ID NO: 2567879 - RNA, 19 nt, Chlamydophila pneumoniae TW-183
agagaaucuccucaucaga

SEQ ID NO: 2567880 - RNA, 22 nt, Chlamydophila pneumoniae TW-183
agagagcuugucacacugcgag

SEQ ID NO: 2567881 - RNA, 19 nt, Chlamydophila pneumoniae TW-183
agagauuaccgaagagccc

SEQ ID NO: 2567882 - RNA, 16 nt, Chlamydophila pneumoniae TW-183
agagauucauaaaacu

SEQ ID NO: 2567883 - RNA, 17 nt, Chlamydophila pneumoniae TW-183
agagauucauaaaacug

SEQ ID NO: 2567884 - RNA, 20 nt, Chlamydophila pneumoniae TW-183
agagcaagauucuucagaau

SEQ ID NO: 2567885 - RNA, 15 nt, Chlamydophila pneumoniae TW-183
agagcuaugaugaga

SEQ ID NO: 2567886 - RNA, 16 nt, Chlamydophila pneumoniae TW-183
agagcucaucaaugag

SEQ ID NO: 2567887 - RNA, 19 nt, Chlamydophila pneumoniae TW-183
agagcuuuuagguagagaa

SEQ ID NO: 2567888 - RNA, 16 nt, Chlamydophila pneumoniae TW-183
agagggauuuguagga

SEQ ID NO: 2567889 - RNA, 16 nt, Chlamydophila pneumoniae TW-183
agagguaaccagagag

SEQ ID NO: 2567890 - RNA, 17 nt, Chlamydophila pneumoniae TW-183
agaggucacuauagauc

SEQ ID NO: 2567891 - RNA, 13 nt, Chlamydophila pneumoniae TW-183
agaguaaagagua

SEQ ID NO: 2567892 - RNA, 18 nt, Chlamydophila pneumoniae TW-183
agagucuuugaugcuaaa

SEQ ID NO: 2567893 - RNA, 22 nt, Chlamydophila pneumoniae TW-183
agaguugccaggaaacguucuu

SEQ ID NO: 2567894 - RNA, 23 nt, Chlamydophila pneumoniae TW-183
agaguugcuuuauggcucaacuu

SEQ ID NO: 2567895 - RNA, 19 nt, Chlamydophila pneumoniae TW-183
agauaaagacaucucuuua

SEQ ID NO: 2567896 - RNA, 14 nt, Chlamydophila pneumoniae TW-183
agauaacgagacau

SEQ ID NO: 2567897 - RNA, 15 nt, Chlamydophila pneumoniae TW-183
agauaaggaagagag

SEQ ID NO: 2567898 - RNA, 16 nt, Chlamydophila pneumoniae TW-183
agauaaggaagagagu

SEQ ID NO: 2567899 - RNA, 17 nt, Chlamydophila pneumoniae TW-183
agauacggguucguuuc

SEQ ID NO: 2567900 - RNA, 18 nt, Chlamydophila pneumoniae TW-183
agauacuuugcaauacac

SEQ ID NO: 2567901 - RNA, 22 nt, Chlamydophila pneumoniae TW-183
agauagcucuuugauuuucuua

SEQ ID NO: 2567902 - RNA, 22 nt, Chlamydophila pneumoniae TW-183
agauaucgaccuuaaaauugaa

SEQ ID NO: 2567903 - RNA, 15 nt, Chlamydophila pneumoniae TW-183
agauaugaagagacg

SEQ ID NO: 2567904 - RNA, 22 nt, Chlamydophila pneumoniae TW-183
agaucaucuacgauguuuucuu

SEQ ID NO: 2567905 - RNA, 13 nt, Chlamydophila pneumoniae TW-183
agaucccagaaga

SEQ ID NO: 2567906 - RNA, 16 nt, Chlamydophila pneumoniae TW-183
agauccuagagaaugu

SEQ ID NO: 2567907 - RNA, 13 nt, Chlamydophila pneumoniae TW-183
aggauucucucug

SEQ ID NO: 2567908 - RNA, 13 nt, Chlamydophila pneumoniae TW-183
aggcaucacuaau

SEQ ID NO: 2567909 - RNA, 13 nt, Chlamydophila pneumoniae TW-183
aggcuccagcaua

SEQ ID NO: 2567910 - RNA, 17 nt, Chlamydophila pneumoniae TW-183
aggcucuacagcaacca

SEQ ID NO: 2567911 - RNA, 16 nt, Chlamydophila pneumoniae TW-183
aggcugcacacauccu

SEQ ID NO: 2567912 - RNA, 21 nt, Chlamydophila pneumoniae TW-183
aggcugccagagauucuucac

SEQ ID NO: 2567913 - RNA, 15 nt, Chlamydophila pneumoniae TW-183
aggcuguguaaaagu

SEQ ID NO: 2567914 - RNA, 17 nt, Chlamydophila pneumoniae TW-183
aggcuguguaaaaguua

SEQ ID NO: 2567915 - RNA, 19 nt, Chlamydophila pneumoniae TW-183
aggcuuuaccauagaaaga

SEQ ID NO: 2567916 - RNA, 20 nt, Chlamydophila pneumoniae TW-183
aggcuuuaccauagaaagau

SEQ ID NO: 2567917 - RNA, 14 nt, Chlamydophila pneumoniae TW-183
aggcuuuuuucuau

SEQ ID NO: 2567918 - RNA, 14 nt, Chlamydophila pneumoniae TW-183
agggaugguuuccu

SEQ ID NO: 2567919 - RNA, 17 nt, Chlamydophila pneumoniae TW-183
agggcgcuucccuauaa

SEQ ID NO: 2567920 - RNA, 18 nt, Chlamydophila pneumoniae TW-183
agggggaucuucagagag

SEQ ID NO: 2567921 - RNA, 15 nt, Chlamydophila pneumoniae TW-183
aggguucucaaagau

SEQ ID NO: 2567922 - RNA, 12 nt, Chlamydophila pneumoniae TW-183
aggguuugcaug

SEQ ID NO: 2567923 - RNA, 15 nt, Chlamydophila pneumoniae TW-183
agguaaccagagagc

SEQ ID NO: 2567924 - RNA, 15 nt, Chlamydophila pneumoniae TW-183
agguagauagaaauu

SEQ ID NO: 2567925 - RNA, 14 nt, Chlamydophila pneumoniae TW-183
agguaucuccuuga

SEQ ID NO: 2567926 - RNA, 20 nt, Chlamydophila pneumoniae TW-183
agguauugcaaauuucauuu

SEQ ID NO: 2567927 - RNA, 16 nt, Chlamydophila pneumoniae TW-183
aggucacagcauuuuc

SEQ ID NO: 2567928 - RNA, 22 nt, Chlamydophila pneumoniae TW-183
agguguuuuggcugcuuuuguu

SEQ ID NO: 2567929 - RNA, 12 nt, Chlamydophila pneumoniae TW-183
agguucacuuca

SEQ ID NO: 2567930 - RNA, 23 nt, Chlamydophila pneumoniae TW-183
agguuugcaauuuucucaauagu

SEQ ID NO: 2567931 - RNA, 14 nt, Chlamydophila pneumoniae TW-183
agguuuuuccaacu

SEQ ID NO: 2567932 - RNA, 20 nt, Chlamydophila pneumoniae TW-183
agguuuuuccaacuucaacu

SEQ ID NO: 2567933 - RNA, 13 nt, Chlamydophila pneumoniae TW-183
aguaaaacacaaa

SEQ ID NO: 2567934 - RNA, 15 nt, Chlamydophila pneumoniae TW-183
aguaaaacacaaaua

SEQ ID NO: 2567935 - RNA, 13 nt, Chlamydophila pneumoniae TW-183
aguaaaguaugca

SEQ ID NO: 2567936 - RNA, 23 nt, Chlamydophila pneumoniae TW-183
aguaaccaauacagcauaaaaau

SEQ ID NO: 2567937 - RNA, 17 nt, Chlamydophila pneumoniae TW-183
aguaaucacuucagcac

SEQ ID NO: 2567938 - RNA, 20 nt, Chlamydophila pneumoniae TW-183
aguaaucacuucagcacgaa

SEQ ID NO: 2567939 - RNA, 14 nt, Chlamydophila pneumoniae TW-183
aguacgcaaaguac

SEQ ID NO: 2567940 - RNA, 17 nt, Chlamydophila pneumoniae TW-183
aguacgcaaaguacuaa

SEQ ID NO: 2567941 - RNA, 12 nt, Chlamydophila pneumoniae TW-183
aguaggaauuuu

SEQ ID NO: 2567942 - RNA, 20 nt, Chlamydophila pneumoniae TW-183
aguauagcuuuuaguuuccc

SEQ ID NO: 2567943 - RNA, 17 nt, Chlamydophila pneumoniae TW-183
aguaugaggagauaaag

SEQ ID NO: 2567944 - RNA, 19 nt, Chlamydophila pneumoniae TW-183
aguaugaggagauaaagau

SEQ ID NO: 2567945 - RNA, 19 nt, Chlamydophila pneumoniae TW-183
aguauucgauuccugaggc

SEQ ID NO: 2567946 - RNA, 16 nt, Chlamydophila pneumoniae TW-183
agucaccuuacaucca

SEQ ID NO: 2567947 - RNA, 24 nt, Chlamydophila pneumoniae TW-183
agucacggcgaaagcuacagcuaa

SEQ ID NO: 2567948 - RNA, 16 nt, Chlamydophila pneumoniae TW-183
aguccagacuuuccuc

SEQ ID NO: 2567949 - RNA, 16 nt, Chlamydophila pneumoniae TW-183
aguccuaugucaagaa

SEQ ID NO: 2567950 - RNA, 21 nt, Chlamydophila pneumoniae TW-183
aguccuaugucaagaagugcu

SEQ ID NO: 2567951 - RNA, 13 nt, Chlamydophila pneumoniae TW-183
aguccuucuuccc

SEQ ID NO: 2567952 - RNA, 13 nt, Chlamydophila pneumoniae TW-183
aguccuucuuuuc

SEQ ID NO: 2567953 - RNA, 23 nt, Chlamydophila pneumoniae TW-183
aguccuuuaccaucgucuccaaa

SEQ ID NO: 2567954 - RNA, 16 nt, Chlamydophila pneumoniae TW-183
agucucaguugagaac

SEQ ID NO: 2567955 - RNA, 18 nt, Chlamydophila pneumoniae TW-183
agucuccuggaacaguau

SEQ ID NO: 2567956 - RNA, 15 nt, Chlamydophila pneumoniae TW-183
agucuugcgccagca

SEQ ID NO: 2567957 - RNA, 18 nt, Chlamydophila pneumoniae TW-183
agucuugcgccagcaaag

SEQ ID NO: 2567958 - RNA, 20 nt, Chlamydophila pneumoniae TW-183
agucuugcgccagcaaagau

SEQ ID NO: 2567959 - RNA, 21 nt, Chlamydophila pneumoniae TW-183
agucuugcgccagcaaagauu

SEQ ID NO: 2567960 - RNA, 23 nt, Chlamydophila pneumoniae TW-183
agucuugcgccagcaaagauuaa

SEQ ID NO: 2567961 - RNA, 15 nt, Chlamydophila pneumoniae TW-183
agugaacuuuuguac

SEQ ID NO: 2567962 - RNA, 22 nt, Chlamydophila pneumoniae TW-183
agugaacuuuuguacacagaga

SEQ ID NO: 2567963 - RNA, 14 nt, Chlamydophila pneumoniae TW-183
agugacuuuucuuc

SEQ ID NO: 2567964 - RNA, 16 nt, Chlamydophila pneumoniae TW-183
agugacuuuucuucuu

SEQ ID NO: 2567965 - RNA, 22 nt, Chlamydophila pneumoniae TW-183
agugagcucccugauguugccc

SEQ ID NO: 2567966 - RNA, 15 nt, Chlamydophila pneumoniae TW-183
agugauaaggaagaa

SEQ ID NO: 2567967 - RNA, 18 nt, Chlamydophila pneumoniae TW-183
agugccaagagcaucaca

SEQ ID NO: 2567968 - RNA, 18 nt, Chlamydophila pneumoniae TW-183
agugcuguuuuuucacuu

SEQ ID NO: 2567969 - RNA, 18 nt, Chlamydophila pneumoniae TW-183
aguggccgcuauuuauga

SEQ ID NO: 2567970 - RNA, 16 nt, Chlamydophila pneumoniae TW-183
agugucauacgcagca

SEQ ID NO: 2567971 - RNA, 18 nt, Chlamydophila pneumoniae TW-183
aguuacugucugcaaaga

SEQ ID NO: 2567972 - RNA, 20 nt, Chlamydophila pneumoniae TW-183
aguuagguagauagaaauuc

SEQ ID NO: 2567973 - RNA, 22 nt, Chlamydophila pneumoniae TW-183
aguucaucauauuuuucuugaa

SEQ ID NO: 2567974 - RNA, 18 nt, Chlamydophila pneumoniae TW-183
aguuccauagaguaucua

SEQ ID NO: 2567975 - RNA, 17 nt, Chlamydophila pneumoniae TW-183
aguucgcggaucuucuu

SEQ ID NO: 2567976 - RNA, 20 nt, Chlamydophila pneumoniae TW-183
aguucgcggaucuucuucug

SEQ ID NO: 2567977 - RNA, 15 nt, Chlamydophila pneumoniae TW-183
aguucuuccaaagcu

SEQ ID NO: 2567978 - RNA, 21 nt, Chlamydophila pneumoniae TW-183
aguucuuguaauaaaagaaca

SEQ ID NO: 2567979 - RNA, 22 nt, Chlamydophila pneumoniae TW-183
aguucuuguaauaaaagaacau

SEQ ID NO: 2567980 - RNA, 22 nt, Chlamydophila pneumoniae TW-183
aguucuuuuugcagaucuuuua

SEQ ID NO: 2567981 - RNA, 21 nt, Chlamydophila pneumoniae TW-183
aguugaaaugagugagaaugc

SEQ ID NO: 2567982 - RNA, 14 nt, Chlamydophila pneumoniae TW-183
aguugaccauauaa

SEQ ID NO: 2567983 - RNA, 22 nt, Chlamydophila pneumoniae TW-183
aguugaccauauaauacgucuc

SEQ ID NO: 2567984 - RNA, 16 nt, Chlamydophila pneumoniae TW-183
aguugaccuuuuucau

SEQ ID NO: 2567985 - RNA, 20 nt, Chlamydophila pneumoniae TW-183
aguugagaaccuucacaaga

SEQ ID NO: 2567986 - RNA, 17 nt, Chlamydophila pneumoniae TW-183
aguuggaacauaucgau

SEQ ID NO: 2567987 - RNA, 13 nt, Chlamydophila pneumoniae TW-183
aguugggcauuua

SEQ ID NO: 2567988 - RNA, 18 nt, Chlamydophila pneumoniae TW-183
aguuuaaacgucuuauga

SEQ ID NO: 2567989 - RNA, 18 nt, Chlamydophila pneumoniae TW-183
aguuuaugacacagcuaa

SEQ ID NO: 2567990 - RNA, 14 nt, Chlamydophila pneumoniae TW-183
aguuucaaucggag

SEQ ID NO: 2567991 - RNA, 23 nt, Chlamydophila pneumoniae TW-183
aguuucuaaaacagaaauugcuu

SEQ ID NO: 2567992 - RNA, 21 nt, Chlamydophila pneumoniae TW-183
aguuucuacgcgcucuucuuu

SEQ ID NO: 2567993 - RNA, 23 nt, Chlamydophila pneumoniae TW-183
aguuucuacgcgcucuucuuucu

SEQ ID NO: 2567994 - RNA, 15 nt, Chlamydophila pneumoniae TW-183
aguuugauagagaaa

SEQ ID NO: 2567995 - RNA, 21 nt, Chlamydophila pneumoniae TW-183
aguuuguagcauuucuuucuc

SEQ ID NO: 2567996 - RNA, 16 nt, Chlamydophila pneumoniae TW-183
aguuuucaagucugua

SEQ ID NO: 2567997 - RNA, 14 nt, Chlamydophila pneumoniae TW-183
aguuuuccauccac

SEQ ID NO: 2567998 - RNA, 19 nt, Chlamydophila pneumoniae TW-183
aguuuuuguucauccagaa

SEQ ID NO: 2567999 - RNA, 12 nt, Chlamydophila pneumoniae TW-183
aguuuuuuucuu

SEQ ID NO: 2568000 - RNA, 16 nt, Chlamydophila pneumoniae TW-183
auaaaaaguuuuuguu

SEQ ID NO: 2568001 - RNA, 16 nt, Chlamydophila pneumoniae TW-183
auaaaaauucucauaa

SEQ ID NO: 2568002 - RNA, 14 nt, Chlamydophila pneumoniae TW-183
auaaaacauaggcu

SEQ ID NO: 2568003 - RNA, 12 nt, Chlamydophila pneumoniae TW-183
auaaaauagccc

SEQ ID NO: 2568004 - RNA, 19 nt, Chlamydophila pneumoniae TW-183
aucgcucucuccaugagcu

SEQ ID NO: 2568005 - RNA, 16 nt, Chlamydophila pneumoniae TW-183
aucgucccuaaagcuu

SEQ ID NO: 2568006 - RNA, 15 nt, Chlamydophila pneumoniae TW-183
aucguccucaccgau

SEQ ID NO: 2568007 - RNA, 18 nt, Chlamydophila pneumoniae TW-183
aucuauaggauuugcaua

SEQ ID NO: 2568008 - RNA, 17 nt, Chlamydophila pneumoniae TW-183
aucuaugaaguccugau

SEQ ID NO: 2568009 - RNA, 13 nt, Chlamydophila pneumoniae TW-183
aucucaaaaucaa

SEQ ID NO: 2568010 - RNA, 10 nt, Chlamydophila pneumoniae TW-183
aucucaguag

SEQ ID NO: 2568011 - RNA, 22 nt, Chlamydophila pneumoniae TW-183
aucucaguaggagcagcggcac

SEQ ID NO: 2568012 - RNA, 20 nt, Chlamydophila pneumoniae TW-183
aucucaugcggacuuuauuc

SEQ ID NO: 2568013 - RNA, 19 nt, Chlamydophila pneumoniae TW-183
aucuccaagccaugcaaug

SEQ ID NO: 2568014 - RNA, 21 nt, Chlamydophila pneumoniae TW-183
aucuccaagccaugcaaugaa

SEQ ID NO: 2568015 - RNA, 20 nt, Chlamydophila pneumoniae TW-183
aucuccccauucacaaaucu

SEQ ID NO: 2568016 - RNA, 18 nt, Chlamydophila pneumoniae TW-183
aucuccuuguucuugaac

SEQ ID NO: 2568017 - RNA, 13 nt, Chlamydophila pneumoniae TW-183
aucucgaaccaua

SEQ ID NO: 2568018 - RNA, 15 nt, Chlamydophila pneumoniae TW-183
aucucgggagaacau

SEQ ID NO: 2568019 - RNA, 18 nt, Chlamydophila pneumoniae TW-183
aucucgggagaacaugcc

SEQ ID NO: 2568020 - RNA, 22 nt, Chlamydophila pneumoniae TW-183
aucucguagcuauuuuugagga

SEQ ID NO: 2568021 - RNA, 23 nt, Chlamydophila pneumoniae TW-183
aucucuagggauaauuaaacucu

SEQ ID NO: 2568022 - RNA, 13 nt, Chlamydophila pneumoniae TW-183
aucucuccagcuu

SEQ ID NO: 2568023 - RNA, 18 nt, Chlamydophila pneumoniae TW-183
aucucugacuugcaagcu

SEQ ID NO: 2568024 - RNA, 23 nt, Chlamydophila pneumoniae TW-183
aucuguaauagcaggaguuuuca

SEQ ID NO: 2568025 - RNA, 14 nt, Chlamydophila pneumoniae TW-183
aucuguaguaggca

SEQ ID NO: 2568026 - RNA, 17 nt, Chlamydophila pneumoniae TW-183
aucuguaguaggcacuu

SEQ ID NO: 2568027 - RNA, 20 nt, Chlamydophila pneumoniae TW-183
aucuguauaugcuuggcaau

SEQ ID NO: 2568028 - RNA, 13 nt, Chlamydophila pneumoniae TW-183
aucuuagcuccug

SEQ ID NO: 2568029 - RNA, 15 nt, Chlamydophila pneumoniae TW-183
aucuuaucaagagcu

SEQ ID NO: 2568030 - RNA, 13 nt, Chlamydophila pneumoniae TW-183
aucuucagagaga

SEQ ID NO: 2568031 - RNA, 15 nt, Chlamydophila pneumoniae TW-183
aucuucagagagaac

SEQ ID NO: 2568032 - RNA, 22 nt, Chlamydophila pneumoniae TW-183
aucuucagagagaacaggaggu

SEQ ID NO: 2568033 - RNA, 23 nt, Chlamydophila pneumoniae TW-183
aucuucaucacaaaauucaugca

SEQ ID NO: 2568034 - RNA, 15 nt, Chlamydophila pneumoniae TW-183
aucuuccccuaaaaa

SEQ ID NO: 2568035 - RNA, 17 nt, Chlamydophila pneumoniae TW-183
aucuucucuuaugaagu

SEQ ID NO: 2568036 - RNA, 23 nt, Chlamydophila pneumoniae TW-183
aucuucuucuggcugagagaagc

SEQ ID NO: 2568037 - RNA, 14 nt, Chlamydophila pneumoniae TW-183
aucuugauuaggaa

SEQ ID NO: 2568038 - RNA, 15 nt, Chlamydophila pneumoniae TW-183
aucuugauuaggaac

SEQ ID NO: 2568039 - RNA, 23 nt, Chlamydophila pneumoniae TW-183
augaagagaguucucucuucacu

SEQ ID NO: 2568040 - RNA, 14 nt, Chlamydophila pneumoniae TW-183
augaauaccagaag

SEQ ID NO: 2568041 - RNA, 20 nt, Chlamydophila pneumoniae TW-183
augacguuaauaaagaggcu

SEQ ID NO: 2568042 - RNA, 18 nt, Chlamydophila pneumoniae TW-183
augagcucaggcaacaac

SEQ ID NO: 2568043 - RNA, 13 nt, Chlamydophila pneumoniae TW-183
augauaauuucau

SEQ ID NO: 2568044 - RNA, 19 nt, Chlamydophila pneumoniae TW-183
augauuucuuuagcuuuau

SEQ ID NO: 2568045 - RNA, 15 nt, Chlamydophila pneumoniae TW-183
augccauuguagaga

SEQ ID NO: 2568046 - RNA, 19 nt, Chlamydophila pneumoniae TW-183
augccucaggucugcugag

SEQ ID NO: 2568047 - RNA, 13 nt, Chlamydophila pneumoniae TW-183
augcuaagcucca

SEQ ID NO: 2568048 - RNA, 19 nt, Chlamydophila pneumoniae TW-183
augcugaggacgcagagau

SEQ ID NO: 2568049 - RNA, 17 nt, Chlamydophila pneumoniae TW-183
augcuuagcaaaggcaa

SEQ ID NO: 2568050 - RNA, 14 nt, Chlamydophila pneumoniae TW-183
auggaaagaaacaa

SEQ ID NO: 2568051 - RNA, 17 nt, Chlamydophila pneumoniae TW-183
auggaauggcuuuuguu

SEQ ID NO: 2568052 - RNA, 18 nt, Chlamydophila pneumoniae TW-183
auggagaaggacacuaga

SEQ ID NO: 2568053 - RNA, 15 nt, Chlamydophila pneumoniae TW-183
auggcacuugagcac

SEQ ID NO: 2568054 - RNA, 14 nt, Chlamydophila pneumoniae TW-183
augguacaauacug

SEQ ID NO: 2568055 - RNA, 15 nt, Chlamydophila pneumoniae TW-183
augguacaauacugg

SEQ ID NO: 2568056 - RNA, 19 nt, Chlamydophila pneumoniae TW-183
auggucuuggguuuuaaau

SEQ ID NO: 2568057 - RNA, 22 nt, Chlamydophila pneumoniae TW-183
augguguucuucagcccacugu

SEQ ID NO: 2568058 - RNA, 17 nt, Chlamydophila pneumoniae TW-183
auguaaucauaaaaaaa

SEQ ID NO: 2568059 - RNA, 17 nt, Chlamydophila pneumoniae TW-183
auguaaucccagauuuu

SEQ ID NO: 2568060 - RNA, 18 nt, Chlamydophila pneumoniae TW-183
auguaaucccagauuuuu

SEQ ID NO: 2568061 - RNA, 13 nt, Chlamydophila pneumoniae TW-183
auguacaaugaua

SEQ ID NO: 2568062 - RNA, 16 nt, Chlamydophila pneumoniae TW-183
auguacaguaaaguau

SEQ ID NO: 2568063 - RNA, 16 nt, Chlamydophila pneumoniae TW-183
auguagcuguuccaag

SEQ ID NO: 2568064 - RNA, 22 nt, Chlamydophila pneumoniae TW-183
auguaucggggauugcaaaauu

SEQ ID NO: 2568065 - RNA, 22 nt, Chlamydophila pneumoniae TW-183
auguauggugcgcgucuccuug

SEQ ID NO: 2568066 - RNA, 17 nt, Chlamydophila pneumoniae TW-183
auguccuccauggaaag

SEQ ID NO: 2568067 - RNA, 13 nt, Chlamydophila pneumoniae TW-183
auguggcagaguc

SEQ ID NO: 2568068 - RNA, 18 nt, Chlamydophila pneumoniae TW-183
auguuaagcguauagaau

SEQ ID NO: 2568069 - RNA, 21 nt, Chlamydophila pneumoniae TW-183
auguuaagcguauagaauaga

SEQ ID NO: 2568070 - RNA, 19 nt, Chlamydophila pneumoniae TW-183
auguuucuaagcugaaaga

SEQ ID NO: 2568071 - RNA, 20 nt, Chlamydophila pneumoniae TW-183
auguuucuaagcugaaagaa

SEQ ID NO: 2568072 - RNA, 19 nt, Chlamydophila pneumoniae TW-183
auuaaaucguacuucacuu

SEQ ID NO: 2568073 - RNA, 22 nt, Chlamydophila pneumoniae TW-183
auuaaaucguacuucacuucug

SEQ ID NO: 2568074 - RNA, 18 nt, Chlamydophila pneumoniae TW-183
auuaacuuuauacagcug

SEQ ID NO: 2568075 - RNA, 14 nt, Chlamydophila pneumoniae TW-183
auuaagaagaagcu

SEQ ID NO: 2568076 - RNA, 14 nt, Chlamydophila pneumoniae TW-183
auuaagaauggaug

SEQ ID NO: 2568077 - RNA, 12 nt, Chlamydophila pneumoniae TW-183
auuaagaggagu

SEQ ID NO: 2568078 - RNA, 15 nt, Chlamydophila pneumoniae TW-183
auuaaggcuccagca

SEQ ID NO: 2568079 - RNA, 13 nt, Chlamydophila pneumoniae TW-183
auuaagucaccuu

SEQ ID NO: 2568080 - RNA, 15 nt, Chlamydophila pneumoniae TW-183
auuaagucaccuuaa

SEQ ID NO: 2568081 - RNA, 15 nt, Chlamydophila pneumoniae TW-183
auuaccuugagacaa

SEQ ID NO: 2568082 - RNA, 17 nt, Chlamydophila pneumoniae TW-183
auuacuagaucccucaa

SEQ ID NO: 2568083 - RNA, 12 nt, Chlamydophila pneumoniae TW-183
auuauuaaacuc

SEQ ID NO: 2568084 - RNA, 12 nt, Chlamydophila pneumoniae TW-183
auuauucuagag

SEQ ID NO: 2568085 - RNA, 15 nt, Chlamydophila pneumoniae TW-183
auuauucuagaguug

SEQ ID NO: 2568086 - RNA, 15 nt, Chlamydophila pneumoniae TW-183
auucacaaaucuucc

SEQ ID NO: 2568087 - RNA, 23 nt, Chlamydophila pneumoniae TW-183
auucauaaagaggaaugaagaga

SEQ ID NO: 2568088 - RNA, 23 nt, Chlamydophila pneumoniae TW-183
auucaucuaggggagcuauuacu

SEQ ID NO: 2568089 - RNA, 14 nt, Chlamydophila pneumoniae TW-183
auuccaggcucuag

SEQ ID NO: 2568090 - RNA, 12 nt, Chlamydophila pneumoniae TW-183
auuccauggaua

SEQ ID NO: 2568091 - RNA, 17 nt, Chlamydophila pneumoniae TW-183
auuccucucacauuugc

SEQ ID NO: 2568092 - RNA, 18 nt, Chlamydophila pneumoniae TW-183
auuccugaggcuauagaa

SEQ ID NO: 2568093 - RNA, 16 nt, Chlamydophila pneumoniae TW-183
auucgagauauggaag

SEQ ID NO: 2568094 - RNA, 16 nt, Chlamydophila pneumoniae TW-183
auucgcugucuagaac

SEQ ID NO: 2568095 - RNA, 15 nt, Chlamydophila pneumoniae TW-183
auucggaccaaugau

SEQ ID NO: 2568096 - RNA, 19 nt, Chlamydophila pneumoniae TW-183
auucucccaauauccagaa

SEQ ID NO: 2568097 - RNA, 15 nt, Chlamydophila pneumoniae TW-183
auucucuaaaugauu

SEQ ID NO: 2568098 - RNA, 19 nt, Chlamydophila pneumoniae TW-183
auucucuaaaugauuuuua

SEQ ID NO: 2568099 - RNA, 12 nt, Chlamydophila pneumoniae TW-183
auucucuucacu

SEQ ID NO: 2568100 - RNA, 15 nt, Chlamydophila pneumoniae TW-183
auucugagaaagaag

SEQ ID NO: 2568101 - RNA, 21 nt, Chlamydophila pneumoniae TW-183
auucuggagucgagcagaaau

SEQ ID NO: 2568102 - RNA, 14 nt, Chlamydophila pneumoniae TW-183
caauaaaaugucca

SEQ ID NO: 2568103 - RNA, 13 nt, Chlamydophila pneumoniae TW-183
caauaaacaacga

SEQ ID NO: 2568104 - RNA, 19 nt, Chlamydophila pneumoniae TW-183
caauaaacaacgaucguca

SEQ ID NO: 2568105 - RNA, 12 nt, Chlamydophila pneumoniae TW-183
caauaaagauag

SEQ ID NO: 2568106 - RNA, 18 nt, Chlamydophila pneumoniae TW-183
caauacagcauaaaaauu

SEQ ID NO: 2568107 - RNA, 13 nt, Chlamydophila pneumoniae TW-183
caauaggcaccca

SEQ ID NO: 2568108 - RNA, 17 nt, Chlamydophila pneumoniae TW-183
caauauaaaugcuauuu

SEQ ID NO: 2568109 - RNA, 20 nt, Chlamydophila pneumoniae TW-183
caauauaaaugcuauuuucc

SEQ ID NO: 2568110 - RNA, 13 nt, Chlamydophila pneumoniae TW-183
caaucaauaaaau

SEQ ID NO: 2568111 - RNA, 15 nt, Chlamydophila pneumoniae TW-183
caaucacacuacauu

SEQ ID NO: 2568112 - RNA, 14 nt, Chlamydophila pneumoniae TW-183
caaucuaaauaaga

SEQ ID NO: 2568113 - RNA, 17 nt, Chlamydophila pneumoniae TW-183
caaucuauuuagaaacu

SEQ ID NO: 2568114 - RNA, 15 nt, Chlamydophila pneumoniae TW-183
caaucucuagggaua

SEQ ID NO: 2568115 - RNA, 19 nt, Chlamydophila pneumoniae TW-183
caaucucuagggauaauua

SEQ ID NO: 2568116 - RNA, 10 nt, Chlamydophila pneumoniae TW-183
caaucuuuga

SEQ ID NO: 2568117 - RNA, 15 nt, Chlamydophila pneumoniae TW-183
caaugauaauuucau

SEQ ID NO: 2568118 - RNA, 15 nt, Chlamydophila pneumoniae TW-183
caaugauaucagcau

SEQ ID NO: 2568119 - RNA, 22 nt, Chlamydophila pneumoniae TW-183
caaugauuucuuuagcuuuauu

SEQ ID NO: 2568120 - RNA, 16 nt, Chlamydophila pneumoniae TW-183
caauuccccuucauca

SEQ ID NO: 2568121 - RNA, 17 nt, Chlamydophila pneumoniae TW-183
caauuccccuucaucaa

SEQ ID NO: 2568122 - RNA, 18 nt, Chlamydophila pneumoniae TW-183
caauuccccuucaucaau

SEQ ID NO: 2568123 - RNA, 15 nt, Chlamydophila pneumoniae TW-183
caauugaaucagauu

SEQ ID NO: 2568124 - RNA, 20 nt, Chlamydophila pneumoniae TW-183
caauugaaucagauuagagu

SEQ ID NO: 2568125 - RNA, 12 nt, Chlamydophila pneumoniae TW-183
caauugagcucu

SEQ ID NO: 2568126 - RNA, 15 nt, Chlamydophila pneumoniae TW-183
caauugagcuucuuu

SEQ ID NO: 2568127 - RNA, 23 nt, Chlamydophila pneumoniae TW-183
caauugagcuucuuuagauagcu

SEQ ID NO: 2568128 - RNA, 18 nt, Chlamydophila pneumoniae TW-183
caauuuucucaauagugu

SEQ ID NO: 2568129 - RNA, 15 nt, Chlamydophila pneumoniae TW-183
cacaauauaaaugcu

SEQ ID NO: 2568130 - RNA, 15 nt, Chlamydophila pneumoniae TW-183
cacagacuugaggaa

SEQ ID NO: 2568131 - RNA, 21 nt, Chlamydophila pneumoniae TW-183
cacagacuugaggaaucugaa

SEQ ID NO: 2568132 - RNA, 18 nt, Chlamydophila pneumoniae TW-183
cacagagaugcuucuaaa

SEQ ID NO: 2568133 - RNA, 22 nt, Chlamydophila pneumoniae TW-183
cacagagaugcuucuaaacaau

SEQ ID NO: 2568134 - RNA, 15 nt, Chlamydophila pneumoniae TW-183
cacagauaggaacca

SEQ ID NO: 2568135 - RNA, 13 nt, Chlamydophila pneumoniae TW-183
cacagcauuuucu

SEQ ID NO: 2568136 - RNA, 23 nt, Chlamydophila pneumoniae TW-183
cacagcauuuucucugagcagcu

SEQ ID NO: 2568137 - RNA, 17 nt, Chlamydophila pneumoniae TW-183
cacagcuaugauugaaa

SEQ ID NO: 2568138 - RNA, 19 nt, Chlamydophila pneumoniae TW-183
cacaggggaacgcucucua

SEQ ID NO: 2568139 - RNA, 20 nt, Chlamydophila pneumoniae TW-183
cacaggggaacgcucucuag

SEQ ID NO: 2568140 - RNA, 17 nt, Chlamydophila pneumoniae TW-183
cacauacaguacgcaaa

SEQ ID NO: 2568141 - RNA, 20 nt, Chlamydophila pneumoniae TW-183
cacauacaguacgcaaagua

SEQ ID NO: 2568142 - RNA, 23 nt, Chlamydophila pneumoniae TW-183
cacauacucuucauccugaucuu

SEQ ID NO: 2568143 - RNA, 14 nt, Chlamydophila pneumoniae TW-183
cacaugucucuuaa

SEQ ID NO: 2568144 - RNA, 16 nt, Chlamydophila pneumoniae TW-183
cacaugucucuuaaaa

SEQ ID NO: 2568145 - RNA, 17 nt, Chlamydophila pneumoniae TW-183
cacauuguuuaaguccu

SEQ ID NO: 2568146 - RNA, 23 nt, Chlamydophila pneumoniae TW-183
cacauuguuuaaguccuucuucc

SEQ ID NO: 2568147 - RNA, 15 nt, Chlamydophila pneumoniae TW-183
caccaaaaauuccgu

SEQ ID NO: 2568148 - RNA, 17 nt, Chlamydophila pneumoniae TW-183
caccaaugauaauuuca

SEQ ID NO: 2568149 - RNA, 14 nt, Chlamydophila pneumoniae TW-183
caccagaagcaacu

SEQ ID NO: 2568150 - RNA, 19 nt, Chlamydophila pneumoniae TW-183
caccagaagcaacuaaacu

SEQ ID NO: 2568151 - RNA, 18 nt, Chlamydophila pneumoniae TW-183
caccagaagcauugagga

SEQ ID NO: 2568152 - RNA, 22 nt, Chlamydophila pneumoniae TW-183
caccagacccucgaguaccgac

SEQ ID NO: 2568153 - RNA, 17 nt, Chlamydophila pneumoniae TW-183
caccauuuuugaauaug

SEQ ID NO: 2568154 - RNA, 22 nt, Chlamydophila pneumoniae TW-183
cacccaaacugaugccaagaaa

SEQ ID NO: 2568155 - RNA, 16 nt, Chlamydophila pneumoniae TW-183
caccuaaaguuugagc

SEQ ID NO: 2568156 - RNA, 18 nt, Chlamydophila pneumoniae TW-183
caccuaaaguuugagcua

SEQ ID NO: 2568157 - RNA, 20 nt, Chlamydophila pneumoniae TW-183
caccuuaauggcuccuacuc

SEQ ID NO: 2568158 - RNA, 23 nt, Chlamydophila pneumoniae TW-183
caccuuaauggcuccuacuccua

SEQ ID NO: 2568159 - RNA, 14 nt, Chlamydophila pneumoniae TW-183
caccuuacauccaa

SEQ ID NO: 2568160 - RNA, 15 nt, Chlamydophila pneumoniae TW-183
caccuuacauccaau

SEQ ID NO: 2568161 - RNA, 20 nt, Chlamydophila pneumoniae TW-183
cacgaccucgaauuccuccc

SEQ ID NO: 2568162 - RNA, 23 nt, Chlamydophila pneumoniae TW-183
cacgaguucgcggaucuucuucu

SEQ ID NO: 2568163 - RNA, 17 nt, Chlamydophila pneumoniae TW-183
cacggauuuucucuaca

SEQ ID NO: 2568164 - RNA, 18 nt, Chlamydophila pneumoniae TW-183
cacuaaguuuaggcagga

SEQ ID NO: 2568165 - RNA, 20 nt, Chlamydophila pneumoniae TW-183
cacucuaucauaucuucaaa

SEQ ID NO: 2568166 - RNA, 13 nt, Chlamydophila pneumoniae TW-183
cacugcgagagaa

SEQ ID NO: 2568167 - RNA, 15 nt, Chlamydophila pneumoniae TW-183
cacuguuuugcuucu

SEQ ID NO: 2568168 - RNA, 14 nt, Chlamydophila pneumoniae TW-183
cacuuaaagguaaa

SEQ ID NO: 2568169 - RNA, 16 nt, Chlamydophila pneumoniae TW-183
cacuuacagauaagga

SEQ ID NO: 2568170 - RNA, 17 nt, Chlamydophila pneumoniae TW-183
cacuuacagauaaggaa

SEQ ID NO: 2568171 - RNA, 15 nt, Chlamydophila pneumoniae TW-183
cacuuucugauguga

SEQ ID NO: 2568172 - RNA, 16 nt, Chlamydophila pneumoniae TW-183
cagaaacuccaaaaua

SEQ ID NO: 2568173 - RNA, 18 nt, Chlamydophila pneumoniae TW-183
cagaaagaaggucuucca

SEQ ID NO: 2568174 - RNA, 21 nt, Chlamydophila pneumoniae TW-183
cagaaagaaggucuuccaucu

SEQ ID NO: 2568175 - RNA, 21 nt, Chlamydophila pneumoniae TW-183
cagaaauacguccagccugca

SEQ ID NO: 2568176 - RNA, 18 nt, Chlamydophila pneumoniae TW-183
cagaaauugcuucuucca

SEQ ID NO: 2568177 - RNA, 13 nt, Chlamydophila pneumoniae TW-183
cagaagcaaaggu

SEQ ID NO: 2568178 - RNA, 21 nt, Chlamydophila pneumoniae TW-183
cagaagcaacuaaacucucca

SEQ ID NO: 2568179 - RNA, 20 nt, Chlamydophila pneumoniae TW-183
cagaagcauugaggacaaca

SEQ ID NO: 2568180 - RNA, 16 nt, Chlamydophila pneumoniae TW-183
cagaaggcuuguuucu

SEQ ID NO: 2568181 - RNA, 17 nt, Chlamydophila pneumoniae TW-183
cagaagugaucuugaga

SEQ ID NO: 2568182 - RNA, 23 nt, Chlamydophila pneumoniae TW-183
cagaagugaucuugagaaaagaa

SEQ ID NO: 2568183 - RNA, 14 nt, Chlamydophila pneumoniae TW-183
cagaaguuccuacu

SEQ ID NO: 2568184 - RNA, 21 nt, Chlamydophila pneumoniae TW-183
cagaauaccuucaacaagaau

SEQ ID NO: 2568185 - RNA, 15 nt, Chlamydophila pneumoniae TW-183
cagaaucuaugagag

SEQ ID NO: 2568186 - RNA, 19 nt, Chlamydophila pneumoniae TW-183
cagaccucucccuugggau

SEQ ID NO: 2568187 - RNA, 20 nt, Chlamydophila pneumoniae TW-183
cagaccucucccuugggauu

SEQ ID NO: 2568188 - RNA, 16 nt, Chlamydophila pneumoniae TW-183
cagacuugaggaaucu

SEQ ID NO: 2568189 - RNA, 14 nt, Chlamydophila pneumoniae TW-183
cagacuuuccucuc

SEQ ID NO: 2568190 - RNA, 14 nt, Chlamydophila pneumoniae TW-183
cagagagaacagga

SEQ ID NO: 2568191 - RNA, 17 nt, Chlamydophila pneumoniae TW-183
cagagaugcuaacaacu

SEQ ID NO: 2568192 - RNA, 16 nt, Chlamydophila pneumoniae TW-183
cagagaugcuucuaaa

SEQ ID NO: 2568193 - RNA, 15 nt, Chlamydophila pneumoniae TW-183
cagagauguggcaga

SEQ ID NO: 2568194 - RNA, 13 nt, Chlamydophila pneumoniae TW-183
cagagauucuuca

SEQ ID NO: 2568195 - RNA, 20 nt, Chlamydophila pneumoniae TW-183
cagagauugccaggagagcu

SEQ ID NO: 2568196 - RNA, 20 nt, Chlamydophila pneumoniae TW-183
cagaggucgauuugaacaug

SEQ ID NO: 2568197 - RNA, 18 nt, Chlamydophila pneumoniae TW-183
cagaguccuucuuuuccg

SEQ ID NO: 2568198 - RNA, 17 nt, Chlamydophila pneumoniae TW-183
cagaucuuuuaugcgag

SEQ ID NO: 2568199 - RNA, 20 nt, Chlamydophila pneumoniae TW-183
cagauuuuaacaacuucaca

SEQ ID NO: 2568200 - RNA, 15 nt, Chlamydophila pneumoniae TW-183
ccaaaaauucccaua

SEQ ID NO: 2568201 - RNA, 20 nt, Chlamydophila pneumoniae TW-183
ccaaaagaauuaagaagaag

SEQ ID NO: 2568202 - RNA, 19 nt, Chlamydophila pneumoniae TW-183
ccaaaccucuuagcuauca

SEQ ID NO: 2568203 - RNA, 20 nt, Chlamydophila pneumoniae TW-183
ccaaacggcugauucuccca

SEQ ID NO: 2568204 - RNA, 14 nt, Chlamydophila pneumoniae TW-183
ccaaagcuucuuuc

SEQ ID NO: 2568205 - RNA, 17 nt, Chlamydophila pneumoniae TW-183
ccaaaguuuguagcauu

SEQ ID NO: 2568206 - RNA, 23 nt, Chlamydophila pneumoniae TW-183
ccaacacgcacaaacuaacauag

SEQ ID NO: 2568207 - RNA, 22 nt, Chlamydophila pneumoniae TW-183
ccaagagucuuugaugcuaaac

SEQ ID NO: 2568208 - RNA, 20 nt, Chlamydophila pneumoniae TW-183
ccaagcuuugcgcuuguucu

SEQ ID NO: 2568209 - RNA, 22 nt, Chlamydophila pneumoniae TW-183
ccaaguguugccagcccauguc

SEQ ID NO: 2568210 - RNA, 18 nt, Chlamydophila pneumoniae TW-183
ccaauacagcauaaaaau

SEQ ID NO: 2568211 - RNA, 20 nt, Chlamydophila pneumoniae TW-183
ccaauauccagaaauacguc

SEQ ID NO: 2568212 - RNA, 19 nt, Chlamydophila pneumoniae TW-183
ccaaucgauaacguugccu

SEQ ID NO: 2568213 - RNA, 12 nt, Chlamydophila pneumoniae TW-183
ccaaucugcuga

SEQ ID NO: 2568214 - RNA, 18 nt, Chlamydophila pneumoniae TW-183
ccaauuccccuucaucaa

SEQ ID NO: 2568215 - RNA, 15 nt, Chlamydophila pneumoniae TW-183
ccacaacauaacagg

SEQ ID NO: 2568216 - RNA, 22 nt, Chlamydophila pneumoniae TW-183
ccacgaccugcaaacuccccag

SEQ ID NO: 2568217 - RNA, 15 nt, Chlamydophila pneumoniae TW-183
ccacgcacuccugga

SEQ ID NO: 2568218 - RNA, 16 nt, Chlamydophila pneumoniae TW-183
ccacggauuuucucua

SEQ ID NO: 2568219 - RNA, 22 nt, Chlamydophila pneumoniae TW-183
ccacuaaguuuaggcaggaagu

SEQ ID NO: 2568220 - RNA, 17 nt, Chlamydophila pneumoniae TW-183
ccagaacacaugucucu

SEQ ID NO: 2568221 - RNA, 20 nt, Chlamydophila pneumoniae TW-183
ccagaauaccuucaacaaga

SEQ ID NO: 2568222 - RNA, 19 nt, Chlamydophila pneumoniae TW-183
ccagacuuuccucucuuua

SEQ ID NO: 2568223 - RNA, 17 nt, Chlamydophila pneumoniae TW-183
ccaggaaacguucuuuc

SEQ ID NO: 2568224 - RNA, 14 nt, Chlamydophila pneumoniae TW-183
ccaggauggcuccu

SEQ ID NO: 2568225 - RNA, 16 nt, Chlamydophila pneumoniae TW-183
ccauagaguaucuaaa

SEQ ID NO: 2568226 - RNA, 17 nt, Chlamydophila pneumoniae TW-183
ccauccacgaccucgaa

SEQ ID NO: 2568227 - RNA, 17 nt, Chlamydophila pneumoniae TW-183
ccauccacgaccugcaa

SEQ ID NO: 2568228 - RNA, 20 nt, Chlamydophila pneumoniae TW-183
ccaucucaugcggacuuuau

SEQ ID NO: 2568229 - RNA, 15 nt, Chlamydophila pneumoniae TW-183
ccaugaucuuagcuc

SEQ ID NO: 2568230 - RNA, 20 nt, Chlamydophila pneumoniae TW-183
ccaugaucuuagcuccugua

SEQ ID NO: 2568231 - RNA, 16 nt, Chlamydophila pneumoniae TW-183
ccauggauauggaaug

SEQ ID NO: 2568232 - RNA, 14 nt, Chlamydophila pneumoniae TW-183
ccauucacaaaucu

SEQ ID NO: 2568233 - RNA, 18 nt, Chlamydophila pneumoniae TW-183
ccauucacaaaucuuccc

SEQ ID NO: 2568234 - RNA, 13 nt, Chlamydophila pneumoniae TW-183
ccauuucauguaa

SEQ ID NO: 2568235 - RNA, 19 nt, Chlamydophila pneumoniae TW-183
ccauuucauguaagaaugu

SEQ ID NO: 2568236 - RNA, 15 nt, Chlamydophila pneumoniae TW-183
cccaauauccagaaa

SEQ ID NO: 2568237 - RNA, 18 nt, Chlamydophila pneumoniae TW-183
cccacggcaaguuguggc

SEQ ID NO: 2568238 - RNA, 17 nt, Chlamydophila pneumoniae TW-183
cccagauuuuuuugguu

SEQ ID NO: 2568239 - RNA, 11 nt, Chlamydophila pneumoniae TW-183
cccagccuuga

SEQ ID NO: 2568240 - RNA, 11 nt, Chlamydophila pneumoniae TW-183
cccauuacagc

SEQ ID NO: 2568241 - RNA, 22 nt, Chlamydophila pneumoniae TW-183
ccccaaacauggacaauauaga

SEQ ID NO: 2568242 - RNA, 19 nt, Chlamydophila pneumoniae TW-183
ccccacgcuaaacuaaaau

SEQ ID NO: 2568243 - RNA, 17 nt, Chlamydophila pneumoniae TW-183
ccccuucuaauacuuua

SEQ ID NO: 2568244 - RNA, 14 nt, Chlamydophila pneumoniae TW-183
cccgagacuucucu

SEQ ID NO: 2568245 - RNA, 12 nt, Chlamydophila pneumoniae TW-183
cccuaagauucg

SEQ ID NO: 2568246 - RNA, 19 nt, Chlamydophila pneumoniae TW-183
cccucacaauauaaaugcu

SEQ ID NO: 2568247 - RNA, 13 nt, Chlamydophila pneumoniae TW-183
cccucgaaccacu

SEQ ID NO: 2568248 - RNA, 12 nt, Chlamydophila pneumoniae TW-183
cccucuucaucc

SEQ ID NO: 2568249 - RNA, 23 nt, Chlamydophila pneumoniae TW-183
cccucuucauccgaagacucaaa

SEQ ID NO: 2568250 - RNA, 17 nt, Chlamydophila pneumoniae TW-183
cccugaugcuguaucuc

SEQ ID NO: 2568251 - RNA, 16 nt, Chlamydophila pneumoniae TW-183
cccuugggauuccuua

SEQ ID NO: 2568252 - RNA, 15 nt, Chlamydophila pneumoniae TW-183
ccgaaucucuccagc

SEQ ID NO: 2568253 - RNA, 17 nt, Chlamydophila pneumoniae TW-183
ccgacauucacccucau

SEQ ID NO: 2568254 - RNA, 15 nt, Chlamydophila pneumoniae TW-183
ccgagacuucucucu

SEQ ID NO: 2568255 - RNA, 15 nt, Chlamydophila pneumoniae TW-183
ccgagcuuuuugcuu

SEQ ID NO: 2568256 - RNA, 16 nt, Chlamydophila pneumoniae TW-183
ccgaucauuuuugcua

SEQ ID NO: 2568257 - RNA, 20 nt, Chlamydophila pneumoniae TW-183
ccgccuugacggguugugaa

SEQ ID NO: 2568258 - RNA, 14 nt, Chlamydophila pneumoniae TW-183
ccgccuuucuaccc

SEQ ID NO: 2568259 - RNA, 13 nt, Chlamydophila pneumoniae TW-183
ccguaacugaggc

SEQ ID NO: 2568260 - RNA, 18 nt, Chlamydophila pneumoniae TW-183
ccguacgaguaucuacuu

SEQ ID NO: 2568261 - RNA, 20 nt, Chlamydophila pneumoniae TW-183
ccguacgaguaucuacuuug

SEQ ID NO: 2568262 - RNA, 21 nt, Chlamydophila pneumoniae TW-183
ccguaggguagccauccacga

SEQ ID NO: 2568263 - RNA, 15 nt, Chlamydophila pneumoniae TW-183
ccgugacuccagaag

SEQ ID NO: 2568264 - RNA, 17 nt, Chlamydophila pneumoniae TW-183
ccgugacuccagaaggu

SEQ ID NO: 2568265 - RNA, 13 nt, Chlamydophila pneumoniae TW-183
ccuaaaacaaaau

SEQ ID NO: 2568266 - RNA, 21 nt, Chlamydophila pneumoniae TW-183
ccuaaaacaaaaucaaaaacu

SEQ ID NO: 2568267 - RNA, 23 nt, Chlamydophila pneumoniae TW-183
ccuaaaguuugagcuaagcugaa

SEQ ID NO: 2568268 - RNA, 16 nt, Chlamydophila pneumoniae TW-183
ccuaagugauaaggaa

SEQ ID NO: 2568269 - RNA, 17 nt, Chlamydophila pneumoniae TW-183
ccuaagugauaaggaag

SEQ ID NO: 2568270 - RNA, 12 nt, Chlamydophila pneumoniae TW-183
ccuaauauccau

SEQ ID NO: 2568271 - RNA, 15 nt, Chlamydophila pneumoniae TW-183
ccuagagaguucuug

SEQ ID NO: 2568272 - RNA, 16 nt, Chlamydophila pneumoniae TW-183
ccuaggagaaaucaca

SEQ ID NO: 2568273 - RNA, 16 nt, Chlamydophila pneumoniae TW-183
ccuauaguauaauagu

SEQ ID NO: 2568274 - RNA, 21 nt, Chlamydophila pneumoniae TW-183
ccuauaguauaauagugagcu

SEQ ID NO: 2568275 - RNA, 20 nt, Chlamydophila pneumoniae TW-183
ccuaugucaagaagugcuuu

SEQ ID NO: 2568276 - RNA, 20 nt, Chlamydophila pneumoniae TW-183
ccucaucagaagccaccaaa

SEQ ID NO: 2568277 - RNA, 23 nt, Chlamydophila pneumoniae TW-183
ccucaucagaagccaccaaaaau

SEQ ID NO: 2568278 - RNA, 16 nt, Chlamydophila pneumoniae TW-183
ccuccucuucuucauc

SEQ ID NO: 2568279 - RNA, 20 nt, Chlamydophila pneumoniae TW-183
ccucgagcagaaacuccaaa

SEQ ID NO: 2568280 - RNA, 15 nt, Chlamydophila pneumoniae TW-183
ccucgccgcugcccu

SEQ ID NO: 2568281 - RNA, 16 nt, Chlamydophila pneumoniae TW-183
ccucgccgcugcccua

SEQ ID NO: 2568282 - RNA, 18 nt, Chlamydophila pneumoniae TW-183
ccucuaaggacaaaucuc

SEQ ID NO: 2568283 - RNA, 20 nt, Chlamydophila pneumoniae TW-183
ccucuaaggacaaaucuccc

SEQ ID NO: 2568284 - RNA, 22 nt, Chlamydophila pneumoniae TW-183
ccucuaaggacaaaucucccaa

SEQ ID NO: 2568285 - RNA, 15 nt, Chlamydophila pneumoniae TW-183
ccucuagaagacaca

SEQ ID NO: 2568286 - RNA, 17 nt, Chlamydophila pneumoniae TW-183
ccucuagaagacacagg

SEQ ID NO: 2568287 - RNA, 18 nt, Chlamydophila pneumoniae TW-183
ccucucacauuugcagac

SEQ ID NO: 2568288 - RNA, 16 nt, Chlamydophila pneumoniae TW-183
ccucugggaagacucu

SEQ ID NO: 2568289 - RNA, 20 nt, Chlamydophila pneumoniae TW-183
ccucugggaagacucucauc

SEQ ID NO: 2568290 - RNA, 22 nt, Chlamydophila pneumoniae TW-183
ccucugggaagacucucaucag

SEQ ID NO: 2568291 - RNA, 18 nt, Chlamydophila pneumoniae TW-183
ccucuguagguuuuucca

SEQ ID NO: 2568292 - RNA, 16 nt, Chlamydophila pneumoniae TW-183
ccugaaaaaagaagcu

SEQ ID NO: 2568293 - RNA, 17 nt, Chlamydophila pneumoniae TW-183
ccugaaaaaagaagcuu

SEQ ID NO: 2568294 - RNA, 14 nt, Chlamydophila pneumoniae TW-183
ccugaucuucuuga

SEQ ID NO: 2568295 - RNA, 15 nt, Chlamydophila pneumoniae TW-183
ccugauguugcccua

SEQ ID NO: 2568296 - RNA, 16 nt, Chlamydophila pneumoniae TW-183
ccugcaaacuccccag

SEQ ID NO: 2568297 - RNA, 17 nt, Chlamydophila pneumoniae TW-183
ccugcaccagacccucg

SEQ ID NO: 2568298 - RNA, 20 nt, Chlamydophila pneumoniae TW-183
cuaagcugaaagaacacucc

SEQ ID NO: 2568299 - RNA, 20 nt, Chlamydophila pneumoniae TW-183
cuaagcugugcauuuucuuc

SEQ ID NO: 2568300 - RNA, 21 nt, Chlamydophila pneumoniae TW-183
cuaagcugugcauuuucuucu

SEQ ID NO: 2568301 - RNA, 17 nt, Chlamydophila pneumoniae TW-183
cuaagucguuaacauca

SEQ ID NO: 2568302 - RNA, 15 nt, Chlamydophila pneumoniae TW-183
cuaagugauaaggaa

SEQ ID NO: 2568303 - RNA, 17 nt, Chlamydophila pneumoniae TW-183
cuaagugauaaggaaga

SEQ ID NO: 2568304 - RNA, 16 nt, Chlamydophila pneumoniae TW-183
cuaauaagauccaaaa

SEQ ID NO: 2568305 - RNA, 18 nt, Chlamydophila pneumoniae TW-183
cuaauaagauccaaaaau

SEQ ID NO: 2568306 - RNA, 20 nt, Chlamydophila pneumoniae TW-183
cuaauaggggaccuaucggg

SEQ ID NO: 2568307 - RNA, 12 nt, Chlamydophila pneumoniae TW-183
cuaauauugauu

SEQ ID NO: 2568308 - RNA, 17 nt, Chlamydophila pneumoniae TW-183
cuaaucaauccaagaau

SEQ ID NO: 2568309 - RNA, 15 nt, Chlamydophila pneumoniae TW-183
cuaaucucaggcauu

SEQ ID NO: 2568310 - RNA, 20 nt, Chlamydophila pneumoniae TW-183
cuacaaaauuauuaaacucg

SEQ ID NO: 2568311 - RNA, 16 nt, Chlamydophila pneumoniae TW-183
cuacaaauuaccuuga

SEQ ID NO: 2568312 - RNA, 11 nt, Chlamydophila pneumoniae TW-183
cuacaacaguu

SEQ ID NO: 2568313 - RNA, 15 nt, Chlamydophila pneumoniae TW-183
cuacaagcuuagcaa

SEQ ID NO: 2568314 - RNA, 22 nt, Chlamydophila pneumoniae TW-183
cuacaauuuccuugguauccca

SEQ ID NO: 2568315 - RNA, 17 nt, Chlamydophila pneumoniae TW-183
cuacagagggaauuuca

SEQ ID NO: 2568316 - RNA, 18 nt, Chlamydophila pneumoniae TW-183
cuacagagggaauuucau

SEQ ID NO: 2568317 - RNA, 18 nt, Chlamydophila pneumoniae TW-183
cuacagcuaacgaaguga

SEQ ID NO: 2568318 - RNA, 22 nt, Chlamydophila pneumoniae TW-183
cuacauaguuguucggacaaaa

SEQ ID NO: 2568319 - RNA, 14 nt, Chlamydophila pneumoniae TW-183
cuaccauaucuuga

SEQ ID NO: 2568320 - RNA, 18 nt, Chlamydophila pneumoniae TW-183
cuaccccacgcuaaacua

SEQ ID NO: 2568321 - RNA, 15 nt, Chlamydophila pneumoniae TW-183
cuacgcgcucuucuu

SEQ ID NO: 2568322 - RNA, 13 nt, Chlamydophila pneumoniae TW-183
cuacuuacaagaa

SEQ ID NO: 2568323 - RNA, 18 nt, Chlamydophila pneumoniae TW-183
cuagaacacucagagaug

SEQ ID NO: 2568324 - RNA, 22 nt, Chlamydophila pneumoniae TW-183
cuagagaguucuuguaauaaaa

SEQ ID NO: 2568325 - RNA, 21 nt, Chlamydophila pneumoniae TW-183
cuagaguugcuuuauggcuca

SEQ ID NO: 2568326 - RNA, 15 nt, Chlamydophila pneumoniae TW-183
cuagcaccuaauaaa

SEQ ID NO: 2568327 - RNA, 16 nt, Chlamydophila pneumoniae TW-183
cuagcaguugcaauac

SEQ ID NO: 2568328 - RNA, 21 nt, Chlamydophila pneumoniae TW-183
cuaggaacucuuuaaaagggc

SEQ ID NO: 2568329 - RNA, 16 nt, Chlamydophila pneumoniae TW-183
cuaggagaaaucacac

SEQ ID NO: 2568330 - RNA, 12 nt, Chlamydophila pneumoniae TW-183
cuauaaaauaaa

SEQ ID NO: 2568331 - RNA, 17 nt, Chlamydophila pneumoniae TW-183
cuauaaagcaaaugccu

SEQ ID NO: 2568332 - RNA, 23 nt, Chlamydophila pneumoniae TW-183
cuauagauacuuugcaauacacc

SEQ ID NO: 2568333 - RNA, 21 nt, Chlamydophila pneumoniae TW-183
cuauagcuugaaauaauugag

SEQ ID NO: 2568334 - RNA, 22 nt, Chlamydophila pneumoniae TW-183
cuauaguauaauagugagcucc

SEQ ID NO: 2568335 - RNA, 14 nt, Chlamydophila pneumoniae TW-183
cuauauuuuuuccc

SEQ ID NO: 2568336 - RNA, 16 nt, Chlamydophila pneumoniae TW-183
cuaucauaucuucaaa

SEQ ID NO: 2568337 - RNA, 16 nt, Chlamydophila pneumoniae TW-183
cuaucuccuuguucuu

SEQ ID NO: 2568338 - RNA, 18 nt, Chlamydophila pneumoniae TW-183
cuaugggaggaauuccuc

SEQ ID NO: 2568339 - RNA, 19 nt, Chlamydophila pneumoniae TW-183
cuaugggaggaauuccucu

SEQ ID NO: 2568340 - RNA, 20 nt, Chlamydophila pneumoniae TW-183
cuaugggaggaauuccucuc

SEQ ID NO: 2568341 - RNA, 15 nt, Chlamydophila pneumoniae TW-183
cuauguguucucgaa

SEQ ID NO: 2568342 - RNA, 13 nt, Chlamydophila pneumoniae TW-183
cuauuaagucacc

SEQ ID NO: 2568343 - RNA, 18 nt, Chlamydophila pneumoniae TW-183
cuauucgcugucuagaac

SEQ ID NO: 2568344 - RNA, 14 nt, Chlamydophila pneumoniae TW-183
cuauuguuuguccu

SEQ ID NO: 2568345 - RNA, 19 nt, Chlamydophila pneumoniae TW-183
cuauuuuccucuauauuuu

SEQ ID NO: 2568346 - RNA, 14 nt, Chlamydophila pneumoniae TW-183
cuauuuuugaggaa

SEQ ID NO: 2568347 - RNA, 12 nt, Chlamydophila pneumoniae TW-183
cuauuuuuuaag

SEQ ID NO: 2568348 - RNA, 13 nt, Chlamydophila pneumoniae TW-183
cucaaagaauacu

SEQ ID NO: 2568349 - RNA, 15 nt, Chlamydophila pneumoniae TW-183
cucaaggucacagca

SEQ ID NO: 2568350 - RNA, 17 nt, Chlamydophila pneumoniae TW-183
cucaaggucacagcauu

SEQ ID NO: 2568351 - RNA, 20 nt, Chlamydophila pneumoniae TW-183
cucaaggucacagcauuuuc

SEQ ID NO: 2568352 - RNA, 19 nt, Chlamydophila pneumoniae TW-183
cucaauaguguaacauuga

SEQ ID NO: 2568353 - RNA, 19 nt, Chlamydophila pneumoniae TW-183
cucaccagaagcaacuaaa

SEQ ID NO: 2568354 - RNA, 15 nt, Chlamydophila pneumoniae TW-183
cucaggauauauaga

SEQ ID NO: 2568355 - RNA, 12 nt, Chlamydophila pneumoniae TW-183
cucaguugagaa

SEQ ID NO: 2568356 - RNA, 22 nt, Chlamydophila pneumoniae TW-183
cucauaaccuaaggcauggcac

SEQ ID NO: 2568357 - RNA, 17 nt, Chlamydophila pneumoniae TW-183
cucaucagcaaaacucc

SEQ ID NO: 2568358 - RNA, 21 nt, Chlamydophila pneumoniae TW-183
cucaucaguaaaagacugaaa

SEQ ID NO: 2568359 - RNA, 19 nt, Chlamydophila pneumoniae TW-183
cucaugcggacuuuauucu

SEQ ID NO: 2568360 - RNA, 20 nt, Chlamydophila pneumoniae TW-183
cucaugcggacuuuauucuc

SEQ ID NO: 2568361 - RNA, 19 nt, Chlamydophila pneumoniae TW-183
cucauuaagaggagucccc

SEQ ID NO: 2568362 - RNA, 18 nt, Chlamydophila pneumoniae TW-183
cucauuccagcaucuucu

SEQ ID NO: 2568363 - RNA, 19 nt, Chlamydophila pneumoniae TW-183
cucauuccagcaucuucuc

SEQ ID NO: 2568364 - RNA, 16 nt, Chlamydophila pneumoniae TW-183
cuccaaaaauucccau

SEQ ID NO: 2568365 - RNA, 18 nt, Chlamydophila pneumoniae TW-183
cuccaaaagcucuacaag

SEQ ID NO: 2568366 - RNA, 15 nt, Chlamydophila pneumoniae TW-183
cuccaaaauauucuu

SEQ ID NO: 2568367 - RNA, 19 nt, Chlamydophila pneumoniae TW-183
cuccaacuaaaccuucaau

SEQ ID NO: 2568368 - RNA, 19 nt, Chlamydophila pneumoniae TW-183
cuccaagcuuggucgcaag

SEQ ID NO: 2568369 - RNA, 17 nt, Chlamydophila pneumoniae TW-183
cuccacgcacuccugga

SEQ ID NO: 2568370 - RNA, 17 nt, Chlamydophila pneumoniae TW-183
cuccaguaucuucucuu

SEQ ID NO: 2568371 - RNA, 15 nt, Chlamydophila pneumoniae TW-183
cucccaauauccaga

SEQ ID NO: 2568372 - RNA, 20 nt, Chlamydophila pneumoniae TW-183
cuccgaauggagaaggacac

SEQ ID NO: 2568373 - RNA, 12 nt, Chlamydophila pneumoniae TW-183
cuccgcucuaag

SEQ ID NO: 2568374 - RNA, 21 nt, Chlamydophila pneumoniae TW-183
cuccgcucuaagcugugcauu

SEQ ID NO: 2568375 - RNA, 23 nt, Chlamydophila pneumoniae TW-183
cuccuaaggaaaccacguccauu

SEQ ID NO: 2568376 - RNA, 21 nt, Chlamydophila pneumoniae TW-183
cuccuaagucguuaacaucaa

SEQ ID NO: 2568377 - RNA, 16 nt, Chlamydophila pneumoniae TW-183
cuccuccaaucugcug

SEQ ID NO: 2568378 - RNA, 18 nt, Chlamydophila pneumoniae TW-183
cuccugacucuuauugca

SEQ ID NO: 2568379 - RNA, 22 nt, Chlamydophila pneumoniae TW-183
cuccuggaagaauuucauaaga

SEQ ID NO: 2568380 - RNA, 16 nt, Chlamydophila pneumoniae TW-183
cuccuugauaaaacgc

SEQ ID NO: 2568381 - RNA, 13 nt, Chlamydophila pneumoniae TW-183
cucgaaacucuuu

SEQ ID NO: 2568382 - RNA, 19 nt, Chlamydophila pneumoniae TW-183
cucgaacaggagagagaag

SEQ ID NO: 2568383 - RNA, 18 nt, Chlamydophila pneumoniae TW-183
cucgaaccacuguccaug

SEQ ID NO: 2568384 - RNA, 22 nt, Chlamydophila pneumoniae TW-183
cucggauggacuacugaaacac

SEQ ID NO: 2568385 - RNA, 13 nt, Chlamydophila pneumoniae TW-183
cucgggagaacau

SEQ ID NO: 2568386 - RNA, 20 nt, Chlamydophila pneumoniae TW-183
cucgggauucguagcuuccc

SEQ ID NO: 2568387 - RNA, 21 nt, Chlamydophila pneumoniae TW-183
cucuaagcugugcauuuucuu

SEQ ID NO: 2568388 - RNA, 21 nt, Chlamydophila pneumoniae TW-183
cucuaaggacaaaucucccaa

SEQ ID NO: 2568389 - RNA, 16 nt, Chlamydophila pneumoniae TW-183
cucuaccccacgcuaa

SEQ ID NO: 2568390 - RNA, 20 nt, Chlamydophila pneumoniae TW-183
cucuagcaccuaauaaagaa

SEQ ID NO: 2568391 - RNA, 23 nt, Chlamydophila pneumoniae TW-183
cucuagcaccuaauaaagaaggu

SEQ ID NO: 2568392 - RNA, 19 nt, Chlamydophila pneumoniae TW-183
cucuagggauaauuaaacu

SEQ ID NO: 2568393 - RNA, 16 nt, Chlamydophila pneumoniae TW-183
cucuauaaauuucuca

SEQ ID NO: 2568394 - RNA, 12 nt, Chlamydophila pneumoniae TW-183
cucuauauuuuu

SEQ ID NO: 2568395 - RNA, 14 nt, Chlamydophila pneumoniae TW-183
cuucggaucuguaa

SEQ ID NO: 2568396 - RNA, 17 nt, Chlamydophila pneumoniae TW-183
cuucuaaaaucuucucu

SEQ ID NO: 2568397 - RNA, 16 nt, Chlamydophila pneumoniae TW-183
cuucuaaggaaauuac

SEQ ID NO: 2568398 - RNA, 20 nt, Chlamydophila pneumoniae TW-183
cuucuaaggaaauuacaauc

SEQ ID NO: 2568399 - RNA, 16 nt, Chlamydophila pneumoniae TW-183
cuucuaugguaaucac

SEQ ID NO: 2568400 - RNA, 22 nt, Chlamydophila pneumoniae TW-183
cuucuaugguaaucaccuuaga

SEQ ID NO: 2568401 - RNA, 18 nt, Chlamydophila pneumoniae TW-183
cuucuucccagccuugau

SEQ ID NO: 2568402 - RNA, 20 nt, Chlamydophila pneumoniae TW-183
cuucuucguaagcugcaauc

SEQ ID NO: 2568403 - RNA, 22 nt, Chlamydophila pneumoniae TW-183
cuucuucuggcugagagaagca

SEQ ID NO: 2568404 - RNA, 17 nt, Chlamydophila pneumoniae TW-183
cuucuugcaaucuuuga

SEQ ID NO: 2568405 - RNA, 15 nt, Chlamydophila pneumoniae TW-183
cuucuugugauccuu

SEQ ID NO: 2568406 - RNA, 17 nt, Chlamydophila pneumoniae TW-183
cuucuuguuuuugugga

SEQ ID NO: 2568407 - RNA, 20 nt, Chlamydophila pneumoniae TW-183
cuucuuuagauagcucuuug

SEQ ID NO: 2568408 - RNA, 14 nt, Chlamydophila pneumoniae TW-183
cuucuuucugcucu

SEQ ID NO: 2568409 - RNA, 23 nt, Chlamydophila pneumoniae TW-183
cuucuuuuauauuaagaauggau

SEQ ID NO: 2568410 - RNA, 15 nt, Chlamydophila pneumoniae TW-183
cuugaaauugcucuu

SEQ ID NO: 2568411 - RNA, 12 nt, Chlamydophila pneumoniae TW-183
cuugaacaucuc

SEQ ID NO: 2568412 - RNA, 22 nt, Chlamydophila pneumoniae TW-183
cuugacuaaauccaccaaugau

SEQ ID NO: 2568413 - RNA, 17 nt, Chlamydophila pneumoniae TW-183
cuugagaaaagaacagg

SEQ ID NO: 2568414 - RNA, 12 nt, Chlamydophila pneumoniae TW-183
cuugaucaggau

SEQ ID NO: 2568415 - RNA, 15 nt, Chlamydophila pneumoniae TW-183
cuugauucucuucca

SEQ ID NO: 2568416 - RNA, 14 nt, Chlamydophila pneumoniae TW-183
cuugauuugggaug

SEQ ID NO: 2568417 - RNA, 22 nt, Chlamydophila pneumoniae TW-183
cuugauuuucaaagaccagaau

SEQ ID NO: 2568418 - RNA, 18 nt, Chlamydophila pneumoniae TW-183
cuugcauuuuuuggaaua

SEQ ID NO: 2568419 - RNA, 13 nt, Chlamydophila pneumoniae TW-183
cuuggucgcaagg

SEQ ID NO: 2568420 - RNA, 18 nt, Chlamydophila pneumoniae TW-183
cuuggucggaguuuuuuu

SEQ ID NO: 2568421 - RNA, 20 nt, Chlamydophila pneumoniae TW-183
cuuggucggaguuuuuuucu

SEQ ID NO: 2568422 - RNA, 20 nt, Chlamydophila pneumoniae TW-183
cuugucacacugcgagagaa

SEQ ID NO: 2568423 - RNA, 22 nt, Chlamydophila pneumoniae TW-183
cuuguuaugaugauccacugcu

SEQ ID NO: 2568424 - RNA, 17 nt, Chlamydophila pneumoniae TW-183
cuuguucuugaacaucu

SEQ ID NO: 2568425 - RNA, 15 nt, Chlamydophila pneumoniae TW-183
cuuguucuuuucauc

SEQ ID NO: 2568426 - RNA, 16 nt, Chlamydophila pneumoniae TW-183
cuuguucuuuucauca

SEQ ID NO: 2568427 - RNA, 17 nt, Chlamydophila pneumoniae TW-183
cuuguucuuuucaucaa

SEQ ID NO: 2568428 - RNA, 15 nt, Chlamydophila pneumoniae TW-183
cuuguugcaauugcc

SEQ ID NO: 2568429 - RNA, 17 nt, Chlamydophila pneumoniae TW-183
cuuuaccauagaaagau

SEQ ID NO: 2568430 - RNA, 18 nt, Chlamydophila pneumoniae TW-183
cuuuagauagcucuuuga

SEQ ID NO: 2568431 - RNA, 22 nt, Chlamydophila pneumoniae TW-183
cuuuauagauaugccucagguc

SEQ ID NO: 2568432 - RNA, 20 nt, Chlamydophila pneumoniae TW-183
cuuuauggcucaacuuaagu

SEQ ID NO: 2568433 - RNA, 16 nt, Chlamydophila pneumoniae TW-183
cuuuauugauagcuga

SEQ ID NO: 2568434 - RNA, 16 nt, Chlamydophila pneumoniae TW-183
cuuucaaaccacggau

SEQ ID NO: 2568435 - RNA, 13 nt, Chlamydophila pneumoniae TW-183
cuuucagaaagaa

SEQ ID NO: 2568436 - RNA, 21 nt, Chlamydophila pneumoniae TW-183
cuuucaucagcaucggugucu

SEQ ID NO: 2568437 - RNA, 18 nt, Chlamydophila pneumoniae TW-183
cuuuccagggcauucucu

SEQ ID NO: 2568438 - RNA, 11 nt, Chlamydophila pneumoniae TW-183
cuuuccucucu

SEQ ID NO: 2568439 - RNA, 21 nt, Chlamydophila pneumoniae TW-183
cuuuccucucuuuauauuuuu

SEQ ID NO: 2568440 - RNA, 19 nt, Chlamydophila pneumoniae TW-183
cuuugaagcucgaccucua

SEQ ID NO: 2568441 - RNA, 20 nt, Chlamydophila pneumoniae TW-183
cuuugaggauacgaauaagu

SEQ ID NO: 2568442 - RNA, 19 nt, Chlamydophila pneumoniae TW-183
cuuugaggcaagucucaaa

SEQ ID NO: 2568443 - RNA, 13 nt, Chlamydophila pneumoniae TW-183
cuuugcaugagga

SEQ ID NO: 2568444 - RNA, 14 nt, Chlamydophila pneumoniae TW-183
cuuugcaugaggag

SEQ ID NO: 2568445 - RNA, 15 nt, Chlamydophila pneumoniae TW-183
cuuugcgcuuguucu

SEQ ID NO: 2568446 - RNA, 16 nt, Chlamydophila pneumoniae TW-183
cuuugcgcuuguucuu

SEQ ID NO: 2568447 - RNA, 23 nt, Chlamydophila pneumoniae TW-183
cuuugcgcuuguucuuuucauca

SEQ ID NO: 2568448 - RNA, 14 nt, Chlamydophila pneumoniae TW-183
cuuugggauaaaaa

SEQ ID NO: 2568449 - RNA, 16 nt, Chlamydophila pneumoniae TW-183
cuuugugauuacagca

SEQ ID NO: 2568450 - RNA, 16 nt, Chlamydophila pneumoniae TW-183
cuuuuagguagagaau

SEQ ID NO: 2568451 - RNA, 13 nt, Chlamydophila pneumoniae TW-183
cuuuucaucaaga

SEQ ID NO: 2568452 - RNA, 20 nt, Chlamydophila pneumoniae TW-183
cuuuuccggggagaacuuca

SEQ ID NO: 2568453 - RNA, 18 nt, Chlamydophila pneumoniae TW-183
cuuuucugaagauuuuuu

SEQ ID NO: 2568454 - RNA, 21 nt, Chlamydophila pneumoniae TW-183
cuuuucugaaucuuuuguuuu

SEQ ID NO: 2568455 - RNA, 15 nt, Chlamydophila pneumoniae TW-183
cuuuugugauaccuc

SEQ ID NO: 2568456 - RNA, 18 nt, Chlamydophila pneumoniae TW-183
cuuuuguuguuuuugcug

SEQ ID NO: 2568457 - RNA, 14 nt, Chlamydophila pneumoniae TW-183
cuuuuucagcuucu

SEQ ID NO: 2568458 - RNA, 20 nt, Chlamydophila pneumoniae TW-183
cuuuuugauuagaguuuuug

SEQ ID NO: 2568459 - RNA, 14 nt, Chlamydophila pneumoniae TW-183
cuuuuugcagaucu

SEQ ID NO: 2568460 - RNA, 23 nt, Chlamydophila pneumoniae TW-183
gaaaaaccccuagaacuuuacaa

SEQ ID NO: 2568461 - RNA, 20 nt, Chlamydophila pneumoniae TW-183
gaaaaagccuaugggaggaa

SEQ ID NO: 2568462 - RNA, 21 nt, Chlamydophila pneumoniae TW-183
gaaaaagccuaugggaggaau

SEQ ID NO: 2568463 - RNA, 14 nt, Chlamydophila pneumoniae TW-183
gaaaacauagagau

SEQ ID NO: 2568464 - RNA, 15 nt, Chlamydophila pneumoniae TW-183
gaaaagaacagggga

SEQ ID NO: 2568465 - RNA, 12 nt, Chlamydophila pneumoniae TW-183
gaaaagagcuca

SEQ ID NO: 2568466 - RNA, 15 nt, Chlamydophila pneumoniae TW-183
gaaaauaagcaguuu

SEQ ID NO: 2568467 - RNA, 23 nt, Chlamydophila pneumoniae TW-183
gaaaauaguacgcuuuuuacuga

SEQ ID NO: 2568468 - RNA, 24 nt, Chlamydophila pneumoniae TW-183
gaaacacuuuggauaggauaggag

SEQ ID NO: 2568469 - RNA, 15 nt, Chlamydophila pneumoniae TW-183
gaaaccagaacacau

SEQ ID NO: 2568470 - RNA, 16 nt, Chlamydophila pneumoniae TW-183
gaaaccagaacacaug

SEQ ID NO: 2568471 - RNA, 22 nt, Chlamydophila pneumoniae TW-183
gaaauacguccagccugcacca

SEQ ID NO: 2568472 - RNA, 15 nt, Chlamydophila pneumoniae TW-183
gaaauacuuuuccua

SEQ ID NO: 2568473 - RNA, 14 nt, Chlamydophila pneumoniae TW-183
gaaauauacugcca

SEQ ID NO: 2568474 - RNA, 12 nt, Chlamydophila pneumoniae TW-183
gaaauccuccua

SEQ ID NO: 2568475 - RNA, 17 nt, Chlamydophila pneumoniae TW-183
gaaaugcucuucugcag

SEQ ID NO: 2568476 - RNA, 23 nt, Chlamydophila pneumoniae TW-183
gaaauuagagggauuuguaggaa

SEQ ID NO: 2568477 - RNA, 22 nt, Chlamydophila pneumoniae TW-183
gaaauugaauaucgaguucuuu

SEQ ID NO: 2568478 - RNA, 23 nt, Chlamydophila pneumoniae TW-183
gaacagcauggacuccaagaaua

SEQ ID NO: 2568479 - RNA, 21 nt, Chlamydophila pneumoniae TW-183
gaacaguauaaucagaaguga

SEQ ID NO: 2568480 - RNA, 18 nt, Chlamydophila pneumoniae TW-183
gaacccgagacuucucuc

SEQ ID NO: 2568481 - RNA, 13 nt, Chlamydophila pneumoniae TW-183
gaacgugcugcga

SEQ ID NO: 2568482 - RNA, 19 nt, Chlamydophila pneumoniae TW-183
gaagaaacuucucuaggaa

SEQ ID NO: 2568483 - RNA, 17 nt, Chlamydophila pneumoniae TW-183
gaagaauuucauaagag

SEQ ID NO: 2568484 - RNA, 20 nt, Chlamydophila pneumoniae TW-183
gaagaauuucauaagagaac

SEQ ID NO: 2568485 - RNA, 18 nt, Chlamydophila pneumoniae TW-183
gaagaauuucgucuucau

SEQ ID NO: 2568486 - RNA, 18 nt, Chlamydophila pneumoniae TW-183
gaagacccucgaaccacu

SEQ ID NO: 2568487 - RNA, 19 nt, Chlamydophila pneumoniae TW-183
gaagacucucaucagcaaa

SEQ ID NO: 2568488 - RNA, 18 nt, Chlamydophila pneumoniae TW-183
gaagagcauuuaaaacgg

SEQ ID NO: 2568489 - RNA, 20 nt, Chlamydophila pneumoniae TW-183
gaagagcauuuaaaacggcu

SEQ ID NO: 2568490 - RNA, 16 nt, Chlamydophila pneumoniae TW-183
gaagauccuagagaau

SEQ ID NO: 2568491 - RNA, 17 nt, Chlamydophila pneumoniae TW-183
gaagcaacuaaacucuc

SEQ ID NO: 2568492 - RNA, 16 nt, Chlamydophila pneumoniae TW-183
gauaacguugccuguu

SEQ ID NO: 2568493 - RNA, 14 nt, Chlamydophila pneumoniae TW-183
gauaaguucuucca

SEQ ID NO: 2568494 - RNA, 15 nt, Chlamydophila pneumoniae TW-183
gauaaguucuuccaa

SEQ ID NO: 2568495 - RNA, 18 nt, Chlamydophila pneumoniae TW-183
gauacucugaacaggaau

SEQ ID NO: 2568496 - RNA, 13 nt, Chlamydophila pneumoniae TW-183
gauagagaaaaua

SEQ ID NO: 2568497 - RNA, 19 nt, Chlamydophila pneumoniae TW-183
gauagaucguuucuaucuc

SEQ ID NO: 2568498 - RNA, 23 nt, Chlamydophila pneumoniae TW-183
gauagcgucuguuaacucagaga

SEQ ID NO: 2568499 - RNA, 13 nt, Chlamydophila pneumoniae TW-183
gauaggaaccacu

SEQ ID NO: 2568500 - RNA, 16 nt, Chlamydophila pneumoniae TW-183
gauagggaccaugauc

SEQ ID NO: 2568501 - RNA, 18 nt, Chlamydophila pneumoniae TW-183
gauagggaccaugaucuu

SEQ ID NO: 2568502 - RNA, 23 nt, Chlamydophila pneumoniae TW-183
gauaggugagguuugugcugcuu

SEQ ID NO: 2568503 - RNA, 11 nt, Chlamydophila pneumoniae TW-183
gauauauagag

SEQ ID NO: 2568504 - RNA, 16 nt, Chlamydophila pneumoniae TW-183
gauauauagagcagac

SEQ ID NO: 2568505 - RNA, 16 nt, Chlamydophila pneumoniae TW-183
gauauugcggaaauug

SEQ ID NO: 2568506 - RNA, 16 nt, Chlamydophila pneumoniae TW-183
gaucacauagaaaaca

SEQ ID NO: 2568507 - RNA, 22 nt, Chlamydophila pneumoniae TW-183
gaucccgggccuaucucuauga

SEQ ID NO: 2568508 - RNA, 15 nt, Chlamydophila pneumoniae TW-183
gauccgaaaagaacc

SEQ ID NO: 2568509 - RNA, 23 nt, Chlamydophila pneumoniae TW-183
gauccugaaaaaagaagcuuucc

SEQ ID NO: 2568510 - RNA, 22 nt, Chlamydophila pneumoniae TW-183
gaucuagagaagaaaagagcuc

SEQ ID NO: 2568511 - RNA, 22 nt, Chlamydophila pneumoniae TW-183
gaucucaguaggagcagcggca

SEQ ID NO: 2568512 - RNA, 19 nt, Chlamydophila pneumoniae TW-183
gaucugaaguugaaaugag

SEQ ID NO: 2568513 - RNA, 17 nt, Chlamydophila pneumoniae TW-183
gaucuguaauagcagga

SEQ ID NO: 2568514 - RNA, 23 nt, Chlamydophila pneumoniae TW-183
gaugaauccaaaauaaauagaag

SEQ ID NO: 2568515 - RNA, 15 nt, Chlamydophila pneumoniae TW-183
gaugacuuucagagc

SEQ ID NO: 2568516 - RNA, 22 nt, Chlamydophila pneumoniae TW-183
gaugaugcccugacguuuugau

SEQ ID NO: 2568517 - RNA, 13 nt, Chlamydophila pneumoniae TW-183
gaugccaagaaau

SEQ ID NO: 2568518 - RNA, 14 nt, Chlamydophila pneumoniae TW-183
gaugccaagaaaua

SEQ ID NO: 2568519 - RNA, 15 nt, Chlamydophila pneumoniae TW-183
gaugccaagaaauau

SEQ ID NO: 2568520 - RNA, 17 nt, Chlamydophila pneumoniae TW-183
gaugcugaggacgcaga

SEQ ID NO: 2568521 - RNA, 20 nt, Chlamydophila pneumoniae TW-183
gaugugauguucugcugcuu

SEQ ID NO: 2568522 - RNA, 22 nt, Chlamydophila pneumoniae TW-183
gauguuauaagugacuuuucuu

SEQ ID NO: 2568523 - RNA, 15 nt, Chlamydophila pneumoniae TW-183
gauguugcccuacaa

SEQ ID NO: 2568524 - RNA, 14 nt, Chlamydophila pneumoniae TW-183
gauuaccuaaaaca

SEQ ID NO: 2568525 - RNA, 18 nt, Chlamydophila pneumoniae TW-183
gauuaccuaaaacaaaau

SEQ ID NO: 2568526 - RNA, 13 nt, Chlamydophila pneumoniae TW-183
gauuccugaggcu

SEQ ID NO: 2568527 - RNA, 14 nt, Chlamydophila pneumoniae TW-183
gauucguagcuucc

SEQ ID NO: 2568528 - RNA, 20 nt, Chlamydophila pneumoniae TW-183
gauucucccaauauccagaa

SEQ ID NO: 2568529 - RNA, 20 nt, Chlamydophila pneumoniae TW-183
gauucucucugccuaccaaa

SEQ ID NO: 2568530 - RNA, 21 nt, Chlamydophila pneumoniae TW-183
gauucucucugccuaccaaag

SEQ ID NO: 2568531 - RNA, 16 nt, Chlamydophila pneumoniae TW-183
gauugauccacagauc

SEQ ID NO: 2568532 - RNA, 13 nt, Chlamydophila pneumoniae TW-183
gauugccaggaga

SEQ ID NO: 2568533 - RNA, 16 nt, Chlamydophila pneumoniae TW-183
gauuggaucuagagaa

SEQ ID NO: 2568534 - RNA, 15 nt, Chlamydophila pneumoniae TW-183
gauuguaaaaguagc

SEQ ID NO: 2568535 - RNA, 19 nt, Chlamydophila pneumoniae TW-183
gauuuaaaugcaagugcuu

SEQ ID NO: 2568536 - RNA, 23 nt, Chlamydophila pneumoniae TW-183
gauuuccaauccauucugagaaa

SEQ ID NO: 2568537 - RNA, 17 nt, Chlamydophila pneumoniae TW-183
gauuuccccuucagagg

SEQ ID NO: 2568538 - RNA, 15 nt, Chlamydophila pneumoniae TW-183
gauuuccuuuuggga

SEQ ID NO: 2568539 - RNA, 16 nt, Chlamydophila pneumoniae TW-183
gauuucuccagcagcu

SEQ ID NO: 2568540 - RNA, 20 nt, Chlamydophila pneumoniae TW-183
gauuucuuuuucagcuucua

SEQ ID NO: 2568541 - RNA, 17 nt, Chlamydophila pneumoniae TW-183
gauuuucuuagcuucca

SEQ ID NO: 2568542 - RNA, 21 nt, Chlamydophila pneumoniae TW-183
gauuuugcagugauaaaccaa

SEQ ID NO: 2568543 - RNA, 14 nt, Chlamydophila pneumoniae TW-183
gauuuuucaagacc

SEQ ID NO: 2568544 - RNA, 17 nt, Chlamydophila pneumoniae TW-183
gcaaaaaugaaagaaac

SEQ ID NO: 2568545 - RNA, 17 nt, Chlamydophila pneumoniae TW-183
gcaaaagcaaggcugcc

SEQ ID NO: 2568546 - RNA, 14 nt, Chlamydophila pneumoniae TW-183
gcaaacuccccagu

SEQ ID NO: 2568547 - RNA, 15 nt, Chlamydophila pneumoniae TW-183
gcaaacuccccaguu

SEQ ID NO: 2568548 - RNA, 13 nt, Chlamydophila pneumoniae TW-183
gcaaagauuucca

SEQ ID NO: 2568549 - RNA, 18 nt, Chlamydophila pneumoniae TW-183
gcaaauuucauuuagaca

SEQ ID NO: 2568550 - RNA, 19 nt, Chlamydophila pneumoniae TW-183
gcaacaacgccuacaugga

SEQ ID NO: 2568551 - RNA, 19 nt, Chlamydophila pneumoniae TW-183
gcaagcuucuuguuuuugu

SEQ ID NO: 2568552 - RNA, 14 nt, Chlamydophila pneumoniae TW-183
gcaaggagcucccu

SEQ ID NO: 2568553 - RNA, 15 nt, Chlamydophila pneumoniae TW-183
gcaagggcggagaau

SEQ ID NO: 2568554 - RNA, 13 nt, Chlamydophila pneumoniae TW-183
gcaaguaaagaaa

SEQ ID NO: 2568555 - RNA, 14 nt, Chlamydophila pneumoniae TW-183
gcaaguaaagaaau

SEQ ID NO: 2568556 - RNA, 15 nt, Chlamydophila pneumoniae TW-183
gcaaguaaagaaauu

SEQ ID NO: 2568557 - RNA, 19 nt, Chlamydophila pneumoniae TW-183
gcaaucguuucuauagacu

SEQ ID NO: 2568558 - RNA, 14 nt, Chlamydophila pneumoniae TW-183
gcacgucugcaccu

SEQ ID NO: 2568559 - RNA, 20 nt, Chlamydophila pneumoniae TW-183
gcacuuaucucuuucuugaa

SEQ ID NO: 2568560 - RNA, 10 nt, Chlamydophila pneumoniae TW-183
gcacuuuccg

SEQ ID NO: 2568561 - RNA, 19 nt, Chlamydophila pneumoniae TW-183
gcagaguccuucuuuuccg

SEQ ID NO: 2568562 - RNA, 18 nt, Chlamydophila pneumoniae TW-183
gcagauauacuuuuucag

SEQ ID NO: 2568563 - RNA, 22 nt, Chlamydophila pneumoniae TW-183
gcagcgugaauaucaucacuaa

SEQ ID NO: 2568564 - RNA, 17 nt, Chlamydophila pneumoniae TW-183
gcagcucggauggacua

SEQ ID NO: 2568565 - RNA, 18 nt, Chlamydophila pneumoniae TW-183
gcagcuucccaagcagaa

SEQ ID NO: 2568566 - RNA, 22 nt, Chlamydophila pneumoniae TW-183
gcaggaagucaccuuacaucca

SEQ ID NO: 2568567 - RNA, 15 nt, Chlamydophila pneumoniae TW-183
gcaggaguuuucaag

SEQ ID NO: 2568568 - RNA, 14 nt, Chlamydophila pneumoniae TW-183
gcaggccaacucuc

SEQ ID NO: 2568569 - RNA, 20 nt, Chlamydophila pneumoniae TW-183
gcaggugugugguaaaaaua

SEQ ID NO: 2568570 - RNA, 19 nt, Chlamydophila pneumoniae TW-183
gcauaaccuuugacaacac

SEQ ID NO: 2568571 - RNA, 16 nt, Chlamydophila pneumoniae TW-183
gcauaaucuuuaacaa

SEQ ID NO: 2568572 - RNA, 22 nt, Chlamydophila pneumoniae TW-183
gcauagccuuccauaucuagaa

SEQ ID NO: 2568573 - RNA, 22 nt, Chlamydophila pneumoniae TW-183
gcauccuguagagcaagauucu

SEQ ID NO: 2568574 - RNA, 12 nt, Chlamydophila pneumoniae TW-183
gcaugaggagac

SEQ ID NO: 2568575 - RNA, 16 nt, Chlamydophila pneumoniae TW-183
gcauggacuccaagaa

SEQ ID NO: 2568576 - RNA, 18 nt, Chlamydophila pneumoniae TW-183
gcauuggaaaucuuauaa

SEQ ID NO: 2568577 - RNA, 23 nt, Chlamydophila pneumoniae TW-183
gcauuuaaaacggcuguacuucc

SEQ ID NO: 2568578 - RNA, 22 nt, Chlamydophila pneumoniae TW-183
gcauuuaaacuaagaauaccua

SEQ ID NO: 2568579 - RNA, 15 nt, Chlamydophila pneumoniae TW-183
gcauuucuuucucuu

SEQ ID NO: 2568580 - RNA, 12 nt, Chlamydophila pneumoniae TW-183
gcauuuucucug

SEQ ID NO: 2568581 - RNA, 19 nt, Chlamydophila pneumoniae TW-183
gcauuuucucugagcagcu

SEQ ID NO: 2568582 - RNA, 13 nt, Chlamydophila pneumoniae TW-183
gccaagaaauaua

SEQ ID NO: 2568583 - RNA, 15 nt, Chlamydophila pneumoniae TW-183
gccaagagagcuugu

SEQ ID NO: 2568584 - RNA, 20 nt, Chlamydophila pneumoniae TW-183
gccaagauacuacuuacaag

SEQ ID NO: 2568585 - RNA, 12 nt, Chlamydophila pneumoniae TW-183
gccaaggucuuc

SEQ ID NO: 2568586 - RNA, 16 nt, Chlamydophila pneumoniae TW-183
gccaaggucuucccga

SEQ ID NO: 2568587 - RNA, 21 nt, Chlamydophila pneumoniae TW-183
gccacuaaguuuaggcaggaa

SEQ ID NO: 2568588 - RNA, 22 nt, Chlamydophila pneumoniae TW-183
gccacuaaguuuaggcaggaag

SEQ ID NO: 2568589 - RNA, 17 nt, Chlamydophila pneumoniae TW-183
gccagagauucuucaca

SEQ ID NO: 2568590 - RNA, 16 nt, Chlamydophila pneumoniae TW-183
ggcauuucuccacaug

SEQ ID NO: 2568591 - RNA, 23 nt, Chlamydophila pneumoniae TW-183
ggccaguuacugucugcaaagag

SEQ ID NO: 2568592 - RNA, 12 nt, Chlamydophila pneumoniae TW-183
ggcguuuuugca

SEQ ID NO: 2568593 - RNA, 14 nt, Chlamydophila pneumoniae TW-183
ggcuauagaauaca

SEQ ID NO: 2568594 - RNA, 16 nt, Chlamydophila pneumoniae TW-183
ggcucuauaaauuucu

SEQ ID NO: 2568595 - RNA, 15 nt, Chlamydophila pneumoniae TW-183
ggcucuauaggggau

SEQ ID NO: 2568596 - RNA, 24 nt, Chlamydophila pneumoniae TW-183
ggcugauucucccaauauccagaa

SEQ ID NO: 2568597 - RNA, 22 nt, Chlamydophila pneumoniae TW-183
ggcugcuuuuguuguuuuugcu

SEQ ID NO: 2568598 - RNA, 21 nt, Chlamydophila pneumoniae TW-183
ggcuuuaccauagaaagauaa

SEQ ID NO: 2568599 - RNA, 22 nt, Chlamydophila pneumoniae TW-183
gggagcgaaguuuuucuggaag

SEQ ID NO: 2568600 - RNA, 16 nt, Chlamydophila pneumoniae TW-183
gggaggaauuccucuc

SEQ ID NO: 2568601 - RNA, 14 nt, Chlamydophila pneumoniae TW-183
gggagucucuggag

SEQ ID NO: 2568602 - RNA, 20 nt, Chlamydophila pneumoniae TW-183
gggaucacagucuuaaaucc

SEQ ID NO: 2568603 - RNA, 16 nt, Chlamydophila pneumoniae TW-183
gggaucuucagagaga

SEQ ID NO: 2568604 - RNA, 17 nt, Chlamydophila pneumoniae TW-183
gggaucuucagagagaa

SEQ ID NO: 2568605 - RNA, 21 nt, Chlamydophila pneumoniae TW-183
ggggaucuucagagagaacag

SEQ ID NO: 2568606 - RNA, 15 nt, Chlamydophila pneumoniae TW-183
gggucuacaacaguu

SEQ ID NO: 2568607 - RNA, 22 nt, Chlamydophila pneumoniae TW-183
ggucacuauagaucucuugaag

SEQ ID NO: 2568608 - RNA, 12 nt, Chlamydophila pneumoniae TW-183
ggugacuaaaca

SEQ ID NO: 2568609 - RNA, 17 nt, Chlamydophila pneumoniae TW-183
gguggguagccaggaug

SEQ ID NO: 2568610 - RNA, 19 nt, Chlamydophila pneumoniae TW-183
gguuccuggauuuaggaug

SEQ ID NO: 2568611 - RNA, 13 nt, Chlamydophila pneumoniae TW-183
gguuuuuccaacu

SEQ ID NO: 2568612 - RNA, 12 nt, Chlamydophila pneumoniae TW-183
guaaaaauauag

SEQ ID NO: 2568613 - RNA, 11 nt, Chlamydophila pneumoniae TW-183
guaaaacacaa

SEQ ID NO: 2568614 - RNA, 15 nt, Chlamydophila pneumoniae TW-183
guaaaacacaaauag

SEQ ID NO: 2568615 - RNA, 16 nt, Chlamydophila pneumoniae TW-183
guaaaacuacaggaaa

SEQ ID NO: 2568616 - RNA, 20 nt, Chlamydophila pneumoniae TW-183
guaaagaguagccccagcaa

SEQ ID NO: 2568617 - RNA, 19 nt, Chlamydophila pneumoniae TW-183
guaaauuuuuccuucaaca

SEQ ID NO: 2568618 - RNA, 19 nt, Chlamydophila pneumoniae TW-183
guaacauugaccuaaagga

SEQ ID NO: 2568619 - RNA, 14 nt, Chlamydophila pneumoniae TW-183
guaaccacaggauc

SEQ ID NO: 2568620 - RNA, 13 nt, Chlamydophila pneumoniae TW-183
guaaccagagagc

SEQ ID NO: 2568621 - RNA, 18 nt, Chlamydophila pneumoniae TW-183
guaagcugcaaucucaaa

SEQ ID NO: 2568622 - RNA, 22 nt, Chlamydophila pneumoniae TW-183
guaaguaaccaauacagcauaa

SEQ ID NO: 2568623 - RNA, 19 nt, Chlamydophila pneumoniae TW-183
guaauagcaggaguuuuca

SEQ ID NO: 2568624 - RNA, 14 nt, Chlamydophila pneumoniae TW-183
guaauccuucuuuc

SEQ ID NO: 2568625 - RNA, 23 nt, Chlamydophila pneumoniae TW-183
guaauccuucuuucugcucuucu

SEQ ID NO: 2568626 - RNA, 14 nt, Chlamydophila pneumoniae TW-183
guaaugccagcagc

SEQ ID NO: 2568627 - RNA, 22 nt, Chlamydophila pneumoniae TW-183
guaauuucuaaauagaaaacau

SEQ ID NO: 2568628 - RNA, 19 nt, Chlamydophila pneumoniae TW-183
guacaaugauaucagcaua

SEQ ID NO: 2568629 - RNA, 14 nt, Chlamydophila pneumoniae TW-183
guaccaagaaaaua

SEQ ID NO: 2568630 - RNA, 15 nt, Chlamydophila pneumoniae TW-183
guacgcaaaguacua

SEQ ID NO: 2568631 - RNA, 18 nt, Chlamydophila pneumoniae TW-183
guacgcaaguaaagaaau

SEQ ID NO: 2568632 - RNA, 19 nt, Chlamydophila pneumoniae TW-183
guacuuccccaaacaugga

SEQ ID NO: 2568633 - RNA, 12 nt, Chlamydophila pneumoniae TW-183
guagagcaagau

SEQ ID NO: 2568634 - RNA, 16 nt, Chlamydophila pneumoniae TW-183
guagagcaagauucuu

SEQ ID NO: 2568635 - RNA, 20 nt, Chlamydophila pneumoniae TW-183
guagauagaaauucuguaga

SEQ ID NO: 2568636 - RNA, 21 nt, Chlamydophila pneumoniae TW-183
guagccguaggguagccaucc

SEQ ID NO: 2568637 - RNA, 16 nt, Chlamydophila pneumoniae TW-183
guaguaggcacuuauc

SEQ ID NO: 2568638 - RNA, 18 nt, Chlamydophila pneumoniae TW-183
guaguauccuuucaucag

SEQ ID NO: 2568639 - RNA, 15 nt, Chlamydophila pneumoniae TW-183
guagucaugauuuuu

SEQ ID NO: 2568640 - RNA, 22 nt, Chlamydophila pneumoniae TW-183
guagucaugauuuuucaaucaa

SEQ ID NO: 2568641 - RNA, 17 nt, Chlamydophila pneumoniae TW-183
guaguccgcagauuuua

SEQ ID NO: 2568642 - RNA, 19 nt, Chlamydophila pneumoniae TW-183
guaguuucuaaaacagaaa

SEQ ID NO: 2568643 - RNA, 19 nt, Chlamydophila pneumoniae TW-183
guauccuuucaucagcauc

SEQ ID NO: 2568644 - RNA, 17 nt, Chlamydophila pneumoniae TW-183
guaugaggagauaaaga

SEQ ID NO: 2568645 - RNA, 17 nt, Chlamydophila pneumoniae TW-183
guauugcaaauuucauu

SEQ ID NO: 2568646 - RNA, 19 nt, Chlamydophila pneumoniae TW-183
gucacacugcgagagaaag

SEQ ID NO: 2568647 - RNA, 21 nt, Chlamydophila pneumoniae TW-183
gucaccuuaauggcuccuacu

SEQ ID NO: 2568648 - RNA, 16 nt, Chlamydophila pneumoniae TW-183
gucaugauuuuucaau

SEQ ID NO: 2568649 - RNA, 16 nt, Chlamydophila pneumoniae TW-183
guccagccugcaccag

SEQ ID NO: 2568650 - RNA, 21 nt, Chlamydophila pneumoniae TW-183
guccauuucauguaagaaugu

SEQ ID NO: 2568651 - RNA, 15 nt, Chlamydophila pneumoniae TW-183
gucccacaaaugaua

SEQ ID NO: 2568652 - RNA, 14 nt, Chlamydophila pneumoniae TW-183
guccgcagauuuua

SEQ ID NO: 2568653 - RNA, 19 nt, Chlamydophila pneumoniae TW-183
guccuccauggaaagaaac

SEQ ID NO: 2568654 - RNA, 20 nt, Chlamydophila pneumoniae TW-183
guccuccauggaaagaaaca

SEQ ID NO: 2568655 - RNA, 19 nt, Chlamydophila pneumoniae TW-183
guccuugcagcccugcaua

SEQ ID NO: 2568656 - RNA, 16 nt, Chlamydophila pneumoniae TW-183
gucggagauuguuuca

SEQ ID NO: 2568657 - RNA, 13 nt, Chlamydophila pneumoniae TW-183
gucggaguuuuuu

SEQ ID NO: 2568658 - RNA, 21 nt, Chlamydophila pneumoniae TW-183
gucggcucuauaaauuucuca

SEQ ID NO: 2568659 - RNA, 17 nt, Chlamydophila pneumoniae TW-183
gucuccaaaaauuccca

SEQ ID NO: 2568660 - RNA, 19 nt, Chlamydophila pneumoniae TW-183
gucuccuggaacaguauaa

SEQ ID NO: 2568661 - RNA, 13 nt, Chlamydophila pneumoniae TW-183
gucuccuugauuu

SEQ ID NO: 2568662 - RNA, 21 nt, Chlamydophila pneumoniae TW-183
gucucgaaacucuuugaggau

SEQ ID NO: 2568663 - RNA, 22 nt, Chlamydophila pneumoniae TW-183
gucucuggaguuugauagagaa

SEQ ID NO: 2568664 - RNA, 14 nt, Chlamydophila pneumoniae TW-183
gucugcugaggaga

SEQ ID NO: 2568665 - RNA, 13 nt, Chlamydophila pneumoniae TW-183
gucuguaaggaca

SEQ ID NO: 2568666 - RNA, 22 nt, Chlamydophila pneumoniae TW-183
gucuuccccccucacaauauaa

SEQ ID NO: 2568667 - RNA, 21 nt, Chlamydophila pneumoniae TW-183
gugaacuuuuguacacagaga

SEQ ID NO: 2568668 - RNA, 15 nt, Chlamydophila pneumoniae TW-183
gugaagaaaccagaa

SEQ ID NO: 2568669 - RNA, 14 nt, Chlamydophila pneumoniae TW-183
gugaucuugagaaa

SEQ ID NO: 2568670 - RNA, 17 nt, Chlamydophila pneumoniae TW-183
gugcaaguucacacgua

SEQ ID NO: 2568671 - RNA, 13 nt, Chlamydophila pneumoniae TW-183
gugcaugcaucuu

SEQ ID NO: 2568672 - RNA, 21 nt, Chlamydophila pneumoniae TW-183
gugccuguaauugauguuccu

SEQ ID NO: 2568673 - RNA, 20 nt, Chlamydophila pneumoniae TW-183
gugcgcgucuccuugauuug

SEQ ID NO: 2568674 - RNA, 15 nt, Chlamydophila pneumoniae TW-183
gugcucggcacuuac

SEQ ID NO: 2568675 - RNA, 16 nt, Chlamydophila pneumoniae TW-183
guggguagccaggaug

SEQ ID NO: 2568676 - RNA, 23 nt, Chlamydophila pneumoniae TW-183
gugguaaaaauauaggcugcaca

SEQ ID NO: 2568677 - RNA, 14 nt, Chlamydophila pneumoniae TW-183
guguaaaaguuagg

SEQ ID NO: 2568678 - RNA, 16 nt, Chlamydophila pneumoniae TW-183
gugucauacgcagcac

SEQ ID NO: 2568679 - RNA, 16 nt, Chlamydophila pneumoniae TW-183
guguggguacaggggg

SEQ ID NO: 2568680 - RNA, 18 nt, Chlamydophila pneumoniae TW-183
gugugguaaaaauauagg

SEQ ID NO: 2568681 - RNA, 13 nt, Chlamydophila pneumoniae TW-183
guuauaagugacu

SEQ ID NO: 2568682 - RNA, 20 nt, Chlamydophila pneumoniae TW-183
guuauaagugacuuuucuuc

SEQ ID NO: 2568683 - RNA, 21 nt, Chlamydophila pneumoniae TW-183
guuaucaaaagguuuuauaaa

SEQ ID NO: 2568684 - RNA, 13 nt, Chlamydophila pneumoniae TW-183
guuaucaggaacu

SEQ ID NO: 2568685 - RNA, 23 nt, Chlamydophila pneumoniae TW-183
guucaccagaagcauugaggaca

SEQ ID NO: 2568686 - RNA, 15 nt, Chlamydophila pneumoniae TW-183
guucacuucaucgac

SEQ ID NO: 2568687 - RNA, 14 nt, Chlamydophila pneumoniae TW-183
uaauaaaagaacau

SEQ ID NO: 2568688 - RNA, 14 nt, Chlamydophila pneumoniae TW-183
uaauagaagaucau

SEQ ID NO: 2568689 - RNA, 14 nt, Chlamydophila pneumoniae TW-183
uaauagcaggaguu

SEQ ID NO: 2568690 - RNA, 12 nt, Chlamydophila pneumoniae TW-183
uaaucaccuuag

SEQ ID NO: 2568691 - RNA, 14 nt, Chlamydophila pneumoniae TW-183
uaaucauaaaaaaa

SEQ ID NO: 2568692 - RNA, 22 nt, Chlamydophila pneumoniae TW-183
uaauccuccucgaauggagugc

SEQ ID NO: 2568693 - RNA, 14 nt, Chlamydophila pneumoniae TW-183
uaauccuucuuucu

SEQ ID NO: 2568694 - RNA, 18 nt, Chlamydophila pneumoniae TW-183
uaaucgagagaagaaauu

SEQ ID NO: 2568695 - RNA, 19 nt, Chlamydophila pneumoniae TW-183
uaaucuauaggauuugcau

SEQ ID NO: 2568696 - RNA, 14 nt, Chlamydophila pneumoniae TW-183
uaaucucaccagaa

SEQ ID NO: 2568697 - RNA, 16 nt, Chlamydophila pneumoniae TW-183
uaauggcuccuacucc

SEQ ID NO: 2568698 - RNA, 13 nt, Chlamydophila pneumoniae TW-183
uacaaaauuauua

SEQ ID NO: 2568699 - RNA, 15 nt, Chlamydophila pneumoniae TW-183
uacaaaauuauuaaa

SEQ ID NO: 2568700 - RNA, 22 nt, Chlamydophila pneumoniae TW-183
uacaagugucugaguuagcuuu

SEQ ID NO: 2568701 - RNA, 12 nt, Chlamydophila pneumoniae TW-183
uacaaguugaga

SEQ ID NO: 2568702 - RNA, 17 nt, Chlamydophila pneumoniae TW-183
uacaaguugagagagag

SEQ ID NO: 2568703 - RNA, 13 nt, Chlamydophila pneumoniae TW-183
uacaauacuggag

SEQ ID NO: 2568704 - RNA, 22 nt, Chlamydophila pneumoniae TW-183
uacaaucucuagggauaauuaa

SEQ ID NO: 2568705 - RNA, 20 nt, Chlamydophila pneumoniae TW-183
uacaauuagagauucauaaa

SEQ ID NO: 2568706 - RNA, 17 nt, Chlamydophila pneumoniae TW-183
uacagagggaauuucau

SEQ ID NO: 2568707 - RNA, 15 nt, Chlamydophila pneumoniae TW-183
uacagauaaggaaga

SEQ ID NO: 2568708 - RNA, 18 nt, Chlamydophila pneumoniae TW-183
uacagaugcaugauccua

SEQ ID NO: 2568709 - RNA, 14 nt, Chlamydophila pneumoniae TW-183
uacagcaaccacau

SEQ ID NO: 2568710 - RNA, 15 nt, Chlamydophila pneumoniae TW-183
uacagcauaaaaauu

SEQ ID NO: 2568711 - RNA, 22 nt, Chlamydophila pneumoniae TW-183
uacagcauaaaaauucucauaa

SEQ ID NO: 2568712 - RNA, 17 nt, Chlamydophila pneumoniae TW-183
uacagugacauccggau

SEQ ID NO: 2568713 - RNA, 20 nt, Chlamydophila pneumoniae TW-183
uacaucaaugauaucgccuu

SEQ ID NO: 2568714 - RNA, 22 nt, Chlamydophila pneumoniae TW-183
uacauuugauucauaaagagga

SEQ ID NO: 2568715 - RNA, 17 nt, Chlamydophila pneumoniae TW-183
uaccaucgucuccaaaa

SEQ ID NO: 2568716 - RNA, 16 nt, Chlamydophila pneumoniae TW-183
uaccgaccgaaucucu

SEQ ID NO: 2568717 - RNA, 20 nt, Chlamydophila pneumoniae TW-183
uaccuuaguuuuuucuaagg

SEQ ID NO: 2568718 - RNA, 14 nt, Chlamydophila pneumoniae TW-183
uaccuugagacaaa

SEQ ID NO: 2568719 - RNA, 14 nt, Chlamydophila pneumoniae TW-183
uaccuuguuuuccu

SEQ ID NO: 2568720 - RNA, 14 nt, Chlamydophila pneumoniae TW-183
uacgauguuuucuu

SEQ ID NO: 2568721 - RNA, 15 nt, Chlamydophila pneumoniae TW-183
uacgcaaaguacuaa

SEQ ID NO: 2568722 - RNA, 15 nt, Chlamydophila pneumoniae TW-183
uacgcaaguaaagaa

SEQ ID NO: 2568723 - RNA, 18 nt, Chlamydophila pneumoniae TW-183
uacgcaaguaaagaaauu

SEQ ID NO: 2568724 - RNA, 20 nt, Chlamydophila pneumoniae TW-183
uacgcaaguaaagaaauucu

SEQ ID NO: 2568725 - RNA, 19 nt, Chlamydophila pneumoniae TW-183
uacgccgugccuauagaaa

SEQ ID NO: 2568726 - RNA, 15 nt, Chlamydophila pneumoniae TW-183
uacgcgcucuucuuu

SEQ ID NO: 2568727 - RNA, 23 nt, Chlamydophila pneumoniae TW-183
uacguuuugucgguaauuuccau

SEQ ID NO: 2568728 - RNA, 13 nt, Chlamydophila pneumoniae TW-183
uacuacucucauc

SEQ ID NO: 2568729 - RNA, 18 nt, Chlamydophila pneumoniae TW-183
uacuacuuacaagaacaa

SEQ ID NO: 2568730 - RNA, 20 nt, Chlamydophila pneumoniae TW-183
uacucugaacaggaauagaa

SEQ ID NO: 2568731 - RNA, 17 nt, Chlamydophila pneumoniae TW-183
uacugccagcgaucaca

SEQ ID NO: 2568732 - RNA, 21 nt, Chlamydophila pneumoniae TW-183
uacuggagagguaaccagaga

SEQ ID NO: 2568733 - RNA, 23 nt, Chlamydophila pneumoniae TW-183
uacuggagagguaaccagagagc

SEQ ID NO: 2568734 - RNA, 14 nt, Chlamydophila pneumoniae TW-183
uacuuacaagaaca

SEQ ID NO: 2568735 - RNA, 15 nt, Chlamydophila pneumoniae TW-183
uacuuacaagaacaa

SEQ ID NO: 2568736 - RNA, 19 nt, Chlamydophila pneumoniae TW-183
uacuucaagaaaaaccccu

SEQ ID NO: 2568737 - RNA, 12 nt, Chlamydophila pneumoniae TW-183
uacuuccccaaa

SEQ ID NO: 2568738 - RNA, 11 nt, Chlamydophila pneumoniae TW-183
uacuuuuccua

SEQ ID NO: 2568739 - RNA, 23 nt, Chlamydophila pneumoniae TW-183
uagaaacucgggauucguagcuu

SEQ ID NO: 2568740 - RNA, 20 nt, Chlamydophila pneumoniae TW-183
uagaacagcauggacuccaa

SEQ ID NO: 2568741 - RNA, 18 nt, Chlamydophila pneumoniae TW-183
uagaagguguuuuggcug

SEQ ID NO: 2568742 - RNA, 21 nt, Chlamydophila pneumoniae TW-183
uagaagguguuuuggcugcuu

SEQ ID NO: 2568743 - RNA, 12 nt, Chlamydophila pneumoniae TW-183
uagagaagaaaa

SEQ ID NO: 2568744 - RNA, 15 nt, Chlamydophila pneumoniae TW-183
uagagaagaaaagag

SEQ ID NO: 2568745 - RNA, 17 nt, Chlamydophila pneumoniae TW-183
uagagagcgcagagucu

SEQ ID NO: 2568746 - RNA, 20 nt, Chlamydophila pneumoniae TW-183
uagagauuaccgaagagccc

SEQ ID NO: 2568747 - RNA, 22 nt, Chlamydophila pneumoniae TW-183
uagagauucauaaaacuguaau

SEQ ID NO: 2568748 - RNA, 23 nt, Chlamydophila pneumoniae TW-183
uagagcaagauucuucagaaucu

SEQ ID NO: 2568749 - RNA, 11 nt, Chlamydophila pneumoniae TW-183
uagagccuaga

SEQ ID NO: 2568750 - RNA, 16 nt, Chlamydophila pneumoniae TW-183
uagagggauuuguagg

SEQ ID NO: 2568751 - RNA, 16 nt, Chlamydophila pneumoniae TW-183
uagaguugcuuuaugg

SEQ ID NO: 2568752 - RNA, 13 nt, Chlamydophila pneumoniae TW-183
uagauaugccuca

SEQ ID NO: 2568753 - RNA, 18 nt, Chlamydophila pneumoniae TW-183
uagauaugccucaggucu

SEQ ID NO: 2568754 - RNA, 15 nt, Chlamydophila pneumoniae TW-183
uagaucccagaagaa

SEQ ID NO: 2568755 - RNA, 18 nt, Chlamydophila pneumoniae TW-183
uagaucccucaagcgauu

SEQ ID NO: 2568756 - RNA, 21 nt, Chlamydophila pneumoniae TW-183
uagaucgauuaccuaaaacaa

SEQ ID NO: 2568757 - RNA, 24 nt, Chlamydophila pneumoniae TW-183
uagauugccuuugaucaggagucu

SEQ ID NO: 2568758 - RNA, 19 nt, Chlamydophila pneumoniae TW-183
uagauuuuuacuugcccaa

SEQ ID NO: 2568759 - RNA, 11 nt, Chlamydophila pneumoniae TW-183
uagcaaaggca

SEQ ID NO: 2568760 - RNA, 20 nt, Chlamydophila pneumoniae TW-183
uagcaauugagcuucuuuag

SEQ ID NO: 2568761 - RNA, 21 nt, Chlamydophila pneumoniae TW-183
uagcagcccgcacaucaugcu

SEQ ID NO: 2568762 - RNA, 18 nt, Chlamydophila pneumoniae TW-183
uagccauuccauggauau

SEQ ID NO: 2568763 - RNA, 11 nt, Chlamydophila pneumoniae TW-183
uagcccuugca

SEQ ID NO: 2568764 - RNA, 14 nt, Chlamydophila pneumoniae TW-183
uagccgaguccuau

SEQ ID NO: 2568765 - RNA, 23 nt, Chlamydophila pneumoniae TW-183
uagccuuacggccccuggaauuu

SEQ ID NO: 2568766 - RNA, 22 nt, Chlamydophila pneumoniae TW-183
uagcucuugcgaacuauccuaa

SEQ ID NO: 2568767 - RNA, 23 nt, Chlamydophila pneumoniae TW-183
uaggaagaugaauaccagaagca

SEQ ID NO: 2568768 - RNA, 21 nt, Chlamydophila pneumoniae TW-183
uaggagggguaaaccaauuga

SEQ ID NO: 2568769 - RNA, 14 nt, Chlamydophila pneumoniae TW-183
uaggauccaggagu

SEQ ID NO: 2568770 - RNA, 12 nt, Chlamydophila pneumoniae TW-183
uaggauuugcau

SEQ ID NO: 2568771 - RNA, 18 nt, Chlamydophila pneumoniae TW-183
uaggauuugcauagaggg

SEQ ID NO: 2568772 - RNA, 22 nt, Chlamydophila pneumoniae TW-183
uaggcaagauuaugaugccuca

SEQ ID NO: 2568773 - RNA, 17 nt, Chlamydophila pneumoniae TW-183
uaggcacuuaucucuuu

SEQ ID NO: 2568774 - RNA, 22 nt, Chlamydophila pneumoniae TW-183
uaggcaguggcucuauagggga

SEQ ID NO: 2568775 - RNA, 12 nt, Chlamydophila pneumoniae TW-183
uaggcccaagaa

SEQ ID NO: 2568776 - RNA, 16 nt, Chlamydophila pneumoniae TW-183
uagggagugaggaauc

SEQ ID NO: 2568777 - RNA, 23 nt, Chlamydophila pneumoniae TW-183
uagggagugaggaaucauaacca

SEQ ID NO: 2568778 - RNA, 14 nt, Chlamydophila pneumoniae TW-183
uagggguuucccug

SEQ ID NO: 2568779 - RNA, 16 nt, Chlamydophila pneumoniae TW-183
uaggguagccauccac

SEQ ID NO: 2568780 - RNA, 13 nt, Chlamydophila pneumoniae TW-183
uaggguucucaaa

SEQ ID NO: 2568781 - RNA, 18 nt, Chlamydophila pneumoniae TW-183
uaggguuugcaugccuau

SEQ ID NO: 2568782 - RNA, 21 nt, Chlamydophila pneumoniae TW-183
uaggguuugcaugccuauuaa

SEQ ID NO: 2568783 - RNA, 17 nt, Chlamydophila pneumoniae TW-183
uagguagauagaaauuc

SEQ ID NO: 2568784 - RNA, 19 nt, Chlamydophila pneumoniae TW-183
uaggucuuaaaguagccau

SEQ ID NO: 2568785 - RNA, 11 nt, Chlamydophila pneumoniae TW-183
ucaucaaugag

SEQ ID NO: 2568786 - RNA, 16 nt, Chlamydophila pneumoniae TW-183
ucaucaguaaaagacu

SEQ ID NO: 2568787 - RNA, 15 nt, Chlamydophila pneumoniae TW-183
ucauccgaagacuca

SEQ ID NO: 2568788 - RNA, 20 nt, Chlamydophila pneumoniae TW-183
ucaugaaagugcucuuuuaa

SEQ ID NO: 2568789 - RNA, 10 nt, Chlamydophila pneumoniae TW-183
ucaugaggac

SEQ ID NO: 2568790 - RNA, 17 nt, Chlamydophila pneumoniae TW-183
ucaugcgcuaccuuagu

SEQ ID NO: 2568791 - RNA, 21 nt, Chlamydophila pneumoniae TW-183
ucauguccuccauggaaagaa

SEQ ID NO: 2568792 - RNA, 15 nt, Chlamydophila pneumoniae TW-183
ucauuccagcaucuu

SEQ ID NO: 2568793 - RNA, 15 nt, Chlamydophila pneumoniae TW-183
ucauugcagauauac

SEQ ID NO: 2568794 - RNA, 23 nt, Chlamydophila pneumoniae TW-183
ucauugcagauauacuuuuucag

SEQ ID NO: 2568795 - RNA, 13 nt, Chlamydophila pneumoniae TW-183
uccaaauucuugc

SEQ ID NO: 2568796 - RNA, 12 nt, Chlamydophila pneumoniae TW-183
uccaacuucaac

SEQ ID NO: 2568797 - RNA, 13 nt, Chlamydophila pneumoniae TW-183
uccaacuucaacu

SEQ ID NO: 2568798 - RNA, 18 nt, Chlamydophila pneumoniae TW-183
uccaagaauagccauaau

SEQ ID NO: 2568799 - RNA, 16 nt, Chlamydophila pneumoniae TW-183
uccaaucugcugaagg

SEQ ID NO: 2568800 - RNA, 18 nt, Chlamydophila pneumoniae TW-183
uccaaucugcugaaggga

SEQ ID NO: 2568801 - RNA, 20 nt, Chlamydophila pneumoniae TW-183
uccaccaaugauaauuucau

SEQ ID NO: 2568802 - RNA, 22 nt, Chlamydophila pneumoniae TW-183
uccacgaccugcaaacucccca

SEQ ID NO: 2568803 - RNA, 23 nt, Chlamydophila pneumoniae TW-183
uccacgaguucgcggaucuucuu

SEQ ID NO: 2568804 - RNA, 21 nt, Chlamydophila pneumoniae TW-183
uccacgcuaucuccuuguucu

SEQ ID NO: 2568805 - RNA, 20 nt, Chlamydophila pneumoniae TW-183
uccagacuuuccucucuuua

SEQ ID NO: 2568806 - RNA, 16 nt, Chlamydophila pneumoniae TW-183
uccaguaucuucucuu

SEQ ID NO: 2568807 - RNA, 16 nt, Chlamydophila pneumoniae TW-183
uccaucggcauuucuc

SEQ ID NO: 2568808 - RNA, 22 nt, Chlamydophila pneumoniae TW-183
uccauggauauggaauggcuuu

SEQ ID NO: 2568809 - RNA, 23 nt, Chlamydophila pneumoniae TW-183
uccauguacaaugauaucagcau

SEQ ID NO: 2568810 - RNA, 18 nt, Chlamydophila pneumoniae TW-183
uccauucugagaaagaag

SEQ ID NO: 2568811 - RNA, 16 nt, Chlamydophila pneumoniae TW-183
uccauuggcauagagc

SEQ ID NO: 2568812 - RNA, 21 nt, Chlamydophila pneumoniae TW-183
uccauuggcauagagccuaga

SEQ ID NO: 2568813 - RNA, 20 nt, Chlamydophila pneumoniae TW-183
ucccacggugccuaggcuaa

SEQ ID NO: 2568814 - RNA, 20 nt, Chlamydophila pneumoniae TW-183
ucccagauuuuuuugguugc

SEQ ID NO: 2568815 - RNA, 24 nt, Chlamydophila pneumoniae TW-183
uccccccucacaauauaaaugcua

SEQ ID NO: 2568816 - RNA, 19 nt, Chlamydophila pneumoniae TW-183
uccccuucaucaauaaaga

SEQ ID NO: 2568817 - RNA, 13 nt, Chlamydophila pneumoniae TW-183
ucccgacaagcuu

SEQ ID NO: 2568818 - RNA, 22 nt, Chlamydophila pneumoniae TW-183
ucccuauaaagcaaaugccugu

SEQ ID NO: 2568819 - RNA, 18 nt, Chlamydophila pneumoniae TW-183
ucccuguaguuucuaaaa

SEQ ID NO: 2568820 - RNA, 13 nt, Chlamydophila pneumoniae TW-183
ucccuuuuuaagu

SEQ ID NO: 2568821 - RNA, 16 nt, Chlamydophila pneumoniae TW-183
uccgaauggagaagga

SEQ ID NO: 2568822 - RNA, 17 nt, Chlamydophila pneumoniae TW-183
uccgauuaacuuuauac

SEQ ID NO: 2568823 - RNA, 17 nt, Chlamydophila pneumoniae TW-183
uccggggagaacuucaa

SEQ ID NO: 2568824 - RNA, 18 nt, Chlamydophila pneumoniae TW-183
uccuaagucguuaacauc

SEQ ID NO: 2568825 - RNA, 16 nt, Chlamydophila pneumoniae TW-183
uccuacuccuaaagua

SEQ ID NO: 2568826 - RNA, 16 nt, Chlamydophila pneumoniae TW-183
uccuagggagugagga

SEQ ID NO: 2568827 - RNA, 18 nt, Chlamydophila pneumoniae TW-183
uccuagggagugaggaau

SEQ ID NO: 2568828 - RNA, 19 nt, Chlamydophila pneumoniae TW-183
uccuaugucaagaagugcu

SEQ ID NO: 2568829 - RNA, 19 nt, Chlamydophila pneumoniae TW-183
uccuauuuuagcauaaucu

SEQ ID NO: 2568830 - RNA, 18 nt, Chlamydophila pneumoniae TW-183
uccuccuagguucuuuuu

SEQ ID NO: 2568831 - RNA, 23 nt, Chlamydophila pneumoniae TW-183
uccucuaaggacaaaucucccaa

SEQ ID NO: 2568832 - RNA, 14 nt, Chlamydophila pneumoniae TW-183
uccucucuuuauau

SEQ ID NO: 2568833 - RNA, 20 nt, Chlamydophila pneumoniae TW-183
uccucuucuucaucuucuaa

SEQ ID NO: 2568834 - RNA, 22 nt, Chlamydophila pneumoniae TW-183
uccuggaagaauuucauaagag

SEQ ID NO: 2568835 - RNA, 16 nt, Chlamydophila pneumoniae TW-183
uccuggagcaugagag

SEQ ID NO: 2568836 - RNA, 15 nt, Chlamydophila pneumoniae TW-183
uccuguagagcaaga

SEQ ID NO: 2568837 - RNA, 16 nt, Chlamydophila pneumoniae TW-183
uccuuaacaacaucac

SEQ ID NO: 2568838 - RNA, 17 nt, Chlamydophila pneumoniae TW-183
uccuuacuugcauagau

SEQ ID NO: 2568839 - RNA, 14 nt, Chlamydophila pneumoniae TW-183
uccuucaacacacc

SEQ ID NO: 2568840 - RNA, 18 nt, Chlamydophila pneumoniae TW-183
uccuugaaauugcucuug

SEQ ID NO: 2568841 - RNA, 14 nt, Chlamydophila pneumoniae TW-183
uccuugauuuggga

SEQ ID NO: 2568842 - RNA, 16 nt, Chlamydophila pneumoniae TW-183
uccuuguucuugaaca

SEQ ID NO: 2568843 - RNA, 15 nt, Chlamydophila pneumoniae TW-183
uccuuucaucagcau

SEQ ID NO: 2568844 - RNA, 22 nt, Chlamydophila pneumoniae TW-183
ucgaaacacucaugaaagugcu

SEQ ID NO: 2568845 - RNA, 17 nt, Chlamydophila pneumoniae TW-183
ucgaaacucuuugagga

SEQ ID NO: 2568846 - RNA, 11 nt, Chlamydophila pneumoniae TW-183
ucgaaccacug

SEQ ID NO: 2568847 - RNA, 16 nt, Chlamydophila pneumoniae TW-183
ucgaagcuugcugauu

SEQ ID NO: 2568848 - RNA, 12 nt, Chlamydophila pneumoniae TW-183
ucgaauuccucc

SEQ ID NO: 2568849 - RNA, 21 nt, Chlamydophila pneumoniae TW-183
ucgagaaaugcucuucugcag

SEQ ID NO: 2568850 - RNA, 19 nt, Chlamydophila pneumoniae TW-183
ucgagagaagaaauucuga

SEQ ID NO: 2568851 - RNA, 20 nt, Chlamydophila pneumoniae TW-183
ucgaguaccgaccgaaucuc

SEQ ID NO: 2568852 - RNA, 16 nt, Chlamydophila pneumoniae TW-183
ucgaguucuuuuugca

SEQ ID NO: 2568853 - RNA, 21 nt, Chlamydophila pneumoniae TW-183
ucgcaaaaauccgauaagaua

SEQ ID NO: 2568854 - RNA, 23 nt, Chlamydophila pneumoniae TW-183
ucgcaacuuaagauacuucucca

SEQ ID NO: 2568855 - RNA, 15 nt, Chlamydophila pneumoniae TW-183
ucgcuuaacaaacuu

SEQ ID NO: 2568856 - RNA, 16 nt, Chlamydophila pneumoniae TW-183
ucggcucuauaaauuu

SEQ ID NO: 2568857 - RNA, 17 nt, Chlamydophila pneumoniae TW-183
ucggcucuauaaauuuc

SEQ ID NO: 2568858 - RNA, 21 nt, Chlamydophila pneumoniae TW-183
ucgguaaccugugaaaauuuu

SEQ ID NO: 2568859 - RNA, 17 nt, Chlamydophila pneumoniae TW-183
ucguagcaggcaucacu

SEQ ID NO: 2568860 - RNA, 20 nt, Chlamydophila pneumoniae TW-183
ucguagcaggcaucacuaau

SEQ ID NO: 2568861 - RNA, 21 nt, Chlamydophila pneumoniae TW-183
ucguccugacacaacucuuaa

SEQ ID NO: 2568862 - RNA, 15 nt, Chlamydophila pneumoniae TW-183
ucgucuccaaaaauu

SEQ ID NO: 2568863 - RNA, 22 nt, Chlamydophila pneumoniae TW-183
ucguuaaaaacuauccuauuuu

SEQ ID NO: 2568864 - RNA, 16 nt, Chlamydophila pneumoniae TW-183
ucguuuccgaucauuu

SEQ ID NO: 2568865 - RNA, 21 nt, Chlamydophila pneumoniae TW-183
ucguuuccgaucauuuuugcu

SEQ ID NO: 2568866 - RNA, 16 nt, Chlamydophila pneumoniae TW-183
ucuaaaaucuucucug

SEQ ID NO: 2568867 - RNA, 17 nt, Chlamydophila pneumoniae TW-183
ucuaaaaucuucucugc

SEQ ID NO: 2568868 - RNA, 16 nt, Chlamydophila pneumoniae TW-183
ucuaaauagaaaacau

SEQ ID NO: 2568869 - RNA, 18 nt, Chlamydophila pneumoniae TW-183
ucuaaaugauuuuuaauu

SEQ ID NO: 2568870 - RNA, 16 nt, Chlamydophila pneumoniae TW-183
ucuaagacuucuggaa

SEQ ID NO: 2568871 - RNA, 21 nt, Chlamydophila pneumoniae TW-183
ucuaagcugaaagaacacucc

SEQ ID NO: 2568872 - RNA, 20 nt, Chlamydophila pneumoniae TW-183
ucuaagcugugcauuuucuu

SEQ ID NO: 2568873 - RNA, 12 nt, Chlamydophila pneumoniae TW-183
ucuaaggaaauu

SEQ ID NO: 2568874 - RNA, 18 nt, Chlamydophila pneumoniae TW-183
ucuaaggacaaaucuccc

SEQ ID NO: 2568875 - RNA, 15 nt, Chlamydophila pneumoniae TW-183
ucuaaguucuuaaga

SEQ ID NO: 2568876 - RNA, 20 nt, Chlamydophila pneumoniae TW-183
ucuacaggauauugcggaaa

SEQ ID NO: 2568877 - RNA, 16 nt, Chlamydophila pneumoniae TW-183
ucuacgauguuuucuu

SEQ ID NO: 2568878 - RNA, 18 nt, Chlamydophila pneumoniae TW-183
ucuacgcgcucuucuuuc

SEQ ID NO: 2568879 - RNA, 20 nt, Chlamydophila pneumoniae TW-183
ucuacgcgcucuucuuucuc

SEQ ID NO: 2568880 - RNA, 17 nt, Chlamydophila pneumoniae TW-183
ucuagaacacucagaga

SEQ ID NO: 2568881 - RNA, 14 nt, Chlamydophila pneumoniae TW-183
ucuagagaagaaaa

SEQ ID NO: 2568882 - RNA, 17 nt, Chlamydophila pneumoniae TW-183
ugaauaguagaguugac

SEQ ID NO: 2568883 - RNA, 17 nt, Chlamydophila pneumoniae TW-183
ugaauaucaucacuaag

SEQ ID NO: 2568884 - RNA, 20 nt, Chlamydophila pneumoniae TW-183
ugaauaugauuuccacuugu

SEQ ID NO: 2568885 - RNA, 19 nt, Chlamydophila pneumoniae TW-183
ugaauuaauaaaagagcuc

SEQ ID NO: 2568886 - RNA, 17 nt, Chlamydophila pneumoniae TW-183
ugacaaauagaaaggaa

SEQ ID NO: 2568887 - RNA, 21 nt, Chlamydophila pneumoniae TW-183
ugacacaacucuuaaaucgcu

SEQ ID NO: 2568888 - RNA, 18 nt, Chlamydophila pneumoniae TW-183
ugacacagcuaaucaauc

SEQ ID NO: 2568889 - RNA, 23 nt, Chlamydophila pneumoniae TW-183
ugacacucuaucauaucuucaaa

SEQ ID NO: 2568890 - RNA, 13 nt, Chlamydophila pneumoniae TW-183
ugaccuucucaag

SEQ ID NO: 2568891 - RNA, 20 nt, Chlamydophila pneumoniae TW-183
ugaccuucucaagaucuuca

SEQ ID NO: 2568892 - RNA, 18 nt, Chlamydophila pneumoniae TW-183
ugacgcuuuuccaaagca

SEQ ID NO: 2568893 - RNA, 20 nt, Chlamydophila pneumoniae TW-183
ugacguuaauaaagaggcuc

SEQ ID NO: 2568894 - RNA, 22 nt, Chlamydophila pneumoniae TW-183
ugacguugcgaacagcuccugg

SEQ ID NO: 2568895 - RNA, 21 nt, Chlamydophila pneumoniae TW-183
ugacuauagggagacucuuga

SEQ ID NO: 2568896 - RNA, 17 nt, Chlamydophila pneumoniae TW-183
ugacuccagaaggugug

SEQ ID NO: 2568897 - RNA, 17 nt, Chlamydophila pneumoniae TW-183
ugacucuuauugcagaa

SEQ ID NO: 2568898 - RNA, 12 nt, Chlamydophila pneumoniae TW-183
ugacuuuucuuc

SEQ ID NO: 2568899 - RNA, 15 nt, Chlamydophila pneumoniae TW-183
ugagaaagaaguccu

SEQ ID NO: 2568900 - RNA, 13 nt, Chlamydophila pneumoniae TW-183
ugagaaauauaaa

SEQ ID NO: 2568901 - RNA, 14 nt, Chlamydophila pneumoniae TW-183
ugagauugaggaua

SEQ ID NO: 2568902 - RNA, 17 nt, Chlamydophila pneumoniae TW-183
ugagcagcuuuaucagg

SEQ ID NO: 2568903 - RNA, 13 nt, Chlamydophila pneumoniae TW-183
ugagcucucuagc

SEQ ID NO: 2568904 - RNA, 20 nt, Chlamydophila pneumoniae TW-183
ugaggaacgcacgccaagag

SEQ ID NO: 2568905 - RNA, 18 nt, Chlamydophila pneumoniae TW-183
ugaggaaucauaaccaaa

SEQ ID NO: 2568906 - RNA, 18 nt, Chlamydophila pneumoniae TW-183
ugaggauaaguucuucca

SEQ ID NO: 2568907 - RNA, 18 nt, Chlamydophila pneumoniae TW-183
ugaggauacgaauaaguu

SEQ ID NO: 2568908 - RNA, 21 nt, Chlamydophila pneumoniae TW-183
ugaggcaaagauuuccaaucc

SEQ ID NO: 2568909 - RNA, 23 nt, Chlamydophila pneumoniae TW-183
ugaggcaaagauuuccaauccau

SEQ ID NO: 2568910 - RNA, 14 nt, Chlamydophila pneumoniae TW-183
ugaggcaagucuca

SEQ ID NO: 2568911 - RNA, 17 nt, Chlamydophila pneumoniae TW-183
ugagguuugugcugcuu

SEQ ID NO: 2568912 - RNA, 10 nt, Chlamydophila pneumoniae TW-183
ugagucgaca

SEQ ID NO: 2568913 - RNA, 15 nt, Chlamydophila pneumoniae TW-183
ugagucgacaugcag

SEQ ID NO: 2568914 - RNA, 14 nt, Chlamydophila pneumoniae TW-183
ugauaacuuugcau

SEQ ID NO: 2568915 - RNA, 18 nt, Chlamydophila pneumoniae TW-183
ugauaauuacagaaguuc

SEQ ID NO: 2568916 - RNA, 16 nt, Chlamydophila pneumoniae TW-183
ugauaauuucauuaua

SEQ ID NO: 2568917 - RNA, 13 nt, Chlamydophila pneumoniae TW-183
ugauagagaaaau

SEQ ID NO: 2568918 - RNA, 19 nt, Chlamydophila pneumoniae TW-183
ugauaucagcauauuuccg

SEQ ID NO: 2568919 - RNA, 13 nt, Chlamydophila pneumoniae TW-183
ugaucugaaguug

SEQ ID NO: 2568920 - RNA, 21 nt, Chlamydophila pneumoniae TW-183
ugaucugaaguugaaaugagu

SEQ ID NO: 2568921 - RNA, 15 nt, Chlamydophila pneumoniae TW-183
ugaugccaagaaaua

SEQ ID NO: 2568922 - RNA, 18 nt, Chlamydophila pneumoniae TW-183
ugaugcccugacguuuug

SEQ ID NO: 2568923 - RNA, 20 nt, Chlamydophila pneumoniae TW-183
ugaugcuguaucuccacgca

SEQ ID NO: 2568924 - RNA, 20 nt, Chlamydophila pneumoniae TW-183
ugauuacagcaucuauagaa

SEQ ID NO: 2568925 - RNA, 13 nt, Chlamydophila pneumoniae TW-183
ugauuaggaacaa

SEQ ID NO: 2568926 - RNA, 22 nt, Chlamydophila pneumoniae TW-183
ugauucucccaauauccagaaa

SEQ ID NO: 2568927 - RNA, 22 nt, Chlamydophila pneumoniae TW-183
ugauuggaucuagagaagaaaa

SEQ ID NO: 2568928 - RNA, 13 nt, Chlamydophila pneumoniae TW-183
ugauuugggauga

SEQ ID NO: 2568929 - RNA, 17 nt, Chlamydophila pneumoniae TW-183
ugauuuucuuagcuucc

SEQ ID NO: 2568930 - RNA, 18 nt, Chlamydophila pneumoniae TW-183
ugauuuucuuagcuucca

SEQ ID NO: 2568931 - RNA, 19 nt, Chlamydophila pneumoniae TW-183
ugauuuuucaaucaauaaa

SEQ ID NO: 2568932 - RNA, 17 nt, Chlamydophila pneumoniae TW-183
ugcaaaaaugaaagaaa

SEQ ID NO: 2568933 - RNA, 12 nt, Chlamydophila pneumoniae TW-183
ugcaaauuucau

SEQ ID NO: 2568934 - RNA, 16 nt, Chlamydophila pneumoniae TW-183
ugcaagugcuuucagg

SEQ ID NO: 2568935 - RNA, 16 nt, Chlamydophila pneumoniae TW-183
ugcaaguucacacgua

SEQ ID NO: 2568936 - RNA, 14 nt, Chlamydophila pneumoniae TW-183
ugcaaucucaaaau

SEQ ID NO: 2568937 - RNA, 20 nt, Chlamydophila pneumoniae TW-183
ugcaaugcuaagcuccauaa

SEQ ID NO: 2568938 - RNA, 17 nt, Chlamydophila pneumoniae TW-183
ugcaauugccauaucau

SEQ ID NO: 2568939 - RNA, 15 nt, Chlamydophila pneumoniae TW-183
ugcacacauccugga

SEQ ID NO: 2568940 - RNA, 15 nt, Chlamydophila pneumoniae TW-183
ugcagaaucuaugag

SEQ ID NO: 2568941 - RNA, 21 nt, Chlamydophila pneumoniae TW-183
ugcaggacugucuagcaguug

SEQ ID NO: 2568942 - RNA, 16 nt, Chlamydophila pneumoniae TW-183
ugcauaggcuuuacca

SEQ ID NO: 2568943 - RNA, 12 nt, Chlamydophila pneumoniae TW-183
ugcaucuuauca

SEQ ID NO: 2568944 - RNA, 19 nt, Chlamydophila pneumoniae TW-183
ugcaucuuaucaagagcuc

SEQ ID NO: 2568945 - RNA, 13 nt, Chlamydophila pneumoniae TW-183
ugcaugaggagac

SEQ ID NO: 2568946 - RNA, 15 nt, Chlamydophila pneumoniae TW-183
ugcauuuucuucuug

SEQ ID NO: 2568947 - RNA, 16 nt, Chlamydophila pneumoniae TW-183
ugcauuuucuucuugc

SEQ ID NO: 2568948 - RNA, 13 nt, Chlamydophila pneumoniae TW-183
ugccaagagcauc

SEQ ID NO: 2568949 - RNA, 16 nt, Chlamydophila pneumoniae TW-183
ugccagagauucuuca

SEQ ID NO: 2568950 - RNA, 18 nt, Chlamydophila pneumoniae TW-183
ugccagagauucuucaca

SEQ ID NO: 2568951 - RNA, 15 nt, Chlamydophila pneumoniae TW-183
ugccagcagcgagga

SEQ ID NO: 2568952 - RNA, 19 nt, Chlamydophila pneumoniae TW-183
ugccaggagagcuaacagc

SEQ ID NO: 2568953 - RNA, 18 nt, Chlamydophila pneumoniae TW-183
ugcccuacaauuuccuug

SEQ ID NO: 2568954 - RNA, 15 nt, Chlamydophila pneumoniae TW-183
ugccgagaauacaga

SEQ ID NO: 2568955 - RNA, 12 nt, Chlamydophila pneumoniae TW-183
ugccuuucucuu

SEQ ID NO: 2568956 - RNA, 15 nt, Chlamydophila pneumoniae TW-183
ugccuuugaucagga

SEQ ID NO: 2568957 - RNA, 18 nt, Chlamydophila pneumoniae TW-183
ugcgcagcucggauggac

SEQ ID NO: 2568958 - RNA, 17 nt, Chlamydophila pneumoniae TW-183
ugcggcucucuucauug

SEQ ID NO: 2568959 - RNA, 13 nt, Chlamydophila pneumoniae TW-183
ugcuaacaacucc

SEQ ID NO: 2568960 - RNA, 13 nt, Chlamydophila pneumoniae TW-183
ugcuaagcuccau

SEQ ID NO: 2568961 - RNA, 19 nt, Chlamydophila pneumoniae TW-183
ugcuaagcuccauaaaaau

SEQ ID NO: 2568962 - RNA, 21 nt, Chlamydophila pneumoniae TW-183
ugcuaagcuccauaaaaauag

SEQ ID NO: 2568963 - RNA, 22 nt, Chlamydophila pneumoniae TW-183
ugcuauagcuugaaauaauuga

SEQ ID NO: 2568964 - RNA, 20 nt, Chlamydophila pneumoniae TW-183
ugcuauuuuccucuauauuu

SEQ ID NO: 2568965 - RNA, 16 nt, Chlamydophila pneumoniae TW-183
ugcucuagucuuucaa

SEQ ID NO: 2568966 - RNA, 21 nt, Chlamydophila pneumoniae TW-183
ugcugaagauuuuuucuuggu

SEQ ID NO: 2568967 - RNA, 14 nt, Chlamydophila pneumoniae TW-183
ugcugaagggacag

SEQ ID NO: 2568968 - RNA, 15 nt, Chlamydophila pneumoniae TW-183
ugcugauuucuuuuu

SEQ ID NO: 2568969 - RNA, 18 nt, Chlamydophila pneumoniae TW-183
ugcugauuucuuuuucag

SEQ ID NO: 2568970 - RNA, 14 nt, Chlamydophila pneumoniae TW-183
ugcugcuucagaaa

SEQ ID NO: 2568971 - RNA, 21 nt, Chlamydophila pneumoniae TW-183
ugcugcuuccccuaauagggg

SEQ ID NO: 2568972 - RNA, 14 nt, Chlamydophila pneumoniae TW-183
ugcuguuuuuucac

SEQ ID NO: 2568973 - RNA, 16 nt, Chlamydophila pneumoniae TW-183
ugcuuaaaauucugua

SEQ ID NO: 2568974 - RNA, 19 nt, Chlamydophila pneumoniae TW-183
ugcuuaagaguuuuacauc

SEQ ID NO: 2568975 - RNA, 15 nt, Chlamydophila pneumoniae TW-183
ugcuuagcaaaggca

SEQ ID NO: 2568976 - RNA, 19 nt, Chlamydophila pneumoniae TW-183
ugcuuuuguuguuuuugcu

SEQ ID NO: 2568977 - RNA, 14 nt, Chlamydophila pneumoniae TW-183
uggacuccaagaau

SEQ ID NO: 2568978 - RNA, 12 nt, Chlamydophila pneumoniae TW-183
uggaucagaaaa

SEQ ID NO: 2568979 - RNA, 16 nt, Chlamydophila pneumoniae TW-183
uggaucuagagaagaa

SEQ ID NO: 2568980 - RNA, 17 nt, Chlamydophila pneumoniae TW-183
uucagaggcuagaaaau

SEQ ID NO: 2568981 - RNA, 14 nt, Chlamydophila pneumoniae TW-183
uucagccugucuau

SEQ ID NO: 2568982 - RNA, 19 nt, Chlamydophila pneumoniae TW-183
uucagugcuguuuuuucac

SEQ ID NO: 2568983 - RNA, 15 nt, Chlamydophila pneumoniae TW-183
uucaucaauaaagau

SEQ ID NO: 2568984 - RNA, 21 nt, Chlamydophila pneumoniae TW-183
uucaucacaaaauucaugcaa

SEQ ID NO: 2568985 - RNA, 12 nt, Chlamydophila pneumoniae TW-183
uucaugcaaaac

SEQ ID NO: 2568986 - RNA, 22 nt, Chlamydophila pneumoniae TW-183
uucauguccuccauggaaagaa

SEQ ID NO: 2568987 - RNA, 13 nt, Chlamydophila pneumoniae TW-183
uucauugcaaaaa

SEQ ID NO: 2568988 - RNA, 17 nt, Chlamydophila pneumoniae TW-183
uucauugcagauauacu

SEQ ID NO: 2568989 - RNA, 13 nt, Chlamydophila pneumoniae TW-183
uuccaacuucaac

SEQ ID NO: 2568990 - RNA, 17 nt, Chlamydophila pneumoniae TW-183
uuccaauccauucugag

SEQ ID NO: 2568991 - RNA, 20 nt, Chlamydophila pneumoniae TW-183
uuccaauccauucugagaaa

SEQ ID NO: 2568992 - RNA, 15 nt, Chlamydophila pneumoniae TW-183
uuccaggcucuagga

SEQ ID NO: 2568993 - RNA, 22 nt, Chlamydophila pneumoniae TW-183
uuccauagaguaucuaaaacuu

SEQ ID NO: 2568994 - RNA, 16 nt, Chlamydophila pneumoniae TW-183
uuccccuaauagggga

SEQ ID NO: 2568995 - RNA, 22 nt, Chlamydophila pneumoniae TW-183
uucccguacgaguaucuacuuu

SEQ ID NO: 2568996 - RNA, 15 nt, Chlamydophila pneumoniae TW-183
uucccuauaaagcaa

SEQ ID NO: 2568997 - RNA, 19 nt, Chlamydophila pneumoniae TW-183
uuccggggagaacuucaac

SEQ ID NO: 2568998 - RNA, 23 nt, Chlamydophila pneumoniae TW-183
uuccgugcgauuuccccuucaga

SEQ ID NO: 2568999 - RNA, 22 nt, Chlamydophila pneumoniae TW-183
uuccuacaacggcaaucuauuu

SEQ ID NO: 2569000 - RNA, 16 nt, Chlamydophila pneumoniae TW-183
uuccuacuucugcagg

SEQ ID NO: 2569001 - RNA, 20 nt, Chlamydophila pneumoniae TW-183
uuccucuaucagggagcgga

SEQ ID NO: 2569002 - RNA, 18 nt, Chlamydophila pneumoniae TW-183
uucgacaaccaaaacaga

SEQ ID NO: 2569003 - RNA, 13 nt, Chlamydophila pneumoniae TW-183
uucgauuccugag

SEQ ID NO: 2569004 - RNA, 16 nt, Chlamydophila pneumoniae TW-183
uucguagcuucccgua

SEQ ID NO: 2569005 - RNA, 17 nt, Chlamydophila pneumoniae TW-183
uucguggagugcucuac

SEQ ID NO: 2569006 - RNA, 22 nt, Chlamydophila pneumoniae TW-183
uucuaaaacagaaauugcuucu

SEQ ID NO: 2569007 - RNA, 19 nt, Chlamydophila pneumoniae TW-183
uucuaaacaauuucaauuc

SEQ ID NO: 2569008 - RNA, 17 nt, Chlamydophila pneumoniae TW-183
uucuaaauagaaaacau

SEQ ID NO: 2569009 - RNA, 19 nt, Chlamydophila pneumoniae TW-183
uucuaagcugaaagaacac

SEQ ID NO: 2569010 - RNA, 12 nt, Chlamydophila pneumoniae TW-183
uucuaaguucuu

SEQ ID NO: 2569011 - RNA, 17 nt, Chlamydophila pneumoniae TW-183
uucuauacgaacacaga

SEQ ID NO: 2569012 - RNA, 17 nt, Chlamydophila pneumoniae TW-183
uucuauauguaauuucc

SEQ ID NO: 2569013 - RNA, 22 nt, Chlamydophila pneumoniae TW-183
uucuauucgcugucuagaacac

SEQ ID NO: 2569014 - RNA, 14 nt, Chlamydophila pneumoniae TW-183
uucucaaagaucau

SEQ ID NO: 2569015 - RNA, 20 nt, Chlamydophila pneumoniae TW-183
uucuccaaccucgagauccu

SEQ ID NO: 2569016 - RNA, 21 nt, Chlamydophila pneumoniae TW-183
uucuccaguaucuucucuuau

SEQ ID NO: 2569017 - RNA, 22 nt, Chlamydophila pneumoniae TW-183
uucucgaacaggagagagaagg

SEQ ID NO: 2569018 - RNA, 16 nt, Chlamydophila pneumoniae TW-183
uucucgaagcuugcug

SEQ ID NO: 2569019 - RNA, 21 nt, Chlamydophila pneumoniae TW-183
uucucugagcagcuucgcaau

SEQ ID NO: 2569020 - RNA, 19 nt, Chlamydophila pneumoniae TW-183
uucugcaaugcuaagcucc

SEQ ID NO: 2569021 - RNA, 15 nt, Chlamydophila pneumoniae TW-183
uucuggaagauguug

SEQ ID NO: 2569022 - RNA, 22 nt, Chlamydophila pneumoniae TW-183
uucuguaaagugaaauugaacu

SEQ ID NO: 2569023 - RNA, 13 nt, Chlamydophila pneumoniae TW-183
uucuucacaaucu

SEQ ID NO: 2569024 - RNA, 20 nt, Chlamydophila pneumoniae TW-183
uucuucacaaucuaaauaag

SEQ ID NO: 2569025 - RNA, 17 nt, Chlamydophila pneumoniae TW-183
uucuucgguguagaucu

SEQ ID NO: 2569026 - RNA, 12 nt, Chlamydophila pneumoniae TW-183
uucuucuaaaau

SEQ ID NO: 2569027 - RNA, 20 nt, Chlamydophila pneumoniae TW-183
uucuucuggcugagagaagc

SEQ ID NO: 2569028 - RNA, 22 nt, Chlamydophila pneumoniae TW-183
uucuugcgacauaaccaucgau

SEQ ID NO: 2569029 - RNA, 22 nt, Chlamydophila pneumoniae TW-183
uucuuggucggaguuuuuuucu

SEQ ID NO: 2569030 - RNA, 18 nt, Chlamydophila pneumoniae TW-183
uucuuguaauaaaagaac

SEQ ID NO: 2569031 - RNA, 20 nt, Chlamydophila pneumoniae TW-183
uucuuguaauaaaagaacau

SEQ ID NO: 2569032 - RNA, 13 nt, Chlamydophila pneumoniae TW-183
uucuuucaaacca

SEQ ID NO: 2569033 - RNA, 14 nt, Chlamydophila pneumoniae TW-183
uucuuucugcucuu

SEQ ID NO: 2569034 - RNA, 14 nt, Chlamydophila pneumoniae TW-183
uugaaaauuuuccc

SEQ ID NO: 2569035 - RNA, 21 nt, Chlamydophila pneumoniae TW-183
uugaaaccguaacugaggcaa

SEQ ID NO: 2569036 - RNA, 13 nt, Chlamydophila pneumoniae TW-183
uugaaauugcucu

SEQ ID NO: 2569037 - RNA, 14 nt, Chlamydophila pneumoniae TW-183
uugaaauugcucuu

SEQ ID NO: 2569038 - RNA, 14 nt, Chlamydophila pneumoniae TW-183
uugaacaugaggau

SEQ ID NO: 2569039 - RNA, 19 nt, Chlamydophila pneumoniae TW-183
uugaauaagauuuugaaaa

SEQ ID NO: 2569040 - RNA, 14 nt, Chlamydophila pneumoniae TW-183
uugacaucuguagu

SEQ ID NO: 2569041 - RNA, 14 nt, Chlamydophila pneumoniae TW-183
uugaccuuuuucau

SEQ ID NO: 2569042 - RNA, 15 nt, Chlamydophila pneumoniae TW-183
uugacuauugggagg

SEQ ID NO: 2569043 - RNA, 12 nt, Chlamydophila pneumoniae TW-183
uugacugaaacu

SEQ ID NO: 2569044 - RNA, 14 nt, Chlamydophila pneumoniae TW-183
uugagacaaagaau

SEQ ID NO: 2569045 - RNA, 14 nt, Chlamydophila pneumoniae TW-183
uugagcacauuguu

SEQ ID NO: 2569046 - RNA, 19 nt, Chlamydophila pneumoniae TW-183
uugagccaacagguucacu

SEQ ID NO: 2569047 - RNA, 10 nt, Chlamydophila pneumoniae TW-183
uugagcucuc

SEQ ID NO: 2569048 - RNA, 13 nt, Chlamydophila pneumoniae TW-183
uugagcuucuuua

SEQ ID NO: 2569049 - RNA, 18 nt, Chlamydophila pneumoniae TW-183
uugaggaacgcacgccaa

SEQ ID NO: 2569050 - RNA, 20 nt, Chlamydophila pneumoniae TW-183
uugaggaaucugaaucucau

SEQ ID NO: 2569051 - RNA, 22 nt, Chlamydophila pneumoniae TW-183
uugaggauacgaauaaguuuug

SEQ ID NO: 2569052 - RNA, 19 nt, Chlamydophila pneumoniae TW-183
uugaggcaagucucaaagg

SEQ ID NO: 2569053 - RNA, 23 nt, Chlamydophila pneumoniae TW-183
uugauaacuuugcaugaggagac

SEQ ID NO: 2569054 - RNA, 13 nt, Chlamydophila pneumoniae TW-183
uugauagagaaaa

SEQ ID NO: 2569055 - RNA, 15 nt, Chlamydophila pneumoniae TW-183
uugaucgcuugugca

SEQ ID NO: 2569056 - RNA, 19 nt, Chlamydophila pneumoniae TW-183
uugauguacaguaaaguau

SEQ ID NO: 2569057 - RNA, 13 nt, Chlamydophila pneumoniae TW-183
uugauguuccuug

SEQ ID NO: 2569058 - RNA, 12 nt, Chlamydophila pneumoniae TW-183
uugauucauaaa

SEQ ID NO: 2569059 - RNA, 21 nt, Chlamydophila pneumoniae TW-183
uugauuuugcagugauaaacc

SEQ ID NO: 2569060 - RNA, 17 nt, Chlamydophila pneumoniae TW-183
uugcaaaaaugaaagaa

SEQ ID NO: 2569061 - RNA, 14 nt, Chlamydophila pneumoniae TW-183
uugcaaucuuugaa

SEQ ID NO: 2569062 - RNA, 19 nt, Chlamydophila pneumoniae TW-183
uugcagcucggaaugcucu

SEQ ID NO: 2569063 - RNA, 18 nt, Chlamydophila pneumoniae TW-183
uugcauagcggcaacaag

SEQ ID NO: 2569064 - RNA, 13 nt, Chlamydophila pneumoniae TW-183
uugcaugaggaga

SEQ ID NO: 2569065 - RNA, 14 nt, Chlamydophila pneumoniae TW-183
uugcaugaggagac

SEQ ID NO: 2569066 - RNA, 22 nt, Chlamydophila pneumoniae TW-183
uugccaggaaacguucuuucaa

SEQ ID NO: 2569067 - RNA, 19 nt, Chlamydophila pneumoniae TW-183
uugccuggggaucuuagga

SEQ ID NO: 2569068 - RNA, 14 nt, Chlamydophila pneumoniae TW-183
uugcgacauaacca

SEQ ID NO: 2569069 - RNA, 11 nt, Chlamydophila pneumoniae TW-183
uugcugaagau

SEQ ID NO: 2569070 - RNA, 12 nt, Chlamydophila pneumoniae TW-183
uugcugaagauu

SEQ ID NO: 2569071 - RNA, 14 nt, Chlamydophila pneumoniae TW-183
uugcugaagauuuu

SEQ ID NO: 2569072 - RNA, 20 nt, Chlamydophila pneumoniae TW-183
uugcugaagauuuuuucuug

SEQ ID NO: 2569073 - RNA, 23 nt, Chlamydophila pneumoniae TW-183
uugcugaagauuuuuucuugguc

SEQ ID NO: 2569074 - RNA, 23 nt, Chlamydophila pneumoniae TW-183
uugcugcgaaugucguuaaaaac

SEQ ID NO: 2569075 - RNA, 14 nt, Chlamydophila pneumoniae TW-183
uugcuguggaauuu

SEQ ID NO: 2569076 - RNA, 18 nt, Chlamydophila pneumoniae TW-183
uuggaucuagagaagaaa

SEQ ID NO: 2569077 - RNA, 20 nt, Chlamydophila pneumoniae TW-183
uuggaucuagagaagaaaag

SEQ ID NO: 2569078 - RNA, 15 nt, Chlamydophila pneumoniae TW-183
aaaaaagaaauacuu

SEQ ID NO: 2569079 - RNA, 16 nt, Chlamydophila pneumoniae TW-183
aaaaacccucaaagaa

SEQ ID NO: 2569080 - RNA, 13 nt, Chlamydophila pneumoniae TW-183
aaaaagaaauacu

SEQ ID NO: 2569081 - RNA, 18 nt, Chlamydophila pneumoniae TW-183
aaaaagcuuuuuucucuu

SEQ ID NO: 2569082 - RNA, 21 nt, Chlamydophila pneumoniae TW-183
aaaaaguuccauagaguaucu

SEQ ID NO: 2569083 - RNA, 16 nt, Chlamydophila pneumoniae TW-183
aaaaauccgauaagau

SEQ ID NO: 2569084 - RNA, 22 nt, Chlamydophila pneumoniae TW-183
aaaaauucuagaccugccaaga

SEQ ID NO: 2569085 - RNA, 13 nt, Chlamydophila pneumoniae TW-183
aaaacauauccca

SEQ ID NO: 2569086 - RNA, 16 nt, Chlamydophila pneumoniae TW-183
aaaacccucaaagaau

SEQ ID NO: 2569087 - RNA, 17 nt, Chlamydophila pneumoniae TW-183
aaaacccucaaagaaua

SEQ ID NO: 2569088 - RNA, 22 nt, Chlamydophila pneumoniae TW-183
aaaacggcuguacuuccccaaa

SEQ ID NO: 2569089 - RNA, 20 nt, Chlamydophila pneumoniae TW-183
aaaacuuagaaaagugaaga

SEQ ID NO: 2569090 - RNA, 23 nt, Chlamydophila pneumoniae TW-183
aaaagaaccuaggaaauccuccu

SEQ ID NO: 2569091 - RNA, 20 nt, Chlamydophila pneumoniae TW-183
aaaagagaacauguuucuaa

SEQ ID NO: 2569092 - RNA, 13 nt, Chlamydophila pneumoniae TW-183
aaaagagcucaaa

SEQ ID NO: 2569093 - RNA, 15 nt, Chlamydophila pneumoniae TW-183
aaaagagcucaaaaa

SEQ ID NO: 2569094 - RNA, 20 nt, Chlamydophila pneumoniae TW-183
aaaagagcucaaaaaguucc

SEQ ID NO: 2569095 - RNA, 22 nt, Chlamydophila pneumoniae TW-183
aaaagcuagucuuucuaagaag

SEQ ID NO: 2569096 - RNA, 18 nt, Chlamydophila pneumoniae TW-183
aaaagcuuuuuucucuug

SEQ ID NO: 2569097 - RNA, 17 nt, Chlamydophila pneumoniae TW-183
aaaagucaugaggacug

SEQ ID NO: 2569098 - RNA, 18 nt, Chlamydophila pneumoniae TW-183
aaaagucaugaggacugu

SEQ ID NO: 2569099 - RNA, 22 nt, Chlamydophila pneumoniae TW-183
aaaaguuuuuguucauccagaa

SEQ ID NO: 2569100 - RNA, 14 nt, Chlamydophila pneumoniae TW-183
aaaauaaauuuuau

SEQ ID NO: 2569101 - RNA, 18 nt, Chlamydophila pneumoniae TW-183
aaaauaagcaguuuucag

SEQ ID NO: 2569102 - RNA, 20 nt, Chlamydophila pneumoniae TW-183
aaaauaguacgcuuuuuacu

SEQ ID NO: 2569103 - RNA, 14 nt, Chlamydophila pneumoniae TW-183
aaaaucaaauagau

SEQ ID NO: 2569104 - RNA, 21 nt, Chlamydophila pneumoniae TW-183
aaaaucaaauagauuuuuacu

SEQ ID NO: 2569105 - RNA, 14 nt, Chlamydophila pneumoniae TW-183
aaaaugaaagaaac

SEQ ID NO: 2569106 - RNA, 17 nt, Chlamydophila pneumoniae TW-183
aaaauucaugcaaaaca

SEQ ID NO: 2569107 - RNA, 18 nt, Chlamydophila pneumoniae TW-183
aaaauugcauuuaaacua

SEQ ID NO: 2569108 - RNA, 21 nt, Chlamydophila pneumoniae TW-183
aaaauugcauuuaaacuaaga

SEQ ID NO: 2569109 - RNA, 12 nt, Chlamydophila pneumoniae TW-183
aaaauuuuccca

SEQ ID NO: 2569110 - RNA, 17 nt, Chlamydophila pneumoniae TW-183
aaacacaaauagcaaga

SEQ ID NO: 2569111 - RNA, 19 nt, Chlamydophila pneumoniae TW-183
aaacacaaauagcaagagc

SEQ ID NO: 2569112 - RNA, 20 nt, Chlamydophila pneumoniae TW-183
aaacacaaauagcaagagcu

SEQ ID NO: 2569113 - RNA, 20 nt, Chlamydophila pneumoniae TW-183
aaacacgcccugaugcugua

SEQ ID NO: 2569114 - RNA, 16 nt, Chlamydophila pneumoniae TW-183
aaacacucaugaaagu

SEQ ID NO: 2569115 - RNA, 14 nt, Chlamydophila pneumoniae TW-183
aaacagaaauugcu

SEQ ID NO: 2569116 - RNA, 15 nt, Chlamydophila pneumoniae TW-183
aaacaucacucagga

SEQ ID NO: 2569117 - RNA, 16 nt, Chlamydophila pneumoniae TW-183
aaaccaauugagcucu

SEQ ID NO: 2569118 - RNA, 19 nt, Chlamydophila pneumoniae TW-183
aaaccacggauuuucucua

SEQ ID NO: 2569119 - RNA, 12 nt, Chlamydophila pneumoniae TW-183
aaaccagaacac

SEQ ID NO: 2569120 - RNA, 17 nt, Chlamydophila pneumoniae TW-183
aaacccucaaagaauac

SEQ ID NO: 2569121 - RNA, 16 nt, Chlamydophila pneumoniae TW-183
aaaccguaacugaggc

SEQ ID NO: 2569122 - RNA, 23 nt, Chlamydophila pneumoniae TW-183
aaaccguaacugaggcaaagauu

SEQ ID NO: 2569123 - RNA, 19 nt, Chlamydophila pneumoniae TW-183
aaaccucuuagcuaucaac

SEQ ID NO: 2569124 - RNA, 17 nt, Chlamydophila pneumoniae TW-183
aaaccuucaaugauuuc

SEQ ID NO: 2569125 - RNA, 21 nt, Chlamydophila pneumoniae TW-183
aaacgcccucuagaagacaca

SEQ ID NO: 2569126 - RNA, 19 nt, Chlamydophila pneumoniae TW-183
aaacggcuguacuucccca

SEQ ID NO: 2569127 - RNA, 17 nt, Chlamydophila pneumoniae TW-183
aaacuaaaucaacuaca

SEQ ID NO: 2569128 - RNA, 12 nt, Chlamydophila pneumoniae TW-183
aaacuccaaaau

SEQ ID NO: 2569129 - RNA, 20 nt, Chlamydophila pneumoniae TW-183
aaacuccaaguguugccagc

SEQ ID NO: 2569130 - RNA, 20 nt, Chlamydophila pneumoniae TW-183
aaacucugacgucuccaaca

SEQ ID NO: 2569131 - RNA, 15 nt, Chlamydophila pneumoniae TW-183
aaacucuuugaggau

SEQ ID NO: 2569132 - RNA, 12 nt, Chlamydophila pneumoniae TW-183
aaacuucuugug

SEQ ID NO: 2569133 - RNA, 12 nt, Chlamydophila pneumoniae TW-183
aaagaacacucc

SEQ ID NO: 2569134 - RNA, 16 nt, Chlamydophila pneumoniae TW-183
aaagagcucaaaaagu

SEQ ID NO: 2569135 - RNA, 20 nt, Chlamydophila pneumoniae TW-183
aaagagcucaaaaaguucca

SEQ ID NO: 2569136 - RNA, 23 nt, Chlamydophila pneumoniae TW-183
aaagagcucaucaaugagaaaua

SEQ ID NO: 2569137 - RNA, 14 nt, Chlamydophila pneumoniae TW-183
aaagaggaaugaag

SEQ ID NO: 2569138 - RNA, 14 nt, Chlamydophila pneumoniae TW-183
aaagagugccaaga

SEQ ID NO: 2569139 - RNA, 23 nt, Chlamydophila pneumoniae TW-183
aaagagugccaagagcaucacaa

SEQ ID NO: 2569140 - RNA, 22 nt, Chlamydophila pneumoniae TW-183
aaagauaacgagacaugaugca

SEQ ID NO: 2569141 - RNA, 22 nt, Chlamydophila pneumoniae TW-183
aaagaucgggucuacaacaguu

SEQ ID NO: 2569142 - RNA, 11 nt, Chlamydophila pneumoniae TW-183
aaagcacauac

SEQ ID NO: 2569143 - RNA, 23 nt, Chlamydophila pneumoniae TW-183
aaagcuuuuccguaaguaaccaa

SEQ ID NO: 2569144 - RNA, 17 nt, Chlamydophila pneumoniae TW-183
aaagcuuuuuucucuug

SEQ ID NO: 2569145 - RNA, 18 nt, Chlamydophila pneumoniae TW-183
aaaggaaucccuuuuuaa

SEQ ID NO: 2569146 - RNA, 16 nt, Chlamydophila pneumoniae TW-183
aaaggaccuguuuucu

SEQ ID NO: 2569147 - RNA, 17 nt, Chlamydophila pneumoniae TW-183
aaaggaccuguuuucuu

SEQ ID NO: 2569148 - RNA, 19 nt, Chlamydophila pneumoniae TW-183
aaaggcaacaacgccuaca

SEQ ID NO: 2569149 - RNA, 16 nt, Chlamydophila pneumoniae TW-183
aaagggcgcuucccua

SEQ ID NO: 2569150 - RNA, 13 nt, Chlamydophila pneumoniae TW-183
aaagguaaaacua

SEQ ID NO: 2569151 - RNA, 14 nt, Chlamydophila pneumoniae TW-183
aaagguuuuauaaa

SEQ ID NO: 2569152 - RNA, 19 nt, Chlamydophila pneumoniae TW-183
aaaguagccauuccaugga

SEQ ID NO: 2569153 - RNA, 18 nt, Chlamydophila pneumoniae TW-183
aaagucacggcgaaagcu

SEQ ID NO: 2569154 - RNA, 20 nt, Chlamydophila pneumoniae TW-183
aaaguuagguagauagaaau

SEQ ID NO: 2569155 - RNA, 15 nt, Chlamydophila pneumoniae TW-183
aaaguuuaugacaca

SEQ ID NO: 2569156 - RNA, 20 nt, Chlamydophila pneumoniae TW-183
aaaguuugagcuaagcugaa

SEQ ID NO: 2569157 - RNA, 20 nt, Chlamydophila pneumoniae TW-183
aaaguuuguagcauuucuuu

SEQ ID NO: 2569158 - RNA, 21 nt, Chlamydophila pneumoniae TW-183
aaauaaaaaaacccucaaaga

SEQ ID NO: 2569159 - RNA, 16 nt, Chlamydophila pneumoniae TW-183
aaauaguucaucauau

SEQ ID NO: 2569160 - RNA, 14 nt, Chlamydophila pneumoniae TW-183
aaauaucggaagag

SEQ ID NO: 2569161 - RNA, 16 nt, Chlamydophila pneumoniae TW-183
aaauccaccaaugaua

SEQ ID NO: 2569162 - RNA, 20 nt, Chlamydophila pneumoniae TW-183
aaaucccgagauaugaagag

SEQ ID NO: 2569163 - RNA, 16 nt, Chlamydophila pneumoniae TW-183
aaaucccgccuuucua

SEQ ID NO: 2569164 - RNA, 16 nt, Chlamydophila pneumoniae TW-183
aaauccgauaagauaa

SEQ ID NO: 2569165 - RNA, 23 nt, Chlamydophila pneumoniae TW-183
aaaucgguaaccugugaaaauuu

SEQ ID NO: 2569166 - RNA, 21 nt, Chlamydophila pneumoniae TW-183
aaaucucauuccagcaucuuc

SEQ ID NO: 2569167 - RNA, 12 nt, Chlamydophila pneumoniae TW-183
aaaucuucucug

SEQ ID NO: 2569168 - RNA, 12 nt, Chlamydophila pneumoniae TW-183
aaaugagagacg

SEQ ID NO: 2569169 - RNA, 12 nt, Chlamydophila pneumoniae TW-183
aaaugccuguac

SEQ ID NO: 2569170 - RNA, 18 nt, Chlamydophila pneumoniae TW-183
aaaugcuauuuuccucua

SEQ ID NO: 2569171 - RNA, 23 nt, Chlamydophila pneumoniae TW-183
aaauucuagaccugccaagauac

SEQ ID NO: 2569172 - RNA, 22 nt, Chlamydophila pneumoniae TW-183
aaauucuggagucgagcagaaa

SEQ ID NO: 2569173 - RNA, 18 nt, Chlamydophila pneumoniae TW-183
aaauucuguaaagugaaa

SEQ ID NO: 2569174 - RNA, 17 nt, Chlamydophila pneumoniae TW-183
aaauugaauaucgaguu

SEQ ID NO: 2569175 - RNA, 17 nt, Chlamydophila pneumoniae TW-183
aaauuuucccauuacag

SEQ ID NO: 2569176 - RNA, 12 nt, Chlamydophila pneumoniae TW-183
aaauuuuuccuu

SEQ ID NO: 2569177 - RNA, 16 nt, Chlamydophila pneumoniae TW-183
aacaaaaucaaaaacu

SEQ ID NO: 2569178 - RNA, 22 nt, Chlamydophila pneumoniae TW-183
aacaaaguuuaugacacagcua

SEQ ID NO: 2569179 - RNA, 22 nt, Chlamydophila pneumoniae TW-183
aacaacaucacuuauauuuucu

SEQ ID NO: 2569180 - RNA, 19 nt, Chlamydophila pneumoniae TW-183
aacaaguaccaagaaaaua

SEQ ID NO: 2569181 - RNA, 14 nt, Chlamydophila pneumoniae TW-183
aacacaaauagcaa

SEQ ID NO: 2569182 - RNA, 20 nt, Chlamydophila pneumoniae TW-183
aacacagauaggaaccacuu

SEQ ID NO: 2569183 - RNA, 23 nt, Chlamydophila pneumoniae TW-183
aacacaugucucuuaaaaaaaau

SEQ ID NO: 2569184 - RNA, 16 nt, Chlamydophila pneumoniae TW-183
aacacgcacaaacuaa

SEQ ID NO: 2569185 - RNA, 20 nt, Chlamydophila pneumoniae TW-183
aacacgcccacggaaagcac

SEQ ID NO: 2569186 - RNA, 14 nt, Chlamydophila pneumoniae TW-183
aacagcaacacucg

SEQ ID NO: 2569187 - RNA, 19 nt, Chlamydophila pneumoniae TW-183
aacagcauggacuccaaga

SEQ ID NO: 2569188 - RNA, 21 nt, Chlamydophila pneumoniae TW-183
aacagcauggacuccaagaau

SEQ ID NO: 2569189 - RNA, 21 nt, Chlamydophila pneumoniae TW-183
aacagcgguugccuuucucuu

SEQ ID NO: 2569190 - RNA, 22 nt, Chlamydophila pneumoniae TW-183
aacagcuccuggauauugucaa

SEQ ID NO: 2569191 - RNA, 17 nt, Chlamydophila pneumoniae TW-183
aacaggaauagaaaauc

SEQ ID NO: 2569192 - RNA, 19 nt, Chlamydophila pneumoniae TW-183
aacauaaccuccucuucuu

SEQ ID NO: 2569193 - RNA, 18 nt, Chlamydophila pneumoniae TW-183
aacaucacuuauauuuuc

SEQ ID NO: 2569194 - RNA, 15 nt, Chlamydophila pneumoniae TW-183
aacaucucgaaccau

SEQ ID NO: 2569195 - RNA, 14 nt, Chlamydophila pneumoniae TW-183
aacauggacaauau

SEQ ID NO: 2569196 - RNA, 20 nt, Chlamydophila pneumoniae TW-183
aaccaaaagaauuaagaaga

SEQ ID NO: 2569197 - RNA, 20 nt, Chlamydophila pneumoniae TW-183
aaccaauugagcucucuagc

SEQ ID NO: 2569198 - RNA, 19 nt, Chlamydophila pneumoniae TW-183
aaccacuguccaugcacga

SEQ ID NO: 2569199 - RNA, 11 nt, Chlamydophila pneumoniae TW-183
aaccagagagc

SEQ ID NO: 2569200 - RNA, 19 nt, Chlamydophila pneumoniae TW-183
aaccauucaucuaggggag

SEQ ID NO: 2569201 - RNA, 19 nt, Chlamydophila pneumoniae TW-183
aacccgagacuucucucuu

SEQ ID NO: 2569202 - RNA, 15 nt, Chlamydophila pneumoniae TW-183
aacccucaaagaaua

SEQ ID NO: 2569203 - RNA, 13 nt, Chlamydophila pneumoniae TW-183
aaccuucaaugau

SEQ ID NO: 2569204 - RNA, 22 nt, Chlamydophila pneumoniae TW-183
aacgaagugaggagaauagcaa

SEQ ID NO: 2569205 - RNA, 23 nt, Chlamydophila pneumoniae TW-183
aacgaucgucaguaaaacacaaa

SEQ ID NO: 2569206 - RNA, 14 nt, Chlamydophila pneumoniae TW-183
aacgauuucuucuu

SEQ ID NO: 2569207 - RNA, 14 nt, Chlamydophila pneumoniae TW-183
aacgcacgccaaga

SEQ ID NO: 2569208 - RNA, 15 nt, Chlamydophila pneumoniae TW-183
aacgcacgccaagag

SEQ ID NO: 2569209 - RNA, 16 nt, Chlamydophila pneumoniae TW-183
aacgcacgccaagaga

SEQ ID NO: 2569210 - RNA, 19 nt, Chlamydophila pneumoniae TW-183
aacgcucucuagcaccuaa

SEQ ID NO: 2569211 - RNA, 22 nt, Chlamydophila pneumoniae TW-183
aacgcucucuagcaccuaauaa

SEQ ID NO: 2569212 - RNA, 23 nt, Chlamydophila pneumoniae TW-183
aacgggagcguuuuuugaaaauu

SEQ ID NO: 2569213 - RNA, 22 nt, Chlamydophila pneumoniae TW-183
aacgguugucucgaaacucuuu

SEQ ID NO: 2569214 - RNA, 15 nt, Chlamydophila pneumoniae TW-183
aacuaaaaguuuuuu

SEQ ID NO: 2569215 - RNA, 14 nt, Chlamydophila pneumoniae TW-183
aacuaaacucucca

SEQ ID NO: 2569216 - RNA, 19 nt, Chlamydophila pneumoniae TW-183
aacuaagaauaccuauagg

SEQ ID NO: 2569217 - RNA, 12 nt, Chlamydophila pneumoniae TW-183
aacuccaaaaua

SEQ ID NO: 2569218 - RNA, 13 nt, Chlamydophila pneumoniae TW-183
aacuccaaaauau

SEQ ID NO: 2569219 - RNA, 15 nt, Chlamydophila pneumoniae TW-183
aacuccaaaauauuc

SEQ ID NO: 2569220 - RNA, 16 nt, Chlamydophila pneumoniae TW-183
aacuccaaaauauucu

SEQ ID NO: 2569221 - RNA, 23 nt, Chlamydophila pneumoniae TW-183
aacuccucuaaggacaaaucucc

SEQ ID NO: 2569222 - RNA, 14 nt, Chlamydophila pneumoniae TW-183
aacucucaguuaaa

SEQ ID NO: 2569223 - RNA, 13 nt, Chlamydophila pneumoniae TW-183
aacucuuugagga

SEQ ID NO: 2569224 - RNA, 23 nt, Chlamydophila pneumoniae TW-183
aacugaggcaaagauuuccaauc

SEQ ID NO: 2569225 - RNA, 15 nt, Chlamydophila pneumoniae TW-183
aacugaugccaagaa

SEQ ID NO: 2569226 - RNA, 14 nt, Chlamydophila pneumoniae TW-183
aacugcauaaucuc

SEQ ID NO: 2569227 - RNA, 15 nt, Chlamydophila pneumoniae TW-183
aacugcauaaucuca

SEQ ID NO: 2569228 - RNA, 17 nt, Chlamydophila pneumoniae TW-183
aacuuaaagacuugcuu

SEQ ID NO: 2569229 - RNA, 14 nt, Chlamydophila pneumoniae TW-183
aacuucaacaaagg

SEQ ID NO: 2569230 - RNA, 19 nt, Chlamydophila pneumoniae TW-183
aacuucaacuucuccaacu

SEQ ID NO: 2569231 - RNA, 12 nt, Chlamydophila pneumoniae TW-183
aacuucucuagg

SEQ ID NO: 2569232 - RNA, 20 nt, Chlamydophila pneumoniae TW-183
aacuucuugugauccuugca

SEQ ID NO: 2569233 - RNA, 14 nt, Chlamydophila pneumoniae TW-183
aacuugagccaaca

SEQ ID NO: 2569234 - RNA, 17 nt, Chlamydophila pneumoniae TW-183
aacuuggugagcagcuu

SEQ ID NO: 2569235 - RNA, 19 nt, Chlamydophila pneumoniae TW-183
aacuuguuuucguaagaga

SEQ ID NO: 2569236 - RNA, 16 nt, Chlamydophila pneumoniae TW-183
aacuuugaggcaaguc

SEQ ID NO: 2569237 - RNA, 12 nt, Chlamydophila pneumoniae TW-183
aagaaauucuga

SEQ ID NO: 2569238 - RNA, 20 nt, Chlamydophila pneumoniae TW-183
aagaacugcauaaucucacc

SEQ ID NO: 2569239 - RNA, 19 nt, Chlamydophila pneumoniae TW-183
aagaagacuagcuuuucau

SEQ ID NO: 2569240 - RNA, 13 nt, Chlamydophila pneumoniae TW-183
aagaagguugaga

SEQ ID NO: 2569241 - RNA, 15 nt, Chlamydophila pneumoniae TW-183
aagaagugcuuuuag

SEQ ID NO: 2569242 - RNA, 18 nt, Chlamydophila pneumoniae TW-183
aagaauagcguagaggac

SEQ ID NO: 2569243 - RNA, 17 nt, Chlamydophila pneumoniae TW-183
aagaauguagcuguucc

SEQ ID NO: 2569244 - RNA, 21 nt, Chlamydophila pneumoniae TW-183
aagaauguagcuguuccaaga

SEQ ID NO: 2569245 - RNA, 16 nt, Chlamydophila pneumoniae TW-183
aagaauuaagaagaag

SEQ ID NO: 2569246 - RNA, 21 nt, Chlamydophila pneumoniae TW-183
aagaccagaauaccuucaaca

SEQ ID NO: 2569247 - RNA, 16 nt, Chlamydophila pneumoniae TW-183
aagaccuaagcucaua

SEQ ID NO: 2569248 - RNA, 15 nt, Chlamydophila pneumoniae TW-183
aagacucaaagaacu

SEQ ID NO: 2569249 - RNA, 21 nt, Chlamydophila pneumoniae TW-183
aagagaaucuccucaucagaa

SEQ ID NO: 2569250 - RNA, 20 nt, Chlamydophila pneumoniae TW-183
aagagagcuugucacacugc

SEQ ID NO: 2569251 - RNA, 16 nt, Chlamydophila pneumoniae TW-183
aagagcuaugaugaga

SEQ ID NO: 2569252 - RNA, 13 nt, Chlamydophila pneumoniae TW-183
aagagcucaaaaa

SEQ ID NO: 2569253 - RNA, 22 nt, Chlamydophila pneumoniae TW-183
aagagcucguaauccuucuuuc

SEQ ID NO: 2569254 - RNA, 23 nt, Chlamydophila pneumoniae TW-183
aagagcucguaauccuucuuucu

SEQ ID NO: 2569255 - RNA, 20 nt, Chlamydophila pneumoniae TW-183
aagaggcucccaucgucccu

SEQ ID NO: 2569256 - RNA, 17 nt, Chlamydophila pneumoniae TW-183
aagagugccaagagcau

SEQ ID NO: 2569257 - RNA, 19 nt, Chlamydophila pneumoniae TW-183
aagauacuacuuacaagaa

SEQ ID NO: 2569258 - RNA, 19 nt, Chlamydophila pneumoniae TW-183
aagauagggaccaugaucu

SEQ ID NO: 2569259 - RNA, 21 nt, Chlamydophila pneumoniae TW-183
aagauagggaccaugaucuua

SEQ ID NO: 2569260 - RNA, 22 nt, Chlamydophila pneumoniae TW-183
aagauccuaauauccauaagau

SEQ ID NO: 2569261 - RNA, 23 nt, Chlamydophila pneumoniae TW-183
aagaucgcucgaucgugcucugc

SEQ ID NO: 2569262 - RNA, 15 nt, Chlamydophila pneumoniae TW-183
aagaugaauaccaga

SEQ ID NO: 2569263 - RNA, 16 nt, Chlamydophila pneumoniae TW-183
aagaugaauaccagaa

SEQ ID NO: 2569264 - RNA, 22 nt, Chlamydophila pneumoniae TW-183
aagaugaauaccagaagcaaag

SEQ ID NO: 2569265 - RNA, 20 nt, Chlamydophila pneumoniae TW-183
aagauguuguuuuuugauug

SEQ ID NO: 2569266 - RNA, 14 nt, Chlamydophila pneumoniae TW-183
aagauuauucuaga

SEQ ID NO: 2569267 - RNA, 23 nt, Chlamydophila pneumoniae TW-183
aagauuuccaauccauucugaga

SEQ ID NO: 2569268 - RNA, 14 nt, Chlamydophila pneumoniae TW-183
aagauuuugaaaau

SEQ ID NO: 2569269 - RNA, 13 nt, Chlamydophila pneumoniae TW-183
aagcaaaagcaag

SEQ ID NO: 2569270 - RNA, 18 nt, Chlamydophila pneumoniae TW-183
aagcaaaugccuguacua

SEQ ID NO: 2569271 - RNA, 17 nt, Chlamydophila pneumoniae TW-183
aagcaacuaaacucucc

SEQ ID NO: 2569272 - RNA, 18 nt, Chlamydophila pneumoniae TW-183
aagcaacuaaacucucca

SEQ ID NO: 2569273 - RNA, 22 nt, Chlamydophila pneumoniae TW-183
aagcacauacaguacgcaaagu

SEQ ID NO: 2569274 - RNA, 14 nt, Chlamydophila pneumoniae TW-183
aagcacccucuuca

SEQ ID NO: 2569275 - RNA, 18 nt, Chlamydophila pneumoniae TW-183
aagcacccucuucauccg

SEQ ID NO: 2569276 - RNA, 20 nt, Chlamydophila pneumoniae TW-183
aagcacccucuucauccgaa

SEQ ID NO: 2569277 - RNA, 18 nt, Chlamydophila pneumoniae TW-183
aagcagaggguuccaaga

SEQ ID NO: 2569278 - RNA, 21 nt, Chlamydophila pneumoniae TW-183
aagcaggugugugguaaaaau

SEQ ID NO: 2569279 - RNA, 20 nt, Chlamydophila pneumoniae TW-183
aagccaugcaaugaaggcgu

SEQ ID NO: 2569280 - RNA, 22 nt, Chlamydophila pneumoniae TW-183
aagcguauagaauagaauguau

SEQ ID NO: 2569281 - RNA, 15 nt, Chlamydophila pneumoniae TW-183
aagcuagucuuucua

SEQ ID NO: 2569282 - RNA, 14 nt, Chlamydophila pneumoniae TW-183
aagcucauaagaaa

SEQ ID NO: 2569283 - RNA, 19 nt, Chlamydophila pneumoniae TW-183
aagcucgaccucuagcuca

SEQ ID NO: 2569284 - RNA, 20 nt, Chlamydophila pneumoniae TW-183
aagcugacaaauagaaagga

SEQ ID NO: 2569285 - RNA, 19 nt, Chlamydophila pneumoniae TW-183
aagcuggauucugucuaua

SEQ ID NO: 2569286 - RNA, 12 nt, Chlamydophila pneumoniae TW-183
aagcugugcauu

SEQ ID NO: 2569287 - RNA, 19 nt, Chlamydophila pneumoniae TW-183
aagcuguggcgauuuuacu

SEQ ID NO: 2569288 - RNA, 16 nt, Chlamydophila pneumoniae TW-183
aaggacaaaucuccca

SEQ ID NO: 2569289 - RNA, 23 nt, Chlamydophila pneumoniae TW-183
aaggaccuguuuucuuuucugaa

SEQ ID NO: 2569290 - RNA, 14 nt, Chlamydophila pneumoniae TW-183
aaggccuauagauu

SEQ ID NO: 2569291 - RNA, 18 nt, Chlamydophila pneumoniae TW-183
aaggcggcuuuuugcaag

SEQ ID NO: 2569292 - RNA, 14 nt, Chlamydophila pneumoniae TW-183
aaggcugcuugaga

SEQ ID NO: 2569293 - RNA, 20 nt, Chlamydophila pneumoniae TW-183
aagguaaaacuacaggaaaa

SEQ ID NO: 2569294 - RNA, 14 nt, Chlamydophila pneumoniae TW-183
aaggucacagcauu

SEQ ID NO: 2569295 - RNA, 19 nt, Chlamydophila pneumoniae TW-183
aagguuacaccuaaaguuu

SEQ ID NO: 2569296 - RNA, 19 nt, Chlamydophila pneumoniae TW-183
aagguucccuacuccauug

SEQ ID NO: 2569297 - RNA, 22 nt, Chlamydophila pneumoniae TW-183
aagguugagacguaaccacagg

SEQ ID NO: 2569298 - RNA, 18 nt, Chlamydophila pneumoniae TW-183
aagguuuuauaaagaucg

SEQ ID NO: 2569299 - RNA, 18 nt, Chlamydophila pneumoniae TW-183
aaguacuaauuacagaau

SEQ ID NO: 2569300 - RNA, 17 nt, Chlamydophila pneumoniae TW-183
aaguauucgauuccuga

SEQ ID NO: 2569301 - RNA, 17 nt, Chlamydophila pneumoniae TW-183
aagucaccuuacaucca

SEQ ID NO: 2569302 - RNA, 17 nt, Chlamydophila pneumoniae TW-183
aagucacggcgaaagcu

SEQ ID NO: 2569303 - RNA, 23 nt, Chlamydophila pneumoniae TW-183
aagucacggcgaaagcuacagcu

SEQ ID NO: 2569304 - RNA, 13 nt, Chlamydophila pneumoniae TW-183
aagucaugaggac

SEQ ID NO: 2569305 - RNA, 17 nt, Chlamydophila pneumoniae TW-183
aaguccagacuuuccuc

SEQ ID NO: 2569306 - RNA, 23 nt, Chlamydophila pneumoniae TW-183
aaguccagacuuuccucucuuua

SEQ ID NO: 2569307 - RNA, 19 nt, Chlamydophila pneumoniae TW-183
aagugaggagaauagcaag

SEQ ID NO: 2569308 - RNA, 18 nt, Chlamydophila pneumoniae TW-183
aagugauaaggaagaauu

SEQ ID NO: 2569309 - RNA, 20 nt, Chlamydophila pneumoniae TW-183
aagugucugaguuagcuuuu

SEQ ID NO: 2569310 - RNA, 16 nt, Chlamydophila pneumoniae TW-183
aaguuagguagauaga

SEQ ID NO: 2569311 - RNA, 15 nt, Chlamydophila pneumoniae TW-183
aaguucuugauuuuc

SEQ ID NO: 2569312 - RNA, 15 nt, Chlamydophila pneumoniae TW-183
aaguugaccuuuuuc

SEQ ID NO: 2569313 - RNA, 17 nt, Chlamydophila pneumoniae TW-183
aaguugaccuuuuucau

SEQ ID NO: 2569314 - RNA, 13 nt, Chlamydophila pneumoniae TW-183
aaguugagagaga

SEQ ID NO: 2569315 - RNA, 17 nt, Chlamydophila pneumoniae TW-183
aaguuguugauaauuac

SEQ ID NO: 2569316 - RNA, 14 nt, Chlamydophila pneumoniae TW-183
aaguuuaggcagga

SEQ ID NO: 2569317 - RNA, 17 nt, Chlamydophila pneumoniae TW-183
aaguuuucgauacacaa

SEQ ID NO: 2569318 - RNA, 22 nt, Chlamydophila pneumoniae TW-183
aauaaaaaaacccucaaagaau

SEQ ID NO: 2569319 - RNA, 13 nt, Chlamydophila pneumoniae TW-183
aauaaaagcaccc

SEQ ID NO: 2569320 - RNA, 13 nt, Chlamydophila pneumoniae TW-183
aauaagauccaaa

SEQ ID NO: 2569321 - RNA, 21 nt, Chlamydophila pneumoniae TW-183
aauaccaauugggcuaggguu

SEQ ID NO: 2569322 - RNA, 14 nt, Chlamydophila pneumoniae TW-183
aauaccagaagcaa

SEQ ID NO: 2569323 - RNA, 17 nt, Chlamydophila pneumoniae TW-183
aauaccguuuuaggaag

SEQ ID NO: 2569324 - RNA, 16 nt, Chlamydophila pneumoniae TW-183
aauagagaaagagugc

SEQ ID NO: 2569325 - RNA, 21 nt, Chlamydophila pneumoniae TW-183
aauagauuuuuacuugcccaa

SEQ ID NO: 2569326 - RNA, 19 nt, Chlamydophila pneumoniae TW-183
aauagcaagagcuauaccu

SEQ ID NO: 2569327 - RNA, 20 nt, Chlamydophila pneumoniae TW-183
aauagccauaauuagaacag

SEQ ID NO: 2569328 - RNA, 18 nt, Chlamydophila pneumoniae TW-183
aauaggcacccaaacuga

SEQ ID NO: 2569329 - RNA, 14 nt, Chlamydophila pneumoniae TW-183
aauagggugggagu

SEQ ID NO: 2569330 - RNA, 14 nt, Chlamydophila pneumoniae TW-183
aauaguacgcuuuu

SEQ ID NO: 2569331 - RNA, 12 nt, Chlamydophila pneumoniae TW-183
aauaucaucacu

SEQ ID NO: 2569332 - RNA, 18 nt, Chlamydophila pneumoniae TW-183
aauaucgaguucuuuuug

SEQ ID NO: 2569333 - RNA, 22 nt, Chlamydophila pneumoniae TW-183
aauaucgaguucuuuuugcaga

SEQ ID NO: 2569334 - RNA, 18 nt, Chlamydophila pneumoniae TW-183
aauauggguguaaauuuu

SEQ ID NO: 2569335 - RNA, 13 nt, Chlamydophila pneumoniae TW-183
aaucaauaaaaug

SEQ ID NO: 2569336 - RNA, 14 nt, Chlamydophila pneumoniae TW-183
aaucaauccaagaa

SEQ ID NO: 2569337 - RNA, 18 nt, Chlamydophila pneumoniae TW-183
aaucauaaccaaaagaau

SEQ ID NO: 2569338 - RNA, 14 nt, Chlamydophila pneumoniae TW-183
aauccaccaaugau

SEQ ID NO: 2569339 - RNA, 21 nt, Chlamydophila pneumoniae TW-183
aauccaccaaugauaauuuca

SEQ ID NO: 2569340 - RNA, 15 nt, Chlamydophila pneumoniae TW-183
aauccauucugagaa

SEQ ID NO: 2569341 - RNA, 18 nt, Chlamydophila pneumoniae TW-183
aauccauucugagaaaga

SEQ ID NO: 2569342 - RNA, 20 nt, Chlamydophila pneumoniae TW-183
aauccauucugagaaagaag

SEQ ID NO: 2569343 - RNA, 21 nt, Chlamydophila pneumoniae TW-183
aauccauucugagaaagaagu

SEQ ID NO: 2569344 - RNA, 22 nt, Chlamydophila pneumoniae TW-183
aauccauucugagaaagaaguc

SEQ ID NO: 2569345 - RNA, 16 nt, Chlamydophila pneumoniae TW-183
aaucccgugcuaggaa

SEQ ID NO: 2569346 - RNA, 17 nt, Chlamydophila pneumoniae TW-183
aaucccgugcuaggaag

SEQ ID NO: 2569347 - RNA, 18 nt, Chlamydophila pneumoniae TW-183
aaucccgugcuaggaaga

SEQ ID NO: 2569348 - RNA, 15 nt, Chlamydophila pneumoniae TW-183
aaucccugcacucuu

SEQ ID NO: 2569349 - RNA, 20 nt, Chlamydophila pneumoniae TW-183
aauccuccuagguucuuuuu

SEQ ID NO: 2569350 - RNA, 19 nt, Chlamydophila pneumoniae TW-183
aauccuucuuucugcucuu

SEQ ID NO: 2569351 - RNA, 23 nt, Chlamydophila pneumoniae TW-183
aaucgagagaagaaauucugacu

SEQ ID NO: 2569352 - RNA, 17 nt, Chlamydophila pneumoniae TW-183
aaucgauaacguugccu

SEQ ID NO: 2569353 - RNA, 21 nt, Chlamydophila pneumoniae TW-183
aaucgcuguuuuagcauagca

SEQ ID NO: 2569354 - RNA, 20 nt, Chlamydophila pneumoniae TW-183
aaucguuucuauagacucua

SEQ ID NO: 2569355 - RNA, 11 nt, Chlamydophila pneumoniae TW-183
aaucuaugaga

SEQ ID NO: 2569356 - RNA, 19 nt, Chlamydophila pneumoniae TW-183
aaucucaaaaucaaauaga

SEQ ID NO: 2569357 - RNA, 20 nt, Chlamydophila pneumoniae TW-183
aaucucaccagaagcaacua

SEQ ID NO: 2569358 - RNA, 18 nt, Chlamydophila pneumoniae TW-183
aaucucauuccagcaucu

SEQ ID NO: 2569359 - RNA, 16 nt, Chlamydophila pneumoniae TW-183
aaucuccucaucagaa

SEQ ID NO: 2569360 - RNA, 16 nt, Chlamydophila pneumoniae TW-183
aaucugaaucucauaa

SEQ ID NO: 2569361 - RNA, 23 nt, Chlamydophila pneumoniae TW-183
aaucugugaguacccagucaucg

SEQ ID NO: 2569362 - RNA, 17 nt, Chlamydophila pneumoniae TW-183
aaucuuccccuaaaaau

SEQ ID NO: 2569363 - RNA, 13 nt, Chlamydophila pneumoniae TW-183
aaugccagcagcg

SEQ ID NO: 2569364 - RNA, 21 nt, Chlamydophila pneumoniae TW-183
aaugccuguacuaucuuuuuu

SEQ ID NO: 2569365 - RNA, 15 nt, Chlamydophila pneumoniae TW-183
aaugcuaagcuccau

SEQ ID NO: 2569366 - RNA, 13 nt, Chlamydophila pneumoniae TW-183
aaugcuauuuucc

SEQ ID NO: 2569367 - RNA, 21 nt, Chlamydophila pneumoniae TW-183
aauguaucggggauugcaaaa

SEQ ID NO: 2569368 - RNA, 18 nt, Chlamydophila pneumoniae TW-183
aauguccaacucagcuuu

SEQ ID NO: 2569369 - RNA, 21 nt, Chlamydophila pneumoniae TW-183
aauguugggaugaucucguag

SEQ ID NO: 2569370 - RNA, 14 nt, Chlamydophila pneumoniae TW-183
aauuaauaaaagag

SEQ ID NO: 2569371 - RNA, 18 nt, Chlamydophila pneumoniae TW-183
aauuaccuugagacaaag

SEQ ID NO: 2569372 - RNA, 15 nt, Chlamydophila pneumoniae TW-183
aauuagaaucagagg

SEQ ID NO: 2569373 - RNA, 15 nt, Chlamydophila pneumoniae TW-183
aauucaugcaaaaca

SEQ ID NO: 2569374 - RNA, 17 nt, Chlamydophila pneumoniae TW-183
aauuccccuucaucaau

SEQ ID NO: 2569375 - RNA, 20 nt, Chlamydophila pneumoniae TW-183
aauucccguagguagagcug

SEQ ID NO: 2569376 - RNA, 15 nt, Chlamydophila pneumoniae TW-183
aauucggcagaaggc

SEQ ID NO: 2569377 - RNA, 16 nt, Chlamydophila pneumoniae TW-183
aauucggcagaaggcu

SEQ ID NO: 2569378 - RNA, 14 nt, Chlamydophila pneumoniae TW-183
aauugacuggaggc

SEQ ID NO: 2569379 - RNA, 15 nt, Chlamydophila pneumoniae TW-183
aauugcucuugcucu

SEQ ID NO: 2569380 - RNA, 16 nt, Chlamydophila pneumoniae TW-183
aauugcucuugcucua

SEQ ID NO: 2569381 - RNA, 19 nt, Chlamydophila pneumoniae TW-183
aauuuccaaucacacuaca

SEQ ID NO: 2569382 - RNA, 14 nt, Chlamydophila pneumoniae TW-183
aauuucgucuucau

SEQ ID NO: 2569383 - RNA, 23 nt, Chlamydophila pneumoniae TW-183
aauuuucagccugucuauaaaau

SEQ ID NO: 2569384 - RNA, 19 nt, Chlamydophila pneumoniae TW-183
aauuuuuccuucaacacac

SEQ ID NO: 2569385 - RNA, 18 nt, Chlamydophila pneumoniae TW-183
acaaaaccuggauugauc

SEQ ID NO: 2569386 - RNA, 15 nt, Chlamydophila pneumoniae TW-183
acaaacuaaaucaac

SEQ ID NO: 2569387 - RNA, 15 nt, Chlamydophila pneumoniae TW-183
acaacauaacagggu

SEQ ID NO: 2569388 - RNA, 15 nt, Chlamydophila pneumoniae TW-183
acaacaucacuauca

SEQ ID NO: 2569389 - RNA, 21 nt, Chlamydophila pneumoniae TW-183
acaacgccuacauggaucccu

SEQ ID NO: 2569390 - RNA, 17 nt, Chlamydophila pneumoniae TW-183
acaacggcaaucuauuu

SEQ ID NO: 2569391 - RNA, 13 nt, Chlamydophila pneumoniae TW-183
acaacuccuaagu

SEQ ID NO: 2569392 - RNA, 15 nt, Chlamydophila pneumoniae TW-183
acaacuuugaggcaa

SEQ ID NO: 2569393 - RNA, 13 nt, Chlamydophila pneumoniae TW-183
acaagaauaacuu

SEQ ID NO: 2569394 - RNA, 19 nt, Chlamydophila pneumoniae TW-183
acaagagcgcauuuuacag

SEQ ID NO: 2569395 - RNA, 20 nt, Chlamydophila pneumoniae TW-183
acaagcuuagcaacccaagc

SEQ ID NO: 2569396 - RNA, 16 nt, Chlamydophila pneumoniae TW-183
acaaguaccaagaaaa

SEQ ID NO: 2569397 - RNA, 15 nt, Chlamydophila pneumoniae TW-183
acaaguugagagaga

SEQ ID NO: 2569398 - RNA, 21 nt, Chlamydophila pneumoniae TW-183
acaauaggcacccaaacugau

SEQ ID NO: 2569399 - RNA, 14 nt, Chlamydophila pneumoniae TW-183
acaauauaaaugcu

SEQ ID NO: 2569400 - RNA, 17 nt, Chlamydophila pneumoniae TW-183
acaauauagagaucuag

SEQ ID NO: 2569401 - RNA, 21 nt, Chlamydophila pneumoniae TW-183
acaaucuacggcauaaccuuu

SEQ ID NO: 2569402 - RNA, 23 nt, Chlamydophila pneumoniae TW-183
acaauuagagauucauaaaacug

SEQ ID NO: 2569403 - RNA, 23 nt, Chlamydophila pneumoniae TW-183
acaauuuccuugguaucccaauc

SEQ ID NO: 2569404 - RNA, 17 nt, Chlamydophila pneumoniae TW-183
acacaaaaagcuuuuuu

SEQ ID NO: 2569405 - RNA, 12 nt, Chlamydophila pneumoniae TW-183
acacaaauagca

SEQ ID NO: 2569406 - RNA, 23 nt, Chlamydophila pneumoniae TW-183
acacagacuugaggaaucugaau

SEQ ID NO: 2569407 - RNA, 21 nt, Chlamydophila pneumoniae TW-183
acacaggggaacgcucucuag

SEQ ID NO: 2569408 - RNA, 20 nt, Chlamydophila pneumoniae TW-183
acacaugucucuuaaaaaaa

SEQ ID NO: 2569409 - RNA, 15 nt, Chlamydophila pneumoniae TW-183
acaccauuuuugaau

SEQ ID NO: 2569410 - RNA, 13 nt, Chlamydophila pneumoniae TW-183
acaccuucuucua

SEQ ID NO: 2569411 - RNA, 12 nt, Chlamydophila pneumoniae TW-183
acacucuaucau

SEQ ID NO: 2569412 - RNA, 13 nt, Chlamydophila pneumoniae TW-183
acacugcgagaga

SEQ ID NO: 2569413 - RNA, 17 nt, Chlamydophila pneumoniae TW-183
acagauaagacaauaaa

SEQ ID NO: 2569414 - RNA, 16 nt, Chlamydophila pneumoniae TW-183
acagcauaaaaauucu

SEQ ID NO: 2569415 - RNA, 14 nt, Chlamydophila pneumoniae TW-183
acagcaucaggauu

SEQ ID NO: 2569416 - RNA, 13 nt, Chlamydophila pneumoniae TW-183
acagcaucggcaa

SEQ ID NO: 2569417 - RNA, 19 nt, Chlamydophila pneumoniae TW-183
acagcaucggcaaccaguu

SEQ ID NO: 2569418 - RNA, 21 nt, Chlamydophila pneumoniae TW-183
acagcauggacuccaagaaua

SEQ ID NO: 2569419 - RNA, 22 nt, Chlamydophila pneumoniae TW-183
acagcuucuucguaagcugcaa

SEQ ID NO: 2569420 - RNA, 15 nt, Chlamydophila pneumoniae TW-183
acaggagagagaagg

SEQ ID NO: 2569421 - RNA, 23 nt, Chlamydophila pneumoniae TW-183
acaguccuuuaccaucgucucca

SEQ ID NO: 2569422 - RNA, 22 nt, Chlamydophila pneumoniae TW-183
acauagaaaacauaucccauag

SEQ ID NO: 2569423 - RNA, 22 nt, Chlamydophila pneumoniae TW-183
acaucacuuauauuuucuauuc

SEQ ID NO: 2569424 - RNA, 22 nt, Chlamydophila pneumoniae TW-183
acaucuccaagccaugcaauga

SEQ ID NO: 2569425 - RNA, 12 nt, Chlamydophila pneumoniae TW-183
acaucucuuuaa

SEQ ID NO: 2569426 - RNA, 16 nt, Chlamydophila pneumoniae TW-183
acaugcgcguauaagg

SEQ ID NO: 2569427 - RNA, 20 nt, Chlamydophila pneumoniae TW-183
acaugucucuuaaaaaaaau

SEQ ID NO: 2569428 - RNA, 13 nt, Chlamydophila pneumoniae TW-183
acauuaagaggaa

SEQ ID NO: 2569429 - RNA, 17 nt, Chlamydophila pneumoniae TW-183
acauucuucugucugua

SEQ ID NO: 2569430 - RNA, 21 nt, Chlamydophila pneumoniae TW-183
acauucuucugucuguauuuc

SEQ ID NO: 2569431 - RNA, 14 nt, Chlamydophila pneumoniae TW-183
acauuguuuaaguc

SEQ ID NO: 2569432 - RNA, 22 nt, Chlamydophila pneumoniae TW-183
accaaaaauuccguuaagaugu

SEQ ID NO: 2569433 - RNA, 14 nt, Chlamydophila pneumoniae TW-183
accaauacagcaua

SEQ ID NO: 2569434 - RNA, 19 nt, Chlamydophila pneumoniae TW-183
accaaugaucguagcuaaa

SEQ ID NO: 2569435 - RNA, 18 nt, Chlamydophila pneumoniae TW-183
accaauugagcucucuag

SEQ ID NO: 2569436 - RNA, 22 nt, Chlamydophila pneumoniae TW-183
accacuguccaugcacgagauu

SEQ ID NO: 2569437 - RNA, 19 nt, Chlamydophila pneumoniae TW-183
accacuuaggguucucaaa

SEQ ID NO: 2569438 - RNA, 20 nt, Chlamydophila pneumoniae TW-183
accacuuuagaauuuucuuu

SEQ ID NO: 2569439 - RNA, 14 nt, Chlamydophila pneumoniae TW-183
accagaauaccuuc

SEQ ID NO: 2569440 - RNA, 15 nt, Chlamydophila pneumoniae TW-183
accagaauaccuuca

SEQ ID NO: 2569441 - RNA, 19 nt, Chlamydophila pneumoniae TW-183
accaucgucuccaaaaauu

SEQ ID NO: 2569442 - RNA, 19 nt, Chlamydophila pneumoniae TW-183
acccaaacugaugccaaga

SEQ ID NO: 2569443 - RNA, 23 nt, Chlamydophila pneumoniae TW-183
acccaagcuuugcgcuuguucuu

SEQ ID NO: 2569444 - RNA, 22 nt, Chlamydophila pneumoniae TW-183
accccacgcuaaacuaaaaugg

SEQ ID NO: 2569445 - RNA, 13 nt, Chlamydophila pneumoniae TW-183
accccuagaacuu

SEQ ID NO: 2569446 - RNA, 18 nt, Chlamydophila pneumoniae TW-183
acccgagacuucucucuu

SEQ ID NO: 2569447 - RNA, 21 nt, Chlamydophila pneumoniae TW-183
acccucaaagaauacucuaag

SEQ ID NO: 2569448 - RNA, 15 nt, Chlamydophila pneumoniae TW-183
acccucgaaccacug

SEQ ID NO: 2569449 - RNA, 19 nt, Chlamydophila pneumoniae TW-183
accgagcuuuuugcuuuuc

SEQ ID NO: 2569450 - RNA, 21 nt, Chlamydophila pneumoniae TW-183
accguaacugaggcaaagauu

SEQ ID NO: 2569451 - RNA, 14 nt, Chlamydophila pneumoniae TW-183
accuaaaacaaaau

SEQ ID NO: 2569452 - RNA, 14 nt, Chlamydophila pneumoniae TW-183
accuaauaaagaag

SEQ ID NO: 2569453 - RNA, 17 nt, Chlamydophila pneumoniae TW-183
accuaggagaaaucaca

SEQ ID NO: 2569454 - RNA, 19 nt, Chlamydophila pneumoniae TW-183
accucaagaugcauucuga

SEQ ID NO: 2569455 - RNA, 21 nt, Chlamydophila pneumoniae TW-183
accuccucuucuucaucuucu

SEQ ID NO: 2569456 - RNA, 17 nt, Chlamydophila pneumoniae TW-183
accugugaaaauuuucu

SEQ ID NO: 2569457 - RNA, 13 nt, Chlamydophila pneumoniae TW-183
accuguuuucuuu

SEQ ID NO: 2569458 - RNA, 20 nt, Chlamydophila pneumoniae TW-183
accuuacauccaauuuuguu

SEQ ID NO: 2569459 - RNA, 12 nt, Chlamydophila pneumoniae TW-183
accuucaaugau

SEQ ID NO: 2569460 - RNA, 18 nt, Chlamydophila pneumoniae TW-183
accuucaaugauuucuuu

SEQ ID NO: 2569461 - RNA, 13 nt, Chlamydophila pneumoniae TW-183
accuucacaagaa

SEQ ID NO: 2569462 - RNA, 16 nt, Chlamydophila pneumoniae TW-183
accuucacaagaaaac

SEQ ID NO: 2569463 - RNA, 16 nt, Chlamydophila pneumoniae TW-183
accuugagacaaagaa

SEQ ID NO: 2569464 - RNA, 21 nt, Chlamydophila pneumoniae TW-183
accuugagacaaagaaucccc

SEQ ID NO: 2569465 - RNA, 16 nt, Chlamydophila pneumoniae TW-183
acgacguuuugcugug

SEQ ID NO: 2569466 - RNA, 15 nt, Chlamydophila pneumoniae TW-183
acgagacaugaugca

SEQ ID NO: 2569467 - RNA, 21 nt, Chlamydophila pneumoniae TW-183
acgaguucgcggaucuucuuc

SEQ ID NO: 2569468 - RNA, 22 nt, Chlamydophila pneumoniae TW-183
acgauauaaucacguccuucua

SEQ ID NO: 2569469 - RNA, 21 nt, Chlamydophila pneumoniae TW-183
acgcaaaguacuaauuacaga

SEQ ID NO: 2569470 - RNA, 15 nt, Chlamydophila pneumoniae TW-183
acgcaaguaaagaaa

SEQ ID NO: 2569471 - RNA, 16 nt, Chlamydophila pneumoniae TW-183
acgcaaguaaagaaau

SEQ ID NO: 2569472 - RNA, 13 nt, Chlamydophila pneumoniae TW-183
acgcacgccaaga

SEQ ID NO: 2569473 - RNA, 11 nt, Chlamydophila pneumoniae TW-183
acgcagagaug

SEQ ID NO: 2569474 - RNA, 15 nt, Chlamydophila pneumoniae TW-183
acgcaugacgcuuuu

SEQ ID NO: 2569475 - RNA, 21 nt, Chlamydophila pneumoniae TW-183
acgcccacggaaagcacauac

SEQ ID NO: 2569476 - RNA, 15 nt, Chlamydophila pneumoniae TW-183
acggaaagcacauac

SEQ ID NO: 2569477 - RNA, 19 nt, Chlamydophila pneumoniae TW-183
acguacgcaaguaaagaaa

SEQ ID NO: 2569478 - RNA, 17 nt, Chlamydophila pneumoniae TW-183
acguagcuacaaaauua

SEQ ID NO: 2569479 - RNA, 19 nt, Chlamydophila pneumoniae TW-183
acguccucaccuugugaga

SEQ ID NO: 2569480 - RNA, 16 nt, Chlamydophila pneumoniae TW-183
acgucuccaacagucu

SEQ ID NO: 2569481 - RNA, 19 nt, Chlamydophila pneumoniae TW-183
acguugcgaacagcuccug

SEQ ID NO: 2569482 - RNA, 15 nt, Chlamydophila pneumoniae TW-183
acuaaaaguuuuuua

SEQ ID NO: 2569483 - RNA, 18 nt, Chlamydophila pneumoniae TW-183
acuaaacaccuucuucua

SEQ ID NO: 2569484 - RNA, 23 nt, Chlamydophila pneumoniae TW-183
acuaaaucaacuacaucuccaag

SEQ ID NO: 2569485 - RNA, 12 nt, Chlamydophila pneumoniae TW-183
acuaacauagau

SEQ ID NO: 2569486 - RNA, 16 nt, Chlamydophila pneumoniae TW-183
acuacucucaucaagg

SEQ ID NO: 2569487 - RNA, 13 nt, Chlamydophila pneumoniae TW-183
acuagaauaccgu

SEQ ID NO: 2569488 - RNA, 18 nt, Chlamydophila pneumoniae TW-183
acuaucauggacaagcaa

SEQ ID NO: 2569489 - RNA, 20 nt, Chlamydophila pneumoniae TW-183
acuaucauggacaagcaaaa

SEQ ID NO: 2569490 - RNA, 16 nt, Chlamydophila pneumoniae TW-183
acuauuaggcuuuuuu

SEQ ID NO: 2569491 - RNA, 21 nt, Chlamydophila pneumoniae TW-183
acuauugggagguucgcagaa

SEQ ID NO: 2569492 - RNA, 12 nt, Chlamydophila pneumoniae TW-183
acucagagauug

SEQ ID NO: 2569493 - RNA, 20 nt, Chlamydophila pneumoniae TW-183
acucaggauauauagagcag

SEQ ID NO: 2569494 - RNA, 14 nt, Chlamydophila pneumoniae TW-183
acucaucaguaaaa

SEQ ID NO: 2569495 - RNA, 13 nt, Chlamydophila pneumoniae TW-183
acuccaagaauag

SEQ ID NO: 2569496 - RNA, 19 nt, Chlamydophila pneumoniae TW-183
acuccaagaauagcaggaa

SEQ ID NO: 2569497 - RNA, 12 nt, Chlamydophila pneumoniae TW-183
acucuacaagug

SEQ ID NO: 2569498 - RNA, 16 nt, Chlamydophila pneumoniae TW-183
acucucaucagcaaaa

SEQ ID NO: 2569499 - RNA, 23 nt, Chlamydophila pneumoniae TW-183
acucuuuaaaagggcgcuucccu

SEQ ID NO: 2569500 - RNA, 14 nt, Chlamydophila pneumoniae TW-183
acugaggcaaagau

SEQ ID NO: 2569501 - RNA, 22 nt, Chlamydophila pneumoniae TW-183
acugaugccaagaaauauacug

SEQ ID NO: 2569502 - RNA, 18 nt, Chlamydophila pneumoniae TW-183
acugccagcgaucacaua

SEQ ID NO: 2569503 - RNA, 16 nt, Chlamydophila pneumoniae TW-183
acugcuucaaaacaua

SEQ ID NO: 2569504 - RNA, 17 nt, Chlamydophila pneumoniae TW-183
acugcuuuaggcccaag

SEQ ID NO: 2569505 - RNA, 15 nt, Chlamydophila pneumoniae TW-183
acuggagagguaacc

SEQ ID NO: 2569506 - RNA, 22 nt, Chlamydophila pneumoniae TW-183
acuggagagguaaccagagagc

SEQ ID NO: 2569507 - RNA, 16 nt, Chlamydophila pneumoniae TW-183
acuuaaagacuugcuu

SEQ ID NO: 2569508 - RNA, 13 nt, Chlamydophila pneumoniae TW-183
acuuaagauacuu

SEQ ID NO: 2569509 - RNA, 22 nt, Chlamydophila pneumoniae TW-183
acuuaagauacuucuccacagc

SEQ ID NO: 2569510 - RNA, 20 nt, Chlamydophila pneumoniae TW-183
acuuaaguugaccuuuuuca

SEQ ID NO: 2569511 - RNA, 21 nt, Chlamydophila pneumoniae TW-183
acuucaacaaaggcuccaaac

SEQ ID NO: 2569512 - RNA, 22 nt, Chlamydophila pneumoniae TW-183
acuucaacaaaggcuccaaacg

SEQ ID NO: 2569513 - RNA, 18 nt, Chlamydophila pneumoniae TW-183
acuucaacuucuccaacu

SEQ ID NO: 2569514 - RNA, 17 nt, Chlamydophila pneumoniae TW-183
acuucaucgacaguauu

SEQ ID NO: 2569515 - RNA, 17 nt, Chlamydophila pneumoniae TW-183
acuuccccaaacaugga

SEQ ID NO: 2569516 - RNA, 23 nt, Chlamydophila pneumoniae TW-183
acuucuccacagcuucuucguaa

SEQ ID NO: 2569517 - RNA, 23 nt, Chlamydophila pneumoniae TW-183
acuucugaugacguuaauaaaga

SEQ ID NO: 2569518 - RNA, 18 nt, Chlamydophila pneumoniae TW-183
acuugcaagcuucuuguu

SEQ ID NO: 2569519 - RNA, 17 nt, Chlamydophila pneumoniae TW-183
acuugcauuuuuuggaa

SEQ ID NO: 2569520 - RNA, 15 nt, Chlamydophila pneumoniae TW-183
acuugcccaaaaguu

SEQ ID NO: 2569521 - RNA, 14 nt, Chlamydophila pneumoniae TW-183
acuuuaacgaagaa

SEQ ID NO: 2569522 - RNA, 12 nt, Chlamydophila pneumoniae TW-183
acuuuauucucu

SEQ ID NO: 2569523 - RNA, 14 nt, Chlamydophila pneumoniae TW-183
acuuuauucucuuc

SEQ ID NO: 2569524 - RNA, 18 nt, Chlamydophila pneumoniae TW-183
acuuucccuucuaaggaa

SEQ ID NO: 2569525 - RNA, 12 nt, Chlamydophila pneumoniae TW-183
acuuuccucucu

SEQ ID NO: 2569526 - RNA, 15 nt, Chlamydophila pneumoniae TW-183
acuuuccucucuuua

SEQ ID NO: 2569527 - RNA, 15 nt, Chlamydophila pneumoniae TW-183
acuuugugauuacag

SEQ ID NO: 2569528 - RNA, 18 nt, Chlamydophila pneumoniae TW-183
acuuuuguacacagagau

SEQ ID NO: 2569529 - RNA, 22 nt, Chlamydophila pneumoniae TW-183
acuuuuguacacagagaugcuu

SEQ ID NO: 2569530 - RNA, 19 nt, Chlamydophila pneumoniae TW-183
agaaaaaccccuagaacuu

SEQ ID NO: 2569531 - RNA, 14 nt, Chlamydophila pneumoniae TW-183
agaaaacaaaguca

SEQ ID NO: 2569532 - RNA, 14 nt, Chlamydophila pneumoniae TW-183
agaaaacauagaga

SEQ ID NO: 2569533 - RNA, 21 nt, Chlamydophila pneumoniae TW-183
agaaaacauagagauucuaca

SEQ ID NO: 2569534 - RNA, 16 nt, Chlamydophila pneumoniae TW-183
agaaaagaacagggga

SEQ ID NO: 2569535 - RNA, 20 nt, Chlamydophila pneumoniae TW-183
agaaaauaguacgcuuuuua

SEQ ID NO: 2569536 - RNA, 16 nt, Chlamydophila pneumoniae TW-183
agaaaccagaacacau

SEQ ID NO: 2569537 - RNA, 14 nt, Chlamydophila pneumoniae TW-183
agaaacuccaaaau

SEQ ID NO: 2569538 - RNA, 17 nt, Chlamydophila pneumoniae TW-183
agaaacuccaaaauauu

SEQ ID NO: 2569539 - RNA, 21 nt, Chlamydophila pneumoniae TW-183
agaaacuccaaaauauucuuu

SEQ ID NO: 2569540 - RNA, 13 nt, Chlamydophila pneumoniae TW-183
agaaacuucucua

SEQ ID NO: 2569541 - RNA, 12 nt, Chlamydophila pneumoniae TW-183
agaaagauaacg

SEQ ID NO: 2569542 - RNA, 16 nt, Chlamydophila pneumoniae TW-183
agaaauauacugccag

SEQ ID NO: 2569543 - RNA, 14 nt, Chlamydophila pneumoniae TW-183
agaaaucacacuua

SEQ ID NO: 2569544 - RNA, 21 nt, Chlamydophila pneumoniae TW-183
agaaaugcucuucugcagcgu

SEQ ID NO: 2569545 - RNA, 21 nt, Chlamydophila pneumoniae TW-183
agaaauuagaguaugaggaga

SEQ ID NO: 2569546 - RNA, 21 nt, Chlamydophila pneumoniae TW-183
agaacacucagagauguggca

SEQ ID NO: 2569547 - RNA, 21 nt, Chlamydophila pneumoniae TW-183
agaacccgagacuucucucuu

SEQ ID NO: 2569548 - RNA, 20 nt, Chlamydophila pneumoniae TW-183
agaaccuucacaagaaaaca

SEQ ID NO: 2569549 - RNA, 21 nt, Chlamydophila pneumoniae TW-183
agaaccuucacaagaaaacaa

SEQ ID NO: 2569550 - RNA, 24 nt, Chlamydophila pneumoniae TW-183
agaaccuucacaagaaaacaaagu

SEQ ID NO: 2569551 - RNA, 23 nt, Chlamydophila pneumoniae TW-183
agaacugcauaaucucaccagaa

SEQ ID NO: 2569552 - RNA, 15 nt, Chlamydophila pneumoniae TW-183
agaacuuuacaauua

SEQ ID NO: 2569553 - RNA, 15 nt, Chlamydophila pneumoniae TW-183
agaagcaacuaaacu

SEQ ID NO: 2569554 - RNA, 17 nt, Chlamydophila pneumoniae TW-183
agaagcaacuaaacucu

SEQ ID NO: 2569555 - RNA, 14 nt, Chlamydophila pneumoniae TW-183
agaagcauugagga

SEQ ID NO: 2569556 - RNA, 22 nt, Chlamydophila pneumoniae TW-183
agaagcuuuccuccuuguuucc

SEQ ID NO: 2569557 - RNA, 19 nt, Chlamydophila pneumoniae TW-183
agaaggcucucaaggucac

SEQ ID NO: 2569558 - RNA, 18 nt, Chlamydophila pneumoniae TW-183
agaaggcuuguuucuguu

SEQ ID NO: 2569559 - RNA, 13 nt, Chlamydophila pneumoniae TW-183
agaagggacuugu

SEQ ID NO: 2569560 - RNA, 20 nt, Chlamydophila pneumoniae TW-183
agaaguauucgauuccugag

SEQ ID NO: 2569561 - RNA, 21 nt, Chlamydophila pneumoniae TW-183
agaauaacgcaagggcggaga

SEQ ID NO: 2569562 - RNA, 23 nt, Chlamydophila pneumoniae TW-183
agaauaccguuuuaggaagguca

SEQ ID NO: 2569563 - RNA, 16 nt, Chlamydophila pneumoniae TW-183
agaauaccuauagguu

SEQ ID NO: 2569564 - RNA, 15 nt, Chlamydophila pneumoniae TW-183
agaauaccuucaaca

SEQ ID NO: 2569565 - RNA, 19 nt, Chlamydophila pneumoniae TW-183
agaauaccuucaacaagaa

SEQ ID NO: 2569566 - RNA, 13 nt, Chlamydophila pneumoniae TW-183
agaauagcaagca

SEQ ID NO: 2569567 - RNA, 16 nt, Chlamydophila pneumoniae TW-183
agaauagcaggaagga

SEQ ID NO: 2569568 - RNA, 18 nt, Chlamydophila pneumoniae TW-183
agaauagccauaauuaga

SEQ ID NO: 2569569 - RNA, 18 nt, Chlamydophila pneumoniae TW-183
agaaucgaguucuucauu

SEQ ID NO: 2569570 - RNA, 21 nt, Chlamydophila pneumoniae TW-183
agaaugcuguaaucgagagaa

SEQ ID NO: 2569571 - RNA, 14 nt, Chlamydophila pneumoniae TW-183
agaauguaugugaa

SEQ ID NO: 2569572 - RNA, 21 nt, Chlamydophila pneumoniae TW-183
agaauguaugugaaagauuau

SEQ ID NO: 2569573 - RNA, 20 nt, Chlamydophila pneumoniae TW-183
agaauuaagaagaagcugac

SEQ ID NO: 2569574 - RNA, 16 nt, Chlamydophila pneumoniae TW-183
agaauuucgucuucau

SEQ ID NO: 2569575 - RNA, 20 nt, Chlamydophila pneumoniae TW-183
agaauuuucuuuugcagcaa

SEQ ID NO: 2569576 - RNA, 17 nt, Chlamydophila pneumoniae TW-183
agacaauaaaauagccc

SEQ ID NO: 2569577 - RNA, 19 nt, Chlamydophila pneumoniae TW-183
agacacaaaaagcuuuuuu

SEQ ID NO: 2569578 - RNA, 15 nt, Chlamydophila pneumoniae TW-183
agaccugccaagaua

SEQ ID NO: 2569579 - RNA, 13 nt, Chlamydophila pneumoniae TW-183
agacucucaucag

SEQ ID NO: 2569580 - RNA, 13 nt, Chlamydophila pneumoniae TW-183
agacuuuccucuc

SEQ ID NO: 2569581 - RNA, 17 nt, Chlamydophila pneumoniae TW-183
agacuuuccucucuuua

SEQ ID NO: 2569582 - RNA, 13 nt, Chlamydophila pneumoniae TW-183
agacuuucugacg

SEQ ID NO: 2569583 - RNA, 20 nt, Chlamydophila pneumoniae TW-183
agagaaaauaagcaguuuuc

SEQ ID NO: 2569584 - RNA, 20 nt, Chlamydophila pneumoniae TW-183
agagaacuuuaacgaagaag

SEQ ID NO: 2569585 - RNA, 15 nt, Chlamydophila pneumoniae TW-183
agagaagcagaaucu

SEQ ID NO: 2569586 - RNA, 18 nt, Chlamydophila pneumoniae TW-183
agagaaucuccucaucag

SEQ ID NO: 2569587 - RNA, 13 nt, Chlamydophila pneumoniae TW-183
agagagaacagga

SEQ ID NO: 2569588 - RNA, 15 nt, Chlamydophila pneumoniae TW-183
agagaggguaagcug

SEQ ID NO: 2569589 - RNA, 17 nt, Chlamydophila pneumoniae TW-183
agagaguucucucuuca

SEQ ID NO: 2569590 - RNA, 23 nt, Chlamydophila pneumoniae TW-183
agagaguucuuguaauaaaagaa

SEQ ID NO: 2569591 - RNA, 12 nt, Chlamydophila pneumoniae TW-183
agagaguuuuug

SEQ ID NO: 2569592 - RNA, 15 nt, Chlamydophila pneumoniae TW-183
agagaugcuaacaac

SEQ ID NO: 2569593 - RNA, 14 nt, Chlamydophila pneumoniae TW-183
agagauucuacaaa

SEQ ID NO: 2569594 - RNA, 21 nt, Chlamydophila pneumoniae TW-183
agagauugccaggagagcuaa

SEQ ID NO: 2569595 - RNA, 13 nt, Chlamydophila pneumoniae TW-183
agagcagaccucu

SEQ ID NO: 2569596 - RNA, 18 nt, Chlamydophila pneumoniae TW-183
agagcuaacagcacguaa

SEQ ID NO: 2569597 - RNA, 13 nt, Chlamydophila pneumoniae TW-183
agagcuaugauga

SEQ ID NO: 2569598 - RNA, 14 nt, Chlamydophila pneumoniae TW-183
agagcucaucaaug

SEQ ID NO: 2569599 - RNA, 19 nt, Chlamydophila pneumoniae TW-183
agagcucguaauccuucuu

SEQ ID NO: 2569600 - RNA, 22 nt, Chlamydophila pneumoniae TW-183
agagcuggggauggucuucccc

SEQ ID NO: 2569601 - RNA, 20 nt, Chlamydophila pneumoniae TW-183
agagcuugucacacugcgag

SEQ ID NO: 2569602 - RNA, 13 nt, Chlamydophila pneumoniae TW-183
agaggaaugaaga

SEQ ID NO: 2569603 - RNA, 18 nt, Chlamydophila pneumoniae TW-183
agaggaaugaagagaguu

SEQ ID NO: 2569604 - RNA, 16 nt, Chlamydophila pneumoniae TW-183
agaggcuguccuugca

SEQ ID NO: 2569605 - RNA, 14 nt, Chlamydophila pneumoniae TW-183
agagggaaggaaua

SEQ ID NO: 2569606 - RNA, 20 nt, Chlamydophila pneumoniae TW-183
agaggguuuuuuugcugcga

SEQ ID NO: 2569607 - RNA, 23 nt, Chlamydophila pneumoniae TW-183
agaggguuuuuuugcugcgaaug

SEQ ID NO: 2569608 - RNA, 12 nt, Chlamydophila pneumoniae TW-183
agaguagcccca

SEQ ID NO: 2569609 - RNA, 16 nt, Chlamydophila pneumoniae TW-183
agaguccuucuuuucc

SEQ ID NO: 2569610 - RNA, 16 nt, Chlamydophila pneumoniae TW-183
agagugacucaucagu

SEQ ID NO: 2569611 - RNA, 14 nt, Chlamydophila pneumoniae TW-183
agaguuagauguaa

SEQ ID NO: 2569612 - RNA, 15 nt, Chlamydophila pneumoniae TW-183
agaguugcuuuaugg

SEQ ID NO: 2569613 - RNA, 19 nt, Chlamydophila pneumoniae TW-183
agaguuuuacaucaaugau

SEQ ID NO: 2569614 - RNA, 23 nt, Chlamydophila pneumoniae TW-183
agaguuuuuggccgauaggaaga

SEQ ID NO: 2569615 - RNA, 20 nt, Chlamydophila pneumoniae TW-183
agaguuuuuguguuugacug

SEQ ID NO: 2569616 - RNA, 13 nt, Chlamydophila pneumoniae TW-183
agauaaagaauuc

SEQ ID NO: 2569617 - RNA, 15 nt, Chlamydophila pneumoniae TW-183
agauacgaaguccca

SEQ ID NO: 2569618 - RNA, 21 nt, Chlamydophila pneumoniae TW-183
agauacuaucugccauaggau

SEQ ID NO: 2569619 - RNA, 22 nt, Chlamydophila pneumoniae TW-183
agauacuaucugccauaggauc

SEQ ID NO: 2569620 - RNA, 18 nt, Chlamydophila pneumoniae TW-183
agauacuucuccacagcu

SEQ ID NO: 2569621 - RNA, 14 nt, Chlamydophila pneumoniae TW-183
agauagcucuugcg

SEQ ID NO: 2569622 - RNA, 24 nt, Chlamydophila pneumoniae TW-183
agauagcucuuugauuuucuuagc

SEQ ID NO: 2569623 - RNA, 21 nt, Chlamydophila pneumoniae TW-183
agauauacuuuuucagcaacg

SEQ ID NO: 2569624 - RNA, 13 nt, Chlamydophila pneumoniae TW-183
agauaugaagaga

SEQ ID NO: 2569625 - RNA, 19 nt, Chlamydophila pneumoniae TW-183
agauaugccucaggucugc

SEQ ID NO: 2569626 - RNA, 23 nt, Chlamydophila pneumoniae TW-183
agauaugccucaggucugcugag

SEQ ID NO: 2569627 - RNA, 23 nt, Chlamydophila pneumoniae TW-183
agaucaaguccucgccgcugccc

SEQ ID NO: 2569628 - RNA, 13 nt, Chlamydophila pneumoniae TW-183
agauccaaaaauu

SEQ ID NO: 2569629 - RNA, 14 nt, Chlamydophila pneumoniae TW-183
agauccugaaaaaa

SEQ ID NO: 2569630 - RNA, 15 nt, Chlamydophila pneumoniae TW-183
agaucgaucucugug

SEQ ID NO: 2569631 - RNA, 22 nt, Chlamydophila pneumoniae TW-183
agaucgaucucugugguuccug

SEQ ID NO: 2569632 - RNA, 20 nt, Chlamydophila pneumoniae TW-183
agaucgauuaccuaaaacaa

SEQ ID NO: 2569633 - RNA, 21 nt, Chlamydophila pneumoniae TW-183
agaucgauuaccuaaaacaaa

SEQ ID NO: 2569634 - RNA, 20 nt, Chlamydophila pneumoniae TW-183
agaucgggucuacaacaguu

SEQ ID NO: 2569635 - RNA, 11 nt, Chlamydophila pneumoniae TW-183
agaucucuaag

SEQ ID NO: 2569636 - RNA, 13 nt, Chlamydophila pneumoniae TW-183
agaucuucaucac

SEQ ID NO: 2569637 - RNA, 18 nt, Chlamydophila pneumoniae TW-183
agaugaauaccagaagca

SEQ ID NO: 2569638 - RNA, 23 nt, Chlamydophila pneumoniae TW-183
agaugaauaccagaagcaaaggu

SEQ ID NO: 2569639 - RNA, 15 nt, Chlamydophila pneumoniae TW-183
agaugcuaacaacuc

SEQ ID NO: 2569640 - RNA, 23 nt, Chlamydophila pneumoniae TW-183
agaugcuucuaaacaauuucaau

SEQ ID NO: 2569641 - RNA, 20 nt, Chlamydophila pneumoniae TW-183
agauuaccgaagagccccca

SEQ ID NO: 2569642 - RNA, 17 nt, Chlamydophila pneumoniae TW-183
agauuaugaugccucau

SEQ ID NO: 2569643 - RNA, 15 nt, Chlamydophila pneumoniae TW-183
agauucauaaaacug

SEQ ID NO: 2569644 - RNA, 16 nt, Chlamydophila pneumoniae TW-183
agauucuucagaaucu

SEQ ID NO: 2569645 - RNA, 17 nt, Chlamydophila pneumoniae TW-183
agauugaggauaaguuc

SEQ ID NO: 2569646 - RNA, 22 nt, Chlamydophila pneumoniae TW-183
agauugaggauaaguucuucca

SEQ ID NO: 2569647 - RNA, 19 nt, Chlamydophila pneumoniae TW-183
agauugccaggagagcuaa

SEQ ID NO: 2569648 - RNA, 14 nt, Chlamydophila pneumoniae TW-183
agauuuuuucuugg

SEQ ID NO: 2569649 - RNA, 17 nt, Chlamydophila pneumoniae TW-183
agcaaagguaaauugac

SEQ ID NO: 2569650 - RNA, 15 nt, Chlamydophila pneumoniae TW-183
agcaacccaagcuuu

SEQ ID NO: 2569651 - RNA, 14 nt, Chlamydophila pneumoniae TW-183
agcaacuaaacucu

SEQ ID NO: 2569652 - RNA, 22 nt, Chlamydophila pneumoniae TW-183
agcaacuucccgaacagcggca

SEQ ID NO: 2569653 - RNA, 23 nt, Chlamydophila pneumoniae TW-183
agcaaguuguugauaauuacaga

SEQ ID NO: 2569654 - RNA, 22 nt, Chlamydophila pneumoniae TW-183
agcacauacaguacgcaaagua

SEQ ID NO: 2569655 - RNA, 18 nt, Chlamydophila pneumoniae TW-183
agcaccuaauaaagaagg

SEQ ID NO: 2569656 - RNA, 17 nt, Chlamydophila pneumoniae TW-183
agcacgcacuaaucuau

SEQ ID NO: 2569657 - RNA, 15 nt, Chlamydophila pneumoniae TW-183
agcagaaacuccaaa

SEQ ID NO: 2569658 - RNA, 18 nt, Chlamydophila pneumoniae TW-183
agcagaaacuccaaaaua

SEQ ID NO: 2569659 - RNA, 18 nt, Chlamydophila pneumoniae TW-183
agcagaccucucccuugg

SEQ ID NO: 2569660 - RNA, 23 nt, Chlamydophila pneumoniae TW-183
agcagaccucucccuugggauuc

SEQ ID NO: 2569661 - RNA, 17 nt, Chlamydophila pneumoniae TW-183
agcagcuucgcaaucuu

SEQ ID NO: 2569662 - RNA, 21 nt, Chlamydophila pneumoniae TW-183
agcaggaguuuucaagucugu

SEQ ID NO: 2569663 - RNA, 20 nt, Chlamydophila pneumoniae TW-183
agcaggugugugguaaaaau

SEQ ID NO: 2569664 - RNA, 19 nt, Chlamydophila pneumoniae TW-183
agcauaaggauucugagaa

SEQ ID NO: 2569665 - RNA, 15 nt, Chlamydophila pneumoniae TW-183
agcauaaucuuuaac

SEQ ID NO: 2569666 - RNA, 17 nt, Chlamydophila pneumoniae TW-183
agcauccuguagagcaa

SEQ ID NO: 2569667 - RNA, 21 nt, Chlamydophila pneumoniae TW-183
agcauccuguagagcaagauu

SEQ ID NO: 2569668 - RNA, 19 nt, Chlamydophila pneumoniae TW-183
agcaucgcuuaacaaacuu

SEQ ID NO: 2569669 - RNA, 15 nt, Chlamydophila pneumoniae TW-183
agcauggacuccaag

SEQ ID NO: 2569670 - RNA, 17 nt, Chlamydophila pneumoniae TW-183
agcauggacuccaagaa

SEQ ID NO: 2569671 - RNA, 15 nt, Chlamydophila pneumoniae TW-183
agccacuaaguuuag

SEQ ID NO: 2569672 - RNA, 13 nt, Chlamydophila pneumoniae TW-183
agccccagcaacc

SEQ ID NO: 2569673 - RNA, 23 nt, Chlamydophila pneumoniae TW-183
agcccuagaguaaagaguagccc

SEQ ID NO: 2569674 - RNA, 21 nt, Chlamydophila pneumoniae TW-183
agccguaggguagccauccac

SEQ ID NO: 2569675 - RNA, 20 nt, Chlamydophila pneumoniae TW-183
agccuaugggaggaauuccu

SEQ ID NO: 2569676 - RNA, 14 nt, Chlamydophila pneumoniae TW-183
agccugcaccagac

SEQ ID NO: 2569677 - RNA, 15 nt, Chlamydophila pneumoniae TW-183
agcgaucacauagaa

SEQ ID NO: 2569678 - RNA, 19 nt, Chlamydophila pneumoniae TW-183
agcgaucacauagaaaaca

SEQ ID NO: 2569679 - RNA, 15 nt, Chlamydophila pneumoniae TW-183
agcguguauccaucu

SEQ ID NO: 2569680 - RNA, 18 nt, Chlamydophila pneumoniae TW-183
agcguuuuuugaaaauuu

SEQ ID NO: 2569681 - RNA, 19 nt, Chlamydophila pneumoniae TW-183
agcuaauaagauccaaaaa

SEQ ID NO: 2569682 - RNA, 18 nt, Chlamydophila pneumoniae TW-183
agcuaaucaauccaagaa

SEQ ID NO: 2569683 - RNA, 17 nt, Chlamydophila pneumoniae TW-183
agcuagucuuucuaaga

SEQ ID NO: 2569684 - RNA, 15 nt, Chlamydophila pneumoniae TW-183
agcuaugaugagaac

SEQ ID NO: 2569685 - RNA, 17 nt, Chlamydophila pneumoniae TW-183
agcuaugaugagaacgu

SEQ ID NO: 2569686 - RNA, 12 nt, Chlamydophila pneumoniae TW-183
agcuauuuuuga

SEQ ID NO: 2569687 - RNA, 14 nt, Chlamydophila pneumoniae TW-183
agcucaaaaaguuc

SEQ ID NO: 2569688 - RNA, 15 nt, Chlamydophila pneumoniae TW-183
agcucgaccucuagc

SEQ ID NO: 2569689 - RNA, 18 nt, Chlamydophila pneumoniae TW-183
agcucuagggguuucccu

SEQ ID NO: 2569690 - RNA, 13 nt, Chlamydophila pneumoniae TW-183
agcucuuugauuu

SEQ ID NO: 2569691 - RNA, 22 nt, Chlamydophila pneumoniae TW-183
agcucuuugauuuucuuagcuu

SEQ ID NO: 2569692 - RNA, 20 nt, Chlamydophila pneumoniae TW-183
agcucuuugggauaaaaagu

SEQ ID NO: 2569693 - RNA, 16 nt, Chlamydophila pneumoniae TW-183
agcugaaaucauggaa

SEQ ID NO: 2569694 - RNA, 15 nt, Chlamydophila pneumoniae TW-183
agcugcaaucucaaa

SEQ ID NO: 2569695 - RNA, 19 nt, Chlamydophila pneumoniae TW-183
agcugcaaucucaaaauca

SEQ ID NO: 2569696 - RNA, 12 nt, Chlamydophila pneumoniae TW-183
agcuggauucug

SEQ ID NO: 2569697 - RNA, 12 nt, Chlamydophila pneumoniae TW-183
agcugugcauuu

SEQ ID NO: 2569698 - RNA, 18 nt, Chlamydophila pneumoniae TW-183
agcuguggcgauuuuacu

SEQ ID NO: 2569699 - RNA, 13 nt, Chlamydophila pneumoniae TW-183
agcuucuugaugu

SEQ ID NO: 2569700 - RNA, 22 nt, Chlamydophila pneumoniae TW-183
agcuucuuguuuuuguggacaa

SEQ ID NO: 2569701 - RNA, 19 nt, Chlamydophila pneumoniae TW-183
agcuucuuuagauagcucu

SEQ ID NO: 2569702 - RNA, 14 nt, Chlamydophila pneumoniae TW-183
agcuugaaauaauu

SEQ ID NO: 2569703 - RNA, 13 nt, Chlamydophila pneumoniae TW-183
agcuugucacacu

SEQ ID NO: 2569704 - RNA, 22 nt, Chlamydophila pneumoniae TW-183
agcuuuccuccuuguuucccag

SEQ ID NO: 2569705 - RNA, 22 nt, Chlamydophila pneumoniae TW-183
agcuuuuuucucuugcuucaga

SEQ ID NO: 2569706 - RNA, 21 nt, Chlamydophila pneumoniae TW-183
aggaaacgauuucuucuucua

SEQ ID NO: 2569707 - RNA, 19 nt, Chlamydophila pneumoniae TW-183
aggaaauuacaaucucuag

SEQ ID NO: 2569708 - RNA, 19 nt, Chlamydophila pneumoniae TW-183
aggaacucuuuaaaagggc

SEQ ID NO: 2569709 - RNA, 14 nt, Chlamydophila pneumoniae TW-183
aggaaggaauagag

SEQ ID NO: 2569710 - RNA, 15 nt, Chlamydophila pneumoniae TW-183
aggaaggaauagaga

SEQ ID NO: 2569711 - RNA, 15 nt, Chlamydophila pneumoniae TW-183
aggaauagagaaaga

SEQ ID NO: 2569712 - RNA, 17 nt, Chlamydophila pneumoniae TW-183
aggaauagagaaagagu

SEQ ID NO: 2569713 - RNA, 21 nt, Chlamydophila pneumoniae TW-183
aggaaucauaaccaaaagaau

SEQ ID NO: 2569714 - RNA, 21 nt, Chlamydophila pneumoniae TW-183
aggaaucccugcacucuuuca

SEQ ID NO: 2569715 - RNA, 13 nt, Chlamydophila pneumoniae TW-183
aggaauuccucuc

SEQ ID NO: 2569716 - RNA, 16 nt, Chlamydophila pneumoniae TW-183
aggaauuccucucaca

SEQ ID NO: 2569717 - RNA, 15 nt, Chlamydophila pneumoniae TW-183
aggaauuuucagccu

SEQ ID NO: 2569718 - RNA, 13 nt, Chlamydophila pneumoniae TW-183
aggacaaaucucc

SEQ ID NO: 2569719 - RNA, 21 nt, Chlamydophila pneumoniae TW-183
aggacaaucaacauucuucug

SEQ ID NO: 2569720 - RNA, 16 nt, Chlamydophila pneumoniae TW-183
aggaccuguaguaaaa

SEQ ID NO: 2569721 - RNA, 21 nt, Chlamydophila pneumoniae TW-183
aggagauaaagauguagaaua

SEQ ID NO: 2569722 - RNA, 17 nt, Chlamydophila pneumoniae TW-183
aggagcgggauaggcaa

SEQ ID NO: 2569723 - RNA, 17 nt, Chlamydophila pneumoniae TW-183
aggagcucccuaagauu

SEQ ID NO: 2569724 - RNA, 18 nt, Chlamydophila pneumoniae TW-183
aggaguuuucaagucugu

SEQ ID NO: 2569725 - RNA, 20 nt, Chlamydophila pneumoniae TW-183
aggaguuuucaagucuguaa

SEQ ID NO: 2569726 - RNA, 12 nt, Chlamydophila pneumoniae TW-183
aggaguuuucca

SEQ ID NO: 2569727 - RNA, 18 nt, Chlamydophila pneumoniae TW-183
aggauaaguucuuccaaa

SEQ ID NO: 2569728 - RNA, 17 nt, Chlamydophila pneumoniae TW-183
aggauacgaauaaguuu

SEQ ID NO: 2569729 - RNA, 17 nt, Chlamydophila pneumoniae TW-183
aggauguuguggaucag

SEQ ID NO: 2569730 - RNA, 17 nt, Chlamydophila pneumoniae TW-183
aggauucucucugccua

SEQ ID NO: 2569731 - RNA, 23 nt, Chlamydophila pneumoniae TW-183
aggauucugagaaguuaagacaa

SEQ ID NO: 2569732 - RNA, 15 nt, Chlamydophila pneumoniae TW-183
aggauucuuuuugau

SEQ ID NO: 2569733 - RNA, 14 nt, Chlamydophila pneumoniae TW-183
aggcaaagauuucc

SEQ ID NO: 2569734 - RNA, 16 nt, Chlamydophila pneumoniae TW-183
aggcaagauuaugaug

SEQ ID NO: 2569735 - RNA, 23 nt, Chlamydophila pneumoniae TW-183
aggcacccaaacugaugccaaga

SEQ ID NO: 2569736 - RNA, 17 nt, Chlamydophila pneumoniae TW-183
aggcauggcacaguccu

SEQ ID NO: 2569737 - RNA, 16 nt, Chlamydophila pneumoniae TW-183
aggcauuggaaaucuu

SEQ ID NO: 2569738 - RNA, 15 nt, Chlamydophila pneumoniae TW-183
aggcuacugaagagg

SEQ ID NO: 2569739 - RNA, 18 nt, Chlamydophila pneumoniae TW-183
aggcucuacagcaaccac

SEQ ID NO: 2569740 - RNA, 21 nt, Chlamydophila pneumoniae TW-183
aggcuguccuugcagcccugc

SEQ ID NO: 2569741 - RNA, 15 nt, Chlamydophila pneumoniae TW-183
aggcuuguuucuguu

SEQ ID NO: 2569742 - RNA, 22 nt, Chlamydophila pneumoniae TW-183
agggaauuucauguccuccaug

SEQ ID NO: 2569743 - RNA, 23 nt, Chlamydophila pneumoniae TW-183
agggacagucuccuggaacagua

SEQ ID NO: 2569744 - RNA, 17 nt, Chlamydophila pneumoniae TW-183
agggagacucuugaggc

SEQ ID NO: 2569745 - RNA, 18 nt, Chlamydophila pneumoniae TW-183
agggcaaccauucaucua

SEQ ID NO: 2569746 - RNA, 13 nt, Chlamydophila pneumoniae TW-183
agggcauucucua

SEQ ID NO: 2569747 - RNA, 19 nt, Chlamydophila pneumoniae TW-183
agggcauucucuaaaugau

SEQ ID NO: 2569748 - RNA, 17 nt, Chlamydophila pneumoniae TW-183
agggggaucuucagaga

SEQ ID NO: 2569749 - RNA, 23 nt, Chlamydophila pneumoniae TW-183
agggggaucuucagagagaacag

SEQ ID NO: 2569750 - RNA, 23 nt, Chlamydophila pneumoniae TW-183
aggguagccauccacgaccugca

SEQ ID NO: 2569751 - RNA, 17 nt, Chlamydophila pneumoniae TW-183
agguaaaacuacaggaa

SEQ ID NO: 2569752 - RNA, 21 nt, Chlamydophila pneumoniae TW-183
agguaaccagagagcuuuuag

SEQ ID NO: 2569753 - RNA, 18 nt, Chlamydophila pneumoniae TW-183
agguaguccgcagauuuu

SEQ ID NO: 2569754 - RNA, 20 nt, Chlamydophila pneumoniae TW-183
agguaguccgcagauuuuaa

SEQ ID NO: 2569755 - RNA, 20 nt, Chlamydophila pneumoniae TW-183
aggucacagcauuuucucug

SEQ ID NO: 2569756 - RNA, 17 nt, Chlamydophila pneumoniae TW-183
aggucugcugaggagag

SEQ ID NO: 2569757 - RNA, 17 nt, Chlamydophila pneumoniae TW-183
aggucuuccaucucuuu

SEQ ID NO: 2569758 - RNA, 19 nt, Chlamydophila pneumoniae TW-183
aggucuuccaucucuuuaa

SEQ ID NO: 2569759 - RNA, 16 nt, Chlamydophila pneumoniae TW-183
agguggguagccagga

SEQ ID NO: 2569760 - RNA, 13 nt, Chlamydophila pneumoniae TW-183
agguucaccagaa

SEQ ID NO: 2569761 - RNA, 21 nt, Chlamydophila pneumoniae TW-183
agguuuuuccaacuucaacuu

SEQ ID NO: 2569762 - RNA, 20 nt, Chlamydophila pneumoniae TW-183
aguaaagaaauucuggaguc

SEQ ID NO: 2569763 - RNA, 14 nt, Chlamydophila pneumoniae TW-183
aguaccaagaaaau

SEQ ID NO: 2569764 - RNA, 15 nt, Chlamydophila pneumoniae TW-183
aguaccaagaaaaua

SEQ ID NO: 2569765 - RNA, 18 nt, Chlamydophila pneumoniae TW-183
aguaccaagaaaauagua

SEQ ID NO: 2569766 - RNA, 15 nt, Chlamydophila pneumoniae TW-183
aguacccagucaucg

SEQ ID NO: 2569767 - RNA, 19 nt, Chlamydophila pneumoniae TW-183
aguaccgaccgaaucucuc

SEQ ID NO: 2569768 - RNA, 17 nt, Chlamydophila pneumoniae TW-183
aguagcauccuguagag

SEQ ID NO: 2569769 - RNA, 13 nt, Chlamydophila pneumoniae TW-183
aguaggagcagcg

SEQ ID NO: 2569770 - RNA, 22 nt, Chlamydophila pneumoniae TW-183
aguauaauagugagcucccuga

SEQ ID NO: 2569771 - RNA, 13 nt, Chlamydophila pneumoniae TW-183
aguauaaucagaa

SEQ ID NO: 2569772 - RNA, 15 nt, Chlamydophila pneumoniae TW-183
aguauccuuucauca

SEQ ID NO: 2569773 - RNA, 17 nt, Chlamydophila pneumoniae TW-183
aguaucgggauuuuguc

SEQ ID NO: 2569774 - RNA, 23 nt, Chlamydophila pneumoniae TW-183
aguaucgggauuuugucgagaac

SEQ ID NO: 2569775 - RNA, 16 nt, Chlamydophila pneumoniae TW-183
aguaucuaaaacuucu

SEQ ID NO: 2569776 - RNA, 17 nt, Chlamydophila pneumoniae TW-183
aguaucuaaaacuucuu

SEQ ID NO: 2569777 - RNA, 12 nt, Chlamydophila pneumoniae TW-183
aguaucuacuuu

SEQ ID NO: 2569778 - RNA, 12 nt, Chlamydophila pneumoniae TW-183
agucaaacauca

SEQ ID NO: 2569779 - RNA, 18 nt, Chlamydophila pneumoniae TW-183
agucauacauuugauuca

SEQ ID NO: 2569780 - RNA, 22 nt, Chlamydophila pneumoniae TW-183
agucaugauuuuucaaucaaua

SEQ ID NO: 2569781 - RNA, 15 nt, Chlamydophila pneumoniae TW-183
aguccagacuuuccu

SEQ ID NO: 2569782 - RNA, 15 nt, Chlamydophila pneumoniae TW-183
aguccugauuuuuca

SEQ ID NO: 2569783 - RNA, 22 nt, Chlamydophila pneumoniae TW-183
aguccuucuucccagccuugau

SEQ ID NO: 2569784 - RNA, 15 nt, Chlamydophila pneumoniae TW-183
agucguuaacaucaa

SEQ ID NO: 2569785 - RNA, 17 nt, Chlamydophila pneumoniae TW-183
agucuuucuaagaagac

SEQ ID NO: 2569786 - RNA, 19 nt, Chlamydophila pneumoniae TW-183
agugaucuugagaaaagaa

SEQ ID NO: 2569787 - RNA, 15 nt, Chlamydophila pneumoniae TW-183
agugcuuucaggagu

SEQ ID NO: 2569788 - RNA, 20 nt, Chlamydophila pneumoniae TW-183
aguggccgcuauuuaugagg

SEQ ID NO: 2569789 - RNA, 13 nt, Chlamydophila pneumoniae TW-183
aguggcgacugca

SEQ ID NO: 2569790 - RNA, 23 nt, Chlamydophila pneumoniae TW-183
aguguaacauugaccuaaaggaa

SEQ ID NO: 2569791 - RNA, 17 nt, Chlamydophila pneumoniae TW-183
agugucauacgcagcac

SEQ ID NO: 2569792 - RNA, 20 nt, Chlamydophila pneumoniae TW-183
agugucauacgcagcacgca

SEQ ID NO: 2569793 - RNA, 21 nt, Chlamydophila pneumoniae TW-183
agugugguuuaccuuguuuuc

SEQ ID NO: 2569794 - RNA, 18 nt, Chlamydophila pneumoniae TW-183
aguguugccagcccaugu

SEQ ID NO: 2569795 - RNA, 16 nt, Chlamydophila pneumoniae TW-183
aguuaaagagcauccu

SEQ ID NO: 2569796 - RNA, 19 nt, Chlamydophila pneumoniae TW-183
aguuacgcgaccucuguag

SEQ ID NO: 2569797 - RNA, 20 nt, Chlamydophila pneumoniae TW-183
aguuagauguaaucauaaaa

SEQ ID NO: 2569798 - RNA, 15 nt, Chlamydophila pneumoniae TW-183
aguucucucuucacu

SEQ ID NO: 2569799 - RNA, 14 nt, Chlamydophila pneumoniae TW-183
aguucuuaagaauc

SEQ ID NO: 2569800 - RNA, 18 nt, Chlamydophila pneumoniae TW-183
aguucuucauugcagaua

SEQ ID NO: 2569801 - RNA, 18 nt, Chlamydophila pneumoniae TW-183
aguucuugauucucuucc

SEQ ID NO: 2569802 - RNA, 19 nt, Chlamydophila pneumoniae TW-183
aguucuuguaauaaaagaa

SEQ ID NO: 2569803 - RNA, 12 nt, Chlamydophila pneumoniae TW-183
aguugaaaugag

SEQ ID NO: 2569804 - RNA, 22 nt, Chlamydophila pneumoniae TW-183
aguugagaaccuucacaagaaa

SEQ ID NO: 2569805 - RNA, 20 nt, Chlamydophila pneumoniae TW-183
aguuugauagagaaaauaag

SEQ ID NO: 2569806 - RNA, 19 nt, Chlamydophila pneumoniae TW-183
aguuuucgauacacaagau

SEQ ID NO: 2569807 - RNA, 14 nt, Chlamydophila pneumoniae TW-183
auaaaaaaacccuc

SEQ ID NO: 2569808 - RNA, 22 nt, Chlamydophila pneumoniae TW-183
auaaaacgcuauuguuuguccu

SEQ ID NO: 2569809 - RNA, 17 nt, Chlamydophila pneumoniae TW-183
auaaaagagcucaaaaa

SEQ ID NO: 2569810 - RNA, 16 nt, Chlamydophila pneumoniae TW-183
auaaagaagguugaga

SEQ ID NO: 2569811 - RNA, 16 nt, Chlamydophila pneumoniae TW-183
auaaagacaucucuuu

SEQ ID NO: 2569812 - RNA, 12 nt, Chlamydophila pneumoniae TW-183
auaaagaggcuc

SEQ ID NO: 2569813 - RNA, 15 nt, Chlamydophila pneumoniae TW-183
auaaagcaaaugccu

SEQ ID NO: 2569814 - RNA, 20 nt, Chlamydophila pneumoniae TW-183
auaaaggaccuguuuucuuu

SEQ ID NO: 2569815 - RNA, 23 nt, Chlamydophila pneumoniae TW-183
auaacagagauggucuuggguuu

SEQ ID NO: 2569816 - RNA, 15 nt, Chlamydophila pneumoniae TW-183
auaaccaaaagaauu

SEQ ID NO: 2569817 - RNA, 21 nt, Chlamydophila pneumoniae TW-183
auaaccaaaagaauuaagaag

SEQ ID NO: 2569818 - RNA, 15 nt, Chlamydophila pneumoniae TW-183
auaaccuaaggcaug

SEQ ID NO: 2569819 - RNA, 21 nt, Chlamydophila pneumoniae TW-183
auaaccuuugacaacaccaca

SEQ ID NO: 2569820 - RNA, 20 nt, Chlamydophila pneumoniae TW-183
auaacuugagccaacagguu

SEQ ID NO: 2569821 - RNA, 13 nt, Chlamydophila pneumoniae TW-183
auaacuuuagaug

SEQ ID NO: 2569822 - RNA, 15 nt, Chlamydophila pneumoniae TW-183
auaacuuuagaugga

SEQ ID NO: 2569823 - RNA, 20 nt, Chlamydophila pneumoniae TW-183
auaacuuugcaugaggagac

SEQ ID NO: 2569824 - RNA, 17 nt, Chlamydophila pneumoniae TW-183
auaagauaaagaauucu

SEQ ID NO: 2569825 - RNA, 14 nt, Chlamydophila pneumoniae TW-183
auaagauccaaaaa

SEQ ID NO: 2569826 - RNA, 15 nt, Chlamydophila pneumoniae TW-183
auaagauccaaaaau

SEQ ID NO: 2569827 - RNA, 18 nt, Chlamydophila pneumoniae TW-183
auaagauccaaaaauucu

SEQ ID NO: 2569828 - RNA, 14 nt, Chlamydophila pneumoniae TW-183
auaagauuuugaaa

SEQ ID NO: 2569829 - RNA, 21 nt, Chlamydophila pneumoniae TW-183
auaaggauguuguggaucaga

SEQ ID NO: 2569830 - RNA, 19 nt, Chlamydophila pneumoniae TW-183
auaaggauucugagaaguu

SEQ ID NO: 2569831 - RNA, 18 nt, Chlamydophila pneumoniae TW-183
auaagggggaucuucaga

SEQ ID NO: 2569832 - RNA, 23 nt, Chlamydophila pneumoniae TW-183
auaagggggaucuucagagagaa

SEQ ID NO: 2569833 - RNA, 16 nt, Chlamydophila pneumoniae TW-183
auaagugacuuuucuu

SEQ ID NO: 2569834 - RNA, 19 nt, Chlamydophila pneumoniae TW-183
auaagugacuuuucuucuu

SEQ ID NO: 2569835 - RNA, 11 nt, Chlamydophila pneumoniae TW-183
auaaguucuuc

SEQ ID NO: 2569836 - RNA, 13 nt, Chlamydophila pneumoniae TW-183
auaaguucuucca

SEQ ID NO: 2569837 - RNA, 15 nt, Chlamydophila pneumoniae TW-183
auaauaaaagcaccc

SEQ ID NO: 2569838 - RNA, 14 nt, Chlamydophila pneumoniae TW-183
auaauagugagcuc

SEQ ID NO: 2569839 - RNA, 14 nt, Chlamydophila pneumoniae TW-183
auaaucuauaggau

SEQ ID NO: 2569840 - RNA, 15 nt, Chlamydophila pneumoniae TW-183
auaaucucaccagaa

SEQ ID NO: 2569841 - RNA, 15 nt, Chlamydophila pneumoniae TW-183
auaaugguacaauac

SEQ ID NO: 2569842 - RNA, 12 nt, Chlamydophila pneumoniae TW-183
auaauuaaacuc

SEQ ID NO: 2569843 - RNA, 14 nt, Chlamydophila pneumoniae TW-183
auaccagaagcaaa

SEQ ID NO: 2569844 - RNA, 16 nt, Chlamydophila pneumoniae TW-183
auaccguuuuaggaag

SEQ ID NO: 2569845 - RNA, 18 nt, Chlamydophila pneumoniae TW-183
auaccuccuccaaucugc

SEQ ID NO: 2569846 - RNA, 22 nt, Chlamydophila pneumoniae TW-183
auaccuucaacaagaauaacuu

SEQ ID NO: 2569847 - RNA, 19 nt, Chlamydophila pneumoniae TW-183
auacgccaaggucuucccg

SEQ ID NO: 2569848 - RNA, 15 nt, Chlamydophila pneumoniae TW-183
auacuacucucauca

SEQ ID NO: 2569849 - RNA, 18 nt, Chlamydophila pneumoniae TW-183
auacuguuaacaaguacc

SEQ ID NO: 2569850 - RNA, 23 nt, Chlamydophila pneumoniae TW-183
auacuuuaggaggggggauucug

SEQ ID NO: 2569851 - RNA, 17 nt, Chlamydophila pneumoniae TW-183
auacuuuuccuacaacg

SEQ ID NO: 2569852 - RNA, 16 nt, Chlamydophila pneumoniae TW-183
auagaaaacauauccc

SEQ ID NO: 2569853 - RNA, 15 nt, Chlamydophila pneumoniae TW-183
auagaaaaucuuguu

SEQ ID NO: 2569854 - RNA, 22 nt, Chlamydophila pneumoniae TW-183
auagaaauucuguagauacuau

SEQ ID NO: 2569855 - RNA, 15 nt, Chlamydophila pneumoniae TW-183
auagaagaucauuaa

SEQ ID NO: 2569856 - RNA, 17 nt, Chlamydophila pneumoniae TW-183
auagaauacacagcuau

SEQ ID NO: 2569857 - RNA, 14 nt, Chlamydophila pneumoniae TW-183
auagaauagaaugu

SEQ ID NO: 2569858 - RNA, 19 nt, Chlamydophila pneumoniae TW-183
auagacucuggcauagcua

SEQ ID NO: 2569859 - RNA, 18 nt, Chlamydophila pneumoniae TW-183
auagagagcgcagagucu

SEQ ID NO: 2569860 - RNA, 14 nt, Chlamydophila pneumoniae TW-183
auagagauucuaca

SEQ ID NO: 2569861 - RNA, 17 nt, Chlamydophila pneumoniae TW-183
auagagccuagagaguu

SEQ ID NO: 2569862 - RNA, 17 nt, Chlamydophila pneumoniae TW-183
auagaguaucuaaaacu

SEQ ID NO: 2569863 - RNA, 20 nt, Chlamydophila pneumoniae TW-183
auagaguaucuaaaacuucu

SEQ ID NO: 2569864 - RNA, 22 nt, Chlamydophila pneumoniae TW-183
auagauagggccgugaagcaga

SEQ ID NO: 2569865 - RNA, 18 nt, Chlamydophila pneumoniae TW-183
auagauaucuuugggaga

SEQ ID NO: 2569866 - RNA, 13 nt, Chlamydophila pneumoniae TW-183
auagauaugccuc

SEQ ID NO: 2569867 - RNA, 14 nt, Chlamydophila pneumoniae TW-183
auagauaugccuca

SEQ ID NO: 2569868 - RNA, 12 nt, Chlamydophila pneumoniae TW-183
auagaucucuug

SEQ ID NO: 2569869 - RNA, 23 nt, Chlamydophila pneumoniae TW-183
auagcaggaaggaauagagaaag

SEQ ID NO: 2569870 - RNA, 13 nt, Chlamydophila pneumoniae TW-183
auagcagucuugc

SEQ ID NO: 2569871 - RNA, 21 nt, Chlamydophila pneumoniae TW-183
auagccucgagcagaaacucc

SEQ ID NO: 2569872 - RNA, 23 nt, Chlamydophila pneumoniae TW-183
auagccuuccauaucuagaaguu

SEQ ID NO: 2569873 - RNA, 14 nt, Chlamydophila pneumoniae TW-183
auagcuuugaagag

SEQ ID NO: 2569874 - RNA, 17 nt, Chlamydophila pneumoniae TW-183
auagcuuuggaacgugc

SEQ ID NO: 2569875 - RNA, 15 nt, Chlamydophila pneumoniae TW-183
auaggauccaggagu

SEQ ID NO: 2569876 - RNA, 17 nt, Chlamydophila pneumoniae TW-183
auaggcuuuaccauaga

SEQ ID NO: 2569877 - RNA, 16 nt, Chlamydophila pneumoniae TW-183
auaguuaaauuuccaa

SEQ ID NO: 2569878 - RNA, 19 nt, Chlamydophila pneumoniae TW-183
auaguuaaauuuccaaaga

SEQ ID NO: 2569879 - RNA, 19 nt, Chlamydophila pneumoniae TW-183
auauaaaugcuauuuuccu

SEQ ID NO: 2569880 - RNA, 15 nt, Chlamydophila pneumoniae TW-183
auauaauacgucuca

SEQ ID NO: 2569881 - RNA, 22 nt, Chlamydophila pneumoniae TW-183
auauaauacgucucaucgcuuu

SEQ ID NO: 2569882 - RNA, 22 nt, Chlamydophila pneumoniae TW-183
auauacugccagcgaucacaua

SEQ ID NO: 2569883 - RNA, 20 nt, Chlamydophila pneumoniae TW-183
auauagagagcgcagagucu

SEQ ID NO: 2569884 - RNA, 22 nt, Chlamydophila pneumoniae TW-183
auauagguuuagauugccuuug

SEQ ID NO: 2569885 - RNA, 13 nt, Chlamydophila pneumoniae TW-183
auaucagcuucuu

SEQ ID NO: 2569886 - RNA, 19 nt, Chlamydophila pneumoniae TW-183
auaucagcuucuugaugua

SEQ ID NO: 2569887 - RNA, 14 nt, Chlamydophila pneumoniae TW-183
auaucaucacuaag

SEQ ID NO: 2569888 - RNA, 12 nt, Chlamydophila pneumoniae TW-183
auauccagaaau

SEQ ID NO: 2569889 - RNA, 19 nt, Chlamydophila pneumoniae TW-183
auauccauaagaucucuaa

SEQ ID NO: 2569890 - RNA, 20 nt, Chlamydophila pneumoniae TW-183
auauccguauggauuucucc

SEQ ID NO: 2569891 - RNA, 22 nt, Chlamydophila pneumoniae TW-183
auaucgccuuccuuaacaacau

SEQ ID NO: 2569892 - RNA, 15 nt, Chlamydophila pneumoniae TW-183
auaucuuugggagau

SEQ ID NO: 2569893 - RNA, 13 nt, Chlamydophila pneumoniae TW-183
auaugaagagacg

SEQ ID NO: 2569894 - RNA, 19 nt, Chlamydophila pneumoniae TW-183
auaugcuuggcaauagcuu

SEQ ID NO: 2569895 - RNA, 23 nt, Chlamydophila pneumoniae TW-183
auauggguguaaauuuuuccuuc

SEQ ID NO: 2569896 - RNA, 17 nt, Chlamydophila pneumoniae TW-183
auauucuuucaaaccac

SEQ ID NO: 2569897 - RNA, 17 nt, Chlamydophila pneumoniae TW-183
auauugucaagaggcug

SEQ ID NO: 2569898 - RNA, 18 nt, Chlamydophila pneumoniae TW-183
auauugucaagaggcugu

SEQ ID NO: 2569899 - RNA, 16 nt, Chlamydophila pneumoniae TW-183
aucaaauagauuuuua

SEQ ID NO: 2569900 - RNA, 15 nt, Chlamydophila pneumoniae TW-183
aucaacauucuucug

SEQ ID NO: 2569901 - RNA, 22 nt, Chlamydophila pneumoniae TW-183
aucaacauucuucugucuguau

SEQ ID NO: 2569902 - RNA, 15 nt, Chlamydophila pneumoniae TW-183
aucaagagcucguaa

SEQ ID NO: 2569903 - RNA, 21 nt, Chlamydophila pneumoniae TW-183
aucaagagcucguaauccuuc

SEQ ID NO: 2569904 - RNA, 22 nt, Chlamydophila pneumoniae TW-183
aucacacuuaaagguaaaacua

SEQ ID NO: 2569905 - RNA, 15 nt, Chlamydophila pneumoniae TW-183
aucacauagaaaaca

SEQ ID NO: 2569906 - RNA, 17 nt, Chlamydophila pneumoniae TW-183
aucacauagaaaacaua

SEQ ID NO: 2569907 - RNA, 15 nt, Chlamydophila pneumoniae TW-183
aucacguccuucuau

SEQ ID NO: 2569908 - RNA, 20 nt, Chlamydophila pneumoniae TW-183
aucagaaaaaaugcguuuug

SEQ ID NO: 2569909 - RNA, 18 nt, Chlamydophila pneumoniae TW-183
aucagaagccaccaaaaa

SEQ ID NO: 2569910 - RNA, 22 nt, Chlamydophila pneumoniae TW-183
aucagaagccaccaaaaauucc

SEQ ID NO: 2569911 - RNA, 23 nt, Chlamydophila pneumoniae TW-183
aucagcuucuugauguacaguaa

SEQ ID NO: 2569912 - RNA, 17 nt, Chlamydophila pneumoniae TW-183
aucauaaccaaaagaau

SEQ ID NO: 2569913 - RNA, 13 nt, Chlamydophila pneumoniae TW-183
aucauaucuucaa

SEQ ID NO: 2569914 - RNA, 12 nt, Chlamydophila pneumoniae TW-183
aucauauuuuuc

SEQ ID NO: 2569915 - RNA, 17 nt, Chlamydophila pneumoniae TW-183
aucauauuuuucuugaa

SEQ ID NO: 2569916 - RNA, 20 nt, Chlamydophila pneumoniae TW-183
aucauggacaagcaaaagca

SEQ ID NO: 2569917 - RNA, 19 nt, Chlamydophila pneumoniae TW-183
aucauuaaggugugcuccu

SEQ ID NO: 2569918 - RNA, 13 nt, Chlamydophila pneumoniae TW-183
aucauuuuugcua

SEQ ID NO: 2569919 - RNA, 14 nt, Chlamydophila pneumoniae TW-183
auccaagaauagcc

SEQ ID NO: 2569920 - RNA, 17 nt, Chlamydophila pneumoniae TW-183
auccaagaauagccaua

SEQ ID NO: 2569921 - RNA, 17 nt, Chlamydophila pneumoniae TW-183
auccaucggcauuucuc

SEQ ID NO: 2569922 - RNA, 21 nt, Chlamydophila pneumoniae TW-183
auccaucggcauuucuccaca

SEQ ID NO: 2569923 - RNA, 21 nt, Chlamydophila pneumoniae TW-183
aucccgccuuucuacccuucc

SEQ ID NO: 2569924 - RNA, 17 nt, Chlamydophila pneumoniae TW-183
aucccugcacucuuuca

SEQ ID NO: 2569925 - RNA, 23 nt, Chlamydophila pneumoniae TW-183
aucccugcacucuuucagaaaga

SEQ ID NO: 2569926 - RNA, 18 nt, Chlamydophila pneumoniae TW-183
aucccuguaguuucuaaa

SEQ ID NO: 2569927 - RNA, 18 nt, Chlamydophila pneumoniae TW-183
auccgaagacucaaagaa

SEQ ID NO: 2569928 - RNA, 22 nt, Chlamydophila pneumoniae TW-183
auccguagugagguuugcaauu

SEQ ID NO: 2569929 - RNA, 15 nt, Chlamydophila pneumoniae TW-183
auccuggagcaugag

SEQ ID NO: 2569930 - RNA, 14 nt, Chlamydophila pneumoniae TW-183
auccuugcaaaaca

SEQ ID NO: 2569931 - RNA, 16 nt, Chlamydophila pneumoniae TW-183
auccuugcaaaacagc

SEQ ID NO: 2569932 - RNA, 19 nt, Chlamydophila pneumoniae TW-183
auccuugcaaaacagcauc

SEQ ID NO: 2569933 - RNA, 15 nt, Chlamydophila pneumoniae TW-183
aucgaccuuaaaauu

SEQ ID NO: 2569934 - RNA, 23 nt, Chlamydophila pneumoniae TW-183
aucgaucucugugguuccuggau

SEQ ID NO: 2569935 - RNA, 17 nt, Chlamydophila pneumoniae TW-183
aucgauuaccuaaaaca

SEQ ID NO: 2569936 - RNA, 18 nt, Chlamydophila pneumoniae TW-183
aucgccuuccuuaacaac

SEQ ID NO: 2569937 - RNA, 16 nt, Chlamydophila pneumoniae TW-183
aucguacuucacuucu

SEQ ID NO: 2569938 - RNA, 15 nt, Chlamydophila pneumoniae TW-183
aucguuaucaaaagg

SEQ ID NO: 2569939 - RNA, 17 nt, Chlamydophila pneumoniae TW-183
aucuaaauaagauuuua

SEQ ID NO: 2569940 - RNA, 17 nt, Chlamydophila pneumoniae TW-183
aucuacgauguuuucuu

SEQ ID NO: 2569941 - RNA, 20 nt, Chlamydophila pneumoniae TW-183
aucuagagaagaaaagagcu

SEQ ID NO: 2569942 - RNA, 19 nt, Chlamydophila pneumoniae TW-183
aucuauagaauuuccaauc

SEQ ID NO: 2569943 - RNA, 15 nt, Chlamydophila pneumoniae TW-183
aucuaugagaguaag

SEQ ID NO: 2569944 - RNA, 12 nt, Chlamydophila pneumoniae TW-183
aucuauuuagaa

SEQ ID NO: 2569945 - RNA, 16 nt, Chlamydophila pneumoniae TW-183
aucucaaaaucaaaua

SEQ ID NO: 2569946 - RNA, 17 nt, Chlamydophila pneumoniae TW-183
aucucauuccagcaucu

SEQ ID NO: 2569947 - RNA, 14 nt, Chlamydophila pneumoniae TW-183
aucuccucaucaga

SEQ ID NO: 2569948 - RNA, 15 nt, Chlamydophila pneumoniae TW-183
aucuccucaucagaa

SEQ ID NO: 2569949 - RNA, 22 nt, Chlamydophila pneumoniae TW-183
aucucuaaguucuugauuuuca

SEQ ID NO: 2569950 - RNA, 21 nt, Chlamydophila pneumoniae TW-183
aucucuagggauaauuaaacu

SEQ ID NO: 2569951 - RNA, 13 nt, Chlamydophila pneumoniae TW-183
aucucuccucccc

SEQ ID NO: 2569952 - RNA, 22 nt, Chlamydophila pneumoniae TW-183
aucucugacuugcaagcuucuu

SEQ ID NO: 2569953 - RNA, 16 nt, Chlamydophila pneumoniae TW-183
aucucugugguuccug

SEQ ID NO: 2569954 - RNA, 16 nt, Chlamydophila pneumoniae TW-183
aucucuugaagcacuu

SEQ ID NO: 2569955 - RNA, 15 nt, Chlamydophila pneumoniae TW-183
aucucuuuaaauguu

SEQ ID NO: 2569956 - RNA, 13 nt, Chlamydophila pneumoniae TW-183
aucucuuuaacuu

SEQ ID NO: 2569957 - RNA, 13 nt, Chlamydophila pneumoniae TW-183
aucugccauagga

SEQ ID NO: 2569958 - RNA, 13 nt, Chlamydophila pneumoniae TW-183
aucugguagagaa

SEQ ID NO: 2569959 - RNA, 18 nt, Chlamydophila pneumoniae TW-183
aucuguaguaggcacuua

SEQ ID NO: 2569960 - RNA, 15 nt, Chlamydophila pneumoniae TW-183
aucuucaagaccacu

SEQ ID NO: 2569961 - RNA, 16 nt, Chlamydophila pneumoniae TW-183
aucuucagagagaaca

SEQ ID NO: 2569962 - RNA, 17 nt, Chlamydophila pneumoniae TW-183
aucuuccccuaaaaauu

SEQ ID NO: 2569963 - RNA, 22 nt, Chlamydophila pneumoniae TW-183
aucuucuucuggcugagagaag

SEQ ID NO: 2569964 - RNA, 14 nt, Chlamydophila pneumoniae TW-183
aucuugagaaaaga

SEQ ID NO: 2569965 - RNA, 16 nt, Chlamydophila pneumoniae TW-183
aucuugagaaaagaac

SEQ ID NO: 2569966 - RNA, 11 nt, Chlamydophila pneumoniae TW-183
aucuuguugua

SEQ ID NO: 2569967 - RNA, 17 nt, Chlamydophila pneumoniae TW-183
aucuuuuuaauaaaggg

SEQ ID NO: 2569968 - RNA, 21 nt, Chlamydophila pneumoniae TW-183
augaaagugcucuuuuaacuu

SEQ ID NO: 2569969 - RNA, 20 nt, Chlamydophila pneumoniae TW-183
augaauaccagaagcaaagg

SEQ ID NO: 2569970 - RNA, 14 nt, Chlamydophila pneumoniae TW-183
augagaguaaguuu

SEQ ID NO: 2569971 - RNA, 22 nt, Chlamydophila pneumoniae TW-183
augagggagcgaaguuuuucug

SEQ ID NO: 2569972 - RNA, 13 nt, Chlamydophila pneumoniae TW-183
augauaucagcau

SEQ ID NO: 2569973 - RNA, 16 nt, Chlamydophila pneumoniae TW-183
augaucuuagcuccug

SEQ ID NO: 2569974 - RNA, 18 nt, Chlamydophila pneumoniae TW-183
augaugagaacguccuca

SEQ ID NO: 2569975 - RNA, 22 nt, Chlamydophila pneumoniae TW-183
augauuucuuuagcuuuauuga

SEQ ID NO: 2569976 - RNA, 23 nt, Chlamydophila pneumoniae TW-183
augcaaaacaacaucacuaucau

SEQ ID NO: 2569977 - RNA, 14 nt, Chlamydophila pneumoniae TW-183
augcaagugcuuuc

SEQ ID NO: 2569978 - RNA, 15 nt, Chlamydophila pneumoniae TW-183
augcaucaaugaagu

SEQ ID NO: 2569979 - RNA, 22 nt, Chlamydophila pneumoniae TW-183
augcauucugauccgaaaagaa

SEQ ID NO: 2569980 - RNA, 21 nt, Chlamydophila pneumoniae TW-183
augccuauuaagucaccuuaa

SEQ ID NO: 2569981 - RNA, 15 nt, Chlamydophila pneumoniae TW-183
augccucaggucugc

SEQ ID NO: 2569982 - RNA, 23 nt, Chlamydophila pneumoniae TW-183
augccucaggucugcugaggaga

SEQ ID NO: 2569983 - RNA, 18 nt, Chlamydophila pneumoniae TW-183
augcgcagcucggaugga

SEQ ID NO: 2569984 - RNA, 17 nt, Chlamydophila pneumoniae TW-183
augcuauuuuccucuau

SEQ ID NO: 2569985 - RNA, 15 nt, Chlamydophila pneumoniae TW-183
augcuuggcaauagc

SEQ ID NO: 2569986 - RNA, 14 nt, Chlamydophila pneumoniae TW-183
auggacaagcaaaa

SEQ ID NO: 2569987 - RNA, 15 nt, Chlamydophila pneumoniae TW-183
auggaucccuguagu

SEQ ID NO: 2569988 - RNA, 20 nt, Chlamydophila pneumoniae TW-183
auggauuucuccagcagcuu

SEQ ID NO: 2569989 - RNA, 16 nt, Chlamydophila pneumoniae TW-183
auggcucaacuuaagu

SEQ ID NO: 2569990 - RNA, 13 nt, Chlamydophila pneumoniae TW-183
auggucuuccccc

SEQ ID NO: 2569991 - RNA, 14 nt, Chlamydophila pneumoniae TW-183
auguaagaauguag

SEQ ID NO: 2569992 - RNA, 19 nt, Chlamydophila pneumoniae TW-183
auguaaucccagauuuuuu

SEQ ID NO: 2569993 - RNA, 23 nt, Chlamydophila pneumoniae TW-183
auguaucggggauugcaaaauuu

SEQ ID NO: 2569994 - RNA, 23 nt, Chlamydophila pneumoniae TW-183
auguauggugcgcgucuccuuga

SEQ ID NO: 2569995 - RNA, 20 nt, Chlamydophila pneumoniae TW-183
auguccuccauggaaagaaa

SEQ ID NO: 2569996 - RNA, 17 nt, Chlamydophila pneumoniae TW-183
augucgcuaccauaucu

SEQ ID NO: 2569997 - RNA, 20 nt, Chlamydophila pneumoniae TW-183
augucucuuaaaaaaaauua

SEQ ID NO: 2569998 - RNA, 22 nt, Chlamydophila pneumoniae TW-183
augucucuuaaaaaaaauuacu

SEQ ID NO: 2569999 - RNA, 20 nt, Chlamydophila pneumoniae TW-183
auguuuguaguguugaauaa

SEQ ID NO: 2570000 - RNA, 21 nt, Chlamydophila pneumoniae TW-183
auguuuguaguguugaauaag

SEQ ID NO: 2570001 - RNA, 22 nt, Chlamydophila pneumoniae TW-183
auguuuguaguguugaauaaga

SEQ ID NO: 2570002 - RNA, 18 nt, Chlamydophila pneumoniae TW-183
auuaaaucguacuucacu

SEQ ID NO: 2570003 - RNA, 12 nt, Chlamydophila pneumoniae TW-183
auuaacuuuaua

SEQ ID NO: 2570004 - RNA, 15 nt, Chlamydophila pneumoniae TW-183
auuaagaauggaugu

SEQ ID NO: 2570005 - RNA, 16 nt, Chlamydophila pneumoniae TW-183
auuaagaggaaagcau

SEQ ID NO: 2570006 - RNA, 22 nt, Chlamydophila pneumoniae TW-183
auuaaggcuccagcauaaggau

SEQ ID NO: 2570007 - RNA, 22 nt, Chlamydophila pneumoniae TW-183
auuacagcaucuauagaauuuc

SEQ ID NO: 2570008 - RNA, 15 nt, Chlamydophila pneumoniae TW-183
auuaccuaaaacaaa

SEQ ID NO: 2570009 - RNA, 19 nt, Chlamydophila pneumoniae TW-183
auuaccuaaaacaaaauca

SEQ ID NO: 2570010 - RNA, 18 nt, Chlamydophila pneumoniae TW-183
auucacaaaucuuccccu

SEQ ID NO: 2570011 - RNA, 18 nt, Chlamydophila pneumoniae TW-183
auucaggauacucugaac

SEQ ID NO: 2570012 - RNA, 17 nt, Chlamydophila pneumoniae TW-183
auucauaaagaggaaug

SEQ ID NO: 2570013 - RNA, 13 nt, Chlamydophila pneumoniae TW-183
auucaugcaaaac

SEQ ID NO: 2570014 - RNA, 14 nt, Chlamydophila pneumoniae TW-183
auuccagcaucuuc

SEQ ID NO: 2570015 - RNA, 19 nt, Chlamydophila pneumoniae TW-183
auuccagcaucuucucgaa

SEQ ID NO: 2570016 - RNA, 15 nt, Chlamydophila pneumoniae TW-183
auuccccuucaucaa

SEQ ID NO: 2570017 - RNA, 20 nt, Chlamydophila pneumoniae TW-183
auuccugaggcuauagaaua

SEQ ID NO: 2570018 - RNA, 17 nt, Chlamydophila pneumoniae TW-183
auuccuuaaugguagcu

SEQ ID NO: 2570019 - RNA, 19 nt, Chlamydophila pneumoniae TW-183
auucgauuccugaggcuau

SEQ ID NO: 2570020 - RNA, 22 nt, Chlamydophila pneumoniae TW-183
auucggcagaaggcuuguuucu

SEQ ID NO: 2570021 - RNA, 18 nt, Chlamydophila pneumoniae TW-183
auucuaagcgcucuucaa

SEQ ID NO: 2570022 - RNA, 12 nt, Chlamydophila pneumoniae TW-183
caaguaaagaaa

SEQ ID NO: 2570023 - RNA, 12 nt, Chlamydophila pneumoniae TW-183
caagucuguaag

SEQ ID NO: 2570024 - RNA, 21 nt, Chlamydophila pneumoniae TW-183
caaguuguugauaauuacaga

SEQ ID NO: 2570025 - RNA, 17 nt, Chlamydophila pneumoniae TW-183
caauacagcauaaaaau

SEQ ID NO: 2570026 - RNA, 23 nt, Chlamydophila pneumoniae TW-183
caauacuggagagguaaccagag

SEQ ID NO: 2570027 - RNA, 19 nt, Chlamydophila pneumoniae TW-183
caauaguguaacauugacc

SEQ ID NO: 2570028 - RNA, 21 nt, Chlamydophila pneumoniae TW-183
caauauaaaugcuauuuuccu

SEQ ID NO: 2570029 - RNA, 18 nt, Chlamydophila pneumoniae TW-183
caaucaacauucuucugu

SEQ ID NO: 2570030 - RNA, 22 nt, Chlamydophila pneumoniae TW-183
caaucucaaaaucaaauagauu

SEQ ID NO: 2570031 - RNA, 13 nt, Chlamydophila pneumoniae TW-183
caaucugcugaag

SEQ ID NO: 2570032 - RNA, 16 nt, Chlamydophila pneumoniae TW-183
caaucugcugaaggga

SEQ ID NO: 2570033 - RNA, 23 nt, Chlamydophila pneumoniae TW-183
caaucuuugaucgcuugugcaug

SEQ ID NO: 2570034 - RNA, 12 nt, Chlamydophila pneumoniae TW-183
caaugagaaaua

SEQ ID NO: 2570035 - RNA, 14 nt, Chlamydophila pneumoniae TW-183
caaugauaauuuca

SEQ ID NO: 2570036 - RNA, 20 nt, Chlamydophila pneumoniae TW-183
caaugauaauuucauuauag

SEQ ID NO: 2570037 - RNA, 18 nt, Chlamydophila pneumoniae TW-183
caauuagagauucauaaa

SEQ ID NO: 2570038 - RNA, 23 nt, Chlamydophila pneumoniae TW-183
caauuccccuucaucaauaaaga

SEQ ID NO: 2570039 - RNA, 17 nt, Chlamydophila pneumoniae TW-183
caauucgagauauggaa

SEQ ID NO: 2570040 - RNA, 22 nt, Chlamydophila pneumoniae TW-183
caauugaaucagauuagaguua

SEQ ID NO: 2570041 - RNA, 16 nt, Chlamydophila pneumoniae TW-183
caauugagcucucuag

SEQ ID NO: 2570042 - RNA, 21 nt, Chlamydophila pneumoniae TW-183
cacaaaaagcuuuuuucucuu

SEQ ID NO: 2570043 - RNA, 13 nt, Chlamydophila pneumoniae TW-183
cacaaaaccugga

SEQ ID NO: 2570044 - RNA, 23 nt, Chlamydophila pneumoniae TW-183
cacaauauaaaugcuauuuuccu

SEQ ID NO: 2570045 - RNA, 16 nt, Chlamydophila pneumoniae TW-183
cacaaucuaaauaaga

SEQ ID NO: 2570046 - RNA, 19 nt, Chlamydophila pneumoniae TW-183
cacacuuaaagguaaaacu

SEQ ID NO: 2570047 - RNA, 23 nt, Chlamydophila pneumoniae TW-183
cacagaucguaaucuguauaugc

SEQ ID NO: 2570048 - RNA, 15 nt, Chlamydophila pneumoniae TW-183
cacagcauuuucucu

SEQ ID NO: 2570049 - RNA, 17 nt, Chlamydophila pneumoniae TW-183
cacagcuaaucaaucca

SEQ ID NO: 2570050 - RNA, 18 nt, Chlamydophila pneumoniae TW-183
cacagcuaaucaauccaa

SEQ ID NO: 2570051 - RNA, 13 nt, Chlamydophila pneumoniae TW-183
caccaagggaugc

SEQ ID NO: 2570052 - RNA, 19 nt, Chlamydophila pneumoniae TW-183
caccaaugauaauuucauu

SEQ ID NO: 2570053 - RNA, 22 nt, Chlamydophila pneumoniae TW-183
caccuaauaaagaagguugaga

SEQ ID NO: 2570054 - RNA, 20 nt, Chlamydophila pneumoniae TW-183
caccuuagagugacucauca

SEQ ID NO: 2570055 - RNA, 22 nt, Chlamydophila pneumoniae TW-183
caccuucuucuaaaaucuucuc

SEQ ID NO: 2570056 - RNA, 23 nt, Chlamydophila pneumoniae TW-183
caccuucuucuaaaaucuucucu

SEQ ID NO: 2570057 - RNA, 21 nt, Chlamydophila pneumoniae TW-183
cacgcacaaacuaacauagau

SEQ ID NO: 2570058 - RNA, 23 nt, Chlamydophila pneumoniae TW-183
cacgcacuccuggagcuguuucu

SEQ ID NO: 2570059 - RNA, 20 nt, Chlamydophila pneumoniae TW-183
cacgcccugaugcuguaucu

SEQ ID NO: 2570060 - RNA, 23 nt, Chlamydophila pneumoniae TW-183
cacuaaucucaggcauucuucau

SEQ ID NO: 2570061 - RNA, 20 nt, Chlamydophila pneumoniae TW-183
cacuccuggagcuguuucug

SEQ ID NO: 2570062 - RNA, 17 nt, Chlamydophila pneumoniae TW-183
cacucuuucagaaagaa

SEQ ID NO: 2570063 - RNA, 16 nt, Chlamydophila pneumoniae TW-183
cacuguaaaaaagaaa

SEQ ID NO: 2570064 - RNA, 18 nt, Chlamydophila pneumoniae TW-183
cacuuaaagguaaaacua

SEQ ID NO: 2570065 - RNA, 16 nt, Chlamydophila pneumoniae TW-183
cacuuacuucaagaaa

SEQ ID NO: 2570066 - RNA, 17 nt, Chlamydophila pneumoniae TW-183
cacuuacuucaagaaaa

SEQ ID NO: 2570067 - RNA, 16 nt, Chlamydophila pneumoniae TW-183
cacuuaggguucucaa

SEQ ID NO: 2570068 - RNA, 14 nt, Chlamydophila pneumoniae TW-183
cacuucagcacgaa

SEQ ID NO: 2570069 - RNA, 21 nt, Chlamydophila pneumoniae TW-183
cagaacacaugucucuuaaaa

SEQ ID NO: 2570070 - RNA, 22 nt, Chlamydophila pneumoniae TW-183
cagaacacaugucucuuaaaaa

SEQ ID NO: 2570071 - RNA, 13 nt, Chlamydophila pneumoniae TW-183
cagaacuucucca

SEQ ID NO: 2570072 - RNA, 16 nt, Chlamydophila pneumoniae TW-183
cagaagcauugaggac

SEQ ID NO: 2570073 - RNA, 17 nt, Chlamydophila pneumoniae TW-183
cagaagccaccaaaaau

SEQ ID NO: 2570074 - RNA, 15 nt, Chlamydophila pneumoniae TW-183
cagaaggcuuguuuc

SEQ ID NO: 2570075 - RNA, 18 nt, Chlamydophila pneumoniae TW-183
cagaaguuccuacuucug

SEQ ID NO: 2570076 - RNA, 23 nt, Chlamydophila pneumoniae TW-183
cagaaguuccuacuucugcagga

SEQ ID NO: 2570077 - RNA, 17 nt, Chlamydophila pneumoniae TW-183
cagaauaccuucaacaa

SEQ ID NO: 2570078 - RNA, 14 nt, Chlamydophila pneumoniae TW-183
cagaaucccgugcu

SEQ ID NO: 2570079 - RNA, 15 nt, Chlamydophila pneumoniae TW-183
cagacacaaaaagcu

SEQ ID NO: 2570080 - RNA, 23 nt, Chlamydophila pneumoniae TW-183
cagacacaaaaagcuuuuuucuc

SEQ ID NO: 2570081 - RNA, 12 nt, Chlamydophila pneumoniae TW-183
cagagauggucu

SEQ ID NO: 2570082 - RNA, 17 nt, Chlamydophila pneumoniae TW-183
cagagauugccaggaga

SEQ ID NO: 2570083 - RNA, 18 nt, Chlamydophila pneumoniae TW-183
cagagauugccaggagag

SEQ ID NO: 2570084 - RNA, 16 nt, Chlamydophila pneumoniae TW-183
cagagcauaggguuuc

SEQ ID NO: 2570085 - RNA, 17 nt, Chlamydophila pneumoniae TW-183
cagaggcuagaaaauca

SEQ ID NO: 2570086 - RNA, 15 nt, Chlamydophila pneumoniae TW-183
cagaguccuucuuuu

SEQ ID NO: 2570087 - RNA, 21 nt, Chlamydophila pneumoniae TW-183
cagauaaagacaucucuuuaa

SEQ ID NO: 2570088 - RNA, 17 nt, Chlamydophila pneumoniae TW-183
cagauauacuuuuucag

SEQ ID NO: 2570089 - RNA, 22 nt, Chlamydophila pneumoniae TW-183
cagaucguaaucuguauaugcu

SEQ ID NO: 2570090 - RNA, 13 nt, Chlamydophila pneumoniae TW-183
cagauuagaguua

SEQ ID NO: 2570091 - RNA, 18 nt, Chlamydophila pneumoniae TW-183
cagauuagaguuagaugu

SEQ ID NO: 2570092 - RNA, 18 nt, Chlamydophila pneumoniae TW-183
cagcaacccgaauuccuc

SEQ ID NO: 2570093 - RNA, 22 nt, Chlamydophila pneumoniae TW-183
cagcaacgaguccuuacuugca

SEQ ID NO: 2570094 - RNA, 18 nt, Chlamydophila pneumoniae TW-183
cagcauaaaaauucucau

SEQ ID NO: 2570095 - RNA, 18 nt, Chlamydophila pneumoniae TW-183
cagcaucaggauucucuc

SEQ ID NO: 2570096 - RNA, 20 nt, Chlamydophila pneumoniae TW-183
cagcaucaggauucucucug

SEQ ID NO: 2570097 - RNA, 19 nt, Chlamydophila pneumoniae TW-183
cagcauggacuccaagaau

SEQ ID NO: 2570098 - RNA, 17 nt, Chlamydophila pneumoniae TW-183
cagcauugccuggggau

SEQ ID NO: 2570099 - RNA, 14 nt, Chlamydophila pneumoniae TW-183
cagcauuuucucug

SEQ ID NO: 2570100 - RNA, 21 nt, Chlamydophila pneumoniae TW-183
cagcauuuucucugagcagcu

SEQ ID NO: 2570101 - RNA, 12 nt, Chlamydophila pneumoniae TW-183
cagcccacuguu

SEQ ID NO: 2570102 - RNA, 20 nt, Chlamydophila pneumoniae TW-183
cagccuugauugaacagucu

SEQ ID NO: 2570103 - RNA, 17 nt, Chlamydophila pneumoniae TW-183
cagcgaggaguuuucca

SEQ ID NO: 2570104 - RNA, 23 nt, Chlamydophila pneumoniae TW-183
cagcgaggaguuuuccaaaguca

SEQ ID NO: 2570105 - RNA, 19 nt, Chlamydophila pneumoniae TW-183
cagcgguugccuuucucuu

SEQ ID NO: 2570106 - RNA, 15 nt, Chlamydophila pneumoniae TW-183
cagcuaacgaaguga

SEQ ID NO: 2570107 - RNA, 19 nt, Chlamydophila pneumoniae TW-183
cagcuaaucaauccaagaa

SEQ ID NO: 2570108 - RNA, 13 nt, Chlamydophila pneumoniae TW-183
cagcuccuggaua

SEQ ID NO: 2570109 - RNA, 15 nt, Chlamydophila pneumoniae TW-183
cagcuucgcaaucuu

SEQ ID NO: 2570110 - RNA, 18 nt, Chlamydophila pneumoniae TW-183
cagcuucgcaaucuuuga

SEQ ID NO: 2570111 - RNA, 11 nt, Chlamydophila pneumoniae TW-183
cagcuucuuga

SEQ ID NO: 2570112 - RNA, 16 nt, Chlamydophila pneumoniae TW-183
caggaacuaaaaguuu

SEQ ID NO: 2570113 - RNA, 17 nt, Chlamydophila pneumoniae TW-183
caggaaggaauagagaa

SEQ ID NO: 2570114 - RNA, 11 nt, Chlamydophila pneumoniae TW-183
caggaggcgcg

SEQ ID NO: 2570115 - RNA, 16 nt, Chlamydophila pneumoniae TW-183
caggaguucuugauuc

SEQ ID NO: 2570116 - RNA, 17 nt, Chlamydophila pneumoniae TW-183
caggaguuuuccuaaau

SEQ ID NO: 2570117 - RNA, 22 nt, Chlamydophila pneumoniae TW-183
caggauacucugaacaggaaua

SEQ ID NO: 2570118 - RNA, 20 nt, Chlamydophila pneumoniae TW-183
caggcaucacuaaucucagg

SEQ ID NO: 2570119 - RNA, 14 nt, Chlamydophila pneumoniae TW-183
ccagagauucuuca

SEQ ID NO: 2570120 - RNA, 22 nt, Chlamydophila pneumoniae TW-183
ccagauuuuuuugguugcuucu

SEQ ID NO: 2570121 - RNA, 14 nt, Chlamydophila pneumoniae TW-183
ccagcaucuucucg

SEQ ID NO: 2570122 - RNA, 15 nt, Chlamydophila pneumoniae TW-183
ccagcaucuucucga

SEQ ID NO: 2570123 - RNA, 22 nt, Chlamydophila pneumoniae TW-183
ccaggaaacguucuuucaauaa

SEQ ID NO: 2570124 - RNA, 18 nt, Chlamydophila pneumoniae TW-183
ccaggagagcuaacagca

SEQ ID NO: 2570125 - RNA, 19 nt, Chlamydophila pneumoniae TW-183
ccaggagagcuaacagcac

SEQ ID NO: 2570126 - RNA, 22 nt, Chlamydophila pneumoniae TW-183
ccaggagagcuaacagcacgua

SEQ ID NO: 2570127 - RNA, 15 nt, Chlamydophila pneumoniae TW-183
ccaguuacugucugc

SEQ ID NO: 2570128 - RNA, 18 nt, Chlamydophila pneumoniae TW-183
ccaguuuuccauccacga

SEQ ID NO: 2570129 - RNA, 17 nt, Chlamydophila pneumoniae TW-183
ccauaauuagaacagca

SEQ ID NO: 2570130 - RNA, 22 nt, Chlamydophila pneumoniae TW-183
ccauaauuagaacagcauggac

SEQ ID NO: 2570131 - RNA, 13 nt, Chlamydophila pneumoniae TW-183
ccauccacgaccu

SEQ ID NO: 2570132 - RNA, 18 nt, Chlamydophila pneumoniae TW-183
ccauccacgaccugcaaa

SEQ ID NO: 2570133 - RNA, 20 nt, Chlamydophila pneumoniae TW-183
ccaucggcauuucuccacau

SEQ ID NO: 2570134 - RNA, 15 nt, Chlamydophila pneumoniae TW-183
ccaugagcucaggca

SEQ ID NO: 2570135 - RNA, 19 nt, Chlamydophila pneumoniae TW-183
ccaugaucuuagcuccugu

SEQ ID NO: 2570136 - RNA, 18 nt, Chlamydophila pneumoniae TW-183
ccauuucauguaagaaug

SEQ ID NO: 2570137 - RNA, 22 nt, Chlamydophila pneumoniae TW-183
ccauuuuugaauaugauuucca

SEQ ID NO: 2570138 - RNA, 19 nt, Chlamydophila pneumoniae TW-183
cccaaacugaugccaagaa

SEQ ID NO: 2570139 - RNA, 16 nt, Chlamydophila pneumoniae TW-183
cccaauauccagaaau

SEQ ID NO: 2570140 - RNA, 20 nt, Chlamydophila pneumoniae TW-183
cccacggcaaguuguggcau

SEQ ID NO: 2570141 - RNA, 14 nt, Chlamydophila pneumoniae TW-183
cccacuagcccuug

SEQ ID NO: 2570142 - RNA, 13 nt, Chlamydophila pneumoniae TW-183
cccagauuuuuuu

SEQ ID NO: 2570143 - RNA, 19 nt, Chlamydophila pneumoniae TW-183
cccaguuuuccauccacga

SEQ ID NO: 2570144 - RNA, 13 nt, Chlamydophila pneumoniae TW-183
cccauagcaugag

SEQ ID NO: 2570145 - RNA, 14 nt, Chlamydophila pneumoniae TW-183
ccccacgcuaaacu

SEQ ID NO: 2570146 - RNA, 21 nt, Chlamydophila pneumoniae TW-183
ccccuggcguucaggauuuag

SEQ ID NO: 2570147 - RNA, 16 nt, Chlamydophila pneumoniae TW-183
cccgagacuucucucu

SEQ ID NO: 2570148 - RNA, 19 nt, Chlamydophila pneumoniae TW-183
cccucaagcgauuucgaaa

SEQ ID NO: 2570149 - RNA, 11 nt, Chlamydophila pneumoniae TW-183
cccucuucauc

SEQ ID NO: 2570150 - RNA, 23 nt, Chlamydophila pneumoniae TW-183
cccuuaaagagaaucuccucauc

SEQ ID NO: 2570151 - RNA, 12 nt, Chlamydophila pneumoniae TW-183
cccuucaucaau

SEQ ID NO: 2570152 - RNA, 12 nt, Chlamydophila pneumoniae TW-183
cccuucuaauac

SEQ ID NO: 2570153 - RNA, 13 nt, Chlamydophila pneumoniae TW-183
ccgaaucucucca

SEQ ID NO: 2570154 - RNA, 22 nt, Chlamydophila pneumoniae TW-183
ccgacaagcuucguccugacac

SEQ ID NO: 2570155 - RNA, 13 nt, Chlamydophila pneumoniae TW-183
ccgagaauacaga

SEQ ID NO: 2570156 - RNA, 13 nt, Chlamydophila pneumoniae TW-183
ccgagacuucucu

SEQ ID NO: 2570157 - RNA, 22 nt, Chlamydophila pneumoniae TW-183
ccgaguccuaugucaagaagug

SEQ ID NO: 2570158 - RNA, 23 nt, Chlamydophila pneumoniae TW-183
ccgcucuaagcugugcauuuucu

SEQ ID NO: 2570159 - RNA, 14 nt, Chlamydophila pneumoniae TW-183
ccguaacugaggca

SEQ ID NO: 2570160 - RNA, 17 nt, Chlamydophila pneumoniae TW-183
ccuaagcucauaagaaa

SEQ ID NO: 2570161 - RNA, 17 nt, Chlamydophila pneumoniae TW-183
ccuaagucguuaacauc

SEQ ID NO: 2570162 - RNA, 13 nt, Chlamydophila pneumoniae TW-183
ccuaauaaagaag

SEQ ID NO: 2570163 - RNA, 19 nt, Chlamydophila pneumoniae TW-183
ccuaauauccauaagaucu

SEQ ID NO: 2570164 - RNA, 19 nt, Chlamydophila pneumoniae TW-183
ccuaauucucgagcagcug

SEQ ID NO: 2570165 - RNA, 20 nt, Chlamydophila pneumoniae TW-183
ccuacaacggcaaucuauuu

SEQ ID NO: 2570166 - RNA, 17 nt, Chlamydophila pneumoniae TW-183
ccuacauggaucccugu

SEQ ID NO: 2570167 - RNA, 20 nt, Chlamydophila pneumoniae TW-183
ccuaccaaaguuuguagcau

SEQ ID NO: 2570168 - RNA, 18 nt, Chlamydophila pneumoniae TW-183
ccuaccucugggaagacu

SEQ ID NO: 2570169 - RNA, 20 nt, Chlamydophila pneumoniae TW-183
ccuaccucugggaagacucu

SEQ ID NO: 2570170 - RNA, 19 nt, Chlamydophila pneumoniae TW-183
ccuagagaguucuuguaau

SEQ ID NO: 2570171 - RNA, 21 nt, Chlamydophila pneumoniae TW-183
ccuagagaguucuuguaauaa

SEQ ID NO: 2570172 - RNA, 21 nt, Chlamydophila pneumoniae TW-183
ccuauaaagcaaaugccugua

SEQ ID NO: 2570173 - RNA, 20 nt, Chlamydophila pneumoniae TW-183
ccuauucugguuucuucauc

SEQ ID NO: 2570174 - RNA, 14 nt, Chlamydophila pneumoniae TW-183
ccucaucagaagcc

SEQ ID NO: 2570175 - RNA, 21 nt, Chlamydophila pneumoniae TW-183
ccucaucagaagccaccaaaa

SEQ ID NO: 2570176 - RNA, 16 nt, Chlamydophila pneumoniae TW-183
ccuccauggaaagaaa

SEQ ID NO: 2570177 - RNA, 11 nt, Chlamydophila pneumoniae TW-183
ccuccucuucu

SEQ ID NO: 2570178 - RNA, 12 nt, Chlamydophila pneumoniae TW-183
ccuccucuucuu

SEQ ID NO: 2570179 - RNA, 17 nt, Chlamydophila pneumoniae TW-183
ccucgaauuccucccag

SEQ ID NO: 2570180 - RNA, 21 nt, Chlamydophila pneumoniae TW-183
ccucgagcagaaacuccaaaa

SEQ ID NO: 2570181 - RNA, 16 nt, Chlamydophila pneumoniae TW-183
ccucgucaccugagcu

SEQ ID NO: 2570182 - RNA, 14 nt, Chlamydophila pneumoniae TW-183
ccucucccuuggga

SEQ ID NO: 2570183 - RNA, 12 nt, Chlamydophila pneumoniae TW-183
ccucuucuucau

SEQ ID NO: 2570184 - RNA, 21 nt, Chlamydophila pneumoniae TW-183
ccugaggcuauagaauacaca

SEQ ID NO: 2570185 - RNA, 23 nt, Chlamydophila pneumoniae TW-183
ccugaguacuuugugauuacagc

SEQ ID NO: 2570186 - RNA, 12 nt, Chlamydophila pneumoniae TW-183
ccugcugcuuca

SEQ ID NO: 2570187 - RNA, 21 nt, Chlamydophila pneumoniae TW-183
ccuggaggcgguggcaugcca

SEQ ID NO: 2570188 - RNA, 14 nt, Chlamydophila pneumoniae TW-183
ccuggauuuaggau

SEQ ID NO: 2570189 - RNA, 15 nt, Chlamydophila pneumoniae TW-183
ccuguacuaucuuuu

SEQ ID NO: 2570190 - RNA, 22 nt, Chlamydophila pneumoniae TW-183
ccuguaguuucuaaaacagaaa

SEQ ID NO: 2570191 - RNA, 21 nt, Chlamydophila pneumoniae TW-183
ccugugugguuggauccaucg

SEQ ID NO: 2570192 - RNA, 15 nt, Chlamydophila pneumoniae TW-183
ccuuaacaacaucac

SEQ ID NO: 2570193 - RNA, 20 nt, Chlamydophila pneumoniae TW-183
ccuuacggccccuggaauuu

SEQ ID NO: 2570194 - RNA, 15 nt, Chlamydophila pneumoniae TW-183
ccuuaguuuuuucua

SEQ ID NO: 2570195 - RNA, 20 nt, Chlamydophila pneumoniae TW-183
ccuucaacacaccauuuuug

SEQ ID NO: 2570196 - RNA, 19 nt, Chlamydophila pneumoniae TW-183
ccuugaaauugcucuugcu

SEQ ID NO: 2570197 - RNA, 16 nt, Chlamydophila pneumoniae TW-183
ccuugagacaaagaau

SEQ ID NO: 2570198 - RNA, 13 nt, Chlamydophila pneumoniae TW-183
ccuugcagcccug

SEQ ID NO: 2570199 - RNA, 23 nt, Chlamydophila pneumoniae TW-183
ccuugggauuccuuaaugguagc

SEQ ID NO: 2570200 - RNA, 17 nt, Chlamydophila pneumoniae TW-183
cgaagacucaaagaacu

SEQ ID NO: 2570201 - RNA, 17 nt, Chlamydophila pneumoniae TW-183
cgaagauccuagagaau

SEQ ID NO: 2570202 - RNA, 23 nt, Chlamydophila pneumoniae TW-183
cgaagcuugcugauuucuuuuuc

SEQ ID NO: 2570203 - RNA, 21 nt, Chlamydophila pneumoniae TW-183
cgaauaaguuuugauuuugca

SEQ ID NO: 2570204 - RNA, 12 nt, Chlamydophila pneumoniae TW-183
cgaaucucucca

SEQ ID NO: 2570205 - RNA, 13 nt, Chlamydophila pneumoniae TW-183
cgaaucucuccag

SEQ ID NO: 2570206 - RNA, 18 nt, Chlamydophila pneumoniae TW-183
cgaaugucguuaaaaacu

SEQ ID NO: 2570207 - RNA, 20 nt, Chlamydophila pneumoniae TW-183
cgaaugucguuaaaaacuau

SEQ ID NO: 2570208 - RNA, 22 nt, Chlamydophila pneumoniae TW-183
cgaccuaggagaaaucacacuu

SEQ ID NO: 2570209 - RNA, 18 nt, Chlamydophila pneumoniae TW-183
cgaccucgaauuccuccc

SEQ ID NO: 2570210 - RNA, 20 nt, Chlamydophila pneumoniae TW-183
cgaccucgaauuccucccag

SEQ ID NO: 2570211 - RNA, 22 nt, Chlamydophila pneumoniae TW-183
cgagaggaaaucccgagauaug

SEQ ID NO: 2570212 - RNA, 20 nt, Chlamydophila pneumoniae TW-183
cgagcuuuuugcuuuucccu

SEQ ID NO: 2570213 - RNA, 15 nt, Chlamydophila pneumoniae TW-183
cgaguaucuacuuug

SEQ ID NO: 2570214 - RNA, 17 nt, Chlamydophila pneumoniae TW-183
cgagucggcucuauaaa

SEQ ID NO: 2570215 - RNA, 19 nt, Chlamydophila pneumoniae TW-183
cgaguucgcggaucuucuu

SEQ ID NO: 2570216 - RNA, 14 nt, Chlamydophila pneumoniae TW-183
cuaugggaggaauu

SEQ ID NO: 2570217 - RNA, 21 nt, Chlamydophila pneumoniae TW-183
cuaugggaggaauuccucuca

SEQ ID NO: 2570218 - RNA, 15 nt, Chlamydophila pneumoniae TW-183
cuaugguaaucaccu

SEQ ID NO: 2570219 - RNA, 14 nt, Chlamydophila pneumoniae TW-183
cuaugucaagaagu

SEQ ID NO: 2570220 - RNA, 13 nt, Chlamydophila pneumoniae TW-183
cuauguguucucg

SEQ ID NO: 2570221 - RNA, 15 nt, Chlamydophila pneumoniae TW-183
cuauuacuagauccc

SEQ ID NO: 2570222 - RNA, 23 nt, Chlamydophila pneumoniae TW-183
cuauuuuugaggaacgcacgcca

SEQ ID NO: 2570223 - RNA, 19 nt, Chlamydophila pneumoniae TW-183
cucaaaucucauuccagca

SEQ ID NO: 2570224 - RNA, 23 nt, Chlamydophila pneumoniae TW-183
cucaacuuaaguugaccuuuuuc

SEQ ID NO: 2570225 - RNA, 13 nt, Chlamydophila pneumoniae TW-183
cucaagaucuuca

SEQ ID NO: 2570226 - RNA, 22 nt, Chlamydophila pneumoniae TW-183
cucaagcgauuucgaaaaagcc

SEQ ID NO: 2570227 - RNA, 22 nt, Chlamydophila pneumoniae TW-183
cucaaggucacagcauuuucuc

SEQ ID NO: 2570228 - RNA, 16 nt, Chlamydophila pneumoniae TW-183
cucaccagaagcaacu

SEQ ID NO: 2570229 - RNA, 20 nt, Chlamydophila pneumoniae TW-183
cucaggucugcugaggagag

SEQ ID NO: 2570230 - RNA, 16 nt, Chlamydophila pneumoniae TW-183
cucaguaggagcagcg

SEQ ID NO: 2570231 - RNA, 19 nt, Chlamydophila pneumoniae TW-183
cucaucaaggccuauagau

SEQ ID NO: 2570232 - RNA, 21 nt, Chlamydophila pneumoniae TW-183
cucaucagaagccaccaaaaa

SEQ ID NO: 2570233 - RNA, 20 nt, Chlamydophila pneumoniae TW-183
cucaucagcaaaacucccga

SEQ ID NO: 2570234 - RNA, 17 nt, Chlamydophila pneumoniae TW-183
cucauuccagcaucuuc

SEQ ID NO: 2570235 - RNA, 13 nt, Chlamydophila pneumoniae TW-183
cuccaacagucug

SEQ ID NO: 2570236 - RNA, 14 nt, Chlamydophila pneumoniae TW-183
cuccaagaauagca

SEQ ID NO: 2570237 - RNA, 19 nt, Chlamydophila pneumoniae TW-183
cuccaagaauagcaggaag

SEQ ID NO: 2570238 - RNA, 15 nt, Chlamydophila pneumoniae TW-183
cuccacagcuucuuc

SEQ ID NO: 2570239 - RNA, 14 nt, Chlamydophila pneumoniae TW-183
cuccacaugccugc

SEQ ID NO: 2570240 - RNA, 14 nt, Chlamydophila pneumoniae TW-183
cuccagcagcuucc

SEQ ID NO: 2570241 - RNA, 13 nt, Chlamydophila pneumoniae TW-183
cuccagcauaagg

SEQ ID NO: 2570242 - RNA, 23 nt, Chlamydophila pneumoniae TW-183
cuccagcauaaggauucugagaa

SEQ ID NO: 2570243 - RNA, 17 nt, Chlamydophila pneumoniae TW-183
cuccauuggcauagagc

SEQ ID NO: 2570244 - RNA, 22 nt, Chlamydophila pneumoniae TW-183
cuccauuggcauagagccuaga

SEQ ID NO: 2570245 - RNA, 17 nt, Chlamydophila pneumoniae TW-183
cucccaauauccagaaa

SEQ ID NO: 2570246 - RNA, 17 nt, Chlamydophila pneumoniae TW-183
cuccgaauggagaagga

SEQ ID NO: 2570247 - RNA, 13 nt, Chlamydophila pneumoniae TW-183
cuccucaucagaa

SEQ ID NO: 2570248 - RNA, 22 nt, Chlamydophila pneumoniae TW-183
cuccucaucagaagccaccaaa

SEQ ID NO: 2570249 - RNA, 17 nt, Chlamydophila pneumoniae TW-183
cuccuccaaucugcuga

SEQ ID NO: 2570250 - RNA, 20 nt, Chlamydophila pneumoniae TW-183
cuccugacucuuauugcaga

SEQ ID NO: 2570251 - RNA, 13 nt, Chlamydophila pneumoniae TW-183
cuccuggaagaau

SEQ ID NO: 2570252 - RNA, 20 nt, Chlamydophila pneumoniae TW-183
cuccuugacuaaauccacca

SEQ ID NO: 2570253 - RNA, 19 nt, Chlamydophila pneumoniae TW-183
cucgaaacucuuugaggau

SEQ ID NO: 2570254 - RNA, 18 nt, Chlamydophila pneumoniae TW-183
cucgaagcuugcugauuu

SEQ ID NO: 2570255 - RNA, 12 nt, Chlamydophila pneumoniae TW-183
cucgaauuccuc

SEQ ID NO: 2570256 - RNA, 21 nt, Chlamydophila pneumoniae TW-183
cucgagcagaaacuccaaaau

SEQ ID NO: 2570257 - RNA, 17 nt, Chlamydophila pneumoniae TW-183
cucguaauccuucuuuc

SEQ ID NO: 2570258 - RNA, 20 nt, Chlamydophila pneumoniae TW-183
cucguagcuauuuuugagga

SEQ ID NO: 2570259 - RNA, 14 nt, Chlamydophila pneumoniae TW-183
cucuaagaggguuu

SEQ ID NO: 2570260 - RNA, 19 nt, Chlamydophila pneumoniae TW-183
cucuaagcugugcauuuuc

SEQ ID NO: 2570261 - RNA, 20 nt, Chlamydophila pneumoniae TW-183
cucuaagcugugcauuuucu

SEQ ID NO: 2570262 - RNA, 22 nt, Chlamydophila pneumoniae TW-183
cucuaaggacaaaucucccaaa

SEQ ID NO: 2570263 - RNA, 19 nt, Chlamydophila pneumoniae TW-183
cucuaccccacgcuaaacu

SEQ ID NO: 2570264 - RNA, 17 nt, Chlamydophila pneumoniae TW-183
cucuagcucaaaucuca

SEQ ID NO: 2570265 - RNA, 21 nt, Chlamydophila pneumoniae TW-183
cucuaggaacucuuuaaaagg

SEQ ID NO: 2570266 - RNA, 15 nt, Chlamydophila pneumoniae TW-183
cucuagggguuuccc

SEQ ID NO: 2570267 - RNA, 19 nt, Chlamydophila pneumoniae TW-183
cucuagucuuucaaccucc

SEQ ID NO: 2570268 - RNA, 17 nt, Chlamydophila pneumoniae TW-183
cucuauauuuuuuccca

SEQ ID NO: 2570269 - RNA, 19 nt, Chlamydophila pneumoniae TW-183
cucuauauuuuuucccaca

SEQ ID NO: 2570270 - RNA, 11 nt, Chlamydophila pneumoniae TW-183
cucuccaaaag

SEQ ID NO: 2570271 - RNA, 16 nt, Chlamydophila pneumoniae TW-183
cucuccagcuugauca

SEQ ID NO: 2570272 - RNA, 23 nt, Chlamydophila pneumoniae TW-183
cucuccuaaugccgagaauacag

SEQ ID NO: 2570273 - RNA, 14 nt, Chlamydophila pneumoniae TW-183
cucuccuccccacu

SEQ ID NO: 2570274 - RNA, 15 nt, Chlamydophila pneumoniae TW-183
cucucugccuaccaa

SEQ ID NO: 2570275 - RNA, 16 nt, Chlamydophila pneumoniae TW-183
cucucugccuaccaaa

SEQ ID NO: 2570276 - RNA, 13 nt, Chlamydophila pneumoniae TW-183
cucugaacaggaa

SEQ ID NO: 2570277 - RNA, 15 nt, Chlamydophila pneumoniae TW-183
cucugagcagcuucg

SEQ ID NO: 2570278 - RNA, 23 nt, Chlamydophila pneumoniae TW-183
cucugccuaccaaaguuuguagc

SEQ ID NO: 2570279 - RNA, 23 nt, Chlamydophila pneumoniae TW-183
cucuggaguuugauagagaaaau

SEQ ID NO: 2570280 - RNA, 21 nt, Chlamydophila pneumoniae TW-183
cucugggaagacucucaucag

SEQ ID NO: 2570281 - RNA, 16 nt, Chlamydophila pneumoniae TW-183
cucugugguuccugga

SEQ ID NO: 2570282 - RNA, 20 nt, Chlamydophila pneumoniae TW-183
cucuucauugcaaaaaugaa

SEQ ID NO: 2570283 - RNA, 12 nt, Chlamydophila pneumoniae TW-183
cucuucugcagc

SEQ ID NO: 2570284 - RNA, 23 nt, Chlamydophila pneumoniae TW-183
cucuucuuucucuaucucucgga

SEQ ID NO: 2570285 - RNA, 18 nt, Chlamydophila pneumoniae TW-183
cucuugcgaacuauccua

SEQ ID NO: 2570286 - RNA, 13 nt, Chlamydophila pneumoniae TW-183
cucuuuaaaaggg

SEQ ID NO: 2570287 - RNA, 22 nt, Chlamydophila pneumoniae TW-183
cucuuuaaaagggcgcuucccu

SEQ ID NO: 2570288 - RNA, 18 nt, Chlamydophila pneumoniae TW-183
cucuuuaaauguugggau

SEQ ID NO: 2570289 - RNA, 16 nt, Chlamydophila pneumoniae TW-183
cucuuuauauuuuuug

SEQ ID NO: 2570290 - RNA, 23 nt, Chlamydophila pneumoniae TW-183
cucuuuauauuuuuugagaaaua

SEQ ID NO: 2570291 - RNA, 12 nt, Chlamydophila pneumoniae TW-183
cucuuugaggau

SEQ ID NO: 2570292 - RNA, 20 nt, Chlamydophila pneumoniae TW-183
cucuuugauuuucuuagcuu

SEQ ID NO: 2570293 - RNA, 12 nt, Chlamydophila pneumoniae TW-183
cugaagauuuuu

SEQ ID NO: 2570294 - RNA, 13 nt, Chlamydophila pneumoniae TW-183
cugaagauuuuuu

SEQ ID NO: 2570295 - RNA, 16 nt, Chlamydophila pneumoniae TW-183
cugaagggacagucuc

SEQ ID NO: 2570296 - RNA, 18 nt, Chlamydophila pneumoniae TW-183
cugacgucuccaacaguc

SEQ ID NO: 2570297 - RNA, 22 nt, Chlamydophila pneumoniae TW-183
cugacguuguguagcugaaauc

SEQ ID NO: 2570298 - RNA, 20 nt, Chlamydophila pneumoniae TW-183
cugacucuuauugcagaauc

SEQ ID NO: 2570299 - RNA, 15 nt, Chlamydophila pneumoniae TW-183
cugagaaguuaagac

SEQ ID NO: 2570300 - RNA, 18 nt, Chlamydophila pneumoniae TW-183
cugagagaagcagaaucu

SEQ ID NO: 2570301 - RNA, 13 nt, Chlamydophila pneumoniae TW-183
cugagcagcuucg

SEQ ID NO: 2570302 - RNA, 15 nt, Chlamydophila pneumoniae TW-183
cugaggacgcagaga

SEQ ID NO: 2570303 - RNA, 22 nt, Chlamydophila pneumoniae TW-183
cugauguugcccuacaauuucc

SEQ ID NO: 2570304 - RNA, 17 nt, Chlamydophila pneumoniae TW-183
cugauguuuuauagaua

SEQ ID NO: 2570305 - RNA, 12 nt, Chlamydophila pneumoniae TW-183
cugauucuccca

SEQ ID NO: 2570306 - RNA, 13 nt, Chlamydophila pneumoniae TW-183
cugauucucccaa

SEQ ID NO: 2570307 - RNA, 19 nt, Chlamydophila pneumoniae TW-183
cugauucucccaauaucca

SEQ ID NO: 2570308 - RNA, 21 nt, Chlamydophila pneumoniae TW-183
cugauuucuuuuucagcuucu

SEQ ID NO: 2570309 - RNA, 20 nt, Chlamydophila pneumoniae TW-183
cugauuuuucaagaccuaag

SEQ ID NO: 2570310 - RNA, 22 nt, Chlamydophila pneumoniae TW-183
cugcaaacuccccaguuuucca

SEQ ID NO: 2570311 - RNA, 18 nt, Chlamydophila pneumoniae TW-183
cugcauaaucucaccaga

SEQ ID NO: 2570312 - RNA, 16 nt, Chlamydophila pneumoniae TW-183
cugcgguagccuggag

SEQ ID NO: 2570313 - RNA, 19 nt, Chlamydophila pneumoniae TW-183
cuuuaccauagaaagauaa

SEQ ID NO: 2570314 - RNA, 13 nt, Chlamydophila pneumoniae TW-183
cuuuauagauaug

SEQ ID NO: 2570315 - RNA, 18 nt, Chlamydophila pneumoniae TW-183
cuuuauggcucaacuuaa

SEQ ID NO: 2570316 - RNA, 17 nt, Chlamydophila pneumoniae TW-183
cuuucaaccuccgcucu

SEQ ID NO: 2570317 - RNA, 16 nt, Chlamydophila pneumoniae TW-183
cuuucugcucuucuau

SEQ ID NO: 2570318 - RNA, 23 nt, Chlamydophila pneumoniae TW-183
cuuugaagcucgaccucuagcuc

SEQ ID NO: 2570319 - RNA, 17 nt, Chlamydophila pneumoniae TW-183
cuuugaucgcuugugca

SEQ ID NO: 2570320 - RNA, 13 nt, Chlamydophila pneumoniae TW-183
cuuugauuuucuu

SEQ ID NO: 2570321 - RNA, 21 nt, Chlamydophila pneumoniae TW-183
cuuugauuuucuuagcuucca

SEQ ID NO: 2570322 - RNA, 21 nt, Chlamydophila pneumoniae TW-183
cuuugcaugaggagaccuuua

SEQ ID NO: 2570323 - RNA, 18 nt, Chlamydophila pneumoniae TW-183
cuuuguuaauagaagauc

SEQ ID NO: 2570324 - RNA, 17 nt, Chlamydophila pneumoniae TW-183
cuuuuagagguuuuugu

SEQ ID NO: 2570325 - RNA, 16 nt, Chlamydophila pneumoniae TW-183
cuuuuauauuaagaau

SEQ ID NO: 2570326 - RNA, 21 nt, Chlamydophila pneumoniae TW-183
cuuuuccggggagaacuucaa

SEQ ID NO: 2570327 - RNA, 14 nt, Chlamydophila pneumoniae TW-183
cuuuucugaagauu

SEQ ID NO: 2570328 - RNA, 17 nt, Chlamydophila pneumoniae TW-183
cuuuucugaagauuuuu

SEQ ID NO: 2570329 - RNA, 19 nt, Chlamydophila pneumoniae TW-183
cuuuucugaagauuuuuua

SEQ ID NO: 2570330 - RNA, 14 nt, Chlamydophila pneumoniae TW-183
cuuuucuucuucgg

SEQ ID NO: 2570331 - RNA, 22 nt, Chlamydophila pneumoniae TW-183
cuuuugugauaccuccuccaau

SEQ ID NO: 2570332 - RNA, 18 nt, Chlamydophila pneumoniae TW-183
cuuuuguuuuagcucuuu

SEQ ID NO: 2570333 - RNA, 23 nt, Chlamydophila pneumoniae TW-183
cuuuuuaauaaagggaaaucgga

SEQ ID NO: 2570334 - RNA, 19 nt, Chlamydophila pneumoniae TW-183
cuuuuucagcuucuacagc

SEQ ID NO: 2570335 - RNA, 18 nt, Chlamydophila pneumoniae TW-183
gaaaaauaucggaagaga

SEQ ID NO: 2570336 - RNA, 13 nt, Chlamydophila pneumoniae TW-183
gaaaacauagaga

SEQ ID NO: 2570337 - RNA, 17 nt, Chlamydophila pneumoniae TW-183
gaaaacgcccucuagaa

SEQ ID NO: 2570338 - RNA, 14 nt, Chlamydophila pneumoniae TW-183
gaaaagaaccuagg

SEQ ID NO: 2570339 - RNA, 19 nt, Chlamydophila pneumoniae TW-183
gaaaagagcucaucaauga

SEQ ID NO: 2570340 - RNA, 20 nt, Chlamydophila pneumoniae TW-183
gaaaagagcucaucaaugag

SEQ ID NO: 2570341 - RNA, 13 nt, Chlamydophila pneumoniae TW-183
gaaacacucauga

SEQ ID NO: 2570342 - RNA, 20 nt, Chlamydophila pneumoniae TW-183
gaaacacucaugaaagugcu

SEQ ID NO: 2570343 - RNA, 22 nt, Chlamydophila pneumoniae TW-183
gaaacccauaaugguacaauac

SEQ ID NO: 2570344 - RNA, 12 nt, Chlamydophila pneumoniae TW-183
gaaagaaacaaa

SEQ ID NO: 2570345 - RNA, 23 nt, Chlamydophila pneumoniae TW-183
gaaagaaguccuagggagugagg

SEQ ID NO: 2570346 - RNA, 18 nt, Chlamydophila pneumoniae TW-183
gaaagagugccaagagca

SEQ ID NO: 2570347 - RNA, 19 nt, Chlamydophila pneumoniae TW-183
gaaagagugccaagagcau

SEQ ID NO: 2570348 - RNA, 22 nt, Chlamydophila pneumoniae TW-183
gaaauaauugaggaguuucuac

SEQ ID NO: 2570349 - RNA, 15 nt, Chlamydophila pneumoniae TW-183
gaaaucacacuuaaa

SEQ ID NO: 2570350 - RNA, 17 nt, Chlamydophila pneumoniae TW-183
gaaaucggagggcuaca

SEQ ID NO: 2570351 - RNA, 13 nt, Chlamydophila pneumoniae TW-183
gaaaugagugaga

SEQ ID NO: 2570352 - RNA, 21 nt, Chlamydophila pneumoniae TW-183
gaaauugaacucucaguuaaa

SEQ ID NO: 2570353 - RNA, 14 nt, Chlamydophila pneumoniae TW-183
gaaauugcucuugc

SEQ ID NO: 2570354 - RNA, 13 nt, Chlamydophila pneumoniae TW-183
gaacaaggcuccg

SEQ ID NO: 2570355 - RNA, 22 nt, Chlamydophila pneumoniae TW-183
gaacaagucggcaggagaggua

SEQ ID NO: 2570356 - RNA, 22 nt, Chlamydophila pneumoniae TW-183
gaacagcauggacuccaagaau

SEQ ID NO: 2570357 - RNA, 12 nt, Chlamydophila pneumoniae TW-183
gaacaggagaga

SEQ ID NO: 2570358 - RNA, 18 nt, Chlamydophila pneumoniae TW-183
gaacaggagagagaaggc

SEQ ID NO: 2570359 - RNA, 20 nt, Chlamydophila pneumoniae TW-183
gaacaggagagagaaggcuc

SEQ ID NO: 2570360 - RNA, 13 nt, Chlamydophila pneumoniae TW-183
gaacaggaggugu

SEQ ID NO: 2570361 - RNA, 21 nt, Chlamydophila pneumoniae TW-183
gaacaggagguguauccguag

SEQ ID NO: 2570362 - RNA, 15 nt, Chlamydophila pneumoniae TW-183
gaacaggggauguga

SEQ ID NO: 2570363 - RNA, 18 nt, Chlamydophila pneumoniae TW-183
gaacaguauaaucagaag

SEQ ID NO: 2570364 - RNA, 19 nt, Chlamydophila pneumoniae TW-183
gaacagucuugcgccagca

SEQ ID NO: 2570365 - RNA, 20 nt, Chlamydophila pneumoniae TW-183
gaacaucucgaaccauacgg

SEQ ID NO: 2570366 - RNA, 23 nt, Chlamydophila pneumoniae TW-183
gaacaugcccccacaaaaccugg

SEQ ID NO: 2570367 - RNA, 16 nt, Chlamydophila pneumoniae TW-183
gaacguacuuagguaa

SEQ ID NO: 2570368 - RNA, 15 nt, Chlamydophila pneumoniae TW-183
gaacuaaaaguuuuu

SEQ ID NO: 2570369 - RNA, 19 nt, Chlamydophila pneumoniae TW-183
gaacuaaaaguuuuuuauu

SEQ ID NO: 2570370 - RNA, 15 nt, Chlamydophila pneumoniae TW-183
gaacucuuuaaaagg

SEQ ID NO: 2570371 - RNA, 15 nt, Chlamydophila pneumoniae TW-183
gaccuguaguaaaau

SEQ ID NO: 2570372 - RNA, 23 nt, Chlamydophila pneumoniae TW-183
gaccuguaguaaaauaagaaauc

SEQ ID NO: 2570373 - RNA, 19 nt, Chlamydophila pneumoniae TW-183
gaccuucucaagaucuuca

SEQ ID NO: 2570374 - RNA, 16 nt, Chlamydophila pneumoniae TW-183
gacgucuccaacaguc

SEQ ID NO: 2570375 - RNA, 22 nt, Chlamydophila pneumoniae TW-183
gacguuaauaaagaggcuccca

SEQ ID NO: 2570376 - RNA, 19 nt, Chlamydophila pneumoniae TW-183
gacuaaacaccuucuucua

SEQ ID NO: 2570377 - RNA, 20 nt, Chlamydophila pneumoniae TW-183
gacuaaacaccuucuucuaa

SEQ ID NO: 2570378 - RNA, 15 nt, Chlamydophila pneumoniae TW-183
gacuagcuuuucaug

SEQ ID NO: 2570379 - RNA, 21 nt, Chlamydophila pneumoniae TW-183
gacuauagggagacucuugag

SEQ ID NO: 2570380 - RNA, 19 nt, Chlamydophila pneumoniae TW-183
gacuccaagaauagcagga

SEQ ID NO: 2570381 - RNA, 14 nt, Chlamydophila pneumoniae TW-183
gacucucaucagca

SEQ ID NO: 2570382 - RNA, 23 nt, Chlamydophila pneumoniae TW-183
gacucucaucagcaaaacucccg

SEQ ID NO: 2570383 - RNA, 10 nt, Chlamydophila pneumoniae TW-183
gacugaaacu

SEQ ID NO: 2570384 - RNA, 22 nt, Chlamydophila pneumoniae TW-183
gacuucuggaagcuguuguucu

SEQ ID NO: 2570385 - RNA, 16 nt, Chlamydophila pneumoniae TW-183
gacuugcaagcuucuu

SEQ ID NO: 2570386 - RNA, 20 nt, Chlamydophila pneumoniae TW-183
gacuugcaagcuucuuguuu

SEQ ID NO: 2570387 - RNA, 12 nt, Chlamydophila pneumoniae TW-183
gacuuuccucuc

SEQ ID NO: 2570388 - RNA, 13 nt, Chlamydophila pneumoniae TW-183
gagaaaauaagca

SEQ ID NO: 2570389 - RNA, 19 nt, Chlamydophila pneumoniae TW-183
gagaaagucgauuuccuuu

SEQ ID NO: 2570390 - RNA, 18 nt, Chlamydophila pneumoniae TW-183
gagaaaugcucuucugca

SEQ ID NO: 2570391 - RNA, 21 nt, Chlamydophila pneumoniae TW-183
gagaacaugcccccacaaaac

SEQ ID NO: 2570392 - RNA, 22 nt, Chlamydophila pneumoniae TW-183
gagaaccuucacaagaaaacaa

SEQ ID NO: 2570393 - RNA, 17 nt, Chlamydophila pneumoniae TW-183
gagaacuucaacaaagg

SEQ ID NO: 2570394 - RNA, 16 nt, Chlamydophila pneumoniae TW-183
gagaaucuccucauca

SEQ ID NO: 2570395 - RNA, 13 nt, Chlamydophila pneumoniae TW-183
gagacuucucucu

SEQ ID NO: 2570396 - RNA, 16 nt, Chlamydophila pneumoniae TW-183
gagacuucucucuuaa

SEQ ID NO: 2570397 - RNA, 21 nt, Chlamydophila pneumoniae TW-183
gagagaagcagaaucugugag

SEQ ID NO: 2570398 - RNA, 20 nt, Chlamydophila pneumoniae TW-183
gagagcuuuuagguagagaa

SEQ ID NO: 2570399 - RNA, 21 nt, Chlamydophila pneumoniae TW-183
gagaggaaaucccgagauaug

SEQ ID NO: 2570400 - RNA, 22 nt, Chlamydophila pneumoniae TW-183
gagaggaaaucccgagauauga

SEQ ID NO: 2570401 - RNA, 22 nt, Chlamydophila pneumoniae TW-183
gagagguaaccagagagcuuuu

SEQ ID NO: 2570402 - RNA, 17 nt, Chlamydophila pneumoniae TW-183
gagauccuccuggaaga

SEQ ID NO: 2570403 - RNA, 21 nt, Chlamydophila pneumoniae TW-183
gagaugccauaagcaagcaac

SEQ ID NO: 2570404 - RNA, 14 nt, Chlamydophila pneumoniae TW-183
gagaugcuaacaac

SEQ ID NO: 2570405 - RNA, 17 nt, Chlamydophila pneumoniae TW-183
gagaugcuucuaaacaa

SEQ ID NO: 2570406 - RNA, 17 nt, Chlamydophila pneumoniae TW-183
gagauuaccgaagagcc

SEQ ID NO: 2570407 - RNA, 15 nt, Chlamydophila pneumoniae TW-183
gagauugccaggaga

SEQ ID NO: 2570408 - RNA, 12 nt, Chlamydophila pneumoniae TW-183
gagcagaaacuc

SEQ ID NO: 2570409 - RNA, 23 nt, Chlamydophila pneumoniae TW-183
gagcagcuuuaucaggaucuuga

SEQ ID NO: 2570410 - RNA, 21 nt, Chlamydophila pneumoniae TW-183
gagcauccuguagccacuaag

SEQ ID NO: 2570411 - RNA, 19 nt, Chlamydophila pneumoniae TW-183
gagcauugacuugggauuc

SEQ ID NO: 2570412 - RNA, 17 nt, Chlamydophila pneumoniae TW-183
gagcucaucaaugagaa

SEQ ID NO: 2570413 - RNA, 15 nt, Chlamydophila pneumoniae TW-183
gaggaacgcacgcca

SEQ ID NO: 2570414 - RNA, 22 nt, Chlamydophila pneumoniae TW-183
gaggaaucauaaccaaaagaau

SEQ ID NO: 2570415 - RNA, 21 nt, Chlamydophila pneumoniae TW-183
gaggaaucugaaucucauaag

SEQ ID NO: 2570416 - RNA, 12 nt, Chlamydophila pneumoniae TW-183
gaggaaugaaga

SEQ ID NO: 2570417 - RNA, 13 nt, Chlamydophila pneumoniae TW-183
gaggaaugaagag

SEQ ID NO: 2570418 - RNA, 15 nt, Chlamydophila pneumoniae TW-183
gaggacgcagagaug

SEQ ID NO: 2570419 - RNA, 14 nt, Chlamydophila pneumoniae TW-183
gaggaguuuuccaa

SEQ ID NO: 2570420 - RNA, 11 nt, Chlamydophila pneumoniae TW-183
gaggcaaagau

SEQ ID NO: 2570421 - RNA, 15 nt, Chlamydophila pneumoniae TW-183
gaggcaagucucaaa

SEQ ID NO: 2570422 - RNA, 21 nt, Chlamydophila pneumoniae TW-183
gaggcggagguacguaucuuc

SEQ ID NO: 2570423 - RNA, 14 nt, Chlamydophila pneumoniae TW-183
gaggcuagaaaauc

SEQ ID NO: 2570424 - RNA, 23 nt, Chlamydophila pneumoniae TW-183
gagggguaaaccaauugagcucu

SEQ ID NO: 2570425 - RNA, 13 nt, Chlamydophila pneumoniae TW-183
gagggucucagca

SEQ ID NO: 2570426 - RNA, 17 nt, Chlamydophila pneumoniae TW-183
gagguaaccagagagcu

SEQ ID NO: 2570427 - RNA, 16 nt, Chlamydophila pneumoniae TW-183
gagguucgcagaacuu

SEQ ID NO: 2570428 - RNA, 13 nt, Chlamydophila pneumoniae TW-183
gaguagccccagc

SEQ ID NO: 2570429 - RNA, 23 nt, Chlamydophila pneumoniae TW-183
gaguagccccagcaacccgaauu

SEQ ID NO: 2570430 - RNA, 19 nt, Chlamydophila pneumoniae TW-183
gaguaugaggagauaaaga

SEQ ID NO: 2570431 - RNA, 18 nt, Chlamydophila pneumoniae TW-183
gaucucaguaggagcagc

SEQ ID NO: 2570432 - RNA, 19 nt, Chlamydophila pneumoniae TW-183
gaucuggagagggaaggaa

SEQ ID NO: 2570433 - RNA, 14 nt, Chlamydophila pneumoniae TW-183
gaucuuagcuccug

SEQ ID NO: 2570434 - RNA, 17 nt, Chlamydophila pneumoniae TW-183
gaucuucagagagaaca

SEQ ID NO: 2570435 - RNA, 18 nt, Chlamydophila pneumoniae TW-183
gaucuugagaaaagaaca

SEQ ID NO: 2570436 - RNA, 23 nt, Chlamydophila pneumoniae TW-183
gaucuuuugauaacuuugcauga

SEQ ID NO: 2570437 - RNA, 14 nt, Chlamydophila pneumoniae TW-183
gaugaauaccagaa

SEQ ID NO: 2570438 - RNA, 16 nt, Chlamydophila pneumoniae TW-183
gaugacuuucagagca

SEQ ID NO: 2570439 - RNA, 19 nt, Chlamydophila pneumoniae TW-183
gaugauccacugcuuuagg

SEQ ID NO: 2570440 - RNA, 21 nt, Chlamydophila pneumoniae TW-183
gaugauccacugcuuuaggcc

SEQ ID NO: 2570441 - RNA, 20 nt, Chlamydophila pneumoniae TW-183
gaugcaguccacgcuaucuc

SEQ ID NO: 2570442 - RNA, 18 nt, Chlamydophila pneumoniae TW-183
gaugccauuguagagauu

SEQ ID NO: 2570443 - RNA, 19 nt, Chlamydophila pneumoniae TW-183
gaugcuuagcaaaggcaac

SEQ ID NO: 2570444 - RNA, 17 nt, Chlamydophila pneumoniae TW-183
gauggucauaccaaccu

SEQ ID NO: 2570445 - RNA, 20 nt, Chlamydophila pneumoniae TW-183
gaugugccgugacuccagaa

SEQ ID NO: 2570446 - RNA, 17 nt, Chlamydophila pneumoniae TW-183
gauguuguggaucagaa

SEQ ID NO: 2570447 - RNA, 22 nt, Chlamydophila pneumoniae TW-183
gauuacagcaucuauagaauuu

SEQ ID NO: 2570448 - RNA, 17 nt, Chlamydophila pneumoniae TW-183
gauuaccuaaaacaaaa

SEQ ID NO: 2570449 - RNA, 19 nt, Chlamydophila pneumoniae TW-183
gauuaggaacaagucggca

SEQ ID NO: 2570450 - RNA, 15 nt, Chlamydophila pneumoniae TW-183
gauuaugaugccuca

SEQ ID NO: 2570451 - RNA, 14 nt, Chlamydophila pneumoniae TW-183
gauuauucuagagu

SEQ ID NO: 2570452 - RNA, 13 nt, Chlamydophila pneumoniae TW-183
gauucuacaaauu

SEQ ID NO: 2570453 - RNA, 13 nt, Chlamydophila pneumoniae TW-183
gauucuucagaau

SEQ ID NO: 2570454 - RNA, 18 nt, Chlamydophila pneumoniae TW-183
gauugaggauaaguucuu

SEQ ID NO: 2570455 - RNA, 21 nt, Chlamydophila pneumoniae TW-183
gauugaggauaaguucuucca

SEQ ID NO: 2570456 - RNA, 20 nt, Chlamydophila pneumoniae TW-183
gauuuccccuucagaggcua

SEQ ID NO: 2570457 - RNA, 14 nt, Chlamydophila pneumoniae TW-183
gauuucuuuuucag

SEQ ID NO: 2570458 - RNA, 19 nt, Chlamydophila pneumoniae TW-183
gauuuucaaagaccagaau

SEQ ID NO: 2570459 - RNA, 11 nt, Chlamydophila pneumoniae TW-183
gauuuucucua

SEQ ID NO: 2570460 - RNA, 11 nt, Chlamydophila pneumoniae TW-183
gauuuugugag

SEQ ID NO: 2570461 - RNA, 19 nt, Chlamydophila pneumoniae TW-183
gauuuuuuugguugcuucu

SEQ ID NO: 2570462 - RNA, 21 nt, Chlamydophila pneumoniae TW-183
gcaaacuccccaguuuuccau

SEQ ID NO: 2570463 - RNA, 16 nt, Chlamydophila pneumoniae TW-183
gcaacuaaacucucca

SEQ ID NO: 2570464 - RNA, 19 nt, Chlamydophila pneumoniae TW-183
gcaagcuguggcgauuuua

SEQ ID NO: 2570465 - RNA, 22 nt, Chlamydophila pneumoniae TW-183
gcaaguuguugauaauuacaga

SEQ ID NO: 2570466 - RNA, 21 nt, Chlamydophila pneumoniae TW-183
gcaauacaccaagggaugcca

SEQ ID NO: 2570467 - RNA, 18 nt, Chlamydophila pneumoniae TW-183
gcaaucuuugaagcucga

SEQ ID NO: 2570468 - RNA, 22 nt, Chlamydophila pneumoniae TW-183
gcaaucuuugaucgcuugugca

SEQ ID NO: 2570469 - RNA, 18 nt, Chlamydophila pneumoniae TW-183
gcaauugagcuucuuuag

SEQ ID NO: 2570470 - RNA, 15 nt, Chlamydophila pneumoniae TW-183
gcaauuuucucaaua

SEQ ID NO: 2570471 - RNA, 15 nt, Chlamydophila pneumoniae TW-183
gcacaaacuaacaua

SEQ ID NO: 2570472 - RNA, 23 nt, Chlamydophila pneumoniae TW-183
gcacccaaacugaugccaagaaa

SEQ ID NO: 2570473 - RNA, 16 nt, Chlamydophila pneumoniae TW-183
gcaccuaauaaagaag

SEQ ID NO: 2570474 - RNA, 15 nt, Chlamydophila pneumoniae TW-183
gcacgagagccucgg

SEQ ID NO: 2570475 - RNA, 18 nt, Chlamydophila pneumoniae TW-183
gcacuguaaaaaagaaau

SEQ ID NO: 2570476 - RNA, 13 nt, Chlamydophila pneumoniae TW-183
gcacuuacuucaa

SEQ ID NO: 2570477 - RNA, 18 nt, Chlamydophila pneumoniae TW-183
gcagagaugcuaacaacu

SEQ ID NO: 2570478 - RNA, 14 nt, Chlamydophila pneumoniae TW-183
gcagaguccuucuu

SEQ ID NO: 2570479 - RNA, 18 nt, Chlamydophila pneumoniae TW-183
gcagaguccuucuuuucc

SEQ ID NO: 2570480 - RNA, 23 nt, Chlamydophila pneumoniae TW-183
gcagagucucaguugagaaccuu

SEQ ID NO: 2570481 - RNA, 13 nt, Chlamydophila pneumoniae TW-183
gcagaucuuuuau

SEQ ID NO: 2570482 - RNA, 20 nt, Chlamydophila pneumoniae TW-183
gcaggcaucacuaaucucag

SEQ ID NO: 2570483 - RNA, 19 nt, Chlamydophila pneumoniae TW-183
gcaguccacgcuaucuccu

SEQ ID NO: 2570484 - RNA, 16 nt, Chlamydophila pneumoniae TW-183
gcaguugcaauaccaa

SEQ ID NO: 2570485 - RNA, 21 nt, Chlamydophila pneumoniae TW-183
gcauaaggauucugagaaguu

SEQ ID NO: 2570486 - RNA, 17 nt, Chlamydophila pneumoniae TW-183
gcauaaucucaccagaa

SEQ ID NO: 2570487 - RNA, 20 nt, Chlamydophila pneumoniae TW-183
gcauagauaucuuugggaga

SEQ ID NO: 2570488 - RNA, 13 nt, Chlamydophila pneumoniae TW-183
gcaucuucucgaa

SEQ ID NO: 2570489 - RNA, 21 nt, Chlamydophila pneumoniae TW-183
gcaugacgcuuuuccaaagca

SEQ ID NO: 2570490 - RNA, 22 nt, Chlamydophila pneumoniae TW-183
gcaugcaucuuaucaagagcuc

SEQ ID NO: 2570491 - RNA, 22 nt, Chlamydophila pneumoniae TW-183
gcaugccauaaucuauaggauu

SEQ ID NO: 2570492 - RNA, 20 nt, Chlamydophila pneumoniae TW-183
gcauucucuaaaugauuuuu

SEQ ID NO: 2570493 - RNA, 13 nt, Chlamydophila pneumoniae TW-183
gcauuuaaaacgg

SEQ ID NO: 2570494 - RNA, 16 nt, Chlamydophila pneumoniae TW-183
gcauuuaaacuaagaa

SEQ ID NO: 2570495 - RNA, 17 nt, Chlamydophila pneumoniae TW-183
gcauuuucuucuugcaa

SEQ ID NO: 2570496 - RNA, 12 nt, Chlamydophila pneumoniae TW-183
gccaacucucua

SEQ ID NO: 2570497 - RNA, 23 nt, Chlamydophila pneumoniae TW-183
gccagcagcgaggaguuuuccaa

SEQ ID NO: 2570498 - RNA, 21 nt, Chlamydophila pneumoniae TW-183
gccagcgaucacauagaaaac

SEQ ID NO: 2570499 - RNA, 20 nt, Chlamydophila pneumoniae TW-183
gccaggagagcuaacagcac

SEQ ID NO: 2570500 - RNA, 18 nt, Chlamydophila pneumoniae TW-183
gccccuggaauuucucca

SEQ ID NO: 2570501 - RNA, 19 nt, Chlamydophila pneumoniae TW-183
gccccuggaauuucuccag

SEQ ID NO: 2570502 - RNA, 22 nt, Chlamydophila pneumoniae TW-183
gccccuuaaagagaaucuccuc

SEQ ID NO: 2570503 - RNA, 21 nt, Chlamydophila pneumoniae TW-183
gcccugaugcuguaucuccac

SEQ ID NO: 2570504 - RNA, 21 nt, Chlamydophila pneumoniae TW-183
gccgugccuauagaaauuaga

SEQ ID NO: 2570505 - RNA, 13 nt, Chlamydophila pneumoniae TW-183
gccuaccaaaguu

SEQ ID NO: 2570506 - RNA, 18 nt, Chlamydophila pneumoniae TW-183
gccuauagaaauuagagu

SEQ ID NO: 2570507 - RNA, 23 nt, Chlamydophila pneumoniae TW-183
gccuaugggaggaauuccucuca

SEQ ID NO: 2570508 - RNA, 12 nt, Chlamydophila pneumoniae TW-183
gccucauugccg

SEQ ID NO: 2570509 - RNA, 15 nt, Chlamydophila pneumoniae TW-183
gccugcacgucugca

SEQ ID NO: 2570510 - RNA, 22 nt, Chlamydophila pneumoniae TW-183
gccuggaggcgguggcaugcca

SEQ ID NO: 2570511 - RNA, 23 nt, Chlamydophila pneumoniae TW-183
gccuggggaucuuaggaaauuug

SEQ ID NO: 2570512 - RNA, 20 nt, Chlamydophila pneumoniae TW-183
gccuguaauugauguuccuu

SEQ ID NO: 2570513 - RNA, 22 nt, Chlamydophila pneumoniae TW-183
gccugucuauaaaauaaauuuu

SEQ ID NO: 2570514 - RNA, 15 nt, Chlamydophila pneumoniae TW-183
gccuuacggccccug

SEQ ID NO: 2570515 - RNA, 20 nt, Chlamydophila pneumoniae TW-183
gccuuccuuaacaacaucac

SEQ ID NO: 2570516 - RNA, 17 nt, Chlamydophila pneumoniae TW-183
gccuugauugaacaguc

SEQ ID NO: 2570517 - RNA, 11 nt, Chlamydophila pneumoniae TW-183
gccuuucucuu

SEQ ID NO: 2570518 - RNA, 17 nt, Chlamydophila pneumoniae TW-183
gcgaaugucguuaaaaa

SEQ ID NO: 2570519 - RNA, 15 nt, Chlamydophila pneumoniae TW-183
gcgaccuaggagaaa

SEQ ID NO: 2570520 - RNA, 17 nt, Chlamydophila pneumoniae TW-183
gcgauacaauaaacaac

SEQ ID NO: 2570521 - RNA, 13 nt, Chlamydophila pneumoniae TW-183
gcgcuacagugac

SEQ ID NO: 2570522 - RNA, 15 nt, Chlamydophila pneumoniae TW-183
gcggaucuucuucug

SEQ ID NO: 2570523 - RNA, 22 nt, Chlamydophila pneumoniae TW-183
gcggcaacaagagcgcauuuua

SEQ ID NO: 2570524 - RNA, 19 nt, Chlamydophila pneumoniae TW-183
gcgucuccuugauuuggga

SEQ ID NO: 2570525 - RNA, 18 nt, Chlamydophila pneumoniae TW-183
gcguucuugaaucuucaa

SEQ ID NO: 2570526 - RNA, 18 nt, Chlamydophila pneumoniae TW-183
gcguuuuuugaaaauuuu

SEQ ID NO: 2570527 - RNA, 17 nt, Chlamydophila pneumoniae TW-183
gcuaaucaauccaagaa

SEQ ID NO: 2570528 - RNA, 20 nt, Chlamydophila pneumoniae TW-183
gguaucuccuugauaaaacg

SEQ ID NO: 2570529 - RNA, 15 nt, Chlamydophila pneumoniae TW-183
ggucacagcauuuuc

SEQ ID NO: 2570530 - RNA, 22 nt, Chlamydophila pneumoniae TW-183
ggucgauugagauugaggauaa

SEQ ID NO: 2570531 - RNA, 24 nt, Chlamydophila pneumoniae TW-183
ggugacuaaacaccuucuucuaaa

SEQ ID NO: 2570532 - RNA, 17 nt, Chlamydophila pneumoniae TW-183
ggugccuaggcuaagag

SEQ ID NO: 2570533 - RNA, 22 nt, Chlamydophila pneumoniae TW-183
gguucauuuccaaauucuugca

SEQ ID NO: 2570534 - RNA, 19 nt, Chlamydophila pneumoniae TW-183
gguuugcaugccuauuaag

SEQ ID NO: 2570535 - RNA, 14 nt, Chlamydophila pneumoniae TW-183
guaaaaauggcacu

SEQ ID NO: 2570536 - RNA, 21 nt, Chlamydophila pneumoniae TW-183
guaaaacacaaauagcaagag

SEQ ID NO: 2570537 - RNA, 20 nt, Chlamydophila pneumoniae TW-183
guaaaccaauugagcucucu

SEQ ID NO: 2570538 - RNA, 14 nt, Chlamydophila pneumoniae TW-183
guaaaguaugcaua

SEQ ID NO: 2570539 - RNA, 20 nt, Chlamydophila pneumoniae TW-183
guaaaguaugcauagccucg

SEQ ID NO: 2570540 - RNA, 20 nt, Chlamydophila pneumoniae TW-183
guaaauuuuuccuucaacac

SEQ ID NO: 2570541 - RNA, 20 nt, Chlamydophila pneumoniae TW-183
guaacauugaccuaaaggaa

SEQ ID NO: 2570542 - RNA, 19 nt, Chlamydophila pneumoniae TW-183
guaaccaauacagcauaaa

SEQ ID NO: 2570543 - RNA, 18 nt, Chlamydophila pneumoniae TW-183
guaauccuucuuucugcu

SEQ ID NO: 2570544 - RNA, 19 nt, Chlamydophila pneumoniae TW-183
guaauccuucuuucugcuc

SEQ ID NO: 2570545 - RNA, 18 nt, Chlamydophila pneumoniae TW-183
guaaucgagagaagaaau

SEQ ID NO: 2570546 - RNA, 14 nt, Chlamydophila pneumoniae TW-183
guaaucuguauaug

SEQ ID NO: 2570547 - RNA, 19 nt, Chlamydophila pneumoniae TW-183
guaauuuccauguacaaug

SEQ ID NO: 2570548 - RNA, 12 nt, Chlamydophila pneumoniae TW-183
guaccaagaaaa

SEQ ID NO: 2570549 - RNA, 13 nt, Chlamydophila pneumoniae TW-183
guaccaagaaaau

SEQ ID NO: 2570550 - RNA, 15 nt, Chlamydophila pneumoniae TW-183
guaccacauacucuu

SEQ ID NO: 2570551 - RNA, 16 nt, Chlamydophila pneumoniae TW-183
guaccacauacucuuc

SEQ ID NO: 2570552 - RNA, 17 nt, Chlamydophila pneumoniae TW-183
guaccacauacucuuca

SEQ ID NO: 2570553 - RNA, 19 nt, Chlamydophila pneumoniae TW-183
guacgcaaguaaagaaauu

SEQ ID NO: 2570554 - RNA, 21 nt, Chlamydophila pneumoniae TW-183
guacgucuuucaccaacuccu

SEQ ID NO: 2570555 - RNA, 19 nt, Chlamydophila pneumoniae TW-183
guacuaauuacagaauccc

SEQ ID NO: 2570556 - RNA, 16 nt, Chlamydophila pneumoniae TW-183
guagaauaacgcaagg

SEQ ID NO: 2570557 - RNA, 18 nt, Chlamydophila pneumoniae TW-183
guagcauuucuuucucuu

SEQ ID NO: 2570558 - RNA, 11 nt, Chlamydophila pneumoniae TW-183
guagccccagc

SEQ ID NO: 2570559 - RNA, 15 nt, Chlamydophila pneumoniae TW-183
guagccccagcaacc

SEQ ID NO: 2570560 - RNA, 24 nt, Chlamydophila pneumoniae TW-183
guagccuggaggcgguggcaugcc

SEQ ID NO: 2570561 - RNA, 22 nt, Chlamydophila pneumoniae TW-183
guagcuacaaaauuauuaaacu

SEQ ID NO: 2570562 - RNA, 17 nt, Chlamydophila pneumoniae TW-183
guagcuauuuuugagga

SEQ ID NO: 2570563 - RNA, 12 nt, Chlamydophila pneumoniae TW-183
guaggagcagcg

SEQ ID NO: 2570564 - RNA, 14 nt, Chlamydophila pneumoniae TW-183
guagguuuuuccaa

SEQ ID NO: 2570565 - RNA, 17 nt, Chlamydophila pneumoniae TW-183
guaguuucuaaaacaga

SEQ ID NO: 2570566 - RNA, 19 nt, Chlamydophila pneumoniae TW-183
guauaauagugagcucccu

SEQ ID NO: 2570567 - RNA, 16 nt, Chlamydophila pneumoniae TW-183
guauacgguaaugcca

SEQ ID NO: 2570568 - RNA, 19 nt, Chlamydophila pneumoniae TW-183
guaucaagaauaugggugu

SEQ ID NO: 2570569 - RNA, 22 nt, Chlamydophila pneumoniae TW-183
guaucuucuucgguguagaucu

SEQ ID NO: 2570570 - RNA, 21 nt, Chlamydophila pneumoniae TW-183
guauggauuucuccagcagcu

SEQ ID NO: 2570571 - RNA, 17 nt, Chlamydophila pneumoniae TW-183
gucaagaagugcuuuua

SEQ ID NO: 2570572 - RNA, 16 nt, Chlamydophila pneumoniae TW-183
gucacagcauuuucuc

SEQ ID NO: 2570573 - RNA, 17 nt, Chlamydophila pneumoniae TW-183
gucacagcauuuucucu

SEQ ID NO: 2570574 - RNA, 19 nt, Chlamydophila pneumoniae TW-183
gucaccuuaauggcuccua

SEQ ID NO: 2570575 - RNA, 13 nt, Chlamydophila pneumoniae TW-183
gucaguaaaacac

SEQ ID NO: 2570576 - RNA, 17 nt, Chlamydophila pneumoniae TW-183
gucauacuacucucauc

SEQ ID NO: 2570577 - RNA, 23 nt, Chlamydophila pneumoniae TW-183
gucaucaguggcgacugcaacag

SEQ ID NO: 2570578 - RNA, 15 nt, Chlamydophila pneumoniae TW-183
gucaugauuuuucaa

SEQ ID NO: 2570579 - RNA, 16 nt, Chlamydophila pneumoniae TW-183
guccagacuuuccucu

SEQ ID NO: 2570580 - RNA, 13 nt, Chlamydophila pneumoniae TW-183
guccuuacuugca

SEQ ID NO: 2570581 - RNA, 12 nt, Chlamydophila pneumoniae TW-183
guccuucuuccc

SEQ ID NO: 2570582 - RNA, 22 nt, Chlamydophila pneumoniae TW-183
gucggcucuauaaauuucucau

SEQ ID NO: 2570583 - RNA, 16 nt, Chlamydophila pneumoniae TW-183
gucuagaacacucaga

SEQ ID NO: 2570584 - RNA, 20 nt, Chlamydophila pneumoniae TW-183
gucuagcaguugcaauacca

SEQ ID NO: 2570585 - RNA, 20 nt, Chlamydophila pneumoniae TW-183
gucucuuaaaaaaaauuacu

SEQ ID NO: 2570586 - RNA, 23 nt, Chlamydophila pneumoniae TW-183
gucugcaaagagcaaaggagcgg

SEQ ID NO: 2570587 - RNA, 17 nt, Chlamydophila pneumoniae TW-183
gucuguuaacucagaga

SEQ ID NO: 2570588 - RNA, 13 nt, Chlamydophila pneumoniae TW-183
gucuuccaucucu

SEQ ID NO: 2570589 - RNA, 19 nt, Chlamydophila pneumoniae TW-183
gucuugacguugcgaacag

SEQ ID NO: 2570590 - RNA, 20 nt, Chlamydophila pneumoniae TW-183
gugacuaaacaccuucuucu

SEQ ID NO: 2570591 - RNA, 14 nt, Chlamydophila pneumoniae TW-183
gugacuuuucuucu

SEQ ID NO: 2570592 - RNA, 14 nt, Chlamydophila pneumoniae TW-183
gugcaugcaucuua

SEQ ID NO: 2570593 - RNA, 14 nt, Chlamydophila pneumoniae TW-183
gugcauuuucuucu

SEQ ID NO: 2570594 - RNA, 13 nt, Chlamydophila pneumoniae TW-183
gugccuguaauug

SEQ ID NO: 2570595 - RNA, 13 nt, Chlamydophila pneumoniae TW-183
gugcucuacccca

SEQ ID NO: 2570596 - RNA, 20 nt, Chlamydophila pneumoniae TW-183
gugcuguuuuuucacuuaca

SEQ ID NO: 2570597 - RNA, 22 nt, Chlamydophila pneumoniae TW-183
guggaucagaaaaaaugcguuu

SEQ ID NO: 2570598 - RNA, 16 nt, Chlamydophila pneumoniae TW-183
gugguuggauccaucg

SEQ ID NO: 2570599 - RNA, 13 nt, Chlamydophila pneumoniae TW-183
gugucuacaaaga

SEQ ID NO: 2570600 - RNA, 16 nt, Chlamydophila pneumoniae TW-183
gugugugguaaaaaua

SEQ ID NO: 2570601 - RNA, 13 nt, Chlamydophila pneumoniae TW-183
guguugaauaaga

SEQ ID NO: 2570602 - RNA, 12 nt, Chlamydophila pneumoniae TW-183
guuaaagagcau

SEQ ID NO: 2570603 - RNA, 19 nt, Chlamydophila pneumoniae TW-183
guuaacaaguaccaagaaa

SEQ ID NO: 2570604 - RNA, 21 nt, Chlamydophila pneumoniae TW-183
guuaacaaguaccaagaaaau

SEQ ID NO: 2570605 - RNA, 11 nt, Chlamydophila pneumoniae TW-183
guuaacaucaa

SEQ ID NO: 2570606 - RNA, 15 nt, Chlamydophila pneumoniae TW-183
guuaggauauggugu

SEQ ID NO: 2570607 - RNA, 15 nt, Chlamydophila pneumoniae TW-183
guuaggucuuaaagu

SEQ ID NO: 2570608 - RNA, 22 nt, Chlamydophila pneumoniae TW-183
guucaacuuuguuaauagaaga

SEQ ID NO: 2570609 - RNA, 19 nt, Chlamydophila pneumoniae TW-183
guucacuucaucgacagua

SEQ ID NO: 2570610 - RNA, 14 nt, Chlamydophila pneumoniae TW-183
guuccauagaguau

SEQ ID NO: 2570611 - RNA, 20 nt, Chlamydophila pneumoniae TW-183
guuccuacuucugcaggacu

SEQ ID NO: 2570612 - RNA, 19 nt, Chlamydophila pneumoniae TW-183
guucucaaagaucaucuac

SEQ ID NO: 2570613 - RNA, 13 nt, Chlamydophila pneumoniae TW-183
guucuugauuuuc

SEQ ID NO: 2570614 - RNA, 17 nt, Chlamydophila pneumoniae TW-183
guucuuguaauaaaaga

SEQ ID NO: 2570615 - RNA, 12 nt, Chlamydophila pneumoniae TW-183
guucuuuuugca

SEQ ID NO: 2570616 - RNA, 17 nt, Chlamydophila pneumoniae TW-183
guugaaaugagugagaa

SEQ ID NO: 2570617 - RNA, 15 nt, Chlamydophila pneumoniae TW-183
guugaccuuuuucau

SEQ ID NO: 2570618 - RNA, 23 nt, Chlamydophila pneumoniae TW-183
guugcgaacagcuccuggauauu

SEQ ID NO: 2570619 - RNA, 20 nt, Chlamydophila pneumoniae TW-183
guuggauccaucggcauuuc

SEQ ID NO: 2570620 - RNA, 23 nt, Chlamydophila pneumoniae TW-183
guuggauccaucggcauuucucc

SEQ ID NO: 2570621 - RNA, 15 nt, Chlamydophila pneumoniae TW-183
guuguuuuugcugaa

SEQ ID NO: 2570622 - RNA, 18 nt, Chlamydophila pneumoniae TW-183
guuuaaguccuucuuccc

SEQ ID NO: 2570623 - RNA, 12 nt, Chlamydophila pneumoniae TW-183
guuuagguaggc

SEQ ID NO: 2570624 - RNA, 19 nt, Chlamydophila pneumoniae TW-183
guuuccgaucauuuuugcu

SEQ ID NO: 2570625 - RNA, 13 nt, Chlamydophila pneumoniae TW-183
guuucuucaucug

SEQ ID NO: 2570626 - RNA, 16 nt, Chlamydophila pneumoniae TW-183
uacaauacuggagagg

SEQ ID NO: 2570627 - RNA, 17 nt, Chlamydophila pneumoniae TW-183
uacaaucucuagggaua

SEQ ID NO: 2570628 - RNA, 22 nt, Chlamydophila pneumoniae TW-183
uacaauuagagauucauaaaac

SEQ ID NO: 2570629 - RNA, 23 nt, Chlamydophila pneumoniae TW-183
uacaauuagagauucauaaaacu

SEQ ID NO: 2570630 - RNA, 21 nt, Chlamydophila pneumoniae TW-183
uacaauuuccuugguauccca

SEQ ID NO: 2570631 - RNA, 22 nt, Chlamydophila pneumoniae TW-183
uacagagggaauuucauguccu

SEQ ID NO: 2570632 - RNA, 21 nt, Chlamydophila pneumoniae TW-183
uacagagucuguguagccgua

SEQ ID NO: 2570633 - RNA, 14 nt, Chlamydophila pneumoniae TW-183
uacagcauaaaaau

SEQ ID NO: 2570634 - RNA, 18 nt, Chlamydophila pneumoniae TW-183
uacagcaucggcaaccag

SEQ ID NO: 2570635 - RNA, 16 nt, Chlamydophila pneumoniae TW-183
uacaggaaaacgcccu

SEQ ID NO: 2570636 - RNA, 17 nt, Chlamydophila pneumoniae TW-183
uacaucuccaagccaug

SEQ ID NO: 2570637 - RNA, 21 nt, Chlamydophila pneumoniae TW-183
uaccaaccuucgauuccaggc

SEQ ID NO: 2570638 - RNA, 20 nt, Chlamydophila pneumoniae TW-183
uaccaaggcagguaucuccu

SEQ ID NO: 2570639 - RNA, 15 nt, Chlamydophila pneumoniae TW-183
uaccauagaaagaua

SEQ ID NO: 2570640 - RNA, 19 nt, Chlamydophila pneumoniae TW-183
uacccuuccggggugcgac

SEQ ID NO: 2570641 - RNA, 19 nt, Chlamydophila pneumoniae TW-183
uaccgaccgaaucucucca

SEQ ID NO: 2570642 - RNA, 19 nt, Chlamydophila pneumoniae TW-183
uaccuuaguuuuuucuaag

SEQ ID NO: 2570643 - RNA, 22 nt, Chlamydophila pneumoniae TW-183
uaccuucaacaagaauaacuuu

SEQ ID NO: 2570644 - RNA, 15 nt, Chlamydophila pneumoniae TW-183
uaccuuguuuuccug

SEQ ID NO: 2570645 - RNA, 14 nt, Chlamydophila pneumoniae TW-183
uacgaauaaguuuu

SEQ ID NO: 2570646 - RNA, 13 nt, Chlamydophila pneumoniae TW-183
uacgauguuuucu

SEQ ID NO: 2570647 - RNA, 16 nt, Chlamydophila pneumoniae TW-183
uacgcaaguaaagaaa

SEQ ID NO: 2570648 - RNA, 14 nt, Chlamydophila pneumoniae TW-183
uacgcgcucuucuu

SEQ ID NO: 2570649 - RNA, 14 nt, Chlamydophila pneumoniae TW-183
uacgcuuuuuacug

SEQ ID NO: 2570650 - RNA, 15 nt, Chlamydophila pneumoniae TW-183
uacuacucucaucaa

SEQ ID NO: 2570651 - RNA, 15 nt, Chlamydophila pneumoniae TW-183
uacuacuuacaagaa

SEQ ID NO: 2570652 - RNA, 17 nt, Chlamydophila pneumoniae TW-183
uacuacuuacaagaaca

SEQ ID NO: 2570653 - RNA, 15 nt, Chlamydophila pneumoniae TW-183
uacuccauuggcaua

SEQ ID NO: 2570654 - RNA, 20 nt, Chlamydophila pneumoniae TW-183
uacuuacaagaacaaggcuc

SEQ ID NO: 2570655 - RNA, 24 nt, Chlamydophila pneumoniae TW-183
uacuucuccacagcuucuucguaa

SEQ ID NO: 2570656 - RNA, 23 nt, Chlamydophila pneumoniae TW-183
uacuuuaggaggggggauucugu

SEQ ID NO: 2570657 - RNA, 17 nt, Chlamydophila pneumoniae TW-183
uagaaaagugaagaaac

SEQ ID NO: 2570658 - RNA, 13 nt, Chlamydophila pneumoniae TW-183
uagaaaggaaucc

SEQ ID NO: 2570659 - RNA, 20 nt, Chlamydophila pneumoniae TW-183
uagaaauucuguagauacua

SEQ ID NO: 2570660 - RNA, 15 nt, Chlamydophila pneumoniae TW-183
uagaacacucagaga

SEQ ID NO: 2570661 - RNA, 16 nt, Chlamydophila pneumoniae TW-183
uagaacacucagagau

SEQ ID NO: 2570662 - RNA, 22 nt, Chlamydophila pneumoniae TW-183
uagaacagcauggacuccaaga

SEQ ID NO: 2570663 - RNA, 16 nt, Chlamydophila pneumoniae TW-183
uagaauacacagcuau

SEQ ID NO: 2570664 - RNA, 22 nt, Chlamydophila pneumoniae TW-183
uagaaucagagggacuccugug

SEQ ID NO: 2570665 - RNA, 23 nt, Chlamydophila pneumoniae TW-183
uagaaucagagggacuccuguga

SEQ ID NO: 2570666 - RNA, 12 nt, Chlamydophila pneumoniae TW-183
uagaauuuucuu

SEQ ID NO: 2570667 - RNA, 12 nt, Chlamydophila pneumoniae TW-183
uagagaaaauaa

SEQ ID NO: 2570668 - RNA, 23 nt, Chlamydophila pneumoniae TW-183
uagagaaagagugccaagagcau

SEQ ID NO: 2570669 - RNA, 23 nt, Chlamydophila pneumoniae TW-183
uagagaagaaaagagcucaucaa

SEQ ID NO: 2570670 - RNA, 18 nt, Chlamydophila pneumoniae TW-183
uagagauucuacaaauua

SEQ ID NO: 2570671 - RNA, 19 nt, Chlamydophila pneumoniae TW-183
uagagcaagauucuucaga

SEQ ID NO: 2570672 - RNA, 17 nt, Chlamydophila pneumoniae TW-183
uagaggguccagggucu

SEQ ID NO: 2570673 - RNA, 16 nt, Chlamydophila pneumoniae TW-183
uagagugacucaucag

SEQ ID NO: 2570674 - RNA, 16 nt, Chlamydophila pneumoniae TW-183
uagaguugacaauagg

SEQ ID NO: 2570675 - RNA, 21 nt, Chlamydophila pneumoniae TW-183
uagauacuuugcaauacacca

SEQ ID NO: 2570676 - RNA, 22 nt, Chlamydophila pneumoniae TW-183
uagauagcucuuugauuuucuu

SEQ ID NO: 2570677 - RNA, 18 nt, Chlamydophila pneumoniae TW-183
uagaucguuucuaucucc

SEQ ID NO: 2570678 - RNA, 19 nt, Chlamydophila pneumoniae TW-183
uagaucguuucuaucuccg

SEQ ID NO: 2570679 - RNA, 19 nt, Chlamydophila pneumoniae TW-183
uagauguaaucauaaaaaa

SEQ ID NO: 2570680 - RNA, 14 nt, Chlamydophila pneumoniae TW-183
uagauuuaaaugca

SEQ ID NO: 2570681 - RNA, 13 nt, Chlamydophila pneumoniae TW-183
uagauuuuuacuu

SEQ ID NO: 2570682 - RNA, 23 nt, Chlamydophila pneumoniae TW-183
uagcaaagcgauggcuauagaua

SEQ ID NO: 2570683 - RNA, 15 nt, Chlamydophila pneumoniae TW-183
uagcaccuaauaaag

SEQ ID NO: 2570684 - RNA, 16 nt, Chlamydophila pneumoniae TW-183
uagcaggaguuuucaa

SEQ ID NO: 2570685 - RNA, 20 nt, Chlamydophila pneumoniae TW-183
uagcauaaucuuuaacaaag

SEQ ID NO: 2570686 - RNA, 20 nt, Chlamydophila pneumoniae TW-183
uagcauagccuuccauaucu

SEQ ID NO: 2570687 - RNA, 15 nt, Chlamydophila pneumoniae TW-183
uagcauuucuuucuc

SEQ ID NO: 2570688 - RNA, 16 nt, Chlamydophila pneumoniae TW-183
uagcauuucuuucucu

SEQ ID NO: 2570689 - RNA, 17 nt, Chlamydophila pneumoniae TW-183
uagcauuucuuucucuu

SEQ ID NO: 2570690 - RNA, 23 nt, Chlamydophila pneumoniae TW-183
uagcccuagaguaaagaguagcc

SEQ ID NO: 2570691 - RNA, 22 nt, Chlamydophila pneumoniae TW-183
ucgaucucugugguuccuggau

SEQ ID NO: 2570692 - RNA, 18 nt, Chlamydophila pneumoniae TW-183
ucgauugagauugaggau

SEQ ID NO: 2570693 - RNA, 19 nt, Chlamydophila pneumoniae TW-183
ucgccuuccuuaacaacau

SEQ ID NO: 2570694 - RNA, 15 nt, Chlamydophila pneumoniae TW-183
ucgcggaucuucuuc

SEQ ID NO: 2570695 - RNA, 12 nt, Chlamydophila pneumoniae TW-183
ucgcuaccauau

SEQ ID NO: 2570696 - RNA, 14 nt, Chlamydophila pneumoniae TW-183
ucgcuugugcaugc

SEQ ID NO: 2570697 - RNA, 20 nt, Chlamydophila pneumoniae TW-183
ucgcuugugcaugcaucuua

SEQ ID NO: 2570698 - RNA, 15 nt, Chlamydophila pneumoniae TW-183
ucggagauuguuuca

SEQ ID NO: 2570699 - RNA, 13 nt, Chlamydophila pneumoniae TW-183
ucggaucuguaau

SEQ ID NO: 2570700 - RNA, 16 nt, Chlamydophila pneumoniae TW-183
ucggggauugcaaaau

SEQ ID NO: 2570701 - RNA, 21 nt, Chlamydophila pneumoniae TW-183
ucgguaauuuccauguacaau

SEQ ID NO: 2570702 - RNA, 17 nt, Chlamydophila pneumoniae TW-183
ucggugucuacaaagau

SEQ ID NO: 2570703 - RNA, 22 nt, Chlamydophila pneumoniae TW-183
ucguaauccuucuuucugcucu

SEQ ID NO: 2570704 - RNA, 16 nt, Chlamydophila pneumoniae TW-183
ucguaccugcugcuuc

SEQ ID NO: 2570705 - RNA, 14 nt, Chlamydophila pneumoniae TW-183
ucguagcuaaauug

SEQ ID NO: 2570706 - RNA, 12 nt, Chlamydophila pneumoniae TW-183
ucguagcuuccc

SEQ ID NO: 2570707 - RNA, 12 nt, Chlamydophila pneumoniae TW-183
ucgucaccugag

SEQ ID NO: 2570708 - RNA, 22 nt, Chlamydophila pneumoniae TW-183
ucguccugacacaacucuuaaa

SEQ ID NO: 2570709 - RNA, 18 nt, Chlamydophila pneumoniae TW-183
ucuaaaacagaaauugcu

SEQ ID NO: 2570710 - RNA, 20 nt, Chlamydophila pneumoniae TW-183
ucuaaaagcaaguuguugau

SEQ ID NO: 2570711 - RNA, 17 nt, Chlamydophila pneumoniae TW-183
ucuaagcgcucuucaau

SEQ ID NO: 2570712 - RNA, 23 nt, Chlamydophila pneumoniae TW-183
ucuaagcugugcauuuucuucuu

SEQ ID NO: 2570713 - RNA, 20 nt, Chlamydophila pneumoniae TW-183
ucuaaggacaaaucucccaa

SEQ ID NO: 2570714 - RNA, 19 nt, Chlamydophila pneumoniae TW-183
ucuaaggcauuggaaaucu

SEQ ID NO: 2570715 - RNA, 14 nt, Chlamydophila pneumoniae TW-183
ucuacaaagauccu

SEQ ID NO: 2570716 - RNA, 23 nt, Chlamydophila pneumoniae TW-183
ucuacgauguuuucuuauccuug

SEQ ID NO: 2570717 - RNA, 16 nt, Chlamydophila pneumoniae TW-183
ucuacgcgcucuucuu

SEQ ID NO: 2570718 - RNA, 23 nt, Chlamydophila pneumoniae TW-183
ucuacgcgcucuucuuucucuau

SEQ ID NO: 2570719 - RNA, 17 nt, Chlamydophila pneumoniae TW-183
ucuacgcggagaaugcu

SEQ ID NO: 2570720 - RNA, 21 nt, Chlamydophila pneumoniae TW-183
ucuagaaaaauucuuuaggga

SEQ ID NO: 2570721 - RNA, 13 nt, Chlamydophila pneumoniae TW-183
ucuagaacacuca

SEQ ID NO: 2570722 - RNA, 14 nt, Chlamydophila pneumoniae TW-183
ucuagaaguuuaaa

SEQ ID NO: 2570723 - RNA, 17 nt, Chlamydophila pneumoniae TW-183
ucuagaguugcuuuaug

SEQ ID NO: 2570724 - RNA, 22 nt, Chlamydophila pneumoniae TW-183
ucuagcaguugcaauaccaauu

SEQ ID NO: 2570725 - RNA, 19 nt, Chlamydophila pneumoniae TW-183
ucuaugagaguaaguuuuu

SEQ ID NO: 2570726 - RNA, 22 nt, Chlamydophila pneumoniae TW-183
ucuaugagaguaaguuuuuaau

SEQ ID NO: 2570727 - RNA, 14 nt, Chlamydophila pneumoniae TW-183
ucuauguguucucg

SEQ ID NO: 2570728 - RNA, 18 nt, Chlamydophila pneumoniae TW-183
ucuauucgcugucuagaa

SEQ ID NO: 2570729 - RNA, 16 nt, Chlamydophila pneumoniae TW-183
ucucaaagaucaucua

SEQ ID NO: 2570730 - RNA, 22 nt, Chlamydophila pneumoniae TW-183
ucucaaggucacagcauuuucu

SEQ ID NO: 2570731 - RNA, 14 nt, Chlamydophila pneumoniae TW-183
ucucacauuugcag

SEQ ID NO: 2570732 - RNA, 13 nt, Chlamydophila pneumoniae TW-183
ucucaccagaagc

SEQ ID NO: 2570733 - RNA, 18 nt, Chlamydophila pneumoniae TW-183
ucucaccagaagcaacua

SEQ ID NO: 2570734 - RNA, 15 nt, Chlamydophila pneumoniae TW-183
ucucaguuaaagagc

SEQ ID NO: 2570735 - RNA, 14 nt, Chlamydophila pneumoniae TW-183
ucucauaaguauag

SEQ ID NO: 2570736 - RNA, 16 nt, Chlamydophila pneumoniae TW-183
ucucaugcauaggcuu

SEQ ID NO: 2570737 - RNA, 22 nt, Chlamydophila pneumoniae TW-183
ucucaugcggacuuuauucucu

SEQ ID NO: 2570738 - RNA, 17 nt, Chlamydophila pneumoniae TW-183
ucucauuccagcaucuu

SEQ ID NO: 2570739 - RNA, 19 nt, Chlamydophila pneumoniae TW-183
ucucauuccagcaucuucu

SEQ ID NO: 2570740 - RNA, 23 nt, Chlamydophila pneumoniae TW-183
ucucauuccagcaucuucucgaa

SEQ ID NO: 2570741 - RNA, 16 nt, Chlamydophila pneumoniae TW-183
ucuccaaaagcucuac

SEQ ID NO: 2570742 - RNA, 13 nt, Chlamydophila pneumoniae TW-183
ucuccaacuaaac

SEQ ID NO: 2570743 - RNA, 18 nt, Chlamydophila pneumoniae TW-183
ucuccaguaucuucucuu

SEQ ID NO: 2570744 - RNA, 15 nt, Chlamydophila pneumoniae TW-183
ucuccccauucacaa

SEQ ID NO: 2570745 - RNA, 13 nt, Chlamydophila pneumoniae TW-183
ucuccucaucaga

SEQ ID NO: 2570746 - RNA, 14 nt, Chlamydophila pneumoniae TW-183
ucuccucaucagaa

SEQ ID NO: 2570747 - RNA, 15 nt, Chlamydophila pneumoniae TW-183
ucuccuugauuuggg

SEQ ID NO: 2570748 - RNA, 12 nt, Chlamydophila pneumoniae TW-183
ucucgaagcuug

SEQ ID NO: 2570749 - RNA, 13 nt, Chlamydophila pneumoniae TW-183
ucucuaaaugauu

SEQ ID NO: 2570750 - RNA, 16 nt, Chlamydophila pneumoniae TW-183
ucucuaaaugauuuuu

SEQ ID NO: 2570751 - RNA, 18 nt, Chlamydophila pneumoniae TW-183
ucucuaaaugauuuuuaa

SEQ ID NO: 2570752 - RNA, 21 nt, Chlamydophila pneumoniae TW-183
ucucuagcuguuaauucccgu

SEQ ID NO: 2570753 - RNA, 15 nt, Chlamydophila pneumoniae TW-183
ucucuaggaacucuu

SEQ ID NO: 2570754 - RNA, 16 nt, Chlamydophila pneumoniae TW-183
ucucugccuaccaaag

SEQ ID NO: 2570755 - RNA, 13 nt, Chlamydophila pneumoniae TW-183
ucucuuaaaaaaa

SEQ ID NO: 2570756 - RNA, 15 nt, Chlamydophila pneumoniae TW-183
ucucuuaaaaaaaau

SEQ ID NO: 2570757 - RNA, 22 nt, Chlamydophila pneumoniae TW-183
ucucuucgcuggcauguuuaau

SEQ ID NO: 2570758 - RNA, 20 nt, Chlamydophila pneumoniae TW-183
ucucuugaagcacuuugacu

SEQ ID NO: 2570759 - RNA, 19 nt, Chlamydophila pneumoniae TW-183
ucucuuuaacuucuaaaag

SEQ ID NO: 2570760 - RNA, 13 nt, Chlamydophila pneumoniae TW-183
ucugaaacauaag

SEQ ID NO: 2570761 - RNA, 18 nt, Chlamydophila pneumoniae TW-183
ucugaacaggaauagaaa

SEQ ID NO: 2570762 - RNA, 13 nt, Chlamydophila pneumoniae TW-183
ucugagaaguuaa

SEQ ID NO: 2570763 - RNA, 16 nt, Chlamydophila pneumoniae TW-183
ucugaguuagcuuuug

SEQ ID NO: 2570764 - RNA, 16 nt, Chlamydophila pneumoniae TW-183
ucugauccgaaaagaa

SEQ ID NO: 2570765 - RNA, 17 nt, Chlamydophila pneumoniae TW-183
ucugcaggacugucuag

SEQ ID NO: 2570766 - RNA, 15 nt, Chlamydophila pneumoniae TW-183
ucugcugaagggaca

SEQ ID NO: 2570767 - RNA, 18 nt, Chlamydophila pneumoniae TW-183
ucuggcugagagaagcag

SEQ ID NO: 2570768 - RNA, 18 nt, Chlamydophila pneumoniae TW-183
ucugggaguuguaaaacu

SEQ ID NO: 2570769 - RNA, 23 nt, Chlamydophila pneumoniae TW-183
ucuguagguuuuuccaacuucaa

SEQ ID NO: 2570770 - RNA, 14 nt, Chlamydophila pneumoniae TW-183
ucuuagcuccugua

SEQ ID NO: 2570771 - RNA, 17 nt, Chlamydophila pneumoniae TW-183
ucuuauagggaauuuuu

SEQ ID NO: 2570772 - RNA, 18 nt, Chlamydophila pneumoniae TW-183
ucuuaugaaguccagacu

SEQ ID NO: 2570773 - RNA, 23 nt, Chlamydophila pneumoniae TW-183
ucuuaugaaguccagacuuuccu

SEQ ID NO: 2570774 - RNA, 13 nt, Chlamydophila pneumoniae TW-183
ucuucagcccacu

SEQ ID NO: 2570775 - RNA, 22 nt, Chlamydophila pneumoniae TW-183
ucuucagcccacuguuuugcuu

SEQ ID NO: 2570776 - RNA, 15 nt, Chlamydophila pneumoniae TW-183
ucuucaucacaaaau

SEQ ID NO: 2570777 - RNA, 16 nt, Chlamydophila pneumoniae TW-183
ucuucauccgaagacu

SEQ ID NO: 2570778 - RNA, 19 nt, Chlamydophila pneumoniae TW-183
ucuucauugcaaaaaugaa

SEQ ID NO: 2570779 - RNA, 20 nt, Chlamydophila pneumoniae TW-183
ucuucauugcaaaaaugaaa

SEQ ID NO: 2570780 - RNA, 19 nt, Chlamydophila pneumoniae TW-183
ucuuccaucucuuuaaaug

SEQ ID NO: 2570781 - RNA, 16 nt, Chlamydophila pneumoniae TW-183
ucuuccccccucacaa

SEQ ID NO: 2570782 - RNA, 14 nt, Chlamydophila pneumoniae TW-183
ucuuccgauuaacu

SEQ ID NO: 2570783 - RNA, 15 nt, Chlamydophila pneumoniae TW-183
ucuucgcuggcaugu

SEQ ID NO: 2570784 - RNA, 23 nt, Chlamydophila pneumoniae TW-183
ucuucgcuggcauguuuaauauc

SEQ ID NO: 2570785 - RNA, 21 nt, Chlamydophila pneumoniae TW-183
ucuucguaagcugcaaucuca

SEQ ID NO: 2570786 - RNA, 16 nt, Chlamydophila pneumoniae TW-183
ucuucuaaaaucuucu

SEQ ID NO: 2570787 - RNA, 17 nt, Chlamydophila pneumoniae TW-183
ucuucuaaaaucuucuc

SEQ ID NO: 2570788 - RNA, 21 nt, Chlamydophila pneumoniae TW-183
ucuucucgaacaggagagaga

SEQ ID NO: 2570789 - RNA, 17 nt, Chlamydophila pneumoniae TW-183
ucuucuggcugagagaa

SEQ ID NO: 2570790 - RNA, 17 nt, Chlamydophila pneumoniae TW-183
ucuucuucaucuucuaa

SEQ ID NO: 2570791 - RNA, 14 nt, Chlamydophila pneumoniae TW-183
ucuucuucuggcug

SEQ ID NO: 2570792 - RNA, 13 nt, Chlamydophila pneumoniae TW-183
ucuucuuucucua

SEQ ID NO: 2570793 - RNA, 17 nt, Chlamydophila pneumoniae TW-183
ucuugauguacaguaaa

SEQ ID NO: 2570794 - RNA, 22 nt, Chlamydophila pneumoniae TW-183
ucuugcucuagucuuucaaccu

SEQ ID NO: 2570795 - RNA, 15 nt, Chlamydophila pneumoniae TW-183
ucuuuagauagcucu

SEQ ID NO: 2570796 - RNA, 16 nt, Chlamydophila pneumoniae TW-183
ucuuucaauaacagag

SEQ ID NO: 2570797 - RNA, 14 nt, Chlamydophila pneumoniae TW-183
ucuuucuaagaaga

SEQ ID NO: 2570798 - RNA, 14 nt, Chlamydophila pneumoniae TW-183
ucuuucugcucuuc

SEQ ID NO: 2570799 - RNA, 15 nt, Chlamydophila pneumoniae TW-183
ucuuucugcucuucu

SEQ ID NO: 2570800 - RNA, 20 nt, Chlamydophila pneumoniae TW-183
ucuuugaggauacgaauaag

SEQ ID NO: 2570801 - RNA, 13 nt, Chlamydophila pneumoniae TW-183
ucuuugauuuucu

SEQ ID NO: 2570802 - RNA, 14 nt, Chlamydophila pneumoniae TW-183
ucuuugauuuucuu

SEQ ID NO: 2570803 - RNA, 19 nt, Chlamydophila pneumoniae TW-183
ucuuugggagauccugaaa

SEQ ID NO: 2570804 - RNA, 19 nt, Chlamydophila pneumoniae TW-183
ucuuugggauaaaaaguuu

SEQ ID NO: 2570805 - RNA, 18 nt, Chlamydophila pneumoniae TW-183
ucuuuucaucaagaaccc

SEQ ID NO: 2570806 - RNA, 17 nt, Chlamydophila pneumoniae TW-183
ucuuuucugaagauuuu

SEQ ID NO: 2570807 - RNA, 16 nt, Chlamydophila pneumoniae TW-183
ucuuuugauaacuuug

SEQ ID NO: 2570808 - RNA, 21 nt, Chlamydophila pneumoniae TW-183
ugaaaaucgcaccuugaccuc

SEQ ID NO: 2570809 - RNA, 17 nt, Chlamydophila pneumoniae TW-183
ugaaaccguaacugagg

SEQ ID NO: 2570810 - RNA, 12 nt, Chlamydophila pneumoniae TW-183
ugaaaucaugga

SEQ ID NO: 2570811 - RNA, 16 nt, Chlamydophila pneumoniae TW-183
ugaaauugcucuugcu

SEQ ID NO: 2570812 - RNA, 18 nt, Chlamydophila pneumoniae TW-183
ugaacuuuuguacacaga

SEQ ID NO: 2570813 - RNA, 16 nt, Chlamydophila pneumoniae TW-183
ugaagaaaccagaaca

SEQ ID NO: 2570814 - RNA, 15 nt, Chlamydophila pneumoniae TW-183
ugaagauuuuuucuu

SEQ ID NO: 2570815 - RNA, 20 nt, Chlamydophila pneumoniae TW-183
ugaagcagaggguuccaaga

SEQ ID NO: 2570816 - RNA, 17 nt, Chlamydophila pneumoniae TW-183
ugaagggacagucuccu

SEQ ID NO: 2570817 - RNA, 18 nt, Chlamydophila pneumoniae TW-183
ugaaguccagacuuuccu

SEQ ID NO: 2570818 - RNA, 12 nt, Chlamydophila pneumoniae TW-183
ugaauaagauuu

SEQ ID NO: 2570819 - RNA, 17 nt, Chlamydophila pneumoniae TW-183
ugaauaccagaagcaaa

SEQ ID NO: 2570820 - RNA, 19 nt, Chlamydophila pneumoniae TW-183
ugaauaguagaguugacaa

SEQ ID NO: 2570821 - RNA, 14 nt, Chlamydophila pneumoniae TW-183
ugaauaucaucacu

SEQ ID NO: 2570822 - RNA, 13 nt, Chlamydophila pneumoniae TW-183
ugaaucuucaaga

SEQ ID NO: 2570823 - RNA, 15 nt, Chlamydophila pneumoniae TW-183
ugaauuaauaaaaga

SEQ ID NO: 2570824 - RNA, 16 nt, Chlamydophila pneumoniae TW-183
ugaauuaauaaaagag

SEQ ID NO: 2570825 - RNA, 13 nt, Chlamydophila pneumoniae TW-183
ugacaaaauauuu

SEQ ID NO: 2570826 - RNA, 13 nt, Chlamydophila pneumoniae TW-183
ugacaaauagaaa

SEQ ID NO: 2570827 - RNA, 13 nt, Chlamydophila pneumoniae TW-183
ugaccuuuuucau

SEQ ID NO: 2570828 - RNA, 14 nt, Chlamydophila pneumoniae TW-183
ugaccuuuuucauu

SEQ ID NO: 2570829 - RNA, 17 nt, Chlamydophila pneumoniae TW-183
ugacgcuuuuccaaagc

SEQ ID NO: 2570830 - RNA, 18 nt, Chlamydophila pneumoniae TW-183
ugacgucuccaacagucu

SEQ ID NO: 2570831 - RNA, 22 nt, Chlamydophila pneumoniae TW-183
ugacguuaauaaagaggcuccc

SEQ ID NO: 2570832 - RNA, 19 nt, Chlamydophila pneumoniae TW-183
ugacuaaacaccuucuucu

SEQ ID NO: 2570833 - RNA, 22 nt, Chlamydophila pneumoniae TW-183
ugacuaaacaccuucuucuaaa

SEQ ID NO: 2570834 - RNA, 11 nt, Chlamydophila pneumoniae TW-183
ugacugaaacu

SEQ ID NO: 2570835 - RNA, 12 nt, Chlamydophila pneumoniae TW-183
ugacugaaacuc

SEQ ID NO: 2570836 - RNA, 15 nt, Chlamydophila pneumoniae TW-183
ugacuuuucuucuuc

SEQ ID NO: 2570837 - RNA, 18 nt, Chlamydophila pneumoniae TW-183
ugagaaccuucacaagaa

SEQ ID NO: 2570838 - RNA, 23 nt, Chlamydophila pneumoniae TW-183
ugagccaacagguucacuucauc

SEQ ID NO: 2570839 - RNA, 12 nt, Chlamydophila pneumoniae TW-183
ugagcuucuuua

SEQ ID NO: 2570840 - RNA, 14 nt, Chlamydophila pneumoniae TW-183
ugagcuucuuuaga

SEQ ID NO: 2570841 - RNA, 22 nt, Chlamydophila pneumoniae TW-183
ugaggaacgcacgccaagagag

SEQ ID NO: 2570842 - RNA, 22 nt, Chlamydophila pneumoniae TW-183
ugaggaaucauaaccaaaagaa

SEQ ID NO: 2570843 - RNA, 19 nt, Chlamydophila pneumoniae TW-183
ugaggacgcagagaugcua

SEQ ID NO: 2570844 - RNA, 19 nt, Chlamydophila pneumoniae TW-183
ugaggauaaguucuuccaa

SEQ ID NO: 2570845 - RNA, 14 nt, Chlamydophila pneumoniae TW-183
ugaggcuauagaau

SEQ ID NO: 2570846 - RNA, 20 nt, Chlamydophila pneumoniae TW-183
ugaguuagcuuuugugauac

SEQ ID NO: 2570847 - RNA, 13 nt, Chlamydophila pneumoniae TW-183
ugauaaggaagaa

SEQ ID NO: 2570848 - RNA, 22 nt, Chlamydophila pneumoniae TW-183
ugauaaggaagaauuucgucuu

SEQ ID NO: 2570849 - RNA, 14 nt, Chlamydophila pneumoniae TW-183
ugauagagaaaaua

SEQ ID NO: 2570850 - RNA, 16 nt, Chlamydophila pneumoniae TW-183
ugauagagaaaauaag

SEQ ID NO: 2570851 - RNA, 13 nt, Chlamydophila pneumoniae TW-183
ugauauuccuuga

SEQ ID NO: 2570852 - RNA, 13 nt, Chlamydophila pneumoniae TW-183
ugaucaggagucu

SEQ ID NO: 2570853 - RNA, 16 nt, Chlamydophila pneumoniae TW-183
ugauccuugcaaaaca

SEQ ID NO: 2570854 - RNA, 17 nt, Chlamydophila pneumoniae TW-183
ugauccuugcaaaacag

SEQ ID NO: 2570855 - RNA, 18 nt, Chlamydophila pneumoniae TW-183
ugaucuauguagauuacc

SEQ ID NO: 2570856 - RNA, 15 nt, Chlamydophila pneumoniae TW-183
ugaugcuguaucucc

SEQ ID NO: 2570857 - RNA, 16 nt, Chlamydophila pneumoniae TW-183
ugauguugcccuacaa

SEQ ID NO: 2570858 - RNA, 17 nt, Chlamydophila pneumoniae TW-183
ugauucauaaagaggaa

SEQ ID NO: 2570859 - RNA, 21 nt, Chlamydophila pneumoniae TW-183
ugauucauaaagaggaaugaa

SEQ ID NO: 2570860 - RNA, 15 nt, Chlamydophila pneumoniae TW-183
ugauugaaaccguaa

SEQ ID NO: 2570861 - RNA, 17 nt, Chlamydophila pneumoniae TW-183
ugauugaacagucuugc

SEQ ID NO: 2570862 - RNA, 16 nt, Chlamydophila pneumoniae TW-183
ugcaaaaaugaaagaa

SEQ ID NO: 2570863 - RNA, 12 nt, Chlamydophila pneumoniae TW-183
ugcaaaauuuaa

SEQ ID NO: 2570864 - RNA, 18 nt, Chlamydophila pneumoniae TW-183
ugcaagcuucaucaggag

SEQ ID NO: 2570865 - RNA, 17 nt, Chlamydophila pneumoniae TW-183
ugcaagugcuuucagga

SEQ ID NO: 2570866 - RNA, 14 nt, Chlamydophila pneumoniae TW-183
ugcacgagagccuc

SEQ ID NO: 2570867 - RNA, 17 nt, Chlamydophila pneumoniae TW-183
ugcacucuuucagaaag

SEQ ID NO: 2570868 - RNA, 19 nt, Chlamydophila pneumoniae TW-183
ugcagauauacuuuuucag

SEQ ID NO: 2570869 - RNA, 13 nt, Chlamydophila pneumoniae TW-183
ugcagaucuuuua

SEQ ID NO: 2570870 - RNA, 19 nt, Chlamydophila pneumoniae TW-183
ugcagcgaucaaaggcugc

SEQ ID NO: 2570871 - RNA, 19 nt, Chlamydophila pneumoniae TW-183
ugcaguccacgcuaucucc

SEQ ID NO: 2570872 - RNA, 20 nt, Chlamydophila pneumoniae TW-183
ugcaguccacgcuaucuccu

SEQ ID NO: 2570873 - RNA, 13 nt, Chlamydophila pneumoniae TW-183
ugcauaaucucac

SEQ ID NO: 2570874 - RNA, 21 nt, Chlamydophila pneumoniae TW-183
ugcauagauaucuuugggaga

SEQ ID NO: 2570875 - RNA, 17 nt, Chlamydophila pneumoniae TW-183
ugcaugauccuauuuuu

SEQ ID NO: 2570876 - RNA, 17 nt, Chlamydophila pneumoniae TW-183
ugcaugcaucuuaucaa

SEQ ID NO: 2570877 - RNA, 18 nt, Chlamydophila pneumoniae TW-183
ugcauuuucuucuugcaa

SEQ ID NO: 2570878 - RNA, 13 nt, Chlamydophila pneumoniae TW-183
ugccagcccaugu

SEQ ID NO: 2570879 - RNA, 18 nt, Chlamydophila pneumoniae TW-183
ugccucaggucugcugag

SEQ ID NO: 2570880 - RNA, 20 nt, Chlamydophila pneumoniae TW-183
ugccucauugccguggugag

SEQ ID NO: 2570881 - RNA, 14 nt, Chlamydophila pneumoniae TW-183
ugccuguuuuauug

SEQ ID NO: 2570882 - RNA, 19 nt, Chlamydophila pneumoniae TW-183
ugcgaaugucguuaaaaac

SEQ ID NO: 2570883 - RNA, 23 nt, Chlamydophila pneumoniae TW-183
ugcgauuuccccuucagaggcua

SEQ ID NO: 2570884 - RNA, 14 nt, Chlamydophila pneumoniae TW-183
ugcgcgucuccuug

SEQ ID NO: 2570885 - RNA, 16 nt, Chlamydophila pneumoniae TW-183
ugcgcuuguucuuuuc

SEQ ID NO: 2570886 - RNA, 23 nt, Chlamydophila pneumoniae TW-183
ugcggaugugccgugacuccaga

SEQ ID NO: 2570887 - RNA, 21 nt, Chlamydophila pneumoniae TW-183
ugcuagaucuggagagggaag

SEQ ID NO: 2570888 - RNA, 14 nt, Chlamydophila pneumoniae TW-183
ugcuaggaagauga

SEQ ID NO: 2570889 - RNA, 15 nt, Chlamydophila pneumoniae TW-183
ugcuauuuuccucua

SEQ ID NO: 2570890 - RNA, 23 nt, Chlamydophila pneumoniae TW-183
ugcuccuaagugauaaggaagaa

SEQ ID NO: 2570891 - RNA, 22 nt, Chlamydophila pneumoniae TW-183
ugcucuuuuaacuuaaagacuu

SEQ ID NO: 2570892 - RNA, 17 nt, Chlamydophila pneumoniae TW-183
ugcugaagauuuuuucu

SEQ ID NO: 2570893 - RNA, 21 nt, Chlamydophila pneumoniae TW-183
ugcugaggacgcagagaugcu

SEQ ID NO: 2570894 - RNA, 17 nt, Chlamydophila pneumoniae TW-183
ugcuucuauuuuagaau

SEQ ID NO: 2570895 - RNA, 17 nt, Chlamydophila pneumoniae TW-183
ugcuuggcaauagcuuu

SEQ ID NO: 2570896 - RNA, 20 nt, Chlamydophila pneumoniae TW-183
ugcuuuauggcucaacuuaa

SEQ ID NO: 2570897 - RNA, 23 nt, Chlamydophila pneumoniae TW-183
ugcuuucaggaguucuugauucu

SEQ ID NO: 2570898 - RNA, 22 nt, Chlamydophila pneumoniae TW-183
uggaacaguauaaucagaagug

SEQ ID NO: 2570899 - RNA, 17 nt, Chlamydophila pneumoniae TW-183
uggaagaauuucauaag

SEQ ID NO: 2570900 - RNA, 19 nt, Chlamydophila pneumoniae TW-183
uggaauauagguuuagauu

SEQ ID NO: 2570901 - RNA, 23 nt, Chlamydophila pneumoniae TW-183
uggaauggcuuuuguuuuguauu

SEQ ID NO: 2570902 - RNA, 13 nt, Chlamydophila pneumoniae TW-183
uggaauuuuccug

SEQ ID NO: 2570903 - RNA, 15 nt, Chlamydophila pneumoniae TW-183
uggacaauauagaga

SEQ ID NO: 2570904 - RNA, 17 nt, Chlamydophila pneumoniae TW-183
uggacuacugaaacacu

SEQ ID NO: 2570905 - RNA, 12 nt, Chlamydophila pneumoniae TW-183
uggacuccaaga

SEQ ID NO: 2570906 - RNA, 17 nt, Chlamydophila pneumoniae TW-183
uggagagggaaggaaua

SEQ ID NO: 2570907 - RNA, 15 nt, Chlamydophila pneumoniae TW-183
uggagcuguuucugc

SEQ ID NO: 2570908 - RNA, 21 nt, Chlamydophila pneumoniae TW-183
uggaggcgguggcaugccaua

SEQ ID NO: 2570909 - RNA, 17 nt, Chlamydophila pneumoniae TW-183
uggauauugucaagagg

SEQ ID NO: 2570910 - RNA, 20 nt, Chlamydophila pneumoniae TW-183
uggaucagaaaaaaugcguu

SEQ ID NO: 2570911 - RNA, 21 nt, Chlamydophila pneumoniae TW-183
uggauccaucggcauuucucc

SEQ ID NO: 2570912 - RNA, 22 nt, Chlamydophila pneumoniae TW-183
uggauccaucggcauuucucca

SEQ ID NO: 2570913 - RNA, 20 nt, Chlamydophila pneumoniae TW-183
uggaucuagagaagaaaaga

SEQ ID NO: 2570914 - RNA, 22 nt, Chlamydophila pneumoniae TW-183
uggauuucuccagcagcuuccc

SEQ ID NO: 2570915 - RNA, 14 nt, Chlamydophila pneumoniae TW-183
uggcauagagccua

SEQ ID NO: 2570916 - RNA, 20 nt, Chlamydophila pneumoniae TW-183
uggcuauagauacuuugcaa

SEQ ID NO: 2570917 - RNA, 14 nt, Chlamydophila pneumoniae TW-183
uggcucuauagggg

SEQ ID NO: 2570918 - RNA, 15 nt, Chlamydophila pneumoniae TW-183
uggcugagagaagca

SEQ ID NO: 2570919 - RNA, 17 nt, Chlamydophila pneumoniae TW-183
ugggaguuguaaaacuu

SEQ ID NO: 2570920 - RNA, 21 nt, Chlamydophila pneumoniae TW-183
ugggcauuuaacaacaugcgc

SEQ ID NO: 2570921 - RNA, 18 nt, Chlamydophila pneumoniae TW-183
uggggaucuuaggaaauu

SEQ ID NO: 2570922 - RNA, 20 nt, Chlamydophila pneumoniae TW-183
ugguccaucgagaaaugcuc

SEQ ID NO: 2570923 - RNA, 17 nt, Chlamydophila pneumoniae TW-183
uggucuuggguuuuaaa

SEQ ID NO: 2570924 - RNA, 13 nt, Chlamydophila pneumoniae TW-183
ugguuccuggauu

SEQ ID NO: 2570925 - RNA, 11 nt, Chlamydophila pneumoniae TW-183
uguaaaaguua

SEQ ID NO: 2570926 - RNA, 15 nt, Chlamydophila pneumoniae TW-183
uguaaauuuuuccuu

SEQ ID NO: 2570927 - RNA, 18 nt, Chlamydophila pneumoniae TW-183
uguaauaaaagaacauua

SEQ ID NO: 2570928 - RNA, 13 nt, Chlamydophila pneumoniae TW-183
uguacacagagau

SEQ ID NO: 2570929 - RNA, 16 nt, Chlamydophila pneumoniae TW-183
uguacacagagaugcu

SEQ ID NO: 2570930 - RNA, 20 nt, Chlamydophila pneumoniae TW-183
uguacaguaaaguaugcaua

SEQ ID NO: 2570931 - RNA, 22 nt, Chlamydophila pneumoniae TW-183
uguacuuccccaaacauggaca

SEQ ID NO: 2570932 - RNA, 24 nt, Chlamydophila pneumoniae TW-183
uguagaggucacuauagaucucuu

SEQ ID NO: 2570933 - RNA, 19 nt, Chlamydophila pneumoniae TW-183
uguagcauuucuuucucuu

SEQ ID NO: 2570934 - RNA, 20 nt, Chlamydophila pneumoniae TW-183
uguaguuucuaaaacagaaa

SEQ ID NO: 2570935 - RNA, 22 nt, Chlamydophila pneumoniae TW-183
uguauaugcuuggcaauagcuu

SEQ ID NO: 2570936 - RNA, 22 nt, Chlamydophila pneumoniae TW-183
uguauggugcgcgucuccuuga

SEQ ID NO: 2570937 - RNA, 15 nt, Chlamydophila pneumoniae TW-183
ugucaagaagugcuu

SEQ ID NO: 2570938 - RNA, 21 nt, Chlamydophila pneumoniae TW-183
uguccuccauggaaagaaaca

SEQ ID NO: 2570939 - RNA, 13 nt, Chlamydophila pneumoniae TW-183
uguccuugcagcc

SEQ ID NO: 2570940 - RNA, 15 nt, Chlamydophila pneumoniae TW-183
ugucgguaauuucca

SEQ ID NO: 2570941 - RNA, 13 nt, Chlamydophila pneumoniae TW-183
ugucguuaaaaac

SEQ ID NO: 2570942 - RNA, 17 nt, Chlamydophila pneumoniae TW-183
ugucugcaaagagcaaa

SEQ ID NO: 2570943 - RNA, 14 nt, Chlamydophila pneumoniae TW-183
ugugauauucuugg

SEQ ID NO: 2570944 - RNA, 19 nt, Chlamydophila pneumoniae TW-183
ugugauccuugcaaaacag

SEQ ID NO: 2570945 - RNA, 15 nt, Chlamydophila pneumoniae TW-183
ugugauguucugcug

SEQ ID NO: 2570946 - RNA, 15 nt, Chlamydophila pneumoniae TW-183
ugugcaugcaucuua

SEQ ID NO: 2570947 - RNA, 17 nt, Chlamydophila pneumoniae TW-183
ugugcauuuucuucuug

SEQ ID NO: 2570948 - RNA, 23 nt, Chlamydophila pneumoniae TW-183
ugugcauuuucuucuugcaaucu

SEQ ID NO: 2570949 - RNA, 14 nt, Chlamydophila pneumoniae TW-183
uguggaauuuuccu

SEQ ID NO: 2570950 - RNA, 22 nt, Chlamydophila pneumoniae TW-183
ugugguaaaaauauaggcugca

SEQ ID NO: 2570951 - RNA, 18 nt, Chlamydophila pneumoniae TW-183
uguuaacaaguaccaaga

SEQ ID NO: 2570952 - RNA, 23 nt, Chlamydophila pneumoniae TW-183
uguuaacaaguaccaagaaaaua

SEQ ID NO: 2570953 - RNA, 20 nt, Chlamydophila pneumoniae TW-183
uguuaauagaagaucauuaa

SEQ ID NO: 2570954 - RNA, 20 nt, Chlamydophila pneumoniae TW-183
uguuauaagugacuuuucuu

SEQ ID NO: 2570955 - RNA, 11 nt, Chlamydophila pneumoniae TW-183
uguucugcugc

SEQ ID NO: 2570956 - RNA, 14 nt, Chlamydophila pneumoniae TW-183
uguucuuuucauca

SEQ ID NO: 2570957 - RNA, 14 nt, Chlamydophila pneumoniae TW-183
uguugaauaagauu

SEQ ID NO: 2570958 - RNA, 13 nt, Chlamydophila pneumoniae TW-183
uguuuacagaugc

SEQ ID NO: 2570959 - RNA, 15 nt, Chlamydophila pneumoniae TW-183
uguuucgaaaguugg

SEQ ID NO: 2570960 - RNA, 12 nt, Chlamydophila pneumoniae TW-183
uguuuuauagau

SEQ ID NO: 2570961 - RNA, 16 nt, Chlamydophila pneumoniae TW-183
uguuuuugcugaagau

SEQ ID NO: 2570962 - RNA, 21 nt, Chlamydophila pneumoniae TW-183
uuaaacucugacgucuccaac

SEQ ID NO: 2570963 - RNA, 22 nt, Chlamydophila pneumoniae TW-183
uuaaacucugacgucuccaaca

SEQ ID NO: 2570964 - RNA, 11 nt, Chlamydophila pneumoniae TW-183
uuaaagagcau

SEQ ID NO: 2570965 - RNA, 24 nt, Chlamydophila pneumoniae TW-183
uuaaagagcauccuguagccacua

SEQ ID NO: 2570966 - RNA, 15 nt, Chlamydophila pneumoniae TW-183
uuaaagguaaaacua

SEQ ID NO: 2570967 - RNA, 13 nt, Chlamydophila pneumoniae TW-183
uuaacaaacuugu

SEQ ID NO: 2570968 - RNA, 18 nt, Chlamydophila pneumoniae TW-183
uuaacaaguaccaagaaa

SEQ ID NO: 2570969 - RNA, 19 nt, Chlamydophila pneumoniae TW-183
uuaacaaguaccaagaaaa

SEQ ID NO: 2570970 - RNA, 14 nt, Chlamydophila pneumoniae TW-183
uuaagaggaaagca

SEQ ID NO: 2570971 - RNA, 18 nt, Chlamydophila pneumoniae TW-183
uuaaguugaccuuuuuca

SEQ ID NO: 2570972 - RNA, 17 nt, Chlamydophila pneumoniae TW-183
uuaaugguagcuuaaga

SEQ ID NO: 2570973 - RNA, 20 nt, Chlamydophila pneumoniae TW-183
uuacagaugcaugauccuau

SEQ ID NO: 2570974 - RNA, 18 nt, Chlamydophila pneumoniae TW-183
uuacagcaucuauagaau

SEQ ID NO: 2570975 - RNA, 13 nt, Chlamydophila pneumoniae TW-183
uuacaucaaugau

SEQ ID NO: 2570976 - RNA, 21 nt, Chlamydophila pneumoniae TW-183
uuaccaucgucuccaaaaauu

SEQ ID NO: 2570977 - RNA, 17 nt, Chlamydophila pneumoniae TW-183
uuacugucugcaaagag

SEQ ID NO: 2570978 - RNA, 16 nt, Chlamydophila pneumoniae TW-183
uuacuucaagaaaaac

SEQ ID NO: 2570979 - RNA, 16 nt, Chlamydophila pneumoniae TW-183
uuacuugcauagauau

SEQ ID NO: 2570980 - RNA, 22 nt, Chlamydophila pneumoniae TW-183
uuacuugcgauacaauaaacaa

SEQ ID NO: 2570981 - RNA, 13 nt, Chlamydophila pneumoniae TW-183
uuagagugacuca

SEQ ID NO: 2570982 - RNA, 18 nt, Chlamydophila pneumoniae TW-183
uuagaguugaccauauaa

SEQ ID NO: 2570983 - RNA, 18 nt, Chlamydophila pneumoniae TW-183
uuagaucgauuaccuaaa

SEQ ID NO: 2570984 - RNA, 13 nt, Chlamydophila pneumoniae TW-183
uuagcaauugagc

SEQ ID NO: 2570985 - RNA, 23 nt, Chlamydophila pneumoniae TW-183
uuagguagauagaaauucuguag

SEQ ID NO: 2570986 - RNA, 12 nt, Chlamydophila pneumoniae TW-183
uuaggucuuaaa

SEQ ID NO: 2570987 - RNA, 21 nt, Chlamydophila pneumoniae TW-183
uuagucccgccguaugcauca

SEQ ID NO: 2570988 - RNA, 22 nt, Chlamydophila pneumoniae TW-183
uuauaaagaucgggucuacaac

SEQ ID NO: 2570989 - RNA, 15 nt, Chlamydophila pneumoniae TW-183
uuauagauaugccuc

SEQ ID NO: 2570990 - RNA, 11 nt, Chlamydophila pneumoniae TW-183
uuauauuaaga

SEQ ID NO: 2570991 - RNA, 20 nt, Chlamydophila pneumoniae TW-183
uuaucaaaagguuuuauaaa

SEQ ID NO: 2570992 - RNA, 20 nt, Chlamydophila pneumoniae TW-183
uuaucaggaacuaaaaguuu

SEQ ID NO: 2570993 - RNA, 19 nt, Chlamydophila pneumoniae TW-183
uuauccuugaaauugcucu

SEQ ID NO: 2570994 - RNA, 23 nt, Chlamydophila pneumoniae TW-183
uuaucgauaauaaaagcacccuc

SEQ ID NO: 2570995 - RNA, 19 nt, Chlamydophila pneumoniae TW-183
uuaugagggagcgaaguuu

SEQ ID NO: 2570996 - RNA, 20 nt, Chlamydophila pneumoniae TW-183
uucaacaaaggcuccaaacg

SEQ ID NO: 2570997 - RNA, 15 nt, Chlamydophila pneumoniae TW-183
uucaacaagaauaac

SEQ ID NO: 2570998 - RNA, 23 nt, Chlamydophila pneumoniae TW-183
uucaacuuuguuaauagaagauc

SEQ ID NO: 2570999 - RNA, 11 nt, Chlamydophila pneumoniae TW-183
uucaagaaaaa

SEQ ID NO: 2571000 - RNA, 20 nt, Chlamydophila pneumoniae TW-183
uucaauagguaaggaaacga

SEQ ID NO: 2571001 - RNA, 21 nt, Chlamydophila pneumoniae TW-183
uucaaugauuucuuuagcuuu

SEQ ID NO: 2571002 - RNA, 23 nt, Chlamydophila pneumoniae TW-183
uucacaaaucuuccccuaaaaau

SEQ ID NO: 2571003 - RNA, 20 nt, Chlamydophila pneumoniae TW-183
uucaccagaagcauugagga

SEQ ID NO: 2571004 - RNA, 22 nt, Chlamydophila pneumoniae TW-183
uucacccucauuaagaggaguc

SEQ ID NO: 2571005 - RNA, 19 nt, Chlamydophila pneumoniae TW-183
uucacuauuaggcuuuuuu

SEQ ID NO: 2571006 - RNA, 15 nt, Chlamydophila pneumoniae TW-183
uucacuuacagauaa

SEQ ID NO: 2571007 - RNA, 17 nt, Chlamydophila pneumoniae TW-183
uucacuuacagauaagg

SEQ ID NO: 2571008 - RNA, 11 nt, Chlamydophila pneumoniae TW-183
uucacuucauc

SEQ ID NO: 2571009 - RNA, 23 nt, Chlamydophila pneumoniae TW-183
uucagagagaacaggagguguau

SEQ ID NO: 2571010 - RNA, 14 nt, Chlamydophila pneumoniae TW-183
uucaggauuuagag

SEQ ID NO: 2571011 - RNA, 14 nt, Chlamydophila pneumoniae TW-183
uucagugcuguuuu

SEQ ID NO: 2571012 - RNA, 13 nt, Chlamydophila pneumoniae TW-183
uucauaaaacugu

SEQ ID NO: 2571013 - RNA, 23 nt, Chlamydophila pneumoniae TW-183
uucaucaagaacccgagacuucu

SEQ ID NO: 2571014 - RNA, 17 nt, Chlamydophila pneumoniae TW-183
uucaucaggagaacggu

SEQ ID NO: 2571015 - RNA, 20 nt, Chlamydophila pneumoniae TW-183
uucaucuaggggagcuauua

SEQ ID NO: 2571016 - RNA, 14 nt, Chlamydophila pneumoniae TW-183
uucauguccuccau

SEQ ID NO: 2571017 - RNA, 14 nt, Chlamydophila pneumoniae TW-183
uucauugcagauau

SEQ ID NO: 2571018 - RNA, 21 nt, Chlamydophila pneumoniae TW-183
uucauuguagaggucacuaua

SEQ ID NO: 2571019 - RNA, 13 nt, Chlamydophila pneumoniae TW-183
uuccaagagucuu

SEQ ID NO: 2571020 - RNA, 23 nt, Chlamydophila pneumoniae TW-183
uuccaauccauucugagaaagaa

SEQ ID NO: 2571021 - RNA, 22 nt, Chlamydophila pneumoniae TW-183
uuccagggcauucucuaaauga

SEQ ID NO: 2571022 - RNA, 19 nt, Chlamydophila pneumoniae TW-183
uuccauggauauggaaugg

SEQ ID NO: 2571023 - RNA, 15 nt, Chlamydophila pneumoniae TW-183
uuccauguacaauga

SEQ ID NO: 2571024 - RNA, 21 nt, Chlamydophila pneumoniae TW-183
uucccagccuugauugaacag

SEQ ID NO: 2571025 - RNA, 21 nt, Chlamydophila pneumoniae TW-183
uuccccuucagaggcuagaaa

SEQ ID NO: 2571026 - RNA, 13 nt, Chlamydophila pneumoniae TW-183
uuccccuucauca

SEQ ID NO: 2571027 - RNA, 17 nt, Chlamydophila pneumoniae TW-183
uuccggguucauuucca

SEQ ID NO: 2571028 - RNA, 12 nt, Chlamydophila pneumoniae TW-183
uuccuagagucg

SEQ ID NO: 2571029 - RNA, 19 nt, Chlamydophila pneumoniae TW-183
uuccuuaaugguagcuuaa

SEQ ID NO: 2571030 - RNA, 17 nt, Chlamydophila pneumoniae TW-183
uucgcggaucuucuucu

SEQ ID NO: 2571031 - RNA, 18 nt, Chlamydophila pneumoniae TW-183
uucgcugucuagaacacu

SEQ ID NO: 2571032 - RNA, 13 nt, Chlamydophila pneumoniae TW-183
uucgucuucauaa

SEQ ID NO: 2571033 - RNA, 16 nt, Chlamydophila pneumoniae TW-183
uucguggagugcucua

SEQ ID NO: 2571034 - RNA, 22 nt, Chlamydophila pneumoniae TW-183
uucguuuccgaucauuuuugcu

SEQ ID NO: 2571035 - RNA, 12 nt, Chlamydophila pneumoniae TW-183
uucuaaacaauu

SEQ ID NO: 2571036 - RNA, 21 nt, Chlamydophila pneumoniae TW-183
uucuaaaucccgccuuucuac

SEQ ID NO: 2571037 - RNA, 13 nt, Chlamydophila pneumoniae TW-183
uucuauguguucu

SEQ ID NO: 2571038 - RNA, 17 nt, Chlamydophila pneumoniae TW-183
uucuauguguucucgaa

SEQ ID NO: 2571039 - RNA, 17 nt, Chlamydophila pneumoniae TW-183
uucuauuuucaggaggc

SEQ ID NO: 2571040 - RNA, 14 nt, Chlamydophila pneumoniae TW-183
uucucaagaucuuc

SEQ ID NO: 2571041 - RNA, 18 nt, Chlamydophila pneumoniae TW-183
uucucaagaucuucauca

SEQ ID NO: 2571042 - RNA, 19 nt, Chlamydophila pneumoniae TW-183
uucucuaggaacucuuuaa

SEQ ID NO: 2571043 - RNA, 14 nt, Chlamydophila pneumoniae TW-183
uucucugagcagcu

SEQ ID NO: 2571044 - RNA, 14 nt, Chlamydophila pneumoniae TW-183
uucugaagauuuuu

SEQ ID NO: 2571045 - RNA, 19 nt, Chlamydophila pneumoniae TW-183
uucugauccgaaaagaacc

SEQ ID NO: 2571046 - RNA, 22 nt, Chlamydophila pneumoniae TW-183
uucugaugacguuaauaaagag

SEQ ID NO: 2571047 - RNA, 20 nt, Chlamydophila pneumoniae TW-183
uucuggaagauguuguuuuu

SEQ ID NO: 2571048 - RNA, 23 nt, Chlamydophila pneumoniae TW-183
uucugucuauaagauagcucuug

SEQ ID NO: 2571049 - RNA, 20 nt, Chlamydophila pneumoniae TW-183
uucuuaucaaaauaaaaaaa

SEQ ID NO: 2571050 - RNA, 22 nt, Chlamydophila pneumoniae TW-183
uucuuauccuugaaauugcucu

SEQ ID NO: 2571051 - RNA, 18 nt, Chlamydophila pneumoniae TW-183
uucuucaucuucuaaauc

SEQ ID NO: 2571052 - RNA, 16 nt, Chlamydophila pneumoniae TW-183
uucuucauugcagaua

SEQ ID NO: 2571053 - RNA, 18 nt, Chlamydophila pneumoniae TW-183
uucuuccaaagcuucuuu

SEQ ID NO: 2571054 - RNA, 24 nt, Chlamydophila pneumoniae TW-183
uucuucuaaaaucuucucugcuau

SEQ ID NO: 2571055 - RNA, 18 nt, Chlamydophila pneumoniae TW-183
uucuucuucggaucugua

SEQ ID NO: 2571056 - RNA, 21 nt, Chlamydophila pneumoniae TW-183
uucuuggaauauagguuuaga

SEQ ID NO: 2571057 - RNA, 18 nt, Chlamydophila pneumoniae TW-183
uucuuucggugucucuag

SEQ ID NO: 2571058 - RNA, 15 nt, Chlamydophila pneumoniae TW-183
uucuuuucugaagau

SEQ ID NO: 2571059 - RNA, 15 nt, Chlamydophila pneumoniae TW-183
uugaaauaauugagg

SEQ ID NO: 2571060 - RNA, 19 nt, Chlamydophila pneumoniae TW-183
uugaacguagcuacaaaau

SEQ ID NO: 2571061 - RNA, 18 nt, Chlamydophila pneumoniae TW-183
uugacaauaggcacccaa

SEQ ID NO: 2571062 - RNA, 23 nt, Chlamydophila pneumoniae TW-183
uugacuaaauccaccaaugauaa

SEQ ID NO: 2571063 - RNA, 15 nt, Chlamydophila pneumoniae TW-183
uugagaaaagaacag

SEQ ID NO: 2571064 - RNA, 13 nt, Chlamydophila pneumoniae TW-183
uugagcucucuag

SEQ ID NO: 2571065 - RNA, 17 nt, Chlamydophila pneumoniae TW-183
uugaggcaagucucaaa

SEQ ID NO: 2571066 - RNA, 13 nt, Chlamydophila pneumoniae TW-183
uugauaaaacgcu

SEQ ID NO: 2571067 - RNA, 16 nt, Chlamydophila pneumoniae TW-183
uugauaauuacagaag

SEQ ID NO: 2571068 - RNA, 23 nt, Chlamydophila pneumoniae TW-183
uugauuaggaacaagucggcagg

SEQ ID NO: 2571069 - RNA, 16 nt, Chlamydophila pneumoniae TW-183
uugauugaacagucuu

SEQ ID NO: 2571070 - RNA, 21 nt, Chlamydophila pneumoniae TW-183
uugcaauaccaauugggcuag

SEQ ID NO: 2571071 - RNA, 14 nt, Chlamydophila pneumoniae TW-183
uugcaauugccaua

SEQ ID NO: 2571072 - RNA, 16 nt, Chlamydophila pneumoniae TW-183
uugcagcucggaaugc

SEQ ID NO: 2571073 - RNA, 14 nt, Chlamydophila pneumoniae TW-183
uugcauagauaucu

SEQ ID NO: 2571074 - RNA, 21 nt, Chlamydophila pneumoniae TW-183
uugcauuaaaucguacuucac

SEQ ID NO: 2571075 - RNA, 12 nt, Chlamydophila pneumoniae TW-183
uugccuuucucu

SEQ ID NO: 2571076 - RNA, 19 nt, Chlamydophila pneumoniae TW-183
uugcgaacagcuccuggau

SEQ ID NO: 2571077 - RNA, 15 nt, Chlamydophila pneumoniae TW-183
uugcgccagcaaaga

SEQ ID NO: 2571078 - RNA, 16 nt, Chlamydophila pneumoniae TW-183
uugcggaaauugaaua

SEQ ID NO: 2571079 - RNA, 18 nt, Chlamydophila pneumoniae TW-183
uugcuagaucuggagagg

SEQ ID NO: 2571080 - RNA, 17 nt, Chlamydophila pneumoniae TW-183
uugcucuagucuuucaa

SEQ ID NO: 2571081 - RNA, 15 nt, Chlamydophila pneumoniae TW-183
uugcugaagauuuuu

SEQ ID NO: 2571082 - RNA, 13 nt, Chlamydophila pneumoniae TW-183
uugcugauuucuu

SEQ ID NO: 2571083 - RNA, 19 nt, Chlamydophila pneumoniae TW-183
uugcugauuucuuuuucag

SEQ ID NO: 2571084 - RNA, 19 nt, Chlamydophila pneumoniae TW-183
uugcuguggaauuuuccug

SEQ ID NO: 2571085 - RNA, 22 nt, Chlamydophila pneumoniae TW-183
uugcuucuccccgagauacggg

SEQ ID NO: 2571086 - RNA, 15 nt, Chlamydophila pneumoniae TW-183
uuggauaggauagga

SEQ ID NO: 2571087 - RNA, 16 nt, Chlamydophila pneumoniae TW-183
uuggaucuagagaaga

SEQ ID NO: 2571088 - RNA, 14 nt, Chlamydophila pneumoniae TW-183
uuggcaauagcuuu

SEQ ID NO: 2571089 - RNA, 21 nt, Chlamydophila pneumoniae TW-183
uugggagauccugaaaaaaga

SEQ ID NO: 2571090 - RNA, 16 nt, Chlamydophila pneumoniae TW-183
uugggauaaaaaguuu

SEQ ID NO: 2571091 - RNA, 21 nt, Chlamydophila pneumoniae TW-183
uugucacacugcgagagaaag

SEQ ID NO: 2571092 - RNA, 17 nt, Chlamydophila pneumoniae TW-183
uugugauccuugcaaaa

SEQ ID NO: 2571093 - RNA, 15 nt, Chlamydophila pneumoniae TW-183
uugugcgucaucaac

SEQ ID NO: 2571094 - RNA, 23 nt, Chlamydophila pneumoniae TW-183
uuguggacaacgauuguaaaagu

SEQ ID NO: 2571095 - RNA, 13 nt, Chlamydophila pneumoniae TW-183
uuguuguaacggg

SEQ ID NO: 2571096 - RNA, 14 nt, Chlamydophila pneumoniae TW-183
uuguuguuuuugcu

SEQ ID NO: 2571097 - RNA, 21 nt, Chlamydophila pneumoniae TW-183
uuuaaccgagcuuuuugcuuu

SEQ ID NO: 2571098 - RNA, 17 nt, Chlamydophila pneumoniae TW-183
uuuaacuucuaaaagca

SEQ ID NO: 2571099 - RNA, 21 nt, Chlamydophila pneumoniae TW-183
uuuaaucgauacgguuuuuau

SEQ ID NO: 2571100 - RNA, 16 nt, Chlamydophila pneumoniae TW-183
uuuacaauuagagauu

SEQ ID NO: 2571101 - RNA, 20 nt, Chlamydophila pneumoniae TW-183
uuuacacugcuucaaaacau

SEQ ID NO: 2571102 - RNA, 13 nt, Chlamydophila pneumoniae TW-183
uuuagcaauugag

SEQ ID NO: 2571103 - RNA, 16 nt, Chlamydophila pneumoniae TW-183
uuuagcgcuacaguga

SEQ ID NO: 2571104 - RNA, 15 nt, Chlamydophila pneumoniae TW-183
uuuaguuucccacua

SEQ ID NO: 2571105 - RNA, 18 nt, Chlamydophila pneumoniae TW-183
uuuauagcggaguguuuu

SEQ ID NO: 2571106 - RNA, 23 nt, Chlamydophila pneumoniae TW-183
uuuauauuuuuugagaaauauaa

SEQ ID NO: 2571107 - RNA, 22 nt, Chlamydophila pneumoniae TW-183
uuuaucccagauaaagacaucu

SEQ ID NO: 2571108 - RNA, 21 nt, Chlamydophila pneumoniae TW-183
uuucaaagaccagaauaccuu

SEQ ID NO: 2571109 - RNA, 17 nt, Chlamydophila pneumoniae TW-183
uuucaccaacuccucua

SEQ ID NO: 2571110 - RNA, 21 nt, Chlamydophila pneumoniae TW-183
uuucaccaacuccucuaagga

SEQ ID NO: 2571111 - RNA, 18 nt, Chlamydophila pneumoniae TW-183
uuucagugcuguuuuuuc

SEQ ID NO: 2571112 - RNA, 18 nt, Chlamydophila pneumoniae TW-183
uuucauguaagaauguag

SEQ ID NO: 2571113 - RNA, 13 nt, Chlamydophila pneumoniae TW-183
uuuccaacuucaa

SEQ ID NO: 2571114 - RNA, 15 nt, Chlamydophila pneumoniae TW-183
uuucccuucuaagga

SEQ ID NO: 2571115 - RNA, 19 nt, Chlamydophila pneumoniae TW-183
uuuccggggagaacuucaa

SEQ ID NO: 2571116 - RNA, 21 nt, Chlamydophila pneumoniae TW-183
uuuccggggagaacuucaaca

SEQ ID NO: 2571117 - RNA, 23 nt, Chlamydophila pneumoniae TW-183
uuuccguaaguaaccaauacagc

SEQ ID NO: 2571118 - RNA, 22 nt, Chlamydophila pneumoniae TW-183
uuuccucuaucagggagcggaa

SEQ ID NO: 2571119 - RNA, 17 nt, Chlamydophila pneumoniae TW-183
uuuccuugguaucccaa

SEQ ID NO: 2571120 - RNA, 19 nt, Chlamydophila pneumoniae TW-183
uuucuaaauagaaaacaua

SEQ ID NO: 2571121 - RNA, 20 nt, Chlamydophila pneumoniae TW-183
uuucuaaauagaaaacauag

SEQ ID NO: 2571122 - RNA, 17 nt, Chlamydophila pneumoniae TW-183
uuucuacgcgcucuucu

SEQ ID NO: 2571123 - RNA, 12 nt, Chlamydophila pneumoniae TW-183
uuucuauuuuca

SEQ ID NO: 2571124 - RNA, 17 nt, Chlamydophila pneumoniae TW-183
uuucucaauaguguaac

SEQ ID NO: 2571125 - RNA, 13 nt, Chlamydophila pneumoniae TW-183
uuucugaagauuu

SEQ ID NO: 2571126 - RNA, 18 nt, Chlamydophila pneumoniae TW-183
uuucugaaucuuuuguuu

SEQ ID NO: 2571127 - RNA, 13 nt, Chlamydophila pneumoniae TW-183
uuucugcucuucu

SEQ ID NO: 2571128 - RNA, 22 nt, Chlamydophila pneumoniae TW-183
uuucuggaagauguuguuuuuu

SEQ ID NO: 2571129 - RNA, 17 nt, Chlamydophila pneumoniae TW-183
uuucuguugcacuuucc

SEQ ID NO: 2571130 - RNA, 13 nt, Chlamydophila pneumoniae TW-183
uuugacaacacca

SEQ ID NO: 2571131 - RNA, 14 nt, Chlamydophila pneumoniae TW-183
uuugauagagaaaa

SEQ ID NO: 2571132 - RNA, 17 nt, Chlamydophila pneumoniae TW-183
uuugauagagaaaauaa

SEQ ID NO: 2571133 - RNA, 13 nt, Chlamydophila pneumoniae TW-183
uuugauucauaaa

SEQ ID NO: 2571134 - RNA, 16 nt, Chlamydophila pneumoniae TW-183
uuugauucauaaagag

SEQ ID NO: 2571135 - RNA, 19 nt, Chlamydophila pneumoniae TW-183
uuugauuuucuuagcuucc

SEQ ID NO: 2571136 - RNA, 17 nt, Chlamydophila pneumoniae TW-183
uuugcuagaucuggaga

SEQ ID NO: 2571137 - RNA, 12 nt, Chlamydophila pneumoniae TW-183
uuugcugaagau

SEQ ID NO: 2571138 - RNA, 16 nt, Chlamydophila pneumoniae TW-183
uuugcugcgaaugucg

SEQ ID NO: 2571139 - RNA, 15 nt, Chlamydophila pneumoniae TW-183
uuuguacacagagau

SEQ ID NO: 2571140 - RNA, 14 nt, Chlamydophila pneumoniae TW-183
uuuguaguguugaa

SEQ ID NO: 2571141 - RNA, 18 nt, Chlamydophila pneumoniae TW-183
uuugucgguaauuuccau

SEQ ID NO: 2571142 - RNA, 22 nt, Chlamydophila pneumoniae TW-183
uuugugauauucuuggaauaua

SEQ ID NO: 2571143 - RNA, 19 nt, Chlamydophila pneumoniae TW-183
uuuguguauggucucagga

SEQ ID NO: 2571144 - RNA, 20 nt, Chlamydophila pneumoniae TW-183
uuuuacuugcccaaaaguuu

SEQ ID NO: 2571145 - RNA, 14 nt, Chlamydophila pneumoniae TW-183
uuuucaagucugua

SEQ ID NO: 2571146 - RNA, 19 nt, Chlamydophila pneumoniae TW-183
uuuucagcaacgaguccuu

SEQ ID NO: 2571147 - RNA, 22 nt, Chlamydophila pneumoniae TW-183
uuuucaggaggcgcguagaucc

SEQ ID NO: 2571148 - RNA, 22 nt, Chlamydophila pneumoniae TW-183
uuuucagugcuguuuuuucacu

SEQ ID NO: 2571149 - RNA, 16 nt, Chlamydophila pneumoniae TW-183
uuuucccuuuuuagaa

SEQ ID NO: 2571150 - RNA, 20 nt, Chlamydophila pneumoniae TW-183
uuuucucaauaguguaacau

SEQ ID NO: 2571151 - RNA, 18 nt, Chlamydophila pneumoniae TW-183
uuuucuuagcuuccauau

SEQ ID NO: 2571152 - RNA, 22 nt, Chlamydophila pneumoniae TW-183
uuuucuuauagggaauuuuuuc

SEQ ID NO: 2571153 - RNA, 13 nt, Chlamydophila pneumoniae TW-183
uuuucuucuugca

SEQ ID NO: 2571154 - RNA, 22 nt, Chlamydophila pneumoniae TW-183
uuuucuuuucugaagauuuuuu

SEQ ID NO: 2571155 - RNA, 20 nt, Chlamydophila pneumoniae TW-183
uuuugaaaauugcauuuaaa

SEQ ID NO: 2571156 - RNA, 17 nt, Chlamydophila pneumoniae TW-183
uuuugcugaagauuuuu

SEQ ID NO: 2571157 - RNA, 18 nt, Chlamydophila pneumoniae TW-183
uuuugcugaagauuuuuu

SEQ ID NO: 2571158 - RNA, 21 nt, Chlamydophila pneumoniae TW-183
uuuuuaaccgagcuuuuugcu

SEQ ID NO: 2571159 - RNA, 21 nt, Chlamydophila pneumoniae TW-183
uuuuuagaagguguuuuggcu

SEQ ID NO: 2571160 - RNA, 22 nt, Chlamydophila pneumoniae TW-183
uuuuuagcaauugagcuucuuu

SEQ ID NO: 2571161 - RNA, 17 nt, Chlamydophila pneumoniae TW-183
uuuuuccaacuucaacu

SEQ ID NO: 2571162 - RNA, 13 nt, Chlamydophila pneumoniae TW-183
uuuuucucuugcu

SEQ ID NO: 2571163 - RNA, 22 nt, Chlamydophila pneumoniae TW-183
uuuuucuguuccugaguacuuu

SEQ ID NO: 2571164 - RNA, 13 nt, Chlamydophila pneumoniae TW-183
uuuuugaaaauuu

SEQ ID NO: 2571165 - RNA, 18 nt, Chlamydophila pneumoniae TW-183
uuuuuguucauccagaag

SEQ ID NO: 2571166 - RNA, 11 nt, Chlamydophila pneumoniae TW-183
uuuuuucuauu

SEQ ID NO: 2571167 - RNA, 13 nt, Chlamydophila pneumoniae TW-183
aaaaaaaauuacu

SEQ ID NO: 2571168 - RNA, 18 nt, Chlamydophila pneumoniae TW-183
aaaaaagcuagucuuucu

SEQ ID NO: 2571169 - RNA, 23 nt, Chlamydophila pneumoniae TW-183
aaaaaccccuagaacuuuacaau

SEQ ID NO: 2571170 - RNA, 20 nt, Chlamydophila pneumoniae TW-183
aaaaagcuuuuuucucuugc

SEQ ID NO: 2571171 - RNA, 17 nt, Chlamydophila pneumoniae TW-183
aaaaauccgauaagaua

SEQ ID NO: 2571172 - RNA, 22 nt, Chlamydophila pneumoniae TW-183
aaaaauggcacuugagcacauu

SEQ ID NO: 2571173 - RNA, 13 nt, Chlamydophila pneumoniae TW-183
aaaaauucccaua

SEQ ID NO: 2571174 - RNA, 13 nt, Chlamydophila pneumoniae TW-183
aaaaauucucaua

SEQ ID NO: 2571175 - RNA, 21 nt, Chlamydophila pneumoniae TW-183
aaaaauucucauaaccuaagg

SEQ ID NO: 2571176 - RNA, 16 nt, Chlamydophila pneumoniae TW-183
aaaaauucuuuaggga

SEQ ID NO: 2571177 - RNA, 18 nt, Chlamydophila pneumoniae TW-183
aaaacacgcccugaugcu

SEQ ID NO: 2571178 - RNA, 20 nt, Chlamydophila pneumoniae TW-183
aaaacagauaagacaauaaa

SEQ ID NO: 2571179 - RNA, 15 nt, Chlamydophila pneumoniae TW-183
aaaacauaucccaua

SEQ ID NO: 2571180 - RNA, 13 nt, Chlamydophila pneumoniae TW-183
aaaacgcuauugu

SEQ ID NO: 2571181 - RNA, 15 nt, Chlamydophila pneumoniae TW-183
aaaacggauagggcu

SEQ ID NO: 2571182 - RNA, 23 nt, Chlamydophila pneumoniae TW-183
aaaacuucuugugauccuugcaa

SEQ ID NO: 2571183 - RNA, 21 nt, Chlamydophila pneumoniae TW-183
aaaagaacauuaagaggaaag

SEQ ID NO: 2571184 - RNA, 17 nt, Chlamydophila pneumoniae TW-183
aaaagcuuuuuucucuu

SEQ ID NO: 2571185 - RNA, 15 nt, Chlamydophila pneumoniae TW-183
aaaagucaugaggac

SEQ ID NO: 2571186 - RNA, 19 nt, Chlamydophila pneumoniae TW-183
aaaagugaagaaaccagaa

SEQ ID NO: 2571187 - RNA, 20 nt, Chlamydophila pneumoniae TW-183
aaaauaagcaguuuucagug

SEQ ID NO: 2571188 - RNA, 15 nt, Chlamydophila pneumoniae TW-183
aaaauauucuuucaa

SEQ ID NO: 2571189 - RNA, 13 nt, Chlamydophila pneumoniae TW-183
aaaaucaaaaacu

SEQ ID NO: 2571190 - RNA, 14 nt, Chlamydophila pneumoniae TW-183
aaaaucuucucugc

SEQ ID NO: 2571191 - RNA, 13 nt, Chlamydophila pneumoniae TW-183
aaaaugaaagaaa

SEQ ID NO: 2571192 - RNA, 14 nt, Chlamydophila pneumoniae TW-183
aaaauuauuaaacu

SEQ ID NO: 2571193 - RNA, 15 nt, Chlamydophila pneumoniae TW-183
aaaauucaugcaaaa

SEQ ID NO: 2571194 - RNA, 19 nt, Chlamydophila pneumoniae TW-183
aaaauucccauagcaugag

SEQ ID NO: 2571195 - RNA, 17 nt, Chlamydophila pneumoniae TW-183
aaaauucuguaaaguga

SEQ ID NO: 2571196 - RNA, 21 nt, Chlamydophila pneumoniae TW-183
aaaauugaacguagcuacaaa

SEQ ID NO: 2571197 - RNA, 23 nt, Chlamydophila pneumoniae TW-183
aaaauuuaagauaucgaccuuaa

SEQ ID NO: 2571198 - RNA, 14 nt, Chlamydophila pneumoniae TW-183
aaacaaaaucaaaa

SEQ ID NO: 2571199 - RNA, 23 nt, Chlamydophila pneumoniae TW-183
aaacaacgaucgucaguaaaaca

SEQ ID NO: 2571200 - RNA, 12 nt, Chlamydophila pneumoniae TW-183
aaacaauuucaa

SEQ ID NO: 2571201 - RNA, 11 nt, Chlamydophila pneumoniae TW-183
aaacacaaaua

SEQ ID NO: 2571202 - RNA, 15 nt, Chlamydophila pneumoniae TW-183
aaacaccuucuucua

SEQ ID NO: 2571203 - RNA, 21 nt, Chlamydophila pneumoniae TW-183
aaacaccuucuucuaaaaucu

SEQ ID NO: 2571204 - RNA, 22 nt, Chlamydophila pneumoniae TW-183
aaacacuuuggauaggauagga

SEQ ID NO: 2571205 - RNA, 15 nt, Chlamydophila pneumoniae TW-183
aaacagcaucaggau

SEQ ID NO: 2571206 - RNA, 23 nt, Chlamydophila pneumoniae TW-183
aaacagcaucaggauucucucug

SEQ ID NO: 2571207 - RNA, 22 nt, Chlamydophila pneumoniae TW-183
aaacagcgguugccuuucucuu

SEQ ID NO: 2571208 - RNA, 16 nt, Chlamydophila pneumoniae TW-183
aaacauagagauucua

SEQ ID NO: 2571209 - RNA, 22 nt, Chlamydophila pneumoniae TW-183
aaacuaaaucaacuacaucucc

SEQ ID NO: 2571210 - RNA, 15 nt, Chlamydophila pneumoniae TW-183
aaacuaagaauaccu

SEQ ID NO: 2571211 - RNA, 20 nt, Chlamydophila pneumoniae TW-183
aaacuccaaaauauucuuuc

SEQ ID NO: 2571212 - RNA, 18 nt, Chlamydophila pneumoniae TW-183
aaacuccccaguuuucca

SEQ ID NO: 2571213 - RNA, 13 nt, Chlamydophila pneumoniae TW-183
aaacugaugccaa

SEQ ID NO: 2571214 - RNA, 19 nt, Chlamydophila pneumoniae TW-183
aaacugaugccaagaaaua

SEQ ID NO: 2571215 - RNA, 12 nt, Chlamydophila pneumoniae TW-183
aaacuucucuag

SEQ ID NO: 2571216 - RNA, 22 nt, Chlamydophila pneumoniae TW-183
aaacuuguuuucguaagagaau

SEQ ID NO: 2571217 - RNA, 21 nt, Chlamydophila pneumoniae TW-183
aaagaaauucuggagucgagc

SEQ ID NO: 2571218 - RNA, 21 nt, Chlamydophila pneumoniae TW-183
aaagaaggucuuccaucucuu

SEQ ID NO: 2571219 - RNA, 22 nt, Chlamydophila pneumoniae TW-183
aaagaagguugagacguaacca

SEQ ID NO: 2571220 - RNA, 14 nt, Chlamydophila pneumoniae TW-183
aaagaaguccuagg

SEQ ID NO: 2571221 - RNA, 17 nt, Chlamydophila pneumoniae TW-183
aaagaauuaagaagaag

SEQ ID NO: 2571222 - RNA, 15 nt, Chlamydophila pneumoniae TW-183
aaagacaucucuuua

SEQ ID NO: 2571223 - RNA, 22 nt, Chlamydophila pneumoniae TW-183
aaagacaucucuuuaacuucua

SEQ ID NO: 2571224 - RNA, 14 nt, Chlamydophila pneumoniae TW-183
aaagacugaaaaga

SEQ ID NO: 2571225 - RNA, 22 nt, Chlamydophila pneumoniae TW-183
aaagagaaucuccucaucagaa

SEQ ID NO: 2571226 - RNA, 14 nt, Chlamydophila pneumoniae TW-183
aaagagcucaaaaa

SEQ ID NO: 2571227 - RNA, 17 nt, Chlamydophila pneumoniae TW-183
aaagagugccaagagca

SEQ ID NO: 2571228 - RNA, 18 nt, Chlamydophila pneumoniae TW-183
aaagagugccaagagcau

SEQ ID NO: 2571229 - RNA, 11 nt, Chlamydophila pneumoniae TW-183
aaagauuaagg

SEQ ID NO: 2571230 - RNA, 17 nt, Chlamydophila pneumoniae TW-183
aaagauuauucuagagu

SEQ ID NO: 2571231 - RNA, 15 nt, Chlamydophila pneumoniae TW-183
aaagccuaugggagg

SEQ ID NO: 2571232 - RNA, 16 nt, Chlamydophila pneumoniae TW-183
aaagcuuuuuucucuu

SEQ ID NO: 2571233 - RNA, 19 nt, Chlamydophila pneumoniae TW-183
aaagcuuuuuucucuugcu

SEQ ID NO: 2571234 - RNA, 17 nt, Chlamydophila pneumoniae TW-183
aaaggaaucucgggaga

SEQ ID NO: 2571235 - RNA, 14 nt, Chlamydophila pneumoniae TW-183
aaaguaaucacuuc

SEQ ID NO: 2571236 - RNA, 23 nt, Chlamydophila pneumoniae TW-183
aaagugaaauugaacucucaguu

SEQ ID NO: 2571237 - RNA, 23 nt, Chlamydophila pneumoniae TW-183
aaaguuagguagauagaaauucu

SEQ ID NO: 2571238 - RNA, 22 nt, Chlamydophila pneumoniae TW-183
aaauaaaaaaacccucaaagaa

SEQ ID NO: 2571239 - RNA, 22 nt, Chlamydophila pneumoniae TW-183
aaauaagaaaucaguccuaaag

SEQ ID NO: 2571240 - RNA, 13 nt, Chlamydophila pneumoniae TW-183
aaauaagcaguuu

SEQ ID NO: 2571241 - RNA, 23 nt, Chlamydophila pneumoniae TW-183
aaauacguccagccugcaccaga

SEQ ID NO: 2571242 - RNA, 13 nt, Chlamydophila pneumoniae TW-183
aaauacuuuuccu

SEQ ID NO: 2571243 - RNA, 14 nt, Chlamydophila pneumoniae TW-183
aaauagaaaacaua

SEQ ID NO: 2571244 - RNA, 18 nt, Chlamydophila pneumoniae TW-183
aaauagaaaggaaucccu

SEQ ID NO: 2571245 - RNA, 15 nt, Chlamydophila pneumoniae TW-183
aaauagaaggccagu

SEQ ID NO: 2571246 - RNA, 19 nt, Chlamydophila pneumoniae TW-183
aaauagggugggagucucu

SEQ ID NO: 2571247 - RNA, 15 nt, Chlamydophila pneumoniae TW-183
aaauauacugccagc

SEQ ID NO: 2571248 - RNA, 19 nt, Chlamydophila pneumoniae TW-183
aaauauucuuucaaaccac

SEQ ID NO: 2571249 - RNA, 13 nt, Chlamydophila pneumoniae TW-183
aaaucacacuuaa

SEQ ID NO: 2571250 - RNA, 13 nt, Chlamydophila pneumoniae TW-183
aaauccgauaaga

SEQ ID NO: 2571251 - RNA, 19 nt, Chlamydophila pneumoniae TW-183
aaaucggagggcuacaguu

SEQ ID NO: 2571252 - RNA, 17 nt, Chlamydophila pneumoniae TW-183
aaaucguacuucacuuc

SEQ ID NO: 2571253 - RNA, 15 nt, Chlamydophila pneumoniae TW-183
aagcucuacaagcuc

SEQ ID NO: 2571254 - RNA, 20 nt, Chlamydophila pneumoniae TW-183
aagcugcaaucucaaaauca

SEQ ID NO: 2571255 - RNA, 18 nt, Chlamydophila pneumoniae TW-183
aagcuggauucugucuau

SEQ ID NO: 2571256 - RNA, 11 nt, Chlamydophila pneumoniae TW-183
aagcugugcau

SEQ ID NO: 2571257 - RNA, 19 nt, Chlamydophila pneumoniae TW-183
aagcugugcauuuucuucu

SEQ ID NO: 2571258 - RNA, 21 nt, Chlamydophila pneumoniae TW-183
aagcuucguccugacacaacu

SEQ ID NO: 2571259 - RNA, 22 nt, Chlamydophila pneumoniae TW-183
aagcuucguccugacacaacuc

SEQ ID NO: 2571260 - RNA, 17 nt, Chlamydophila pneumoniae TW-183
aagcuuugcgcuuguuc

SEQ ID NO: 2571261 - RNA, 20 nt, Chlamydophila pneumoniae TW-183
aagcuuugcgcuuguucuuu

SEQ ID NO: 2571262 - RNA, 14 nt, Chlamydophila pneumoniae TW-183
aaggaagagaguuu

SEQ ID NO: 2571263 - RNA, 15 nt, Chlamydophila pneumoniae TW-183
aaggacaaaucuccc

SEQ ID NO: 2571264 - RNA, 16 nt, Chlamydophila pneumoniae TW-183
aaggacaaucaacauu

SEQ ID NO: 2571265 - RNA, 14 nt, Chlamydophila pneumoniae TW-183
aaggauucugagaa

SEQ ID NO: 2571266 - RNA, 21 nt, Chlamydophila pneumoniae TW-183
aaggauucugagaaguuaaga

SEQ ID NO: 2571267 - RNA, 21 nt, Chlamydophila pneumoniae TW-183
aaggcucucaaggucacagca

SEQ ID NO: 2571268 - RNA, 23 nt, Chlamydophila pneumoniae TW-183
aaggcugccagagauucuucaca

SEQ ID NO: 2571269 - RNA, 18 nt, Chlamydophila pneumoniae TW-183
aaggcugcuugagacuug

SEQ ID NO: 2571270 - RNA, 19 nt, Chlamydophila pneumoniae TW-183
aaggcuuguuucuguuuuc

SEQ ID NO: 2571271 - RNA, 18 nt, Chlamydophila pneumoniae TW-183
aagggacuuguuguuuca

SEQ ID NO: 2571272 - RNA, 20 nt, Chlamydophila pneumoniae TW-183
aagggggaucuucagagaga

SEQ ID NO: 2571273 - RNA, 16 nt, Chlamydophila pneumoniae TW-183
aagguaaaacuacagg

SEQ ID NO: 2571274 - RNA, 17 nt, Chlamydophila pneumoniae TW-183
aaggucacagcauuuuc

SEQ ID NO: 2571275 - RNA, 15 nt, Chlamydophila pneumoniae TW-183
aaguaaagaaauucu

SEQ ID NO: 2571276 - RNA, 16 nt, Chlamydophila pneumoniae TW-183
aaguaccaagaaaaua

SEQ ID NO: 2571277 - RNA, 23 nt, Chlamydophila pneumoniae TW-183
aagucaaacaucacucaggauau

SEQ ID NO: 2571278 - RNA, 18 nt, Chlamydophila pneumoniae TW-183
aagucacggcgaaagcua

SEQ ID NO: 2571279 - RNA, 16 nt, Chlamydophila pneumoniae TW-183
aaguccagacuuuccu

SEQ ID NO: 2571280 - RNA, 17 nt, Chlamydophila pneumoniae TW-183
aagugaucuugagaaaa

SEQ ID NO: 2571281 - RNA, 18 nt, Chlamydophila pneumoniae TW-183
aagugaucuugagaaaag

SEQ ID NO: 2571282 - RNA, 20 nt, Chlamydophila pneumoniae TW-183
aagugcuuucaggaguucuu

SEQ ID NO: 2571283 - RNA, 18 nt, Chlamydophila pneumoniae TW-183
aaguuccauagaguaucu

SEQ ID NO: 2571284 - RNA, 18 nt, Chlamydophila pneumoniae TW-183
aaguucuuaagaaucgag

SEQ ID NO: 2571285 - RNA, 22 nt, Chlamydophila pneumoniae TW-183
aaguugaaaugagugagaaugc

SEQ ID NO: 2571286 - RNA, 20 nt, Chlamydophila pneumoniae TW-183
aaguuuugauuuugcaguga

SEQ ID NO: 2571287 - RNA, 16 nt, Chlamydophila pneumoniae TW-183
aaguuuuucuggaaga

SEQ ID NO: 2571288 - RNA, 14 nt, Chlamydophila pneumoniae TW-183
aauaaaagaacauu

SEQ ID NO: 2571289 - RNA, 14 nt, Chlamydophila pneumoniae TW-183
aauaaaauguccaa

SEQ ID NO: 2571290 - RNA, 15 nt, Chlamydophila pneumoniae TW-183
aauaagauccaaaaa

SEQ ID NO: 2571291 - RNA, 17 nt, Chlamydophila pneumoniae TW-183
aauaagauccaaaaauu

SEQ ID NO: 2571292 - RNA, 14 nt, Chlamydophila pneumoniae TW-183
aauaagauuuugaa

SEQ ID NO: 2571293 - RNA, 15 nt, Chlamydophila pneumoniae TW-183
aauaagauuuugaaa

SEQ ID NO: 2571294 - RNA, 16 nt, Chlamydophila pneumoniae TW-183
aauacagcauaaaaau

SEQ ID NO: 2571295 - RNA, 13 nt, Chlamydophila pneumoniae TW-183
aauaccagaagca

SEQ ID NO: 2571296 - RNA, 19 nt, Chlamydophila pneumoniae TW-183
aauaccagaagcaaaggua

SEQ ID NO: 2571297 - RNA, 20 nt, Chlamydophila pneumoniae TW-183
aauaccuucaacaagaauaa

SEQ ID NO: 2571298 - RNA, 15 nt, Chlamydophila pneumoniae TW-183
aauacguccagccug

SEQ ID NO: 2571299 - RNA, 23 nt, Chlamydophila pneumoniae TW-183
aauacguccagccugcaccagac

SEQ ID NO: 2571300 - RNA, 22 nt, Chlamydophila pneumoniae TW-183
aauacuggagagguaaccagag

SEQ ID NO: 2571301 - RNA, 12 nt, Chlamydophila pneumoniae TW-183
aauacuuuuccu

SEQ ID NO: 2571302 - RNA, 22 nt, Chlamydophila pneumoniae TW-183
aauagagaaagagugccaagag

SEQ ID NO: 2571303 - RNA, 14 nt, Chlamydophila pneumoniae TW-183
aauagcaagcacuu

SEQ ID NO: 2571304 - RNA, 23 nt, Chlamydophila pneumoniae TW-183
aauagcaggaaggaauagagaaa

SEQ ID NO: 2571305 - RNA, 14 nt, Chlamydophila pneumoniae TW-183
aauaggcacccaaa

SEQ ID NO: 2571306 - RNA, 17 nt, Chlamydophila pneumoniae TW-183
aauauagagaucuagau

SEQ ID NO: 2571307 - RNA, 15 nt, Chlamydophila pneumoniae TW-183
aauaucaucacuaag

SEQ ID NO: 2571308 - RNA, 14 nt, Chlamydophila pneumoniae TW-183
aauauccagaaaua

SEQ ID NO: 2571309 - RNA, 13 nt, Chlamydophila pneumoniae TW-183
aaucaauccaaga

SEQ ID NO: 2571310 - RNA, 14 nt, Chlamydophila pneumoniae TW-183
aaucagaagugauc

SEQ ID NO: 2571311 - RNA, 13 nt, Chlamydophila pneumoniae TW-183
aaucaguccuaaa

SEQ ID NO: 2571312 - RNA, 15 nt, Chlamydophila pneumoniae TW-183
aaucauaaaaaaagc

SEQ ID NO: 2571313 - RNA, 12 nt, Chlamydophila pneumoniae TW-183
aaucauaaccaa

SEQ ID NO: 2571314 - RNA, 20 nt, Chlamydophila pneumoniae TW-183
aaucauaaccaaaagaauua

SEQ ID NO: 2571315 - RNA, 13 nt, Chlamydophila pneumoniae TW-183
aauccaagaauag

SEQ ID NO: 2571316 - RNA, 20 nt, Chlamydophila pneumoniae TW-183
aaucccugcacucuuucaga

SEQ ID NO: 2571317 - RNA, 21 nt, Chlamydophila pneumoniae TW-183
aauccgauaagauaaagaauu

SEQ ID NO: 2571318 - RNA, 12 nt, Chlamydophila pneumoniae TW-183
aauccuucuuuc

SEQ ID NO: 2571319 - RNA, 19 nt, Chlamydophila pneumoniae TW-183
aaucgagagaagaaauucu

SEQ ID NO: 2571320 - RNA, 22 nt, Chlamydophila pneumoniae TW-183
aaucgagagaagaaauucugac

SEQ ID NO: 2571321 - RNA, 20 nt, Chlamydophila pneumoniae TW-183
aaucgauaacguugccuguu

SEQ ID NO: 2571322 - RNA, 16 nt, Chlamydophila pneumoniae TW-183
aaucuauaggauuugc

SEQ ID NO: 2571323 - RNA, 22 nt, Chlamydophila pneumoniae TW-183
aaucucauuccagcaucuucuc

SEQ ID NO: 2571324 - RNA, 16 nt, Chlamydophila pneumoniae TW-183
aaucucgggagaacau

SEQ ID NO: 2571325 - RNA, 23 nt, Chlamydophila pneumoniae TW-183
aaucucuagggauaauuaaacuc

SEQ ID NO: 2571326 - RNA, 13 nt, Chlamydophila pneumoniae TW-183
aaucugaaucuca

SEQ ID NO: 2571327 - RNA, 19 nt, Chlamydophila pneumoniae TW-183
aaucugugaguacccaguc

SEQ ID NO: 2571328 - RNA, 13 nt, Chlamydophila pneumoniae TW-183
aaucuuccccuaa

SEQ ID NO: 2571329 - RNA, 14 nt, Chlamydophila pneumoniae TW-183
aaucuuugaagcuc

SEQ ID NO: 2571330 - RNA, 20 nt, Chlamydophila pneumoniae TW-183
aaucuuugaagcucgaccuc

SEQ ID NO: 2571331 - RNA, 19 nt, Chlamydophila pneumoniae TW-183
aaucuuugaucgcuugugc

SEQ ID NO: 2571332 - RNA, 14 nt, Chlamydophila pneumoniae TW-183
aaugcuaagcucca

SEQ ID NO: 2571333 - RNA, 21 nt, Chlamydophila pneumoniae TW-183
aaugcuaagcuccauaaaaau

SEQ ID NO: 2571334 - RNA, 15 nt, Chlamydophila pneumoniae TW-183
aaugcucuucugcag

SEQ ID NO: 2571335 - RNA, 22 nt, Chlamydophila pneumoniae TW-183
aauguagcuguuccaagagucu

SEQ ID NO: 2571336 - RNA, 16 nt, Chlamydophila pneumoniae TW-183
aauguagucaugauuu

SEQ ID NO: 2571337 - RNA, 22 nt, Chlamydophila pneumoniae TW-183
aauguagucaugauuuuucaau

SEQ ID NO: 2571338 - RNA, 16 nt, Chlamydophila pneumoniae TW-183
aaugugcucggcacuu

SEQ ID NO: 2571339 - RNA, 21 nt, Chlamydophila pneumoniae TW-183
aauuaccuugagacaaagaau

SEQ ID NO: 2571340 - RNA, 21 nt, Chlamydophila pneumoniae TW-183
aauuacuuagaguugaccaua

SEQ ID NO: 2571341 - RNA, 15 nt, Chlamydophila pneumoniae TW-183
aauuagaacagcaug

SEQ ID NO: 2571342 - RNA, 17 nt, Chlamydophila pneumoniae TW-183
aauuagagggauuugua

SEQ ID NO: 2571343 - RNA, 15 nt, Chlamydophila pneumoniae TW-183
aauuagaguaugagg

SEQ ID NO: 2571344 - RNA, 13 nt, Chlamydophila pneumoniae TW-183
aauuauuaaacuc

SEQ ID NO: 2571345 - RNA, 23 nt, Chlamydophila pneumoniae TW-183
aauucaugcaaaacaacaucacu

SEQ ID NO: 2571346 - RNA, 15 nt, Chlamydophila pneumoniae TW-183
aauuccccuucauca

SEQ ID NO: 2571347 - RNA, 19 nt, Chlamydophila pneumoniae TW-183
aauucggcagaaggcuugu

SEQ ID NO: 2571348 - RNA, 17 nt, Chlamydophila pneumoniae TW-183
aauucuagaccugccaa

SEQ ID NO: 2571349 - RNA, 19 nt, Chlamydophila pneumoniae TW-183
aauucucgagcagcugcac

SEQ ID NO: 2571350 - RNA, 18 nt, Chlamydophila pneumoniae TW-183
acauuugcagacacaaaa

SEQ ID NO: 2571351 - RNA, 20 nt, Chlamydophila pneumoniae TW-183
accaaugauaauuucauuau

SEQ ID NO: 2571352 - RNA, 21 nt, Chlamydophila pneumoniae TW-183
accaauuccccuucaucaaua

SEQ ID NO: 2571353 - RNA, 20 nt, Chlamydophila pneumoniae TW-183
accacagaggucgauuugaa

SEQ ID NO: 2571354 - RNA, 19 nt, Chlamydophila pneumoniae TW-183
accacauacucuucauccu

SEQ ID NO: 2571355 - RNA, 17 nt, Chlamydophila pneumoniae TW-183
accacggauuuucucua

SEQ ID NO: 2571356 - RNA, 15 nt, Chlamydophila pneumoniae TW-183
accacguccauuuca

SEQ ID NO: 2571357 - RNA, 19 nt, Chlamydophila pneumoniae TW-183
accacuuuagaauuuucuu

SEQ ID NO: 2571358 - RNA, 13 nt, Chlamydophila pneumoniae TW-183
accagaagcaacu

SEQ ID NO: 2571359 - RNA, 20 nt, Chlamydophila pneumoniae TW-183
accauagaaagauaacgaga

SEQ ID NO: 2571360 - RNA, 22 nt, Chlamydophila pneumoniae TW-183
accaucgucuccaaaaauuccc

SEQ ID NO: 2571361 - RNA, 16 nt, Chlamydophila pneumoniae TW-183
accaugaucuuagcuc

SEQ ID NO: 2571362 - RNA, 18 nt, Chlamydophila pneumoniae TW-183
acccauaaugguacaaua

SEQ ID NO: 2571363 - RNA, 17 nt, Chlamydophila pneumoniae TW-183
acccguagccccuuaaa

SEQ ID NO: 2571364 - RNA, 14 nt, Chlamydophila pneumoniae TW-183
acccucaaagaaua

SEQ ID NO: 2571365 - RNA, 15 nt, Chlamydophila pneumoniae TW-183
acccucaaagaauac

SEQ ID NO: 2571366 - RNA, 14 nt, Chlamydophila pneumoniae TW-183
accgaaucucucca

SEQ ID NO: 2571367 - RNA, 16 nt, Chlamydophila pneumoniae TW-183
accgaaucucuccagc

SEQ ID NO: 2571368 - RNA, 20 nt, Chlamydophila pneumoniae TW-183
accgaaucucuccagcuuga

SEQ ID NO: 2571369 - RNA, 22 nt, Chlamydophila pneumoniae TW-183
accgaucucaguaggagcagcg

SEQ ID NO: 2571370 - RNA, 19 nt, Chlamydophila pneumoniae TW-183
accguaacugaggcaaaga

SEQ ID NO: 2571371 - RNA, 12 nt, Chlamydophila pneumoniae TW-183
accuaaaacaaa

SEQ ID NO: 2571372 - RNA, 21 nt, Chlamydophila pneumoniae TW-183
accuaggagaaaucacacuua

SEQ ID NO: 2571373 - RNA, 22 nt, Chlamydophila pneumoniae TW-183
accuauagguucaccagaagca

SEQ ID NO: 2571374 - RNA, 14 nt, Chlamydophila pneumoniae TW-183
accucgaauuccuc

SEQ ID NO: 2571375 - RNA, 21 nt, Chlamydophila pneumoniae TW-183
accucgaauuccucccagccc

SEQ ID NO: 2571376 - RNA, 22 nt, Chlamydophila pneumoniae TW-183
accucucccuugggauuccuua

SEQ ID NO: 2571377 - RNA, 19 nt, Chlamydophila pneumoniae TW-183
accuggauugauccacaga

SEQ ID NO: 2571378 - RNA, 16 nt, Chlamydophila pneumoniae TW-183
accuuagagugacuca

SEQ ID NO: 2571379 - RNA, 19 nt, Chlamydophila pneumoniae TW-183
accuuaguuuuuucuaagg

SEQ ID NO: 2571380 - RNA, 13 nt, Chlamydophila pneumoniae TW-183
accuucaacaaga

SEQ ID NO: 2571381 - RNA, 19 nt, Chlamydophila pneumoniae TW-183
accuucaacaagaauaacu

SEQ ID NO: 2571382 - RNA, 21 nt, Chlamydophila pneumoniae TW-183
accuucaaugauuucuuuagc

SEQ ID NO: 2571383 - RNA, 18 nt, Chlamydophila pneumoniae TW-183
accuucgauuccaggcuc

SEQ ID NO: 2571384 - RNA, 18 nt, Chlamydophila pneumoniae TW-183
accuuuuucauugaugcu

SEQ ID NO: 2571385 - RNA, 16 nt, Chlamydophila pneumoniae TW-183
acgaccucgaauuccu

SEQ ID NO: 2571386 - RNA, 20 nt, Chlamydophila pneumoniae TW-183
acgaucgucaguaaaacaca

SEQ ID NO: 2571387 - RNA, 21 nt, Chlamydophila pneumoniae TW-183
acgaucgucaguaaaacacaa

SEQ ID NO: 2571388 - RNA, 16 nt, Chlamydophila pneumoniae TW-183
acgauuucuucuucua

SEQ ID NO: 2571389 - RNA, 20 nt, Chlamydophila pneumoniae TW-183
acgcagagaugcuaacaacu

SEQ ID NO: 2571390 - RNA, 18 nt, Chlamydophila pneumoniae TW-183
acgcccacggaaagcaca

SEQ ID NO: 2571391 - RNA, 16 nt, Chlamydophila pneumoniae TW-183
acgcuaaacuaaaaug

SEQ ID NO: 2571392 - RNA, 14 nt, Chlamydophila pneumoniae TW-183
acggaaagcacaua

SEQ ID NO: 2571393 - RNA, 17 nt, Chlamydophila pneumoniae TW-183
acggcugauucucccaa

SEQ ID NO: 2571394 - RNA, 17 nt, Chlamydophila pneumoniae TW-183
acgguaaugccagcagc

SEQ ID NO: 2571395 - RNA, 18 nt, Chlamydophila pneumoniae TW-183
acguagcuacaaaauuau

SEQ ID NO: 2571396 - RNA, 21 nt, Chlamydophila pneumoniae TW-183
acguccauuucauguaagaau

SEQ ID NO: 2571397 - RNA, 13 nt, Chlamydophila pneumoniae TW-183
acgucuuaugaaa

SEQ ID NO: 2571398 - RNA, 16 nt, Chlamydophila pneumoniae TW-183
acgucuuucaccaacu

SEQ ID NO: 2571399 - RNA, 17 nt, Chlamydophila pneumoniae TW-183
acgucuuucaccaacuc

SEQ ID NO: 2571400 - RNA, 23 nt, Chlamydophila pneumoniae TW-183
acguuaauaaagaggcucccauc

SEQ ID NO: 2571401 - RNA, 20 nt, Chlamydophila pneumoniae TW-183
acguuaucuaagacuucugg

SEQ ID NO: 2571402 - RNA, 12 nt, Chlamydophila pneumoniae TW-183
acguucuuucaa

SEQ ID NO: 2571403 - RNA, 22 nt, Chlamydophila pneumoniae TW-183
acuaaacaccuucuucuaaaau

SEQ ID NO: 2571404 - RNA, 17 nt, Chlamydophila pneumoniae TW-183
acuaaaccuucaaugau

SEQ ID NO: 2571405 - RNA, 19 nt, Chlamydophila pneumoniae TW-183
acuaaguuuaggcaggaag

SEQ ID NO: 2571406 - RNA, 12 nt, Chlamydophila pneumoniae TW-183
acuacagaggga

SEQ ID NO: 2571407 - RNA, 13 nt, Chlamydophila pneumoniae TW-183
acuacauucagga

SEQ ID NO: 2571408 - RNA, 12 nt, Chlamydophila pneumoniae TW-183
acuacugaaaca

SEQ ID NO: 2571409 - RNA, 16 nt, Chlamydophila pneumoniae TW-183
acuacugaaacacuuu

SEQ ID NO: 2571410 - RNA, 14 nt, Chlamydophila pneumoniae TW-183
acuacuuacaagaa

SEQ ID NO: 2571411 - RNA, 17 nt, Chlamydophila pneumoniae TW-183
acuacuuacaagaacaa

SEQ ID NO: 2571412 - RNA, 14 nt, Chlamydophila pneumoniae TW-183
acuagcuuuucaug

SEQ ID NO: 2571413 - RNA, 17 nt, Chlamydophila pneumoniae TW-183
acuauagaucucuugaa

SEQ ID NO: 2571414 - RNA, 17 nt, Chlamydophila pneumoniae TW-183
acuauagggagacucuu

SEQ ID NO: 2571415 - RNA, 23 nt, Chlamydophila pneumoniae TW-183
acuaucauggacaagcaaaagca

SEQ ID NO: 2571416 - RNA, 23 nt, Chlamydophila pneumoniae TW-183
acuauuaggcuuuuuucuauuuu

SEQ ID NO: 2571417 - RNA, 12 nt, Chlamydophila pneumoniae TW-183
acucaaagaacu

SEQ ID NO: 2571418 - RNA, 14 nt, Chlamydophila pneumoniae TW-183
acucagagauugcc

SEQ ID NO: 2571419 - RNA, 21 nt, Chlamydophila pneumoniae TW-183
acucaggauauauagagcaga

SEQ ID NO: 2571420 - RNA, 15 nt, Chlamydophila pneumoniae TW-183
acucaugaaagugcu

SEQ ID NO: 2571421 - RNA, 21 nt, Chlamydophila pneumoniae TW-183
acuccaaaauauucuuucaaa

SEQ ID NO: 2571422 - RNA, 22 nt, Chlamydophila pneumoniae TW-183
acuccuaagucguuaacaucaa

SEQ ID NO: 2571423 - RNA, 14 nt, Chlamydophila pneumoniae TW-183
acuccugacucuua

SEQ ID NO: 2571424 - RNA, 18 nt, Chlamydophila pneumoniae TW-183
acuccuggagcuguuucu

SEQ ID NO: 2571425 - RNA, 20 nt, Chlamydophila pneumoniae TW-183
acucgggauucguagcuucc

SEQ ID NO: 2571426 - RNA, 14 nt, Chlamydophila pneumoniae TW-183
acucuacaaguguc

SEQ ID NO: 2571427 - RNA, 22 nt, Chlamydophila pneumoniae TW-183
acucucaguuaaagagcauccu

SEQ ID NO: 2571428 - RNA, 17 nt, Chlamydophila pneumoniae TW-183
acucuccaaaagcucua

SEQ ID NO: 2571429 - RNA, 16 nt, Chlamydophila pneumoniae TW-183
acucuuauugcagaau

SEQ ID NO: 2571430 - RNA, 15 nt, Chlamydophila pneumoniae TW-183
acucuuucagaaaga

SEQ ID NO: 2571431 - RNA, 19 nt, Chlamydophila pneumoniae TW-183
acucuuuuauuuuaggaag

SEQ ID NO: 2571432 - RNA, 15 nt, Chlamydophila pneumoniae TW-183
acugaauaguagagu

SEQ ID NO: 2571433 - RNA, 21 nt, Chlamydophila pneumoniae TW-183
acugaauaguagaguugacaa

SEQ ID NO: 2571434 - RNA, 16 nt, Chlamydophila pneumoniae TW-183
acugaugccaagaaau

SEQ ID NO: 2571435 - RNA, 16 nt, Chlamydophila pneumoniae TW-183
acugcauaaucucacc

SEQ ID NO: 2571436 - RNA, 22 nt, Chlamydophila pneumoniae TW-183
acugccagcgaucacauagaaa

SEQ ID NO: 2571437 - RNA, 15 nt, Chlamydophila pneumoniae TW-183
acugcgagagaaagu

SEQ ID NO: 2571438 - RNA, 21 nt, Chlamydophila pneumoniae TW-183
acuggaggcuguguaaaaguu

SEQ ID NO: 2571439 - RNA, 20 nt, Chlamydophila pneumoniae TW-183
acugucuagcaguugcaaua

SEQ ID NO: 2571440 - RNA, 17 nt, Chlamydophila pneumoniae TW-183
acuuaaagguaaaacua

SEQ ID NO: 2571441 - RNA, 21 nt, Chlamydophila pneumoniae TW-183
acuuaagauacuucuccacag

SEQ ID NO: 2571442 - RNA, 22 nt, Chlamydophila pneumoniae TW-183
acuuaggguucucaaagaucau

SEQ ID NO: 2571443 - RNA, 24 nt, Chlamydophila pneumoniae TW-183
acuuaggguucucaaagaucaucu

SEQ ID NO: 2571444 - RNA, 17 nt, Chlamydophila pneumoniae TW-183
acuuagguaauguaguc

SEQ ID NO: 2571445 - RNA, 14 nt, Chlamydophila pneumoniae TW-183
acuuauauuuucua

SEQ ID NO: 2571446 - RNA, 16 nt, Chlamydophila pneumoniae TW-183
acuucaacuucuccaa

SEQ ID NO: 2571447 - RNA, 15 nt, Chlamydophila pneumoniae TW-183
agauccugaaaaaag

SEQ ID NO: 2571448 - RNA, 14 nt, Chlamydophila pneumoniae TW-183
agaucuacaucaaa

SEQ ID NO: 2571449 - RNA, 15 nt, Chlamydophila pneumoniae TW-183
agaucuacaucaaau

SEQ ID NO: 2571450 - RNA, 19 nt, Chlamydophila pneumoniae TW-183
agaucucuugaagcacuuu

SEQ ID NO: 2571451 - RNA, 23 nt, Chlamydophila pneumoniae TW-183
agaucuggagagggaaggaauaa

SEQ ID NO: 2571452 - RNA, 21 nt, Chlamydophila pneumoniae TW-183
agaucuucaucacaaaauuca

SEQ ID NO: 2571453 - RNA, 17 nt, Chlamydophila pneumoniae TW-183
agaugcuucuaaacaau

SEQ ID NO: 2571454 - RNA, 22 nt, Chlamydophila pneumoniae TW-183
agauggucuuggguuuuaaaug

SEQ ID NO: 2571455 - RNA, 22 nt, Chlamydophila pneumoniae TW-183
agauguggcagaguccuucuuu

SEQ ID NO: 2571456 - RNA, 16 nt, Chlamydophila pneumoniae TW-183
agauucauaaaacugu

SEQ ID NO: 2571457 - RNA, 12 nt, Chlamydophila pneumoniae TW-183
agauucuacaaa

SEQ ID NO: 2571458 - RNA, 18 nt, Chlamydophila pneumoniae TW-183
agauuguuucaggccugg

SEQ ID NO: 2571459 - RNA, 16 nt, Chlamydophila pneumoniae TW-183
agcaacccgaauuccu

SEQ ID NO: 2571460 - RNA, 15 nt, Chlamydophila pneumoniae TW-183
agcaacgcaugacgc

SEQ ID NO: 2571461 - RNA, 19 nt, Chlamydophila pneumoniae TW-183
agcaacgcaugacgcuuuu

SEQ ID NO: 2571462 - RNA, 22 nt, Chlamydophila pneumoniae TW-183
agcaacgcaugacgcuuuucca

SEQ ID NO: 2571463 - RNA, 18 nt, Chlamydophila pneumoniae TW-183
agcaagagcuauaccuau

SEQ ID NO: 2571464 - RNA, 18 nt, Chlamydophila pneumoniae TW-183
agcaagauucuucagaau

SEQ ID NO: 2571465 - RNA, 22 nt, Chlamydophila pneumoniae TW-183
agcaaggcugccagagauucuu

SEQ ID NO: 2571466 - RNA, 21 nt, Chlamydophila pneumoniae TW-183
agcaccuaauaaagaagguug

SEQ ID NO: 2571467 - RNA, 14 nt, Chlamydophila pneumoniae TW-183
agcacgcacuaauc

SEQ ID NO: 2571468 - RNA, 13 nt, Chlamydophila pneumoniae TW-183
agcagaaacucca

SEQ ID NO: 2571469 - RNA, 18 nt, Chlamydophila pneumoniae TW-183
agcagcccgcacaucaug

SEQ ID NO: 2571470 - RNA, 21 nt, Chlamydophila pneumoniae TW-183
agcaggaaggaauagagaaag

SEQ ID NO: 2571471 - RNA, 16 nt, Chlamydophila pneumoniae TW-183
agcaggcaucacuaau

SEQ ID NO: 2571472 - RNA, 17 nt, Chlamydophila pneumoniae TW-183
agcaguugcaauaccaa

SEQ ID NO: 2571473 - RNA, 12 nt, Chlamydophila pneumoniae TW-183
agcauaaaaauu

SEQ ID NO: 2571474 - RNA, 23 nt, Chlamydophila pneumoniae TW-183
agcaucggugucuacaaagaucc

SEQ ID NO: 2571475 - RNA, 19 nt, Chlamydophila pneumoniae TW-183
agcauggacuccaagaaua

SEQ ID NO: 2571476 - RNA, 16 nt, Chlamydophila pneumoniae TW-183
agcauuucuuucucuu

SEQ ID NO: 2571477 - RNA, 13 nt, Chlamydophila pneumoniae TW-183
agcauuuucucug

SEQ ID NO: 2571478 - RNA, 16 nt, Chlamydophila pneumoniae TW-183
agcauuuucucugagc

SEQ ID NO: 2571479 - RNA, 21 nt, Chlamydophila pneumoniae TW-183
agcauuuucucugagcagcuu

SEQ ID NO: 2571480 - RNA, 20 nt, Chlamydophila pneumoniae TW-183
agccauaauuagaacagcau

SEQ ID NO: 2571481 - RNA, 21 nt, Chlamydophila pneumoniae TW-183
agccauaauuagaacagcaug

SEQ ID NO: 2571482 - RNA, 13 nt, Chlamydophila pneumoniae TW-183
agcccuauagaaa

SEQ ID NO: 2571483 - RNA, 23 nt, Chlamydophila pneumoniae TW-183
agccucgagcagaaacuccaaaa

SEQ ID NO: 2571484 - RNA, 16 nt, Chlamydophila pneumoniae TW-183
agccucuacccucuga

SEQ ID NO: 2571485 - RNA, 17 nt, Chlamydophila pneumoniae TW-183
agccugcaccagacccu

SEQ ID NO: 2571486 - RNA, 12 nt, Chlamydophila pneumoniae TW-183
agccugucuaua

SEQ ID NO: 2571487 - RNA, 23 nt, Chlamydophila pneumoniae TW-183
agccuuacggccccuggaauuuc

SEQ ID NO: 2571488 - RNA, 21 nt, Chlamydophila pneumoniae TW-183
agccuugauugaacagucuug

SEQ ID NO: 2571489 - RNA, 13 nt, Chlamydophila pneumoniae TW-183
agcgaaguuuuuc

SEQ ID NO: 2571490 - RNA, 19 nt, Chlamydophila pneumoniae TW-183
agcggaacaacuuugaggc

SEQ ID NO: 2571491 - RNA, 17 nt, Chlamydophila pneumoniae TW-183
agcggacuuuagcgcua

SEQ ID NO: 2571492 - RNA, 15 nt, Chlamydophila pneumoniae TW-183
agcggcaacauaauc

SEQ ID NO: 2571493 - RNA, 17 nt, Chlamydophila pneumoniae TW-183
agcgggauaggcaagau

SEQ ID NO: 2571494 - RNA, 12 nt, Chlamydophila pneumoniae TW-183
agcgucuucuuu

SEQ ID NO: 2571495 - RNA, 15 nt, Chlamydophila pneumoniae TW-183
agcgugaauaucauc

SEQ ID NO: 2571496 - RNA, 22 nt, Chlamydophila pneumoniae TW-183
agcuaaauuguuaucaggaacu

SEQ ID NO: 2571497 - RNA, 17 nt, Chlamydophila pneumoniae TW-183
agcuaauaagauccaaa

SEQ ID NO: 2571498 - RNA, 16 nt, Chlamydophila pneumoniae TW-183
agcuaaucaauccaag

SEQ ID NO: 2571499 - RNA, 18 nt, Chlamydophila pneumoniae TW-183
agcuagucuuucuaagaa

SEQ ID NO: 2571500 - RNA, 18 nt, Chlamydophila pneumoniae TW-183
agcuaucaaccauaaaga

SEQ ID NO: 2571501 - RNA, 23 nt, Chlamydophila pneumoniae TW-183
agcuauuuuugaggaacgcacgc

SEQ ID NO: 2571502 - RNA, 12 nt, Chlamydophila pneumoniae TW-183
agcucaaaaagu

SEQ ID NO: 2571503 - RNA, 12 nt, Chlamydophila pneumoniae TW-183
agcucauaagaa

SEQ ID NO: 2571504 - RNA, 13 nt, Chlamydophila pneumoniae TW-183
agcuccuggauau

SEQ ID NO: 2571505 - RNA, 22 nt, Chlamydophila pneumoniae TW-183
agcucggauggacuacugaaac

SEQ ID NO: 2571506 - RNA, 17 nt, Chlamydophila pneumoniae TW-183
agcucguaauccuucuu

SEQ ID NO: 2571507 - RNA, 23 nt, Chlamydophila pneumoniae TW-183
agcucuuugauuuucuuagcuuc

SEQ ID NO: 2571508 - RNA, 15 nt, Chlamydophila pneumoniae TW-183
agcugacuccuugua

SEQ ID NO: 2571509 - RNA, 20 nt, Chlamydophila pneumoniae TW-183
agcuggggauggucuucccc

SEQ ID NO: 2571510 - RNA, 14 nt, Chlamydophila pneumoniae TW-183
agcugugcauuuuc

SEQ ID NO: 2571511 - RNA, 13 nt, Chlamydophila pneumoniae TW-183
agcuguuguucug

SEQ ID NO: 2571512 - RNA, 21 nt, Chlamydophila pneumoniae TW-183
agcuuagcaacccaagcuuug

SEQ ID NO: 2571513 - RNA, 15 nt, Chlamydophila pneumoniae TW-183
agcuucuacagcauc

SEQ ID NO: 2571514 - RNA, 20 nt, Chlamydophila pneumoniae TW-183
agcuucuuuagauagcucuu

SEQ ID NO: 2571515 - RNA, 23 nt, Chlamydophila pneumoniae TW-183
agcuugucacacugcgagagaaa

SEQ ID NO: 2571516 - RNA, 18 nt, Chlamydophila pneumoniae TW-183
agcuuuauugauagcuga

SEQ ID NO: 2571517 - RNA, 17 nt, Chlamydophila pneumoniae TW-183
agcuuuuaguuucccac

SEQ ID NO: 2571518 - RNA, 23 nt, Chlamydophila pneumoniae TW-183
agcuuuuccguaaguaaccaaua

SEQ ID NO: 2571519 - RNA, 13 nt, Chlamydophila pneumoniae TW-183
agcuuuugugaua

SEQ ID NO: 2571520 - RNA, 12 nt, Chlamydophila pneumoniae TW-183
agcuuuuugcuu

SEQ ID NO: 2571521 - RNA, 18 nt, Chlamydophila pneumoniae TW-183
agcuuuuugcuuuucccu

SEQ ID NO: 2571522 - RNA, 12 nt, Chlamydophila pneumoniae TW-183
agcuuuuuucuc

SEQ ID NO: 2571523 - RNA, 14 nt, Chlamydophila pneumoniae TW-183
agcuuuuuucucuu

SEQ ID NO: 2571524 - RNA, 15 nt, Chlamydophila pneumoniae TW-183
aggaaacguucuuuc

SEQ ID NO: 2571525 - RNA, 21 nt, Chlamydophila pneumoniae TW-183
aggaaaucccgagauaugaag

SEQ ID NO: 2571526 - RNA, 22 nt, Chlamydophila pneumoniae TW-183
aggaaaucccgagauaugaaga

SEQ ID NO: 2571527 - RNA, 17 nt, Chlamydophila pneumoniae TW-183
aggaacgcacgccaaga

SEQ ID NO: 2571528 - RNA, 22 nt, Chlamydophila pneumoniae TW-183
aggaagaugaauaccagaagca

SEQ ID NO: 2571529 - RNA, 23 nt, Chlamydophila pneumoniae TW-183
aggaagucaccuuacauccaauu

SEQ ID NO: 2571530 - RNA, 14 nt, Chlamydophila pneumoniae TW-183
aggaaucauaacca

SEQ ID NO: 2571531 - RNA, 19 nt, Chlamydophila pneumoniae TW-183
aggaaucccugcacucuuu

SEQ ID NO: 2571532 - RNA, 14 nt, Chlamydophila pneumoniae TW-183
aggaaugaagagag

SEQ ID NO: 2571533 - RNA, 18 nt, Chlamydophila pneumoniae TW-183
aggaccuguuuucuuuuc

SEQ ID NO: 2571534 - RNA, 20 nt, Chlamydophila pneumoniae TW-183
aggagaccuuuauagauaug

SEQ ID NO: 2571535 - RNA, 12 nt, Chlamydophila pneumoniae TW-183
aggagagagaag

SEQ ID NO: 2571536 - RNA, 23 nt, Chlamydophila pneumoniae TW-183
aggaguccccuggcguucaggau

SEQ ID NO: 2571537 - RNA, 23 nt, Chlamydophila pneumoniae TW-183
aggaguuucuacgcgcucuucuu

SEQ ID NO: 2571538 - RNA, 19 nt, Chlamydophila pneumoniae TW-183
aggaguuuucaagucugua

SEQ ID NO: 2571539 - RNA, 13 nt, Chlamydophila pneumoniae TW-183
aggaguuuuccaa

SEQ ID NO: 2571540 - RNA, 16 nt, Chlamydophila pneumoniae TW-183
aggauacgaauaaguu

SEQ ID NO: 2571541 - RNA, 16 nt, Chlamydophila pneumoniae TW-183
aggauauauagagcag

SEQ ID NO: 2571542 - RNA, 15 nt, Chlamydophila pneumoniae TW-183
aggaucugguugagg

SEQ ID NO: 2571543 - RNA, 16 nt, Chlamydophila pneumoniae TW-183
aggaugcuuagcaaag

SEQ ID NO: 2571544 - RNA, 24 nt, Chlamydophila pneumoniae TW-183
auaaacagcgguugccuuucucuu

SEQ ID NO: 2571545 - RNA, 21 nt, Chlamydophila pneumoniae TW-183
auaaagaucgggucuacaaca

SEQ ID NO: 2571546 - RNA, 21 nt, Chlamydophila pneumoniae TW-183
auaaagcccuuuugaauaucc

SEQ ID NO: 2571547 - RNA, 21 nt, Chlamydophila pneumoniae TW-183
auaaaugcuauuuuccucuau

SEQ ID NO: 2571548 - RNA, 17 nt, Chlamydophila pneumoniae TW-183
auaaauuucucaugcau

SEQ ID NO: 2571549 - RNA, 24 nt, Chlamydophila pneumoniae TW-183
auaaauuucucaugcauaggcuuu

SEQ ID NO: 2571550 - RNA, 20 nt, Chlamydophila pneumoniae TW-183
auaaccuaaggcauggcaca

SEQ ID NO: 2571551 - RNA, 21 nt, Chlamydophila pneumoniae TW-183
auaacuccacuaccaaggcag

SEQ ID NO: 2571552 - RNA, 19 nt, Chlamydophila pneumoniae TW-183
auaacuuugcaugaggaga

SEQ ID NO: 2571553 - RNA, 18 nt, Chlamydophila pneumoniae TW-183
auaagaaaucaguccuaa

SEQ ID NO: 2571554 - RNA, 15 nt, Chlamydophila pneumoniae TW-183
auaagauagcucuug

SEQ ID NO: 2571555 - RNA, 16 nt, Chlamydophila pneumoniae TW-183
auaagcaagcaacuga

SEQ ID NO: 2571556 - RNA, 20 nt, Chlamydophila pneumoniae TW-183
auaaguuuugauuuugcagu

SEQ ID NO: 2571557 - RNA, 13 nt, Chlamydophila pneumoniae TW-183
auaauaaaagcac

SEQ ID NO: 2571558 - RNA, 22 nt, Chlamydophila pneumoniae TW-183
auaauagugagcucccugaugu

SEQ ID NO: 2571559 - RNA, 22 nt, Chlamydophila pneumoniae TW-183
auaaucucaccagaagcaacua

SEQ ID NO: 2571560 - RNA, 22 nt, Chlamydophila pneumoniae TW-183
auaaugguacaauacuggagag

SEQ ID NO: 2571561 - RNA, 14 nt, Chlamydophila pneumoniae TW-183
auaauuagaacagc

SEQ ID NO: 2571562 - RNA, 15 nt, Chlamydophila pneumoniae TW-183
auaauuagaacagca

SEQ ID NO: 2571563 - RNA, 19 nt, Chlamydophila pneumoniae TW-183
auacaacgguauguauggu

SEQ ID NO: 2571564 - RNA, 15 nt, Chlamydophila pneumoniae TW-183
auacagcauaaaaau

SEQ ID NO: 2571565 - RNA, 16 nt, Chlamydophila pneumoniae TW-183
auacagcauaaaaauu

SEQ ID NO: 2571566 - RNA, 16 nt, Chlamydophila pneumoniae TW-183
auacaguacgcaaagu

SEQ ID NO: 2571567 - RNA, 17 nt, Chlamydophila pneumoniae TW-183
auaccagaagcaaaggu

SEQ ID NO: 2571568 - RNA, 14 nt, Chlamydophila pneumoniae TW-183
auaccuccuccaau

SEQ ID NO: 2571569 - RNA, 19 nt, Chlamydophila pneumoniae TW-183
auaccuccuccaaucugcu

SEQ ID NO: 2571570 - RNA, 19 nt, Chlamydophila pneumoniae TW-183
auaccuucaacaagaauaa

SEQ ID NO: 2571571 - RNA, 13 nt, Chlamydophila pneumoniae TW-183
auacgcagcacgc

SEQ ID NO: 2571572 - RNA, 19 nt, Chlamydophila pneumoniae TW-183
auacggcguaguauccuuu

SEQ ID NO: 2571573 - RNA, 15 nt, Chlamydophila pneumoniae TW-183
auacguccagccugc

SEQ ID NO: 2571574 - RNA, 20 nt, Chlamydophila pneumoniae TW-183
auacuacuuacaagaacaag

SEQ ID NO: 2571575 - RNA, 16 nt, Chlamydophila pneumoniae TW-183
auacuguuaacaagua

SEQ ID NO: 2571576 - RNA, 15 nt, Chlamydophila pneumoniae TW-183
auacuucuccacagc

SEQ ID NO: 2571577 - RNA, 18 nt, Chlamydophila pneumoniae TW-183
auagaaaacauagagauu

SEQ ID NO: 2571578 - RNA, 14 nt, Chlamydophila pneumoniae TW-183
auagaaaugagaga

SEQ ID NO: 2571579 - RNA, 14 nt, Chlamydophila pneumoniae TW-183
auagaaauucugua

SEQ ID NO: 2571580 - RNA, 16 nt, Chlamydophila pneumoniae TW-183
auagaaauucuguaga

SEQ ID NO: 2571581 - RNA, 15 nt, Chlamydophila pneumoniae TW-183
auagaauacacagcu

SEQ ID NO: 2571582 - RNA, 21 nt, Chlamydophila pneumoniae TW-183
auagagagcgccuaaacccac

SEQ ID NO: 2571583 - RNA, 17 nt, Chlamydophila pneumoniae TW-183
auagagauucuacaaau

SEQ ID NO: 2571584 - RNA, 20 nt, Chlamydophila pneumoniae TW-183
auagagccuagagaguucuu

SEQ ID NO: 2571585 - RNA, 21 nt, Chlamydophila pneumoniae TW-183
auagaguaucuaaaacuucuu

SEQ ID NO: 2571586 - RNA, 23 nt, Chlamydophila pneumoniae TW-183
auagaguaucuaaaacuucuugu

SEQ ID NO: 2571587 - RNA, 13 nt, Chlamydophila pneumoniae TW-183
auagaucucuuga

SEQ ID NO: 2571588 - RNA, 17 nt, Chlamydophila pneumoniae TW-183
auagcaagcacuuucgc

SEQ ID NO: 2571589 - RNA, 19 nt, Chlamydophila pneumoniae TW-183
auagccauaauuagaacag

SEQ ID NO: 2571590 - RNA, 13 nt, Chlamydophila pneumoniae TW-183
auagcgucuguua

SEQ ID NO: 2571591 - RNA, 19 nt, Chlamydophila pneumoniae TW-183
auagcucuuugauuuucuu

SEQ ID NO: 2571592 - RNA, 16 nt, Chlamydophila pneumoniae TW-183
auagcuuugaagagca

SEQ ID NO: 2571593 - RNA, 16 nt, Chlamydophila pneumoniae TW-183
auaggauccaggaguu

SEQ ID NO: 2571594 - RNA, 23 nt, Chlamydophila pneumoniae TW-183
auaggcugcacacauccuggagc

SEQ ID NO: 2571595 - RNA, 22 nt, Chlamydophila pneumoniae TW-183
auaguauaauagugagcucccu

SEQ ID NO: 2571596 - RNA, 21 nt, Chlamydophila pneumoniae TW-183
auauaagggggaucuucagag

SEQ ID NO: 2571597 - RNA, 13 nt, Chlamydophila pneumoniae TW-183
auauauagagcag

SEQ ID NO: 2571598 - RNA, 18 nt, Chlamydophila pneumoniae TW-183
auaucagcauauuuccga

SEQ ID NO: 2571599 - RNA, 17 nt, Chlamydophila pneumoniae TW-183
auaucgaccuuaaaauu

SEQ ID NO: 2571600 - RNA, 18 nt, Chlamydophila pneumoniae TW-183
auaucgaguucuuuuugc

SEQ ID NO: 2571601 - RNA, 22 nt, Chlamydophila pneumoniae TW-183
auaucgaguucuuuuugcagau

SEQ ID NO: 2571602 - RNA, 13 nt, Chlamydophila pneumoniae TW-183
auaucgauaggau

SEQ ID NO: 2571603 - RNA, 15 nt, Chlamydophila pneumoniae TW-183
auaugauuuccacuu

SEQ ID NO: 2571604 - RNA, 21 nt, Chlamydophila pneumoniae TW-183
auauggaaggcggcuuuuugc

SEQ ID NO: 2571605 - RNA, 14 nt, Chlamydophila pneumoniae TW-183
auauggaauggcuu

SEQ ID NO: 2571606 - RNA, 22 nt, Chlamydophila pneumoniae TW-183
auauggguguaaauuuuuccuu

SEQ ID NO: 2571607 - RNA, 21 nt, Chlamydophila pneumoniae TW-183
auauuuuuugagaaauauaaa

SEQ ID NO: 2571608 - RNA, 21 nt, Chlamydophila pneumoniae TW-183
aucaaaggcugcuugagacuu

SEQ ID NO: 2571609 - RNA, 14 nt, Chlamydophila pneumoniae TW-183
aucaacauucuucu

SEQ ID NO: 2571610 - RNA, 22 nt, Chlamydophila pneumoniae TW-183
aucaaccgaagauccuagagaa

SEQ ID NO: 2571611 - RNA, 16 nt, Chlamydophila pneumoniae TW-183
aucaacuacaucucca

SEQ ID NO: 2571612 - RNA, 18 nt, Chlamydophila pneumoniae TW-183
aucaacuacaucuccaag

SEQ ID NO: 2571613 - RNA, 16 nt, Chlamydophila pneumoniae TW-183
aucaagagcucguaau

SEQ ID NO: 2571614 - RNA, 15 nt, Chlamydophila pneumoniae TW-183
aucacuaucauggac

SEQ ID NO: 2571615 - RNA, 17 nt, Chlamydophila pneumoniae TW-183
aucacuuauauuuucua

SEQ ID NO: 2571616 - RNA, 18 nt, Chlamydophila pneumoniae TW-183
aucacuuauauuuucuau

SEQ ID NO: 2571617 - RNA, 15 nt, Chlamydophila pneumoniae TW-183
aucagcaaaacuccc

SEQ ID NO: 2571618 - RNA, 19 nt, Chlamydophila pneumoniae TW-183
aucagcaucggugucuaca

SEQ ID NO: 2571619 - RNA, 18 nt, Chlamydophila pneumoniae TW-183
aucaggagucucuggaag

SEQ ID NO: 2571620 - RNA, 18 nt, Chlamydophila pneumoniae TW-183
aucaggauggucauacca

SEQ ID NO: 2571621 - RNA, 16 nt, Chlamydophila pneumoniae TW-183
aucaguaaaagacuga

SEQ ID NO: 2571622 - RNA, 21 nt, Chlamydophila pneumoniae TW-183
aucaucuacgauguuuucuua

SEQ ID NO: 2571623 - RNA, 20 nt, Chlamydophila pneumoniae TW-183
auccacagaucguaaucugu

SEQ ID NO: 2571624 - RNA, 16 nt, Chlamydophila pneumoniae TW-183
auccacugcuuuaggc

SEQ ID NO: 2571625 - RNA, 15 nt, Chlamydophila pneumoniae TW-183
auccauaagaucucu

SEQ ID NO: 2571626 - RNA, 23 nt, Chlamydophila pneumoniae TW-183
aucccagauaaagacaucucuuu

SEQ ID NO: 2571627 - RNA, 22 nt, Chlamydophila pneumoniae TW-183
aucccagauuuuuuugguugcu

SEQ ID NO: 2571628 - RNA, 17 nt, Chlamydophila pneumoniae TW-183
auccccguccuguacca

SEQ ID NO: 2571629 - RNA, 18 nt, Chlamydophila pneumoniae TW-183
aucccgugcuaggaagau

SEQ ID NO: 2571630 - RNA, 21 nt, Chlamydophila pneumoniae TW-183
aucccuguaguuucuaaaaca

SEQ ID NO: 2571631 - RNA, 22 nt, Chlamydophila pneumoniae TW-183
auccuagagaaugugcucggca

SEQ ID NO: 2571632 - RNA, 16 nt, Chlamydophila pneumoniae TW-183
auccuauuuuagcaua

SEQ ID NO: 2571633 - RNA, 22 nt, Chlamydophila pneumoniae TW-183
auccuccuagguucuuuuuuug

SEQ ID NO: 2571634 - RNA, 16 nt, Chlamydophila pneumoniae TW-183
auccugaaaaaagaag

SEQ ID NO: 2571635 - RNA, 15 nt, Chlamydophila pneumoniae TW-183
auccugaucuucuug

SEQ ID NO: 2571636 - RNA, 15 nt, Chlamydophila pneumoniae TW-183
auccuguagagcaag

SEQ ID NO: 2571637 - RNA, 22 nt, Chlamydophila pneumoniae TW-183
auccuguagagcaagauucuuc

SEQ ID NO: 2571638 - RNA, 15 nt, Chlamydophila pneumoniae TW-183
auccuugcaaaacag

SEQ ID NO: 2571639 - RNA, 23 nt, Chlamydophila pneumoniae TW-183
aucgagaaaugcucuucugcagc

SEQ ID NO: 2571640 - RNA, 14 nt, Chlamydophila pneumoniae TW-183
aucgaucucugugg

SEQ ID NO: 2571641 - RNA, 22 nt, Chlamydophila pneumoniae TW-183
auucuucauuguagaggucacu

SEQ ID NO: 2571642 - RNA, 12 nt, Chlamydophila pneumoniae TW-183
auucuucugucu

SEQ ID NO: 2571643 - RNA, 17 nt, Chlamydophila pneumoniae TW-183
auucuugcauagcggca

SEQ ID NO: 2571644 - RNA, 13 nt, Chlamydophila pneumoniae TW-183
auugaaucagauu

SEQ ID NO: 2571645 - RNA, 16 nt, Chlamydophila pneumoniae TW-183
auugaggauaaguucu

SEQ ID NO: 2571646 - RNA, 20 nt, Chlamydophila pneumoniae TW-183
auugaggauaaguucuucca

SEQ ID NO: 2571647 - RNA, 15 nt, Chlamydophila pneumoniae TW-183
auugauguuccuuga

SEQ ID NO: 2571648 - RNA, 19 nt, Chlamydophila pneumoniae TW-183
auugcaaaaaugaaagaaa

SEQ ID NO: 2571649 - RNA, 14 nt, Chlamydophila pneumoniae TW-183
auugcaaaauuuaa

SEQ ID NO: 2571650 - RNA, 20 nt, Chlamydophila pneumoniae TW-183
auugcagauauacuuuuuca

SEQ ID NO: 2571651 - RNA, 15 nt, Chlamydophila pneumoniae TW-183
auugcauuuaaacua

SEQ ID NO: 2571652 - RNA, 22 nt, Chlamydophila pneumoniae TW-183
auugcauuuaaacuaagaauac

SEQ ID NO: 2571653 - RNA, 17 nt, Chlamydophila pneumoniae TW-183
auugcggaaauugaaua

SEQ ID NO: 2571654 - RNA, 14 nt, Chlamydophila pneumoniae TW-183
auuggaucuagaga

SEQ ID NO: 2571655 - RNA, 16 nt, Chlamydophila pneumoniae TW-183
auuggaucuagagaag

SEQ ID NO: 2571656 - RNA, 17 nt, Chlamydophila pneumoniae TW-183
auuggaucuagagaaga

SEQ ID NO: 2571657 - RNA, 22 nt, Chlamydophila pneumoniae TW-183
auuguaauuucuaaauagaaaa

SEQ ID NO: 2571658 - RNA, 14 nt, Chlamydophila pneumoniae TW-183
auuguuaucaggaa

SEQ ID NO: 2571659 - RNA, 15 nt, Chlamydophila pneumoniae TW-183
auuuaacaacaugcg

SEQ ID NO: 2571660 - RNA, 23 nt, Chlamydophila pneumoniae TW-183
auuuaagauaucgaccuuaaaau

SEQ ID NO: 2571661 - RNA, 20 nt, Chlamydophila pneumoniae TW-183
auuuacaauuguguuugcag

SEQ ID NO: 2571662 - RNA, 20 nt, Chlamydophila pneumoniae TW-183
auuuaggagggguaaaccaa

SEQ ID NO: 2571663 - RNA, 23 nt, Chlamydophila pneumoniae TW-183
auuuaggaugaauccaaaauaaa

SEQ ID NO: 2571664 - RNA, 18 nt, Chlamydophila pneumoniae TW-183
auuucauaagagaacuuu

SEQ ID NO: 2571665 - RNA, 17 nt, Chlamydophila pneumoniae TW-183
auuucauguaagaaugu

SEQ ID NO: 2571666 - RNA, 15 nt, Chlamydophila pneumoniae TW-183
auuucauguccucca

SEQ ID NO: 2571667 - RNA, 16 nt, Chlamydophila pneumoniae TW-183
auuuccaaauucuugc

SEQ ID NO: 2571668 - RNA, 19 nt, Chlamydophila pneumoniae TW-183
auuuccaauccauucugag

SEQ ID NO: 2571669 - RNA, 23 nt, Chlamydophila pneumoniae TW-183
auuucuaaauagaaaacauagag

SEQ ID NO: 2571670 - RNA, 16 nt, Chlamydophila pneumoniae TW-183
auuucuccaguaucuu

SEQ ID NO: 2571671 - RNA, 17 nt, Chlamydophila pneumoniae TW-183
auuugugcgucaucaac

SEQ ID NO: 2571672 - RNA, 22 nt, Chlamydophila pneumoniae TW-183
auuuguguauggucucaggauc

SEQ ID NO: 2571673 - RNA, 22 nt, Chlamydophila pneumoniae TW-183
auuuuacuugcgauacaauaaa

SEQ ID NO: 2571674 - RNA, 14 nt, Chlamydophila pneumoniae TW-183
auuuuagcauaauc

SEQ ID NO: 2571675 - RNA, 22 nt, Chlamydophila pneumoniae TW-183
auuuuaggaagcuuaucaagaa

SEQ ID NO: 2571676 - RNA, 21 nt, Chlamydophila pneumoniae TW-183
auuuucagccugucuauaaaa

SEQ ID NO: 2571677 - RNA, 21 nt, Chlamydophila pneumoniae TW-183
auuuucuauucgcugucuaga

SEQ ID NO: 2571678 - RNA, 15 nt, Chlamydophila pneumoniae TW-183
auuuucucaauagug

SEQ ID NO: 2571679 - RNA, 16 nt, Chlamydophila pneumoniae TW-183
auuuucucuacacaga

SEQ ID NO: 2571680 - RNA, 20 nt, Chlamydophila pneumoniae TW-183
auuuucuggugccuguaauu

SEQ ID NO: 2571681 - RNA, 17 nt, Chlamydophila pneumoniae TW-183
auuuuuccuucaacaca

SEQ ID NO: 2571682 - RNA, 15 nt, Chlamydophila pneumoniae TW-183
auuuuugaauaugau

SEQ ID NO: 2571683 - RNA, 23 nt, Chlamydophila pneumoniae TW-183
auuuuuuaaccgagcuuuuugcu

SEQ ID NO: 2571684 - RNA, 16 nt, Chlamydophila pneumoniae TW-183
auuuuuucuguuccug

SEQ ID NO: 2571685 - RNA, 11 nt, Chlamydophila pneumoniae TW-183
auuuuuucuug

SEQ ID NO: 2571686 - RNA, 15 nt, Chlamydophila pneumoniae TW-183
auuuuuugagaaaua

SEQ ID NO: 2571687 - RNA, 16 nt, Chlamydophila pneumoniae TW-183
auuuuuugagaaauau

SEQ ID NO: 2571688 - RNA, 21 nt, Chlamydophila pneumoniae TW-183
auuuuuugagaaauauaaaca

SEQ ID NO: 2571689 - RNA, 14 nt, Chlamydophila pneumoniae TW-183
auuuuuuuagcaau

SEQ ID NO: 2571690 - RNA, 18 nt, Chlamydophila pneumoniae TW-183
caaaaaguuccauagagu

SEQ ID NO: 2571691 - RNA, 16 nt, Chlamydophila pneumoniae TW-183
caaaacauaaccuccu

SEQ ID NO: 2571692 - RNA, 15 nt, Chlamydophila pneumoniae TW-183
caaaagaauuaagaa

SEQ ID NO: 2571693 - RNA, 21 nt, Chlamydophila pneumoniae TW-183
caaaagaauuaagaagaagcu

SEQ ID NO: 2571694 - RNA, 20 nt, Chlamydophila pneumoniae TW-183
caaaaguaaucacuucagca

SEQ ID NO: 2571695 - RNA, 16 nt, Chlamydophila pneumoniae TW-183
caaaagucaugaggac

SEQ ID NO: 2571696 - RNA, 18 nt, Chlamydophila pneumoniae TW-183
caaaagucaugaggacug

SEQ ID NO: 2571697 - RNA, 12 nt, Chlamydophila pneumoniae TW-183
caaaauaaaaaa

SEQ ID NO: 2571698 - RNA, 15 nt, Chlamydophila pneumoniae TW-183
caaaauauucuuuca

SEQ ID NO: 2571699 - RNA, 22 nt, Chlamydophila pneumoniae TW-183
caaacauggacaauauagagau

SEQ ID NO: 2571700 - RNA, 15 nt, Chlamydophila pneumoniae TW-183
caaaccacggauuuu

SEQ ID NO: 2571701 - RNA, 20 nt, Chlamydophila pneumoniae TW-183
caaaccacggauuuucucua

SEQ ID NO: 2571702 - RNA, 21 nt, Chlamydophila pneumoniae TW-183
caaaccacggauuuucucuac

SEQ ID NO: 2571703 - RNA, 19 nt, Chlamydophila pneumoniae TW-183
caaacuaacauagauaagg

SEQ ID NO: 2571704 - RNA, 13 nt, Chlamydophila pneumoniae TW-183
caaagaccagaau

SEQ ID NO: 2571705 - RNA, 13 nt, Chlamydophila pneumoniae TW-183
caaagauauaagg

SEQ ID NO: 2571706 - RNA, 13 nt, Chlamydophila pneumoniae TW-183
caaagauccuaau

SEQ ID NO: 2571707 - RNA, 14 nt, Chlamydophila pneumoniae TW-183
caaagauuuccaau

SEQ ID NO: 2571708 - RNA, 19 nt, Chlamydophila pneumoniae TW-183
caaaggagcgggauaggca

SEQ ID NO: 2571709 - RNA, 20 nt, Chlamydophila pneumoniae TW-183
caaaguacuaauuacagaau

SEQ ID NO: 2571710 - RNA, 12 nt, Chlamydophila pneumoniae TW-183
caaaguuuauga

SEQ ID NO: 2571711 - RNA, 17 nt, Chlamydophila pneumoniae TW-183
caaauaguucaucauau

SEQ ID NO: 2571712 - RNA, 21 nt, Chlamydophila pneumoniae TW-183
caaaucucauuccagcaucuu

SEQ ID NO: 2571713 - RNA, 22 nt, Chlamydophila pneumoniae TW-183
caaauuaccuugagacaaagaa

SEQ ID NO: 2571714 - RNA, 21 nt, Chlamydophila pneumoniae TW-183
caacaaaggcuccaaacgcaa

SEQ ID NO: 2571715 - RNA, 16 nt, Chlamydophila pneumoniae TW-183
caacacgcacaaacua

SEQ ID NO: 2571716 - RNA, 15 nt, Chlamydophila pneumoniae TW-183
caacccgaauuccuc

SEQ ID NO: 2571717 - RNA, 18 nt, Chlamydophila pneumoniae TW-183
caacccgaauuccucucc

SEQ ID NO: 2571718 - RNA, 16 nt, Chlamydophila pneumoniae TW-183
caacgaucgucaguaa

SEQ ID NO: 2571719 - RNA, 19 nt, Chlamydophila pneumoniae TW-183
caacgaucgucaguaaaac

SEQ ID NO: 2571720 - RNA, 19 nt, Chlamydophila pneumoniae TW-183
caacgcaugacgcuuuucc

SEQ ID NO: 2571721 - RNA, 20 nt, Chlamydophila pneumoniae TW-183
caacuaaaccuucaaugauu

SEQ ID NO: 2571722 - RNA, 16 nt, Chlamydophila pneumoniae TW-183
caacuaaacucuccaa

SEQ ID NO: 2571723 - RNA, 20 nt, Chlamydophila pneumoniae TW-183
caacucuacaagugucugag

SEQ ID NO: 2571724 - RNA, 14 nt, Chlamydophila pneumoniae TW-183
caacuucuccaacu

SEQ ID NO: 2571725 - RNA, 17 nt, Chlamydophila pneumoniae TW-183
caacuuuguuaauagaa

SEQ ID NO: 2571726 - RNA, 20 nt, Chlamydophila pneumoniae TW-183
caagagcaucacaaacuaaa

SEQ ID NO: 2571727 - RNA, 23 nt, Chlamydophila pneumoniae TW-183
caagagcucguaauccuucuuuc

SEQ ID NO: 2571728 - RNA, 22 nt, Chlamydophila pneumoniae TW-183
caagaggcuguccuugcagccc

SEQ ID NO: 2571729 - RNA, 17 nt, Chlamydophila pneumoniae TW-183
caagauacuacuuacaa

SEQ ID NO: 2571730 - RNA, 20 nt, Chlamydophila pneumoniae TW-183
caagauacuacuuacaagaa

SEQ ID NO: 2571731 - RNA, 21 nt, Chlamydophila pneumoniae TW-183
caagcaacugauguuuuauag

SEQ ID NO: 2571732 - RNA, 16 nt, Chlamydophila pneumoniae TW-183
caagcacuuucgcaaa

SEQ ID NO: 2571733 - RNA, 17 nt, Chlamydophila pneumoniae TW-183
caagcacuuucgcaaaa

SEQ ID NO: 2571734 - RNA, 22 nt, Chlamydophila pneumoniae TW-183
caagcaggugugugguaaaaau

SEQ ID NO: 2571735 - RNA, 16 nt, Chlamydophila pneumoniae TW-183
caagcuuagcaaccca

SEQ ID NO: 2571736 - RNA, 20 nt, Chlamydophila pneumoniae TW-183
caagcuuugcgcuuguucuu

SEQ ID NO: 2571737 - RNA, 14 nt, Chlamydophila pneumoniae TW-183
caaguugagagaga

SEQ ID NO: 2571738 - RNA, 18 nt, Chlamydophila pneumoniae TW-183
cagcacgaauaaagcccu

SEQ ID NO: 2571739 - RNA, 22 nt, Chlamydophila pneumoniae TW-183
cagcagcuucccaagcagaaga

SEQ ID NO: 2571740 - RNA, 15 nt, Chlamydophila pneumoniae TW-183
cagcauaaaaauucu

SEQ ID NO: 2571741 - RNA, 22 nt, Chlamydophila pneumoniae TW-183
cagcauaaggauucugagaagu

SEQ ID NO: 2571742 - RNA, 15 nt, Chlamydophila pneumoniae TW-183
cagcauggacuccaa

SEQ ID NO: 2571743 - RNA, 18 nt, Chlamydophila pneumoniae TW-183
cagcauggacuccaagaa

SEQ ID NO: 2571744 - RNA, 15 nt, Chlamydophila pneumoniae TW-183
cagccugcaccagac

SEQ ID NO: 2571745 - RNA, 13 nt, Chlamydophila pneumoniae TW-183
cagccugucuaua

SEQ ID NO: 2571746 - RNA, 19 nt, Chlamydophila pneumoniae TW-183
cagccugucuauaaaauaa

SEQ ID NO: 2571747 - RNA, 24 nt, Chlamydophila pneumoniae TW-183
cagcgacaacacgcccacggaaag

SEQ ID NO: 2571748 - RNA, 12 nt, Chlamydophila pneumoniae TW-183
cagcggcacccu

SEQ ID NO: 2571749 - RNA, 22 nt, Chlamydophila pneumoniae TW-183
cagcgugaauaucaucacuaag

SEQ ID NO: 2571750 - RNA, 13 nt, Chlamydophila pneumoniae TW-183
cagcuaaucaauc

SEQ ID NO: 2571751 - RNA, 20 nt, Chlamydophila pneumoniae TW-183
cagcuaaucaauccaagaau

SEQ ID NO: 2571752 - RNA, 14 nt, Chlamydophila pneumoniae TW-183
cagcucggaaugcu

SEQ ID NO: 2571753 - RNA, 23 nt, Chlamydophila pneumoniae TW-183
cagcuucccaagcagaagacccu

SEQ ID NO: 2571754 - RNA, 16 nt, Chlamydophila pneumoniae TW-183
cagcuucgcaaucuuu

SEQ ID NO: 2571755 - RNA, 15 nt, Chlamydophila pneumoniae TW-183
cagcuucuacagcau

SEQ ID NO: 2571756 - RNA, 20 nt, Chlamydophila pneumoniae TW-183
cagcuucuugauguacagua

SEQ ID NO: 2571757 - RNA, 17 nt, Chlamydophila pneumoniae TW-183
cagcuuuaucaggaucu

SEQ ID NO: 2571758 - RNA, 22 nt, Chlamydophila pneumoniae TW-183
cagcuuuaucaggaucuugauu

SEQ ID NO: 2571759 - RNA, 20 nt, Chlamydophila pneumoniae TW-183
caggaaaacgcccucuagaa

SEQ ID NO: 2571760 - RNA, 17 nt, Chlamydophila pneumoniae TW-183
caggaaacguucuuuca

SEQ ID NO: 2571761 - RNA, 18 nt, Chlamydophila pneumoniae TW-183
caggaaacguucuuucaa

SEQ ID NO: 2571762 - RNA, 16 nt, Chlamydophila pneumoniae TW-183
caggagagagaaggcu

SEQ ID NO: 2571763 - RNA, 23 nt, Chlamydophila pneumoniae TW-183
caggagagagaaggcucucaagg

SEQ ID NO: 2571764 - RNA, 17 nt, Chlamydophila pneumoniae TW-183
caggauauugcggaaau

SEQ ID NO: 2571765 - RNA, 15 nt, Chlamydophila pneumoniae TW-183
caggcaucacuaauc

SEQ ID NO: 2571766 - RNA, 18 nt, Chlamydophila pneumoniae TW-183
caggccuggugcuuaaaa

SEQ ID NO: 2571767 - RNA, 23 nt, Chlamydophila pneumoniae TW-183
caggggaugugauguucugcugc

SEQ ID NO: 2571768 - RNA, 22 nt, Chlamydophila pneumoniae TW-183
caggguuucucggauccuccaa

SEQ ID NO: 2571769 - RNA, 15 nt, Chlamydophila pneumoniae TW-183
caggucugcugagga

SEQ ID NO: 2571770 - RNA, 20 nt, Chlamydophila pneumoniae TW-183
caggugacuaaacaccuucu

SEQ ID NO: 2571771 - RNA, 20 nt, Chlamydophila pneumoniae TW-183
caguaaaacacaaauagcaa

SEQ ID NO: 2571772 - RNA, 16 nt, Chlamydophila pneumoniae TW-183
caguauaaucagaagu

SEQ ID NO: 2571773 - RNA, 14 nt, Chlamydophila pneumoniae TW-183
cagucuccuggaac

SEQ ID NO: 2571774 - RNA, 23 nt, Chlamydophila pneumoniae TW-183
cagucuugcgccagcaaagauua

SEQ ID NO: 2571775 - RNA, 22 nt, Chlamydophila pneumoniae TW-183
cagugcuguuuuuucacuuaca

SEQ ID NO: 2571776 - RNA, 14 nt, Chlamydophila pneumoniae TW-183
caguuaaagagcau

SEQ ID NO: 2571777 - RNA, 13 nt, Chlamydophila pneumoniae TW-183
caguugcggagau

SEQ ID NO: 2571778 - RNA, 15 nt, Chlamydophila pneumoniae TW-183
caguuuuccauccac

SEQ ID NO: 2571779 - RNA, 14 nt, Chlamydophila pneumoniae TW-183
cauaaaaaaagcua

SEQ ID NO: 2571780 - RNA, 15 nt, Chlamydophila pneumoniae TW-183
cauaaaaauucucau

SEQ ID NO: 2571781 - RNA, 17 nt, Chlamydophila pneumoniae TW-183
cauaaccuccucuucuu

SEQ ID NO: 2571782 - RNA, 14 nt, Chlamydophila pneumoniae TW-183
cauaagagaacuuu

SEQ ID NO: 2571783 - RNA, 13 nt, Chlamydophila pneumoniae TW-183
cauaagaucucua

SEQ ID NO: 2571784 - RNA, 22 nt, Chlamydophila pneumoniae TW-183
cauaagaucucuaaguucuuga

SEQ ID NO: 2571785 - RNA, 16 nt, Chlamydophila pneumoniae TW-183
cauaaucucaccagaa

SEQ ID NO: 2571786 - RNA, 20 nt, Chlamydophila pneumoniae TW-183
cauaaucucaccagaagcaa

SEQ ID NO: 2571787 - RNA, 22 nt, Chlamydophila pneumoniae TW-183
cauaaucucaccagaagcaacu

SEQ ID NO: 2571788 - RNA, 23 nt, Chlamydophila pneumoniae TW-183
cauacgccgugccuauagaaauu

SEQ ID NO: 2571789 - RNA, 14 nt, Chlamydophila pneumoniae TW-183
cauacucuucaucc

SEQ ID NO: 2571790 - RNA, 15 nt, Chlamydophila pneumoniae TW-183
cauagagauucuaca

SEQ ID NO: 2571791 - RNA, 17 nt, Chlamydophila pneumoniae TW-183
cauaggauccaggaguu

SEQ ID NO: 2571792 - RNA, 20 nt, Chlamydophila pneumoniae TW-183
cauaggcuuuaccauagaaa

SEQ ID NO: 2571793 - RNA, 20 nt, Chlamydophila pneumoniae TW-183
cauauaauacgucucaucgc

SEQ ID NO: 2571794 - RNA, 18 nt, Chlamydophila pneumoniae TW-183
cauauacuguuaacaagu

SEQ ID NO: 2571795 - RNA, 16 nt, Chlamydophila pneumoniae TW-183
cauauuuuucuugaag

SEQ ID NO: 2571796 - RNA, 20 nt, Chlamydophila pneumoniae TW-183
caucaaauaguucaucauau

SEQ ID NO: 2571797 - RNA, 13 nt, Chlamydophila pneumoniae TW-183
caucaaggccuau

SEQ ID NO: 2571798 - RNA, 18 nt, Chlamydophila pneumoniae TW-183
caucaaugagaaauaggg

SEQ ID NO: 2571799 - RNA, 23 nt, Chlamydophila pneumoniae TW-183
caucaaugauaucgccuuccuua

SEQ ID NO: 2571800 - RNA, 19 nt, Chlamydophila pneumoniae TW-183
caucacaaacuaaaucaac

SEQ ID NO: 2571801 - RNA, 14 nt, Chlamydophila pneumoniae TW-183
caucacuaaucuca

SEQ ID NO: 2571802 - RNA, 15 nt, Chlamydophila pneumoniae TW-183
caucacuuauauuuu

SEQ ID NO: 2571803 - RNA, 16 nt, Chlamydophila pneumoniae TW-183
caucagaagccaccaa

SEQ ID NO: 2571804 - RNA, 18 nt, Chlamydophila pneumoniae TW-183
caucagaagccaccaaaa

SEQ ID NO: 2571805 - RNA, 19 nt, Chlamydophila pneumoniae TW-183
caucagcaaaacucccgac

SEQ ID NO: 2571806 - RNA, 13 nt, Chlamydophila pneumoniae TW-183
caucaggauucuc

SEQ ID NO: 2571807 - RNA, 14 nt, Chlamydophila pneumoniae TW-183
caucaggauucucu

SEQ ID NO: 2571808 - RNA, 16 nt, Chlamydophila pneumoniae TW-183
caucaggauucucucu

SEQ ID NO: 2571809 - RNA, 20 nt, Chlamydophila pneumoniae TW-183
caucaguggcgacugcaaca

SEQ ID NO: 2571810 - RNA, 12 nt, Chlamydophila pneumoniae TW-183
cauccagaagua

SEQ ID NO: 2571811 - RNA, 22 nt, Chlamydophila pneumoniae TW-183
caucggcauuucuccacaugcc

SEQ ID NO: 2571812 - RNA, 22 nt, Chlamydophila pneumoniae TW-183
caucuacgauguuuucuuaucc

SEQ ID NO: 2571813 - RNA, 23 nt, Chlamydophila pneumoniae TW-183
caucuuaucaagagcucguaauc

SEQ ID NO: 2571814 - RNA, 19 nt, Chlamydophila pneumoniae TW-183
caugacgcuuuuccaaagc

SEQ ID NO: 2571815 - RNA, 21 nt, Chlamydophila pneumoniae TW-183
caugagagucgaaacacucau

SEQ ID NO: 2571816 - RNA, 23 nt, Chlamydophila pneumoniae TW-183
caugagagucgaaacacucauga

SEQ ID NO: 2571817 - RNA, 17 nt, Chlamydophila pneumoniae TW-183
caugagcucaggcaaca

SEQ ID NO: 2571818 - RNA, 18 nt, Chlamydophila pneumoniae TW-183
caugcacgagagccucgg

SEQ ID NO: 2571819 - RNA, 22 nt, Chlamydophila pneumoniae TW-183
caugcauaggcuuuaccauaga

SEQ ID NO: 2571820 - RNA, 16 nt, Chlamydophila pneumoniae TW-183
caugcggacuuuauuc

SEQ ID NO: 2571821 - RNA, 16 nt, Chlamydophila pneumoniae TW-183
cauggacaauauagag

SEQ ID NO: 2571822 - RNA, 15 nt, Chlamydophila pneumoniae TW-183
cauggacuccaagaa

SEQ ID NO: 2571823 - RNA, 15 nt, Chlamydophila pneumoniae TW-183
cauggauauggaaug

SEQ ID NO: 2571824 - RNA, 20 nt, Chlamydophila pneumoniae TW-183
cauguacaaugauaucagca

SEQ ID NO: 2571825 - RNA, 16 nt, Chlamydophila pneumoniae TW-183
caugucucuuaaaaaa

SEQ ID NO: 2571826 - RNA, 22 nt, Chlamydophila pneumoniae TW-183
caugucucuuaaaaaaaauuac

SEQ ID NO: 2571827 - RNA, 20 nt, Chlamydophila pneumoniae TW-183
cauguuaagcguauagaaua

SEQ ID NO: 2571828 - RNA, 12 nt, Chlamydophila pneumoniae TW-183
cauuaaggugug

SEQ ID NO: 2571829 - RNA, 17 nt, Chlamydophila pneumoniae TW-183
cauuccagcaucuucuc

SEQ ID NO: 2571830 - RNA, 22 nt, Chlamydophila pneumoniae TW-183
cauugcagauauacuuuuucag

SEQ ID NO: 2571831 - RNA, 13 nt, Chlamydophila pneumoniae TW-183
cauuguuuaaguc

SEQ ID NO: 2571832 - RNA, 16 nt, Chlamydophila pneumoniae TW-183
cauuuaaacuaagaau

SEQ ID NO: 2571833 - RNA, 18 nt, Chlamydophila pneumoniae TW-183
cauuuaaacuaagaauac

SEQ ID NO: 2571834 - RNA, 16 nt, Chlamydophila pneumoniae TW-183
cauuucauguaagaau

SEQ ID NO: 2571835 - RNA, 20 nt, Chlamydophila pneumoniae TW-183
ccuggaacaguauaaucaga

SEQ ID NO: 2571836 - RNA, 18 nt, Chlamydophila pneumoniae TW-183
ccuggacgauauaaucac

SEQ ID NO: 2571837 - RNA, 18 nt, Chlamydophila pneumoniae TW-183
ccuggauugauccacaga

SEQ ID NO: 2571838 - RNA, 20 nt, Chlamydophila pneumoniae TW-183
ccuguaauugauguuccuug

SEQ ID NO: 2571839 - RNA, 22 nt, Chlamydophila pneumoniae TW-183
ccuguaccacauacucuucauc

SEQ ID NO: 2571840 - RNA, 19 nt, Chlamydophila pneumoniae TW-183
ccuguaguaaaauaagaaa

SEQ ID NO: 2571841 - RNA, 23 nt, Chlamydophila pneumoniae TW-183
ccuguaguuucuaaaacagaaau

SEQ ID NO: 2571842 - RNA, 19 nt, Chlamydophila pneumoniae TW-183
ccugugauagguagcagcc

SEQ ID NO: 2571843 - RNA, 16 nt, Chlamydophila pneumoniae TW-183
ccuguuuuauugggaa

SEQ ID NO: 2571844 - RNA, 22 nt, Chlamydophila pneumoniae TW-183
ccuguuuucuuuucugaagauu

SEQ ID NO: 2571845 - RNA, 18 nt, Chlamydophila pneumoniae TW-183
ccuuaaagagaaucuccu

SEQ ID NO: 2571846 - RNA, 19 nt, Chlamydophila pneumoniae TW-183
ccuuaaagagaaucuccuc

SEQ ID NO: 2571847 - RNA, 22 nt, Chlamydophila pneumoniae TW-183
ccuuacucccaugggauaggaa

SEQ ID NO: 2571848 - RNA, 12 nt, Chlamydophila pneumoniae TW-183
ccuucaacacac

SEQ ID NO: 2571849 - RNA, 19 nt, Chlamydophila pneumoniae TW-183
ccuucacaagaaaacaaag

SEQ ID NO: 2571850 - RNA, 14 nt, Chlamydophila pneumoniae TW-183
ccuucgauuccagg

SEQ ID NO: 2571851 - RNA, 15 nt, Chlamydophila pneumoniae TW-183
ccuugacuaaaucca

SEQ ID NO: 2571852 - RNA, 21 nt, Chlamydophila pneumoniae TW-183
ccuugcagcgacaacacgccc

SEQ ID NO: 2571853 - RNA, 14 nt, Chlamydophila pneumoniae TW-183
ccuugguaucccaa

SEQ ID NO: 2571854 - RNA, 15 nt, Chlamydophila pneumoniae TW-183
ccuugugagaggguc

SEQ ID NO: 2571855 - RNA, 12 nt, Chlamydophila pneumoniae TW-183
ccuuguucuuga

SEQ ID NO: 2571856 - RNA, 12 nt, Chlamydophila pneumoniae TW-183
ccuuguuuuccu

SEQ ID NO: 2571857 - RNA, 13 nt, Chlamydophila pneumoniae TW-183
ccuuguuuuccug

SEQ ID NO: 2571858 - RNA, 23 nt, Chlamydophila pneumoniae TW-183
ccuuucucuuccgauuaacuuua

SEQ ID NO: 2571859 - RNA, 19 nt, Chlamydophila pneumoniae TW-183
ccuuuuucauugaugcuua

SEQ ID NO: 2571860 - RNA, 18 nt, Chlamydophila pneumoniae TW-183
cgaaacucuuugaggaua

SEQ ID NO: 2571861 - RNA, 18 nt, Chlamydophila pneumoniae TW-183
cgaaagcuacagcuaacg

SEQ ID NO: 2571862 - RNA, 15 nt, Chlamydophila pneumoniae TW-183
cgaacagcuccugga

SEQ ID NO: 2571863 - RNA, 18 nt, Chlamydophila pneumoniae TW-183
cgaagcuugcugauuucu

SEQ ID NO: 2571864 - RNA, 20 nt, Chlamydophila pneumoniae TW-183
cgacaugcaggccaacucuc

SEQ ID NO: 2571865 - RNA, 17 nt, Chlamydophila pneumoniae TW-183
cgaccuaggagaaauca

SEQ ID NO: 2571866 - RNA, 17 nt, Chlamydophila pneumoniae TW-183
cgaccucgaauuccucc

SEQ ID NO: 2571867 - RNA, 19 nt, Chlamydophila pneumoniae TW-183
cgaccugcaaacuccccag

SEQ ID NO: 2571868 - RNA, 21 nt, Chlamydophila pneumoniae TW-183
cgacguuuugcuguggaauuu

SEQ ID NO: 2571869 - RNA, 18 nt, Chlamydophila pneumoniae TW-183
cgagaguugccaggaaac

SEQ ID NO: 2571870 - RNA, 19 nt, Chlamydophila pneumoniae TW-183
cgagaguugccaggaaacg

SEQ ID NO: 2571871 - RNA, 15 nt, Chlamydophila pneumoniae TW-183
cgagauaugaagaga

SEQ ID NO: 2571872 - RNA, 18 nt, Chlamydophila pneumoniae TW-183
cgagauccuccuggaaga

SEQ ID NO: 2571873 - RNA, 16 nt, Chlamydophila pneumoniae TW-183
cgagcagaaacuccaa

SEQ ID NO: 2571874 - RNA, 16 nt, Chlamydophila pneumoniae TW-183
cgaguccuuacuugca

SEQ ID NO: 2571875 - RNA, 21 nt, Chlamydophila pneumoniae TW-183
cgauaacguugccuguuuuau

SEQ ID NO: 2571876 - RNA, 14 nt, Chlamydophila pneumoniae TW-183
cgaucgucaguaaa

SEQ ID NO: 2571877 - RNA, 12 nt, Chlamydophila pneumoniae TW-183
cgauuaccuaaa

SEQ ID NO: 2571878 - RNA, 14 nt, Chlamydophila pneumoniae TW-183
cgauuccugaggcu

SEQ ID NO: 2571879 - RNA, 15 nt, Chlamydophila pneumoniae TW-183
cgauuccugaggcua

SEQ ID NO: 2571880 - RNA, 22 nt, Chlamydophila pneumoniae TW-183
cgauuguaaaaguagcauccug

SEQ ID NO: 2571881 - RNA, 18 nt, Chlamydophila pneumoniae TW-183
cgauuugaacaugaggau

SEQ ID NO: 2571882 - RNA, 20 nt, Chlamydophila pneumoniae TW-183
cgcaaguaaagaaauucugg

SEQ ID NO: 2571883 - RNA, 12 nt, Chlamydophila pneumoniae TW-183
cgccuacaaguu

SEQ ID NO: 2571884 - RNA, 12 nt, Chlamydophila pneumoniae TW-183
cgcggaucuucu

SEQ ID NO: 2571885 - RNA, 17 nt, Chlamydophila pneumoniae TW-183
cgcuaccauaucuugag

SEQ ID NO: 2571886 - RNA, 20 nt, Chlamydophila pneumoniae TW-183
cgcucuaagcugugcauuuu

SEQ ID NO: 2571887 - RNA, 14 nt, Chlamydophila pneumoniae TW-183
cgcucucuccauga

SEQ ID NO: 2571888 - RNA, 16 nt, Chlamydophila pneumoniae TW-183
cgcuuguucuuuucau

SEQ ID NO: 2571889 - RNA, 13 nt, Chlamydophila pneumoniae TW-183
cgcuuuuuacuga

SEQ ID NO: 2571890 - RNA, 16 nt, Chlamydophila pneumoniae TW-183
cggaaauugaauaucg

SEQ ID NO: 2571891 - RNA, 22 nt, Chlamydophila pneumoniae TW-183
cggaugugccgugacuccagaa

SEQ ID NO: 2571892 - RNA, 13 nt, Chlamydophila pneumoniae TW-183
cggauuuucucua

SEQ ID NO: 2571893 - RNA, 17 nt, Chlamydophila pneumoniae TW-183
cggauuuucucuacaca

SEQ ID NO: 2571894 - RNA, 15 nt, Chlamydophila pneumoniae TW-183
cggcaacauaaucau

SEQ ID NO: 2571895 - RNA, 20 nt, Chlamydophila pneumoniae TW-183
cggcacuuacuucaagaaaa

SEQ ID NO: 2571896 - RNA, 14 nt, Chlamydophila pneumoniae TW-183
cggcucucuucauu

SEQ ID NO: 2571897 - RNA, 19 nt, Chlamydophila pneumoniae TW-183
cgggaucguagcaggcauc

SEQ ID NO: 2571898 - RNA, 18 nt, Chlamydophila pneumoniae TW-183
cgggauucguagcuuccc

SEQ ID NO: 2571899 - RNA, 13 nt, Chlamydophila pneumoniae TW-183
cggugucuacaaa

SEQ ID NO: 2571900 - RNA, 14 nt, Chlamydophila pneumoniae TW-183
cguaaccacaggau

SEQ ID NO: 2571901 - RNA, 18 nt, Chlamydophila pneumoniae TW-183
cguaacugaggcaaagau

SEQ ID NO: 2571902 - RNA, 17 nt, Chlamydophila pneumoniae TW-183
cguaagcugcaaucuca

SEQ ID NO: 2571903 - RNA, 17 nt, Chlamydophila pneumoniae TW-183
cguaauccuucuuucug

SEQ ID NO: 2571904 - RNA, 18 nt, Chlamydophila pneumoniae TW-183
cguacgcaaguaaagaaa

SEQ ID NO: 2571905 - RNA, 18 nt, Chlamydophila pneumoniae TW-183
cguagcaggcaucacuaa

SEQ ID NO: 2571906 - RNA, 20 nt, Chlamydophila pneumoniae TW-183
cguaggguagccauccacga

SEQ ID NO: 2571907 - RNA, 21 nt, Chlamydophila pneumoniae TW-183
cguaguauccuuucaucagca

SEQ ID NO: 2571908 - RNA, 16 nt, Chlamydophila pneumoniae TW-183
cguauaaggauguugu

SEQ ID NO: 2571909 - RNA, 20 nt, Chlamydophila pneumoniae TW-183
cguauggauuucuccagcag

SEQ ID NO: 2571910 - RNA, 22 nt, Chlamydophila pneumoniae TW-183
cguauggauuucuccagcagcu

SEQ ID NO: 2571911 - RNA, 16 nt, Chlamydophila pneumoniae TW-183
cgucaguaaaacacaa

SEQ ID NO: 2571912 - RNA, 22 nt, Chlamydophila pneumoniae TW-183
cgucaguaaaacacaaauagca

SEQ ID NO: 2571913 - RNA, 18 nt, Chlamydophila pneumoniae TW-183
cguccagccugcaccaga

SEQ ID NO: 2571914 - RNA, 19 nt, Chlamydophila pneumoniae TW-183
cguccagccugcaccagac

SEQ ID NO: 2571915 - RNA, 14 nt, Chlamydophila pneumoniae TW-183
cgucuccaacaguc

SEQ ID NO: 2571916 - RNA, 19 nt, Chlamydophila pneumoniae TW-183
cguggagugcucuacccca

SEQ ID NO: 2571917 - RNA, 17 nt, Chlamydophila pneumoniae TW-183
cguggcuuuguaaaaau

SEQ ID NO: 2571918 - RNA, 22 nt, Chlamydophila pneumoniae TW-183
cguucaacuuuguuaauagaag

SEQ ID NO: 2571919 - RNA, 22 nt, Chlamydophila pneumoniae TW-183
cguuuugucgguaauuuccaug

SEQ ID NO: 2571920 - RNA, 14 nt, Chlamydophila pneumoniae TW-183
cuaaaacaaaauca

SEQ ID NO: 2571921 - RNA, 14 nt, Chlamydophila pneumoniae TW-183
cuaaaaguuuuuua

SEQ ID NO: 2571922 - RNA, 15 nt, Chlamydophila pneumoniae TW-183
cuaaaccuucaauga

SEQ ID NO: 2571923 - RNA, 13 nt, Chlamydophila pneumoniae TW-183
cuaaacucuccaa

SEQ ID NO: 2571924 - RNA, 20 nt, Chlamydophila pneumoniae TW-183
cuaaacucuccaaaagcucu

SEQ ID NO: 2571925 - RNA, 17 nt, Chlamydophila pneumoniae TW-183
cuaaaggaaucucggga

SEQ ID NO: 2571926 - RNA, 13 nt, Chlamydophila pneumoniae TW-183
cuaaagugucaua

SEQ ID NO: 2571927 - RNA, 14 nt, Chlamydophila pneumoniae TW-183
cuaaauagaaaaca

SEQ ID NO: 2571928 - RNA, 16 nt, Chlamydophila pneumoniae TW-183
cuaaauagaaaacaua

SEQ ID NO: 2571929 - RNA, 23 nt, Chlamydophila pneumoniae TW-183
cuaaaucaacuacaucuccaagc

SEQ ID NO: 2571930 - RNA, 23 nt, Chlamydophila pneumoniae TW-183
cuaacgaagugaggagaauagca

SEQ ID NO: 2571931 - RNA, 18 nt, Chlamydophila pneumoniae TW-183
cuaagagcgucuucuuuu

SEQ ID NO: 2571932 - RNA, 12 nt, Chlamydophila pneumoniae TW-183
cucuaucucucg

SEQ ID NO: 2571933 - RNA, 14 nt, Chlamydophila pneumoniae TW-183
cucuaucucucgga

SEQ ID NO: 2571934 - RNA, 19 nt, Chlamydophila pneumoniae TW-183
cucucaguuaaagagcauc

SEQ ID NO: 2571935 - RNA, 13 nt, Chlamydophila pneumoniae TW-183
cucuccaaaagcu

SEQ ID NO: 2571936 - RNA, 16 nt, Chlamydophila pneumoniae TW-183
cucucuccaugagcuc

SEQ ID NO: 2571937 - RNA, 18 nt, Chlamydophila pneumoniae TW-183
cucucuuuauauuuuuug

SEQ ID NO: 2571938 - RNA, 21 nt, Chlamydophila pneumoniae TW-183
cucugacuugcaagcuucuug

SEQ ID NO: 2571939 - RNA, 18 nt, Chlamydophila pneumoniae TW-183
cucugagucgacaugcag

SEQ ID NO: 2571940 - RNA, 15 nt, Chlamydophila pneumoniae TW-183
cucugccuaccaaag

SEQ ID NO: 2571941 - RNA, 23 nt, Chlamydophila pneumoniae TW-183
cucuguagguuuuuccaacuuca

SEQ ID NO: 2571942 - RNA, 17 nt, Chlamydophila pneumoniae TW-183
cucugugguuccuggau

SEQ ID NO: 2571943 - RNA, 23 nt, Chlamydophila pneumoniae TW-183
cucugugguuccuggauuuagga

SEQ ID NO: 2571944 - RNA, 20 nt, Chlamydophila pneumoniae TW-183
cucuuaauuuuuuuagcaau

SEQ ID NO: 2571945 - RNA, 16 nt, Chlamydophila pneumoniae TW-183
cucuuauugcagaauc

SEQ ID NO: 2571946 - RNA, 22 nt, Chlamydophila pneumoniae TW-183
cucuucacuauuaggcuuuuuu

SEQ ID NO: 2571947 - RNA, 21 nt, Chlamydophila pneumoniae TW-183
cucuucgcuggcauguuuaau

SEQ ID NO: 2571948 - RNA, 20 nt, Chlamydophila pneumoniae TW-183
cucuucuauguguucucgaa

SEQ ID NO: 2571949 - RNA, 16 nt, Chlamydophila pneumoniae TW-183
cucuugcucuagucuu

SEQ ID NO: 2571950 - RNA, 21 nt, Chlamydophila pneumoniae TW-183
cucuuuaacuucuaaaagcaa

SEQ ID NO: 2571951 - RNA, 20 nt, Chlamydophila pneumoniae TW-183
cucuuuauauuuuuugagaa

SEQ ID NO: 2571952 - RNA, 22 nt, Chlamydophila pneumoniae TW-183
cucuuugauuuucuuagcuucc

SEQ ID NO: 2571953 - RNA, 17 nt, Chlamydophila pneumoniae TW-183
cugaaagaacacuccug

SEQ ID NO: 2571954 - RNA, 20 nt, Chlamydophila pneumoniae TW-183
cugaaagaacacuccugacu

SEQ ID NO: 2571955 - RNA, 15 nt, Chlamydophila pneumoniae TW-183
cugaagaggccugca

SEQ ID NO: 2571956 - RNA, 10 nt, Chlamydophila pneumoniae TW-183
cugaagauuu

SEQ ID NO: 2571957 - RNA, 14 nt, Chlamydophila pneumoniae TW-183
cugaaucuuuuguu

SEQ ID NO: 2571958 - RNA, 22 nt, Chlamydophila pneumoniae TW-183
cugacuauagggagacucuuga

SEQ ID NO: 2571959 - RNA, 19 nt, Chlamydophila pneumoniae TW-183
cugacuugcaagcuucuug

SEQ ID NO: 2571960 - RNA, 15 nt, Chlamydophila pneumoniae TW-183
cugagaaagaagucc

SEQ ID NO: 2571961 - RNA, 12 nt, Chlamydophila pneumoniae TW-183
cugagagaagca

SEQ ID NO: 2571962 - RNA, 17 nt, Chlamydophila pneumoniae TW-183
cugaggacgcagagaug

SEQ ID NO: 2571963 - RNA, 22 nt, Chlamydophila pneumoniae TW-183
cugaggcuauagaauacacagc

SEQ ID NO: 2571964 - RNA, 14 nt, Chlamydophila pneumoniae TW-183
cugaugccaagaaa

SEQ ID NO: 2571965 - RNA, 22 nt, Chlamydophila pneumoniae TW-183
cugaugccaagaaauauacugc

SEQ ID NO: 2571966 - RNA, 22 nt, Chlamydophila pneumoniae TW-183
cugaugcugaggacgcagagau

SEQ ID NO: 2571967 - RNA, 22 nt, Chlamydophila pneumoniae TW-183
cugauucucccaauauccagaa

SEQ ID NO: 2571968 - RNA, 16 nt, Chlamydophila pneumoniae TW-183
cugauuucuuuuucag

SEQ ID NO: 2571969 - RNA, 16 nt, Chlamydophila pneumoniae TW-183
cugcauaaucucacca

SEQ ID NO: 2571970 - RNA, 20 nt, Chlamydophila pneumoniae TW-183
cugcauaaucucaccagaag

SEQ ID NO: 2571971 - RNA, 21 nt, Chlamydophila pneumoniae TW-183
cugccagagauucuucacaau

SEQ ID NO: 2571972 - RNA, 20 nt, Chlamydophila pneumoniae TW-183
cugcugaggagaguaagguc

SEQ ID NO: 2571973 - RNA, 23 nt, Chlamydophila pneumoniae TW-183
cugcugaggagaguaaggucauu

SEQ ID NO: 2571974 - RNA, 22 nt, Chlamydophila pneumoniae TW-183
cugcuugugaggcuauagcaua

SEQ ID NO: 2571975 - RNA, 14 nt, Chlamydophila pneumoniae TW-183
cugcuuuuguuguu

SEQ ID NO: 2571976 - RNA, 18 nt, Chlamydophila pneumoniae TW-183
cuggaagaauuucauaag

SEQ ID NO: 2571977 - RNA, 20 nt, Chlamydophila pneumoniae TW-183
cuggaagauguuguuuuuug

SEQ ID NO: 2571978 - RNA, 24 nt, Chlamydophila pneumoniae TW-183
cuggaggcgguggcaugccauaau

SEQ ID NO: 2571979 - RNA, 18 nt, Chlamydophila pneumoniae TW-183
cuggauugauccacagau

SEQ ID NO: 2571980 - RNA, 15 nt, Chlamydophila pneumoniae TW-183
cugggaagacucuca

SEQ ID NO: 2571981 - RNA, 14 nt, Chlamydophila pneumoniae TW-183
cugguuucuucauc

SEQ ID NO: 2571982 - RNA, 17 nt, Chlamydophila pneumoniae TW-183
cugguuucuucaucugg

SEQ ID NO: 2571983 - RNA, 18 nt, Chlamydophila pneumoniae TW-183
cuguaacuugcauuuuuu

SEQ ID NO: 2571984 - RNA, 17 nt, Chlamydophila pneumoniae TW-183
cuguaauugauguuccu

SEQ ID NO: 2571985 - RNA, 16 nt, Chlamydophila pneumoniae TW-183
cuguaccacauacucu

SEQ ID NO: 2571986 - RNA, 16 nt, Chlamydophila pneumoniae TW-183
cuguacuaucuuuuuu

SEQ ID NO: 2571987 - RNA, 14 nt, Chlamydophila pneumoniae TW-183
cuguacuuccccaa

SEQ ID NO: 2571988 - RNA, 21 nt, Chlamydophila pneumoniae TW-183
cuguagguuuuuccaacuuca

SEQ ID NO: 2571989 - RNA, 17 nt, Chlamydophila pneumoniae TW-183
cuguccuugcagcccug

SEQ ID NO: 2571990 - RNA, 18 nt, Chlamydophila pneumoniae TW-183
cugucuagaacacucaga

SEQ ID NO: 2571991 - RNA, 13 nt, Chlamydophila pneumoniae TW-183
cugugcauuuucu

SEQ ID NO: 2571992 - RNA, 18 nt, Chlamydophila pneumoniae TW-183
cugugcauuuucuucuug

SEQ ID NO: 2571993 - RNA, 14 nt, Chlamydophila pneumoniae TW-183
cuguggaauuuucc

SEQ ID NO: 2571994 - RNA, 14 nt, Chlamydophila pneumoniae TW-183
cugugguuccugga

SEQ ID NO: 2571995 - RNA, 16 nt, Chlamydophila pneumoniae TW-183
cugugguuccuggauu

SEQ ID NO: 2571996 - RNA, 13 nt, Chlamydophila pneumoniae TW-183
cuguuaacucaga

SEQ ID NO: 2571997 - RNA, 18 nt, Chlamydophila pneumoniae TW-183
cuguuccugaguacuuug

SEQ ID NO: 2571998 - RNA, 15 nt, Chlamydophila pneumoniae TW-183
cuguugcacuuuccg

SEQ ID NO: 2571999 - RNA, 21 nt, Chlamydophila pneumoniae TW-183
cuguuuuuucacuuacagaua

SEQ ID NO: 2572000 - RNA, 20 nt, Chlamydophila pneumoniae TW-183
cuuaaaauucuguaaaguga

SEQ ID NO: 2572001 - RNA, 20 nt, Chlamydophila pneumoniae TW-183
cuuaaagagaaucuccucau

SEQ ID NO: 2572002 - RNA, 11 nt, Chlamydophila pneumoniae TW-183
cuuaacaacau

SEQ ID NO: 2572003 - RNA, 24 nt, Chlamydophila pneumoniae TW-183
cuuaagaaucgaguucuucauugc

SEQ ID NO: 2572004 - RNA, 15 nt, Chlamydophila pneumoniae TW-183
cuuaagauacuucuc

SEQ ID NO: 2572005 - RNA, 17 nt, Chlamydophila pneumoniae TW-183
cuuacagauaaggaaga

SEQ ID NO: 2572006 - RNA, 19 nt, Chlamydophila pneumoniae TW-183
cuuacggccccuggaauuu

SEQ ID NO: 2572007 - RNA, 22 nt, Chlamydophila pneumoniae TW-183
cuuacggccccuggaauuucuc

SEQ ID NO: 2572008 - RNA, 23 nt, Chlamydophila pneumoniae TW-183
cuuacggccccuggaauuucucc

SEQ ID NO: 2572009 - RNA, 20 nt, Chlamydophila pneumoniae TW-183
cuuagaguugaccauauaau

SEQ ID NO: 2572010 - RNA, 15 nt, Chlamydophila pneumoniae TW-183
cuuaggguucucaaa

SEQ ID NO: 2572011 - RNA, 17 nt, Chlamydophila pneumoniae TW-183
cuuaucaagagcucgua

SEQ ID NO: 2572012 - RNA, 15 nt, Chlamydophila pneumoniae TW-183
cuuauugcagaaucu

SEQ ID NO: 2572013 - RNA, 15 nt, Chlamydophila pneumoniae TW-183
cuucaacaagaauaa

SEQ ID NO: 2572014 - RNA, 21 nt, Chlamydophila pneumoniae TW-183
cuucacuauuaggcuuuuuuc

SEQ ID NO: 2572015 - RNA, 22 nt, Chlamydophila pneumoniae TW-183
cuucacucuuuuauuuuaggaa

SEQ ID NO: 2572016 - RNA, 16 nt, Chlamydophila pneumoniae TW-183
cuucagaaucuuugug

SEQ ID NO: 2572017 - RNA, 16 nt, Chlamydophila pneumoniae TW-183
cuucagagagaacagg

SEQ ID NO: 2572018 - RNA, 18 nt, Chlamydophila pneumoniae TW-183
cuucagagagaacaggag

SEQ ID NO: 2572019 - RNA, 21 nt, Chlamydophila pneumoniae TW-183
cuucagcacgaauaaagcccu

SEQ ID NO: 2572020 - RNA, 16 nt, Chlamydophila pneumoniae TW-183
cuucaucaauaaagau

SEQ ID NO: 2572021 - RNA, 21 nt, Chlamydophila pneumoniae TW-183
cuucauccgaagacucaaaga

SEQ ID NO: 2572022 - RNA, 18 nt, Chlamydophila pneumoniae TW-183
cuucaucuucuaaauccc

SEQ ID NO: 2572023 - RNA, 14 nt, Chlamydophila pneumoniae TW-183
cuuccauaucuaga

SEQ ID NO: 2572024 - RNA, 20 nt, Chlamydophila pneumoniae TW-183
cuuccaucucuuuaaauguu

SEQ ID NO: 2572025 - RNA, 20 nt, Chlamydophila pneumoniae TW-183
cuucccaagcagaagacccu

SEQ ID NO: 2572026 - RNA, 14 nt, Chlamydophila pneumoniae TW-183
cuucccagccuuga

SEQ ID NO: 2572027 - RNA, 16 nt, Chlamydophila pneumoniae TW-183
cuuccccaaacaugga

SEQ ID NO: 2572028 - RNA, 20 nt, Chlamydophila pneumoniae TW-183
cuuccgugcgauuuccccuu

SEQ ID NO: 2572029 - RNA, 20 nt, Chlamydophila pneumoniae TW-183
gaagcaacuaaacucuccaa

SEQ ID NO: 2572030 - RNA, 15 nt, Chlamydophila pneumoniae TW-183
gaagcaguuuaggua

SEQ ID NO: 2572031 - RNA, 15 nt, Chlamydophila pneumoniae TW-183
gaagcugacaaauag

SEQ ID NO: 2572032 - RNA, 21 nt, Chlamydophila pneumoniae TW-183
gaaggcggcuuuuugcaagcu

SEQ ID NO: 2572033 - RNA, 16 nt, Chlamydophila pneumoniae TW-183
gaaggcuuguuucugu

SEQ ID NO: 2572034 - RNA, 18 nt, Chlamydophila pneumoniae TW-183
gaagguguggguacaggg

SEQ ID NO: 2572035 - RNA, 17 nt, Chlamydophila pneumoniae TW-183
gaaguccagacuuuccu

SEQ ID NO: 2572036 - RNA, 17 nt, Chlamydophila pneumoniae TW-183
gaagucccacaaaugau

SEQ ID NO: 2572037 - RNA, 22 nt, Chlamydophila pneumoniae TW-183
gaaguccuagggagugaggaau

SEQ ID NO: 2572038 - RNA, 23 nt, Chlamydophila pneumoniae TW-183
gaagugaucuugagaaaagaaca

SEQ ID NO: 2572039 - RNA, 23 nt, Chlamydophila pneumoniae TW-183
gaagugcuuuuagagguuuuugu

SEQ ID NO: 2572040 - RNA, 19 nt, Chlamydophila pneumoniae TW-183
gaaguugaaaugagugaga

SEQ ID NO: 2572041 - RNA, 23 nt, Chlamydophila pneumoniae TW-183
gaaguugaaaugagugagaaugc

SEQ ID NO: 2572042 - RNA, 15 nt, Chlamydophila pneumoniae TW-183
gaaguuuaaacgucu

SEQ ID NO: 2572043 - RNA, 19 nt, Chlamydophila pneumoniae TW-183
gaauaaagcccuuuugaau

SEQ ID NO: 2572044 - RNA, 13 nt, Chlamydophila pneumoniae TW-183
gaauaacuuuaga

SEQ ID NO: 2572045 - RNA, 22 nt, Chlamydophila pneumoniae TW-183
gaauaagauuuugaaaauugca

SEQ ID NO: 2572046 - RNA, 21 nt, Chlamydophila pneumoniae TW-183
gaauaaguuuugauuuugcag

SEQ ID NO: 2572047 - RNA, 17 nt, Chlamydophila pneumoniae TW-183
gaauaccucaagaugca

SEQ ID NO: 2572048 - RNA, 23 nt, Chlamydophila pneumoniae TW-183
gaauaccuucaacaagaauaacu

SEQ ID NO: 2572049 - RNA, 18 nt, Chlamydophila pneumoniae TW-183
gaauagcaagcacuuucg

SEQ ID NO: 2572050 - RNA, 22 nt, Chlamydophila pneumoniae TW-183
gaauaucgaguucuuuuugcag

SEQ ID NO: 2572051 - RNA, 14 nt, Chlamydophila pneumoniae TW-183
gaaucagauuagag

SEQ ID NO: 2572052 - RNA, 21 nt, Chlamydophila pneumoniae TW-183
gaaucgaguucuucauugcag

SEQ ID NO: 2572053 - RNA, 18 nt, Chlamydophila pneumoniae TW-183
gaaucucauaaguauaga

SEQ ID NO: 2572054 - RNA, 21 nt, Chlamydophila pneumoniae TW-183
gaaucucauaaguauagagag

SEQ ID NO: 2572055 - RNA, 15 nt, Chlamydophila pneumoniae TW-183
gaaucuccucaucag

SEQ ID NO: 2572056 - RNA, 17 nt, Chlamydophila pneumoniae TW-183
gaaucuccucaucagaa

SEQ ID NO: 2572057 - RNA, 17 nt, Chlamydophila pneumoniae TW-183
gaaucucgggagaacau

SEQ ID NO: 2572058 - RNA, 17 nt, Chlamydophila pneumoniae TW-183
gaaucuuuuguuuuagc

SEQ ID NO: 2572059 - RNA, 19 nt, Chlamydophila pneumoniae TW-183
gaaugccaaaccucuuagc

SEQ ID NO: 2572060 - RNA, 20 nt, Chlamydophila pneumoniae TW-183
gaauuccucccagcccuaua

SEQ ID NO: 2572061 - RNA, 12 nt, Chlamydophila pneumoniae TW-183
gaauuuuccuga

SEQ ID NO: 2572062 - RNA, 16 nt, Chlamydophila pneumoniae TW-183
gaauuuucuuuugcag

SEQ ID NO: 2572063 - RNA, 15 nt, Chlamydophila pneumoniae TW-183
gacaaauagaaagga

SEQ ID NO: 2572064 - RNA, 20 nt, Chlamydophila pneumoniae TW-183
gacaagguggguagccagga

SEQ ID NO: 2572065 - RNA, 16 nt, Chlamydophila pneumoniae TW-183
gacaauaaaauagccc

SEQ ID NO: 2572066 - RNA, 18 nt, Chlamydophila pneumoniae TW-183
gacaaucaacauucuucu

SEQ ID NO: 2572067 - RNA, 12 nt, Chlamydophila pneumoniae TW-183
gacacaacucuu

SEQ ID NO: 2572068 - RNA, 19 nt, Chlamydophila pneumoniae TW-183
gacacagcuaaucaaucca

SEQ ID NO: 2572069 - RNA, 13 nt, Chlamydophila pneumoniae TW-183
gaccgaaucucuc

SEQ ID NO: 2572070 - RNA, 21 nt, Chlamydophila pneumoniae TW-183
gaccucuguagguuuuuccaa

SEQ ID NO: 2572071 - RNA, 13 nt, Chlamydophila pneumoniae TW-183
gaccuguuuucuu

SEQ ID NO: 2572072 - RNA, 21 nt, Chlamydophila pneumoniae TW-183
gaccuguuuucuuuucugaag

SEQ ID NO: 2572073 - RNA, 20 nt, Chlamydophila pneumoniae TW-183
gaccuucucaagaucuucau

SEQ ID NO: 2572074 - RNA, 23 nt, Chlamydophila pneumoniae TW-183
gacgacguuuugcuguggaauuu

SEQ ID NO: 2572075 - RNA, 20 nt, Chlamydophila pneumoniae TW-183
gacguugcgaacagcuccug

SEQ ID NO: 2572076 - RNA, 15 nt, Chlamydophila pneumoniae TW-183
gacuccaagaauagc

SEQ ID NO: 2572077 - RNA, 23 nt, Chlamydophila pneumoniae TW-183
gacugaaaagaucguuaucaaaa

SEQ ID NO: 2572078 - RNA, 11 nt, Chlamydophila pneumoniae TW-183
gacugaaacuc

SEQ ID NO: 2572079 - RNA, 14 nt, Chlamydophila pneumoniae TW-183
gacuucucucuuaa

SEQ ID NO: 2572080 - RNA, 18 nt, Chlamydophila pneumoniae TW-183
gacuucuggaagcuguug

SEQ ID NO: 2572081 - RNA, 16 nt, Chlamydophila pneumoniae TW-183
gagaaagagugccaag

SEQ ID NO: 2572082 - RNA, 13 nt, Chlamydophila pneumoniae TW-183
gagaaaucacacu

SEQ ID NO: 2572083 - RNA, 14 nt, Chlamydophila pneumoniae TW-183
gagaacauguuucu

SEQ ID NO: 2572084 - RNA, 12 nt, Chlamydophila pneumoniae TW-183
gagaacuucaac

SEQ ID NO: 2572085 - RNA, 22 nt, Chlamydophila pneumoniae TW-183
gagaacuuuaacgaagaaggga

SEQ ID NO: 2572086 - RNA, 15 nt, Chlamydophila pneumoniae TW-183
gagaaguuaagacaa

SEQ ID NO: 2572087 - RNA, 18 nt, Chlamydophila pneumoniae TW-183
gagaauacagagucugug

SEQ ID NO: 2572088 - RNA, 12 nt, Chlamydophila pneumoniae TW-183
gagaaugcugua

SEQ ID NO: 2572089 - RNA, 13 nt, Chlamydophila pneumoniae TW-183
gagagaagaaauu

SEQ ID NO: 2572090 - RNA, 15 nt, Chlamydophila pneumoniae TW-183
gagagguaggcagug

SEQ ID NO: 2572091 - RNA, 22 nt, Chlamydophila pneumoniae TW-183
gagaguucuuguaauaaaagaa

SEQ ID NO: 2572092 - RNA, 15 nt, Chlamydophila pneumoniae TW-183
gagauucauaaaacu

SEQ ID NO: 2572093 - RNA, 16 nt, Chlamydophila pneumoniae TW-183
gagauucuugaggacc

SEQ ID NO: 2572094 - RNA, 18 nt, Chlamydophila pneumoniae TW-183
gagcagaaacuccaaaau

SEQ ID NO: 2572095 - RNA, 17 nt, Chlamydophila pneumoniae TW-183
gagcaugagagucgaaa

SEQ ID NO: 2572096 - RNA, 21 nt, Chlamydophila pneumoniae TW-183
gagccaacagguucacuucau

SEQ ID NO: 2572097 - RNA, 18 nt, Chlamydophila pneumoniae TW-183
gagccuagagaguucuug

SEQ ID NO: 2572098 - RNA, 12 nt, Chlamydophila pneumoniae TW-183
gagcggaauuuc

SEQ ID NO: 2572099 - RNA, 23 nt, Chlamydophila pneumoniae TW-183
gagcuaugaugagaacguccuca

SEQ ID NO: 2572100 - RNA, 20 nt, Chlamydophila pneumoniae TW-183
gagcucguaauccuucuuuc

SEQ ID NO: 2572101 - RNA, 15 nt, Chlamydophila pneumoniae TW-183
gagcuguuucugcaa

SEQ ID NO: 2572102 - RNA, 21 nt, Chlamydophila pneumoniae TW-183
gagcuucuuuagauagcucuu

SEQ ID NO: 2572103 - RNA, 22 nt, Chlamydophila pneumoniae TW-183
gagcuucuuuagauagcucuuu

SEQ ID NO: 2572104 - RNA, 20 nt, Chlamydophila pneumoniae TW-183
gagcuuuuagguagagaauc

SEQ ID NO: 2572105 - RNA, 14 nt, Chlamydophila pneumoniae TW-183
gaggacgaaucaau

SEQ ID NO: 2572106 - RNA, 20 nt, Chlamydophila pneumoniae TW-183
gaggagaauagcaagcacuu

SEQ ID NO: 2572107 - RNA, 13 nt, Chlamydophila pneumoniae TW-183
gaggagauaaaga

SEQ ID NO: 2572108 - RNA, 16 nt, Chlamydophila pneumoniae TW-183
gaggauucuuuuugau

SEQ ID NO: 2572109 - RNA, 21 nt, Chlamydophila pneumoniae TW-183
gaggcuagaaaaucauacgcc

SEQ ID NO: 2572110 - RNA, 11 nt, Chlamydophila pneumoniae TW-183
gagggauuugu

SEQ ID NO: 2572111 - RNA, 16 nt, Chlamydophila pneumoniae TW-183
gaggguuccaagagcu

SEQ ID NO: 2572112 - RNA, 14 nt, Chlamydophila pneumoniae TW-183
gagguaaccagaga

SEQ ID NO: 2572113 - RNA, 20 nt, Chlamydophila pneumoniae TW-183
gagguucgcagaacuucucc

SEQ ID NO: 2572114 - RNA, 22 nt, Chlamydophila pneumoniae TW-183
gagguucgcagaacuucuccaa

SEQ ID NO: 2572115 - RNA, 14 nt, Chlamydophila pneumoniae TW-183
gaguaugaggagau

SEQ ID NO: 2572116 - RNA, 21 nt, Chlamydophila pneumoniae TW-183
gagugccaagagcaucacaaa

SEQ ID NO: 2572117 - RNA, 22 nt, Chlamydophila pneumoniae TW-183
gagugcucuaccccacgcuaaa

SEQ ID NO: 2572118 - RNA, 13 nt, Chlamydophila pneumoniae TW-183
gaguuagcuuuug

SEQ ID NO: 2572119 - RNA, 19 nt, Chlamydophila pneumoniae TW-183
gaguucgcggaucuucuuc

SEQ ID NO: 2572120 - RNA, 15 nt, Chlamydophila pneumoniae TW-183
gaguugccaggaaac

SEQ ID NO: 2572121 - RNA, 23 nt, Chlamydophila pneumoniae TW-183
gaguuucuacgcgcucuucuuuc

SEQ ID NO: 2572122 - RNA, 15 nt, Chlamydophila pneumoniae TW-183
gaguuugauagagaa

SEQ ID NO: 2572123 - RNA, 12 nt, Chlamydophila pneumoniae TW-183
gaguuuuccuaa

SEQ ID NO: 2572124 - RNA, 23 nt, Chlamydophila pneumoniae TW-183
gaguuuuuguguuugacugaaac

SEQ ID NO: 2572125 - RNA, 16 nt, Chlamydophila pneumoniae TW-183
gauaacgagacaugau

SEQ ID NO: 2572126 - RNA, 16 nt, Chlamydophila pneumoniae TW-183
gccagcccaugucuuu

SEQ ID NO: 2572127 - RNA, 22 nt, Chlamydophila pneumoniae TW-183
gccaguuacugucugcaaagag

SEQ ID NO: 2572128 - RNA, 20 nt, Chlamydophila pneumoniae TW-183
gccauuccauggauauggaa

SEQ ID NO: 2572129 - RNA, 14 nt, Chlamydophila pneumoniae TW-183
gcccuauaguauaa

SEQ ID NO: 2572130 - RNA, 21 nt, Chlamydophila pneumoniae TW-183
gcccuauaguauaauagugag

SEQ ID NO: 2572131 - RNA, 19 nt, Chlamydophila pneumoniae TW-183
gcccuugcagcgacaacac

SEQ ID NO: 2572132 - RNA, 14 nt, Chlamydophila pneumoniae TW-183
gccgugaagcagag

SEQ ID NO: 2572133 - RNA, 16 nt, Chlamydophila pneumoniae TW-183
gccucgagcagaaacu

SEQ ID NO: 2572134 - RNA, 16 nt, Chlamydophila pneumoniae TW-183
gccucuacccucugag

SEQ ID NO: 2572135 - RNA, 17 nt, Chlamydophila pneumoniae TW-183
gccuuccauaucuagaa

SEQ ID NO: 2572136 - RNA, 23 nt, Chlamydophila pneumoniae TW-183
gccuuccauaucuagaaguuuaa

SEQ ID NO: 2572137 - RNA, 15 nt, Chlamydophila pneumoniae TW-183
gcgaaugucguuaaa

SEQ ID NO: 2572138 - RNA, 16 nt, Chlamydophila pneumoniae TW-183
gcgauacaauaaacaa

SEQ ID NO: 2572139 - RNA, 21 nt, Chlamydophila pneumoniae TW-183
gcgcuaccuuaguuuuuucua

SEQ ID NO: 2572140 - RNA, 13 nt, Chlamydophila pneumoniae TW-183
gcgcucuucuuuc

SEQ ID NO: 2572141 - RNA, 17 nt, Chlamydophila pneumoniae TW-183
gcgcucuucuuucucua

SEQ ID NO: 2572142 - RNA, 20 nt, Chlamydophila pneumoniae TW-183
gcgcuuguucuuuucaucaa

SEQ ID NO: 2572143 - RNA, 15 nt, Chlamydophila pneumoniae TW-183
gcggacuuuagcgcu

SEQ ID NO: 2572144 - RNA, 14 nt, Chlamydophila pneumoniae TW-183
gcggcuuuuugcaa

SEQ ID NO: 2572145 - RNA, 15 nt, Chlamydophila pneumoniae TW-183
gcuaauaagauccaa

SEQ ID NO: 2572146 - RNA, 17 nt, Chlamydophila pneumoniae TW-183
gcuacaaaauuauuaaa

SEQ ID NO: 2572147 - RNA, 15 nt, Chlamydophila pneumoniae TW-183
gcuagaaaaucauac

SEQ ID NO: 2572148 - RNA, 15 nt, Chlamydophila pneumoniae TW-183
gcuaggaagaugaau

SEQ ID NO: 2572149 - RNA, 17 nt, Chlamydophila pneumoniae TW-183
gcuauaccuauauagag

SEQ ID NO: 2572150 - RNA, 13 nt, Chlamydophila pneumoniae TW-183
gcuaugaugagaa

SEQ ID NO: 2572151 - RNA, 14 nt, Chlamydophila pneumoniae TW-183
gcuaugaugagaac

SEQ ID NO: 2572152 - RNA, 22 nt, Chlamydophila pneumoniae TW-183
gcuauuuuccucuauauuuuuu

SEQ ID NO: 2572153 - RNA, 21 nt, Chlamydophila pneumoniae TW-183
gcucaaaaaguuccauagagu

SEQ ID NO: 2572154 - RNA, 14 nt, Chlamydophila pneumoniae TW-183
gcucauaagaaauu

SEQ ID NO: 2572155 - RNA, 21 nt, Chlamydophila pneumoniae TW-183
gcucgguacgucuuucaccaa

SEQ ID NO: 2572156 - RNA, 16 nt, Chlamydophila pneumoniae TW-183
gcucguaauccuucuu

SEQ ID NO: 2572157 - RNA, 22 nt, Chlamydophila pneumoniae TW-183
gcucuaagcugugcauuuucuu

SEQ ID NO: 2572158 - RNA, 23 nt, Chlamydophila pneumoniae TW-183
gcucuaccccacgcuaaacuaaa

SEQ ID NO: 2572159 - RNA, 15 nt, Chlamydophila pneumoniae TW-183
gcucuagucuuucaa

SEQ ID NO: 2572160 - RNA, 19 nt, Chlamydophila pneumoniae TW-183
gcucucaaggucacagcau

SEQ ID NO: 2572161 - RNA, 22 nt, Chlamydophila pneumoniae TW-183
gcucucaaggucacagcauuuu

SEQ ID NO: 2572162 - RNA, 16 nt, Chlamydophila pneumoniae TW-183
gcucuucaauagguaa

SEQ ID NO: 2572163 - RNA, 19 nt, Chlamydophila pneumoniae TW-183
gcucuucuauguguucucg

SEQ ID NO: 2572164 - RNA, 12 nt, Chlamydophila pneumoniae TW-183
gcucuucuuucu

SEQ ID NO: 2572165 - RNA, 13 nt, Chlamydophila pneumoniae TW-183
gcucuucuuucuc

SEQ ID NO: 2572166 - RNA, 16 nt, Chlamydophila pneumoniae TW-183
gcucuucuuucucuau

SEQ ID NO: 2572167 - RNA, 19 nt, Chlamydophila pneumoniae TW-183
gcucuucuuucucuaucuc

SEQ ID NO: 2572168 - RNA, 20 nt, Chlamydophila pneumoniae TW-183
gcucuuugauuuucuuagcu

SEQ ID NO: 2572169 - RNA, 16 nt, Chlamydophila pneumoniae TW-183
gcucuuuuaacuuaaa

SEQ ID NO: 2572170 - RNA, 13 nt, Chlamydophila pneumoniae TW-183
gcugaagauuuuu

SEQ ID NO: 2572171 - RNA, 13 nt, Chlamydophila pneumoniae TW-183
gcugagagaagca

SEQ ID NO: 2572172 - RNA, 15 nt, Chlamydophila pneumoniae TW-183
gcugaggacgcagag

SEQ ID NO: 2572173 - RNA, 16 nt, Chlamydophila pneumoniae TW-183
gcugauuucuuuuuca

SEQ ID NO: 2572174 - RNA, 22 nt, Chlamydophila pneumoniae TW-183
gcuguaaucgagagaagaaauu

SEQ ID NO: 2572175 - RNA, 20 nt, Chlamydophila pneumoniae TW-183
gcugucuagaacacucagag

SEQ ID NO: 2572176 - RNA, 19 nt, Chlamydophila pneumoniae TW-183
gcuguggaauuuuccugag

SEQ ID NO: 2572177 - RNA, 14 nt, Chlamydophila pneumoniae TW-183
gcuguguaaaaguu

SEQ ID NO: 2572178 - RNA, 19 nt, Chlamydophila pneumoniae TW-183
gcuuccccuaauaggggac

SEQ ID NO: 2572179 - RNA, 19 nt, Chlamydophila pneumoniae TW-183
gcuuccgugcgauuucccc

SEQ ID NO: 2572180 - RNA, 17 nt, Chlamydophila pneumoniae TW-183
gcuucgcaaucuuugau

SEQ ID NO: 2572181 - RNA, 16 nt, Chlamydophila pneumoniae TW-183
gcuucuauuuuagaau

SEQ ID NO: 2572182 - RNA, 18 nt, Chlamydophila pneumoniae TW-183
gcuucuuguuuuugugga

SEQ ID NO: 2572183 - RNA, 12 nt, Chlamydophila pneumoniae TW-183
gcuugaaauaau

SEQ ID NO: 2572184 - RNA, 21 nt, Chlamydophila pneumoniae TW-183
gcuugugcaugcaucuuauca

SEQ ID NO: 2572185 - RNA, 18 nt, Chlamydophila pneumoniae TW-183
gcuuuccuccuuguuucc

SEQ ID NO: 2572186 - RNA, 17 nt, Chlamydophila pneumoniae TW-183
gcuuuugugauaccucc

SEQ ID NO: 2572187 - RNA, 14 nt, Chlamydophila pneumoniae TW-183
gcuuuuguuguuuu

SEQ ID NO: 2572188 - RNA, 10 nt, Chlamydophila pneumoniae TW-183
gcuuuuugcu

SEQ ID NO: 2572189 - RNA, 14 nt, Chlamydophila pneumoniae TW-183
ggaaagcacauaca

SEQ ID NO: 2572190 - RNA, 20 nt, Chlamydophila pneumoniae TW-183
ggaacauaucgauaggauuc

SEQ ID NO: 2572191 - RNA, 21 nt, Chlamydophila pneumoniae TW-183
ggaacuaaaaguuuuuuauuu

SEQ ID NO: 2572192 - RNA, 21 nt, Chlamydophila pneumoniae TW-183
ggaagaauuucauaagagaac

SEQ ID NO: 2572193 - RNA, 13 nt, Chlamydophila pneumoniae TW-183
ggaagacucucau

SEQ ID NO: 2572194 - RNA, 20 nt, Chlamydophila pneumoniae TW-183
ggaagacucucaucagcaaa

SEQ ID NO: 2572195 - RNA, 21 nt, Chlamydophila pneumoniae TW-183
ggaagaugaauaccagaagca

SEQ ID NO: 2572196 - RNA, 22 nt, Chlamydophila pneumoniae TW-183
ggaaucccugcacucuuucaga

SEQ ID NO: 2572197 - RNA, 18 nt, Chlamydophila pneumoniae TW-183
ggacaacagcaacacucg

SEQ ID NO: 2572198 - RNA, 14 nt, Chlamydophila pneumoniae TW-183
ggacaaucaacauu

SEQ ID NO: 2572199 - RNA, 13 nt, Chlamydophila pneumoniae TW-183
ggaccuguuuucu

SEQ ID NO: 2572200 - RNA, 17 nt, Chlamydophila pneumoniae TW-183
ggaccuguuuucuuuuc

SEQ ID NO: 2572201 - RNA, 21 nt, Chlamydophila pneumoniae TW-183
ggaccuguuuucuuuucugaa

SEQ ID NO: 2572202 - RNA, 13 nt, Chlamydophila pneumoniae TW-183
ggacuacugaaac

SEQ ID NO: 2572203 - RNA, 14 nt, Chlamydophila pneumoniae TW-183
ggacuacugaaaca

SEQ ID NO: 2572204 - RNA, 22 nt, Chlamydophila pneumoniae TW-183
ggacuccaagaauagcaggaag

SEQ ID NO: 2572205 - RNA, 15 nt, Chlamydophila pneumoniae TW-183
ggagaauagcaagca

SEQ ID NO: 2572206 - RNA, 19 nt, Chlamydophila pneumoniae TW-183
ggagagguaaccagagagc

SEQ ID NO: 2572207 - RNA, 22 nt, Chlamydophila pneumoniae TW-183
ggagauaaagauguagaauaac

SEQ ID NO: 2572208 - RNA, 17 nt, Chlamydophila pneumoniae TW-183
ggagauccugaaaaaag

SEQ ID NO: 2572209 - RNA, 13 nt, Chlamydophila pneumoniae TW-183
ggagaugccauaa

SEQ ID NO: 2572210 - RNA, 20 nt, Chlamydophila pneumoniae TW-183
ggagugaggaaucauaacca

SEQ ID NO: 2572211 - RNA, 17 nt, Chlamydophila pneumoniae TW-183
ggauaaaaaguuuuugu

SEQ ID NO: 2572212 - RNA, 13 nt, Chlamydophila pneumoniae TW-183
ggauaauuaaacu

SEQ ID NO: 2572213 - RNA, 20 nt, Chlamydophila pneumoniae TW-183
ggauacucugaacaggaaua

SEQ ID NO: 2572214 - RNA, 20 nt, Chlamydophila pneumoniae TW-183
ggauauugucaagaggcugu

SEQ ID NO: 2572215 - RNA, 12 nt, Chlamydophila pneumoniae TW-183
ggauccaggagu

SEQ ID NO: 2572216 - RNA, 15 nt, Chlamydophila pneumoniae TW-183
ggauccaucggcauu

SEQ ID NO: 2572217 - RNA, 20 nt, Chlamydophila pneumoniae TW-183
ggaucgcucucuccaugagc

SEQ ID NO: 2572218 - RNA, 11 nt, Chlamydophila pneumoniae TW-183
ggaugugaugu

SEQ ID NO: 2572219 - RNA, 16 nt, Chlamydophila pneumoniae TW-183
ggauucugucuauaag

SEQ ID NO: 2572220 - RNA, 20 nt, Chlamydophila pneumoniae TW-183
ggcaacaacgccuacaugga

SEQ ID NO: 2572221 - RNA, 22 nt, Chlamydophila pneumoniae TW-183
ggcaacaagagcgcauuuuaca

SEQ ID NO: 2572222 - RNA, 15 nt, Chlamydophila pneumoniae TW-183
ggcaauagcuuugaa

SEQ ID NO: 2572223 - RNA, 22 nt, Chlamydophila pneumoniae TW-183
ggcacccaaacugaugccaaga

SEQ ID NO: 2572224 - RNA, 22 nt, Chlamydophila pneumoniae TW-183
guuccauagaguaucuaaaacu

SEQ ID NO: 2572225 - RNA, 18 nt, Chlamydophila pneumoniae TW-183
guucgcggaucuucuucu

SEQ ID NO: 2572226 - RNA, 15 nt, Chlamydophila pneumoniae TW-183
guucuugauuuucaa

SEQ ID NO: 2572227 - RNA, 14 nt, Chlamydophila pneumoniae TW-183
guucuuguaauaaa

SEQ ID NO: 2572228 - RNA, 15 nt, Chlamydophila pneumoniae TW-183
guucuuucaauaaca

SEQ ID NO: 2572229 - RNA, 17 nt, Chlamydophila pneumoniae TW-183
guucuuucaauaacaga

SEQ ID NO: 2572230 - RNA, 19 nt, Chlamydophila pneumoniae TW-183
guugagaaccuucacaaga

SEQ ID NO: 2572231 - RNA, 13 nt, Chlamydophila pneumoniae TW-183
guugcacuuuccg

SEQ ID NO: 2572232 - RNA, 18 nt, Chlamydophila pneumoniae TW-183
guuguugauaauuacaga

SEQ ID NO: 2572233 - RNA, 21 nt, Chlamydophila pneumoniae TW-183
guuuacagaugcaugauccua

SEQ ID NO: 2572234 - RNA, 22 nt, Chlamydophila pneumoniae TW-183
guuuacagaugcaugauccuau

SEQ ID NO: 2572235 - RNA, 14 nt, Chlamydophila pneumoniae TW-183
guuucuaaaacaga

SEQ ID NO: 2572236 - RNA, 21 nt, Chlamydophila pneumoniae TW-183
guuucuaaaacagaaauugcu

SEQ ID NO: 2572237 - RNA, 22 nt, Chlamydophila pneumoniae TW-183
guuucuacgcgcucuucuuucu

SEQ ID NO: 2572238 - RNA, 21 nt, Chlamydophila pneumoniae TW-183
guuuucggggucggagauugu

SEQ ID NO: 2572239 - RNA, 17 nt, Chlamydophila pneumoniae TW-183
guuuucguaagagaauu

SEQ ID NO: 2572240 - RNA, 21 nt, Chlamydophila pneumoniae TW-183
guuuucuguugcacuuuccgu

SEQ ID NO: 2572241 - RNA, 17 nt, Chlamydophila pneumoniae TW-183
guuuucuuuucugaaga

SEQ ID NO: 2572242 - RNA, 20 nt, Chlamydophila pneumoniae TW-183
guuuucuuuucugaagauuu

SEQ ID NO: 2572243 - RNA, 18 nt, Chlamydophila pneumoniae TW-183
guuuugcuguggaauuuu

SEQ ID NO: 2572244 - RNA, 16 nt, Chlamydophila pneumoniae TW-183
uaaaaacuauccuauu

SEQ ID NO: 2572245 - RNA, 23 nt, Chlamydophila pneumoniae TW-183
uaaaaauaggaggcucuacagca

SEQ ID NO: 2572246 - RNA, 23 nt, Chlamydophila pneumoniae TW-183
uaaaaauggcacuugagcacauu

SEQ ID NO: 2572247 - RNA, 16 nt, Chlamydophila pneumoniae TW-183
uaaaacaaaaucaaaa

SEQ ID NO: 2572248 - RNA, 19 nt, Chlamydophila pneumoniae TW-183
uaaaacacaaauagcaaga

SEQ ID NO: 2572249 - RNA, 20 nt, Chlamydophila pneumoniae TW-183
uaaaacacaaauagcaagag

SEQ ID NO: 2572250 - RNA, 17 nt, Chlamydophila pneumoniae TW-183
uaaaacuacaggaaaac

SEQ ID NO: 2572251 - RNA, 13 nt, Chlamydophila pneumoniae TW-183
uaaaacuuagaaa

SEQ ID NO: 2572252 - RNA, 13 nt, Chlamydophila pneumoniae TW-183
uaaaagacugaaa

SEQ ID NO: 2572253 - RNA, 16 nt, Chlamydophila pneumoniae TW-183
uaaaagagcucaaaaa

SEQ ID NO: 2572254 - RNA, 17 nt, Chlamydophila pneumoniae TW-183
uaaaaguagcauccugu

SEQ ID NO: 2572255 - RNA, 16 nt, Chlamydophila pneumoniae TW-183
uaaaaguuuuuuauuu

SEQ ID NO: 2572256 - RNA, 14 nt, Chlamydophila pneumoniae TW-183
uaaaauaagaaauc

SEQ ID NO: 2572257 - RNA, 15 nt, Chlamydophila pneumoniae TW-183
uaaaauagcccuaga

SEQ ID NO: 2572258 - RNA, 14 nt, Chlamydophila pneumoniae TW-183
uaaaaucuucucug

SEQ ID NO: 2572259 - RNA, 17 nt, Chlamydophila pneumoniae TW-183
uaaaaucuucucugcua

SEQ ID NO: 2572260 - RNA, 23 nt, Chlamydophila pneumoniae TW-183
uaaacagcgguugccuuucucuu

SEQ ID NO: 2572261 - RNA, 23 nt, Chlamydophila pneumoniae TW-183
uaaaccuaccucugggaagacuc

SEQ ID NO: 2572262 - RNA, 15 nt, Chlamydophila pneumoniae TW-183
uaaaccuucaaugau

SEQ ID NO: 2572263 - RNA, 20 nt, Chlamydophila pneumoniae TW-183
uaaacuaaaaugguaaaccu

SEQ ID NO: 2572264 - RNA, 12 nt, Chlamydophila pneumoniae TW-183
uaaacucuccaa

SEQ ID NO: 2572265 - RNA, 18 nt, Chlamydophila pneumoniae TW-183
uaaacucuccaaaagcuc

SEQ ID NO: 2572266 - RNA, 13 nt, Chlamydophila pneumoniae TW-183
uaaagaauucucc

SEQ ID NO: 2572267 - RNA, 15 nt, Chlamydophila pneumoniae TW-183
uaaagagaaucuccu

SEQ ID NO: 2572268 - RNA, 15 nt, Chlamydophila pneumoniae TW-183
uaaagagcauccugu

SEQ ID NO: 2572269 - RNA, 23 nt, Chlamydophila pneumoniae TW-183
uaaagaucgggucuacaacaguu

SEQ ID NO: 2572270 - RNA, 14 nt, Chlamydophila pneumoniae TW-183
uaaagcaaaugccu

SEQ ID NO: 2572271 - RNA, 13 nt, Chlamydophila pneumoniae TW-183
uaaagcuuuuccg

SEQ ID NO: 2572272 - RNA, 19 nt, Chlamydophila pneumoniae TW-183
uaaaggaaucucgggagaa

SEQ ID NO: 2572273 - RNA, 18 nt, Chlamydophila pneumoniae TW-183
uaaaggaccuguuuucuu

SEQ ID NO: 2572274 - RNA, 18 nt, Chlamydophila pneumoniae TW-183
uaaauagaaaacauagag

SEQ ID NO: 2572275 - RNA, 19 nt, Chlamydophila pneumoniae TW-183
uaaaugcuauuuuccucua

SEQ ID NO: 2572276 - RNA, 21 nt, Chlamydophila pneumoniae TW-183
uaaauguugggaugaucucgu

SEQ ID NO: 2572277 - RNA, 20 nt, Chlamydophila pneumoniae TW-183
uaaauuuuuccuucaacaca

SEQ ID NO: 2572278 - RNA, 17 nt, Chlamydophila pneumoniae TW-183
uaacaaguaccaagaaa

SEQ ID NO: 2572279 - RNA, 19 nt, Chlamydophila pneumoniae TW-183
uaacaaguaccaagaaaau

SEQ ID NO: 2572280 - RNA, 20 nt, Chlamydophila pneumoniae TW-183
uaacauaaagucaaacauca

SEQ ID NO: 2572281 - RNA, 13 nt, Chlamydophila pneumoniae TW-183
uaacauagauaag

SEQ ID NO: 2572282 - RNA, 14 nt, Chlamydophila pneumoniae TW-183
uaaccaaaagaauu

SEQ ID NO: 2572283 - RNA, 12 nt, Chlamydophila pneumoniae TW-183
uaaccagagagc

SEQ ID NO: 2572284 - RNA, 21 nt, Chlamydophila pneumoniae TW-183
uaaccguggcuuuguaaaaau

SEQ ID NO: 2572285 - RNA, 17 nt, Chlamydophila pneumoniae TW-183
uaaccuaaggcauggca

SEQ ID NO: 2572286 - RNA, 20 nt, Chlamydophila pneumoniae TW-183
uaaccuuugacaacaccaca

SEQ ID NO: 2572287 - RNA, 21 nt, Chlamydophila pneumoniae TW-183
uaaccuuugacaacaccacag

SEQ ID NO: 2572288 - RNA, 23 nt, Chlamydophila pneumoniae TW-183
uaacguacgcaaguaaagaaauu

SEQ ID NO: 2572289 - RNA, 18 nt, Chlamydophila pneumoniae TW-183
uaacucagagauugccag

SEQ ID NO: 2572290 - RNA, 22 nt, Chlamydophila pneumoniae TW-183
uaacugaggcaaagauuuccaa

SEQ ID NO: 2572291 - RNA, 20 nt, Chlamydophila pneumoniae TW-183
uaacuuaaagacuugcuucc

SEQ ID NO: 2572292 - RNA, 22 nt, Chlamydophila pneumoniae TW-183
uaacuucuaaaagcaaguuguu

SEQ ID NO: 2572293 - RNA, 21 nt, Chlamydophila pneumoniae TW-183
uaacuuggugagcagcuuuau

SEQ ID NO: 2572294 - RNA, 20 nt, Chlamydophila pneumoniae TW-183
uaagaaucgaguucuucauu

SEQ ID NO: 2572295 - RNA, 13 nt, Chlamydophila pneumoniae TW-183
uaagaauggaugu

SEQ ID NO: 2572296 - RNA, 15 nt, Chlamydophila pneumoniae TW-183
uaagagaacuuuaac

SEQ ID NO: 2572297 - RNA, 21 nt, Chlamydophila pneumoniae TW-183
uaagaguuuuacaucaaugau

SEQ ID NO: 2572298 - RNA, 15 nt, Chlamydophila pneumoniae TW-183
uaagauacuucucca

SEQ ID NO: 2572299 - RNA, 20 nt, Chlamydophila pneumoniae TW-183
uaagauacuucuccacagcu

SEQ ID NO: 2572300 - RNA, 14 nt, Chlamydophila pneumoniae TW-183
uaagauccaaaaau

SEQ ID NO: 2572301 - RNA, 20 nt, Chlamydophila pneumoniae TW-183
uaagcaagcaacugauguuu

SEQ ID NO: 2572302 - RNA, 22 nt, Chlamydophila pneumoniae TW-183
uaagcaagcaacugauguuuua

SEQ ID NO: 2572303 - RNA, 20 nt, Chlamydophila pneumoniae TW-183
uaagcuaauaagauccaaaa

SEQ ID NO: 2572304 - RNA, 21 nt, Chlamydophila pneumoniae TW-183
uaagcuaauaagauccaaaaa

SEQ ID NO: 2572305 - RNA, 19 nt, Chlamydophila pneumoniae TW-183
uaagcuccauaaaaauagg

SEQ ID NO: 2572306 - RNA, 15 nt, Chlamydophila pneumoniae TW-183
uaagcugaaagaaca

SEQ ID NO: 2572307 - RNA, 15 nt, Chlamydophila pneumoniae TW-183
uaagcugcaaucuca

SEQ ID NO: 2572308 - RNA, 17 nt, Chlamydophila pneumoniae TW-183
uaagcugcaaucucaaa

SEQ ID NO: 2572309 - RNA, 17 nt, Chlamydophila pneumoniae TW-183
uaagcugugcauuuucu

SEQ ID NO: 2572310 - RNA, 14 nt, Chlamydophila pneumoniae TW-183
uaaggacaaaucuc

SEQ ID NO: 2572311 - RNA, 19 nt, Chlamydophila pneumoniae TW-183
uaaggacaaaucucccaaa

SEQ ID NO: 2572312 - RNA, 16 nt, Chlamydophila pneumoniae TW-183
uaaggauguuguggau

SEQ ID NO: 2572313 - RNA, 13 nt, Chlamydophila pneumoniae TW-183
uaaggcuccagca

SEQ ID NO: 2572314 - RNA, 17 nt, Chlamydophila pneumoniae TW-183
uaaguaaccaauacagc

SEQ ID NO: 2572315 - RNA, 16 nt, Chlamydophila pneumoniae TW-183
uaaguccuucuuccca

SEQ ID NO: 2572316 - RNA, 23 nt, Chlamydophila pneumoniae TW-183
uaaguccuucuucccagccuuga

SEQ ID NO: 2572317 - RNA, 16 nt, Chlamydophila pneumoniae TW-183
uaagugacuuuucuuc

SEQ ID NO: 2572318 - RNA, 18 nt, Chlamydophila pneumoniae TW-183
uaagugacuuuucuucuu

SEQ ID NO: 2572319 - RNA, 17 nt, Chlamydophila pneumoniae TW-183
uaagugauaaggaagaa

SEQ ID NO: 2572320 - RNA, 13 nt, Chlamydophila pneumoniae TW-183
uaaguucuuccaa

SEQ ID NO: 2572321 - RNA, 16 nt, Chlamydophila pneumoniae TW-183
uaguauccuuucauca

SEQ ID NO: 2572322 - RNA, 23 nt, Chlamydophila pneumoniae TW-183
uagucaugauuuuucaaucaaua

SEQ ID NO: 2572323 - RNA, 15 nt, Chlamydophila pneumoniae TW-183
uagucuuucaaccuc

SEQ ID NO: 2572324 - RNA, 15 nt, Chlamydophila pneumoniae TW-183
uagucuuucuaagaa

SEQ ID NO: 2572325 - RNA, 16 nt, Chlamydophila pneumoniae TW-183
uauaaagcaaaugccu

SEQ ID NO: 2572326 - RNA, 23 nt, Chlamydophila pneumoniae TW-183
uauaagggggaucuucagagaga

SEQ ID NO: 2572327 - RNA, 19 nt, Chlamydophila pneumoniae TW-183
uauaagugacuuuucuucu

SEQ ID NO: 2572328 - RNA, 15 nt, Chlamydophila pneumoniae TW-183
uauacgguaaugcca

SEQ ID NO: 2572329 - RNA, 12 nt, Chlamydophila pneumoniae TW-183
uauacuuuuuca

SEQ ID NO: 2572330 - RNA, 17 nt, Chlamydophila pneumoniae TW-183
uauagauaugccucagg

SEQ ID NO: 2572331 - RNA, 16 nt, Chlamydophila pneumoniae TW-183
uauagauuuugugagg

SEQ ID NO: 2572332 - RNA, 17 nt, Chlamydophila pneumoniae TW-183
uauaggcugcacacauc

SEQ ID NO: 2572333 - RNA, 20 nt, Chlamydophila pneumoniae TW-183
uauaguauaauagugagcuc

SEQ ID NO: 2572334 - RNA, 14 nt, Chlamydophila pneumoniae TW-183
uauauaaaacauag

SEQ ID NO: 2572335 - RNA, 14 nt, Chlamydophila pneumoniae TW-183
uauauagagcagac

SEQ ID NO: 2572336 - RNA, 14 nt, Chlamydophila pneumoniae TW-183
uauauuuuuuccca

SEQ ID NO: 2572337 - RNA, 15 nt, Chlamydophila pneumoniae TW-183
uaucaaaagguuuua

SEQ ID NO: 2572338 - RNA, 19 nt, Chlamydophila pneumoniae TW-183
uaucaaaagguuuuauaaa

SEQ ID NO: 2572339 - RNA, 17 nt, Chlamydophila pneumoniae TW-183
uaucaaccauaaagaau

SEQ ID NO: 2572340 - RNA, 22 nt, Chlamydophila pneumoniae TW-183
uaucagggagcggaauuucuca

SEQ ID NO: 2572341 - RNA, 15 nt, Chlamydophila pneumoniae TW-183
uaucauaucuucaaa

SEQ ID NO: 2572342 - RNA, 16 nt, Chlamydophila pneumoniae TW-183
uaucauggacaagcaa

SEQ ID NO: 2572343 - RNA, 19 nt, Chlamydophila pneumoniae TW-183
uaucauggacaagcaaaag

SEQ ID NO: 2572344 - RNA, 22 nt, Chlamydophila pneumoniae TW-183
uauccagaaauacguccagccu

SEQ ID NO: 2572345 - RNA, 17 nt, Chlamydophila pneumoniae TW-183
uaucccagauaaagaca

SEQ ID NO: 2572346 - RNA, 16 nt, Chlamydophila pneumoniae TW-183
uauccuuucaucagca

SEQ ID NO: 2572347 - RNA, 14 nt, Chlamydophila pneumoniae TW-183
uaucgaguucuuuu

SEQ ID NO: 2572348 - RNA, 13 nt, Chlamydophila pneumoniae TW-183
uaucuaaaacuuc

SEQ ID NO: 2572349 - RNA, 19 nt, Chlamydophila pneumoniae TW-183
uaugacacagcuaaucaau

SEQ ID NO: 2572350 - RNA, 15 nt, Chlamydophila pneumoniae TW-183
uaugaugccucauug

SEQ ID NO: 2572351 - RNA, 12 nt, Chlamydophila pneumoniae TW-183
uaugcaucaaug

SEQ ID NO: 2572352 - RNA, 22 nt, Chlamydophila pneumoniae TW-183
uauggaaggcggcuuuuugcaa

SEQ ID NO: 2572353 - RNA, 13 nt, Chlamydophila pneumoniae TW-183
uaugggaggaauu

SEQ ID NO: 2572354 - RNA, 20 nt, Chlamydophila pneumoniae TW-183
uaugggaggaauuccucuca

SEQ ID NO: 2572355 - RNA, 24 nt, Chlamydophila pneumoniae TW-183
uaugugaaagauuauucuagaguu

SEQ ID NO: 2572356 - RNA, 17 nt, Chlamydophila pneumoniae TW-183
uauuaggcuuuuuucua

SEQ ID NO: 2572357 - RNA, 19 nt, Chlamydophila pneumoniae TW-183
uauuaggcuuuuuucuauu

SEQ ID NO: 2572358 - RNA, 15 nt, Chlamydophila pneumoniae TW-183
uauucuagaguugcu

SEQ ID NO: 2572359 - RNA, 13 nt, Chlamydophila pneumoniae TW-183
uauucuuggaaua

SEQ ID NO: 2572360 - RNA, 13 nt, Chlamydophila pneumoniae TW-183
uauugauagcuga

SEQ ID NO: 2572361 - RNA, 13 nt, Chlamydophila pneumoniae TW-183
uauugcagaaucu

SEQ ID NO: 2572362 - RNA, 19 nt, Chlamydophila pneumoniae TW-183
uauugcggaaauugaauau

SEQ ID NO: 2572363 - RNA, 23 nt, Chlamydophila pneumoniae TW-183
uauugggaagaaacuucucuagg

SEQ ID NO: 2572364 - RNA, 20 nt, Chlamydophila pneumoniae TW-183
uauuuuuuaagcuaauaaga

SEQ ID NO: 2572365 - RNA, 22 nt, Chlamydophila pneumoniae TW-183
ucaaaagucaugaggacugugg

SEQ ID NO: 2572366 - RNA, 17 nt, Chlamydophila pneumoniae TW-183
ucaaacaucacucagga

SEQ ID NO: 2572367 - RNA, 23 nt, Chlamydophila pneumoniae TW-183
ucaaaccacggauuuucucuaca

SEQ ID NO: 2572368 - RNA, 20 nt, Chlamydophila pneumoniae TW-183
ucaaagaacugcauaaucuc

SEQ ID NO: 2572369 - RNA, 16 nt, Chlamydophila pneumoniae TW-183
ucaaagaauacucuaa

SEQ ID NO: 2572370 - RNA, 20 nt, Chlamydophila pneumoniae TW-183
ucaaagaccagaauaccuuc

SEQ ID NO: 2572371 - RNA, 18 nt, Chlamydophila pneumoniae TW-183
ucaaauagauuuuuacuu

SEQ ID NO: 2572372 - RNA, 13 nt, Chlamydophila pneumoniae TW-183
ucaaauaguucau

SEQ ID NO: 2572373 - RNA, 17 nt, Chlamydophila pneumoniae TW-183
ucaaauaguucaucaua

SEQ ID NO: 2572374 - RNA, 22 nt, Chlamydophila pneumoniae TW-183
ucaaaucucauuccagcaucuu

SEQ ID NO: 2572375 - RNA, 13 nt, Chlamydophila pneumoniae TW-183
ucaacauucuucu

SEQ ID NO: 2572376 - RNA, 21 nt, Chlamydophila pneumoniae TW-183
ucaacauucuucugucuguau

SEQ ID NO: 2572377 - RNA, 15 nt, Chlamydophila pneumoniae TW-183
ucaacuacaucucca

SEQ ID NO: 2572378 - RNA, 19 nt, Chlamydophila pneumoniae TW-183
ucaacuacaucuccaagcc

SEQ ID NO: 2572379 - RNA, 14 nt, Chlamydophila pneumoniae TW-183
ucaacuuuguuaau

SEQ ID NO: 2572380 - RNA, 22 nt, Chlamydophila pneumoniae TW-183
ucaagaacccgagacuucucuc

SEQ ID NO: 2572381 - RNA, 14 nt, Chlamydophila pneumoniae TW-183
ucaagaagugcuuu

SEQ ID NO: 2572382 - RNA, 23 nt, Chlamydophila pneumoniae TW-183
ucaagaccuaagcucauaagaaa

SEQ ID NO: 2572383 - RNA, 13 nt, Chlamydophila pneumoniae TW-183
ucaagaucuucau

SEQ ID NO: 2572384 - RNA, 20 nt, Chlamydophila pneumoniae TW-183
ucaaggccuauagauuuugu

SEQ ID NO: 2572385 - RNA, 18 nt, Chlamydophila pneumoniae TW-183
ucaauagguaaggaaacg

SEQ ID NO: 2572386 - RNA, 19 nt, Chlamydophila pneumoniae TW-183
ucaauccaagaauagccau

SEQ ID NO: 2572387 - RNA, 23 nt, Chlamydophila pneumoniae TW-183
ucacaaaucuuccccuaaaaauu

SEQ ID NO: 2572388 - RNA, 19 nt, Chlamydophila pneumoniae TW-183
ucacacguaagaaaggaug

SEQ ID NO: 2572389 - RNA, 18 nt, Chlamydophila pneumoniae TW-183
ucacacuacauucaggau

SEQ ID NO: 2572390 - RNA, 20 nt, Chlamydophila pneumoniae TW-183
ucacacuuaaagguaaaacu

SEQ ID NO: 2572391 - RNA, 13 nt, Chlamydophila pneumoniae TW-183
ucaccaacuccuc

SEQ ID NO: 2572392 - RNA, 15 nt, Chlamydophila pneumoniae TW-183
ucaccaacuccucua

SEQ ID NO: 2572393 - RNA, 22 nt, Chlamydophila pneumoniae TW-183
ucaccagaagcaacuaaacucu

SEQ ID NO: 2572394 - RNA, 19 nt, Chlamydophila pneumoniae TW-183
ucaccugagcuauaaucua

SEQ ID NO: 2572395 - RNA, 15 nt, Chlamydophila pneumoniae TW-183
ucaccuuagagugac

SEQ ID NO: 2572396 - RNA, 13 nt, Chlamydophila pneumoniae TW-183
ucaccuugugaga

SEQ ID NO: 2572397 - RNA, 21 nt, Chlamydophila pneumoniae TW-183
ucacggcuggcuucaaaacac

SEQ ID NO: 2572398 - RNA, 13 nt, Chlamydophila pneumoniae TW-183
ucacuaucaugga

SEQ ID NO: 2572399 - RNA, 12 nt, Chlamydophila pneumoniae TW-183
ucacucuuuuau

SEQ ID NO: 2572400 - RNA, 16 nt, Chlamydophila pneumoniae TW-183
ucacuucaucgacagu

SEQ ID NO: 2572401 - RNA, 16 nt, Chlamydophila pneumoniae TW-183
ucacuucugaugacgu

SEQ ID NO: 2572402 - RNA, 16 nt, Chlamydophila pneumoniae TW-183
ucagaagugaucuuga

SEQ ID NO: 2572403 - RNA, 21 nt, Chlamydophila pneumoniae TW-183
ucagaagugaucuugagaaaa

SEQ ID NO: 2572404 - RNA, 16 nt, Chlamydophila pneumoniae TW-183
ucagaaucuuugugau

SEQ ID NO: 2572405 - RNA, 16 nt, Chlamydophila pneumoniae TW-183
ucagagauugccagga

SEQ ID NO: 2572406 - RNA, 20 nt, Chlamydophila pneumoniae TW-183
ucagcaucggugucuacaaa

SEQ ID NO: 2572407 - RNA, 13 nt, Chlamydophila pneumoniae TW-183
ucagccugucuau

SEQ ID NO: 2572408 - RNA, 19 nt, Chlamydophila pneumoniae TW-183
ucagccugucuauaaaaua

SEQ ID NO: 2572409 - RNA, 23 nt, Chlamydophila pneumoniae TW-183
ucaggauacucugaacaggaaua

SEQ ID NO: 2572410 - RNA, 15 nt, Chlamydophila pneumoniae TW-183
ucaggcauucuucau

SEQ ID NO: 2572411 - RNA, 18 nt, Chlamydophila pneumoniae TW-183
ucaggugacuaaacaccu

SEQ ID NO: 2572412 - RNA, 13 nt, Chlamydophila pneumoniae TW-183
ucauaaagaggaa

SEQ ID NO: 2572413 - RNA, 18 nt, Chlamydophila pneumoniae TW-183
ucauaaagaggaaugaag

SEQ ID NO: 2572414 - RNA, 19 nt, Chlamydophila pneumoniae TW-183
ucauaaagaggaaugaaga

SEQ ID NO: 2572415 - RNA, 15 nt, Chlamydophila pneumoniae TW-183
ucauaaccuaaggca

SEQ ID NO: 2572416 - RNA, 23 nt, Chlamydophila pneumoniae TW-183
ucauacgccgugccuauagaaau

SEQ ID NO: 2572417 - RNA, 20 nt, Chlamydophila pneumoniae TW-183
ucauauuuuucuugaagguu

SEQ ID NO: 2572418 - RNA, 16 nt, Chlamydophila pneumoniae TW-183
ucuagcucaaaucuca

SEQ ID NO: 2572419 - RNA, 19 nt, Chlamydophila pneumoniae TW-183
ucuagcuguuaauucccgu

SEQ ID NO: 2572420 - RNA, 13 nt, Chlamydophila pneumoniae TW-183
ucuauaaauuucu

SEQ ID NO: 2572421 - RNA, 20 nt, Chlamydophila pneumoniae TW-183
ucuauaagauagcucuugcg

SEQ ID NO: 2572422 - RNA, 19 nt, Chlamydophila pneumoniae TW-183
ucuauauuuuuucccacaa

SEQ ID NO: 2572423 - RNA, 23 nt, Chlamydophila pneumoniae TW-183
ucuaugagaguaaguuuuuaauc

SEQ ID NO: 2572424 - RNA, 13 nt, Chlamydophila pneumoniae TW-183
ucuauuuucagga

SEQ ID NO: 2572425 - RNA, 14 nt, Chlamydophila pneumoniae TW-183
ucuauuuucaggag

SEQ ID NO: 2572426 - RNA, 14 nt, Chlamydophila pneumoniae TW-183
ucucaagaucuuca

SEQ ID NO: 2572427 - RNA, 17 nt, Chlamydophila pneumoniae TW-183
ucucaagaucuucauca

SEQ ID NO: 2572428 - RNA, 17 nt, Chlamydophila pneumoniae TW-183
ucucaguaggagcagcg

SEQ ID NO: 2572429 - RNA, 17 nt, Chlamydophila pneumoniae TW-183
ucucaguuaaagagcau

SEQ ID NO: 2572430 - RNA, 16 nt, Chlamydophila pneumoniae TW-183
ucucaucagcaaaacu

SEQ ID NO: 2572431 - RNA, 15 nt, Chlamydophila pneumoniae TW-183
ucuccaaaagcucua

SEQ ID NO: 2572432 - RNA, 18 nt, Chlamydophila pneumoniae TW-183
ucuccaaaagcucuacaa

SEQ ID NO: 2572433 - RNA, 17 nt, Chlamydophila pneumoniae TW-183
ucuccacagcuucuucg

SEQ ID NO: 2572434 - RNA, 18 nt, Chlamydophila pneumoniae TW-183
ucucccaauauccagaaa

SEQ ID NO: 2572435 - RNA, 15 nt, Chlamydophila pneumoniae TW-183
ucuccguuuuagauc

SEQ ID NO: 2572436 - RNA, 13 nt, Chlamydophila pneumoniae TW-183
ucuccuggaacag

SEQ ID NO: 2572437 - RNA, 17 nt, Chlamydophila pneumoniae TW-183
ucucgggagaacaugcc

SEQ ID NO: 2572438 - RNA, 21 nt, Chlamydophila pneumoniae TW-183
ucucgggagaacaugccccca

SEQ ID NO: 2572439 - RNA, 15 nt, Chlamydophila pneumoniae TW-183
ucucuaaaugauuuu

SEQ ID NO: 2572440 - RNA, 22 nt, Chlamydophila pneumoniae TW-183
ucucuaaguucuugauuuucaa

SEQ ID NO: 2572441 - RNA, 23 nt, Chlamydophila pneumoniae TW-183
ucucuaaguucuugauuuucaaa

SEQ ID NO: 2572442 - RNA, 17 nt, Chlamydophila pneumoniae TW-183
ucucucugccuaccaaa

SEQ ID NO: 2572443 - RNA, 16 nt, Chlamydophila pneumoniae TW-183
ucucuuaaaaaaaauu

SEQ ID NO: 2572444 - RNA, 17 nt, Chlamydophila pneumoniae TW-183
ucucuucacucuuuuau

SEQ ID NO: 2572445 - RNA, 18 nt, Chlamydophila pneumoniae TW-183
ucucuucauugcaaaaau

SEQ ID NO: 2572446 - RNA, 17 nt, Chlamydophila pneumoniae TW-183
ucucuuuaacuucuaaa

SEQ ID NO: 2572447 - RNA, 15 nt, Chlamydophila pneumoniae TW-183
ucugaagauuuuuua

SEQ ID NO: 2572448 - RNA, 19 nt, Chlamydophila pneumoniae TW-183
ucugaaucucauaaguaua

SEQ ID NO: 2572449 - RNA, 23 nt, Chlamydophila pneumoniae TW-183
ucugaaucucauaaguauagaga

SEQ ID NO: 2572450 - RNA, 19 nt, Chlamydophila pneumoniae TW-183
ucugacgucuccaacaguc

SEQ ID NO: 2572451 - RNA, 18 nt, Chlamydophila pneumoniae TW-183
ucugaugacguuaauaaa

SEQ ID NO: 2572452 - RNA, 16 nt, Chlamydophila pneumoniae TW-183
ucugcaaugcuaagcu

SEQ ID NO: 2572453 - RNA, 19 nt, Chlamydophila pneumoniae TW-183
ucugccauaggauccagga

SEQ ID NO: 2572454 - RNA, 17 nt, Chlamydophila pneumoniae TW-183
ucugccuaccaaaguuu

SEQ ID NO: 2572455 - RNA, 16 nt, Chlamydophila pneumoniae TW-183
ucugcuauagcuugaa

SEQ ID NO: 2572456 - RNA, 13 nt, Chlamydophila pneumoniae TW-183
ucugcugaggaga

SEQ ID NO: 2572457 - RNA, 16 nt, Chlamydophila pneumoniae TW-183
ucugcugaggagagua

SEQ ID NO: 2572458 - RNA, 18 nt, Chlamydophila pneumoniae TW-183
ucuggaagauguuguuuu

SEQ ID NO: 2572459 - RNA, 21 nt, Chlamydophila pneumoniae TW-183
ucuggaguuugauagagaaaa

SEQ ID NO: 2572460 - RNA, 16 nt, Chlamydophila pneumoniae TW-183
ucuggcauagcuacaa

SEQ ID NO: 2572461 - RNA, 14 nt, Chlamydophila pneumoniae TW-183
ucugggaagacucu

SEQ ID NO: 2572462 - RNA, 23 nt, Chlamydophila pneumoniae TW-183
ucugggaagacucucaucagcaa

SEQ ID NO: 2572463 - RNA, 19 nt, Chlamydophila pneumoniae TW-183
ucuguaaagugaaauugaa

SEQ ID NO: 2572464 - RNA, 15 nt, Chlamydophila pneumoniae TW-183
ucuguagguuuuucc

SEQ ID NO: 2572465 - RNA, 16 nt, Chlamydophila pneumoniae TW-183
ucuguagguuuuucca

SEQ ID NO: 2572466 - RNA, 16 nt, Chlamydophila pneumoniae TW-183
ucugucuguauuuccg

SEQ ID NO: 2572467 - RNA, 17 nt, Chlamydophila pneumoniae TW-183
ucugugacaaaauauuu

SEQ ID NO: 2572468 - RNA, 15 nt, Chlamydophila pneumoniae TW-183
ucugugaguacccag

SEQ ID NO: 2572469 - RNA, 12 nt, Chlamydophila pneumoniae TW-183
ucuguguagccg

SEQ ID NO: 2572470 - RNA, 11 nt, Chlamydophila pneumoniae TW-183
ucuuagcuccu

SEQ ID NO: 2572471 - RNA, 13 nt, Chlamydophila pneumoniae TW-183
ucuuagcuccugu

SEQ ID NO: 2572472 - RNA, 16 nt, Chlamydophila pneumoniae TW-183
ucuuagcuuccauauu

SEQ ID NO: 2572473 - RNA, 15 nt, Chlamydophila pneumoniae TW-183
ucuuaucaagagcuc

SEQ ID NO: 2572474 - RNA, 13 nt, Chlamydophila pneumoniae TW-183
ucuucauccgaag

SEQ ID NO: 2572475 - RNA, 22 nt, Chlamydophila pneumoniae TW-183
ucuucauugcaaaaaugaaaga

SEQ ID NO: 2572476 - RNA, 16 nt, Chlamydophila pneumoniae TW-183
ucuucauugcagauau

SEQ ID NO: 2572477 - RNA, 16 nt, Chlamydophila pneumoniae TW-183
ucuuccaucucuuuaa

SEQ ID NO: 2572478 - RNA, 16 nt, Chlamydophila pneumoniae TW-183
ucuucggaucuguaau

SEQ ID NO: 2572479 - RNA, 17 nt, Chlamydophila pneumoniae TW-183
ucuucggaucuguaaua

SEQ ID NO: 2572480 - RNA, 18 nt, Chlamydophila pneumoniae TW-183
ucuucuaaaaucuucucu

SEQ ID NO: 2572481 - RNA, 19 nt, Chlamydophila pneumoniae TW-183
ucuucuaaaaucuucucug

SEQ ID NO: 2572482 - RNA, 22 nt, Chlamydophila pneumoniae TW-183
ucuucucgaacaggagagagaa

SEQ ID NO: 2572483 - RNA, 18 nt, Chlamydophila pneumoniae TW-183
ucuucucugcuauagcuu

SEQ ID NO: 2572484 - RNA, 22 nt, Chlamydophila pneumoniae TW-183
ucuucuucgguguagaucuuuu

SEQ ID NO: 2572485 - RNA, 15 nt, Chlamydophila pneumoniae TW-183
ucuucuugcaaucuu

SEQ ID NO: 2572486 - RNA, 22 nt, Chlamydophila pneumoniae TW-183
ucuucuugcaaucuuugaagcu

SEQ ID NO: 2572487 - RNA, 14 nt, Chlamydophila pneumoniae TW-183
ucuucuuucucuau

SEQ ID NO: 2572488 - RNA, 15 nt, Chlamydophila pneumoniae TW-183
ucuugauucucuucc

SEQ ID NO: 2572489 - RNA, 19 nt, Chlamydophila pneumoniae TW-183
ucuugauuuucaaagacca

SEQ ID NO: 2572490 - RNA, 18 nt, Chlamydophila pneumoniae TW-183
ucuuggucggaguuuuuu

SEQ ID NO: 2572491 - RNA, 16 nt, Chlamydophila pneumoniae TW-183
ucuuuagauagcucuu

SEQ ID NO: 2572492 - RNA, 22 nt, Chlamydophila pneumoniae TW-183
ucuuucaaccuccgcucuaagc

SEQ ID NO: 2572493 - RNA, 20 nt, Chlamydophila pneumoniae TW-183
ucuuucaccaacuccucuaa

SEQ ID NO: 2572494 - RNA, 22 nt, Chlamydophila pneumoniae TW-183
ucuuucaccaacuccucuaagg

SEQ ID NO: 2572495 - RNA, 14 nt, Chlamydophila pneumoniae TW-183
ucuuucagaaagaa

SEQ ID NO: 2572496 - RNA, 18 nt, Chlamydophila pneumoniae TW-183
ucuuucggugucucuaga

SEQ ID NO: 2572497 - RNA, 16 nt, Chlamydophila pneumoniae TW-183
ucuuucuaagaagacu

SEQ ID NO: 2572498 - RNA, 16 nt, Chlamydophila pneumoniae TW-183
ucuuucugcucuucua

SEQ ID NO: 2572499 - RNA, 23 nt, Chlamydophila pneumoniae TW-183
ucuuugaagcucgaccucuagcu

SEQ ID NO: 2572500 - RNA, 18 nt, Chlamydophila pneumoniae TW-183
ucuuugaggauacgaaua

SEQ ID NO: 2572501 - RNA, 16 nt, Chlamydophila pneumoniae TW-183
ucuuuuaacuuaaaga

SEQ ID NO: 2572502 - RNA, 17 nt, Chlamydophila pneumoniae TW-183
ucuuuuauauuaagaau

SEQ ID NO: 2572503 - RNA, 13 nt, Chlamydophila pneumoniae TW-183
ucuuuucaucaag

SEQ ID NO: 2572504 - RNA, 14 nt, Chlamydophila pneumoniae TW-183
ucuuuucugaagau

SEQ ID NO: 2572505 - RNA, 17 nt, Chlamydophila pneumoniae TW-183
ucuuuuguuuuagcucu

SEQ ID NO: 2572506 - RNA, 16 nt, Chlamydophila pneumoniae TW-183
ucuuuuucagcuucua

SEQ ID NO: 2572507 - RNA, 14 nt, Chlamydophila pneumoniae TW-183
ugaaaaaagaagcu

SEQ ID NO: 2572508 - RNA, 14 nt, Chlamydophila pneumoniae TW-183
ugaaaauuuuccca

SEQ ID NO: 2572509 - RNA, 20 nt, Chlamydophila pneumoniae TW-183
ugaaaccguaacugaggcaa

SEQ ID NO: 2572510 - RNA, 19 nt, Chlamydophila pneumoniae TW-183
ugaaagauuauucuagagu

SEQ ID NO: 2572511 - RNA, 21 nt, Chlamydophila pneumoniae TW-183
ugaaagauuauucuagaguug

SEQ ID NO: 2572512 - RNA, 21 nt, Chlamydophila pneumoniae TW-183
ugaacguagcuacaaaauuau

SEQ ID NO: 2572513 - RNA, 23 nt, Chlamydophila pneumoniae TW-183
ugaagaaaccagaacacaugucu

SEQ ID NO: 2572514 - RNA, 15 nt, Chlamydophila pneumoniae TW-183
ugaagagcauuuaaa

SEQ ID NO: 2572515 - RNA, 15 nt, Chlamydophila pneumoniae TW-183
ugaauaagauuuuga

SEQ ID NO: 2572516 - RNA, 13 nt, Chlamydophila pneumoniae TW-183
uggauuucuccag

SEQ ID NO: 2572517 - RNA, 20 nt, Chlamydophila pneumoniae TW-183
uggccgauaggaagauagcc

SEQ ID NO: 2572518 - RNA, 13 nt, Chlamydophila pneumoniae TW-183
uggcguucaggau

SEQ ID NO: 2572519 - RNA, 12 nt, Chlamydophila pneumoniae TW-183
ugggaagacucu

SEQ ID NO: 2572520 - RNA, 19 nt, Chlamydophila pneumoniae TW-183
ugggaagacucucaucagc

SEQ ID NO: 2572521 - RNA, 18 nt, Chlamydophila pneumoniae TW-183
ugggagauccugaaaaaa

SEQ ID NO: 2572522 - RNA, 18 nt, Chlamydophila pneumoniae TW-183
ugggaggaauuccucuca

SEQ ID NO: 2572523 - RNA, 15 nt, Chlamydophila pneumoniae TW-183
ugggaugaucucuga

SEQ ID NO: 2572524 - RNA, 15 nt, Chlamydophila pneumoniae TW-183
ugggcgucuucuucg

SEQ ID NO: 2572525 - RNA, 19 nt, Chlamydophila pneumoniae TW-183
ugggcuaggguuucuacag

SEQ ID NO: 2572526 - RNA, 13 nt, Chlamydophila pneumoniae TW-183
ugguaaaaauaua

SEQ ID NO: 2572527 - RNA, 22 nt, Chlamydophila pneumoniae TW-183
ugguacaauacuggagagguaa

SEQ ID NO: 2572528 - RNA, 15 nt, Chlamydophila pneumoniae TW-183
ugguaucccaaucga

SEQ ID NO: 2572529 - RNA, 17 nt, Chlamydophila pneumoniae TW-183
uggucggaguuuuuuuc

SEQ ID NO: 2572530 - RNA, 22 nt, Chlamydophila pneumoniae TW-183
ugguguucuucagcccacuguu

SEQ ID NO: 2572531 - RNA, 18 nt, Chlamydophila pneumoniae TW-183
ugguuuaccuuguuuucc

SEQ ID NO: 2572532 - RNA, 15 nt, Chlamydophila pneumoniae TW-183
ugguuucuucaucug

SEQ ID NO: 2572533 - RNA, 16 nt, Chlamydophila pneumoniae TW-183
uguaaaacuuagaaaa

SEQ ID NO: 2572534 - RNA, 20 nt, Chlamydophila pneumoniae TW-183
uguaaaacuuagaaaaguga

SEQ ID NO: 2572535 - RNA, 14 nt, Chlamydophila pneumoniae TW-183
uguaaaaguagcau

SEQ ID NO: 2572536 - RNA, 23 nt, Chlamydophila pneumoniae TW-183
uguaaagugaaauugaacucuca

SEQ ID NO: 2572537 - RNA, 21 nt, Chlamydophila pneumoniae TW-183
uguaacauugaccuaaaggaa

SEQ ID NO: 2572538 - RNA, 20 nt, Chlamydophila pneumoniae TW-183
uguaacgggagcguuuuuug

SEQ ID NO: 2572539 - RNA, 16 nt, Chlamydophila pneumoniae TW-183
uguaagcgugcaaguu

SEQ ID NO: 2572540 - RNA, 17 nt, Chlamydophila pneumoniae TW-183
uguaauagcaggaguuu

SEQ ID NO: 2572541 - RNA, 20 nt, Chlamydophila pneumoniae TW-183
uguaaucauaaaaaaagcua

SEQ ID NO: 2572542 - RNA, 22 nt, Chlamydophila pneumoniae TW-183
uguaaucccagauuuuuuuggu

SEQ ID NO: 2572543 - RNA, 14 nt, Chlamydophila pneumoniae TW-183
uguagguuuuucca

SEQ ID NO: 2572544 - RNA, 19 nt, Chlamydophila pneumoniae TW-183
uguagucaugauuuuucaa

SEQ ID NO: 2572545 - RNA, 16 nt, Chlamydophila pneumoniae TW-183
uguauaugcuuggcaa

SEQ ID NO: 2572546 - RNA, 18 nt, Chlamydophila pneumoniae TW-183
uguauccguagugagguu

SEQ ID NO: 2572547 - RNA, 23 nt, Chlamydophila pneumoniae TW-183
uguauccguagugagguuugcaa

SEQ ID NO: 2572548 - RNA, 14 nt, Chlamydophila pneumoniae TW-183
uguaucuuuuuaau

SEQ ID NO: 2572549 - RNA, 23 nt, Chlamydophila pneumoniae TW-183
uguauggucucaggaucuuagau

SEQ ID NO: 2572550 - RNA, 13 nt, Chlamydophila pneumoniae TW-183
uguaugugaaaga

SEQ ID NO: 2572551 - RNA, 21 nt, Chlamydophila pneumoniae TW-183
ugucaagaggcuguccuugca

SEQ ID NO: 2572552 - RNA, 19 nt, Chlamydophila pneumoniae TW-183
ugucacacugcgagagaaa

SEQ ID NO: 2572553 - RNA, 23 nt, Chlamydophila pneumoniae TW-183
uguccaugcacgagauucuugag

SEQ ID NO: 2572554 - RNA, 14 nt, Chlamydophila pneumoniae TW-183
ugucucuuaaaaaa

SEQ ID NO: 2572555 - RNA, 16 nt, Chlamydophila pneumoniae TW-183
ugucugaguuagcuuu

SEQ ID NO: 2572556 - RNA, 23 nt, Chlamydophila pneumoniae TW-183
ugugauaccuccuccaaucugcu

SEQ ID NO: 2572557 - RNA, 20 nt, Chlamydophila pneumoniae TW-183
ugugauccuugcaaaacagc

SEQ ID NO: 2572558 - RNA, 16 nt, Chlamydophila pneumoniae TW-183
ugugauguucugcugc

SEQ ID NO: 2572559 - RNA, 13 nt, Chlamydophila pneumoniae TW-183
ugugcaugcaucu

SEQ ID NO: 2572560 - RNA, 15 nt, Chlamydophila pneumoniae TW-183
ugugcauuuucuucu

SEQ ID NO: 2572561 - RNA, 16 nt, Chlamydophila pneumoniae TW-183
ugugcauuuucuucuu

SEQ ID NO: 2572562 - RNA, 13 nt, Chlamydophila pneumoniae TW-183
uguguaaaaguua

SEQ ID NO: 2572563 - RNA, 21 nt, Chlamydophila pneumoniae TW-183
uguuaacaaguaccaagaaaa

SEQ ID NO: 2572564 - RNA, 22 nt, Chlamydophila pneumoniae TW-183
uguuagcaucgcuuaacaaacu

SEQ ID NO: 2572565 - RNA, 15 nt, Chlamydophila pneumoniae TW-183
uguucuuuucaucaa

SEQ ID NO: 2572566 - RNA, 16 nt, Chlamydophila pneumoniae TW-183
uguugauaauuacaga

SEQ ID NO: 2572567 - RNA, 20 nt, Chlamydophila pneumoniae TW-183
uguugcccuacaauuuccuu

SEQ ID NO: 2572568 - RNA, 22 nt, Chlamydophila pneumoniae TW-183
uguuguaacgggagcguuuuuu

SEQ ID NO: 2572569 - RNA, 15 nt, Chlamydophila pneumoniae TW-183
uguuguggaucagaa

SEQ ID NO: 2572570 - RNA, 13 nt, Chlamydophila pneumoniae TW-183
uguuguuuuugcu

SEQ ID NO: 2572571 - RNA, 14 nt, Chlamydophila pneumoniae TW-183
uguuguuuuuugau

SEQ ID NO: 2572572 - RNA, 14 nt, Chlamydophila pneumoniae TW-183
uguuuaaguccuuc

SEQ ID NO: 2572573 - RNA, 19 nt, Chlamydophila pneumoniae TW-183
uguuuaaguccuucuuccc

SEQ ID NO: 2572574 - RNA, 21 nt, Chlamydophila pneumoniae TW-183
uguuuugcuucuauuuuagaa

SEQ ID NO: 2572575 - RNA, 13 nt, Chlamydophila pneumoniae TW-183
uuaaaaaaaauua

SEQ ID NO: 2572576 - RNA, 13 nt, Chlamydophila pneumoniae TW-183
uuaaacuaagaau

SEQ ID NO: 2572577 - RNA, 15 nt, Chlamydophila pneumoniae TW-183
uuaaacuaagaauac

SEQ ID NO: 2572578 - RNA, 15 nt, Chlamydophila pneumoniae TW-183
uuaaagagaaucucc

SEQ ID NO: 2572579 - RNA, 22 nt, Chlamydophila pneumoniae TW-183
uuaaaucguacuucacuucuga

SEQ ID NO: 2572580 - RNA, 17 nt, Chlamydophila pneumoniae TW-183
uuaaauuuccaaagauc

SEQ ID NO: 2572581 - RNA, 13 nt, Chlamydophila pneumoniae TW-183
uuaacaacaucac

SEQ ID NO: 2572582 - RNA, 13 nt, Chlamydophila pneumoniae TW-183
uuaacaacaugcg

SEQ ID NO: 2572583 - RNA, 17 nt, Chlamydophila pneumoniae TW-183
uuaacaaguaccaagaa

SEQ ID NO: 2572584 - RNA, 19 nt, Chlamydophila pneumoniae TW-183
uuaaccgagcuuuuugcuu

SEQ ID NO: 2572585 - RNA, 16 nt, Chlamydophila pneumoniae TW-183
uuaacuucuaaaagca

SEQ ID NO: 2572586 - RNA, 15 nt, Chlamydophila pneumoniae TW-183
uuaagaagaagcuga

SEQ ID NO: 2572587 - RNA, 19 nt, Chlamydophila pneumoniae TW-183
uuaagauaucgaccuuaaa

SEQ ID NO: 2572588 - RNA, 21 nt, Chlamydophila pneumoniae TW-183
uuacagauaaggaagagaguu

SEQ ID NO: 2572589 - RNA, 18 nt, Chlamydophila pneumoniae TW-183
uuacagccuauugcaggg

SEQ ID NO: 2572590 - RNA, 13 nt, Chlamydophila pneumoniae TW-183
uuaccgaagagcc

SEQ ID NO: 2572591 - RNA, 13 nt, Chlamydophila pneumoniae TW-183
uuaccuaaaacaa

SEQ ID NO: 2572592 - RNA, 21 nt, Chlamydophila pneumoniae TW-183
uuacuuagaguugaccauaua

SEQ ID NO: 2572593 - RNA, 22 nt, Chlamydophila pneumoniae TW-183
uuagaaucaaaagucaugagga

SEQ ID NO: 2572594 - RNA, 15 nt, Chlamydophila pneumoniae TW-183
uuagagguuuuugua

SEQ ID NO: 2572595 - RNA, 17 nt, Chlamydophila pneumoniae TW-183
uuagauggauagaucgu

SEQ ID NO: 2572596 - RNA, 23 nt, Chlamydophila pneumoniae TW-183
uuagauggauagaucguuucuau

SEQ ID NO: 2572597 - RNA, 20 nt, Chlamydophila pneumoniae TW-183
uuagggaugguuuccucuau

SEQ ID NO: 2572598 - RNA, 14 nt, Chlamydophila pneumoniae TW-183
uuaguuuuuucuaa

SEQ ID NO: 2572599 - RNA, 22 nt, Chlamydophila pneumoniae TW-183
uuauagauagggccgugaagca

SEQ ID NO: 2572600 - RNA, 23 nt, Chlamydophila pneumoniae TW-183
uuaucaaaagguuuuauaaagau

SEQ ID NO: 2572601 - RNA, 18 nt, Chlamydophila pneumoniae TW-183
uuaucccagauaaagaca

SEQ ID NO: 2572602 - RNA, 16 nt, Chlamydophila pneumoniae TW-183
uuaucuaagacuucug

SEQ ID NO: 2572603 - RNA, 19 nt, Chlamydophila pneumoniae TW-183
uuaucuccccauucacaaa

SEQ ID NO: 2572604 - RNA, 13 nt, Chlamydophila pneumoniae TW-183
uuauuuucuggug

SEQ ID NO: 2572605 - RNA, 16 nt, Chlamydophila pneumoniae TW-183
uucaaagaccagaaua

SEQ ID NO: 2572606 - RNA, 21 nt, Chlamydophila pneumoniae TW-183
uucaacuuuguuaauagaaga

SEQ ID NO: 2572607 - RNA, 13 nt, Chlamydophila pneumoniae TW-183
uucaagucuguaa

SEQ ID NO: 2572608 - RNA, 14 nt, Chlamydophila pneumoniae TW-183
uucaagucuguaag

SEQ ID NO: 2572609 - RNA, 15 nt, Chlamydophila pneumoniae TW-183
uucacaagaaaacaa

SEQ ID NO: 2572610 - RNA, 16 nt, Chlamydophila pneumoniae TW-183
uucacaaucuaaauaa

SEQ ID NO: 2572611 - RNA, 19 nt, Chlamydophila pneumoniae TW-183
uucacaucgugaucuaugu

SEQ ID NO: 2572612 - RNA, 13 nt, Chlamydophila pneumoniae TW-183
uucaccagaagca

SEQ ID NO: 2572613 - RNA, 22 nt, Chlamydophila pneumoniae TW-183
uucacuuacagauaaggaagag

SEQ ID NO: 2572614 - RNA, 23 nt, Chlamydophila pneumoniae TW-183
uuguaaaaauggcacuugagcac

SEQ ID NO: 2572615 - RNA, 22 nt, Chlamydophila pneumoniae TW-183
uuguaagcgugcaaguucacac

SEQ ID NO: 2572616 - RNA, 20 nt, Chlamydophila pneumoniae TW-183
uuguaauuucuaaauagaaa

SEQ ID NO: 2572617 - RNA, 11 nt, Chlamydophila pneumoniae TW-183
uuguaucuuuu

SEQ ID NO: 2572618 - RNA, 19 nt, Chlamydophila pneumoniae TW-183
uugucucaauugaaucaga

SEQ ID NO: 2572619 - RNA, 20 nt, Chlamydophila pneumoniae TW-183
uugucucgaaacucuuugag

SEQ ID NO: 2572620 - RNA, 21 nt, Chlamydophila pneumoniae TW-183
uugugaaaaucgcaccuugac

SEQ ID NO: 2572621 - RNA, 19 nt, Chlamydophila pneumoniae TW-183
uugugcuagguaguguggu

SEQ ID NO: 2572622 - RNA, 21 nt, Chlamydophila pneumoniae TW-183
uuguguauggucucaggaucu

SEQ ID NO: 2572623 - RNA, 12 nt, Chlamydophila pneumoniae TW-183
uuguuagcaucg

SEQ ID NO: 2572624 - RNA, 13 nt, Chlamydophila pneumoniae TW-183
uuguuaucaggaa

SEQ ID NO: 2572625 - RNA, 17 nt, Chlamydophila pneumoniae TW-183
uuguucuuuucaucaag

SEQ ID NO: 2572626 - RNA, 18 nt, Chlamydophila pneumoniae TW-183
uuuaaaugagcaauguuu

SEQ ID NO: 2572627 - RNA, 15 nt, Chlamydophila pneumoniae TW-183
uuuaacuuaaagacu

SEQ ID NO: 2572628 - RNA, 16 nt, Chlamydophila pneumoniae TW-183
uuuaaguccuucuucc

SEQ ID NO: 2572629 - RNA, 20 nt, Chlamydophila pneumoniae TW-183
uuuaauuuucugugacaaaa

SEQ ID NO: 2572630 - RNA, 21 nt, Chlamydophila pneumoniae TW-183
uuuaauuuucugugacaaaau

SEQ ID NO: 2572631 - RNA, 12 nt, Chlamydophila pneumoniae TW-183
uuuaccauagaa

SEQ ID NO: 2572632 - RNA, 16 nt, Chlamydophila pneumoniae TW-183
uuuaccuuguuuuccu

SEQ ID NO: 2572633 - RNA, 21 nt, Chlamydophila pneumoniae TW-183
uuuagaagguguuuuggcugc

SEQ ID NO: 2572634 - RNA, 21 nt, Chlamydophila pneumoniae TW-183
uuuauaaagaucgggucuaca

SEQ ID NO: 2572635 - RNA, 14 nt, Chlamydophila pneumoniae TW-183
uuuauauuaagaau

SEQ ID NO: 2572636 - RNA, 16 nt, Chlamydophila pneumoniae TW-183
uuuaucccagauaaag

SEQ ID NO: 2572637 - RNA, 22 nt, Chlamydophila pneumoniae TW-183
uuuaucuccccauucacaaauc

SEQ ID NO: 2572638 - RNA, 22 nt, Chlamydophila pneumoniae TW-183
uuuaugacacagcuaaucaauc

SEQ ID NO: 2572639 - RNA, 22 nt, Chlamydophila pneumoniae TW-183
uuuauuuuaggaagcuuaucaa

SEQ ID NO: 2572640 - RNA, 17 nt, Chlamydophila pneumoniae TW-183
uuucagugcuguuuuuu

SEQ ID NO: 2572641 - RNA, 19 nt, Chlamydophila pneumoniae TW-183
uuucagugcuguuuuuuca

SEQ ID NO: 2572642 - RNA, 13 nt, Chlamydophila pneumoniae TW-183
uuucauaagagaa

SEQ ID NO: 2572643 - RNA, 17 nt, Chlamydophila pneumoniae TW-183
uuuccaaagaucgaucu

SEQ ID NO: 2572644 - RNA, 16 nt, Chlamydophila pneumoniae TW-183
uuuccaacuucaacuu

SEQ ID NO: 2572645 - RNA, 19 nt, Chlamydophila pneumoniae TW-183
uuuccagggcauucucuaa

SEQ ID NO: 2572646 - RNA, 11 nt, Chlamydophila pneumoniae TW-183
uuuccauccac

SEQ ID NO: 2572647 - RNA, 19 nt, Chlamydophila pneumoniae TW-183
uuuccuugguaucccaauc

SEQ ID NO: 2572648 - RNA, 16 nt, Chlamydophila pneumoniae TW-183
uuucucauagguaaua

SEQ ID NO: 2572649 - RNA, 21 nt, Chlamydophila pneumoniae TW-183
uuucucggauccuccaagauc

SEQ ID NO: 2572650 - RNA, 16 nt, Chlamydophila pneumoniae TW-183
uuucugugacaaaaua

SEQ ID NO: 2572651 - RNA, 13 nt, Chlamydophila pneumoniae TW-183
uuucuguuccuga

SEQ ID NO: 2572652 - RNA, 20 nt, Chlamydophila pneumoniae TW-183
uuucuuauagcuuuggaacg

SEQ ID NO: 2572653 - RNA, 19 nt, Chlamydophila pneumoniae TW-183
uuucuuuucugaagauuuu

SEQ ID NO: 2572654 - RNA, 14 nt, Chlamydophila pneumoniae TW-183
uuucuuuuucagcu

SEQ ID NO: 2572655 - RNA, 14 nt, Chlamydophila pneumoniae TW-183
uuugaucgcuugug

SEQ ID NO: 2572656 - RNA, 13 nt, Chlamydophila pneumoniae TW-183
uuugcaugaggag

SEQ ID NO: 2572657 - RNA, 14 nt, Chlamydophila pneumoniae TW-183
uuugcugaagauuu

SEQ ID NO: 2572658 - RNA, 18 nt, Chlamydophila pneumoniae TW-183
uuugcugaagauuuuuuc

SEQ ID NO: 2572659 - RNA, 19 nt, Chlamydophila pneumoniae TW-183
uuugggagauccugaaaaa

SEQ ID NO: 2572660 - RNA, 17 nt, Chlamydophila pneumoniae TW-183
uuugggauaaaaaguuu

SEQ ID NO: 2572661 - RNA, 23 nt, Chlamydophila pneumoniae TW-183
uuugggauaaaaaguuuuuguuc

SEQ ID NO: 2572662 - RNA, 14 nt, Chlamydophila pneumoniae TW-183
uuuguagcauuucu

SEQ ID NO: 2572663 - RNA, 18 nt, Chlamydophila pneumoniae TW-183
uuuguuaauagaagauca

SEQ ID NO: 2572664 - RNA, 22 nt, Chlamydophila pneumoniae TW-183
uuuuaaguugguccaucgagaa

SEQ ID NO: 2572665 - RNA, 22 nt, Chlamydophila pneumoniae TW-183
uuuuagcauaaucuuuaacaaa

SEQ ID NO: 2572666 - RNA, 18 nt, Chlamydophila pneumoniae TW-183
uuuucaagucuguaagga

SEQ ID NO: 2572667 - RNA, 17 nt, Chlamydophila pneumoniae TW-183
uuuucacuuacagauaa

SEQ ID NO: 2572668 - RNA, 22 nt, Chlamydophila pneumoniae TW-183
uuuucagccugucuauaaaaua

SEQ ID NO: 2572669 - RNA, 13 nt, Chlamydophila pneumoniae TW-183
uuuucagugcugu

SEQ ID NO: 2572670 - RNA, 13 nt, Chlamydophila pneumoniae TW-183
uuuuccucuauau

SEQ ID NO: 2572671 - RNA, 21 nt, Chlamydophila pneumoniae TW-183
uuuuccugugugguuggaucc

SEQ ID NO: 2572672 - RNA, 13 nt, Chlamydophila pneumoniae TW-183
uuuucucugagca

SEQ ID NO: 2572673 - RNA, 12 nt, Chlamydophila pneumoniae TW-183
uuuucugaagau

SEQ ID NO: 2572674 - RNA, 21 nt, Chlamydophila pneumoniae TW-183
uuuucuuauagggaauuuuuu

SEQ ID NO: 2572675 - RNA, 20 nt, Chlamydophila pneumoniae TW-183
uuuucuucuucggaucugua

SEQ ID NO: 2572676 - RNA, 22 nt, Chlamydophila pneumoniae TW-183
uuuucuuuugcagcaacuuccc

SEQ ID NO: 2572677 - RNA, 13 nt, Chlamydophila pneumoniae TW-183
uuuugaaaauuuu

SEQ ID NO: 2572678 - RNA, 15 nt, Chlamydophila pneumoniae TW-183
uuuugauuuugcagu

SEQ ID NO: 2572679 - RNA, 20 nt, Chlamydophila pneumoniae TW-183
uuuugcagugauaaaccaag

SEQ ID NO: 2572680 - RNA, 13 nt, Chlamydophila pneumoniae TW-183
uuuugcugaagau

SEQ ID NO: 2572681 - RNA, 16 nt, Chlamydophila pneumoniae TW-183
uuuugcugaagauuuu

SEQ ID NO: 2572682 - RNA, 15 nt, Chlamydophila pneumoniae TW-183
uuuugcuuuucccuu

SEQ ID NO: 2572683 - RNA, 13 nt, Chlamydophila pneumoniae TW-183
uuuuguacacaga

SEQ ID NO: 2572684 - RNA, 13 nt, Chlamydophila pneumoniae TW-183
uuuuuaauuuucu

SEQ ID NO: 2572685 - RNA, 19 nt, Chlamydophila pneumoniae TW-183
uuuuuagcaauugagcuuc

SEQ ID NO: 2572686 - RNA, 23 nt, Chlamydophila pneumoniae TW-183
uuuuucaaucaauaaaaugucca

SEQ ID NO: 2572687 - RNA, 15 nt, Chlamydophila pneumoniae TW-183
uuuuuccaacuucaa

SEQ ID NO: 2572688 - RNA, 10 nt, Chlamydophila pneumoniae TW-183
uuuuucucuu

SEQ ID NO: 2572689 - RNA, 20 nt, Chlamydophila pneumoniae TW-183
uuuuugaauaugauuuccac

SEQ ID NO: 2572690 - RNA, 17 nt, Chlamydophila pneumoniae TW-183
uuuuugcugaagauuuu

SEQ ID NO: 2572691 - RNA, 22 nt, Chlamydophila pneumoniae TW-183
gaacuguaacuugcauuuuuug

SEQ ID NO: 2572692 - RNA, 18 nt, Chlamydophila pneumoniae TW-183
gaagaaaagagcucauca

SEQ ID NO: 2572693 - RNA, 13 nt, Chlamydophila pneumoniae TW-183
gaagaagggacuu

SEQ ID NO: 2572694 - RNA, 14 nt, Chlamydophila pneumoniae TW-183
gaagacacagggga

SEQ ID NO: 2572695 - RNA, 14 nt, Chlamydophila pneumoniae TW-183
gaagacucucauca

SEQ ID NO: 2572696 - RNA, 20 nt, Chlamydophila pneumoniae TW-183
gaagacucucaucagcaaaa

SEQ ID NO: 2572697 - RNA, 22 nt, Chlamydophila pneumoniae TW-183
gaagacucucaucagcaaaacu

SEQ ID NO: 2572698 - RNA, 15 nt, Chlamydophila pneumoniae TW-183
gaagagaguuuuugg

SEQ ID NO: 2572699 - RNA, 18 nt, Chlamydophila pneumoniae TW-183
gaagcaacuaaacucucc

SEQ ID NO: 2572700 - RNA, 15 nt, Chlamydophila pneumoniae TW-183
gaagcuugcugauuu

SEQ ID NO: 2572701 - RNA, 21 nt, Chlamydophila pneumoniae TW-183
gaagguguuuuggcugcuuuu

SEQ ID NO: 2572702 - RNA, 19 nt, Chlamydophila pneumoniae TW-183
gaaguauucgauuccugag

SEQ ID NO: 2572703 - RNA, 18 nt, Chlamydophila pneumoniae TW-183
gaagucccacaaaugaua

SEQ ID NO: 2572704 - RNA, 18 nt, Chlamydophila pneumoniae TW-183
gaagugaggagaauagca

SEQ ID NO: 2572705 - RNA, 21 nt, Chlamydophila pneumoniae TW-183
gaaguuccuacuucugcagga

SEQ ID NO: 2572706 - RNA, 21 nt, Chlamydophila pneumoniae TW-183
gaaguugaaaugagugagaau

SEQ ID NO: 2572707 - RNA, 14 nt, Chlamydophila pneumoniae TW-183
gaauaagauuuuga

SEQ ID NO: 2572708 - RNA, 20 nt, Chlamydophila pneumoniae TW-183
gaauaagauuuugaaaauug

SEQ ID NO: 2572709 - RNA, 20 nt, Chlamydophila pneumoniae TW-183
gaauaaguuuugauuuugca

SEQ ID NO: 2572710 - RNA, 17 nt, Chlamydophila pneumoniae TW-183
gaauaccguuuuaggaa

SEQ ID NO: 2572711 - RNA, 18 nt, Chlamydophila pneumoniae TW-183
gaauagaauguaugugaa

SEQ ID NO: 2572712 - RNA, 12 nt, Chlamydophila pneumoniae TW-183
gaauagcaggaa

SEQ ID NO: 2572713 - RNA, 18 nt, Chlamydophila pneumoniae TW-183
gaauaucaucacuaagau

SEQ ID NO: 2572714 - RNA, 15 nt, Chlamydophila pneumoniae TW-183
gaaucagauuagagu

SEQ ID NO: 2572715 - RNA, 21 nt, Chlamydophila pneumoniae TW-183
gaauccccccuucuaauacuu

SEQ ID NO: 2572716 - RNA, 20 nt, Chlamydophila pneumoniae TW-183
gaaucgaguucuucauugca

SEQ ID NO: 2572717 - RNA, 15 nt, Chlamydophila pneumoniae TW-183
gaaugaagagaguuc

SEQ ID NO: 2572718 - RNA, 14 nt, Chlamydophila pneumoniae TW-183
gaauggauguugcg

SEQ ID NO: 2572719 - RNA, 19 nt, Chlamydophila pneumoniae TW-183
gaauguaugugaaagauua

SEQ ID NO: 2572720 - RNA, 10 nt, Chlamydophila pneumoniae TW-183
gaauuccucu

SEQ ID NO: 2572721 - RNA, 21 nt, Chlamydophila pneumoniae TW-183
gaauuucuccaguaucuucuc

SEQ ID NO: 2572722 - RNA, 19 nt, Chlamydophila pneumoniae TW-183
gaauuuucagccugucuau

SEQ ID NO: 2572723 - RNA, 14 nt, Chlamydophila pneumoniae TW-183
gacaauauagagau

SEQ ID NO: 2572724 - RNA, 21 nt, Chlamydophila pneumoniae TW-183
gacacaaaaagcuuuuuucuc

SEQ ID NO: 2572725 - RNA, 23 nt, Chlamydophila pneumoniae TW-183
gacacaaaaagcuuuuuucucuu

SEQ ID NO: 2572726 - RNA, 18 nt, Chlamydophila pneumoniae TW-183
gaccaugaucuuagcucc

SEQ ID NO: 2572727 - RNA, 19 nt, Chlamydophila pneumoniae TW-183
gaccucuagcucaaaucuc

SEQ ID NO: 2572728 - RNA, 19 nt, Chlamydophila pneumoniae TW-183
gaccugcaaacuccccagu

SEQ ID NO: 2572729 - RNA, 14 nt, Chlamydophila pneumoniae TW-183
auucuaaguucuua

SEQ ID NO: 2572730 - RNA, 17 nt, Chlamydophila pneumoniae TW-183
auucuagaccugccaag

SEQ ID NO: 2572731 - RNA, 20 nt, Chlamydophila pneumoniae TW-183
auucuagaguugcuuuaugg

SEQ ID NO: 2572732 - RNA, 17 nt, Chlamydophila pneumoniae TW-183
auucucgagcagcugca

SEQ ID NO: 2572733 - RNA, 18 nt, Chlamydophila pneumoniae TW-183
auucugagaaagaagucc

SEQ ID NO: 2572734 - RNA, 21 nt, Chlamydophila pneumoniae TW-183
auucugagaaagaaguccuag

SEQ ID NO: 2572735 - RNA, 11 nt, Chlamydophila pneumoniae TW-183
auucugucuau

SEQ ID NO: 2572736 - RNA, 22 nt, Chlamydophila pneumoniae TW-183
auucuucacaaucuaaauaaga

SEQ ID NO: 2572737 - RNA, 18 nt, Chlamydophila pneumoniae TW-183
auucuucagaaucuuugu

SEQ ID NO: 2572738 - RNA, 22 nt, Chlamydophila pneumoniae TW-183
auucuucagaaucuuugugaua

SEQ ID NO: 2572739 - RNA, 17 nt, Chlamydophila pneumoniae TW-183
auucuucugucuguauu

SEQ ID NO: 2572740 - RNA, 19 nt, Chlamydophila pneumoniae TW-183
auugaaaccguaacugagg

SEQ ID NO: 2572741 - RNA, 23 nt, Chlamydophila pneumoniae TW-183
auugaacagucuugcgccagcaa

SEQ ID NO: 2572742 - RNA, 20 nt, Chlamydophila pneumoniae TW-183
auugaacguagcuacaaaau

SEQ ID NO: 2572743 - RNA, 20 nt, Chlamydophila pneumoniae TW-183
auugaauaucgaguucuuuu

SEQ ID NO: 2572744 - RNA, 23 nt, Chlamydophila pneumoniae TW-183
auugaggacaacagcaacacucg

SEQ ID NO: 2572745 - RNA, 16 nt, Chlamydophila pneumoniae TW-183
auugaugcuuaagagu

SEQ ID NO: 2572746 - RNA, 17 nt, Chlamydophila pneumoniae TW-183
auugaugcuuaagaguu

SEQ ID NO: 2572747 - RNA, 17 nt, Chlamydophila pneumoniae TW-183
auugcaaaaaugaaaga

SEQ ID NO: 2572748 - RNA, 21 nt, Chlamydophila pneumoniae TW-183
auugcaaauuucauuuagaca

SEQ ID NO: 2572749 - RNA, 15 nt, Chlamydophila pneumoniae TW-183
auugcuucuuccaag

SEQ ID NO: 2572750 - RNA, 20 nt, Chlamydophila pneumoniae TW-183
auuggaucuagagaagaaaa

SEQ ID NO: 2572751 - RNA, 14 nt, Chlamydophila pneumoniae TW-183
auuggcauagagcc

SEQ ID NO: 2572752 - RNA, 20 nt, Chlamydophila pneumoniae TW-183
auuggcauagagccuagaga

SEQ ID NO: 2572753 - RNA, 16 nt, Chlamydophila pneumoniae TW-183
auugggagguucgcag

SEQ ID NO: 2572754 - RNA, 22 nt, Chlamydophila pneumoniae TW-183
auugggagguucgcagaacuuc

SEQ ID NO: 2572755 - RNA, 13 nt, Chlamydophila pneumoniae TW-183
auuguagagauua

SEQ ID NO: 2572756 - RNA, 21 nt, Chlamydophila pneumoniae TW-183
auuguuuaaguccuucuuccc

SEQ ID NO: 2572757 - RNA, 16 nt, Chlamydophila pneumoniae TW-183
auuucauguaagaaug

SEQ ID NO: 2572758 - RNA, 19 nt, Chlamydophila pneumoniae TW-183
auuuccggguucauuucca

SEQ ID NO: 2572759 - RNA, 15 nt, Chlamydophila pneumoniae TW-183
auuucuccagcagcu

SEQ ID NO: 2572760 - RNA, 11 nt, Chlamydophila pneumoniae TW-183
auuucuucuuc

SEQ ID NO: 2572761 - RNA, 19 nt, Chlamydophila pneumoniae TW-183
auuucuucuucuauacgaa

SEQ ID NO: 2572762 - RNA, 14 nt, Chlamydophila pneumoniae TW-183
auuucuuucucuuc

SEQ ID NO: 2572763 - RNA, 13 nt, Chlamydophila pneumoniae TW-183
auuugaacaugag

SEQ ID NO: 2572764 - RNA, 16 nt, Chlamydophila pneumoniae TW-183
auuugaacaugaggau

SEQ ID NO: 2572765 - RNA, 21 nt, Chlamydophila pneumoniae TW-183
auuuuacuugcgauacaauaa

SEQ ID NO: 2572766 - RNA, 21 nt, Chlamydophila pneumoniae TW-183
auuuuagggaugguuuccucu

SEQ ID NO: 2572767 - RNA, 17 nt, Chlamydophila pneumoniae TW-183
auuuucagccugucuau

SEQ ID NO: 2572768 - RNA, 17 nt, Chlamydophila pneumoniae TW-183
auuuucccauuacagcc

SEQ ID NO: 2572769 - RNA, 17 nt, Chlamydophila pneumoniae TW-183
auuuucucugagcagcu

SEQ ID NO: 2572770 - RNA, 14 nt, Chlamydophila pneumoniae TW-183
auuuuuaauuuucu

SEQ ID NO: 2572771 - RNA, 10 nt, Chlamydophila pneumoniae TW-183
caaaaauucc

SEQ ID NO: 2572772 - RNA, 20 nt, Chlamydophila pneumoniae TW-183
caaaacagcaucaggauucu

SEQ ID NO: 2572773 - RNA, 19 nt, Chlamydophila pneumoniae TW-183
caaaacauaaccuccucuu

SEQ ID NO: 2572774 - RNA, 22 nt, Chlamydophila pneumoniae TW-183
caaaaccuggauugauccacag

SEQ ID NO: 2572775 - RNA, 18 nt, Chlamydophila pneumoniae TW-183
caaaagcucuacaagcuc

SEQ ID NO: 2572776 - RNA, 15 nt, Chlamydophila pneumoniae TW-183
caaaagguuuuauaa

SEQ ID NO: 2572777 - RNA, 21 nt, Chlamydophila pneumoniae TW-183
caaaagguuuuauaaagaucg

SEQ ID NO: 2572778 - RNA, 17 nt, Chlamydophila pneumoniae TW-183
caaaauaaaaaaacccu

SEQ ID NO: 2572779 - RNA, 24 nt, Chlamydophila pneumoniae TW-183
caaaauaaaaaaacccucaaagaa

SEQ ID NO: 2572780 - RNA, 17 nt, Chlamydophila pneumoniae TW-183
caaaauauuuguuacua

SEQ ID NO: 2572781 - RNA, 19 nt, Chlamydophila pneumoniae TW-183
caaaauucaugcaaaacaa

SEQ ID NO: 2572782 - RNA, 17 nt, Chlamydophila pneumoniae TW-183
caaacaucacucaggau

SEQ ID NO: 2572783 - RNA, 16 nt, Chlamydophila pneumoniae TW-183
caaacuaaaucaacua

SEQ ID NO: 2572784 - RNA, 22 nt, Chlamydophila pneumoniae TW-183
caaacuccccaguuuuccaucc

SEQ ID NO: 2572785 - RNA, 17 nt, Chlamydophila pneumoniae TW-183
caaacugaugccaagaa

SEQ ID NO: 2572786 - RNA, 20 nt, Chlamydophila pneumoniae TW-183
caaacugaugccaagaaaua

SEQ ID NO: 2572787 - RNA, 18 nt, Chlamydophila pneumoniae TW-183
caaacuuguuuucguaag

SEQ ID NO: 2572788 - RNA, 23 nt, Chlamydophila pneumoniae TW-183
caaacuuguuuucguaagagaau

SEQ ID NO: 2572789 - RNA, 19 nt, Chlamydophila pneumoniae TW-183
caaagaacugcauaaucuc

SEQ ID NO: 2572790 - RNA, 15 nt, Chlamydophila pneumoniae TW-183
caaagagcaaaggag

SEQ ID NO: 2572791 - RNA, 12 nt, Chlamydophila pneumoniae TW-183
caaaggcaacaa

SEQ ID NO: 2572792 - RNA, 19 nt, Chlamydophila pneumoniae TW-183
caaaguuuaugacacagcu

SEQ ID NO: 2572793 - RNA, 14 nt, Chlamydophila pneumoniae TW-183
caaauagauuuuua

SEQ ID NO: 2572794 - RNA, 19 nt, Chlamydophila pneumoniae TW-183
caaauagauuuuuacuugc

SEQ ID NO: 2572795 - RNA, 19 nt, Chlamydophila pneumoniae TW-183
caaaucuuccccuaaaaau

SEQ ID NO: 2572796 - RNA, 21 nt, Chlamydophila pneumoniae TW-183
caaaugccuguacuaucuuuu

SEQ ID NO: 2572797 - RNA, 19 nt, Chlamydophila pneumoniae TW-183
caaauuucauuuagacaau

SEQ ID NO: 2572798 - RNA, 13 nt, Chlamydophila pneumoniae TW-183
caacacgcacaaa

SEQ ID NO: 2572799 - RNA, 21 nt, Chlamydophila pneumoniae TW-183
caacacgcacaaacuaacaua

SEQ ID NO: 2572800 - RNA, 15 nt, Chlamydophila pneumoniae TW-183
caacagcaacacucg

SEQ ID NO: 2572801 - RNA, 22 nt, Chlamydophila pneumoniae TW-183
caacaguucgacaaccaaaaca

SEQ ID NO: 2572802 - RNA, 22 nt, Chlamydophila pneumoniae TW-183
caacauaaucauuauccauauc

SEQ ID NO: 2572803 - RNA, 18 nt, Chlamydophila pneumoniae TW-183
caacaugcgcguauaagg

SEQ ID NO: 2572804 - RNA, 16 nt, Chlamydophila pneumoniae TW-183
caaccaguugagucaa

SEQ ID NO: 2572805 - RNA, 16 nt, Chlamydophila pneumoniae TW-183
caacccgaauuccucu

SEQ ID NO: 2572806 - RNA, 22 nt, Chlamydophila pneumoniae TW-183
caaccuucgauuccaggcucua

SEQ ID NO: 2572807 - RNA, 18 nt, Chlamydophila pneumoniae TW-183
caacgaguccuuacuugc

SEQ ID NO: 2572808 - RNA, 12 nt, Chlamydophila pneumoniae TW-183
caacuaaacucu

SEQ ID NO: 2572809 - RNA, 19 nt, Chlamydophila pneumoniae TW-183
caacugauguuuuauagau

SEQ ID NO: 2572810 - RNA, 20 nt, Chlamydophila pneumoniae TW-183
caacugauguuuuauagaua

SEQ ID NO: 2572811 - RNA, 18 nt, Chlamydophila pneumoniae TW-183
caacuucuccaacuaaac

SEQ ID NO: 2572812 - RNA, 19 nt, Chlamydophila pneumoniae TW-183
caacuuuguuaauagaaga

SEQ ID NO: 2572813 - RNA, 23 nt, Chlamydophila pneumoniae TW-183
caacuuuguuaauagaagaucau

SEQ ID NO: 2572814 - RNA, 14 nt, Chlamydophila pneumoniae TW-183
caagaaaaaccccu

SEQ ID NO: 2572815 - RNA, 16 nt, Chlamydophila pneumoniae TW-183
caagaaaacaaaguca

SEQ ID NO: 2572816 - RNA, 18 nt, Chlamydophila pneumoniae TW-183
caagaaauauacugccag

SEQ ID NO: 2572817 - RNA, 18 nt, Chlamydophila pneumoniae TW-183
caagaauagcaggaagga

SEQ ID NO: 2572818 - RNA, 21 nt, Chlamydophila pneumoniae TW-183
caagaauagcaggaaggaaua

SEQ ID NO: 2572819 - RNA, 21 nt, Chlamydophila pneumoniae TW-183
caagaauagccauaauuagaa

SEQ ID NO: 2572820 - RNA, 21 nt, Chlamydophila pneumoniae TW-183
caagaccacuuaggguucuca

SEQ ID NO: 2572821 - RNA, 17 nt, Chlamydophila pneumoniae TW-183
caagauuaugaugccuc

SEQ ID NO: 2572822 - RNA, 23 nt, Chlamydophila pneumoniae TW-183
caagcaggugugugguaaaaaua

SEQ ID NO: 2572823 - RNA, 23 nt, Chlamydophila pneumoniae TW-183
caaggcgaguguagauuauugau

SEQ ID NO: 2572824 - RNA, 23 nt, Chlamydophila pneumoniae TW-183
caaggucacagcauuuucucuga

SEQ ID NO: 2572825 - RNA, 13 nt, Chlamydophila pneumoniae TW-183
caggcauucuuca

SEQ ID NO: 2572826 - RNA, 20 nt, Chlamydophila pneumoniae TW-183
cagggcauucucuaaaugau

SEQ ID NO: 2572827 - RNA, 18 nt, Chlamydophila pneumoniae TW-183
caggucugcugaggagag

SEQ ID NO: 2572828 - RNA, 18 nt, Chlamydophila pneumoniae TW-183
cagguucacuucaucgac

SEQ ID NO: 2572829 - RNA, 16 nt, Chlamydophila pneumoniae TW-183
caguaaaacacaaaua

SEQ ID NO: 2572830 - RNA, 22 nt, Chlamydophila pneumoniae TW-183
caguaaaagacugaaaagaucg

SEQ ID NO: 2572831 - RNA, 14 nt, Chlamydophila pneumoniae TW-183
caguaggagcagcg

SEQ ID NO: 2572832 - RNA, 22 nt, Chlamydophila pneumoniae TW-183
caguaggagcagcggcacccuc

SEQ ID NO: 2572833 - RNA, 22 nt, Chlamydophila pneumoniae TW-183
cagucuccuggaacaguauaau

SEQ ID NO: 2572834 - RNA, 13 nt, Chlamydophila pneumoniae TW-183
caguuaaagagca

SEQ ID NO: 2572835 - RNA, 15 nt, Chlamydophila pneumoniae TW-183
caguucgacaaccaa

SEQ ID NO: 2572836 - RNA, 19 nt, Chlamydophila pneumoniae TW-183
caguuuucagugcuguuuu

SEQ ID NO: 2572837 - RNA, 16 nt, Chlamydophila pneumoniae TW-183
cauaaaaauucucaua

SEQ ID NO: 2572838 - RNA, 20 nt, Chlamydophila pneumoniae TW-183
cauaaccuuugacaacacca

SEQ ID NO: 2572839 - RNA, 15 nt, Chlamydophila pneumoniae TW-183
cauaaguauagagag

SEQ ID NO: 2572840 - RNA, 15 nt, Chlamydophila pneumoniae TW-183
cauaaucucaccaga

SEQ ID NO: 2572841 - RNA, 21 nt, Chlamydophila pneumoniae TW-183
cauacgccgugccuauagaaa

SEQ ID NO: 2572842 - RNA, 16 nt, Chlamydophila pneumoniae TW-183
cauacuacucucauca

SEQ ID NO: 2572843 - RNA, 18 nt, Chlamydophila pneumoniae TW-183
cauacucuucauccugau

SEQ ID NO: 2572844 - RNA, 16 nt, Chlamydophila pneumoniae TW-183
cauagaguaucuaaaa

SEQ ID NO: 2572845 - RNA, 21 nt, Chlamydophila pneumoniae TW-183
cauaggaaugccaaaccucuu

SEQ ID NO: 2572846 - RNA, 23 nt, Chlamydophila pneumoniae TW-183
cauaggcuuuaccauagaaagau

SEQ ID NO: 2572847 - RNA, 19 nt, Chlamydophila pneumoniae TW-183
cauagguaauacgagagga

SEQ ID NO: 2572848 - RNA, 20 nt, Chlamydophila pneumoniae TW-183
cauagguaauacgagaggaa

SEQ ID NO: 2572849 - RNA, 16 nt, Chlamydophila pneumoniae TW-183
cauauaauacgucuca

SEQ ID NO: 2572850 - RNA, 19 nt, Chlamydophila pneumoniae TW-183
cauaucaucgauaucuaag

SEQ ID NO: 2572851 - RNA, 21 nt, Chlamydophila pneumoniae TW-183
cauauuacgcacuguaaaaaa

SEQ ID NO: 2572852 - RNA, 20 nt, Chlamydophila pneumoniae TW-183
cauauuuuucuugaagguuc

SEQ ID NO: 2572853 - RNA, 21 nt, Chlamydophila pneumoniae TW-183
caucaaccgaagauccuagag

SEQ ID NO: 2572854 - RNA, 23 nt, Chlamydophila pneumoniae TW-183
caucacuaagauacgaaguccca

SEQ ID NO: 2572855 - RNA, 18 nt, Chlamydophila pneumoniae TW-183
caucaggcggaugaccuu

SEQ ID NO: 2572856 - RNA, 13 nt, Chlamydophila pneumoniae TW-183
caucaguaaaaga

SEQ ID NO: 2572857 - RNA, 22 nt, Chlamydophila pneumoniae TW-183
cauccacgaccucgaauuccuc

SEQ ID NO: 2572858 - RNA, 15 nt, Chlamydophila pneumoniae TW-183
cauccgaagacucaa

SEQ ID NO: 2572859 - RNA, 14 nt, Chlamydophila pneumoniae TW-183
cauccugaucuucu

SEQ ID NO: 2572860 - RNA, 22 nt, Chlamydophila pneumoniae TW-183
cauccuguagagcaagauucuu

SEQ ID NO: 2572861 - RNA, 23 nt, Chlamydophila pneumoniae TW-183
caucgagaaaugcucuucugcag

SEQ ID NO: 2572862 - RNA, 19 nt, Chlamydophila pneumoniae TW-183
caucggugucuacaaagau

SEQ ID NO: 2572863 - RNA, 19 nt, Chlamydophila pneumoniae TW-183
caucgucuccaaaaauucc

SEQ ID NO: 2572864 - RNA, 17 nt, Chlamydophila pneumoniae TW-183
caucuacgauguuuucu

SEQ ID NO: 2572865 - RNA, 19 nt, Chlamydophila pneumoniae TW-183
caucuacgauguuuucuua

SEQ ID NO: 2572866 - RNA, 21 nt, Chlamydophila pneumoniae TW-183
caucuacgauguuuucuuauc

SEQ ID NO: 2572867 - RNA, 21 nt, Chlamydophila pneumoniae TW-183
caucugggaguuguaaaacuu

SEQ ID NO: 2572868 - RNA, 21 nt, Chlamydophila pneumoniae TW-183
caucuucucgaacaggagaga

SEQ ID NO: 2572869 - RNA, 15 nt, Chlamydophila pneumoniae TW-183
caugacgcuuuucca

SEQ ID NO: 2572870 - RNA, 17 nt, Chlamydophila pneumoniae TW-183
caugaggagaccuuuau

SEQ ID NO: 2572871 - RNA, 22 nt, Chlamydophila pneumoniae TW-183
caugaugcaguccacgcuaucu

SEQ ID NO: 2572872 - RNA, 13 nt, Chlamydophila pneumoniae TW-183
caugauuuuucaa

SEQ ID NO: 2572873 - RNA, 22 nt, Chlamydophila pneumoniae TW-183
caugcacgagagccucggaagu

SEQ ID NO: 2572874 - RNA, 20 nt, Chlamydophila pneumoniae TW-183
caugcauaggcuuuaccaua

SEQ ID NO: 2572875 - RNA, 22 nt, Chlamydophila pneumoniae TW-183
caugcccccacaaaaccuggau

SEQ ID NO: 2572876 - RNA, 22 nt, Chlamydophila pneumoniae TW-183
cauggaagugcggcucucuuca

SEQ ID NO: 2572877 - RNA, 19 nt, Chlamydophila pneumoniae TW-183
cauggacaagcaaaagcaa

SEQ ID NO: 2572878 - RNA, 17 nt, Chlamydophila pneumoniae TW-183
cauggauauggaauggc

SEQ ID NO: 2572879 - RNA, 21 nt, Chlamydophila pneumoniae TW-183
cauguacaaugauaucagcau

SEQ ID NO: 2572880 - RNA, 21 nt, Chlamydophila pneumoniae TW-183
cauguccuccauggaaagaaa

SEQ ID NO: 2572881 - RNA, 17 nt, Chlamydophila pneumoniae TW-183
caugucucuuaaaaaaa

SEQ ID NO: 2572882 - RNA, 18 nt, Chlamydophila pneumoniae TW-183
cauguuaagcguauagaa

SEQ ID NO: 2572883 - RNA, 20 nt, Chlamydophila pneumoniae TW-183
cauguuuaauaucagcuucu

SEQ ID NO: 2572884 - RNA, 15 nt, Chlamydophila pneumoniae TW-183
cauuccagcaucuuc

SEQ ID NO: 2572885 - RNA, 18 nt, Chlamydophila pneumoniae TW-183
cauugacuugggauucuu

SEQ ID NO: 2572886 - RNA, 17 nt, Chlamydophila pneumoniae TW-183
cauugaugcuuaagagu

SEQ ID NO: 2572887 - RNA, 16 nt, Chlamydophila pneumoniae TW-183
cauugcaaaaaugaaa

SEQ ID NO: 2572888 - RNA, 19 nt, Chlamydophila pneumoniae TW-183
cauuggcuccuaaggaaac

SEQ ID NO: 2572889 - RNA, 23 nt, Chlamydophila pneumoniae TW-183
cauuguuuaaguccuucuuccca

SEQ ID NO: 2572890 - RNA, 17 nt, Chlamydophila pneumoniae TW-183
cauuuagacaaucuacg

SEQ ID NO: 2572891 - RNA, 15 nt, Chlamydophila pneumoniae TW-183
cauuugauucauaaa

SEQ ID NO: 2572892 - RNA, 17 nt, Chlamydophila pneumoniae TW-183
cauuugauucauaaaga

SEQ ID NO: 2572893 - RNA, 16 nt, Chlamydophila pneumoniae TW-183
cauuuucuucuugcaa

SEQ ID NO: 2572894 - RNA, 21 nt, Chlamydophila pneumoniae TW-183
cauuuucuucuugcaaucuuu

SEQ ID NO: 2572895 - RNA, 19 nt, Chlamydophila pneumoniae TW-183
ccaaaaauucccauagcau

SEQ ID NO: 2572896 - RNA, 23 nt, Chlamydophila pneumoniae TW-183
ccaaaagaauuaagaagaagcug

SEQ ID NO: 2572897 - RNA, 11 nt, Chlamydophila pneumoniae TW-183
ccaaacaugga

SEQ ID NO: 2572898 - RNA, 21 nt, Chlamydophila pneumoniae TW-183
ccaaacauggacaauauagag

SEQ ID NO: 2572899 - RNA, 16 nt, Chlamydophila pneumoniae TW-183
ccaaagcauauacugu

SEQ ID NO: 2572900 - RNA, 14 nt, Chlamydophila pneumoniae TW-183
ccaaaguuuguagc

SEQ ID NO: 2572901 - RNA, 13 nt, Chlamydophila pneumoniae TW-183
ccaacuccucuaa

SEQ ID NO: 2572902 - RNA, 16 nt, Chlamydophila pneumoniae TW-183
ccaagaaauauacugc

SEQ ID NO: 2572903 - RNA, 22 nt, Chlamydophila pneumoniae TW-183
ccaagcaggugugugguaaaaa

SEQ ID NO: 2572904 - RNA, 13 nt, Chlamydophila pneumoniae TW-183
ccaauacagcaua

SEQ ID NO: 2572905 - RNA, 22 nt, Chlamydophila pneumoniae TW-183
ccaauccauucugagaaagaag

SEQ ID NO: 2572906 - RNA, 14 nt, Chlamydophila pneumoniae TW-183
ccaaucgauaacgu

SEQ ID NO: 2572907 - RNA, 16 nt, Chlamydophila pneumoniae TW-183
ccaauuccccuucauc

SEQ ID NO: 2572908 - RNA, 13 nt, Chlamydophila pneumoniae TW-183
ccacagcuucuuc

SEQ ID NO: 2572909 - RNA, 22 nt, Chlamydophila pneumoniae TW-183
ccacgaguucgcggaucuucuu

SEQ ID NO: 2572910 - RNA, 23 nt, Chlamydophila pneumoniae TW-183
ccacgaguucgcggaucuucuuc

SEQ ID NO: 2572911 - RNA, 15 nt, Chlamydophila pneumoniae TW-183
ccacggauuuucucu

SEQ ID NO: 2572912 - RNA, 13 nt, Chlamydophila pneumoniae TW-183
ccacguccauuuc

SEQ ID NO: 2572913 - RNA, 12 nt, Chlamydophila pneumoniae TW-183
ccacugcuuuag

SEQ ID NO: 2572914 - RNA, 22 nt, Chlamydophila pneumoniae TW-183
ccagaagcaacuaaacucucca

SEQ ID NO: 2572915 - RNA, 16 nt, Chlamydophila pneumoniae TW-183
ccagaagcauugagga

SEQ ID NO: 2572916 - RNA, 20 nt, Chlamydophila pneumoniae TW-183
ccagaagguguggguacagg

SEQ ID NO: 2572917 - RNA, 22 nt, Chlamydophila pneumoniae TW-183
ccagaauaccuucaacaagaau

SEQ ID NO: 2572918 - RNA, 16 nt, Chlamydophila pneumoniae TW-183
ccagacuuuccucucu

SEQ ID NO: 2572919 - RNA, 14 nt, Chlamydophila pneumoniae TW-183
ccagagagcuuuua

SEQ ID NO: 2572920 - RNA, 23 nt, Chlamydophila pneumoniae TW-183
ccagagagcuuuuagguagagaa

SEQ ID NO: 2572921 - RNA, 22 nt, Chlamydophila pneumoniae TW-183
cgaguucgcggaucuucuucug

SEQ ID NO: 2572922 - RNA, 14 nt, Chlamydophila pneumoniae TW-183
cgauuaccuaaaac

SEQ ID NO: 2572923 - RNA, 15 nt, Chlamydophila pneumoniae TW-183
cgauuaccuaaaaca

SEQ ID NO: 2572924 - RNA, 22 nt, Chlamydophila pneumoniae TW-183
cgcaacuuaagauacuucucca

SEQ ID NO: 2572925 - RNA, 23 nt, Chlamydophila pneumoniae TW-183
cgcagauuuuaacaacuucacau

SEQ ID NO: 2572926 - RNA, 14 nt, Chlamydophila pneumoniae TW-183
cgccagcaaagauu

SEQ ID NO: 2572927 - RNA, 17 nt, Chlamydophila pneumoniae TW-183
cgccuuucuacccuucc

SEQ ID NO: 2572928 - RNA, 19 nt, Chlamydophila pneumoniae TW-183
cgcguucuugaaucuucaa

SEQ ID NO: 2572929 - RNA, 19 nt, Chlamydophila pneumoniae TW-183
cgcguuggugaugauuuga

SEQ ID NO: 2572930 - RNA, 14 nt, Chlamydophila pneumoniae TW-183
cgcucguauugaua

SEQ ID NO: 2572931 - RNA, 16 nt, Chlamydophila pneumoniae TW-183
cgcucuaagcugugca

SEQ ID NO: 2572932 - RNA, 13 nt, Chlamydophila pneumoniae TW-183
cgcuuguucuuuu

SEQ ID NO: 2572933 - RNA, 20 nt, Chlamydophila pneumoniae TW-183
cgcuuguucuuuucaucaag

SEQ ID NO: 2572934 - RNA, 21 nt, Chlamydophila pneumoniae TW-183
cgcuuguucuuuucaucaaga

SEQ ID NO: 2572935 - RNA, 17 nt, Chlamydophila pneumoniae TW-183
cggaacaacuuugaggc

SEQ ID NO: 2572936 - RNA, 12 nt, Chlamydophila pneumoniae TW-183
cggaucuguaau

SEQ ID NO: 2572937 - RNA, 22 nt, Chlamydophila pneumoniae TW-183
cggcauuucuccacaugccugc

SEQ ID NO: 2572938 - RNA, 21 nt, Chlamydophila pneumoniae TW-183
cggcugcgguagccuggaggc

SEQ ID NO: 2572939 - RNA, 19 nt, Chlamydophila pneumoniae TW-183
cggggucggagauuguuuc

SEQ ID NO: 2572940 - RNA, 23 nt, Chlamydophila pneumoniae TW-183
cggguucauuuccaaauucuugc

SEQ ID NO: 2572941 - RNA, 16 nt, Chlamydophila pneumoniae TW-183
cgguaaccugugaaaa

SEQ ID NO: 2572942 - RNA, 16 nt, Chlamydophila pneumoniae TW-183
cgguaaugccagcagc

SEQ ID NO: 2572943 - RNA, 16 nt, Chlamydophila pneumoniae TW-183
cggugucuacaaagau

SEQ ID NO: 2572944 - RNA, 13 nt, Chlamydophila pneumoniae TW-183
cguaacugaggca

SEQ ID NO: 2572945 - RNA, 19 nt, Chlamydophila pneumoniae TW-183
cguaagcugcaaucucaaa

SEQ ID NO: 2572946 - RNA, 18 nt, Chlamydophila pneumoniae TW-183
cguaauccuucuuucugc

SEQ ID NO: 2572947 - RNA, 20 nt, Chlamydophila pneumoniae TW-183
cguacgcaaguaaagaaauu

SEQ ID NO: 2572948 - RNA, 14 nt, Chlamydophila pneumoniae TW-183
cguacuucacuucu

SEQ ID NO: 2572949 - RNA, 23 nt, Chlamydophila pneumoniae TW-183
cguagcuacaaaauuauuaaacu

SEQ ID NO: 2572950 - RNA, 13 nt, Chlamydophila pneumoniae TW-183
cguaguauccuuu

SEQ ID NO: 2572951 - RNA, 22 nt, Chlamydophila pneumoniae TW-183
cguaguauccuuucaucagcau

SEQ ID NO: 2572952 - RNA, 14 nt, Chlamydophila pneumoniae TW-183
cguauagaauagaa

SEQ ID NO: 2572953 - RNA, 16 nt, Chlamydophila pneumoniae TW-183
cguaugcaucaaugaa

SEQ ID NO: 2572954 - RNA, 19 nt, Chlamydophila pneumoniae TW-183
cguauggauuucuccagca

SEQ ID NO: 2572955 - RNA, 14 nt, Chlamydophila pneumoniae TW-183
cgucuuucaccaac

SEQ ID NO: 2572956 - RNA, 16 nt, Chlamydophila pneumoniae TW-183
cgugaagcagaggguu

SEQ ID NO: 2572957 - RNA, 18 nt, Chlamydophila pneumoniae TW-183
cgugaauaucaucacuaa

SEQ ID NO: 2572958 - RNA, 15 nt, Chlamydophila pneumoniae TW-183
cgugcaaguucacac

SEQ ID NO: 2572959 - RNA, 14 nt, Chlamydophila pneumoniae TW-183
cgugcucugcaauc

SEQ ID NO: 2572960 - RNA, 14 nt, Chlamydophila pneumoniae TW-183
cguuaaaaacuauc

SEQ ID NO: 2572961 - RNA, 13 nt, Chlamydophila pneumoniae TW-183
cguuaauaaagag

SEQ ID NO: 2572962 - RNA, 18 nt, Chlamydophila pneumoniae TW-183
cguucuuucaauaacaga

SEQ ID NO: 2572963 - RNA, 11 nt, Chlamydophila pneumoniae TW-183
cguugccuguu

SEQ ID NO: 2572964 - RNA, 19 nt, Chlamydophila pneumoniae TW-183
cguuuccgaucauuuuugc

SEQ ID NO: 2572965 - RNA, 18 nt, Chlamydophila pneumoniae TW-183
cguuuugcuguggaauuu

SEQ ID NO: 2572966 - RNA, 14 nt, Chlamydophila pneumoniae TW-183
cuaaaacuucuugu

SEQ ID NO: 2572967 - RNA, 13 nt, Chlamydophila pneumoniae TW-183
cuaaacaauuuca

SEQ ID NO: 2572968 - RNA, 14 nt, Chlamydophila pneumoniae TW-183
cuaaacaccuucuu

SEQ ID NO: 2572969 - RNA, 22 nt, Chlamydophila pneumoniae TW-183
cuaaacaccuucuucuaaaauc

SEQ ID NO: 2572970 - RNA, 23 nt, Chlamydophila pneumoniae TW-183
cuaaaccuucaaugauuucuuua

SEQ ID NO: 2572971 - RNA, 12 nt, Chlamydophila pneumoniae TW-183
cuaaacucucca

SEQ ID NO: 2572972 - RNA, 18 nt, Chlamydophila pneumoniae TW-183
cuaaaguaggaauuuuca

SEQ ID NO: 2572973 - RNA, 21 nt, Chlamydophila pneumoniae TW-183
cuaaauagaaaacauagagau

SEQ ID NO: 2572974 - RNA, 12 nt, Chlamydophila pneumoniae TW-183
cuaacaacuccu

SEQ ID NO: 2572975 - RNA, 16 nt, Chlamydophila pneumoniae TW-183
cuaagcgcucuucaau

SEQ ID NO: 2572976 - RNA, 18 nt, Chlamydophila pneumoniae TW-183
cuaagcuccauaaaaaua

SEQ ID NO: 2572977 - RNA, 19 nt, Chlamydophila pneumoniae TW-183
cuaaggaaauuacaaucuc

SEQ ID NO: 2572978 - RNA, 19 nt, Chlamydophila pneumoniae TW-183
cuaaggacaaaucucccaa

SEQ ID NO: 2572979 - RNA, 18 nt, Chlamydophila pneumoniae TW-183
cuaagucguuaacaucaa

SEQ ID NO: 2572980 - RNA, 16 nt, Chlamydophila pneumoniae TW-183
cuaaguucuuaagaau

SEQ ID NO: 2572981 - RNA, 18 nt, Chlamydophila pneumoniae TW-183
cuaaguuuaggcaggaag

SEQ ID NO: 2572982 - RNA, 17 nt, Chlamydophila pneumoniae TW-183
cuaauaagauccaaaaa

SEQ ID NO: 2572983 - RNA, 15 nt, Chlamydophila pneumoniae TW-183
cuaauacuuuaggag

SEQ ID NO: 2572984 - RNA, 22 nt, Chlamydophila pneumoniae TW-183
cuaauauccauaagaucucuaa

SEQ ID NO: 2572985 - RNA, 19 nt, Chlamydophila pneumoniae TW-183
cuaaucuaugaaguccuga

SEQ ID NO: 2572986 - RNA, 17 nt, Chlamydophila pneumoniae TW-183
cuaaucucaggcauucu

SEQ ID NO: 2572987 - RNA, 21 nt, Chlamydophila pneumoniae TW-183
cuaaucucaggcauucuucau

SEQ ID NO: 2572988 - RNA, 17 nt, Chlamydophila pneumoniae TW-183
cuaauucucgagcagcu

SEQ ID NO: 2572989 - RNA, 13 nt, Chlamydophila pneumoniae TW-183
cuacaaguugaga

SEQ ID NO: 2572990 - RNA, 14 nt, Chlamydophila pneumoniae TW-183
cuacaauuuccuug

SEQ ID NO: 2572991 - RNA, 23 nt, Chlamydophila pneumoniae TW-183
cuacacagacuugaggaaucuga

SEQ ID NO: 2572992 - RNA, 17 nt, Chlamydophila pneumoniae TW-183
cuacaggauauugcgga

SEQ ID NO: 2572993 - RNA, 19 nt, Chlamydophila pneumoniae TW-183
cuacauaguuguucggaca

SEQ ID NO: 2572994 - RNA, 20 nt, Chlamydophila pneumoniae TW-183
cuaccccacgcuaaacuaaa

SEQ ID NO: 2572995 - RNA, 21 nt, Chlamydophila pneumoniae TW-183
cuaccccacgcuaaacuaaaa

SEQ ID NO: 2572996 - RNA, 24 nt, Chlamydophila pneumoniae TW-183
cuaccucugggaagacucucauca

SEQ ID NO: 2572997 - RNA, 14 nt, Chlamydophila pneumoniae TW-183
cuacgauguuuucu

SEQ ID NO: 2572998 - RNA, 17 nt, Chlamydophila pneumoniae TW-183
cuacgcgcucuucuuuc

SEQ ID NO: 2572999 - RNA, 18 nt, Chlamydophila pneumoniae TW-183
cuacuucugcaggacugu

SEQ ID NO: 2573000 - RNA, 23 nt, Chlamydophila pneumoniae TW-183
cuacuuugaccaauuccccuuca

SEQ ID NO: 2573001 - RNA, 16 nt, Chlamydophila pneumoniae TW-183
cuagaacacucagaga

SEQ ID NO: 2573002 - RNA, 20 nt, Chlamydophila pneumoniae TW-183
cuagaauaccguuuuaggaa

SEQ ID NO: 2573003 - RNA, 17 nt, Chlamydophila pneumoniae TW-183
cuagaccugccaagaua

SEQ ID NO: 2573004 - RNA, 17 nt, Chlamydophila pneumoniae TW-183
cuaggguuucuacagga

SEQ ID NO: 2573005 - RNA, 20 nt, Chlamydophila pneumoniae TW-183
cuaggguuucuacaggauau

SEQ ID NO: 2573006 - RNA, 14 nt, Chlamydophila pneumoniae TW-183
cuagguucuuuuuu

SEQ ID NO: 2573007 - RNA, 13 nt, Chlamydophila pneumoniae TW-183
cuagucuuucaac

SEQ ID NO: 2573008 - RNA, 21 nt, Chlamydophila pneumoniae TW-183
cuagucuuucaaccuccgcuc

SEQ ID NO: 2573009 - RNA, 18 nt, Chlamydophila pneumoniae TW-183
cuauaaauuucucaugca

SEQ ID NO: 2573010 - RNA, 19 nt, Chlamydophila pneumoniae TW-183
cuauaaauuucucaugcau

SEQ ID NO: 2573011 - RNA, 22 nt, Chlamydophila pneumoniae TW-183
cuauagaauacacagcuaugau

SEQ ID NO: 2573012 - RNA, 14 nt, Chlamydophila pneumoniae TW-183
cuauagcauagccu

SEQ ID NO: 2573013 - RNA, 13 nt, Chlamydophila pneumoniae TW-183
cuauauuuuuucc

SEQ ID NO: 2573014 - RNA, 13 nt, Chlamydophila pneumoniae TW-183
cuauccuauuuua

SEQ ID NO: 2573015 - RNA, 23 nt, Chlamydophila pneumoniae TW-183
cuaucugccauaggauccaggag

SEQ ID NO: 2573016 - RNA, 23 nt, Chlamydophila pneumoniae TW-183
cuaugagguaguccgcagauuuu

SEQ ID NO: 2573017 - RNA, 23 nt, Chlamydophila pneumoniae TW-183
cuaugaugagaacguccucaccu

SEQ ID NO: 2573018 - RNA, 19 nt, Chlamydophila pneumoniae TW-183
cugcucuucuauguguucu

SEQ ID NO: 2573019 - RNA, 13 nt, Chlamydophila pneumoniae TW-183
cugcugaggagag

SEQ ID NO: 2573020 - RNA, 15 nt, Chlamydophila pneumoniae TW-183
cugcuucaaaacaua

SEQ ID NO: 2573021 - RNA, 22 nt, Chlamydophila pneumoniae TW-183
cugcuucaaaacauaaccuccu

SEQ ID NO: 2573022 - RNA, 15 nt, Chlamydophila pneumoniae TW-183
cugcuugugaggcua

SEQ ID NO: 2573023 - RNA, 13 nt, Chlamydophila pneumoniae TW-183
cugcuuuuguugu

SEQ ID NO: 2573024 - RNA, 18 nt, Chlamydophila pneumoniae TW-183
cugcuuuuguuguuuuug

SEQ ID NO: 2573025 - RNA, 21 nt, Chlamydophila pneumoniae TW-183
cugcuuuuguuguuuuugcug

SEQ ID NO: 2573026 - RNA, 19 nt, Chlamydophila pneumoniae TW-183
cugcuuuuuugaucugaag

SEQ ID NO: 2573027 - RNA, 17 nt, Chlamydophila pneumoniae TW-183
cuggagagguaaccaga

SEQ ID NO: 2573028 - RNA, 17 nt, Chlamydophila pneumoniae TW-183
cuggaggcuguguaaaa

SEQ ID NO: 2573029 - RNA, 14 nt, Chlamydophila pneumoniae TW-183
cuggcugagagaag

SEQ ID NO: 2573030 - RNA, 23 nt, Chlamydophila pneumoniae TW-183
cugggaguuguaaaacuuagaaa

SEQ ID NO: 2573031 - RNA, 15 nt, Chlamydophila pneumoniae TW-183
cugggcgucuucuuc

SEQ ID NO: 2573032 - RNA, 16 nt, Chlamydophila pneumoniae TW-183
cugggcgucuucuucg

SEQ ID NO: 2573033 - RNA, 21 nt, Chlamydophila pneumoniae TW-183
cuguaaaaaagaaauacuuuu

SEQ ID NO: 2573034 - RNA, 21 nt, Chlamydophila pneumoniae TW-183
cuguaccacauacucuucauc

SEQ ID NO: 2573035 - RNA, 22 nt, Chlamydophila pneumoniae TW-183
cuguagguuuuuccaacuucaa

SEQ ID NO: 2573036 - RNA, 18 nt, Chlamydophila pneumoniae TW-183
cuguaguaaaauaagaaa

SEQ ID NO: 2573037 - RNA, 23 nt, Chlamydophila pneumoniae TW-183
cuguaucuccacgcacuccugga

SEQ ID NO: 2573038 - RNA, 16 nt, Chlamydophila pneumoniae TW-183
cugugaaaauuuucuu

SEQ ID NO: 2573039 - RNA, 21 nt, Chlamydophila pneumoniae TW-183
cugugauagguagcagcccgc

SEQ ID NO: 2573040 - RNA, 12 nt, Chlamydophila pneumoniae TW-183
cugugcauuuuc

SEQ ID NO: 2573041 - RNA, 20 nt, Chlamydophila pneumoniae TW-183
cugugcauuuucuucuugca

SEQ ID NO: 2573042 - RNA, 14 nt, Chlamydophila pneumoniae TW-183
cuguggcaauagcg

SEQ ID NO: 2573043 - RNA, 21 nt, Chlamydophila pneumoniae TW-183
cuguguaaaaguuagguagau

SEQ ID NO: 2573044 - RNA, 16 nt, Chlamydophila pneumoniae TW-183
cuguuccaagagucuu

SEQ ID NO: 2573045 - RNA, 13 nt, Chlamydophila pneumoniae TW-183
cuguuuacagaug

SEQ ID NO: 2573046 - RNA, 23 nt, Chlamydophila pneumoniae TW-183
cuguuucugcaaugcuaagcucc

SEQ ID NO: 2573047 - RNA, 15 nt, Chlamydophila pneumoniae TW-183
cuguuuucuuuucug

SEQ ID NO: 2573048 - RNA, 14 nt, Chlamydophila pneumoniae TW-183
cuuaaaaaaaauua

SEQ ID NO: 2573049 - RNA, 16 nt, Chlamydophila pneumoniae TW-183
cuuaaaaaaaauuacu

SEQ ID NO: 2573050 - RNA, 19 nt, Chlamydophila pneumoniae TW-183
cuuaaaagagaacauguuu

SEQ ID NO: 2573051 - RNA, 15 nt, Chlamydophila pneumoniae TW-183
cuuaaaauucuguaa

SEQ ID NO: 2573052 - RNA, 23 nt, Chlamydophila pneumoniae TW-183
cuuaaagguaaaacuacaggaaa

SEQ ID NO: 2573053 - RNA, 20 nt, Chlamydophila pneumoniae TW-183
cuuaacaacaucacuuauau

SEQ ID NO: 2573054 - RNA, 22 nt, Chlamydophila pneumoniae TW-183
cuuaagaaucgaguucuucauu

SEQ ID NO: 2573055 - RNA, 17 nt, Chlamydophila pneumoniae TW-183
cuuaagaguuuuacauc

SEQ ID NO: 2573056 - RNA, 18 nt, Chlamydophila pneumoniae TW-183
cuuaagaguuuuacauca

SEQ ID NO: 2573057 - RNA, 22 nt, Chlamydophila pneumoniae TW-183
cuuaagaguuuuacaucaauga

SEQ ID NO: 2573058 - RNA, 20 nt, Chlamydophila pneumoniae TW-183
cuuaaugguagcuuaagaau

SEQ ID NO: 2573059 - RNA, 13 nt, Chlamydophila pneumoniae TW-183
cuuaauuuuuuua

SEQ ID NO: 2573060 - RNA, 16 nt, Chlamydophila pneumoniae TW-183
cuuacauccaauuuug

SEQ ID NO: 2573061 - RNA, 22 nt, Chlamydophila pneumoniae TW-183
cuuacuugcauagauaucuuug

SEQ ID NO: 2573062 - RNA, 16 nt, Chlamydophila pneumoniae TW-183
cuuaggguucucaaag

SEQ ID NO: 2573063 - RNA, 19 nt, Chlamydophila pneumoniae TW-183
cuuauagggaauuuuuucu

SEQ ID NO: 2573064 - RNA, 20 nt, Chlamydophila pneumoniae TW-183
cuuauagggaauuuuuucug

SEQ ID NO: 2573065 - RNA, 12 nt, Chlamydophila pneumoniae TW-183
cuuaucucuuuc

SEQ ID NO: 2573066 - RNA, 16 nt, Chlamydophila pneumoniae TW-183
cuucaacaagaauaac

SEQ ID NO: 2573067 - RNA, 16 nt, Chlamydophila pneumoniae TW-183
cuucaagaaaaacccc

SEQ ID NO: 2573068 - RNA, 17 nt, Chlamydophila pneumoniae TW-183
cuucaaugauuucuuua

SEQ ID NO: 2573069 - RNA, 14 nt, Chlamydophila pneumoniae TW-183
cuucacaagaaaac

SEQ ID NO: 2573070 - RNA, 16 nt, Chlamydophila pneumoniae TW-183
cuucacaaucuaaaua

SEQ ID NO: 2573071 - RNA, 17 nt, Chlamydophila pneumoniae TW-183
cuucagaaucuuuguga

SEQ ID NO: 2573072 - RNA, 11 nt, Chlamydophila pneumoniae TW-183
cuucagagaga

SEQ ID NO: 2573073 - RNA, 22 nt, Chlamydophila pneumoniae TW-183
cuucagcccacuguuuugcuuc

SEQ ID NO: 2573074 - RNA, 14 nt, Chlamydophila pneumoniae TW-183
cuucaucacaaaau

SEQ ID NO: 2573075 - RNA, 14 nt, Chlamydophila pneumoniae TW-183
cuucauugcaaaaa

SEQ ID NO: 2573076 - RNA, 15 nt, Chlamydophila pneumoniae TW-183
cuucauugcaaaaau

SEQ ID NO: 2573077 - RNA, 19 nt, Chlamydophila pneumoniae TW-183
cuucgauguuauaagugac

SEQ ID NO: 2573078 - RNA, 15 nt, Chlamydophila pneumoniae TW-183
cuucggaucuguaau

SEQ ID NO: 2573079 - RNA, 18 nt, Chlamydophila pneumoniae TW-183
cuucuaaaaucuucucug

SEQ ID NO: 2573080 - RNA, 12 nt, Chlamydophila pneumoniae TW-183
cuucuaaacaau

SEQ ID NO: 2573081 - RNA, 13 nt, Chlamydophila pneumoniae TW-183
cuucuacagcauc

SEQ ID NO: 2573082 - RNA, 18 nt, Chlamydophila pneumoniae TW-183
cuucucaagaucuucauc

SEQ ID NO: 2573083 - RNA, 19 nt, Chlamydophila pneumoniae TW-183
cuucucaagaucuucauca

SEQ ID NO: 2573084 - RNA, 21 nt, Chlamydophila pneumoniae TW-183
cuucucuuaugaaguccagac

SEQ ID NO: 2573085 - RNA, 16 nt, Chlamydophila pneumoniae TW-183
cuucuggcugagagaa

SEQ ID NO: 2573086 - RNA, 14 nt, Chlamydophila pneumoniae TW-183
cuucugucuguauu

SEQ ID NO: 2573087 - RNA, 17 nt, Chlamydophila pneumoniae TW-183
cuucuucgccuacaagu

SEQ ID NO: 2573088 - RNA, 15 nt, Chlamydophila pneumoniae TW-183
cuucuucggaucugu

SEQ ID NO: 2573089 - RNA, 19 nt, Chlamydophila pneumoniae TW-183
cuucuucuaaaaucuucuc

SEQ ID NO: 2573090 - RNA, 20 nt, Chlamydophila pneumoniae TW-183
cuucuucuggcugagagaag

SEQ ID NO: 2573091 - RNA, 14 nt, Chlamydophila pneumoniae TW-183
cuucuuguuuuugu

SEQ ID NO: 2573092 - RNA, 18 nt, Chlamydophila pneumoniae TW-183
cuucuuucugcucuucua

SEQ ID NO: 2573093 - RNA, 19 nt, Chlamydophila pneumoniae TW-183
cuugaaauugcucuugcuc

SEQ ID NO: 2573094 - RNA, 15 nt, Chlamydophila pneumoniae TW-183
cuugaacaucucgaa

SEQ ID NO: 2573095 - RNA, 18 nt, Chlamydophila pneumoniae TW-183
cuugagaaaagaacaggg

SEQ ID NO: 2573096 - RNA, 23 nt, Chlamydophila pneumoniae TW-183
cuugagccaacagguucacuuca

SEQ ID NO: 2573097 - RNA, 20 nt, Chlamydophila pneumoniae TW-183
cuugauaaaacgcuauuguu

SEQ ID NO: 2573098 - RNA, 22 nt, Chlamydophila pneumoniae TW-183
cuugaucaggauggucauacca

SEQ ID NO: 2573099 - RNA, 22 nt, Chlamydophila pneumoniae TW-183
cuugauguaaucccagauuuuu

SEQ ID NO: 2573100 - RNA, 23 nt, Chlamydophila pneumoniae TW-183
cuugauguacaguaaaguaugca

SEQ ID NO: 2573101 - RNA, 17 nt, Chlamydophila pneumoniae TW-183
cuugcaaaacagcauca

SEQ ID NO: 2573102 - RNA, 21 nt, Chlamydophila pneumoniae TW-183
cuugcaaaacagcaucaggau

SEQ ID NO: 2573103 - RNA, 24 nt, Chlamydophila pneumoniae TW-183
cuugcaaaacagcaucaggauucu

SEQ ID NO: 2573104 - RNA, 16 nt, Chlamydophila pneumoniae TW-183
cuugcaaucuuugaag

SEQ ID NO: 2573105 - RNA, 18 nt, Chlamydophila pneumoniae TW-183
cuugcagcccugcauagu

SEQ ID NO: 2573106 - RNA, 18 nt, Chlamydophila pneumoniae TW-183
cuugcagcgacaacacgc

SEQ ID NO: 2573107 - RNA, 15 nt, Chlamydophila pneumoniae TW-183
cuugcgacauaacca

SEQ ID NO: 2573108 - RNA, 23 nt, Chlamydophila pneumoniae TW-183
cuugcgauacaauaaacaacgau

SEQ ID NO: 2573109 - RNA, 17 nt, Chlamydophila pneumoniae TW-183
cuugcugauuucuuuuu

SEQ ID NO: 2573110 - RNA, 18 nt, Chlamydophila pneumoniae TW-183
cuugcugauuucuuuuuc

SEQ ID NO: 2573111 - RNA, 20 nt, Chlamydophila pneumoniae TW-183
cuugcugauuucuuuuucag

SEQ ID NO: 2573112 - RNA, 15 nt, Chlamydophila pneumoniae TW-183
cuuguuucuguuuuc

SEQ ID NO: 2573113 - RNA, 18 nt, Chlamydophila pneumoniae TW-183
cuuguuuuccuguguggu

SEQ ID NO: 2573114 - RNA, 16 nt, Chlamydophila pneumoniae TW-183
cuuuaacuucuaaaag

SEQ ID NO: 2573115 - RNA, 22 nt, Chlamydophila pneumoniae TW-183
uagccguaggguagccauccac

SEQ ID NO: 2573116 - RNA, 22 nt, Chlamydophila pneumoniae TW-183
uagccuggaggcgguggcaugc

SEQ ID NO: 2573117 - RNA, 22 nt, Chlamydophila pneumoniae TW-183
uagcgguacuugcgaaagaucc

SEQ ID NO: 2573118 - RNA, 16 nt, Chlamydophila pneumoniae TW-183
uagcuauuuuugagga

SEQ ID NO: 2573119 - RNA, 18 nt, Chlamydophila pneumoniae TW-183
uagcucaaaucucauucc

SEQ ID NO: 2573120 - RNA, 20 nt, Chlamydophila pneumoniae TW-183
uagcucuuugggauaaaaag

SEQ ID NO: 2573121 - RNA, 18 nt, Chlamydophila pneumoniae TW-183
uagcuuuuaguuucccac

SEQ ID NO: 2573122 - RNA, 12 nt, Chlamydophila pneumoniae TW-183
uaggaaccacuu

SEQ ID NO: 2573123 - RNA, 14 nt, Chlamydophila pneumoniae TW-183
uaggaagaugaaua

SEQ ID NO: 2573124 - RNA, 17 nt, Chlamydophila pneumoniae TW-183
uaggaagcuuaucaaga

SEQ ID NO: 2573125 - RNA, 17 nt, Chlamydophila pneumoniae TW-183
uaggaaggucagaguau

SEQ ID NO: 2573126 - RNA, 18 nt, Chlamydophila pneumoniae TW-183
uaggacccguagccccuu

SEQ ID NO: 2573127 - RNA, 21 nt, Chlamydophila pneumoniae TW-183
uaggagaaaucacacuuaaag

SEQ ID NO: 2573128 - RNA, 12 nt, Chlamydophila pneumoniae TW-183
uaggauucggac

SEQ ID NO: 2573129 - RNA, 23 nt, Chlamydophila pneumoniae TW-183
uaggcuuuuuucuauuuucagga

SEQ ID NO: 2573130 - RNA, 21 nt, Chlamydophila pneumoniae TW-183
uagggaauuuuuucuguuccu

SEQ ID NO: 2573131 - RNA, 16 nt, Chlamydophila pneumoniae TW-183
uagggugggagucucu

SEQ ID NO: 2573132 - RNA, 24 nt, Chlamydophila pneumoniae TW-183
uagguaaggaaacgauuucuucuu

SEQ ID NO: 2573133 - RNA, 17 nt, Chlamydophila pneumoniae TW-183
uaguaaaauaagaaauc

SEQ ID NO: 2573134 - RNA, 19 nt, Chlamydophila pneumoniae TW-183
uagucaugauuuuucaauc

SEQ ID NO: 2573135 - RNA, 14 nt, Chlamydophila pneumoniae TW-183
uagucuuucuaaga

SEQ ID NO: 2573136 - RNA, 16 nt, Chlamydophila pneumoniae TW-183
uagucuuucuaagaag

SEQ ID NO: 2573137 - RNA, 21 nt, Chlamydophila pneumoniae TW-183
uagugaacuuuuguacacaga

SEQ ID NO: 2573138 - RNA, 13 nt, Chlamydophila pneumoniae TW-183
uaguguugaauaa

SEQ ID NO: 2573139 - RNA, 20 nt, Chlamydophila pneumoniae TW-183
uaguucaucauauuuuucuu

SEQ ID NO: 2573140 - RNA, 18 nt, Chlamydophila pneumoniae TW-183
uaguuucccacuagcccu

SEQ ID NO: 2573141 - RNA, 22 nt, Chlamydophila pneumoniae TW-183
uauaaagaucgggucuacaaca

SEQ ID NO: 2573142 - RNA, 17 nt, Chlamydophila pneumoniae TW-183
uauaagggggaucuuca

SEQ ID NO: 2573143 - RNA, 17 nt, Chlamydophila pneumoniae TW-183
uauaagugacuuuucuu

SEQ ID NO: 2573144 - RNA, 13 nt, Chlamydophila pneumoniae TW-183
uauaggauuugca

SEQ ID NO: 2573145 - RNA, 22 nt, Chlamydophila pneumoniae TW-183
uauauguaauuucccuaauucu

SEQ ID NO: 2573146 - RNA, 16 nt, Chlamydophila pneumoniae TW-183
uaucaaccauaaagaa

SEQ ID NO: 2573147 - RNA, 18 nt, Chlamydophila pneumoniae TW-183
uauccagaaauacgucca

SEQ ID NO: 2573148 - RNA, 18 nt, Chlamydophila pneumoniae TW-183
uauccuugaaauugcucu

SEQ ID NO: 2573149 - RNA, 22 nt, Chlamydophila pneumoniae TW-183
uauccuugaaauugcucuugcu

SEQ ID NO: 2573150 - RNA, 16 nt, Chlamydophila pneumoniae TW-183
uaucgaccuuaaaauu

SEQ ID NO: 2573151 - RNA, 23 nt, Chlamydophila pneumoniae TW-183
uaucgccuuccuuaacaacauca

SEQ ID NO: 2573152 - RNA, 21 nt, Chlamydophila pneumoniae TW-183
uaucuagaaguuuaaacgucu

SEQ ID NO: 2573153 - RNA, 17 nt, Chlamydophila pneumoniae TW-183
uaucuucaaaaguaauc

SEQ ID NO: 2573154 - RNA, 20 nt, Chlamydophila pneumoniae TW-183
uaucuucaaaaguaaucacu

SEQ ID NO: 2573155 - RNA, 15 nt, Chlamydophila pneumoniae TW-183
uaugaaacccauaau

SEQ ID NO: 2573156 - RNA, 21 nt, Chlamydophila pneumoniae TW-183
uaugacacagcuaaucaaucc

SEQ ID NO: 2573157 - RNA, 17 nt, Chlamydophila pneumoniae TW-183
uaugaggagauaaagau

SEQ ID NO: 2573158 - RNA, 17 nt, Chlamydophila pneumoniae TW-183
uaugaugccucauugcc

SEQ ID NO: 2573159 - RNA, 21 nt, Chlamydophila pneumoniae TW-183
uaugaugccucauugccgugg

SEQ ID NO: 2573160 - RNA, 23 nt, Chlamydophila pneumoniae TW-183
uaugccucaggucugcugaggag

SEQ ID NO: 2573161 - RNA, 14 nt, Chlamydophila pneumoniae TW-183
uaugucaagaagug

SEQ ID NO: 2573162 - RNA, 22 nt, Chlamydophila pneumoniae TW-183
uauuacgcacuguaaaaaagaa

SEQ ID NO: 2573163 - RNA, 16 nt, Chlamydophila pneumoniae TW-183
uauucugguuucuuca

SEQ ID NO: 2573164 - RNA, 11 nt, Chlamydophila pneumoniae TW-183
ucaaaaacugg

SEQ ID NO: 2573165 - RNA, 11 nt, Chlamydophila pneumoniae TW-183
ucaaaaaguuc

SEQ ID NO: 2573166 - RNA, 20 nt, Chlamydophila pneumoniae TW-183
ucaaaacacgcccugaugcu

SEQ ID NO: 2573167 - RNA, 17 nt, Chlamydophila pneumoniae TW-183
ucaaaagguuuuauaaa

SEQ ID NO: 2573168 - RNA, 20 nt, Chlamydophila pneumoniae TW-183
ucaaaccacggauuuucucu

SEQ ID NO: 2573169 - RNA, 21 nt, Chlamydophila pneumoniae TW-183
ucaaaccacggauuuucucua

SEQ ID NO: 2573170 - RNA, 12 nt, Chlamydophila pneumoniae TW-183
ucaaagauauaa

SEQ ID NO: 2573171 - RNA, 23 nt, Chlamydophila pneumoniae TW-183
ucaaauaguucaucauauuuuuc

SEQ ID NO: 2573172 - RNA, 14 nt, Chlamydophila pneumoniae TW-183
ucaacaagaauaac

SEQ ID NO: 2573173 - RNA, 23 nt, Chlamydophila pneumoniae TW-183
ucaacauucuucugucuguauuu

SEQ ID NO: 2573174 - RNA, 15 nt, Chlamydophila pneumoniae TW-183
ucaaccauaaagaau

SEQ ID NO: 2573175 - RNA, 13 nt, Chlamydophila pneumoniae TW-183
ucaacuacaucuc

SEQ ID NO: 2573176 - RNA, 16 nt, Chlamydophila pneumoniae TW-183
ucaacuacaucuccaa

SEQ ID NO: 2573177 - RNA, 15 nt, Chlamydophila pneumoniae TW-183
ucaagaaaaaccccu

SEQ ID NO: 2573178 - RNA, 23 nt, Chlamydophila pneumoniae TW-183
ucaagaagugcuuuuagagguuu

SEQ ID NO: 2573179 - RNA, 22 nt, Chlamydophila pneumoniae TW-183
ucaagaccuaagcucauaagaa

SEQ ID NO: 2573180 - RNA, 20 nt, Chlamydophila pneumoniae TW-183
ucaagagcucguaauccuuc

SEQ ID NO: 2573181 - RNA, 18 nt, Chlamydophila pneumoniae TW-183
ucaagaucuucaucacaa

SEQ ID NO: 2573182 - RNA, 15 nt, Chlamydophila pneumoniae TW-183
ucaaggccuauagau

SEQ ID NO: 2573183 - RNA, 14 nt, Chlamydophila pneumoniae TW-183
ucaaucaauaaaau

SEQ ID NO: 2573184 - RNA, 13 nt, Chlamydophila pneumoniae TW-183
ucaauccaagaau

SEQ ID NO: 2573185 - RNA, 12 nt, Chlamydophila pneumoniae TW-183
ucaaugagaaau

SEQ ID NO: 2573186 - RNA, 14 nt, Chlamydophila pneumoniae TW-183
ucaauugaaucaga

SEQ ID NO: 2573187 - RNA, 16 nt, Chlamydophila pneumoniae TW-183
ucacaauauaaaugcu

SEQ ID NO: 2573188 - RNA, 17 nt, Chlamydophila pneumoniae TW-183
ucacaauauaaaugcua

SEQ ID NO: 2573189 - RNA, 17 nt, Chlamydophila pneumoniae TW-183
ucacaaucuaaauaaga

SEQ ID NO: 2573190 - RNA, 16 nt, Chlamydophila pneumoniae TW-183
ucacacugcgagagaa

SEQ ID NO: 2573191 - RNA, 16 nt, Chlamydophila pneumoniae TW-183
ucacagcauuuucucu

SEQ ID NO: 2573192 - RNA, 22 nt, Chlamydophila pneumoniae TW-183
ucacagcauuuucucugagcag

SEQ ID NO: 2573193 - RNA, 14 nt, Chlamydophila pneumoniae TW-183
ucacagucuuaaau

SEQ ID NO: 2573194 - RNA, 20 nt, Chlamydophila pneumoniae TW-183
ucaccagaagcaacuaaacu

SEQ ID NO: 2573195 - RNA, 15 nt, Chlamydophila pneumoniae TW-183
ucaccagaagcauug

SEQ ID NO: 2573196 - RNA, 14 nt, Chlamydophila pneumoniae TW-183
ucaccugagcuaua

SEQ ID NO: 2573197 - RNA, 13 nt, Chlamydophila pneumoniae TW-183
ucaccuuacaucc

SEQ ID NO: 2573198 - RNA, 22 nt, Chlamydophila pneumoniae TW-183
ucaccuuacauccaauuuuguu

SEQ ID NO: 2573199 - RNA, 13 nt, Chlamydophila pneumoniae TW-183
ucacucuuuuauu

SEQ ID NO: 2573200 - RNA, 15 nt, Chlamydophila pneumoniae TW-183
ucacuuacagauaag

SEQ ID NO: 2573201 - RNA, 13 nt, Chlamydophila pneumoniae TW-183
ucagagagaacag

SEQ ID NO: 2573202 - RNA, 18 nt, Chlamydophila pneumoniae TW-183
ucagagauugccaggaga

SEQ ID NO: 2573203 - RNA, 19 nt, Chlamydophila pneumoniae TW-183
ucagagauugccaggagag

SEQ ID NO: 2573204 - RNA, 15 nt, Chlamydophila pneumoniae TW-183
ucagaggcuagaaaa

SEQ ID NO: 2573205 - RNA, 14 nt, Chlamydophila pneumoniae TW-183
ucagauuagaguua

SEQ ID NO: 2573206 - RNA, 17 nt, Chlamydophila pneumoniae TW-183
ucagcaacgaguccuua

SEQ ID NO: 2573207 - RNA, 16 nt, Chlamydophila pneumoniae TW-183
ucagcccacuguuuug

SEQ ID NO: 2573208 - RNA, 20 nt, Chlamydophila pneumoniae TW-183
ucagcccacuguuuugcuuc

SEQ ID NO: 2573209 - RNA, 15 nt, Chlamydophila pneumoniae TW-183
ucagcuucuacagca

SEQ ID NO: 2573210 - RNA, 18 nt, Chlamydophila pneumoniae TW-183
ucagcuucuacagcaucg

SEQ ID NO: 2573211 - RNA, 14 nt, Chlamydophila pneumoniae TW-183
ucagcuucuugaug

SEQ ID NO: 2573212 - RNA, 19 nt, Chlamydophila pneumoniae TW-183
ucagcuucuugauguacag

SEQ ID NO: 2573213 - RNA, 23 nt, Chlamydophila pneumoniae TW-183
ucaggcauucuucauuguagagg

SEQ ID NO: 2573214 - RNA, 21 nt, Chlamydophila pneumoniae TW-183
ucagggagcggaauuucucau

SEQ ID NO: 2573215 - RNA, 18 nt, Chlamydophila pneumoniae TW-183
ucaggucugcugaggaga

SEQ ID NO: 2573216 - RNA, 15 nt, Chlamydophila pneumoniae TW-183
ucaguuaaagagcau

SEQ ID NO: 2573217 - RNA, 14 nt, Chlamydophila pneumoniae TW-183
ucauaaagaggaau

SEQ ID NO: 2573218 - RNA, 15 nt, Chlamydophila pneumoniae TW-183
ucauaaccaaaagaa

SEQ ID NO: 2573219 - RNA, 12 nt, Chlamydophila pneumoniae TW-183
ucauaagaaauu

SEQ ID NO: 2573220 - RNA, 13 nt, Chlamydophila pneumoniae TW-183
ucauaagaaauuc

SEQ ID NO: 2573221 - RNA, 19 nt, Chlamydophila pneumoniae TW-183
ucauauuuuucuugaaggu

SEQ ID NO: 2573222 - RNA, 15 nt, Chlamydophila pneumoniae TW-183
ucaucaauaaagaua

SEQ ID NO: 2573223 - RNA, 17 nt, Chlamydophila pneumoniae TW-183
ucaucaauaaagauagg

SEQ ID NO: 2573224 - RNA, 14 nt, Chlamydophila pneumoniae TW-183
ucaucaaugagaaa

SEQ ID NO: 2573225 - RNA, 15 nt, Chlamydophila pneumoniae TW-183
ucaucaaugagaaau

SEQ ID NO: 2573226 - RNA, 17 nt, Chlamydophila pneumoniae TW-183
ucaucaaugagaaauag

SEQ ID NO: 2573227 - RNA, 16 nt, Chlamydophila pneumoniae TW-183
ucaucagaagccacca

SEQ ID NO: 2573228 - RNA, 15 nt, Chlamydophila pneumoniae TW-183
ucaucagcaaaacuc

SEQ ID NO: 2573229 - RNA, 18 nt, Chlamydophila pneumoniae TW-183
ucaucagcaaaacucccg

SEQ ID NO: 2573230 - RNA, 18 nt, Chlamydophila pneumoniae TW-183
ucaucuacgauguuuucu

SEQ ID NO: 2573231 - RNA, 22 nt, Chlamydophila pneumoniae TW-183
ucaucugggaguuguaaaacuu

SEQ ID NO: 2573232 - RNA, 11 nt, Chlamydophila pneumoniae TW-183
ucaugaaagug

SEQ ID NO: 2573233 - RNA, 21 nt, Chlamydophila pneumoniae TW-183
ucaugcggacuuuauucucuu

SEQ ID NO: 2573234 - RNA, 14 nt, Chlamydophila pneumoniae TW-183
ucauuccagcaucu

SEQ ID NO: 2573235 - RNA, 18 nt, Chlamydophila pneumoniae TW-183
ucauuccagcaucuucuc

SEQ ID NO: 2573236 - RNA, 22 nt, Chlamydophila pneumoniae TW-183
uccaacagucugcuuuuuugau

SEQ ID NO: 2573237 - RNA, 18 nt, Chlamydophila pneumoniae TW-183
uccaaccucgagauccuc

SEQ ID NO: 2573238 - RNA, 21 nt, Chlamydophila pneumoniae TW-183
uccaacuaaaccuucaaugau

SEQ ID NO: 2573239 - RNA, 16 nt, Chlamydophila pneumoniae TW-183
uccaagaauagccaua

SEQ ID NO: 2573240 - RNA, 19 nt, Chlamydophila pneumoniae TW-183
uccaauccauucugagaaa

SEQ ID NO: 2573241 - RNA, 13 nt, Chlamydophila pneumoniae TW-183
uccaaucugcuga

SEQ ID NO: 2573242 - RNA, 21 nt, Chlamydophila pneumoniae TW-183
uccacagaucguaaucuguau

SEQ ID NO: 2573243 - RNA, 21 nt, Chlamydophila pneumoniae TW-183
uccacgaguucgcggaucuuc

SEQ ID NO: 2573244 - RNA, 15 nt, Chlamydophila pneumoniae TW-183
uccacugcuuuaggc

SEQ ID NO: 2573245 - RNA, 19 nt, Chlamydophila pneumoniae TW-183
uccagaaauacguccagcc

SEQ ID NO: 2573246 - RNA, 21 nt, Chlamydophila pneumoniae TW-183
uccagccugcaccagacccuc

SEQ ID NO: 2573247 - RNA, 17 nt, Chlamydophila pneumoniae TW-183
uccaguaucuucucuua

SEQ ID NO: 2573248 - RNA, 12 nt, Chlamydophila pneumoniae TW-183
uccauaaaaaua

SEQ ID NO: 2573249 - RNA, 15 nt, Chlamydophila pneumoniae TW-183
uccauagaguaucua

SEQ ID NO: 2573250 - RNA, 21 nt, Chlamydophila pneumoniae TW-183
uccauagaguaucuaaaacuu

SEQ ID NO: 2573251 - RNA, 17 nt, Chlamydophila pneumoniae TW-183
uccauaucuagaaguuu

SEQ ID NO: 2573252 - RNA, 14 nt, Chlamydophila pneumoniae TW-183
uccauauuacgcac

SEQ ID NO: 2573253 - RNA, 13 nt, Chlamydophila pneumoniae TW-183
uccaucucuuuaa

SEQ ID NO: 2573254 - RNA, 13 nt, Chlamydophila pneumoniae TW-183
uccauggaaagaa

SEQ ID NO: 2573255 - RNA, 17 nt, Chlamydophila pneumoniae TW-183
uccauucugagaaagaa

SEQ ID NO: 2573256 - RNA, 16 nt, Chlamydophila pneumoniae TW-183
ucccaauauccagaaa

SEQ ID NO: 2573257 - RNA, 18 nt, Chlamydophila pneumoniae TW-183
ucccaauauccagaaaua

SEQ ID NO: 2573258 - RNA, 18 nt, Chlamydophila pneumoniae TW-183
ucccagaagaaauuagag

SEQ ID NO: 2573259 - RNA, 18 nt, Chlamydophila pneumoniae TW-183
ucccagauuuuuuugguu

SEQ ID NO: 2573260 - RNA, 16 nt, Chlamydophila pneumoniae TW-183
ucccaucgucccuaaa

SEQ ID NO: 2573261 - RNA, 12 nt, Chlamydophila pneumoniae TW-183
ucccaugggaua

SEQ ID NO: 2573262 - RNA, 14 nt, Chlamydophila pneumoniae TW-183
uccccauucacaaa

SEQ ID NO: 2573263 - RNA, 18 nt, Chlamydophila pneumoniae TW-183
uccccauucacaaaucuu

SEQ ID NO: 2573264 - RNA, 11 nt, Chlamydophila pneumoniae TW-183
uccccuaaaaa

SEQ ID NO: 2573265 - RNA, 17 nt, Chlamydophila pneumoniae TW-183
ucccgagauaugaagag

SEQ ID NO: 2573266 - RNA, 21 nt, Chlamydophila pneumoniae TW-183
ucccgagggaugaugcccuga

SEQ ID NO: 2573267 - RNA, 20 nt, Chlamydophila pneumoniae TW-183
ucccuauaaagcaaaugccu

SEQ ID NO: 2573268 - RNA, 23 nt, Chlamydophila pneumoniae TW-183
ucccuauaaagcaaaugccugua

SEQ ID NO: 2573269 - RNA, 20 nt, Chlamydophila pneumoniae TW-183
ucccugauguugcccuacaa

SEQ ID NO: 2573270 - RNA, 23 nt, Chlamydophila pneumoniae TW-183
uccgaagacucaaagaacugcau

SEQ ID NO: 2573271 - RNA, 23 nt, Chlamydophila pneumoniae TW-183
uccgaucauuuuugcuagaucug

SEQ ID NO: 2573272 - RNA, 12 nt, Chlamydophila pneumoniae TW-183
uccguaaguaac

SEQ ID NO: 2573273 - RNA, 17 nt, Chlamydophila pneumoniae TW-183
uccguugaauuaauaaa

SEQ ID NO: 2573274 - RNA, 19 nt, Chlamydophila pneumoniae TW-183
uccuaagucguuaacauca

SEQ ID NO: 2573275 - RNA, 20 nt, Chlamydophila pneumoniae TW-183
uccuaagucguuaacaucaa

SEQ ID NO: 2573276 - RNA, 16 nt, Chlamydophila pneumoniae TW-183
uccuacuucugcagga

SEQ ID NO: 2573277 - RNA, 21 nt, Chlamydophila pneumoniae TW-183
uccuagagucgaguuucuagu

SEQ ID NO: 2573278 - RNA, 15 nt, Chlamydophila pneumoniae TW-183
uccuaugucaagaag

SEQ ID NO: 2573279 - RNA, 20 nt, Chlamydophila pneumoniae TW-183
uccuaugucaagaagugcuu

SEQ ID NO: 2573280 - RNA, 14 nt, Chlamydophila pneumoniae TW-183
uccuauuuuuuaag

SEQ ID NO: 2573281 - RNA, 15 nt, Chlamydophila pneumoniae TW-183
uccucaccgaucuca

SEQ ID NO: 2573282 - RNA, 13 nt, Chlamydophila pneumoniae TW-183
uccucaucagaag

SEQ ID NO: 2573283 - RNA, 14 nt, Chlamydophila pneumoniae TW-183
uccucaucagaagc

SEQ ID NO: 2573284 - RNA, 22 nt, Chlamydophila pneumoniae TW-183
uccuccauggaaagaaacaaau

SEQ ID NO: 2573285 - RNA, 16 nt, Chlamydophila pneumoniae TW-183
uccucgaauggagugc

SEQ ID NO: 2573286 - RNA, 21 nt, Chlamydophila pneumoniae TW-183
uccucuaaggacaaaucuccc

SEQ ID NO: 2573287 - RNA, 22 nt, Chlamydophila pneumoniae TW-183
uccucuauauuuuuucccacaa

SEQ ID NO: 2573288 - RNA, 17 nt, Chlamydophila pneumoniae TW-183
uccugaaaaaagaagcu

SEQ ID NO: 2573289 - RNA, 16 nt, Chlamydophila pneumoniae TW-183
uccugacacaacucuu

SEQ ID NO: 2573290 - RNA, 19 nt, Chlamydophila pneumoniae TW-183
uccugaggcuauagaauac

SEQ ID NO: 2573291 - RNA, 17 nt, Chlamydophila pneumoniae TW-183
uccuggaacaguauaau

SEQ ID NO: 2573292 - RNA, 13 nt, Chlamydophila pneumoniae TW-183
uccuguagccacu

SEQ ID NO: 2573293 - RNA, 22 nt, Chlamydophila pneumoniae TW-183
uccuuaacaacaucacuuauau

SEQ ID NO: 2573294 - RNA, 22 nt, Chlamydophila pneumoniae TW-183
uccuuaaugguagcuuaagaau

SEQ ID NO: 2573295 - RNA, 14 nt, Chlamydophila pneumoniae TW-183
uccuuacucccaug

SEQ ID NO: 2573296 - RNA, 15 nt, Chlamydophila pneumoniae TW-183
uccuucuuucugcuc

SEQ ID NO: 2573297 - RNA, 21 nt, Chlamydophila pneumoniae TW-183
uccuucuuucugcucuucuau

SEQ ID NO: 2573298 - RNA, 18 nt, Chlamydophila pneumoniae TW-183
uccuugauaaaacgcuau

SEQ ID NO: 2573299 - RNA, 19 nt, Chlamydophila pneumoniae TW-183
uccuugcaaaacagcauca

SEQ ID NO: 2573300 - RNA, 17 nt, Chlamydophila pneumoniae TW-183
uccuugcagcccugcau

SEQ ID NO: 2573301 - RNA, 16 nt, Chlamydophila pneumoniae TW-183
ucgaaacacucaugaa

SEQ ID NO: 2573302 - RNA, 19 nt, Chlamydophila pneumoniae TW-183
ucgaaacucuuugaggaua

SEQ ID NO: 2573303 - RNA, 16 nt, Chlamydophila pneumoniae TW-183
ucgacaaccaaaacag

SEQ ID NO: 2573304 - RNA, 20 nt, Chlamydophila pneumoniae TW-183
ucgacaugcaggccaacucu

SEQ ID NO: 2573305 - RNA, 15 nt, Chlamydophila pneumoniae TW-183
ucgagagaagaaauu

SEQ ID NO: 2573306 - RNA, 17 nt, Chlamydophila pneumoniae TW-183
ucgagagaagaaauucu

SEQ ID NO: 2573307 - RNA, 19 nt, Chlamydophila pneumoniae TW-183
ucgagcagaaacuccaaaa

SEQ ID NO: 2573308 - RNA, 21 nt, Chlamydophila pneumoniae TW-183
ucgagcagaaacuccaaaaua

SEQ ID NO: 2573309 - RNA, 15 nt, Chlamydophila pneumoniae TW-183
ucgagcagaaaugau

SEQ ID NO: 2573310 - RNA, 16 nt, Chlamydophila pneumoniae TW-183
ucgauacgguuuuuau

SEQ ID NO: 2573311 - RNA, 14 nt, Chlamydophila pneumoniae TW-183
gaguccuucuuuuc

SEQ ID NO: 2573312 - RNA, 22 nt, Chlamydophila pneumoniae TW-183
gagucgaaacacucaugaaagu

SEQ ID NO: 2573313 - RNA, 17 nt, Chlamydophila pneumoniae TW-183
gagucucuggaguuuga

SEQ ID NO: 2573314 - RNA, 13 nt, Chlamydophila pneumoniae TW-183
gagugacucauca

SEQ ID NO: 2573315 - RNA, 12 nt, Chlamydophila pneumoniae TW-183
gaguguuuucug

SEQ ID NO: 2573316 - RNA, 17 nt, Chlamydophila pneumoniae TW-183
gaguucucucuucacuc

SEQ ID NO: 2573317 - RNA, 14 nt, Chlamydophila pneumoniae TW-183
gaguucuugauucu

SEQ ID NO: 2573318 - RNA, 17 nt, Chlamydophila pneumoniae TW-183
gaguucuuguaauaaaa

SEQ ID NO: 2573319 - RNA, 18 nt, Chlamydophila pneumoniae TW-183
gaguucuuguaauaaaag

SEQ ID NO: 2573320 - RNA, 22 nt, Chlamydophila pneumoniae TW-183
gaguugccaggaaacguucuuu

SEQ ID NO: 2573321 - RNA, 13 nt, Chlamydophila pneumoniae TW-183
gaguuuuacauca

SEQ ID NO: 2573322 - RNA, 13 nt, Chlamydophila pneumoniae TW-183
gaguuuuuuucuu

SEQ ID NO: 2573323 - RNA, 22 nt, Chlamydophila pneumoniae TW-183
gaguuuuuuucuuauagggaau

SEQ ID NO: 2573324 - RNA, 19 nt, Chlamydophila pneumoniae TW-183
gauaaaacgcuauuguuug

SEQ ID NO: 2573325 - RNA, 19 nt, Chlamydophila pneumoniae TW-183
gauaaagacaucucuuuaa

SEQ ID NO: 2573326 - RNA, 13 nt, Chlamydophila pneumoniae TW-183
gauaagauaaaga

SEQ ID NO: 2573327 - RNA, 15 nt, Chlamydophila pneumoniae TW-183
gauaagauaaagaau

SEQ ID NO: 2573328 - RNA, 17 nt, Chlamydophila pneumoniae TW-183
gauaaggaagagaguuu

SEQ ID NO: 2573329 - RNA, 17 nt, Chlamydophila pneumoniae TW-183
gauagcucuuugauuuu

SEQ ID NO: 2573330 - RNA, 15 nt, Chlamydophila pneumoniae TW-183
gauagcugaugcuga

SEQ ID NO: 2573331 - RNA, 21 nt, Chlamydophila pneumoniae TW-183
gauaggaaccacuuuagaauu

SEQ ID NO: 2573332 - RNA, 15 nt, Chlamydophila pneumoniae TW-183
gauaucgaccuuaaa

SEQ ID NO: 2573333 - RNA, 15 nt, Chlamydophila pneumoniae TW-183
gauaugaagagacgu

SEQ ID NO: 2573334 - RNA, 14 nt, Chlamydophila pneumoniae TW-183
gauauugcggaaau

SEQ ID NO: 2573335 - RNA, 13 nt, Chlamydophila pneumoniae TW-183
gauauugucaaga

SEQ ID NO: 2573336 - RNA, 17 nt, Chlamydophila pneumoniae TW-183
gaucacauagaaaacau

SEQ ID NO: 2573337 - RNA, 17 nt, Chlamydophila pneumoniae TW-183
gaucagaaaaaaugcgu

SEQ ID NO: 2573338 - RNA, 21 nt, Chlamydophila pneumoniae TW-183
gaucaucuacgauguuuucuu

SEQ ID NO: 2573339 - RNA, 16 nt, Chlamydophila pneumoniae TW-183
gaucauuuuugcuaga

SEQ ID NO: 2573340 - RNA, 19 nt, Chlamydophila pneumoniae TW-183
gauccaucggcauuucucc

SEQ ID NO: 2573341 - RNA, 23 nt, Chlamydophila pneumoniae TW-183
gaucccuguaguuucuaaaacag

SEQ ID NO: 2573342 - RNA, 22 nt, Chlamydophila pneumoniae TW-183
gaucgauuaccuaaaacaaaau

SEQ ID NO: 2573343 - RNA, 18 nt, Chlamydophila pneumoniae TW-183
gaucgggucuacaacagu

SEQ ID NO: 2573344 - RNA, 17 nt, Chlamydophila pneumoniae TW-183
gaucgucaguaaaacac

SEQ ID NO: 2573345 - RNA, 13 nt, Chlamydophila pneumoniae TW-183
gaucuauguagau

SEQ ID NO: 2573346 - RNA, 18 nt, Chlamydophila pneumoniae TW-183
gcuaaucaauccaagaau

SEQ ID NO: 2573347 - RNA, 16 nt, Chlamydophila pneumoniae TW-183
gcuacaaaauuauuaa

SEQ ID NO: 2573348 - RNA, 20 nt, Chlamydophila pneumoniae TW-183
gcuaccuuaguuuuuucuaa

SEQ ID NO: 2573349 - RNA, 12 nt, Chlamydophila pneumoniae TW-183
gcuagguagugu

SEQ ID NO: 2573350 - RNA, 12 nt, Chlamydophila pneumoniae TW-183
gcuagucuuucu

SEQ ID NO: 2573351 - RNA, 18 nt, Chlamydophila pneumoniae TW-183
gcuauaccuauauagaga

SEQ ID NO: 2573352 - RNA, 18 nt, Chlamydophila pneumoniae TW-183
gcuauagauacuuugcaa

SEQ ID NO: 2573353 - RNA, 21 nt, Chlamydophila pneumoniae TW-183
gcuauagauacuuugcaauac

SEQ ID NO: 2573354 - RNA, 19 nt, Chlamydophila pneumoniae TW-183
gcuaucaaccauaaagaau

SEQ ID NO: 2573355 - RNA, 20 nt, Chlamydophila pneumoniae TW-183
gcucaaaucucauuccagca

SEQ ID NO: 2573356 - RNA, 14 nt, Chlamydophila pneumoniae TW-183
gcuccuugacuaaa

SEQ ID NO: 2573357 - RNA, 15 nt, Chlamydophila pneumoniae TW-183
gcucguauugauauu

SEQ ID NO: 2573358 - RNA, 18 nt, Chlamydophila pneumoniae TW-183
gcucuaagcugugcauuu

SEQ ID NO: 2573359 - RNA, 22 nt, Chlamydophila pneumoniae TW-183
gcucuacaagcucgguacgucu

SEQ ID NO: 2573360 - RNA, 17 nt, Chlamydophila pneumoniae TW-183
gcucuagcuaacauaaa

SEQ ID NO: 2573361 - RNA, 17 nt, Chlamydophila pneumoniae TW-183
gcucuauaaauuucuca

SEQ ID NO: 2573362 - RNA, 19 nt, Chlamydophila pneumoniae TW-183
gcucucuagcaccuaauaa

SEQ ID NO: 2573363 - RNA, 15 nt, Chlamydophila pneumoniae TW-183
gcucucuccaugagc

SEQ ID NO: 2573364 - RNA, 15 nt, Chlamydophila pneumoniae TW-183
gcucuucuuucucua

SEQ ID NO: 2573365 - RNA, 16 nt, Chlamydophila pneumoniae TW-183
gcucuuugauuuucuu

SEQ ID NO: 2573366 - RNA, 18 nt, Chlamydophila pneumoniae TW-183
gcucuuugauuuucuuag

SEQ ID NO: 2573367 - RNA, 20 nt, Chlamydophila pneumoniae TW-183
gcucuuugggauaaaaaguu

SEQ ID NO: 2573368 - RNA, 23 nt, Chlamydophila pneumoniae TW-183
gcucuuugggauaaaaaguuuuu

SEQ ID NO: 2573369 - RNA, 11 nt, Chlamydophila pneumoniae TW-183
gcugaagauuu

SEQ ID NO: 2573370 - RNA, 16 nt, Chlamydophila pneumoniae TW-183
gcugaagauuuuuucu

SEQ ID NO: 2573371 - RNA, 17 nt, Chlamydophila pneumoniae TW-183
gcugaagauuuuuucuu

SEQ ID NO: 2573372 - RNA, 14 nt, Chlamydophila pneumoniae TW-183
gcugauucucccaa

SEQ ID NO: 2573373 - RNA, 14 nt, Chlamydophila pneumoniae TW-183
gcugauuucuuuuu

SEQ ID NO: 2573374 - RNA, 22 nt, Chlamydophila pneumoniae TW-183
gcugauuucuuuuucagcuucu

SEQ ID NO: 2573375 - RNA, 22 nt, Chlamydophila pneumoniae TW-183
gcugcaaucucaaaaucaaaua

SEQ ID NO: 2573376 - RNA, 13 nt, Chlamydophila pneumoniae TW-183
gcugcuucagaaa

SEQ ID NO: 2573377 - RNA, 19 nt, Chlamydophila pneumoniae TW-183
gcugcuuuuguuguuuuug

SEQ ID NO: 2573378 - RNA, 13 nt, Chlamydophila pneumoniae TW-183
gcugugcauuuuc

SEQ ID NO: 2573379 - RNA, 19 nt, Chlamydophila pneumoniae TW-183
gcugugcauuuucuucuug

SEQ ID NO: 2573380 - RNA, 13 nt, Chlamydophila pneumoniae TW-183
gcuguuccaagag

SEQ ID NO: 2573381 - RNA, 13 nt, Chlamydophila pneumoniae TW-183
gcuguuuuuucac

SEQ ID NO: 2573382 - RNA, 11 nt, Chlamydophila pneumoniae TW-183
gcuuagcaacc

SEQ ID NO: 2573383 - RNA, 13 nt, Chlamydophila pneumoniae TW-183
gcuucgcaaucuu

SEQ ID NO: 2573384 - RNA, 16 nt, Chlamydophila pneumoniae TW-183
gcuucgcaaucuuuga

SEQ ID NO: 2573385 - RNA, 16 nt, Chlamydophila pneumoniae TW-183
gcuucuacagcaucgg

SEQ ID NO: 2573386 - RNA, 23 nt, Chlamydophila pneumoniae TW-183
gcuugcugauuucuuuuucagcu

SEQ ID NO: 2573387 - RNA, 20 nt, Chlamydophila pneumoniae TW-183
gcuuuccagggcauucucua

SEQ ID NO: 2573388 - RNA, 16 nt, Chlamydophila pneumoniae TW-183
gcuuugcgcuuguucu

SEQ ID NO: 2573389 - RNA, 22 nt, Chlamydophila pneumoniae TW-183
gcuuuuagagguuuuuguaucu

SEQ ID NO: 2573390 - RNA, 18 nt, Chlamydophila pneumoniae TW-183
gcuuuuguuuuguauuua

SEQ ID NO: 2573391 - RNA, 16 nt, Chlamydophila pneumoniae TW-183
ggaaacguucuuucaa

SEQ ID NO: 2573392 - RNA, 14 nt, Chlamydophila pneumoniae TW-183
ggaacaguauaauc

SEQ ID NO: 2573393 - RNA, 14 nt, Chlamydophila pneumoniae TW-183
ggaacgcucucuag

SEQ ID NO: 2573394 - RNA, 20 nt, Chlamydophila pneumoniae TW-183
ggaagaugaauaccagaagc

SEQ ID NO: 2573395 - RNA, 16 nt, Chlamydophila pneumoniae TW-183
ggaagcuuaucaagaa

SEQ ID NO: 2573396 - RNA, 21 nt, Chlamydophila pneumoniae TW-183
ggaagcuuaucaagaagcuga

SEQ ID NO: 2573397 - RNA, 15 nt, Chlamydophila pneumoniae TW-183
ggaaucccuuuuuaa

SEQ ID NO: 2573398 - RNA, 17 nt, Chlamydophila pneumoniae TW-183
ggaaucucgggagaaca

SEQ ID NO: 2573399 - RNA, 20 nt, Chlamydophila pneumoniae TW-183
ggaaucucgggagaacaugc

SEQ ID NO: 2573400 - RNA, 19 nt, Chlamydophila pneumoniae TW-183
ggaauggcuuuuguuuugu

SEQ ID NO: 2573401 - RNA, 14 nt, Chlamydophila pneumoniae TW-183
ggacaaaucuccca

SEQ ID NO: 2573402 - RNA, 13 nt, Chlamydophila pneumoniae TW-183
ggacaacagcaac

SEQ ID NO: 2573403 - RNA, 14 nt, Chlamydophila pneumoniae TW-183
ggacaauauagaga

SEQ ID NO: 2573404 - RNA, 14 nt, Chlamydophila pneumoniae TW-183
ggacacuagaauac

SEQ ID NO: 2573405 - RNA, 18 nt, Chlamydophila pneumoniae TW-183
ggacgcuaauccuccucg

SEQ ID NO: 2573406 - RNA, 14 nt, Chlamydophila pneumoniae TW-183
ggagaauagcaagc

SEQ ID NO: 2573407 - RNA, 19 nt, Chlamydophila pneumoniae TW-183
ggagaccuuuauagauaug

SEQ ID NO: 2573408 - RNA, 21 nt, Chlamydophila pneumoniae TW-183
ggagaccuuuauagauaugcc

SEQ ID NO: 2573409 - RNA, 13 nt, Chlamydophila pneumoniae TW-183
ggagagggaagga

SEQ ID NO: 2573410 - RNA, 20 nt, Chlamydophila pneumoniae TW-183
ggagauccugaaaaaagaag

SEQ ID NO: 2573411 - RNA, 22 nt, Chlamydophila pneumoniae TW-183
ggagcgaaguuuuucuggaaga

SEQ ID NO: 2573412 - RNA, 18 nt, Chlamydophila pneumoniae TW-183
ggagucucuggaguuuga

SEQ ID NO: 2573413 - RNA, 18 nt, Chlamydophila pneumoniae TW-183
ggaguucuugauucucuu

SEQ ID NO: 2573414 - RNA, 14 nt, Chlamydophila pneumoniae TW-183
ggaguuuuccuaaa

SEQ ID NO: 2573415 - RNA, 15 nt, Chlamydophila pneumoniae TW-183
ggauaaguucuucca

SEQ ID NO: 2573416 - RNA, 17 nt, Chlamydophila pneumoniae TW-183
ggauaggcaagauuaug

SEQ ID NO: 2573417 - RNA, 17 nt, Chlamydophila pneumoniae TW-183
ggaucacagucuuaaau

SEQ ID NO: 2573418 - RNA, 18 nt, Chlamydophila pneumoniae TW-183
ggaucuucagagagaaca

SEQ ID NO: 2573419 - RNA, 23 nt, Chlamydophila pneumoniae TW-183
ggaucuucuucuggcugagagaa

SEQ ID NO: 2573420 - RNA, 18 nt, Chlamydophila pneumoniae TW-183
ggauggacuacugaaaca

SEQ ID NO: 2573421 - RNA, 14 nt, Chlamydophila pneumoniae TW-183
ggauguugcguuag

SEQ ID NO: 2573422 - RNA, 15 nt, Chlamydophila pneumoniae TW-183
ggcaacaagagcgca

SEQ ID NO: 2573423 - RNA, 13 nt, Chlamydophila pneumoniae TW-183
ggcaauagcuuug

SEQ ID NO: 2573424 - RNA, 20 nt, Chlamydophila pneumoniae TW-183
ggcaauagcuuugaagagca

SEQ ID NO: 2573425 - RNA, 15 nt, Chlamydophila pneumoniae TW-183
ggcauguuuaauauc

SEQ ID NO: 2573426 - RNA, 14 nt, Chlamydophila pneumoniae TW-183
ggccccuggaauuu

SEQ ID NO: 2573427 - RNA, 18 nt, Chlamydophila pneumoniae TW-183
ggcuauagaauacacagc

SEQ ID NO: 2573428 - RNA, 13 nt, Chlamydophila pneumoniae TW-183
ggcuauagauacu

SEQ ID NO: 2573429 - RNA, 12 nt, Chlamydophila pneumoniae TW-183
ggcuccagcaua

SEQ ID NO: 2573430 - RNA, 22 nt, Chlamydophila pneumoniae TW-183
ggcucuaggacccguagccccu

SEQ ID NO: 2573431 - RNA, 21 nt, Chlamydophila pneumoniae TW-183
ggcucucaaggucacagcauu

SEQ ID NO: 2573432 - RNA, 14 nt, Chlamydophila pneumoniae TW-183
ggcugagagaagca

SEQ ID NO: 2573433 - RNA, 19 nt, Chlamydophila pneumoniae TW-183
gggaagaaacuucucuagg

SEQ ID NO: 2573434 - RNA, 17 nt, Chlamydophila pneumoniae TW-183
gggaagacucucaucag

SEQ ID NO: 2573435 - RNA, 19 nt, Chlamydophila pneumoniae TW-183
gggauaggcaagauuauga

SEQ ID NO: 2573436 - RNA, 14 nt, Chlamydophila pneumoniae TW-183
gggaucacagucuu

SEQ ID NO: 2573437 - RNA, 15 nt, Chlamydophila pneumoniae TW-183
gggcaggggauaggc

SEQ ID NO: 2573438 - RNA, 14 nt, Chlamydophila pneumoniae TW-183
gggcauucucuaaa

SEQ ID NO: 2573439 - RNA, 18 nt, Chlamydophila pneumoniae TW-183
gggccuaucucuaugagg

SEQ ID NO: 2573440 - RNA, 22 nt, Chlamydophila pneumoniae TW-183
ggggaucuuaggaaauuuggau

SEQ ID NO: 2573441 - RNA, 12 nt, Chlamydophila pneumoniae TW-183
ggguuucccugu

SEQ ID NO: 2573442 - RNA, 14 nt, Chlamydophila pneumoniae TW-183
gguaaaacuacagg

SEQ ID NO: 2573443 - RNA, 14 nt, Chlamydophila pneumoniae TW-183
gguagcuuaagaau

SEQ ID NO: 2573444 - RNA, 18 nt, Chlamydophila pneumoniae TW-183
guuuguaguguugaauaa

SEQ ID NO: 2573445 - RNA, 21 nt, Chlamydophila pneumoniae TW-183
guuuguaguguugaauaagau

SEQ ID NO: 2573446 - RNA, 12 nt, Chlamydophila pneumoniae TW-183
guuuucuuaucc

SEQ ID NO: 2573447 - RNA, 12 nt, Chlamydophila pneumoniae TW-183
guuuucuuuucu

SEQ ID NO: 2573448 - RNA, 22 nt, Chlamydophila pneumoniae TW-183
guuuugauuuugcagugauaaa

SEQ ID NO: 2573449 - RNA, 15 nt, Chlamydophila pneumoniae TW-183
guuuuuaucccagau

SEQ ID NO: 2573450 - RNA, 16 nt, Chlamydophila pneumoniae TW-183
uaaaaaaacccucaaa

SEQ ID NO: 2573451 - RNA, 19 nt, Chlamydophila pneumoniae TW-183
uaaaaaaacccucaaagaa

SEQ ID NO: 2573452 - RNA, 18 nt, Chlamydophila pneumoniae TW-183
uaaaaaaagcuagucuuu

SEQ ID NO: 2573453 - RNA, 20 nt, Chlamydophila pneumoniae TW-183
uaaaaaguuuuuguucaucc

SEQ ID NO: 2573454 - RNA, 22 nt, Chlamydophila pneumoniae TW-183
uaaaaauggcacuugagcacau

SEQ ID NO: 2573455 - RNA, 21 nt, Chlamydophila pneumoniae TW-183
uaaaacaaaaucaaaaacugg

SEQ ID NO: 2573456 - RNA, 16 nt, Chlamydophila pneumoniae TW-183
uaaaacacaaauagca

SEQ ID NO: 2573457 - RNA, 13 nt, Chlamydophila pneumoniae TW-183
uaaaacagaaauu

SEQ ID NO: 2573458 - RNA, 20 nt, Chlamydophila pneumoniae TW-183
uaaaagaacauuaagaggaa

SEQ ID NO: 2573459 - RNA, 21 nt, Chlamydophila pneumoniae TW-183
uaaaagaacauuaagaggaaa

SEQ ID NO: 2573460 - RNA, 16 nt, Chlamydophila pneumoniae TW-183
uaaaaguuagguagau

SEQ ID NO: 2573461 - RNA, 21 nt, Chlamydophila pneumoniae TW-183
uaaaaguuagguagauagaaa

SEQ ID NO: 2573462 - RNA, 23 nt, Chlamydophila pneumoniae TW-183
uaaaaguuagguagauagaaauu

SEQ ID NO: 2573463 - RNA, 23 nt, Chlamydophila pneumoniae TW-183
uaaaaguuuuuuauuuucuggug

SEQ ID NO: 2573464 - RNA, 12 nt, Chlamydophila pneumoniae TW-183
uaaaauaagaaa

SEQ ID NO: 2573465 - RNA, 13 nt, Chlamydophila pneumoniae TW-183
uaaaauagcccua

SEQ ID NO: 2573466 - RNA, 14 nt, Chlamydophila pneumoniae TW-183
uaaacaauuucaau

SEQ ID NO: 2573467 - RNA, 14 nt, Chlamydophila pneumoniae TW-183
uaaacucuccaaaa

SEQ ID NO: 2573468 - RNA, 19 nt, Chlamydophila pneumoniae TW-183
uaaacucuccaaaagcucu

SEQ ID NO: 2573469 - RNA, 14 nt, Chlamydophila pneumoniae TW-183
uaaagaaauucugg

SEQ ID NO: 2573470 - RNA, 15 nt, Chlamydophila pneumoniae TW-183
uaaagacaucucuuu

SEQ ID NO: 2573471 - RNA, 17 nt, Chlamydophila pneumoniae TW-183
uaaagacaucucuuuaa

SEQ ID NO: 2573472 - RNA, 18 nt, Chlamydophila pneumoniae TW-183
uaaagagaaucuccucau

SEQ ID NO: 2573473 - RNA, 13 nt, Chlamydophila pneumoniae TW-183
uaaagagcauccu

SEQ ID NO: 2573474 - RNA, 15 nt, Chlamydophila pneumoniae TW-183
uaaagaguagcccca

SEQ ID NO: 2573475 - RNA, 19 nt, Chlamydophila pneumoniae TW-183
uaaagauguagaauaacgc

SEQ ID NO: 2573476 - RNA, 22 nt, Chlamydophila pneumoniae TW-183
uaaaggaccuguuuucuuuucu

SEQ ID NO: 2573477 - RNA, 13 nt, Chlamydophila pneumoniae TW-183
uaaaguaggaauu

SEQ ID NO: 2573478 - RNA, 18 nt, Chlamydophila pneumoniae TW-183
uaaagugucauacgcagc

SEQ ID NO: 2573479 - RNA, 19 nt, Chlamydophila pneumoniae TW-183
uaaagugucauacgcagca

SEQ ID NO: 2573480 - RNA, 19 nt, Chlamydophila pneumoniae TW-183
uaaaguuugagcuaagcug

SEQ ID NO: 2573481 - RNA, 23 nt, Chlamydophila pneumoniae TW-183
uaaauagaaaacauagagauucu

SEQ ID NO: 2573482 - RNA, 20 nt, Chlamydophila pneumoniae TW-183
uaaaucaacuacaucuccaa

SEQ ID NO: 2573483 - RNA, 19 nt, Chlamydophila pneumoniae TW-183
uaaauccaccaaugauaau

SEQ ID NO: 2573484 - RNA, 14 nt, Chlamydophila pneumoniae TW-183
uaaauuuuuccuuc

SEQ ID NO: 2573485 - RNA, 14 nt, Chlamydophila pneumoniae TW-183
uaacaaaguuuaug

SEQ ID NO: 2573486 - RNA, 14 nt, Chlamydophila pneumoniae TW-183
uaacaacuucacau

SEQ ID NO: 2573487 - RNA, 22 nt, Chlamydophila pneumoniae TW-183
uaacaaguaccaagaaaauagu

SEQ ID NO: 2573488 - RNA, 13 nt, Chlamydophila pneumoniae TW-183
uaacauaaaguca

SEQ ID NO: 2573489 - RNA, 20 nt, Chlamydophila pneumoniae TW-183
uaaccaaaagaauuaagaag

SEQ ID NO: 2573490 - RNA, 23 nt, Chlamydophila pneumoniae TW-183
uaaccaaaagaauuaagaagaag

SEQ ID NO: 2573491 - RNA, 13 nt, Chlamydophila pneumoniae TW-183
uaaccuccucuuc

SEQ ID NO: 2573492 - RNA, 19 nt, Chlamydophila pneumoniae TW-183
uaacgaagugaggagaaua

SEQ ID NO: 2573493 - RNA, 20 nt, Chlamydophila pneumoniae TW-183
uaacgaagugaggagaauag

SEQ ID NO: 2573494 - RNA, 22 nt, Chlamydophila pneumoniae TW-183
uaacgaagugaggagaauagca

SEQ ID NO: 2573495 - RNA, 14 nt, Chlamydophila pneumoniae TW-183
uaacgccaacacgc

SEQ ID NO: 2573496 - RNA, 14 nt, Chlamydophila pneumoniae TW-183
uaacguugccuguu

SEQ ID NO: 2573497 - RNA, 16 nt, Chlamydophila pneumoniae TW-183
uaacugaggcaaagau

SEQ ID NO: 2573498 - RNA, 21 nt, Chlamydophila pneumoniae TW-183
uaacuugcauuuuuuggaaua

SEQ ID NO: 2573499 - RNA, 18 nt, Chlamydophila pneumoniae TW-183
uaacuuggugagcagcuu

SEQ ID NO: 2573500 - RNA, 22 nt, Chlamydophila pneumoniae TW-183
uaacuuggugagcagcuuuauc

SEQ ID NO: 2573501 - RNA, 19 nt, Chlamydophila pneumoniae TW-183
uaagaagacuagcuuuuca

SEQ ID NO: 2573502 - RNA, 20 nt, Chlamydophila pneumoniae TW-183
uaagaauguagcuguuccaa

SEQ ID NO: 2573503 - RNA, 22 nt, Chlamydophila pneumoniae TW-183
uaagacaagguggguagccagg

SEQ ID NO: 2573504 - RNA, 19 nt, Chlamydophila pneumoniae TW-183
uaagacaauaaaauagccc

SEQ ID NO: 2573505 - RNA, 16 nt, Chlamydophila pneumoniae TW-183
uaagacgugcaucgcu

SEQ ID NO: 2573506 - RNA, 16 nt, Chlamydophila pneumoniae TW-183
uaagacuucuggaagc

SEQ ID NO: 2573507 - RNA, 12 nt, Chlamydophila pneumoniae TW-183
uaagaggaaagc

SEQ ID NO: 2573508 - RNA, 20 nt, Chlamydophila pneumoniae TW-183
uaagauaucgaccuuaaaau

SEQ ID NO: 2573509 - RNA, 12 nt, Chlamydophila pneumoniae TW-183
uaagauuuugaa

SEQ ID NO: 2573510 - RNA, 15 nt, Chlamydophila pneumoniae TW-183
uaagcgcucuucaau

SEQ ID NO: 2573511 - RNA, 17 nt, Chlamydophila pneumoniae TW-183
uaagcucauaagaaauu

SEQ ID NO: 2573512 - RNA, 19 nt, Chlamydophila pneumoniae TW-183
uaagcuggauucugucuau

SEQ ID NO: 2573513 - RNA, 20 nt, Chlamydophila pneumoniae TW-183
uaagcuggauucugucuaua

SEQ ID NO: 2573514 - RNA, 17 nt, Chlamydophila pneumoniae TW-183
uaaggaaauuacaaucu

SEQ ID NO: 2573515 - RNA, 23 nt, Chlamydophila pneumoniae TW-183
uaaggaagaauuucgucuucaua

SEQ ID NO: 2573516 - RNA, 16 nt, Chlamydophila pneumoniae TW-183
uaaggaagagaguuuu

SEQ ID NO: 2573517 - RNA, 15 nt, Chlamydophila pneumoniae TW-183
uaaggacaaaucucc

SEQ ID NO: 2573518 - RNA, 18 nt, Chlamydophila pneumoniae TW-183
uaaggacaaaucucccaa

SEQ ID NO: 2573519 - RNA, 22 nt, Chlamydophila pneumoniae TW-183
uaagggggaucuucagagagaa

SEQ ID NO: 2573520 - RNA, 19 nt, Chlamydophila pneumoniae TW-183
uaaguccuucuucccagcc

SEQ ID NO: 2573521 - RNA, 15 nt, Chlamydophila pneumoniae TW-183
uaaguucuuaagaau

SEQ ID NO: 2573522 - RNA, 16 nt, Chlamydophila pneumoniae TW-183
uaaguucuugauuuuc

SEQ ID NO: 2573523 - RNA, 17 nt, Chlamydophila pneumoniae TW-183
uaaguugguccaucgag

SEQ ID NO: 2573524 - RNA, 15 nt, Chlamydophila pneumoniae TW-183
uaauaaaagaacauu

SEQ ID NO: 2573525 - RNA, 14 nt, Chlamydophila pneumoniae TW-183
uaauaaaagcaccc

SEQ ID NO: 2573526 - RNA, 17 nt, Chlamydophila pneumoniae TW-183
uaauacgucucaucgcu

SEQ ID NO: 2573527 - RNA, 19 nt, Chlamydophila pneumoniae TW-183
uaauauccauaagaucucu

SEQ ID NO: 2573528 - RNA, 21 nt, Chlamydophila pneumoniae TW-183
uaaucagaagugaucuugaga

SEQ ID NO: 2573529 - RNA, 21 nt, Chlamydophila pneumoniae TW-183
uaauccuucuuucugcucuuc

SEQ ID NO: 2573530 - RNA, 20 nt, Chlamydophila pneumoniae TW-183
uaaucgagagaagaaauucu

SEQ ID NO: 2573531 - RNA, 12 nt, Chlamydophila pneumoniae TW-183
uaaucucaccag

SEQ ID NO: 2573532 - RNA, 12 nt, Chlamydophila pneumoniae TW-183
uaaucuguauau

SEQ ID NO: 2573533 - RNA, 23 nt, Chlamydophila pneumoniae TW-183
uaaugccgagaauacagagucug

SEQ ID NO: 2573534 - RNA, 14 nt, Chlamydophila pneumoniae TW-183
uaauuacagaaucc

SEQ ID NO: 2573535 - RNA, 20 nt, Chlamydophila pneumoniae TW-183
uaauuucuaaauagaaaaca

SEQ ID NO: 2573536 - RNA, 22 nt, Chlamydophila pneumoniae TW-183
uaauuucuaaauagaaaacaua

SEQ ID NO: 2573537 - RNA, 16 nt, Chlamydophila pneumoniae TW-183
uacaaagauccuaaua

SEQ ID NO: 2573538 - RNA, 24 nt, Chlamydophila pneumoniae TW-183
uacaaauuaccuugagacaaagaa

SEQ ID NO: 2573539 - RNA, 14 nt, Chlamydophila pneumoniae TW-183
uacaagcuuagcaa

SEQ ID NO: 2573540 - RNA, 13 nt, Chlamydophila pneumoniae TW-183
uacaauaaacaac

SEQ ID NO: 2573541 - RNA, 22 nt, Coxiella burnetii RSA 493
aaaaaaacaucggaagaacgau

SEQ ID NO: 2573542 - RNA, 12 nt, Coxiella burnetii RSA 493
aaaaaaaucguu

SEQ ID NO: 2573543 - RNA, 20 nt, Coxiella burnetii RSA 493
aaaaaacgauugcuaaacca

SEQ ID NO: 2573544 - RNA, 11 nt, Coxiella burnetii RSA 493
aaaaaagaaaa

SEQ ID NO: 2573545 - RNA, 13 nt, Coxiella burnetii RSA 493
aaaaaagaaaaua

SEQ ID NO: 2573546 - RNA, 14 nt, Coxiella burnetii RSA 493
aaaaaagcggugga

SEQ ID NO: 2573547 - RNA, 15 nt, Coxiella burnetii RSA 493
aaaaaauaauuauag

SEQ ID NO: 2573548 - RNA, 18 nt, Coxiella burnetii RSA 493
aaaaaauagcgagaaaac

SEQ ID NO: 2573549 - RNA, 12 nt, Coxiella burnetii RSA 493
aaaaaauaguuu

SEQ ID NO: 2573550 - RNA, 22 nt, Coxiella burnetii RSA 493
aaaaaaucuuugcucuaaauua

SEQ ID NO: 2573551 - RNA, 10 nt, Coxiella burnetii RSA 493
aaaaaauucc

SEQ ID NO: 2573552 - RNA, 21 nt, Coxiella burnetii RSA 493
aaaaaauugggaguuguauaa

SEQ ID NO: 2573553 - RNA, 18 nt, Coxiella burnetii RSA 493
aaaaacaaaacaaacguu

SEQ ID NO: 2573554 - RNA, 21 nt, Coxiella burnetii RSA 493
aaaaacagauuuaaauagcuc

SEQ ID NO: 2573555 - RNA, 16 nt, Coxiella burnetii RSA 493
aaaaaccuucguaaga

SEQ ID NO: 2573556 - RNA, 15 nt, Coxiella burnetii RSA 493
aaaaacgccugaaau

SEQ ID NO: 2573557 - RNA, 13 nt, Coxiella burnetii RSA 493
aaaaacuagaaau

SEQ ID NO: 2573558 - RNA, 19 nt, Coxiella burnetii RSA 493
aaaaacuagaaauauuaga

SEQ ID NO: 2573559 - RNA, 20 nt, Coxiella burnetii RSA 493
aaaaacuucaugcaaaaauu

SEQ ID NO: 2573560 - RNA, 16 nt, Coxiella burnetii RSA 493
aaaaagauaaucccaa

SEQ ID NO: 2573561 - RNA, 13 nt, Coxiella burnetii RSA 493
aaaaagcaugauu

SEQ ID NO: 2573562 - RNA, 18 nt, Coxiella burnetii RSA 493
aaaaagcuagcgaaauuu

SEQ ID NO: 2573563 - RNA, 15 nt, Coxiella burnetii RSA 493
aaacaaguuaacaaa

SEQ ID NO: 2573564 - RNA, 13 nt, Coxiella burnetii RSA 493
aaacaaucaaugc

SEQ ID NO: 2573565 - RNA, 19 nt, Coxiella burnetii RSA 493
aaacaccgcccauuuccca

SEQ ID NO: 2573566 - RNA, 14 nt, Coxiella burnetii RSA 493
aaacagauuuaaau

SEQ ID NO: 2573567 - RNA, 15 nt, Coxiella burnetii RSA 493
aaacagauuuaaaua

SEQ ID NO: 2573568 - RNA, 18 nt, Coxiella burnetii RSA 493
aaacagauuuaaauagcu

SEQ ID NO: 2573569 - RNA, 20 nt, Coxiella burnetii RSA 493
aaacagcauuagcuucguuu

SEQ ID NO: 2573570 - RNA, 21 nt, Coxiella burnetii RSA 493
aaacaguauuggcggaugagu

SEQ ID NO: 2573571 - RNA, 17 nt, Coxiella burnetii RSA 493
aaacagugccccuccuc

SEQ ID NO: 2573572 - RNA, 20 nt, Coxiella burnetii RSA 493
aaacagugccccuccucuaa

SEQ ID NO: 2573573 - RNA, 14 nt, Coxiella burnetii RSA 493
aaacauaaaggcca

SEQ ID NO: 2573574 - RNA, 24 nt, Coxiella burnetii RSA 493
aaacauccgcucgucuugcacauu

SEQ ID NO: 2573575 - RNA, 13 nt, Coxiella burnetii RSA 493
aaacauccuccau

SEQ ID NO: 2573576 - RNA, 22 nt, Coxiella burnetii RSA 493
aaacauccuccauuacauaauu

SEQ ID NO: 2573577 - RNA, 15 nt, Coxiella burnetii RSA 493
aaacaugcgaaagca

SEQ ID NO: 2573578 - RNA, 20 nt, Coxiella burnetii RSA 493
aaaccaccgcucgcuugaaa

SEQ ID NO: 2573579 - RNA, 21 nt, Coxiella burnetii RSA 493
aaaccaccgcucgcuugaaaa

SEQ ID NO: 2573580 - RNA, 16 nt, Coxiella burnetii RSA 493
aaaccacuauuugcuu

SEQ ID NO: 2573581 - RNA, 16 nt, Coxiella burnetii RSA 493
aaaccauaaauggaua

SEQ ID NO: 2573582 - RNA, 11 nt, Coxiella burnetii RSA 493
aaaccauucaa

SEQ ID NO: 2573583 - RNA, 19 nt, Coxiella burnetii RSA 493
aaaccauucaaugcuaaau

SEQ ID NO: 2573584 - RNA, 12 nt, Coxiella burnetii RSA 493
aaaccccaacuc

SEQ ID NO: 2573585 - RNA, 18 nt, Coxiella burnetii RSA 493
aaaccccaccgagguaag

SEQ ID NO: 2573586 - RNA, 22 nt, Coxiella burnetii RSA 493
aaacccgagcggauggauuaaa

SEQ ID NO: 2573587 - RNA, 15 nt, Coxiella burnetii RSA 493
aaaccgagcuucaug

SEQ ID NO: 2573588 - RNA, 19 nt, Coxiella burnetii RSA 493
aaaccuaaagaaagaagaa

SEQ ID NO: 2573589 - RNA, 21 nt, Coxiella burnetii RSA 493
aaaccuacacuuuuaaucaca

SEQ ID NO: 2573590 - RNA, 19 nt, Coxiella burnetii RSA 493
aaaccuaccgagucaaaaa

SEQ ID NO: 2573591 - RNA, 23 nt, Coxiella burnetii RSA 493
aaaccuaccgagucaaaaauaaa

SEQ ID NO: 2573592 - RNA, 15 nt, Coxiella burnetii RSA 493
aaaccuacuuuucua

SEQ ID NO: 2573593 - RNA, 16 nt, Coxiella burnetii RSA 493
aaaccuacuuuucuaa

SEQ ID NO: 2573594 - RNA, 16 nt, Coxiella burnetii RSA 493
aaaccuauccaaaaag

SEQ ID NO: 2573595 - RNA, 17 nt, Coxiella burnetii RSA 493
aaaccuauccaaaaaga

SEQ ID NO: 2573596 - RNA, 20 nt, Coxiella burnetii RSA 493
aaaccuauccaaaaagauaa

SEQ ID NO: 2573597 - RNA, 20 nt, Coxiella burnetii RSA 493
aaaccuuuuuuuucaaaaca

SEQ ID NO: 2573598 - RNA, 20 nt, Coxiella burnetii RSA 493
aaacgaauggcccaauaaag

SEQ ID NO: 2573599 - RNA, 17 nt, Coxiella burnetii RSA 493
aaacgacaagccccuuu

SEQ ID NO: 2573600 - RNA, 24 nt, Coxiella burnetii RSA 493
aaacgacaagccccuuuaaugcau

SEQ ID NO: 2573601 - RNA, 21 nt, Coxiella burnetii RSA 493
aaacgacguggaauuauugaa

SEQ ID NO: 2573602 - RNA, 19 nt, Coxiella burnetii RSA 493
aaacgauaaucucaucauc

SEQ ID NO: 2573603 - RNA, 17 nt, Coxiella burnetii RSA 493
aaacgauauuaucaaaa

SEQ ID NO: 2573604 - RNA, 12 nt, Coxiella burnetii RSA 493
aaacgauuaaaa

SEQ ID NO: 2573605 - RNA, 18 nt, Coxiella burnetii RSA 493
aaacgcgcccgccccaau

SEQ ID NO: 2573606 - RNA, 22 nt, Coxiella burnetii RSA 493
aaacgcugccauaguaauucau

SEQ ID NO: 2573607 - RNA, 21 nt, Coxiella burnetii RSA 493
aaacgggcauuggaaaaaacu

SEQ ID NO: 2573608 - RNA, 18 nt, Coxiella burnetii RSA 493
aaacgggcuaaagguuuc

SEQ ID NO: 2573609 - RNA, 19 nt, Coxiella burnetii RSA 493
aaacggggaguggaauuuu

SEQ ID NO: 2573610 - RNA, 21 nt, Coxiella burnetii RSA 493
aaacggggaguggaauuuuaa

SEQ ID NO: 2573611 - RNA, 23 nt, Coxiella burnetii RSA 493
aaacggggaguggaauuuuaaca

SEQ ID NO: 2573612 - RNA, 21 nt, Coxiella burnetii RSA 493
aaacguagaaguuuaaaguua

SEQ ID NO: 2573613 - RNA, 19 nt, Coxiella burnetii RSA 493
aaacguauuccaaauaauc

SEQ ID NO: 2573614 - RNA, 13 nt, Coxiella burnetii RSA 493
aaacgugcuuaau

SEQ ID NO: 2573615 - RNA, 22 nt, Coxiella burnetii RSA 493
aaacgugggagugguuauaauu

SEQ ID NO: 2573616 - RNA, 19 nt, Coxiella burnetii RSA 493
aaacguuuacgucuuuucu

SEQ ID NO: 2573617 - RNA, 15 nt, Coxiella burnetii RSA 493
aaacguuucaucaaa

SEQ ID NO: 2573618 - RNA, 13 nt, Coxiella burnetii RSA 493
aaacuaaaucaau

SEQ ID NO: 2573619 - RNA, 14 nt, Coxiella burnetii RSA 493
aaacuaaauuucca

SEQ ID NO: 2573620 - RNA, 15 nt, Coxiella burnetii RSA 493
aaacuaagcauuaaa

SEQ ID NO: 2573621 - RNA, 13 nt, Coxiella burnetii RSA 493
aaacuagaaauau

SEQ ID NO: 2573622 - RNA, 15 nt, Coxiella burnetii RSA 493
aaacucaauucgcuu

SEQ ID NO: 2573623 - RNA, 19 nt, Coxiella burnetii RSA 493
aaacugagugcaagcguuc

SEQ ID NO: 2573624 - RNA, 18 nt, Coxiella burnetii RSA 493
aaacugcuggaaauaaug

SEQ ID NO: 2573625 - RNA, 13 nt, Coxiella burnetii RSA 493
aaacuggaaaaag

SEQ ID NO: 2573626 - RNA, 21 nt, Coxiella burnetii RSA 493
aaacuggaaaaaggugcccaa

SEQ ID NO: 2573627 - RNA, 23 nt, Coxiella burnetii RSA 493
aaacuggaaaaaggugcccaaga

SEQ ID NO: 2573628 - RNA, 17 nt, Coxiella burnetii RSA 493
aaacuuagccaaucgua

SEQ ID NO: 2573629 - RNA, 15 nt, Coxiella burnetii RSA 493
aaacuucaugcaaaa

SEQ ID NO: 2573630 - RNA, 11 nt, Coxiella burnetii RSA 493
aaacuuuaccu

SEQ ID NO: 2573631 - RNA, 19 nt, Coxiella burnetii RSA 493
aaacuuugcagggcccacu

SEQ ID NO: 2573632 - RNA, 17 nt, Coxiella burnetii RSA 493
aaacuuuucaucccccg

SEQ ID NO: 2573633 - RNA, 19 nt, Coxiella burnetii RSA 493
aaagaaacgauuaaaaauu

SEQ ID NO: 2573634 - RNA, 13 nt, Coxiella burnetii RSA 493
aaagaaagcagau

SEQ ID NO: 2573635 - RNA, 15 nt, Coxiella burnetii RSA 493
aaagaaauaaucaug

SEQ ID NO: 2573636 - RNA, 16 nt, Coxiella burnetii RSA 493
aaagaagaaggucguu

SEQ ID NO: 2573637 - RNA, 17 nt, Coxiella burnetii RSA 493
aaagaagaaggucguuu

SEQ ID NO: 2573638 - RNA, 13 nt, Coxiella burnetii RSA 493
aaagacaacuuua

SEQ ID NO: 2573639 - RNA, 19 nt, Coxiella burnetii RSA 493
aaagacguaccauuaaaag

SEQ ID NO: 2573640 - RNA, 20 nt, Coxiella burnetii RSA 493
aaagagaagcaacuuuaaca

SEQ ID NO: 2573641 - RNA, 19 nt, Coxiella burnetii RSA 493
aaagaguauuuuuuuuaaa

SEQ ID NO: 2573642 - RNA, 21 nt, Coxiella burnetii RSA 493
aaagaguugagcgaagaaaaa

SEQ ID NO: 2573643 - RNA, 16 nt, Coxiella burnetii RSA 493
aaagauaaucccaaua

SEQ ID NO: 2573644 - RNA, 15 nt, Coxiella burnetii RSA 493
aaagauauucuucua

SEQ ID NO: 2573645 - RNA, 20 nt, Coxiella burnetii RSA 493
aaagaucuccccuucuuuaa

SEQ ID NO: 2573646 - RNA, 22 nt, Coxiella burnetii RSA 493
aaagaucuccccuucuuuaaua

SEQ ID NO: 2573647 - RNA, 17 nt, Coxiella burnetii RSA 493
aaagauuccaauauuga

SEQ ID NO: 2573648 - RNA, 23 nt, Coxiella burnetii RSA 493
aaagauuuuaucuuauuauucau

SEQ ID NO: 2573649 - RNA, 16 nt, Coxiella burnetii RSA 493
aaagauuuuuuuauug

SEQ ID NO: 2573650 - RNA, 13 nt, Coxiella burnetii RSA 493
aaagcaaaaauac

SEQ ID NO: 2573651 - RNA, 18 nt, Coxiella burnetii RSA 493
aaagcagcaauuguuugu

SEQ ID NO: 2573652 - RNA, 15 nt, Coxiella burnetii RSA 493
aaagcagcuucuaaa

SEQ ID NO: 2573653 - RNA, 14 nt, Coxiella burnetii RSA 493
aaagcaugauuuag

SEQ ID NO: 2573654 - RNA, 17 nt, Coxiella burnetii RSA 493
aaagcaugauuuaggca

SEQ ID NO: 2573655 - RNA, 19 nt, Coxiella burnetii RSA 493
aaagcauuuaauaccccug

SEQ ID NO: 2573656 - RNA, 23 nt, Coxiella burnetii RSA 493
aaagcauuuuucgcagcaaaaug

SEQ ID NO: 2573657 - RNA, 16 nt, Coxiella burnetii RSA 493
aaagccaaagaccaau

SEQ ID NO: 2573658 - RNA, 20 nt, Coxiella burnetii RSA 493
aaagccaaguuuuaagaaaa

SEQ ID NO: 2573659 - RNA, 21 nt, Coxiella burnetii RSA 493
aaagccaaguuuuaagaaaaa

SEQ ID NO: 2573660 - RNA, 16 nt, Coxiella burnetii RSA 493
aaagccauagaauuaa

SEQ ID NO: 2573661 - RNA, 20 nt, Coxiella burnetii RSA 493
aaagccuaaguuuaacagac

SEQ ID NO: 2573662 - RNA, 21 nt, Coxiella burnetii RSA 493
aaagccuaaguuuaacagaca

SEQ ID NO: 2573663 - RNA, 21 nt, Coxiella burnetii RSA 493
aaagcgagcaaucaaaacagc

SEQ ID NO: 2573664 - RNA, 18 nt, Coxiella burnetii RSA 493
aaagcgcccaaaugaucg

SEQ ID NO: 2573665 - RNA, 21 nt, Coxiella burnetii RSA 493
aaagcggaauuagccagcgaa

SEQ ID NO: 2573666 - RNA, 18 nt, Coxiella burnetii RSA 493
aaagcgguugcauucgua

SEQ ID NO: 2573667 - RNA, 16 nt, Coxiella burnetii RSA 493
aaagcugauuccgauc

SEQ ID NO: 2573668 - RNA, 13 nt, Coxiella burnetii RSA 493
aaaugcgccauug

SEQ ID NO: 2573669 - RNA, 20 nt, Coxiella burnetii RSA 493
aaaugcgguacuuaagaaag

SEQ ID NO: 2573670 - RNA, 23 nt, Coxiella burnetii RSA 493
aaaugcgguacuuaagaaaguau

SEQ ID NO: 2573671 - RNA, 15 nt, Coxiella burnetii RSA 493
aaaugcuuucacuuc

SEQ ID NO: 2573672 - RNA, 15 nt, Coxiella burnetii RSA 493
aaaugcuuuuuaaau

SEQ ID NO: 2573673 - RNA, 16 nt, Coxiella burnetii RSA 493
aaaugcuuuuuaaaua

SEQ ID NO: 2573674 - RNA, 16 nt, Coxiella burnetii RSA 493
aaauggcuuuuuucuu

SEQ ID NO: 2573675 - RNA, 17 nt, Coxiella burnetii RSA 493
aaauggucggccaaaug

SEQ ID NO: 2573676 - RNA, 16 nt, Coxiella burnetii RSA 493
aaauggugaaaagcca

SEQ ID NO: 2573677 - RNA, 23 nt, Coxiella burnetii RSA 493
aaaugguugauuuuuuaauuaag

SEQ ID NO: 2573678 - RNA, 20 nt, Coxiella burnetii RSA 493
aaauguuaggaaggacaaaa

SEQ ID NO: 2573679 - RNA, 14 nt, Coxiella burnetii RSA 493
aaauuaaaaaauag

SEQ ID NO: 2573680 - RNA, 14 nt, Coxiella burnetii RSA 493
aaauuaaaaaucgg

SEQ ID NO: 2573681 - RNA, 14 nt, Coxiella burnetii RSA 493
aaauuaaaauaauc

SEQ ID NO: 2573682 - RNA, 12 nt, Coxiella burnetii RSA 493
aaauuaaaaucu

SEQ ID NO: 2573683 - RNA, 11 nt, Coxiella burnetii RSA 493
aaauuaaauau

SEQ ID NO: 2573684 - RNA, 21 nt, Coxiella burnetii RSA 493
aaauuaagacuaggaaaaaau

SEQ ID NO: 2573685 - RNA, 15 nt, Coxiella burnetii RSA 493
aaauuaauauaauca

SEQ ID NO: 2573686 - RNA, 14 nt, Coxiella burnetii RSA 493
aaauuaauuaucca

SEQ ID NO: 2573687 - RNA, 23 nt, Coxiella burnetii RSA 493
aaauuaauugauagcgauuucca

SEQ ID NO: 2573688 - RNA, 22 nt, Coxiella burnetii RSA 493
aaauuagaauugcugacaccua

SEQ ID NO: 2573689 - RNA, 19 nt, Coxiella burnetii RSA 493
aaauuaggagaucuuuuaa

SEQ ID NO: 2573690 - RNA, 19 nt, Coxiella burnetii RSA 493
aaauuaguaauauuuugca

SEQ ID NO: 2573691 - RNA, 12 nt, Coxiella burnetii RSA 493
aaauuaugcgaa

SEQ ID NO: 2573692 - RNA, 15 nt, Coxiella burnetii RSA 493
aaauuauuaaucaua

SEQ ID NO: 2573693 - RNA, 13 nt, Coxiella burnetii RSA 493
aaauuauucggau

SEQ ID NO: 2573694 - RNA, 13 nt, Coxiella burnetii RSA 493
aaauuauuuuaau

SEQ ID NO: 2573695 - RNA, 14 nt, Coxiella burnetii RSA 493
aaauuauuuuaaua

SEQ ID NO: 2573696 - RNA, 18 nt, Coxiella burnetii RSA 493
aaauucaggggcaaucaa

SEQ ID NO: 2573697 - RNA, 15 nt, Coxiella burnetii RSA 493
aaauuccaaaaacau

SEQ ID NO: 2573698 - RNA, 21 nt, Coxiella burnetii RSA 493
aaauuccaccggcgucugaau

SEQ ID NO: 2573699 - RNA, 21 nt, Coxiella burnetii RSA 493
aaauuccgauuguuguggaua

SEQ ID NO: 2573700 - RNA, 18 nt, Coxiella burnetii RSA 493
aaauucgggcaacgaggu

SEQ ID NO: 2573701 - RNA, 21 nt, Coxiella burnetii RSA 493
aaauucuccuuaauaaaguuu

SEQ ID NO: 2573702 - RNA, 22 nt, Coxiella burnetii RSA 493
aaauucugaaucacuucuucca

SEQ ID NO: 2573703 - RNA, 17 nt, Coxiella burnetii RSA 493
aaauugaucuucuugug

SEQ ID NO: 2573704 - RNA, 20 nt, Coxiella burnetii RSA 493
aaauugauuagcaucuugaa

SEQ ID NO: 2573705 - RNA, 15 nt, Coxiella burnetii RSA 493
aaauugcaaaacuuc

SEQ ID NO: 2573706 - RNA, 20 nt, Coxiella burnetii RSA 493
aaauugcacauggaaaaacg

SEQ ID NO: 2573707 - RNA, 16 nt, Coxiella burnetii RSA 493
aaauugcggaaauuuc

SEQ ID NO: 2573708 - RNA, 13 nt, Coxiella burnetii RSA 493
aaauugcucuuuu

SEQ ID NO: 2573709 - RNA, 17 nt, Coxiella burnetii RSA 493
aaauugcucuuuuucca

SEQ ID NO: 2573710 - RNA, 18 nt, Coxiella burnetii RSA 493
aaauugcugaauugauaa

SEQ ID NO: 2573711 - RNA, 18 nt, Coxiella burnetii RSA 493
aaauuguccuuuucuauu

SEQ ID NO: 2573712 - RNA, 13 nt, Coxiella burnetii RSA 493
aaauuuaaaguuu

SEQ ID NO: 2573713 - RNA, 14 nt, Coxiella burnetii RSA 493
aaauuuaauaaaau

SEQ ID NO: 2573714 - RNA, 19 nt, Coxiella burnetii RSA 493
aaauuuaauaagucuuugc

SEQ ID NO: 2573715 - RNA, 14 nt, Coxiella burnetii RSA 493
aaauuuacuuuacg

SEQ ID NO: 2573716 - RNA, 15 nt, Coxiella burnetii RSA 493
aaauuucauuuaaua

SEQ ID NO: 2573717 - RNA, 20 nt, Coxiella burnetii RSA 493
aaauuucgauuuuacaauaa

SEQ ID NO: 2573718 - RNA, 21 nt, Coxiella burnetii RSA 493
aaauuucucaucugucaucau

SEQ ID NO: 2573719 - RNA, 23 nt, Coxiella burnetii RSA 493
aaauuucucucucauaaucgaua

SEQ ID NO: 2573720 - RNA, 21 nt, Coxiella burnetii RSA 493
aaauuucuuuccagccuuuag

SEQ ID NO: 2573721 - RNA, 13 nt, Coxiella burnetii RSA 493
aaauuugauuaau

SEQ ID NO: 2573722 - RNA, 22 nt, Coxiella burnetii RSA 493
aaauuugcauuaaucuuccauu

SEQ ID NO: 2573723 - RNA, 21 nt, Coxiella burnetii RSA 493
aaauuuucccaggaaagaaaa

SEQ ID NO: 2573724 - RNA, 23 nt, Coxiella burnetii RSA 493
aaauuuuccgugcagaaacaaua

SEQ ID NO: 2573725 - RNA, 13 nt, Coxiella burnetii RSA 493
aaauuuuuaaaug

SEQ ID NO: 2573726 - RNA, 12 nt, Coxiella burnetii RSA 493
aacaaaaucacc

SEQ ID NO: 2573727 - RNA, 16 nt, Coxiella burnetii RSA 493
aacaaaaucaccagaa

SEQ ID NO: 2573728 - RNA, 13 nt, Coxiella burnetii RSA 493
aacaaaauuuuuc

SEQ ID NO: 2573729 - RNA, 15 nt, Coxiella burnetii RSA 493
aacaaacaaaaaaua

SEQ ID NO: 2573730 - RNA, 22 nt, Coxiella burnetii RSA 493
aacaaacgaauggcccaauaaa

SEQ ID NO: 2573731 - RNA, 23 nt, Coxiella burnetii RSA 493
aacaaacgauaaucucaucaucu

SEQ ID NO: 2573732 - RNA, 23 nt, Coxiella burnetii RSA 493
aacaaaguaaguagcucuuaaaa

SEQ ID NO: 2573733 - RNA, 17 nt, Coxiella burnetii RSA 493
aacaaagucucgauccu

SEQ ID NO: 2573734 - RNA, 17 nt, Coxiella burnetii RSA 493
aacaaagugaaauaugu

SEQ ID NO: 2573735 - RNA, 14 nt, Coxiella burnetii RSA 493
aacaaauaaaccua

SEQ ID NO: 2573736 - RNA, 21 nt, Coxiella burnetii RSA 493
aacaaauaaaccuauccaaaa

SEQ ID NO: 2573737 - RNA, 15 nt, Coxiella burnetii RSA 493
aacaacgaaaucuac

SEQ ID NO: 2573738 - RNA, 22 nt, Coxiella burnetii RSA 493
aacaacggcaucaacggaaaaa

SEQ ID NO: 2573739 - RNA, 15 nt, Coxiella burnetii RSA 493
aacaacguaacugau

SEQ ID NO: 2573740 - RNA, 14 nt, Coxiella burnetii RSA 493
aacaacguuucgac

SEQ ID NO: 2573741 - RNA, 16 nt, Coxiella burnetii RSA 493
aacaacuaccugauaa

SEQ ID NO: 2573742 - RNA, 12 nt, Coxiella burnetii RSA 493
aacaagaaaaau

SEQ ID NO: 2573743 - RNA, 17 nt, Coxiella burnetii RSA 493
aacaagaaaaauuccaa

SEQ ID NO: 2573744 - RNA, 23 nt, Coxiella burnetii RSA 493
aacaagaauggcgggaaaaaaua

SEQ ID NO: 2573745 - RNA, 23 nt, Coxiella burnetii RSA 493
aacaagcguuguaaauuuugccc

SEQ ID NO: 2573746 - RNA, 12 nt, Coxiella burnetii RSA 493
aacaagcuggca

SEQ ID NO: 2573747 - RNA, 21 nt, Coxiella burnetii RSA 493
aacaagcuggcauugaaaauc

SEQ ID NO: 2573748 - RNA, 14 nt, Coxiella burnetii RSA 493
aacaaguuaacaaa

SEQ ID NO: 2573749 - RNA, 16 nt, Coxiella burnetii RSA 493
aacaaguuaacaaaau

SEQ ID NO: 2573750 - RNA, 21 nt, Coxiella burnetii RSA 493
aacaaguuaacaaaaucacca

SEQ ID NO: 2573751 - RNA, 15 nt, Coxiella burnetii RSA 493
aacaauuaacuuugc

SEQ ID NO: 2573752 - RNA, 16 nt, Coxiella burnetii RSA 493
aacacagcccccgaau

SEQ ID NO: 2573753 - RNA, 17 nt, Coxiella burnetii RSA 493
aacaccccaauuuuugg

SEQ ID NO: 2573754 - RNA, 16 nt, Coxiella burnetii RSA 493
aacaccguuggaaaag

SEQ ID NO: 2573755 - RNA, 14 nt, Coxiella burnetii RSA 493
aacaccuaaaucaa

SEQ ID NO: 2573756 - RNA, 19 nt, Coxiella burnetii RSA 493
aacaccuaaaucaauuuuc

SEQ ID NO: 2573757 - RNA, 17 nt, Coxiella burnetii RSA 493
aacacgaucaacaaaau

SEQ ID NO: 2573758 - RNA, 11 nt, Coxiella burnetii RSA 493
aacacggcagg

SEQ ID NO: 2573759 - RNA, 21 nt, Coxiella burnetii RSA 493
aacagagggagcagcagccuc

SEQ ID NO: 2573760 - RNA, 22 nt, Coxiella burnetii RSA 493
aacagagggagcagcagccucu

SEQ ID NO: 2573761 - RNA, 13 nt, Coxiella burnetii RSA 493
aacagauuuaaau

SEQ ID NO: 2573762 - RNA, 13 nt, Coxiella burnetii RSA 493
aacagcgaaaaca

SEQ ID NO: 2573763 - RNA, 18 nt, Coxiella burnetii RSA 493
aacagcgcccaauaagga

SEQ ID NO: 2573764 - RNA, 15 nt, Coxiella burnetii RSA 493
aacaggagcgauaaa

SEQ ID NO: 2573765 - RNA, 18 nt, Coxiella burnetii RSA 493
aacaggagcgauaaaaua

SEQ ID NO: 2573766 - RNA, 21 nt, Coxiella burnetii RSA 493
aacaggcagaugauuaaaagc

SEQ ID NO: 2573767 - RNA, 17 nt, Coxiella burnetii RSA 493
aacaguaguuuaucaaa

SEQ ID NO: 2573768 - RNA, 13 nt, Coxiella burnetii RSA 493
aacaguucaguuc

SEQ ID NO: 2573769 - RNA, 13 nt, Coxiella burnetii RSA 493
aacauacgacuuc

SEQ ID NO: 2573770 - RNA, 17 nt, Coxiella burnetii RSA 493
aacauaucuucaacauc

SEQ ID NO: 2573771 - RNA, 20 nt, Coxiella burnetii RSA 493
aacauaucuucaacaucaac

SEQ ID NO: 2573772 - RNA, 20 nt, Coxiella burnetii RSA 493
aacaucaaccccagccgcca

SEQ ID NO: 2573773 - RNA, 16 nt, Coxiella burnetii RSA 493
aacauccuccauuaca

SEQ ID NO: 2573774 - RNA, 21 nt, Coxiella burnetii RSA 493
aacucuuuuagcucauugaaa

SEQ ID NO: 2573775 - RNA, 16 nt, Coxiella burnetii RSA 493
aacugauguauccuaa

SEQ ID NO: 2573776 - RNA, 21 nt, Coxiella burnetii RSA 493
aacugcgccgcaaaguaaaaa

SEQ ID NO: 2573777 - RNA, 23 nt, Coxiella burnetii RSA 493
aacugcgccgcaaaguaaaaaug

SEQ ID NO: 2573778 - RNA, 18 nt, Coxiella burnetii RSA 493
aacugcuggaaauaaugu

SEQ ID NO: 2573779 - RNA, 19 nt, Coxiella burnetii RSA 493
aacugcuggaaauaaugug

SEQ ID NO: 2573780 - RNA, 13 nt, Coxiella burnetii RSA 493
aacuggaaaaagg

SEQ ID NO: 2573781 - RNA, 16 nt, Coxiella burnetii RSA 493
aacuguguucgcugua

SEQ ID NO: 2573782 - RNA, 22 nt, Coxiella burnetii RSA 493
aacuguugguguucuucguuua

SEQ ID NO: 2573783 - RNA, 15 nt, Coxiella burnetii RSA 493
aacuuacgcugaagu

SEQ ID NO: 2573784 - RNA, 17 nt, Coxiella burnetii RSA 493
aacuucaugcaaaaauu

SEQ ID NO: 2573785 - RNA, 22 nt, Coxiella burnetii RSA 493
aacuucaugcaaaaauuguuua

SEQ ID NO: 2573786 - RNA, 15 nt, Coxiella burnetii RSA 493
aacuucccauucuau

SEQ ID NO: 2573787 - RNA, 19 nt, Coxiella burnetii RSA 493
aacuuccuaucaauauuuc

SEQ ID NO: 2573788 - RNA, 18 nt, Coxiella burnetii RSA 493
aacuucucuucaaauuca

SEQ ID NO: 2573789 - RNA, 12 nt, Coxiella burnetii RSA 493
aacuucucuuga

SEQ ID NO: 2573790 - RNA, 16 nt, Coxiella burnetii RSA 493
aacuucucuugaauaa

SEQ ID NO: 2573791 - RNA, 16 nt, Coxiella burnetii RSA 493
aacuuuaggaggaagg

SEQ ID NO: 2573792 - RNA, 17 nt, Coxiella burnetii RSA 493
aacuuuguagaccaauc

SEQ ID NO: 2573793 - RNA, 17 nt, Coxiella burnetii RSA 493
aacuuuuccaucuccuu

SEQ ID NO: 2573794 - RNA, 21 nt, Coxiella burnetii RSA 493
aacuuuuuagggcugaaaaaa

SEQ ID NO: 2573795 - RNA, 14 nt, Coxiella burnetii RSA 493
aagaaaaaaugauu

SEQ ID NO: 2573796 - RNA, 14 nt, Coxiella burnetii RSA 493
aagaaaaagaaauu

SEQ ID NO: 2573797 - RNA, 13 nt, Coxiella burnetii RSA 493
aagaaaaaguuaa

SEQ ID NO: 2573798 - RNA, 22 nt, Coxiella burnetii RSA 493
aagaaaaauuccaaaaacauug

SEQ ID NO: 2573799 - RNA, 15 nt, Coxiella burnetii RSA 493
aagaaacgauuaaaa

SEQ ID NO: 2573800 - RNA, 16 nt, Coxiella burnetii RSA 493
aagaaagccuaaguuu

SEQ ID NO: 2573801 - RNA, 20 nt, Coxiella burnetii RSA 493
aagaaagcgagcaaucaaaa

SEQ ID NO: 2573802 - RNA, 19 nt, Coxiella burnetii RSA 493
aagaaaguuucccacaaaa

SEQ ID NO: 2573803 - RNA, 18 nt, Coxiella burnetii RSA 493
aagaaauugcggaaauuu

SEQ ID NO: 2573804 - RNA, 18 nt, Coxiella burnetii RSA 493
aagaacccaccgcuggug

SEQ ID NO: 2573805 - RNA, 19 nt, Coxiella burnetii RSA 493
aagaaccgcgacuaaacca

SEQ ID NO: 2573806 - RNA, 18 nt, Coxiella burnetii RSA 493
aagaauggcgggaaaaaa

SEQ ID NO: 2573807 - RNA, 14 nt, Coxiella burnetii RSA 493
aagaauuuuucaug

SEQ ID NO: 2573808 - RNA, 18 nt, Coxiella burnetii RSA 493
aagacaacaaaauguuug

SEQ ID NO: 2573809 - RNA, 15 nt, Coxiella burnetii RSA 493
aagacaacuuuauag

SEQ ID NO: 2573810 - RNA, 17 nt, Coxiella burnetii RSA 493
aagacaauguuaaaaca

SEQ ID NO: 2573811 - RNA, 20 nt, Coxiella burnetii RSA 493
aagacaauguuaaaacacau

SEQ ID NO: 2573812 - RNA, 21 nt, Coxiella burnetii RSA 493
aagacaauguuaaaacacaua

SEQ ID NO: 2573813 - RNA, 22 nt, Coxiella burnetii RSA 493
aagacacguucuggaaugacuc

SEQ ID NO: 2573814 - RNA, 21 nt, Coxiella burnetii RSA 493
aagacauuguucauaaaauaa

SEQ ID NO: 2573815 - RNA, 18 nt, Coxiella burnetii RSA 493
aagaccaaucguaaagau

SEQ ID NO: 2573816 - RNA, 14 nt, Coxiella burnetii RSA 493
aagacuaagaauaa

SEQ ID NO: 2573817 - RNA, 14 nt, Coxiella burnetii RSA 493
aagacuaggaaaaa

SEQ ID NO: 2573818 - RNA, 17 nt, Coxiella burnetii RSA 493
aagacucaaagaaauaa

SEQ ID NO: 2573819 - RNA, 13 nt, Coxiella burnetii RSA 493
aagacugauaacu

SEQ ID NO: 2573820 - RNA, 15 nt, Coxiella burnetii RSA 493
aagacugauaacuau

SEQ ID NO: 2573821 - RNA, 16 nt, Coxiella burnetii RSA 493
aagagaaauuaaauuu

SEQ ID NO: 2573822 - RNA, 12 nt, Coxiella burnetii RSA 493
aagaguaaaaaa

SEQ ID NO: 2573823 - RNA, 15 nt, Coxiella burnetii RSA 493
aagaguugagcgaag

SEQ ID NO: 2573824 - RNA, 19 nt, Coxiella burnetii RSA 493
aagaguugagcgaagaaaa

SEQ ID NO: 2573825 - RNA, 12 nt, Coxiella burnetii RSA 493
aagauaauaauu

SEQ ID NO: 2573826 - RNA, 18 nt, Coxiella burnetii RSA 493
aagauaaucccaauaaaa

SEQ ID NO: 2573827 - RNA, 19 nt, Coxiella burnetii RSA 493
aagauauucuucuagaaaa

SEQ ID NO: 2573828 - RNA, 12 nt, Coxiella burnetii RSA 493
aagaucgcugua

SEQ ID NO: 2573829 - RNA, 20 nt, Coxiella burnetii RSA 493
aagaucuccccuucuuuaau

SEQ ID NO: 2573830 - RNA, 23 nt, Coxiella burnetii RSA 493
aagaucuccccuucuuuaauauc

SEQ ID NO: 2573831 - RNA, 14 nt, Coxiella burnetii RSA 493
aagaucuccuugag

SEQ ID NO: 2573832 - RNA, 17 nt, Coxiella burnetii RSA 493
aagauucguaauauuau

SEQ ID NO: 2573833 - RNA, 18 nt, Coxiella burnetii RSA 493
aagauuuauaacaagguu

SEQ ID NO: 2573834 - RNA, 18 nt, Coxiella burnetii RSA 493
aagcaaagcgcguaagca

SEQ ID NO: 2573835 - RNA, 11 nt, Coxiella burnetii RSA 493
aagcaauuuuu

SEQ ID NO: 2573836 - RNA, 12 nt, Coxiella burnetii RSA 493
aagcaauuuuuu

SEQ ID NO: 2573837 - RNA, 12 nt, Coxiella burnetii RSA 493
aagcacaaaagu

SEQ ID NO: 2573838 - RNA, 15 nt, Coxiella burnetii RSA 493
aagcaccccgugaau

SEQ ID NO: 2573839 - RNA, 22 nt, Coxiella burnetii RSA 493
aagcaccgcuggcuuugauucc

SEQ ID NO: 2573840 - RNA, 18 nt, Coxiella burnetii RSA 493
aagcagcaauuguuuguu

SEQ ID NO: 2573841 - RNA, 15 nt, Coxiella burnetii RSA 493
aagcagggcaguaaa

SEQ ID NO: 2573842 - RNA, 17 nt, Coxiella burnetii RSA 493
aagcauauugcaauaau

SEQ ID NO: 2573843 - RNA, 14 nt, Coxiella burnetii RSA 493
aagcaucagauacc

SEQ ID NO: 2573844 - RNA, 17 nt, Coxiella burnetii RSA 493
aagcauuaaaaaauaag

SEQ ID NO: 2573845 - RNA, 20 nt, Coxiella burnetii RSA 493
aagcauuaaaaaauaagaaa

SEQ ID NO: 2573846 - RNA, 21 nt, Coxiella burnetii RSA 493
aagccaaguuuuaagaaaaac

SEQ ID NO: 2573847 - RNA, 13 nt, Coxiella burnetii RSA 493
aagccacacaacc

SEQ ID NO: 2573848 - RNA, 17 nt, Coxiella burnetii RSA 493
aagccauaucaggagca

SEQ ID NO: 2573849 - RNA, 20 nt, Coxiella burnetii RSA 493
aagccauaucaggagcaggg

SEQ ID NO: 2573850 - RNA, 21 nt, Coxiella burnetii RSA 493
aagccugaaaaucaaauuuuc

SEQ ID NO: 2573851 - RNA, 16 nt, Coxiella burnetii RSA 493
aagcgaaauacgggaa

SEQ ID NO: 2573852 - RNA, 20 nt, Coxiella burnetii RSA 493
aagcgaaauacgggaaaaca

SEQ ID NO: 2573853 - RNA, 21 nt, Coxiella burnetii RSA 493
aagcgaaauacgggaaaacaa

SEQ ID NO: 2573854 - RNA, 16 nt, Coxiella burnetii RSA 493
aagcgaaauacgggga

SEQ ID NO: 2573855 - RNA, 19 nt, Coxiella burnetii RSA 493
aagcgaaauacggggaaau

SEQ ID NO: 2573856 - RNA, 21 nt, Coxiella burnetii RSA 493
aagcgaaauacggggaaauaa

SEQ ID NO: 2573857 - RNA, 20 nt, Coxiella burnetii RSA 493
aagcgaaauacggggacaau

SEQ ID NO: 2573858 - RNA, 16 nt, Coxiella burnetii RSA 493
aagcgaaguacgggaa

SEQ ID NO: 2573859 - RNA, 20 nt, Coxiella burnetii RSA 493
aagcgaaguacgggaaaaca

SEQ ID NO: 2573860 - RNA, 21 nt, Coxiella burnetii RSA 493
aagcgaaguacgggaaaacaa

SEQ ID NO: 2573861 - RNA, 19 nt, Coxiella burnetii RSA 493
aagcgagcaaucaaaacag

SEQ ID NO: 2573862 - RNA, 23 nt, Coxiella burnetii RSA 493
aagcgaggaccguuaugaaaaca

SEQ ID NO: 2573863 - RNA, 17 nt, Coxiella burnetii RSA 493
aagcgauuccaaagcag

SEQ ID NO: 2573864 - RNA, 23 nt, Coxiella burnetii RSA 493
aagcgauuccaaagcagauaaau

SEQ ID NO: 2573865 - RNA, 21 nt, Coxiella burnetii RSA 493
aagcgcauauucgccuucuug

SEQ ID NO: 2573866 - RNA, 16 nt, Coxiella burnetii RSA 493
aagcgcgauucauucc

SEQ ID NO: 2573867 - RNA, 18 nt, Coxiella burnetii RSA 493
aagcgcuugguuaacgaa

SEQ ID NO: 2573868 - RNA, 20 nt, Coxiella burnetii RSA 493
aagcggauaagccauuaaaa

SEQ ID NO: 2573869 - RNA, 20 nt, Coxiella burnetii RSA 493
aagcgucaugaaaagcggag

SEQ ID NO: 2573870 - RNA, 12 nt, Coxiella burnetii RSA 493
aagcguuucucg

SEQ ID NO: 2573871 - RNA, 23 nt, Coxiella burnetii RSA 493
aagcuagaaaauaaccuaaaaua

SEQ ID NO: 2573872 - RNA, 13 nt, Coxiella burnetii RSA 493
aagcuaucagcaa

SEQ ID NO: 2573873 - RNA, 22 nt, Coxiella burnetii RSA 493
aagcuaucagcaaucaaaugag

SEQ ID NO: 2573874 - RNA, 16 nt, Coxiella burnetii RSA 493
aagcuauccaaauaau

SEQ ID NO: 2573875 - RNA, 15 nt, Coxiella burnetii RSA 493
aagcucagcccaacc

SEQ ID NO: 2573876 - RNA, 13 nt, Coxiella burnetii RSA 493
aagcucuaacagg

SEQ ID NO: 2573877 - RNA, 16 nt, Coxiella burnetii RSA 493
aagcugaaauugaauu

SEQ ID NO: 2573878 - RNA, 15 nt, Coxiella burnetii RSA 493
aagcugauacaccau

SEQ ID NO: 2573879 - RNA, 19 nt, Coxiella burnetii RSA 493
aauaauuuuccgucguuuu

SEQ ID NO: 2573880 - RNA, 20 nt, Coxiella burnetii RSA 493
aauaauuuuuuuaauuuuuu

SEQ ID NO: 2573881 - RNA, 23 nt, Coxiella burnetii RSA 493
aauaauuuuuuuaauuuuuucau

SEQ ID NO: 2573882 - RNA, 21 nt, Coxiella burnetii RSA 493
aauacaacgcuguuaaaaucc

SEQ ID NO: 2573883 - RNA, 13 nt, Coxiella burnetii RSA 493
aauacaggaaaaa

SEQ ID NO: 2573884 - RNA, 14 nt, Coxiella burnetii RSA 493
aauacaggaaaaag

SEQ ID NO: 2573885 - RNA, 16 nt, Coxiella burnetii RSA 493
aauacaggaaaaagau

SEQ ID NO: 2573886 - RNA, 17 nt, Coxiella burnetii RSA 493
aauacaggaaaaagaua

SEQ ID NO: 2573887 - RNA, 16 nt, Coxiella burnetii RSA 493
aauacaggauuauauu

SEQ ID NO: 2573888 - RNA, 23 nt, Coxiella burnetii RSA 493
aauacaguaaauaaucauuuuua

SEQ ID NO: 2573889 - RNA, 13 nt, Coxiella burnetii RSA 493
aauacauaaaauu

SEQ ID NO: 2573890 - RNA, 19 nt, Coxiella burnetii RSA 493
aauacaucuugauccuuuu

SEQ ID NO: 2573891 - RNA, 13 nt, Coxiella burnetii RSA 493
aauacauucuuca

SEQ ID NO: 2573892 - RNA, 18 nt, Coxiella burnetii RSA 493
aauaccaauucaaauaau

SEQ ID NO: 2573893 - RNA, 13 nt, Coxiella burnetii RSA 493
aauaccauuuucc

SEQ ID NO: 2573894 - RNA, 15 nt, Coxiella burnetii RSA 493
aauaccauuuuccuu

SEQ ID NO: 2573895 - RNA, 16 nt, Coxiella burnetii RSA 493
aauaccauuuuccuuu

SEQ ID NO: 2573896 - RNA, 20 nt, Coxiella burnetii RSA 493
aauaccgauuaauucuuuag

SEQ ID NO: 2573897 - RNA, 23 nt, Coxiella burnetii RSA 493
aauaccuuuuucguuuaacaaug

SEQ ID NO: 2573898 - RNA, 19 nt, Coxiella burnetii RSA 493
aauacgaauguuaauucga

SEQ ID NO: 2573899 - RNA, 15 nt, Coxiella burnetii RSA 493
aauacgagguuuuuu

SEQ ID NO: 2573900 - RNA, 18 nt, Coxiella burnetii RSA 493
aauacgauagcgucuuuu

SEQ ID NO: 2573901 - RNA, 18 nt, Coxiella burnetii RSA 493
aauacggagaaaaugauu

SEQ ID NO: 2573902 - RNA, 17 nt, Coxiella burnetii RSA 493
aauacgggaaaacaaug

SEQ ID NO: 2573903 - RNA, 20 nt, Coxiella burnetii RSA 493
aauacggggacgauagaugg

SEQ ID NO: 2573904 - RNA, 19 nt, Coxiella burnetii RSA 493
aauacuuaaaauuucuuuc

SEQ ID NO: 2573905 - RNA, 14 nt, Coxiella burnetii RSA 493
aauagaaaaaagaa

SEQ ID NO: 2573906 - RNA, 14 nt, Coxiella burnetii RSA 493
aauagaauuuuuga

SEQ ID NO: 2573907 - RNA, 15 nt, Coxiella burnetii RSA 493
aauagacuucgcuaa

SEQ ID NO: 2573908 - RNA, 22 nt, Coxiella burnetii RSA 493
aauagacuucgcuaaauaacau

SEQ ID NO: 2573909 - RNA, 20 nt, Coxiella burnetii RSA 493
aauagagcgggaauuuucga

SEQ ID NO: 2573910 - RNA, 20 nt, Coxiella burnetii RSA 493
aauagagucgggaaauaaaa

SEQ ID NO: 2573911 - RNA, 15 nt, Coxiella burnetii RSA 493
aauagcaaccgcaau

SEQ ID NO: 2573912 - RNA, 23 nt, Coxiella burnetii RSA 493
aauagcaucaagggcaaaaacau

SEQ ID NO: 2573913 - RNA, 18 nt, Coxiella burnetii RSA 493
aauagccauuaauaaagu

SEQ ID NO: 2573914 - RNA, 15 nt, Coxiella burnetii RSA 493
aauagcguauagagu

SEQ ID NO: 2573915 - RNA, 12 nt, Coxiella burnetii RSA 493
aauaggaaaaau

SEQ ID NO: 2573916 - RNA, 16 nt, Coxiella burnetii RSA 493
aauaggcuuucuuuuu

SEQ ID NO: 2573917 - RNA, 14 nt, Coxiella burnetii RSA 493
aauaggucauuuuu

SEQ ID NO: 2573918 - RNA, 21 nt, Coxiella burnetii RSA 493
aauaguggcauuaaaagauuu

SEQ ID NO: 2573919 - RNA, 18 nt, Coxiella burnetii RSA 493
aauaguuacgagcuguuu

SEQ ID NO: 2573920 - RNA, 22 nt, Coxiella burnetii RSA 493
aauaguuugcaauaccauuuuu

SEQ ID NO: 2573921 - RNA, 19 nt, Coxiella burnetii RSA 493
aauauaaauaaucuuccca

SEQ ID NO: 2573922 - RNA, 22 nt, Coxiella burnetii RSA 493
aauauaacgcuccaguauuuca

SEQ ID NO: 2573923 - RNA, 22 nt, Coxiella burnetii RSA 493
aauauaauugagguuuuaauuu

SEQ ID NO: 2573924 - RNA, 16 nt, Coxiella burnetii RSA 493
aauauccgcaauaugc

SEQ ID NO: 2573925 - RNA, 17 nt, Coxiella burnetii RSA 493
aauauccuuguaauuca

SEQ ID NO: 2573926 - RNA, 13 nt, Coxiella burnetii RSA 493
aauaucuagauuu

SEQ ID NO: 2573927 - RNA, 16 nt, Coxiella burnetii RSA 493
aauaucuagauuuaaa

SEQ ID NO: 2573928 - RNA, 17 nt, Coxiella burnetii RSA 493
aauaucuagauuuaaaa

SEQ ID NO: 2573929 - RNA, 13 nt, Coxiella burnetii RSA 493
aauaucugaucaa

SEQ ID NO: 2573930 - RNA, 17 nt, Coxiella burnetii RSA 493
aauaugcacuaaaccuu

SEQ ID NO: 2573931 - RNA, 14 nt, Coxiella burnetii RSA 493
aauauguccaauag

SEQ ID NO: 2573932 - RNA, 15 nt, Coxiella burnetii RSA 493
aauauuaaaacaaga

SEQ ID NO: 2573933 - RNA, 16 nt, Coxiella burnetii RSA 493
aauauuagaaauaaua

SEQ ID NO: 2573934 - RNA, 16 nt, Coxiella burnetii RSA 493
aauauuaguggaauua

SEQ ID NO: 2573935 - RNA, 18 nt, Coxiella burnetii RSA 493
aauauuaucguuuucauu

SEQ ID NO: 2573936 - RNA, 14 nt, Coxiella burnetii RSA 493
aauauuuagcaacu

SEQ ID NO: 2573937 - RNA, 17 nt, Coxiella burnetii RSA 493
aauauuucguuccauga

SEQ ID NO: 2573938 - RNA, 14 nt, Coxiella burnetii RSA 493
aauauuucuuccag

SEQ ID NO: 2573939 - RNA, 22 nt, Coxiella burnetii RSA 493
aauauuuucucaauagaaaaaa

SEQ ID NO: 2573940 - RNA, 23 nt, Coxiella burnetii RSA 493
aauauuuucucaauagaaaaaag

SEQ ID NO: 2573941 - RNA, 14 nt, Coxiella burnetii RSA 493
aauauuuuuauucu

SEQ ID NO: 2573942 - RNA, 17 nt, Coxiella burnetii RSA 493
aauauuuuuauucuucu

SEQ ID NO: 2573943 - RNA, 23 nt, Coxiella burnetii RSA 493
aauauuuuucucuuucauaauuu

SEQ ID NO: 2573944 - RNA, 13 nt, Coxiella burnetii RSA 493
aaucaaaucggcu

SEQ ID NO: 2573945 - RNA, 18 nt, Coxiella burnetii RSA 493
aaucaaaugcuaauuccu

SEQ ID NO: 2573946 - RNA, 13 nt, Coxiella burnetii RSA 493
aaucaaauuuucc

SEQ ID NO: 2573947 - RNA, 14 nt, Coxiella burnetii RSA 493
aaucaaauuuuccg

SEQ ID NO: 2573948 - RNA, 15 nt, Coxiella burnetii RSA 493
aaucaacgaacacau

SEQ ID NO: 2573949 - RNA, 18 nt, Coxiella burnetii RSA 493
aaucaaguagccaaaaua

SEQ ID NO: 2573950 - RNA, 20 nt, Coxiella burnetii RSA 493
aaucaaguagccaaaauaau

SEQ ID NO: 2573951 - RNA, 15 nt, Coxiella burnetii RSA 493
aaucaauaaaacucu

SEQ ID NO: 2573952 - RNA, 19 nt, Coxiella burnetii RSA 493
aaucaaucgcagcauuuuu

SEQ ID NO: 2573953 - RNA, 17 nt, Coxiella burnetii RSA 493
aaucaauucgaaagaaa

SEQ ID NO: 2573954 - RNA, 23 nt, Coxiella burnetii RSA 493
aaucaauuuaccaauuaaagaau

SEQ ID NO: 2573955 - RNA, 23 nt, Coxiella burnetii RSA 493
aaucaauuuucuucgcuggauuu

SEQ ID NO: 2573956 - RNA, 22 nt, Coxiella burnetii RSA 493
aaucacaaaagguaaaaaacua

SEQ ID NO: 2573957 - RNA, 18 nt, Coxiella burnetii RSA 493
aaucacaaguucuucuaa

SEQ ID NO: 2573958 - RNA, 15 nt, Coxiella burnetii RSA 493
aaucagcaaguugca

SEQ ID NO: 2573959 - RNA, 20 nt, Coxiella burnetii RSA 493
aaucauaggggguuaauucg

SEQ ID NO: 2573960 - RNA, 16 nt, Coxiella burnetii RSA 493
aaucauauaauuuuug

SEQ ID NO: 2573961 - RNA, 16 nt, Coxiella burnetii RSA 493
aaucaucaauucggau

SEQ ID NO: 2573962 - RNA, 19 nt, Coxiella burnetii RSA 493
aaucaugaucggauucuga

SEQ ID NO: 2573963 - RNA, 19 nt, Coxiella burnetii RSA 493
aaucccgccccauuuuugu

SEQ ID NO: 2573964 - RNA, 15 nt, Coxiella burnetii RSA 493
aauccgaugagaaag

SEQ ID NO: 2573965 - RNA, 20 nt, Coxiella burnetii RSA 493
aauccgcauaaaaacccauu

SEQ ID NO: 2573966 - RNA, 17 nt, Coxiella burnetii RSA 493
aauccgcuuuauuuuuc

SEQ ID NO: 2573967 - RNA, 15 nt, Coxiella burnetii RSA 493
aauccguaucccaau

SEQ ID NO: 2573968 - RNA, 18 nt, Coxiella burnetii RSA 493
aauccguuuugaaaaaua

SEQ ID NO: 2573969 - RNA, 21 nt, Coxiella burnetii RSA 493
aauccguuuugaaaaauaaaa

SEQ ID NO: 2573970 - RNA, 12 nt, Coxiella burnetii RSA 493
aauccucucucu

SEQ ID NO: 2573971 - RNA, 14 nt, Coxiella burnetii RSA 493
aauccuuguugaau

SEQ ID NO: 2573972 - RNA, 16 nt, Coxiella burnetii RSA 493
aauccuuguugaauuc

SEQ ID NO: 2573973 - RNA, 17 nt, Coxiella burnetii RSA 493
aauccuuguugaauucc

SEQ ID NO: 2573974 - RNA, 18 nt, Coxiella burnetii RSA 493
aauccuuguugaauuccu

SEQ ID NO: 2573975 - RNA, 22 nt, Coxiella burnetii RSA 493
aauccuuuuuguaauccuuguu

SEQ ID NO: 2573976 - RNA, 18 nt, Coxiella burnetii RSA 493
aaucgacggcucucucua

SEQ ID NO: 2573977 - RNA, 23 nt, Coxiella burnetii RSA 493
aaucgauaaucaacggcgcguga

SEQ ID NO: 2573978 - RNA, 17 nt, Coxiella burnetii RSA 493
aaucgauggaagaacau

SEQ ID NO: 2573979 - RNA, 15 nt, Coxiella burnetii RSA 493
aaucgcaaaauucag

SEQ ID NO: 2573980 - RNA, 17 nt, Coxiella burnetii RSA 493
aaucgcuaagcgaaaaa

SEQ ID NO: 2573981 - RNA, 17 nt, Coxiella burnetii RSA 493
aaucgcuccuaaauuuu

SEQ ID NO: 2573982 - RNA, 18 nt, Coxiella burnetii RSA 493
aaucgcuguuaauaauag

SEQ ID NO: 2573983 - RNA, 23 nt, Coxiella burnetii RSA 493
aaucgggaaacuuacgcugaagu

SEQ ID NO: 2573984 - RNA, 15 nt, Coxiella burnetii RSA 493
aauuagcauuuucuc

SEQ ID NO: 2573985 - RNA, 17 nt, Coxiella burnetii RSA 493
aauuauaacuauuuuaa

SEQ ID NO: 2573986 - RNA, 20 nt, Coxiella burnetii RSA 493
aauuauaacuauuuuaaauc

SEQ ID NO: 2573987 - RNA, 16 nt, Coxiella burnetii RSA 493
aauuaucuuaaugaaa

SEQ ID NO: 2573988 - RNA, 20 nt, Coxiella burnetii RSA 493
aauuaucuuaaugaaauuuc

SEQ ID NO: 2573989 - RNA, 13 nt, Coxiella burnetii RSA 493
aauuaugaaaacg

SEQ ID NO: 2573990 - RNA, 23 nt, Coxiella burnetii RSA 493
aauuauucggauucucucgcuca

SEQ ID NO: 2573991 - RNA, 12 nt, Coxiella burnetii RSA 493
aauuauuuuuau

SEQ ID NO: 2573992 - RNA, 18 nt, Coxiella burnetii RSA 493
aauucaaaccaacgaugc

SEQ ID NO: 2573993 - RNA, 17 nt, Coxiella burnetii RSA 493
aauucaauuuuuuugau

SEQ ID NO: 2573994 - RNA, 22 nt, Coxiella burnetii RSA 493
aauucacgauuuucguuguaag

SEQ ID NO: 2573995 - RNA, 20 nt, Coxiella burnetii RSA 493
aauucacggauacgcuuuau

SEQ ID NO: 2573996 - RNA, 16 nt, Coxiella burnetii RSA 493
aauucagcauucccau

SEQ ID NO: 2573997 - RNA, 21 nt, Coxiella burnetii RSA 493
aauucaggggcaaucaaucgc

SEQ ID NO: 2573998 - RNA, 15 nt, Coxiella burnetii RSA 493
aauucauaaauaauu

SEQ ID NO: 2573999 - RNA, 19 nt, Coxiella burnetii RSA 493
aauucaucauuuuccaaaa

SEQ ID NO: 2574000 - RNA, 20 nt, Coxiella burnetii RSA 493
aauucaucauuuuccaaaaa

SEQ ID NO: 2574001 - RNA, 22 nt, Coxiella burnetii RSA 493
aauucaucauuuuccaaaaaau

SEQ ID NO: 2574002 - RNA, 23 nt, Coxiella burnetii RSA 493
aauucaugaaaaguaaauuuaua

SEQ ID NO: 2574003 - RNA, 20 nt, Coxiella burnetii RSA 493
aauuccaaaaacauugguau

SEQ ID NO: 2574004 - RNA, 17 nt, Coxiella burnetii RSA 493
aauuccaauaauugcug

SEQ ID NO: 2574005 - RNA, 23 nt, Coxiella burnetii RSA 493
aauuccaauaauugcugaacaaa

SEQ ID NO: 2574006 - RNA, 14 nt, Coxiella burnetii RSA 493
aauucccuuuugaa

SEQ ID NO: 2574007 - RNA, 15 nt, Coxiella burnetii RSA 493
aauucccuuuugaau

SEQ ID NO: 2574008 - RNA, 22 nt, Coxiella burnetii RSA 493
aauuccggucgugagguuuuac

SEQ ID NO: 2574009 - RNA, 22 nt, Coxiella burnetii RSA 493
aauuccgguuucaaaugaccaa

SEQ ID NO: 2574010 - RNA, 21 nt, Coxiella burnetii RSA 493
aauucgcacaaugcuuuucuc

SEQ ID NO: 2574011 - RNA, 19 nt, Coxiella burnetii RSA 493
aauucgcggguaaauuuau

SEQ ID NO: 2574012 - RNA, 19 nt, Coxiella burnetii RSA 493
aauucgcuaggcugagcca

SEQ ID NO: 2574013 - RNA, 19 nt, Coxiella burnetii RSA 493
aauucgcuccucaauuucc

SEQ ID NO: 2574014 - RNA, 20 nt, Coxiella burnetii RSA 493
aauucgggcaacgaggugca

SEQ ID NO: 2574015 - RNA, 18 nt, Coxiella burnetii RSA 493
aauucuccuuaauaaagu

SEQ ID NO: 2574016 - RNA, 16 nt, Coxiella burnetii RSA 493
aauucucuauauagag

SEQ ID NO: 2574017 - RNA, 17 nt, Coxiella burnetii RSA 493
aauucuggauaagcaua

SEQ ID NO: 2574018 - RNA, 12 nt, Coxiella burnetii RSA 493
aauucuucuuca

SEQ ID NO: 2574019 - RNA, 15 nt, Coxiella burnetii RSA 493
aauucuucuucauuu

SEQ ID NO: 2574020 - RNA, 16 nt, Coxiella burnetii RSA 493
aauucuucuucauuua

SEQ ID NO: 2574021 - RNA, 16 nt, Coxiella burnetii RSA 493
aauucuuucugaaaau

SEQ ID NO: 2574022 - RNA, 22 nt, Coxiella burnetii RSA 493
aauugaaaaaccauucaaugcu

SEQ ID NO: 2574023 - RNA, 13 nt, Coxiella burnetii RSA 493
aauugaaagaauu

SEQ ID NO: 2574024 - RNA, 19 nt, Coxiella burnetii RSA 493
aauugaaguccuuaucacu

SEQ ID NO: 2574025 - RNA, 14 nt, Coxiella burnetii RSA 493
aauugaauuugcuu

SEQ ID NO: 2574026 - RNA, 13 nt, Coxiella burnetii RSA 493
aauugacuuauuu

SEQ ID NO: 2574027 - RNA, 20 nt, Coxiella burnetii RSA 493
aauugacuuauuuuuauucu

SEQ ID NO: 2574028 - RNA, 14 nt, Coxiella burnetii RSA 493
aauugcaaaacagc

SEQ ID NO: 2574029 - RNA, 19 nt, Coxiella burnetii RSA 493
aauugcaaaacuucccauu

SEQ ID NO: 2574030 - RNA, 15 nt, Coxiella burnetii RSA 493
aauugcgcguaaaau

SEQ ID NO: 2574031 - RNA, 19 nt, Coxiella burnetii RSA 493
aauugcgcguaaaauucca

SEQ ID NO: 2574032 - RNA, 13 nt, Coxiella burnetii RSA 493
aauugcugaacaa

SEQ ID NO: 2574033 - RNA, 22 nt, Coxiella burnetii RSA 493
aauugcugaacaaaagccaugc

SEQ ID NO: 2574034 - RNA, 19 nt, Coxiella burnetii RSA 493
aauugcuuucccuuuuuga

SEQ ID NO: 2574035 - RNA, 21 nt, Coxiella burnetii RSA 493
aauugcuuucccuuuuugauu

SEQ ID NO: 2574036 - RNA, 22 nt, Coxiella burnetii RSA 493
aauugcuuucccuuuuugauuu

SEQ ID NO: 2574037 - RNA, 17 nt, Coxiella burnetii RSA 493
aauugggaagcaauuuc

SEQ ID NO: 2574038 - RNA, 19 nt, Coxiella burnetii RSA 493
aauugggaagcaauuucau

SEQ ID NO: 2574039 - RNA, 16 nt, Coxiella burnetii RSA 493
aauugguauauuucau

SEQ ID NO: 2574040 - RNA, 18 nt, Coxiella burnetii RSA 493
aauuguguuuuaauuccc

SEQ ID NO: 2574041 - RNA, 17 nt, Coxiella burnetii RSA 493
aauuguugauuuaacuu

SEQ ID NO: 2574042 - RNA, 12 nt, Coxiella burnetii RSA 493
aauuguuucaug

SEQ ID NO: 2574043 - RNA, 15 nt, Coxiella burnetii RSA 493
aauuguuugaaaaaa

SEQ ID NO: 2574044 - RNA, 12 nt, Coxiella burnetii RSA 493
aauuuaccucca

SEQ ID NO: 2574045 - RNA, 13 nt, Coxiella burnetii RSA 493
aauuuacuuuacg

SEQ ID NO: 2574046 - RNA, 20 nt, Coxiella burnetii RSA 493
aauuuacuuuacgcucaauu

SEQ ID NO: 2574047 - RNA, 18 nt, Coxiella burnetii RSA 493
aauuuagguguaaguccu

SEQ ID NO: 2574048 - RNA, 21 nt, Coxiella burnetii RSA 493
aauuuauccgcuuaaucccau

SEQ ID NO: 2574049 - RNA, 15 nt, Coxiella burnetii RSA 493
aauuuauucaacucu

SEQ ID NO: 2574050 - RNA, 13 nt, Coxiella burnetii RSA 493
aauuuauucgaua

SEQ ID NO: 2574051 - RNA, 20 nt, Coxiella burnetii RSA 493
aauuucaaguaaucuacgaa

SEQ ID NO: 2574052 - RNA, 17 nt, Coxiella burnetii RSA 493
aauuucaaugacuuuaa

SEQ ID NO: 2574053 - RNA, 18 nt, Coxiella burnetii RSA 493
aauuucauccguggaagu

SEQ ID NO: 2574054 - RNA, 20 nt, Coxiella burnetii RSA 493
aauuucauucauucgcuuuu

SEQ ID NO: 2574055 - RNA, 21 nt, Coxiella burnetii RSA 493
aauuucauuuaauaaaucaau

SEQ ID NO: 2574056 - RNA, 21 nt, Coxiella burnetii RSA 493
aauuuccaaacgccaucgauu

SEQ ID NO: 2574057 - RNA, 15 nt, Coxiella burnetii RSA 493
aauuucguugauuaa

SEQ ID NO: 2574058 - RNA, 21 nt, Coxiella burnetii RSA 493
aauuucucauauauuuaccuc

SEQ ID NO: 2574059 - RNA, 18 nt, Coxiella burnetii RSA 493
aauuucucgauaaaaaca

SEQ ID NO: 2574060 - RNA, 18 nt, Coxiella burnetii RSA 493
aauuucucgccauauuug

SEQ ID NO: 2574061 - RNA, 23 nt, Coxiella burnetii RSA 493
aauuucucguugauaaagauucu

SEQ ID NO: 2574062 - RNA, 23 nt, Coxiella burnetii RSA 493
aauuucugcuugcacaucuucac

SEQ ID NO: 2574063 - RNA, 23 nt, Coxiella burnetii RSA 493
aauuucuggcuugcuaugaugcc

SEQ ID NO: 2574064 - RNA, 11 nt, Coxiella burnetii RSA 493
aauuucuuccu

SEQ ID NO: 2574065 - RNA, 16 nt, Coxiella burnetii RSA 493
aauuucuuucuguccu

SEQ ID NO: 2574066 - RNA, 15 nt, Coxiella burnetii RSA 493
aauuugagguugaau

SEQ ID NO: 2574067 - RNA, 22 nt, Coxiella burnetii RSA 493
aauuugaugaucggaggaaaua

SEQ ID NO: 2574068 - RNA, 20 nt, Coxiella burnetii RSA 493
aauuugauuuuuuuugcuuu

SEQ ID NO: 2574069 - RNA, 14 nt, Coxiella burnetii RSA 493
aauuugcuuguuaa

SEQ ID NO: 2574070 - RNA, 15 nt, Coxiella burnetii RSA 493
aauuugggcugucuu

SEQ ID NO: 2574071 - RNA, 17 nt, Coxiella burnetii RSA 493
aauuuguaauugcuucc

SEQ ID NO: 2574072 - RNA, 15 nt, Coxiella burnetii RSA 493
aauuugugaaauaug

SEQ ID NO: 2574073 - RNA, 16 nt, Coxiella burnetii RSA 493
aauuugugauuuuaaa

SEQ ID NO: 2574074 - RNA, 19 nt, Coxiella burnetii RSA 493
aauuugugauuuuaaaaau

SEQ ID NO: 2574075 - RNA, 21 nt, Coxiella burnetii RSA 493
aauuuguugagagucaggaaa

SEQ ID NO: 2574076 - RNA, 13 nt, Coxiella burnetii RSA 493
aauuuuaaaaaac

SEQ ID NO: 2574077 - RNA, 13 nt, Coxiella burnetii RSA 493
aauuuuaaaacau

SEQ ID NO: 2574078 - RNA, 19 nt, Coxiella burnetii RSA 493
aauuuuaguugcuaaugaa

SEQ ID NO: 2574079 - RNA, 13 nt, Coxiella burnetii RSA 493
aauuuuauuauuu

SEQ ID NO: 2574080 - RNA, 19 nt, Coxiella burnetii RSA 493
aauuuuauucucccaaaca

SEQ ID NO: 2574081 - RNA, 22 nt, Coxiella burnetii RSA 493
aauuuucccaggaaagaaaaug

SEQ ID NO: 2574082 - RNA, 13 nt, Coxiella burnetii RSA 493
aauuuugaauccu

SEQ ID NO: 2574083 - RNA, 12 nt, Coxiella burnetii RSA 493
aauuuuuccuuu

SEQ ID NO: 2574084 - RNA, 16 nt, Coxiella burnetii RSA 493
aauuuuuccuuucuuu

SEQ ID NO: 2574085 - RNA, 21 nt, Coxiella burnetii RSA 493
aauuuuucuuuuuuuucuucu

SEQ ID NO: 2574086 - RNA, 16 nt, Coxiella burnetii RSA 493
aauuuuugcaucggua

SEQ ID NO: 2574087 - RNA, 14 nt, Coxiella burnetii RSA 493
aauuuuugccaaua

SEQ ID NO: 2574088 - RNA, 14 nt, Coxiella burnetii RSA 493
aauuuuuugcugau

SEQ ID NO: 2574089 - RNA, 18 nt, Coxiella burnetii RSA 493
acaucuuuuaaaacgcca

SEQ ID NO: 2574090 - RNA, 14 nt, Coxiella burnetii RSA 493
acaugcgccacuaa

SEQ ID NO: 2574091 - RNA, 21 nt, Coxiella burnetii RSA 493
acauggcgguaaugagaacca

SEQ ID NO: 2574092 - RNA, 23 nt, Coxiella burnetii RSA 493
acauuaaggccaauuccaauaau

SEQ ID NO: 2574093 - RNA, 20 nt, Coxiella burnetii RSA 493
acauuauuacauauuucuuu

SEQ ID NO: 2574094 - RNA, 18 nt, Coxiella burnetii RSA 493
acauucgauauguuucaa

SEQ ID NO: 2574095 - RNA, 21 nt, Coxiella burnetii RSA 493
acauucugaacgcucuuccaa

SEQ ID NO: 2574096 - RNA, 16 nt, Coxiella burnetii RSA 493
acauucuucaguaauu

SEQ ID NO: 2574097 - RNA, 20 nt, Coxiella burnetii RSA 493
acauucuucaguaauuuuua

SEQ ID NO: 2574098 - RNA, 16 nt, Coxiella burnetii RSA 493
acauuguucauaaaau

SEQ ID NO: 2574099 - RNA, 16 nt, Coxiella burnetii RSA 493
acauuucacccagacu

SEQ ID NO: 2574100 - RNA, 20 nt, Coxiella burnetii RSA 493
acauuucggacaacaaauaa

SEQ ID NO: 2574101 - RNA, 18 nt, Coxiella burnetii RSA 493
accaaaaaguuuauaaaa

SEQ ID NO: 2574102 - RNA, 18 nt, Coxiella burnetii RSA 493
accaaaagcaugcccaua

SEQ ID NO: 2574103 - RNA, 17 nt, Coxiella burnetii RSA 493
accaaaaggaaugaaua

SEQ ID NO: 2574104 - RNA, 12 nt, Coxiella burnetii RSA 493
accaaaucacgc

SEQ ID NO: 2574105 - RNA, 21 nt, Coxiella burnetii RSA 493
accaaaucacgcuuuuuuucg

SEQ ID NO: 2574106 - RNA, 20 nt, Coxiella burnetii RSA 493
accaaauccgcauaaaaacc

SEQ ID NO: 2574107 - RNA, 23 nt, Coxiella burnetii RSA 493
accaaauccgcauaaaaacccau

SEQ ID NO: 2574108 - RNA, 20 nt, Coxiella burnetii RSA 493
accaaaugcgacaaucauuu

SEQ ID NO: 2574109 - RNA, 15 nt, Coxiella burnetii RSA 493
accaagcucaugaaa

SEQ ID NO: 2574110 - RNA, 20 nt, Coxiella burnetii RSA 493
accaaucguaaagaucauca

SEQ ID NO: 2574111 - RNA, 19 nt, Coxiella burnetii RSA 493
accaaucuauuagcuggca

SEQ ID NO: 2574112 - RNA, 22 nt, Coxiella burnetii RSA 493
accaaugaaacgcgccaaacaa

SEQ ID NO: 2574113 - RNA, 19 nt, Coxiella burnetii RSA 493
accacuaagucgccauugg

SEQ ID NO: 2574114 - RNA, 19 nt, Coxiella burnetii RSA 493
accacuauuugcuuucuuu

SEQ ID NO: 2574115 - RNA, 19 nt, Coxiella burnetii RSA 493
accacucacagcccuaaua

SEQ ID NO: 2574116 - RNA, 13 nt, Coxiella burnetii RSA 493
accacuugcacac

SEQ ID NO: 2574117 - RNA, 16 nt, Coxiella burnetii RSA 493
accagucuguuauacu

SEQ ID NO: 2574118 - RNA, 11 nt, Coxiella burnetii RSA 493
accauaauccu

SEQ ID NO: 2574119 - RNA, 16 nt, Coxiella burnetii RSA 493
accauaggcagccccg

SEQ ID NO: 2574120 - RNA, 17 nt, Coxiella burnetii RSA 493
accaugacggccauggc

SEQ ID NO: 2574121 - RNA, 22 nt, Coxiella burnetii RSA 493
accaugagugccacaaagucag

SEQ ID NO: 2574122 - RNA, 21 nt, Coxiella burnetii RSA 493
accauugucucguuagaaaag

SEQ ID NO: 2574123 - RNA, 20 nt, Coxiella burnetii RSA 493
acccaaucaauucgaaagaa

SEQ ID NO: 2574124 - RNA, 18 nt, Coxiella burnetii RSA 493
acccaccgcuggugagac

SEQ ID NO: 2574125 - RNA, 19 nt, Coxiella burnetii RSA 493
acccacggcgccaucaacc

SEQ ID NO: 2574126 - RNA, 17 nt, Coxiella burnetii RSA 493
acccacguugcaauaac

SEQ ID NO: 2574127 - RNA, 19 nt, Coxiella burnetii RSA 493
acccaggcguagauuuuaa

SEQ ID NO: 2574128 - RNA, 20 nt, Coxiella burnetii RSA 493
acccaggcguagauuuuaaa

SEQ ID NO: 2574129 - RNA, 21 nt, Coxiella burnetii RSA 493
acccaguuguuuuaaauccuu

SEQ ID NO: 2574130 - RNA, 13 nt, Coxiella burnetii RSA 493
acccauccauccc

SEQ ID NO: 2574131 - RNA, 19 nt, Coxiella burnetii RSA 493
acccaucucgaaauuauuu

SEQ ID NO: 2574132 - RNA, 14 nt, Coxiella burnetii RSA 493
acccauuaaguacu

SEQ ID NO: 2574133 - RNA, 13 nt, Coxiella burnetii RSA 493
accccaauuuuug

SEQ ID NO: 2574134 - RNA, 18 nt, Coxiella burnetii RSA 493
accccaugaaacuuacgc

SEQ ID NO: 2574135 - RNA, 12 nt, Coxiella burnetii RSA 493
accccccgccgc

SEQ ID NO: 2574136 - RNA, 16 nt, Coxiella burnetii RSA 493
acccccugucgauacc

SEQ ID NO: 2574137 - RNA, 14 nt, Coxiella burnetii RSA 493
accccuaucaauca

SEQ ID NO: 2574138 - RNA, 20 nt, Coxiella burnetii RSA 493
accccuaucaaucaaauccu

SEQ ID NO: 2574139 - RNA, 14 nt, Coxiella burnetii RSA 493
acccgcauucuuuu

SEQ ID NO: 2574140 - RNA, 17 nt, Coxiella burnetii RSA 493
acccugucauauccaua

SEQ ID NO: 2574141 - RNA, 17 nt, Coxiella burnetii RSA 493
acccuuuugcaaaccgc

SEQ ID NO: 2574142 - RNA, 14 nt, Coxiella burnetii RSA 493
accgagauuuuucc

SEQ ID NO: 2574143 - RNA, 21 nt, Coxiella burnetii RSA 493
accgaggucuuuuauuucacg

SEQ ID NO: 2574144 - RNA, 14 nt, Coxiella burnetii RSA 493
accgauaccagcga

SEQ ID NO: 2574145 - RNA, 21 nt, Coxiella burnetii RSA 493
accgcaaguggggacagugaa

SEQ ID NO: 2574146 - RNA, 16 nt, Coxiella burnetii RSA 493
accgcacgccaaggcu

SEQ ID NO: 2574147 - RNA, 17 nt, Coxiella burnetii RSA 493
accgcagcucaaacaaa

SEQ ID NO: 2574148 - RNA, 18 nt, Coxiella burnetii RSA 493
accgcaugguccaaaaaa

SEQ ID NO: 2574149 - RNA, 21 nt, Coxiella burnetii RSA 493
accgcgaaugguugaaagaaa

SEQ ID NO: 2574150 - RNA, 14 nt, Coxiella burnetii RSA 493
accgcgcugaaguc

SEQ ID NO: 2574151 - RNA, 15 nt, Coxiella burnetii RSA 493
accgcgcugaagucc

SEQ ID NO: 2574152 - RNA, 14 nt, Coxiella burnetii RSA 493
accgcuaaagcaaa

SEQ ID NO: 2574153 - RNA, 17 nt, Coxiella burnetii RSA 493
accgcucgcuugaaaac

SEQ ID NO: 2574154 - RNA, 22 nt, Coxiella burnetii RSA 493
accgcugacgucagaaaacagc

SEQ ID NO: 2574155 - RNA, 14 nt, Coxiella burnetii RSA 493
accggaaauuuuuu

SEQ ID NO: 2574156 - RNA, 15 nt, Coxiella burnetii RSA 493
accggaaauuuuuug

SEQ ID NO: 2574157 - RNA, 16 nt, Coxiella burnetii RSA 493
accggcuagcagagcc

SEQ ID NO: 2574158 - RNA, 21 nt, Coxiella burnetii RSA 493
accggcuucuaaguaaacagc

SEQ ID NO: 2574159 - RNA, 17 nt, Coxiella burnetii RSA 493
accgggcgaugauaaag

SEQ ID NO: 2574160 - RNA, 19 nt, Coxiella burnetii RSA 493
accggguuuacauaagaaa

SEQ ID NO: 2574161 - RNA, 19 nt, Coxiella burnetii RSA 493
accguaaaacgaaucuuua

SEQ ID NO: 2574162 - RNA, 15 nt, Coxiella burnetii RSA 493
accguaagccgcccg

SEQ ID NO: 2574163 - RNA, 22 nt, Coxiella burnetii RSA 493
accguaugaaucagcuuaauca

SEQ ID NO: 2574164 - RNA, 18 nt, Coxiella burnetii RSA 493
accguuaugaaaacauac

SEQ ID NO: 2574165 - RNA, 15 nt, Coxiella burnetii RSA 493
accguucagccgauu

SEQ ID NO: 2574166 - RNA, 22 nt, Coxiella burnetii RSA 493
accguucgaugguacugaugua

SEQ ID NO: 2574167 - RNA, 18 nt, Coxiella burnetii RSA 493
accguuuaauuucugcuu

SEQ ID NO: 2574168 - RNA, 15 nt, Coxiella burnetii RSA 493
accguuuucuaucca

SEQ ID NO: 2574169 - RNA, 20 nt, Coxiella burnetii RSA 493
accuaauuugauuuuuuuug

SEQ ID NO: 2574170 - RNA, 23 nt, Coxiella burnetii RSA 493
accuaauuugauuuuuuuugcuu

SEQ ID NO: 2574171 - RNA, 23 nt, Coxiella burnetii RSA 493
accuacacguuaaauagccaacu

SEQ ID NO: 2574172 - RNA, 20 nt, Coxiella burnetii RSA 493
accuauugcggaauucagga

SEQ ID NO: 2574173 - RNA, 16 nt, Coxiella burnetii RSA 493
accucaccagacguac

SEQ ID NO: 2574174 - RNA, 16 nt, Coxiella burnetii RSA 493
accucagggaauuuaa

SEQ ID NO: 2574175 - RNA, 21 nt, Coxiella burnetii RSA 493
accuccaaaacccauccaucc

SEQ ID NO: 2574176 - RNA, 23 nt, Coxiella burnetii RSA 493
accuccaaaacccauccaucccg

SEQ ID NO: 2574177 - RNA, 15 nt, Coxiella burnetii RSA 493
accucuucuaaagua

SEQ ID NO: 2574178 - RNA, 18 nt, Coxiella burnetii RSA 493
accugagggaauuuuuug

SEQ ID NO: 2574179 - RNA, 19 nt, Coxiella burnetii RSA 493
accugagggaauuuuuugc

SEQ ID NO: 2574180 - RNA, 18 nt, Coxiella burnetii RSA 493
accugcuucgcuucaucc

SEQ ID NO: 2574181 - RNA, 14 nt, Coxiella burnetii RSA 493
accuggcuaguaaa

SEQ ID NO: 2574182 - RNA, 15 nt, Coxiella burnetii RSA 493
accuggcuaguaaau

SEQ ID NO: 2574183 - RNA, 13 nt, Coxiella burnetii RSA 493
accuucaaaaaua

SEQ ID NO: 2574184 - RNA, 14 nt, Coxiella burnetii RSA 493
accuucuuuuuuau

SEQ ID NO: 2574185 - RNA, 23 nt, Coxiella burnetii RSA 493
accuucuuuuuuauguuuggcca

SEQ ID NO: 2574186 - RNA, 21 nt, Coxiella burnetii RSA 493
accuugucacaaguguggauu

SEQ ID NO: 2574187 - RNA, 19 nt, Coxiella burnetii RSA 493
accuuuaauugcuuccuua

SEQ ID NO: 2574188 - RNA, 19 nt, Coxiella burnetii RSA 493
accuuugcgcaaaauuagg

SEQ ID NO: 2574189 - RNA, 23 nt, Coxiella burnetii RSA 493
accuuugcuaacaauuguugauu

SEQ ID NO: 2574190 - RNA, 15 nt, Coxiella burnetii RSA 493
accuuuggcaauaau

SEQ ID NO: 2574191 - RNA, 21 nt, Coxiella burnetii RSA 493
accuuuuucguuuaacaauga

SEQ ID NO: 2574192 - RNA, 20 nt, Coxiella burnetii RSA 493
acgaaaagcugaaauugaau

SEQ ID NO: 2574193 - RNA, 19 nt, Coxiella burnetii RSA 493
acgaaaauaccuuugcaaa

SEQ ID NO: 2574194 - RNA, 21 nt, Coxiella burnetii RSA 493
acuaauggugagucguauucc

SEQ ID NO: 2574195 - RNA, 21 nt, Coxiella burnetii RSA 493
acuaaugguuggacuacauca

SEQ ID NO: 2574196 - RNA, 22 nt, Coxiella burnetii RSA 493
acuaauuauaagacgcuuucaa

SEQ ID NO: 2574197 - RNA, 22 nt, Coxiella burnetii RSA 493
acuacaaauucucccuuuuccu

SEQ ID NO: 2574198 - RNA, 18 nt, Coxiella burnetii RSA 493
acuacacgcuugaaauag

SEQ ID NO: 2574199 - RNA, 21 nt, Coxiella burnetii RSA 493
acuaccuuccgucaauuuuuc

SEQ ID NO: 2574200 - RNA, 16 nt, Coxiella burnetii RSA 493
acuacggacucuuuuc

SEQ ID NO: 2574201 - RNA, 16 nt, Coxiella burnetii RSA 493
acuagcuauucuuuug

SEQ ID NO: 2574202 - RNA, 19 nt, Coxiella burnetii RSA 493
acuagcucuaauugaggug

SEQ ID NO: 2574203 - RNA, 18 nt, Coxiella burnetii RSA 493
acuaggucugauaggaau

SEQ ID NO: 2574204 - RNA, 18 nt, Coxiella burnetii RSA 493
acuaguuauuuuuaaaag

SEQ ID NO: 2574205 - RNA, 20 nt, Coxiella burnetii RSA 493
acuaugguaauaauaacaaa

SEQ ID NO: 2574206 - RNA, 23 nt, Coxiella burnetii RSA 493
acuauugaagucugguuaaaccc

SEQ ID NO: 2574207 - RNA, 18 nt, Coxiella burnetii RSA 493
acuauugcgcaaauugca

SEQ ID NO: 2574208 - RNA, 18 nt, Coxiella burnetii RSA 493
acuauuuaccacgacgau

SEQ ID NO: 2574209 - RNA, 16 nt, Coxiella burnetii RSA 493
acuauuugcuuucuuu

SEQ ID NO: 2574210 - RNA, 20 nt, Coxiella burnetii RSA 493
acuauuugcuuucuuugaac

SEQ ID NO: 2574211 - RNA, 15 nt, Coxiella burnetii RSA 493
acucaaagaaauaau

SEQ ID NO: 2574212 - RNA, 16 nt, Coxiella burnetii RSA 493
acucaaagaaauaauc

SEQ ID NO: 2574213 - RNA, 17 nt, Coxiella burnetii RSA 493
acucacagcccuaauaa

SEQ ID NO: 2574214 - RNA, 12 nt, Coxiella burnetii RSA 493
acucacuuuuuu

SEQ ID NO: 2574215 - RNA, 15 nt, Coxiella burnetii RSA 493
acucagcuuuccccc

SEQ ID NO: 2574216 - RNA, 21 nt, Coxiella burnetii RSA 493
acucaguggcagcuucuuuaa

SEQ ID NO: 2574217 - RNA, 22 nt, Coxiella burnetii RSA 493
acucaguggcagcuucuuuaaa

SEQ ID NO: 2574218 - RNA, 19 nt, Coxiella burnetii RSA 493
acuccaauaauaaaacccg

SEQ ID NO: 2574219 - RNA, 23 nt, Coxiella burnetii RSA 493
acuccacgauauguuguuugcuu

SEQ ID NO: 2574220 - RNA, 22 nt, Coxiella burnetii RSA 493
acuccacgaucugagugucuga

SEQ ID NO: 2574221 - RNA, 16 nt, Coxiella burnetii RSA 493
acuccuaagcaaggcg

SEQ ID NO: 2574222 - RNA, 18 nt, Coxiella burnetii RSA 493
acuccuucgcuuuuucca

SEQ ID NO: 2574223 - RNA, 22 nt, Coxiella burnetii RSA 493
acucggaacugaugaauaacaa

SEQ ID NO: 2574224 - RNA, 14 nt, Coxiella burnetii RSA 493
acucuaauugagua

SEQ ID NO: 2574225 - RNA, 17 nt, Coxiella burnetii RSA 493
acucuaauuuucuuucc

SEQ ID NO: 2574226 - RNA, 23 nt, Coxiella burnetii RSA 493
acucuaauuuucuuuccaucacc

SEQ ID NO: 2574227 - RNA, 13 nt, Coxiella burnetii RSA 493
acucuuauuuucu

SEQ ID NO: 2574228 - RNA, 14 nt, Coxiella burnetii RSA 493
acucuuauuuucug

SEQ ID NO: 2574229 - RNA, 16 nt, Coxiella burnetii RSA 493
acucuuucauaaaagg

SEQ ID NO: 2574230 - RNA, 18 nt, Coxiella burnetii RSA 493
acucuuucauaaaaggaa

SEQ ID NO: 2574231 - RNA, 13 nt, Coxiella burnetii RSA 493
acucuuuuucuua

SEQ ID NO: 2574232 - RNA, 17 nt, Coxiella burnetii RSA 493
acugaagaguaaaaaac

SEQ ID NO: 2574233 - RNA, 20 nt, Coxiella burnetii RSA 493
acugaagaguaaaaaaccaa

SEQ ID NO: 2574234 - RNA, 14 nt, Coxiella burnetii RSA 493
acugaccaucaauc

SEQ ID NO: 2574235 - RNA, 13 nt, Coxiella burnetii RSA 493
acugagaaaacuu

SEQ ID NO: 2574236 - RNA, 16 nt, Coxiella burnetii RSA 493
acugaugaauaacaau

SEQ ID NO: 2574237 - RNA, 16 nt, Coxiella burnetii RSA 493
acugauuagcugacau

SEQ ID NO: 2574238 - RNA, 17 nt, Coxiella burnetii RSA 493
acugcaccauaacuaaa

SEQ ID NO: 2574239 - RNA, 21 nt, Coxiella burnetii RSA 493
acugcgccgcaaaguaaaaau

SEQ ID NO: 2574240 - RNA, 19 nt, Coxiella burnetii RSA 493
acuggguuuuccccaucaa

SEQ ID NO: 2574241 - RNA, 17 nt, Coxiella burnetii RSA 493
acugugagcgcgaaaag

SEQ ID NO: 2574242 - RNA, 19 nt, Coxiella burnetii RSA 493
acugugcggauuaaauaac

SEQ ID NO: 2574243 - RNA, 15 nt, Coxiella burnetii RSA 493
acuguugagcaaagc

SEQ ID NO: 2574244 - RNA, 13 nt, Coxiella burnetii RSA 493
acuguuuuaguuc

SEQ ID NO: 2574245 - RNA, 23 nt, Coxiella burnetii RSA 493
acuuaaccgcugacgucagaaaa

SEQ ID NO: 2574246 - RNA, 12 nt, Coxiella burnetii RSA 493
acuuaagaaagu

SEQ ID NO: 2574247 - RNA, 16 nt, Coxiella burnetii RSA 493
acuuaagagauaagcu

SEQ ID NO: 2574248 - RNA, 21 nt, Coxiella burnetii RSA 493
acuuagcgaauuguaaaaaga

SEQ ID NO: 2574249 - RNA, 20 nt, Coxiella burnetii RSA 493
acuuauaaauuaaauugcuc

SEQ ID NO: 2574250 - RNA, 14 nt, Coxiella burnetii RSA 493
acuuauuuguugaa

SEQ ID NO: 2574251 - RNA, 16 nt, Coxiella burnetii RSA 493
acuuauuuuuauucuu

SEQ ID NO: 2574252 - RNA, 15 nt, Coxiella burnetii RSA 493
acuucaugcaaaaau

SEQ ID NO: 2574253 - RNA, 21 nt, Coxiella burnetii RSA 493
acuuccagauuuaguaaagua

SEQ ID NO: 2574254 - RNA, 22 nt, Coxiella burnetii RSA 493
acuuccagauuuaguaaaguag

SEQ ID NO: 2574255 - RNA, 16 nt, Coxiella burnetii RSA 493
acuucccgcaaaugau

SEQ ID NO: 2574256 - RNA, 17 nt, Coxiella burnetii RSA 493
acuucccgcaaaugauc

SEQ ID NO: 2574257 - RNA, 14 nt, Coxiella burnetii RSA 493
acuuccuaucaaua

SEQ ID NO: 2574258 - RNA, 12 nt, Coxiella burnetii RSA 493
acuuccuucuug

SEQ ID NO: 2574259 - RNA, 14 nt, Coxiella burnetii RSA 493
acuuccuucuuguc

SEQ ID NO: 2574260 - RNA, 22 nt, Coxiella burnetii RSA 493
acuuccuucuugucauucccuu

SEQ ID NO: 2574261 - RNA, 21 nt, Coxiella burnetii RSA 493
acuucgcacaucauugaaaac

SEQ ID NO: 2574262 - RNA, 20 nt, Coxiella burnetii RSA 493
acuucuaccguggccggcaa

SEQ ID NO: 2574263 - RNA, 23 nt, Coxiella burnetii RSA 493
acuugauauucccucuuuaccuc

SEQ ID NO: 2574264 - RNA, 19 nt, Coxiella burnetii RSA 493
acuugcacacuuugaugag

SEQ ID NO: 2574265 - RNA, 13 nt, Coxiella burnetii RSA 493
acuugccuugaga

SEQ ID NO: 2574266 - RNA, 18 nt, Coxiella burnetii RSA 493
acuugcuuuuuucugcga

SEQ ID NO: 2574267 - RNA, 13 nt, Coxiella burnetii RSA 493
acuuggauuuuau

SEQ ID NO: 2574268 - RNA, 13 nt, Coxiella burnetii RSA 493
acuuguugaaaac

SEQ ID NO: 2574269 - RNA, 20 nt, Coxiella burnetii RSA 493
acuuguugcggauuggcuuu

SEQ ID NO: 2574270 - RNA, 22 nt, Coxiella burnetii RSA 493
acuuguuuaucacuccaauaau

SEQ ID NO: 2574271 - RNA, 19 nt, Coxiella burnetii RSA 493
acuuguuuuucgguuucuu

SEQ ID NO: 2574272 - RNA, 13 nt, Coxiella burnetii RSA 493
acuuuaagcacuu

SEQ ID NO: 2574273 - RNA, 18 nt, Coxiella burnetii RSA 493
acuuuaaugaccaccacc

SEQ ID NO: 2574274 - RNA, 19 nt, Coxiella burnetii RSA 493
acuuuagcuaauucuuuuu

SEQ ID NO: 2574275 - RNA, 14 nt, Coxiella burnetii RSA 493
acuuuauaguucau

SEQ ID NO: 2574276 - RNA, 19 nt, Coxiella burnetii RSA 493
acuuucaguaccaaaagca

SEQ ID NO: 2574277 - RNA, 20 nt, Coxiella burnetii RSA 493
acuuuccuguuuuuccucgu

SEQ ID NO: 2574278 - RNA, 12 nt, Coxiella burnetii RSA 493
acuuuccuuauc

SEQ ID NO: 2574279 - RNA, 19 nt, Coxiella burnetii RSA 493
acuuucgauaaauuuugaa

SEQ ID NO: 2574280 - RNA, 20 nt, Coxiella burnetii RSA 493
acuuucgauaaauuuugaau

SEQ ID NO: 2574281 - RNA, 19 nt, Coxiella burnetii RSA 493
acuuucugaagaaucauac

SEQ ID NO: 2574282 - RNA, 12 nt, Coxiella burnetii RSA 493
acuuugauaaau

SEQ ID NO: 2574283 - RNA, 23 nt, Coxiella burnetii RSA 493
acuuugccccguuccaauauuuu

SEQ ID NO: 2574284 - RNA, 12 nt, Coxiella burnetii RSA 493
acuuuguuuuau

SEQ ID NO: 2574285 - RNA, 13 nt, Coxiella burnetii RSA 493
acuuuuauaauca

SEQ ID NO: 2574286 - RNA, 17 nt, Coxiella burnetii RSA 493
acuuuuccaucuccuuu

SEQ ID NO: 2574287 - RNA, 19 nt, Coxiella burnetii RSA 493
acuuuuccaucuccuuuuc

SEQ ID NO: 2574288 - RNA, 16 nt, Coxiella burnetii RSA 493
acuuuucguuguuugg

SEQ ID NO: 2574289 - RNA, 16 nt, Coxiella burnetii RSA 493
acuuuuuacugcaugc

SEQ ID NO: 2574290 - RNA, 18 nt, Coxiella burnetii RSA 493
acuuuuuacugcaugcca

SEQ ID NO: 2574291 - RNA, 18 nt, Coxiella burnetii RSA 493
acuuuuucgccugaauga

SEQ ID NO: 2574292 - RNA, 12 nt, Coxiella burnetii RSA 493
acuuuuuuuaau

SEQ ID NO: 2574293 - RNA, 22 nt, Coxiella burnetii RSA 493
acuuuuuuuaaugcgauucuuu

SEQ ID NO: 2574294 - RNA, 23 nt, Coxiella burnetii RSA 493
acuuuuuuuaaugcgauucuuuu

SEQ ID NO: 2574295 - RNA, 15 nt, Coxiella burnetii RSA 493
agaaaaagaaauugu

SEQ ID NO: 2574296 - RNA, 18 nt, Coxiella burnetii RSA 493
agaaaacccacucgguaa

SEQ ID NO: 2574297 - RNA, 19 nt, Coxiella burnetii RSA 493
agaaaacguuucaucaaaa

SEQ ID NO: 2574298 - RNA, 20 nt, Coxiella burnetii RSA 493
agaaaacguuucaucaaaau

SEQ ID NO: 2574299 - RNA, 15 nt, Coxiella burnetii RSA 493
agauuagaaaaagcg

SEQ ID NO: 2574300 - RNA, 21 nt, Coxiella burnetii RSA 493
agauucaugaaaaucuaaagg

SEQ ID NO: 2574301 - RNA, 14 nt, Coxiella burnetii RSA 493
agauucuuucugau

SEQ ID NO: 2574302 - RNA, 18 nt, Coxiella burnetii RSA 493
agauugcauggucuucua

SEQ ID NO: 2574303 - RNA, 15 nt, Coxiella burnetii RSA 493
agauugccacucuuu

SEQ ID NO: 2574304 - RNA, 18 nt, Coxiella burnetii RSA 493
agauuggugaagaaccca

SEQ ID NO: 2574305 - RNA, 12 nt, Coxiella burnetii RSA 493
agauuuaaauag

SEQ ID NO: 2574306 - RNA, 16 nt, Coxiella burnetii RSA 493
agauuuagccaaaauu

SEQ ID NO: 2574307 - RNA, 19 nt, Coxiella burnetii RSA 493
agauuucuucacggauaau

SEQ ID NO: 2574308 - RNA, 22 nt, Coxiella burnetii RSA 493
agauuuuaaauaccauuuuccu

SEQ ID NO: 2574309 - RNA, 15 nt, Coxiella burnetii RSA 493
agauuuuggcucccu

SEQ ID NO: 2574310 - RNA, 13 nt, Coxiella burnetii RSA 493
agcaaaaauacaa

SEQ ID NO: 2574311 - RNA, 22 nt, Coxiella burnetii RSA 493
agcaaccguugagcaagcagaa

SEQ ID NO: 2574312 - RNA, 20 nt, Coxiella burnetii RSA 493
agcaacuuuaacauuaucau

SEQ ID NO: 2574313 - RNA, 19 nt, Coxiella burnetii RSA 493
agcaagaggaguucuaaaa

SEQ ID NO: 2574314 - RNA, 23 nt, Coxiella burnetii RSA 493
agcaaggaucucaccuggaugua

SEQ ID NO: 2574315 - RNA, 13 nt, Coxiella burnetii RSA 493
agcaaguuuucua

SEQ ID NO: 2574316 - RNA, 22 nt, Coxiella burnetii RSA 493
agcaaguuuucuauauuuucuu

SEQ ID NO: 2574317 - RNA, 19 nt, Coxiella burnetii RSA 493
agcaaucaaaugagccgua

SEQ ID NO: 2574318 - RNA, 17 nt, Coxiella burnetii RSA 493
agcaaugggaacuuuua

SEQ ID NO: 2574319 - RNA, 19 nt, Coxiella burnetii RSA 493
agcaaugggaacuuuuaac

SEQ ID NO: 2574320 - RNA, 18 nt, Coxiella burnetii RSA 493
agcaauugucuaacauuu

SEQ ID NO: 2574321 - RNA, 19 nt, Coxiella burnetii RSA 493
agcaauugucuaacauuug

SEQ ID NO: 2574322 - RNA, 14 nt, Coxiella burnetii RSA 493
agcaauuuuuuauc

SEQ ID NO: 2574323 - RNA, 22 nt, Coxiella burnetii RSA 493
agcacaaaaguggggauaauug

SEQ ID NO: 2574324 - RNA, 21 nt, Coxiella burnetii RSA 493
agcacaaccuugccaagguug

SEQ ID NO: 2574325 - RNA, 19 nt, Coxiella burnetii RSA 493
agcacccaauuaaggucug

SEQ ID NO: 2574326 - RNA, 12 nt, Coxiella burnetii RSA 493
agcagagccgca

SEQ ID NO: 2574327 - RNA, 17 nt, Coxiella burnetii RSA 493
agcagaggugagagcag

SEQ ID NO: 2574328 - RNA, 15 nt, Coxiella burnetii RSA 493
agcagcuaauuuagg

SEQ ID NO: 2574329 - RNA, 14 nt, Coxiella burnetii RSA 493
agcaggauuuucac

SEQ ID NO: 2574330 - RNA, 15 nt, Coxiella burnetii RSA 493
agcagguugcuuuug

SEQ ID NO: 2574331 - RNA, 16 nt, Coxiella burnetii RSA 493
agcaguuugccauuac

SEQ ID NO: 2574332 - RNA, 23 nt, Coxiella burnetii RSA 493
agcauaauaaggcuaauuuuccu

SEQ ID NO: 2574333 - RNA, 14 nt, Coxiella burnetii RSA 493
agcauaaucuuuuu

SEQ ID NO: 2574334 - RNA, 19 nt, Coxiella burnetii RSA 493
agcaucaagggcaaaaaca

SEQ ID NO: 2574335 - RNA, 11 nt, Coxiella burnetii RSA 493
agcauccccca

SEQ ID NO: 2574336 - RNA, 14 nt, Coxiella burnetii RSA 493
agcaucccccaaga

SEQ ID NO: 2574337 - RNA, 18 nt, Coxiella burnetii RSA 493
agcaucuguuucaauuag

SEQ ID NO: 2574338 - RNA, 16 nt, Coxiella burnetii RSA 493
agcaucuugaaucauu

SEQ ID NO: 2574339 - RNA, 20 nt, Coxiella burnetii RSA 493
agcaucuuuuugcaaauaau

SEQ ID NO: 2574340 - RNA, 20 nt, Coxiella burnetii RSA 493
agcaugcccauaaauaacuu

SEQ ID NO: 2574341 - RNA, 15 nt, Coxiella burnetii RSA 493
agcaugcugauuuuc

SEQ ID NO: 2574342 - RNA, 18 nt, Coxiella burnetii RSA 493
agcauuaaaaaauaagaa

SEQ ID NO: 2574343 - RNA, 15 nt, Coxiella burnetii RSA 493
agcauuaauaagacc

SEQ ID NO: 2574344 - RNA, 16 nt, Coxiella burnetii RSA 493
agcauuaccauuuuga

SEQ ID NO: 2574345 - RNA, 18 nt, Coxiella burnetii RSA 493
agcauuagacauuuuucg

SEQ ID NO: 2574346 - RNA, 14 nt, Coxiella burnetii RSA 493
agcauuuucuccaa

SEQ ID NO: 2574347 - RNA, 16 nt, Coxiella burnetii RSA 493
agccaaguuuuaagaa

SEQ ID NO: 2574348 - RNA, 16 nt, Coxiella burnetii RSA 493
agccaauguuugcuca

SEQ ID NO: 2574349 - RNA, 19 nt, Coxiella burnetii RSA 493
agccacaaagaauuuuucc

SEQ ID NO: 2574350 - RNA, 14 nt, Coxiella burnetii RSA 493
agccaccgcaugaa

SEQ ID NO: 2574351 - RNA, 15 nt, Coxiella burnetii RSA 493
agccaguucucuauu

SEQ ID NO: 2574352 - RNA, 17 nt, Coxiella burnetii RSA 493
agccauagaauuaaugu

SEQ ID NO: 2574353 - RNA, 13 nt, Coxiella burnetii RSA 493
agccauaucagga

SEQ ID NO: 2574354 - RNA, 15 nt, Coxiella burnetii RSA 493
agccauuaauaaagu

SEQ ID NO: 2574355 - RNA, 15 nt, Coxiella burnetii RSA 493
agcccaauaacaagc

SEQ ID NO: 2574356 - RNA, 22 nt, Coxiella burnetii RSA 493
agcccguaugagcgaagcgaaa

SEQ ID NO: 2574357 - RNA, 23 nt, Coxiella burnetii RSA 493
agcccguaugcagcgaagcggaa

SEQ ID NO: 2574358 - RNA, 15 nt, Coxiella burnetii RSA 493
agcccuuuagccacg

SEQ ID NO: 2574359 - RNA, 17 nt, Coxiella burnetii RSA 493
agccgaagcgcggccau

SEQ ID NO: 2574360 - RNA, 18 nt, Coxiella burnetii RSA 493
agccgaugacaaauaaac

SEQ ID NO: 2574361 - RNA, 13 nt, Coxiella burnetii RSA 493
agccgauucuuca

SEQ ID NO: 2574362 - RNA, 18 nt, Coxiella burnetii RSA 493
agccgccacaccauaggc

SEQ ID NO: 2574363 - RNA, 13 nt, Coxiella burnetii RSA 493
agccgcuuuuuau

SEQ ID NO: 2574364 - RNA, 14 nt, Coxiella burnetii RSA 493
agccguuauccaug

SEQ ID NO: 2574365 - RNA, 17 nt, Coxiella burnetii RSA 493
agccguucaccccauuu

SEQ ID NO: 2574366 - RNA, 13 nt, Coxiella burnetii RSA 493
agccuaaacgcuu

SEQ ID NO: 2574367 - RNA, 20 nt, Coxiella burnetii RSA 493
agccucuucgcgcaagcacu

SEQ ID NO: 2574368 - RNA, 15 nt, Coxiella burnetii RSA 493
agccugaaaaucaaa

SEQ ID NO: 2574369 - RNA, 18 nt, Coxiella burnetii RSA 493
agccuucgcauaaaacgc

SEQ ID NO: 2574370 - RNA, 14 nt, Coxiella burnetii RSA 493
agccuucuuuuuca

SEQ ID NO: 2574371 - RNA, 15 nt, Coxiella burnetii RSA 493
agccuuuaguuuuau

SEQ ID NO: 2574372 - RNA, 12 nt, Coxiella burnetii RSA 493
agcgaaaacaaa

SEQ ID NO: 2574373 - RNA, 17 nt, Coxiella burnetii RSA 493
agcgaaagccaaguuuu

SEQ ID NO: 2574374 - RNA, 17 nt, Coxiella burnetii RSA 493
agcgaaauacgggaaaa

SEQ ID NO: 2574375 - RNA, 20 nt, Coxiella burnetii RSA 493
agcgaaauacgggaaaacaa

SEQ ID NO: 2574376 - RNA, 21 nt, Coxiella burnetii RSA 493
agcgaaauacgggaaaacaau

SEQ ID NO: 2574377 - RNA, 20 nt, Coxiella burnetii RSA 493
agcgaaauacggggaaauaa

SEQ ID NO: 2574378 - RNA, 20 nt, Coxiella burnetii RSA 493
agcgaaauacggggacaaua

SEQ ID NO: 2574379 - RNA, 20 nt, Coxiella burnetii RSA 493
agcgaaauacggggacgaua

SEQ ID NO: 2574380 - RNA, 15 nt, Coxiella burnetii RSA 493
agcgaacgcggccuu

SEQ ID NO: 2574381 - RNA, 19 nt, Coxiella burnetii RSA 493
agcgaagcgaaauacggga

SEQ ID NO: 2574382 - RNA, 20 nt, Coxiella burnetii RSA 493
agcgaagcgaaauacgggaa

SEQ ID NO: 2574383 - RNA, 21 nt, Coxiella burnetii RSA 493
agcgaagcggaauacggagaa

SEQ ID NO: 2574384 - RNA, 15 nt, Coxiella burnetii RSA 493
agcgaaguacgggaa

SEQ ID NO: 2574385 - RNA, 22 nt, Coxiella burnetii RSA 493
agcgaauaaaaaauuacugaaa

SEQ ID NO: 2574386 - RNA, 16 nt, Coxiella burnetii RSA 493
agcgacggauuuugcu

SEQ ID NO: 2574387 - RNA, 15 nt, Coxiella burnetii RSA 493
agcgacuuuuuucuu

SEQ ID NO: 2574388 - RNA, 18 nt, Coxiella burnetii RSA 493
agcgagcauauaaaaguu

SEQ ID NO: 2574389 - RNA, 18 nt, Coxiella burnetii RSA 493
agcgauuuauuucuucua

SEQ ID NO: 2574390 - RNA, 22 nt, Coxiella burnetii RSA 493
agcgccaacgcgacaagaauuu

SEQ ID NO: 2574391 - RNA, 15 nt, Coxiella burnetii RSA 493
agcgcccaaaugauc

SEQ ID NO: 2574392 - RNA, 21 nt, Coxiella burnetii RSA 493
agcgccgacucuaauugagua

SEQ ID NO: 2574393 - RNA, 16 nt, Coxiella burnetii RSA 493
agcgcgauuuucucuu

SEQ ID NO: 2574394 - RNA, 15 nt, Coxiella burnetii RSA 493
agcgcgcagcgcacg

SEQ ID NO: 2574395 - RNA, 15 nt, Coxiella burnetii RSA 493
agcgcgcugccuugg

SEQ ID NO: 2574396 - RNA, 15 nt, Coxiella burnetii RSA 493
agcgcuaaugagaaa

SEQ ID NO: 2574397 - RNA, 20 nt, Coxiella burnetii RSA 493
agcgcuuacagcaggaacca

SEQ ID NO: 2574398 - RNA, 16 nt, Coxiella burnetii RSA 493
agcggaauaagaaauc

SEQ ID NO: 2574399 - RNA, 14 nt, Coxiella burnetii RSA 493
agcggaauacggga

SEQ ID NO: 2574400 - RNA, 21 nt, Coxiella burnetii RSA 493
agcggauggagcaaacagucc

SEQ ID NO: 2574401 - RNA, 16 nt, Coxiella burnetii RSA 493
agcggcagaaugcuuu

SEQ ID NO: 2574402 - RNA, 14 nt, Coxiella burnetii RSA 493
agcggccucaacaa

SEQ ID NO: 2574403 - RNA, 20 nt, Coxiella burnetii RSA 493
agcggcgauggcugcacagg

SEQ ID NO: 2574404 - RNA, 22 nt, Coxiella burnetii RSA 493
agcgguggcgguuguaauaaug

SEQ ID NO: 2574405 - RNA, 20 nt, Coxiella burnetii RSA 493
agggcgaaaagaucuccuug

SEQ ID NO: 2574406 - RNA, 22 nt, Coxiella burnetii RSA 493
agggcgaugugaaacaugcugc

SEQ ID NO: 2574407 - RNA, 17 nt, Coxiella burnetii RSA 493
agggcggcaaucagaau

SEQ ID NO: 2574408 - RNA, 19 nt, Coxiella burnetii RSA 493
agggguuacuucuuuuucg

SEQ ID NO: 2574409 - RNA, 22 nt, Coxiella burnetii RSA 493
aggguaauaaaguaauuuuaaa

SEQ ID NO: 2574410 - RNA, 17 nt, Coxiella burnetii RSA 493
aggguagauaacgcaau

SEQ ID NO: 2574411 - RNA, 23 nt, Coxiella burnetii RSA 493
agggucuaguuauuuuucaucuu

SEQ ID NO: 2574412 - RNA, 21 nt, Coxiella burnetii RSA 493
agggugacggcggauuaaaaa

SEQ ID NO: 2574413 - RNA, 20 nt, Coxiella burnetii RSA 493
aggguuuugugcauaaauua

SEQ ID NO: 2574414 - RNA, 22 nt, Coxiella burnetii RSA 493
aggguuuugugcauaaauuauu

SEQ ID NO: 2574415 - RNA, 13 nt, Coxiella burnetii RSA 493
agguaaaccuuuu

SEQ ID NO: 2574416 - RNA, 23 nt, Coxiella burnetii RSA 493
agguaaagagggacuauaaagua

SEQ ID NO: 2574417 - RNA, 13 nt, Coxiella burnetii RSA 493
agguaucccuucg

SEQ ID NO: 2574418 - RNA, 15 nt, Coxiella burnetii RSA 493
agguauguugucauc

SEQ ID NO: 2574419 - RNA, 12 nt, Coxiella burnetii RSA 493
agguauuuuaag

SEQ ID NO: 2574420 - RNA, 16 nt, Coxiella burnetii RSA 493
aggucaggcaauuuug

SEQ ID NO: 2574421 - RNA, 14 nt, Coxiella burnetii RSA 493
aggucguuaaaaaa

SEQ ID NO: 2574422 - RNA, 16 nt, Coxiella burnetii RSA 493
aggucguuaaaaaauu

SEQ ID NO: 2574423 - RNA, 20 nt, Coxiella burnetii RSA 493
aggucugauaggaauucuuu

SEQ ID NO: 2574424 - RNA, 20 nt, Coxiella burnetii RSA 493
aggucuuuuauuucacguaa

SEQ ID NO: 2574425 - RNA, 20 nt, Coxiella burnetii RSA 493
aggugauucucucaaagaaa

SEQ ID NO: 2574426 - RNA, 19 nt, Coxiella burnetii RSA 493
aggugcguuccagcgggga

SEQ ID NO: 2574427 - RNA, 22 nt, Coxiella burnetii RSA 493
agguguuuuacguuuaaauaac

SEQ ID NO: 2574428 - RNA, 19 nt, Coxiella burnetii RSA 493
agguuauuuuuuccuauua

SEQ ID NO: 2574429 - RNA, 18 nt, Coxiella burnetii RSA 493
agguucggauuucacuuu

SEQ ID NO: 2574430 - RNA, 20 nt, Coxiella burnetii RSA 493
agguucucuuuaucagaaaa

SEQ ID NO: 2574431 - RNA, 18 nt, Coxiella burnetii RSA 493
agguucuggcuuucccuu

SEQ ID NO: 2574432 - RNA, 20 nt, Coxiella burnetii RSA 493
agguugucaacaaaauuuuu

SEQ ID NO: 2574433 - RNA, 16 nt, Coxiella burnetii RSA 493
agguuuuauuuuuaau

SEQ ID NO: 2574434 - RNA, 17 nt, Coxiella burnetii RSA 493
agguuuucaacaaguaa

SEQ ID NO: 2574435 - RNA, 12 nt, Coxiella burnetii RSA 493
agguuuucgcug

SEQ ID NO: 2574436 - RNA, 12 nt, Coxiella burnetii RSA 493
agguuuuuccuu

SEQ ID NO: 2574437 - RNA, 19 nt, Coxiella burnetii RSA 493
agguuuuuuuaaacguuuu

SEQ ID NO: 2574438 - RNA, 14 nt, Coxiella burnetii RSA 493
aguaaauagaagca

SEQ ID NO: 2574439 - RNA, 21 nt, Coxiella burnetii RSA 493
aguaaauguuucuuuuauaaa

SEQ ID NO: 2574440 - RNA, 15 nt, Coxiella burnetii RSA 493
aguaaccucuccauc

SEQ ID NO: 2574441 - RNA, 17 nt, Coxiella burnetii RSA 493
aguaaccucuccaucca

SEQ ID NO: 2574442 - RNA, 23 nt, Coxiella burnetii RSA 493
aguaagccauaucaggagcaggg

SEQ ID NO: 2574443 - RNA, 16 nt, Coxiella burnetii RSA 493
aguaaucucaauagag

SEQ ID NO: 2574444 - RNA, 18 nt, Coxiella burnetii RSA 493
aguaaucucaauagaggu

SEQ ID NO: 2574445 - RNA, 17 nt, Coxiella burnetii RSA 493
aguaaugacagaaaaag

SEQ ID NO: 2574446 - RNA, 22 nt, Coxiella burnetii RSA 493
aguaaugagcaucuuuucugaa

SEQ ID NO: 2574447 - RNA, 23 nt, Coxiella burnetii RSA 493
aguaaugagcaucuuuucugaaa

SEQ ID NO: 2574448 - RNA, 13 nt, Coxiella burnetii RSA 493
aguaaugguuuug

SEQ ID NO: 2574449 - RNA, 24 nt, Coxiella burnetii RSA 493
aguaauuaccguuuauaucaaccu

SEQ ID NO: 2574450 - RNA, 19 nt, Coxiella burnetii RSA 493
aguaauucaucauuuucca

SEQ ID NO: 2574451 - RNA, 15 nt, Coxiella burnetii RSA 493
aguaauuccagcacc

SEQ ID NO: 2574452 - RNA, 15 nt, Coxiella burnetii RSA 493
aguaauuuuaaaaaa

SEQ ID NO: 2574453 - RNA, 21 nt, Coxiella burnetii RSA 493
aguaauuuuaaaaaaaauacu

SEQ ID NO: 2574454 - RNA, 14 nt, Coxiella burnetii RSA 493
aguaauuuuuaaag

SEQ ID NO: 2574455 - RNA, 18 nt, Coxiella burnetii RSA 493
aguacagguuguuugcuu

SEQ ID NO: 2574456 - RNA, 13 nt, Coxiella burnetii RSA 493
aguacgugcuuug

SEQ ID NO: 2574457 - RNA, 16 nt, Coxiella burnetii RSA 493
aguacuagcaucaaua

SEQ ID NO: 2574458 - RNA, 14 nt, Coxiella burnetii RSA 493
aguagaaaacuuuc

SEQ ID NO: 2574459 - RNA, 14 nt, Coxiella burnetii RSA 493
aguagccaaaauaa

SEQ ID NO: 2574460 - RNA, 17 nt, Coxiella burnetii RSA 493
aguagcuaaaaaauuca

SEQ ID NO: 2574461 - RNA, 23 nt, Coxiella burnetii RSA 493
aguagcuaauacuaaacaaaaua

SEQ ID NO: 2574462 - RNA, 15 nt, Coxiella burnetii RSA 493
aguagcugcaaauuc

SEQ ID NO: 2574463 - RNA, 16 nt, Coxiella burnetii RSA 493
aguaggugauaaugag

SEQ ID NO: 2574464 - RNA, 15 nt, Coxiella burnetii RSA 493
aguauauuugcaguu

SEQ ID NO: 2574465 - RNA, 16 nt, Coxiella burnetii RSA 493
aguauccaacucucua

SEQ ID NO: 2574466 - RNA, 18 nt, Coxiella burnetii RSA 493
aguauccaacucucuagc

SEQ ID NO: 2574467 - RNA, 11 nt, Coxiella burnetii RSA 493
aguauccaucc

SEQ ID NO: 2574468 - RNA, 13 nt, Coxiella burnetii RSA 493
aguauccauccca

SEQ ID NO: 2574469 - RNA, 19 nt, Coxiella burnetii RSA 493
aguaugagcggcaauuuug

SEQ ID NO: 2574470 - RNA, 19 nt, Coxiella burnetii RSA 493
agucaaaaacuucaugcaa

SEQ ID NO: 2574471 - RNA, 22 nt, Coxiella burnetii RSA 493
agucaaaaacuucaugcaaaaa

SEQ ID NO: 2574472 - RNA, 13 nt, Coxiella burnetii RSA 493
agucaaaaauaaa

SEQ ID NO: 2574473 - RNA, 13 nt, Coxiella burnetii RSA 493
agucagacuugcu

SEQ ID NO: 2574474 - RNA, 15 nt, Coxiella burnetii RSA 493
agucagacuugcuuu

SEQ ID NO: 2574475 - RNA, 24 nt, Coxiella burnetii RSA 493
agucagacuugcuuuuuucugcga

SEQ ID NO: 2574476 - RNA, 19 nt, Coxiella burnetii RSA 493
aguccccaaaguuucacga

SEQ ID NO: 2574477 - RNA, 16 nt, Coxiella burnetii RSA 493
aguccgcuuuucccug

SEQ ID NO: 2574478 - RNA, 12 nt, Coxiella burnetii RSA 493
aguccguuaaaa

SEQ ID NO: 2574479 - RNA, 19 nt, Coxiella burnetii RSA 493
aguccguuaaaauuguaag

SEQ ID NO: 2574480 - RNA, 17 nt, Coxiella burnetii RSA 493
aguccuccuucaaggau

SEQ ID NO: 2574481 - RNA, 21 nt, Coxiella burnetii RSA 493
aguccuugacgcucagauaaa

SEQ ID NO: 2574482 - RNA, 16 nt, Coxiella burnetii RSA 493
aguccuugcugaauuc

SEQ ID NO: 2574483 - RNA, 20 nt, Coxiella burnetii RSA 493
aguccuugcugaauucccuu

SEQ ID NO: 2574484 - RNA, 22 nt, Coxiella burnetii RSA 493
aguccuugcugaauucccuuuu

SEQ ID NO: 2574485 - RNA, 14 nt, Coxiella burnetii RSA 493
agucgcaacaagca

SEQ ID NO: 2574486 - RNA, 17 nt, Coxiella burnetii RSA 493
agucgcaacaagcaacg

SEQ ID NO: 2574487 - RNA, 18 nt, Coxiella burnetii RSA 493
agucgcaacaagcaacga

SEQ ID NO: 2574488 - RNA, 19 nt, Coxiella burnetii RSA 493
agucgcaacaagcaacgau

SEQ ID NO: 2574489 - RNA, 18 nt, Coxiella burnetii RSA 493
agucgcccguaugcagcg

SEQ ID NO: 2574490 - RNA, 22 nt, Coxiella burnetii RSA 493
agucgcguaaagauaaaaugac

SEQ ID NO: 2574491 - RNA, 18 nt, Coxiella burnetii RSA 493
agucgcuccccccauuuu

SEQ ID NO: 2574492 - RNA, 20 nt, Coxiella burnetii RSA 493
agucguauuccuuuuucuuu

SEQ ID NO: 2574493 - RNA, 20 nt, Coxiella burnetii RSA 493
agucguuccguauccaucac

SEQ ID NO: 2574494 - RNA, 14 nt, Coxiella burnetii RSA 493
agucguuuuuuaau

SEQ ID NO: 2574495 - RNA, 19 nt, Coxiella burnetii RSA 493
agucguuuuuuaauauuug

SEQ ID NO: 2574496 - RNA, 21 nt, Coxiella burnetii RSA 493
agucuauugaaaaaaacgccc

SEQ ID NO: 2574497 - RNA, 16 nt, Coxiella burnetii RSA 493
agucucagcaucagcc

SEQ ID NO: 2574498 - RNA, 17 nt, Coxiella burnetii RSA 493
agucucagcaucagccu

SEQ ID NO: 2574499 - RNA, 14 nt, Coxiella burnetii RSA 493
agucucuuagcaua

SEQ ID NO: 2574500 - RNA, 20 nt, Coxiella burnetii RSA 493
agucugaacaggcagaugau

SEQ ID NO: 2574501 - RNA, 20 nt, Coxiella burnetii RSA 493
agucuggccugccacaauca

SEQ ID NO: 2574502 - RNA, 19 nt, Coxiella burnetii RSA 493
agucugguuaaacccauuu

SEQ ID NO: 2574503 - RNA, 18 nt, Coxiella burnetii RSA 493
agucugucguuucugauu

SEQ ID NO: 2574504 - RNA, 19 nt, Coxiella burnetii RSA 493
agucuuuuuauauuccuga

SEQ ID NO: 2574505 - RNA, 13 nt, Coxiella burnetii RSA 493
agugaaauaaccu

SEQ ID NO: 2574506 - RNA, 13 nt, Coxiella burnetii RSA 493
agugaaauuuuuu

SEQ ID NO: 2574507 - RNA, 14 nt, Coxiella burnetii RSA 493
agugaaucauccaa

SEQ ID NO: 2574508 - RNA, 16 nt, Coxiella burnetii RSA 493
agugaccgagauuuuu

SEQ ID NO: 2574509 - RNA, 20 nt, Coxiella burnetii RSA 493
agugaccgagauuuuuccga

SEQ ID NO: 2574510 - RNA, 17 nt, Coxiella burnetii RSA 493
auaacauaucuucaaca

SEQ ID NO: 2574511 - RNA, 13 nt, Coxiella burnetii RSA 493
auaaccuaaaaua

SEQ ID NO: 2574512 - RNA, 14 nt, Coxiella burnetii RSA 493
auaaccuuucgcuu

SEQ ID NO: 2574513 - RNA, 15 nt, Coxiella burnetii RSA 493
auaacgcuugcaaua

SEQ ID NO: 2574514 - RNA, 14 nt, Coxiella burnetii RSA 493
auaacuaauugcca

SEQ ID NO: 2574515 - RNA, 15 nt, Coxiella burnetii RSA 493
auaacuauuauuaaa

SEQ ID NO: 2574516 - RNA, 13 nt, Coxiella burnetii RSA 493
auaacuauuuuaa

SEQ ID NO: 2574517 - RNA, 14 nt, Coxiella burnetii RSA 493
auaacuauuuuaaa

SEQ ID NO: 2574518 - RNA, 20 nt, Coxiella burnetii RSA 493
auaacucagcggcaagccag

SEQ ID NO: 2574519 - RNA, 15 nt, Coxiella burnetii RSA 493
auaacuuuacuaaaa

SEQ ID NO: 2574520 - RNA, 17 nt, Coxiella burnetii RSA 493
auaacuuuaguuuuucc

SEQ ID NO: 2574521 - RNA, 13 nt, Coxiella burnetii RSA 493
auaagaaacguau

SEQ ID NO: 2574522 - RNA, 22 nt, Coxiella burnetii RSA 493
auaagccguucaccccauuuca

SEQ ID NO: 2574523 - RNA, 11 nt, Coxiella burnetii RSA 493
auaagcggguu

SEQ ID NO: 2574524 - RNA, 17 nt, Coxiella burnetii RSA 493
auaagcuagaaaauaac

SEQ ID NO: 2574525 - RNA, 19 nt, Coxiella burnetii RSA 493
auaagcuaucagcagaaaa

SEQ ID NO: 2574526 - RNA, 15 nt, Coxiella burnetii RSA 493
auaagcuguuucuuu

SEQ ID NO: 2574527 - RNA, 22 nt, Coxiella burnetii RSA 493
auaaggaaauugauguguuuuc

SEQ ID NO: 2574528 - RNA, 22 nt, Coxiella burnetii RSA 493
auaaggagcggcugaauucaaa

SEQ ID NO: 2574529 - RNA, 17 nt, Coxiella burnetii RSA 493
auaaggauaaggaagac

SEQ ID NO: 2574530 - RNA, 15 nt, Coxiella burnetii RSA 493
auaagggauauauug

SEQ ID NO: 2574531 - RNA, 18 nt, Coxiella burnetii RSA 493
auaaguguggucugaaaa

SEQ ID NO: 2574532 - RNA, 16 nt, Coxiella burnetii RSA 493
auaaguugucgauaaa

SEQ ID NO: 2574533 - RNA, 21 nt, Coxiella burnetii RSA 493
auaauaacgcuaugaaaacca

SEQ ID NO: 2574534 - RNA, 15 nt, Coxiella burnetii RSA 493
auaauaacgcuugca

SEQ ID NO: 2574535 - RNA, 18 nt, Coxiella burnetii RSA 493
auaauacugcaaacccac

SEQ ID NO: 2574536 - RNA, 20 nt, Coxiella burnetii RSA 493
auaauagcguauagaguagg

SEQ ID NO: 2574537 - RNA, 15 nt, Coxiella burnetii RSA 493
auaauaguuugcaau

SEQ ID NO: 2574538 - RNA, 19 nt, Coxiella burnetii RSA 493
auaauaucuagauuuaaaa

SEQ ID NO: 2574539 - RNA, 13 nt, Coxiella burnetii RSA 493
auaauauguccaa

SEQ ID NO: 2574540 - RNA, 21 nt, Coxiella burnetii RSA 493
auaaucacaaaagguaaaaaa

SEQ ID NO: 2574541 - RNA, 12 nt, Coxiella burnetii RSA 493
auaaucaugauc

SEQ ID NO: 2574542 - RNA, 18 nt, Coxiella burnetii RSA 493
auaaucauuuuuccuauu

SEQ ID NO: 2574543 - RNA, 18 nt, Coxiella burnetii RSA 493
auaauccgccuaaauuaa

SEQ ID NO: 2574544 - RNA, 14 nt, Coxiella burnetii RSA 493
auaauccuucuuuu

SEQ ID NO: 2574545 - RNA, 20 nt, Coxiella burnetii RSA 493
auaauccuucuuuugucuug

SEQ ID NO: 2574546 - RNA, 22 nt, Coxiella burnetii RSA 493
auaaucgguccggccggcgauu

SEQ ID NO: 2574547 - RNA, 22 nt, Coxiella burnetii RSA 493
auaaucucgucgcccucauuca

SEQ ID NO: 2574548 - RNA, 17 nt, Coxiella burnetii RSA 493
auaaucuggguuucuuu

SEQ ID NO: 2574549 - RNA, 21 nt, Coxiella burnetii RSA 493
auaaugacuuugauauggcgc

SEQ ID NO: 2574550 - RNA, 17 nt, Coxiella burnetii RSA 493
auaaugagaugaucauc

SEQ ID NO: 2574551 - RNA, 21 nt, Coxiella burnetii RSA 493
auaaugagaugaucaucauca

SEQ ID NO: 2574552 - RNA, 22 nt, Coxiella burnetii RSA 493
auaaugagaugaucaucaucaa

SEQ ID NO: 2574553 - RNA, 15 nt, Coxiella burnetii RSA 493
auaaugaguggcugc

SEQ ID NO: 2574554 - RNA, 21 nt, Coxiella burnetii RSA 493
auaaugggaguaaugacagaa

SEQ ID NO: 2574555 - RNA, 16 nt, Coxiella burnetii RSA 493
auaaugggguaaagcu

SEQ ID NO: 2574556 - RNA, 20 nt, Coxiella burnetii RSA 493
auaaugucuccaaccgauac

SEQ ID NO: 2574557 - RNA, 13 nt, Coxiella burnetii RSA 493
auaaugucugcau

SEQ ID NO: 2574558 - RNA, 20 nt, Coxiella burnetii RSA 493
auaaugucugcauuuuuaau

SEQ ID NO: 2574559 - RNA, 15 nt, Coxiella burnetii RSA 493
auaauguuugauauc

SEQ ID NO: 2574560 - RNA, 14 nt, Coxiella burnetii RSA 493
auaauuacaaucca

SEQ ID NO: 2574561 - RNA, 21 nt, Coxiella burnetii RSA 493
auaauucggguaacaaaguua

SEQ ID NO: 2574562 - RNA, 17 nt, Coxiella burnetii RSA 493
auaauucuuucugaaaa

SEQ ID NO: 2574563 - RNA, 14 nt, Coxiella burnetii RSA 493
auaauuuaaacuca

SEQ ID NO: 2574564 - RNA, 16 nt, Coxiella burnetii RSA 493
auaauuuaaacucaau

SEQ ID NO: 2574565 - RNA, 14 nt, Coxiella burnetii RSA 493
auaauuuauaacaa

SEQ ID NO: 2574566 - RNA, 12 nt, Coxiella burnetii RSA 493
auaauuuccugu

SEQ ID NO: 2574567 - RNA, 17 nt, Coxiella burnetii RSA 493
auaauuugguaaugcuu

SEQ ID NO: 2574568 - RNA, 13 nt, Coxiella burnetii RSA 493
auaauuuuauaaa

SEQ ID NO: 2574569 - RNA, 16 nt, Coxiella burnetii RSA 493
auacaaauuuuuaaga

SEQ ID NO: 2574570 - RNA, 17 nt, Coxiella burnetii RSA 493
auacaaauuuuuaagac

SEQ ID NO: 2574571 - RNA, 18 nt, Coxiella burnetii RSA 493
auacaaugcguagucaua

SEQ ID NO: 2574572 - RNA, 14 nt, Coxiella burnetii RSA 493
auacacauaaugau

SEQ ID NO: 2574573 - RNA, 20 nt, Coxiella burnetii RSA 493
auacacccauacaaggccgg

SEQ ID NO: 2574574 - RNA, 11 nt, Coxiella burnetii RSA 493
auacaggaaaa

SEQ ID NO: 2574575 - RNA, 13 nt, Coxiella burnetii RSA 493
auacaggaaaaag

SEQ ID NO: 2574576 - RNA, 14 nt, Coxiella burnetii RSA 493
auacaggaaaaaga

SEQ ID NO: 2574577 - RNA, 15 nt, Coxiella burnetii RSA 493
auacauaugaauauu

SEQ ID NO: 2574578 - RNA, 15 nt, Coxiella burnetii RSA 493
auacaucgucggcag

SEQ ID NO: 2574579 - RNA, 18 nt, Coxiella burnetii RSA 493
auacaucuugauccuuuu

SEQ ID NO: 2574580 - RNA, 19 nt, Coxiella burnetii RSA 493
auacauucuucaguaauuu

SEQ ID NO: 2574581 - RNA, 22 nt, Coxiella burnetii RSA 493
auacauucuucaguaauuuuua

SEQ ID NO: 2574582 - RNA, 22 nt, Coxiella burnetii RSA 493
auaccaauucaaauaauacugc

SEQ ID NO: 2574583 - RNA, 13 nt, Coxiella burnetii RSA 493
auaccaucaggau

SEQ ID NO: 2574584 - RNA, 18 nt, Coxiella burnetii RSA 493
auaccauuuuuaaauuau

SEQ ID NO: 2574585 - RNA, 22 nt, Coxiella burnetii RSA 493
auacccaaucaauucgaaagaa

SEQ ID NO: 2574586 - RNA, 15 nt, Coxiella burnetii RSA 493
auaccgguaaucauu

SEQ ID NO: 2574587 - RNA, 23 nt, Coxiella burnetii RSA 493
auaccucguccagcucguaagcg

SEQ ID NO: 2574588 - RNA, 17 nt, Coxiella burnetii RSA 493
auacgauauaaaagcau

SEQ ID NO: 2574589 - RNA, 16 nt, Coxiella burnetii RSA 493
auacggcuuuauuuug

SEQ ID NO: 2574590 - RNA, 18 nt, Coxiella burnetii RSA 493
auacgggaaaacaaugau

SEQ ID NO: 2574591 - RNA, 21 nt, Coxiella burnetii RSA 493
auacgggcuacucuuuuucuu

SEQ ID NO: 2574592 - RNA, 15 nt, Coxiella burnetii RSA 493
auacgggcuacuucc

SEQ ID NO: 2574593 - RNA, 18 nt, Coxiella burnetii RSA 493
auacgggcuacuuuacuu

SEQ ID NO: 2574594 - RNA, 22 nt, Coxiella burnetii RSA 493
auacgggcuacuuuacuuuuug

SEQ ID NO: 2574595 - RNA, 15 nt, Coxiella burnetii RSA 493
auacggggacaauag

SEQ ID NO: 2574596 - RNA, 16 nt, Coxiella burnetii RSA 493
auacggugcagaaggc

SEQ ID NO: 2574597 - RNA, 16 nt, Coxiella burnetii RSA 493
auacuaaacaaaauaa

SEQ ID NO: 2574598 - RNA, 19 nt, Coxiella burnetii RSA 493
auacuaaauuaguaauauu

SEQ ID NO: 2574599 - RNA, 21 nt, Coxiella burnetii RSA 493
auacuaaauuguccuuuucua

SEQ ID NO: 2574600 - RNA, 16 nt, Coxiella burnetii RSA 493
auacuaacugcaacug

SEQ ID NO: 2574601 - RNA, 15 nt, Coxiella burnetii RSA 493
auacuagcuuuugaa

SEQ ID NO: 2574602 - RNA, 15 nt, Coxiella burnetii RSA 493
auacuccccuacuuu

SEQ ID NO: 2574603 - RNA, 17 nt, Coxiella burnetii RSA 493
auacugcccaagaaauu

SEQ ID NO: 2574604 - RNA, 22 nt, Coxiella burnetii RSA 493
auacuggcaauaaguguuugau

SEQ ID NO: 2574605 - RNA, 17 nt, Coxiella burnetii RSA 493
auacuuaaaauuucuuu

SEQ ID NO: 2574606 - RNA, 18 nt, Coxiella burnetii RSA 493
auacuuuguuuuuuuuca

SEQ ID NO: 2574607 - RNA, 15 nt, Coxiella burnetii RSA 493
auagaaaaaagaaau

SEQ ID NO: 2574608 - RNA, 22 nt, Coxiella burnetii RSA 493
auagaaaaacuccgcugcucca

SEQ ID NO: 2574609 - RNA, 13 nt, Coxiella burnetii RSA 493
auagaagaacaau

SEQ ID NO: 2574610 - RNA, 14 nt, Coxiella burnetii RSA 493
auagaagcaucaga

SEQ ID NO: 2574611 - RNA, 22 nt, Coxiella burnetii RSA 493
auagacaauuuuuuuuguugaa

SEQ ID NO: 2574612 - RNA, 20 nt, Coxiella burnetii RSA 493
auagaccaucguuuuauaca

SEQ ID NO: 2574613 - RNA, 14 nt, Coxiella burnetii RSA 493
auagacuaccgaga

SEQ ID NO: 2574614 - RNA, 15 nt, Coxiella burnetii RSA 493
auagacuucgcuaaa

SEQ ID NO: 2574615 - RNA, 18 nt, Coxiella burnetii RSA 493
auagacuucgcuaaauaa

SEQ ID NO: 2574616 - RNA, 16 nt, Coxiella burnetii RSA 493
aucacaccaagaaauu

SEQ ID NO: 2574617 - RNA, 22 nt, Coxiella burnetii RSA 493
aucacaccaagaaauugaucuu

SEQ ID NO: 2574618 - RNA, 15 nt, Coxiella burnetii RSA 493
aucacagcaucuaac

SEQ ID NO: 2574619 - RNA, 17 nt, Coxiella burnetii RSA 493
aucacaucccuuuucau

SEQ ID NO: 2574620 - RNA, 13 nt, Coxiella burnetii RSA 493
aucaccaaaauac

SEQ ID NO: 2574621 - RNA, 14 nt, Coxiella burnetii RSA 493
aucaccaaaauaca

SEQ ID NO: 2574622 - RNA, 14 nt, Coxiella burnetii RSA 493
aucaccacaauuaa

SEQ ID NO: 2574623 - RNA, 22 nt, Coxiella burnetii RSA 493
aucaccacaauuaaugcgccua

SEQ ID NO: 2574624 - RNA, 22 nt, Coxiella burnetii RSA 493
aucacccacguugcaauaacaa

SEQ ID NO: 2574625 - RNA, 21 nt, Coxiella burnetii RSA 493
aucaccuuugcuaacaauugu

SEQ ID NO: 2574626 - RNA, 21 nt, Coxiella burnetii RSA 493
aucacgaggaggguaagaaua

SEQ ID NO: 2574627 - RNA, 20 nt, Coxiella burnetii RSA 493
aucacgccaaagcauuccga

SEQ ID NO: 2574628 - RNA, 13 nt, Coxiella burnetii RSA 493
aucacgcuuuuuu

SEQ ID NO: 2574629 - RNA, 14 nt, Coxiella burnetii RSA 493
aucacgcuuuuuuu

SEQ ID NO: 2574630 - RNA, 16 nt, Coxiella burnetii RSA 493
aucacuacgaauagcc

SEQ ID NO: 2574631 - RNA, 16 nt, Coxiella burnetii RSA 493
aucacuccaauaauaa

SEQ ID NO: 2574632 - RNA, 16 nt, Coxiella burnetii RSA 493
aucacuugauaaucaa

SEQ ID NO: 2574633 - RNA, 12 nt, Coxiella burnetii RSA 493
aucagaaacggc

SEQ ID NO: 2574634 - RNA, 17 nt, Coxiella burnetii RSA 493
aucagccugaucaaguu

SEQ ID NO: 2574635 - RNA, 22 nt, Coxiella burnetii RSA 493
aucagccugaucaaguuucucc

SEQ ID NO: 2574636 - RNA, 24 nt, Coxiella burnetii RSA 493
aucauaaucgguuauuucucgaac

SEQ ID NO: 2574637 - RNA, 19 nt, Coxiella burnetii RSA 493
aucauacauaugaauauua

SEQ ID NO: 2574638 - RNA, 14 nt, Coxiella burnetii RSA 493
aucaucaacagaac

SEQ ID NO: 2574639 - RNA, 11 nt, Coxiella burnetii RSA 493
aucaucaaucc

SEQ ID NO: 2574640 - RNA, 14 nt, Coxiella burnetii RSA 493
aucaucaucaaaau

SEQ ID NO: 2574641 - RNA, 15 nt, Coxiella burnetii RSA 493
aucaucaucgccgga

SEQ ID NO: 2574642 - RNA, 12 nt, Coxiella burnetii RSA 493
aucaucgcaaga

SEQ ID NO: 2574643 - RNA, 14 nt, Coxiella burnetii RSA 493
aucaugcauuugau

SEQ ID NO: 2574644 - RNA, 21 nt, Coxiella burnetii RSA 493
aucauguggucucuuuuuuug

SEQ ID NO: 2574645 - RNA, 15 nt, Coxiella burnetii RSA 493
aucauuaucucuuaa

SEQ ID NO: 2574646 - RNA, 19 nt, Coxiella burnetii RSA 493
aucauuccuccguucauuc

SEQ ID NO: 2574647 - RNA, 18 nt, Coxiella burnetii RSA 493
aucauugggccauuuaac

SEQ ID NO: 2574648 - RNA, 23 nt, Coxiella burnetii RSA 493
aucauugguuuuugauugccaaa

SEQ ID NO: 2574649 - RNA, 15 nt, Coxiella burnetii RSA 493
aucauuuugauuuuu

SEQ ID NO: 2574650 - RNA, 13 nt, Coxiella burnetii RSA 493
auccaaaauccag

SEQ ID NO: 2574651 - RNA, 17 nt, Coxiella burnetii RSA 493
auccaaaauccaggcug

SEQ ID NO: 2574652 - RNA, 22 nt, Coxiella burnetii RSA 493
auccaaaccggcccguugcaag

SEQ ID NO: 2574653 - RNA, 14 nt, Coxiella burnetii RSA 493
auccaaauagaugg

SEQ ID NO: 2574654 - RNA, 13 nt, Coxiella burnetii RSA 493
auccaaauauuua

SEQ ID NO: 2574655 - RNA, 22 nt, Coxiella burnetii RSA 493
auccaagggaucauaaucgguu

SEQ ID NO: 2574656 - RNA, 23 nt, Coxiella burnetii RSA 493
auccaauaaacgggcuaaagguu

SEQ ID NO: 2574657 - RNA, 21 nt, Coxiella burnetii RSA 493
auccaauuacuccaauuucau

SEQ ID NO: 2574658 - RNA, 14 nt, Coxiella burnetii RSA 493
auccacaauuucaa

SEQ ID NO: 2574659 - RNA, 18 nt, Coxiella burnetii RSA 493
auccacuuucucgcuuaa

SEQ ID NO: 2574660 - RNA, 20 nt, Coxiella burnetii RSA 493
auccaucacggggucgguaa

SEQ ID NO: 2574661 - RNA, 15 nt, Coxiella burnetii RSA 493
auccaucccaauucu

SEQ ID NO: 2574662 - RNA, 16 nt, Coxiella burnetii RSA 493
auccaucccaauucuc

SEQ ID NO: 2574663 - RNA, 21 nt, Coxiella burnetii RSA 493
auccauccggaugucauaauc

SEQ ID NO: 2574664 - RNA, 21 nt, Coxiella burnetii RSA 493
auccaugaaaggaauccuuuu

SEQ ID NO: 2574665 - RNA, 18 nt, Coxiella burnetii RSA 493
auccauguuggauuucau

SEQ ID NO: 2574666 - RNA, 15 nt, Coxiella burnetii RSA 493
auccccgaacggcac

SEQ ID NO: 2574667 - RNA, 15 nt, Coxiella burnetii RSA 493
auccgacauucuucu

SEQ ID NO: 2574668 - RNA, 18 nt, Coxiella burnetii RSA 493
auccgagcccaauaacaa

SEQ ID NO: 2574669 - RNA, 12 nt, Coxiella burnetii RSA 493
auccgcaauaug

SEQ ID NO: 2574670 - RNA, 16 nt, Coxiella burnetii RSA 493
auccgcaauaugcagc

SEQ ID NO: 2574671 - RNA, 18 nt, Coxiella burnetii RSA 493
auccgcauugcauuucuu

SEQ ID NO: 2574672 - RNA, 15 nt, Coxiella burnetii RSA 493
auccgcgugcggaua

SEQ ID NO: 2574673 - RNA, 17 nt, Coxiella burnetii RSA 493
auccgcuuuaauacagu

SEQ ID NO: 2574674 - RNA, 21 nt, Coxiella burnetii RSA 493
auccgguggaauuagagguuc

SEQ ID NO: 2574675 - RNA, 17 nt, Coxiella burnetii RSA 493
auccgguuuugauuuuu

SEQ ID NO: 2574676 - RNA, 22 nt, Coxiella burnetii RSA 493
auccgguuuugauuuuugcucu

SEQ ID NO: 2574677 - RNA, 15 nt, Coxiella burnetii RSA 493
auccuaauaaaaaua

SEQ ID NO: 2574678 - RNA, 21 nt, Coxiella burnetii RSA 493
auccuacuuucguaaagaccu

SEQ ID NO: 2574679 - RNA, 19 nt, Coxiella burnetii RSA 493
auccucacaaauuauauca

SEQ ID NO: 2574680 - RNA, 15 nt, Coxiella burnetii RSA 493
auccucaucaaacuu

SEQ ID NO: 2574681 - RNA, 14 nt, Coxiella burnetii RSA 493
auccuccauuacau

SEQ ID NO: 2574682 - RNA, 15 nt, Coxiella burnetii RSA 493
auccucgcguuuuau

SEQ ID NO: 2574683 - RNA, 19 nt, Coxiella burnetii RSA 493
auccucgcguuuuaucauu

SEQ ID NO: 2574684 - RNA, 23 nt, Coxiella burnetii RSA 493
auccucuuuagauucaugaaaau

SEQ ID NO: 2574685 - RNA, 16 nt, Coxiella burnetii RSA 493
auccuuaaugaguuca

SEQ ID NO: 2574686 - RNA, 17 nt, Coxiella burnetii RSA 493
auccuuacaaaaauacu

SEQ ID NO: 2574687 - RNA, 18 nt, Coxiella burnetii RSA 493
auccuuacaaaaauacuu

SEQ ID NO: 2574688 - RNA, 10 nt, Coxiella burnetii RSA 493
auccuugagg

SEQ ID NO: 2574689 - RNA, 19 nt, Coxiella burnetii RSA 493
auccuugaggaauugcuac

SEQ ID NO: 2574690 - RNA, 21 nt, Coxiella burnetii RSA 493
auccuugaggaauugcuaccu

SEQ ID NO: 2574691 - RNA, 13 nt, Coxiella burnetii RSA 493
auccuuuaauucg

SEQ ID NO: 2574692 - RNA, 19 nt, Coxiella burnetii RSA 493
auccuuucuaacgucgcaa

SEQ ID NO: 2574693 - RNA, 12 nt, Coxiella burnetii RSA 493
aucgaaauaacg

SEQ ID NO: 2574694 - RNA, 18 nt, Coxiella burnetii RSA 493
aucgacaggacaaaccug

SEQ ID NO: 2574695 - RNA, 14 nt, Coxiella burnetii RSA 493
aucgacuuucucac

SEQ ID NO: 2574696 - RNA, 15 nt, Coxiella burnetii RSA 493
aucgauaaaaauaau

SEQ ID NO: 2574697 - RNA, 16 nt, Coxiella burnetii RSA 493
aucgcaauuaauacau

SEQ ID NO: 2574698 - RNA, 20 nt, Coxiella burnetii RSA 493
aucgcaucauucgggcauuc

SEQ ID NO: 2574699 - RNA, 20 nt, Coxiella burnetii RSA 493
aucgccaugagugcauucau

SEQ ID NO: 2574700 - RNA, 14 nt, Coxiella burnetii RSA 493
aucgcccauauuca

SEQ ID NO: 2574701 - RNA, 13 nt, Coxiella burnetii RSA 493
aucgccggauuac

SEQ ID NO: 2574702 - RNA, 19 nt, Coxiella burnetii RSA 493
aucgccgucccuucugcug

SEQ ID NO: 2574703 - RNA, 14 nt, Coxiella burnetii RSA 493
aucgccguuucugc

SEQ ID NO: 2574704 - RNA, 19 nt, Coxiella burnetii RSA 493
aucgccguuucugcuuuua

SEQ ID NO: 2574705 - RNA, 22 nt, Coxiella burnetii RSA 493
aucgccuugcaaacaaacgaua

SEQ ID NO: 2574706 - RNA, 18 nt, Coxiella burnetii RSA 493
aucgcggacaauaagagc

SEQ ID NO: 2574707 - RNA, 14 nt, Coxiella burnetii RSA 493
aucgcuccuaaauu

SEQ ID NO: 2574708 - RNA, 16 nt, Coxiella burnetii RSA 493
aucgcuccuaaauuuu

SEQ ID NO: 2574709 - RNA, 23 nt, Coxiella burnetii RSA 493
aucgcuccuaucgaagaagcguc

SEQ ID NO: 2574710 - RNA, 21 nt, Coxiella burnetii RSA 493
aucgcugauacuucuucauua

SEQ ID NO: 2574711 - RNA, 13 nt, Coxiella burnetii RSA 493
aucgcugugaaaa

SEQ ID NO: 2574712 - RNA, 16 nt, Coxiella burnetii RSA 493
aucggauuaacgugcu

SEQ ID NO: 2574713 - RNA, 20 nt, Coxiella burnetii RSA 493
aucggcaacgaaaauaccuu

SEQ ID NO: 2574714 - RNA, 17 nt, Coxiella burnetii RSA 493
aucggccuacuuuuucu

SEQ ID NO: 2574715 - RNA, 21 nt, Coxiella burnetii RSA 493
aucggcuucacagagccaccg

SEQ ID NO: 2574716 - RNA, 22 nt, Coxiella burnetii RSA 493
aucguccagguaguuuguuuuu

SEQ ID NO: 2574717 - RNA, 20 nt, Coxiella burnetii RSA 493
aucguccccguauuucgcuu

SEQ ID NO: 2574718 - RNA, 21 nt, Coxiella burnetii RSA 493
aucgucuaaaacuuuguagac

SEQ ID NO: 2574719 - RNA, 19 nt, Coxiella burnetii RSA 493
aucgugccaguauuuuucu

SEQ ID NO: 2574720 - RNA, 23 nt, Coxiella burnetii RSA 493
aucguggguuuuuuaauuuuugc

SEQ ID NO: 2574721 - RNA, 16 nt, Coxiella burnetii RSA 493
augauguuuuaaaauu

SEQ ID NO: 2574722 - RNA, 17 nt, Coxiella burnetii RSA 493
augauguuuuaaaauua

SEQ ID NO: 2574723 - RNA, 15 nt, Coxiella burnetii RSA 493
augauuaaaucaaca

SEQ ID NO: 2574724 - RNA, 16 nt, Coxiella burnetii RSA 493
augauuauagaauggg

SEQ ID NO: 2574725 - RNA, 15 nt, Coxiella burnetii RSA 493
augauucccaccaaa

SEQ ID NO: 2574726 - RNA, 19 nt, Coxiella burnetii RSA 493
augauucccaccaaaauuc

SEQ ID NO: 2574727 - RNA, 17 nt, Coxiella burnetii RSA 493
augauugggcucaaaaa

SEQ ID NO: 2574728 - RNA, 19 nt, Coxiella burnetii RSA 493
augauugggcucaaaaaga

SEQ ID NO: 2574729 - RNA, 19 nt, Coxiella burnetii RSA 493
augauuuuucugugucauu

SEQ ID NO: 2574730 - RNA, 15 nt, Coxiella burnetii RSA 493
augcaaaaccaauga

SEQ ID NO: 2574731 - RNA, 16 nt, Coxiella burnetii RSA 493
augcaagguugaugcu

SEQ ID NO: 2574732 - RNA, 16 nt, Coxiella burnetii RSA 493
augcaaugaauucaaa

SEQ ID NO: 2574733 - RNA, 21 nt, Coxiella burnetii RSA 493
augcacgggcaccauuuuucu

SEQ ID NO: 2574734 - RNA, 14 nt, Coxiella burnetii RSA 493
augcagcacaaagc

SEQ ID NO: 2574735 - RNA, 21 nt, Coxiella burnetii RSA 493
augcagcgaagcgaaauacgg

SEQ ID NO: 2574736 - RNA, 18 nt, Coxiella burnetii RSA 493
augcagcgaagcggaaua

SEQ ID NO: 2574737 - RNA, 12 nt, Coxiella burnetii RSA 493
augcaguuaacc

SEQ ID NO: 2574738 - RNA, 23 nt, Coxiella burnetii RSA 493
augcccauucuuucauuaauucc

SEQ ID NO: 2574739 - RNA, 16 nt, Coxiella burnetii RSA 493
augcccgaaaaggaaa

SEQ ID NO: 2574740 - RNA, 20 nt, Coxiella burnetii RSA 493
augccgcuugaaaaauugaa

SEQ ID NO: 2574741 - RNA, 17 nt, Coxiella burnetii RSA 493
augcgaaaaaugaacaa

SEQ ID NO: 2574742 - RNA, 18 nt, Coxiella burnetii RSA 493
augcgaaaaaugaacaaa

SEQ ID NO: 2574743 - RNA, 16 nt, Coxiella burnetii RSA 493
augcgaauguaaugcu

SEQ ID NO: 2574744 - RNA, 17 nt, Coxiella burnetii RSA 493
augcgaauguaaugcuu

SEQ ID NO: 2574745 - RNA, 20 nt, Coxiella burnetii RSA 493
augcgcggaggaugagaggu

SEQ ID NO: 2574746 - RNA, 19 nt, Coxiella burnetii RSA 493
augcgcuuuccauuuuuua

SEQ ID NO: 2574747 - RNA, 14 nt, Coxiella burnetii RSA 493
augcgggguuuuuu

SEQ ID NO: 2574748 - RNA, 18 nt, Coxiella burnetii RSA 493
augcgguacuuaagaaag

SEQ ID NO: 2574749 - RNA, 22 nt, Coxiella burnetii RSA 493
augcguuuuaaaugcuuuucuu

SEQ ID NO: 2574750 - RNA, 19 nt, Coxiella burnetii RSA 493
augcuaagugauugauuuu

SEQ ID NO: 2574751 - RNA, 20 nt, Coxiella burnetii RSA 493
augcuauaauugaauuugag

SEQ ID NO: 2574752 - RNA, 18 nt, Coxiella burnetii RSA 493
augcuccaucaugauauc

SEQ ID NO: 2574753 - RNA, 19 nt, Coxiella burnetii RSA 493
augcuccgcguuuuuccac

SEQ ID NO: 2574754 - RNA, 22 nt, Coxiella burnetii RSA 493
augcucgcgaaauuuaauaaaa

SEQ ID NO: 2574755 - RNA, 20 nt, Coxiella burnetii RSA 493
augcugagaucggcugaaac

SEQ ID NO: 2574756 - RNA, 22 nt, Coxiella burnetii RSA 493
augcugaugaaauugcacaugg

SEQ ID NO: 2574757 - RNA, 16 nt, Coxiella burnetii RSA 493
augcugccuuaagaga

SEQ ID NO: 2574758 - RNA, 15 nt, Coxiella burnetii RSA 493
augcuucaauaaaaa

SEQ ID NO: 2574759 - RNA, 16 nt, Coxiella burnetii RSA 493
augcuucaauaaaaaa

SEQ ID NO: 2574760 - RNA, 15 nt, Coxiella burnetii RSA 493
augcuugcucuucuu

SEQ ID NO: 2574761 - RNA, 14 nt, Coxiella burnetii RSA 493
augcuuuuaaagug

SEQ ID NO: 2574762 - RNA, 23 nt, Coxiella burnetii RSA 493
augcuuuuaaagugaugauuaaa

SEQ ID NO: 2574763 - RNA, 17 nt, Coxiella burnetii RSA 493
augcuuuucuuucauua

SEQ ID NO: 2574764 - RNA, 22 nt, Coxiella burnetii RSA 493
augcuuuuuuuacuuuuucaaa

SEQ ID NO: 2574765 - RNA, 20 nt, Coxiella burnetii RSA 493
auggaaacgacgaucaccca

SEQ ID NO: 2574766 - RNA, 16 nt, Coxiella burnetii RSA 493
auggaacugauauacg

SEQ ID NO: 2574767 - RNA, 13 nt, Coxiella burnetii RSA 493
auggaaguucuau

SEQ ID NO: 2574768 - RNA, 19 nt, Coxiella burnetii RSA 493
auggacaaauguauuuauc

SEQ ID NO: 2574769 - RNA, 21 nt, Coxiella burnetii RSA 493
auggacgugcaaaugaguaaa

SEQ ID NO: 2574770 - RNA, 14 nt, Coxiella burnetii RSA 493
auggacuacacggu

SEQ ID NO: 2574771 - RNA, 15 nt, Coxiella burnetii RSA 493
auggacuacacgguu

SEQ ID NO: 2574772 - RNA, 15 nt, Coxiella burnetii RSA 493
auggaugaaagauuu

SEQ ID NO: 2574773 - RNA, 14 nt, Coxiella burnetii RSA 493
auggauuaaacccg

SEQ ID NO: 2574774 - RNA, 19 nt, Coxiella burnetii RSA 493
auggauucuucuuuugcca

SEQ ID NO: 2574775 - RNA, 14 nt, Coxiella burnetii RSA 493
auggauuuccacuu

SEQ ID NO: 2574776 - RNA, 15 nt, Coxiella burnetii RSA 493
auggcauuacaaacg

SEQ ID NO: 2574777 - RNA, 17 nt, Coxiella burnetii RSA 493
auggcccaauaaagaaa

SEQ ID NO: 2574778 - RNA, 21 nt, Coxiella burnetii RSA 493
auggccuuugcgguuaaaaaa

SEQ ID NO: 2574779 - RNA, 20 nt, Coxiella burnetii RSA 493
auggcgccugacaaagcggc

SEQ ID NO: 2574780 - RNA, 23 nt, Coxiella burnetii RSA 493
auggcgcuuucguuaagccugaa

SEQ ID NO: 2574781 - RNA, 18 nt, Coxiella burnetii RSA 493
auggcgguacgucaucaa

SEQ ID NO: 2574782 - RNA, 20 nt, Coxiella burnetii RSA 493
auggcgguacgucaucaaaa

SEQ ID NO: 2574783 - RNA, 16 nt, Coxiella burnetii RSA 493
auggcuuguuccgcca

SEQ ID NO: 2574784 - RNA, 21 nt, Coxiella burnetii RSA 493
auggcuuguuccgccauuucc

SEQ ID NO: 2574785 - RNA, 23 nt, Coxiella burnetii RSA 493
auggcuuuauucccgauggggau

SEQ ID NO: 2574786 - RNA, 15 nt, Coxiella burnetii RSA 493
augggaauuuuugaa

SEQ ID NO: 2574787 - RNA, 16 nt, Coxiella burnetii RSA 493
augggauaaaaaaccc

SEQ ID NO: 2574788 - RNA, 22 nt, Coxiella burnetii RSA 493
augggaugucgcuuuauucauu

SEQ ID NO: 2574789 - RNA, 15 nt, Coxiella burnetii RSA 493
augggcguacaaaga

SEQ ID NO: 2574790 - RNA, 15 nt, Coxiella burnetii RSA 493
augguaauaauuuuc

SEQ ID NO: 2574791 - RNA, 15 nt, Coxiella burnetii RSA 493
augguagcaacgccu

SEQ ID NO: 2574792 - RNA, 16 nt, Coxiella burnetii RSA 493
auggucaaaccaauca

SEQ ID NO: 2574793 - RNA, 15 nt, Coxiella burnetii RSA 493
auggucacaugauuu

SEQ ID NO: 2574794 - RNA, 16 nt, Coxiella burnetii RSA 493
auggugauuucuucca

SEQ ID NO: 2574795 - RNA, 13 nt, Coxiella burnetii RSA 493
augguucuuuuga

SEQ ID NO: 2574796 - RNA, 19 nt, Coxiella burnetii RSA 493
augguugauuuuuuaauua

SEQ ID NO: 2574797 - RNA, 21 nt, Coxiella burnetii RSA 493
augguuggacuacaucaaaua

SEQ ID NO: 2574798 - RNA, 21 nt, Coxiella burnetii RSA 493
auguaaaaaccgagcuucaug

SEQ ID NO: 2574799 - RNA, 18 nt, Coxiella burnetii RSA 493
auguauccuaauaaaaau

SEQ ID NO: 2574800 - RNA, 21 nt, Coxiella burnetii RSA 493
auguauccuaauaaaaauauu

SEQ ID NO: 2574801 - RNA, 21 nt, Coxiella burnetii RSA 493
auguauuucaaggaaugauuc

SEQ ID NO: 2574802 - RNA, 21 nt, Coxiella burnetii RSA 493
augucacuauuaaucauucuc

SEQ ID NO: 2574803 - RNA, 16 nt, Coxiella burnetii RSA 493
augucauaaucacaaa

SEQ ID NO: 2574804 - RNA, 20 nt, Coxiella burnetii RSA 493
augucccccgagcaaagcau

SEQ ID NO: 2574805 - RNA, 22 nt, Coxiella burnetii RSA 493
auguccgcauagguauuuccuu

SEQ ID NO: 2574806 - RNA, 15 nt, Coxiella burnetii RSA 493
augucgcuuuauuca

SEQ ID NO: 2574807 - RNA, 18 nt, Coxiella burnetii RSA 493
augucguucaauucugga

SEQ ID NO: 2574808 - RNA, 14 nt, Coxiella burnetii RSA 493
augugaucuacuuc

SEQ ID NO: 2574809 - RNA, 17 nt, Coxiella burnetii RSA 493
auguggagcuugcauua

SEQ ID NO: 2574810 - RNA, 18 nt, Coxiella burnetii RSA 493
auguguaacaaaaacgac

SEQ ID NO: 2574811 - RNA, 12 nt, Coxiella burnetii RSA 493
auguuaaaacac

SEQ ID NO: 2574812 - RNA, 20 nt, Coxiella burnetii RSA 493
auguuauuuuccucccauug

SEQ ID NO: 2574813 - RNA, 20 nt, Coxiella burnetii RSA 493
auguucucuccauuuagaaa

SEQ ID NO: 2574814 - RNA, 23 nt, Coxiella burnetii RSA 493
auguuuagcuaacugauuagcug

SEQ ID NO: 2574815 - RNA, 19 nt, Coxiella burnetii RSA 493
auguuucaauaacagagau

SEQ ID NO: 2574816 - RNA, 21 nt, Coxiella burnetii RSA 493
auguuuccguuuggguugaga

SEQ ID NO: 2574817 - RNA, 12 nt, Coxiella burnetii RSA 493
auuaaaaacaau

SEQ ID NO: 2574818 - RNA, 12 nt, Coxiella burnetii RSA 493
auuaaaaauauu

SEQ ID NO: 2574819 - RNA, 13 nt, Coxiella burnetii RSA 493
auuaaaaaugaua

SEQ ID NO: 2574820 - RNA, 16 nt, Coxiella burnetii RSA 493
auuaaaaauuuuaaaa

SEQ ID NO: 2574821 - RNA, 17 nt, Coxiella burnetii RSA 493
auuaaaaauuuuaaaaa

SEQ ID NO: 2574822 - RNA, 21 nt, Coxiella burnetii RSA 493
auuaaaacaagacaacaaaau

SEQ ID NO: 2574823 - RNA, 20 nt, Coxiella burnetii RSA 493
auuaaaagagcgaauaaaaa

SEQ ID NO: 2574824 - RNA, 19 nt, Coxiella burnetii RSA 493
auuaaaauaauccaaggga

SEQ ID NO: 2574825 - RNA, 16 nt, Coxiella burnetii RSA 493
auuaaaccauaagcaa

SEQ ID NO: 2574826 - RNA, 22 nt, Coxiella burnetii RSA 493
auuccuuuuucuuuuaauugau

SEQ ID NO: 2574827 - RNA, 15 nt, Coxiella burnetii RSA 493
auuccuuuuuuuaau

SEQ ID NO: 2574828 - RNA, 20 nt, Coxiella burnetii RSA 493
auuccuuuuuuuaauguuug

SEQ ID NO: 2574829 - RNA, 21 nt, Coxiella burnetii RSA 493
auucgaacgacuuuuuuuacc

SEQ ID NO: 2574830 - RNA, 20 nt, Coxiella burnetii RSA 493
auucgauauguuucaauaac

SEQ ID NO: 2574831 - RNA, 13 nt, Coxiella burnetii RSA 493
auucgcgcugcaa

SEQ ID NO: 2574832 - RNA, 18 nt, Coxiella burnetii RSA 493
auucgcggguaaauuuau

SEQ ID NO: 2574833 - RNA, 13 nt, Coxiella burnetii RSA 493
auucgcuaagcuu

SEQ ID NO: 2574834 - RNA, 18 nt, Coxiella burnetii RSA 493
auucgcuccucaauuucc

SEQ ID NO: 2574835 - RNA, 16 nt, Coxiella burnetii RSA 493
auucgcuuuuuugcuu

SEQ ID NO: 2574836 - RNA, 20 nt, Coxiella burnetii RSA 493
auucggauacgaccuucuga

SEQ ID NO: 2574837 - RNA, 13 nt, Coxiella burnetii RSA 493
auucgggcauacg

SEQ ID NO: 2574838 - RNA, 14 nt, Coxiella burnetii RSA 493
auucgggcauucgg

SEQ ID NO: 2574839 - RNA, 20 nt, Coxiella burnetii RSA 493
auucgguuuuuuuaaaaaag

SEQ ID NO: 2574840 - RNA, 22 nt, Coxiella burnetii RSA 493
auucgguuuuuuuaaaaaagaa

SEQ ID NO: 2574841 - RNA, 22 nt, Coxiella burnetii RSA 493
auucguaauauuauugagaauc

SEQ ID NO: 2574842 - RNA, 21 nt, Coxiella burnetii RSA 493
auucguauaggaacauucuaa

SEQ ID NO: 2574843 - RNA, 16 nt, Coxiella burnetii RSA 493
auucuaacguuaguuu

SEQ ID NO: 2574844 - RNA, 20 nt, Coxiella burnetii RSA 493
auucuaacguuaguuucuuu

SEQ ID NO: 2574845 - RNA, 23 nt, Coxiella burnetii RSA 493
auucuaacguuaguuucuuuuau

SEQ ID NO: 2574846 - RNA, 17 nt, Coxiella burnetii RSA 493
auucuaauuaaauuacu

SEQ ID NO: 2574847 - RNA, 19 nt, Coxiella burnetii RSA 493
auucuauaaucauuuuucc

SEQ ID NO: 2574848 - RNA, 15 nt, Coxiella burnetii RSA 493
auucuauacuucauc

SEQ ID NO: 2574849 - RNA, 17 nt, Coxiella burnetii RSA 493
auucuauacuucaucuc

SEQ ID NO: 2574850 - RNA, 13 nt, Coxiella burnetii RSA 493
auucuauuagcug

SEQ ID NO: 2574851 - RNA, 14 nt, Coxiella burnetii RSA 493
auucuauuagcugc

SEQ ID NO: 2574852 - RNA, 19 nt, Coxiella burnetii RSA 493
auucucauuugacuuguca

SEQ ID NO: 2574853 - RNA, 17 nt, Coxiella burnetii RSA 493
auucuccuuaauaaagu

SEQ ID NO: 2574854 - RNA, 16 nt, Coxiella burnetii RSA 493
auucucuauuucgaga

SEQ ID NO: 2574855 - RNA, 14 nt, Coxiella burnetii RSA 493
auucucucaaagaa

SEQ ID NO: 2574856 - RNA, 18 nt, Coxiella burnetii RSA 493
auucugaacgcucuucca

SEQ ID NO: 2574857 - RNA, 17 nt, Coxiella burnetii RSA 493
auucugaaucacuucuu

SEQ ID NO: 2574858 - RNA, 14 nt, Coxiella burnetii RSA 493
auucuuaauuuuuc

SEQ ID NO: 2574859 - RNA, 15 nt, Coxiella burnetii RSA 493
auucuucauaggauu

SEQ ID NO: 2574860 - RNA, 21 nt, Coxiella burnetii RSA 493
auucuugaacaggagcgauaa

SEQ ID NO: 2574861 - RNA, 21 nt, Coxiella burnetii RSA 493
auucuugcagugaaauaaccu

SEQ ID NO: 2574862 - RNA, 22 nt, Coxiella burnetii RSA 493
auucuuuagccauugguuuaaa

SEQ ID NO: 2574863 - RNA, 22 nt, Coxiella burnetii RSA 493
auucuuucauuaauuccaucac

SEQ ID NO: 2574864 - RNA, 14 nt, Coxiella burnetii RSA 493
auucuuucauuauc

SEQ ID NO: 2574865 - RNA, 19 nt, Coxiella burnetii RSA 493
auucuuuuggcauuguucu

SEQ ID NO: 2574866 - RNA, 20 nt, Coxiella burnetii RSA 493
auucuuuuuuaauauuuuuu

SEQ ID NO: 2574867 - RNA, 17 nt, Coxiella burnetii RSA 493
auugaaaugcccucaaa

SEQ ID NO: 2574868 - RNA, 15 nt, Coxiella burnetii RSA 493
auugaagaauuuguu

SEQ ID NO: 2574869 - RNA, 12 nt, Coxiella burnetii RSA 493
auugaaguccuu

SEQ ID NO: 2574870 - RNA, 16 nt, Coxiella burnetii RSA 493
auugaagucugguuaa

SEQ ID NO: 2574871 - RNA, 23 nt, Coxiella burnetii RSA 493
auugaauggacgugcaaaugagu

SEQ ID NO: 2574872 - RNA, 13 nt, Coxiella burnetii RSA 493
auugaauuugcuu

SEQ ID NO: 2574873 - RNA, 18 nt, Coxiella burnetii RSA 493
auugaauuugcuuguuaa

SEQ ID NO: 2574874 - RNA, 17 nt, Coxiella burnetii RSA 493
auugacagccagcaauu

SEQ ID NO: 2574875 - RNA, 21 nt, Coxiella burnetii RSA 493
auugacaugaagguacugaag

SEQ ID NO: 2574876 - RNA, 14 nt, Coxiella burnetii RSA 493
auugacuucuuugu

SEQ ID NO: 2574877 - RNA, 20 nt, Coxiella burnetii RSA 493
auugagaguccuaaaauacu

SEQ ID NO: 2574878 - RNA, 17 nt, Coxiella burnetii RSA 493
auugagcggcuuuuuca

SEQ ID NO: 2574879 - RNA, 18 nt, Coxiella burnetii RSA 493
auugaggaaaauaagaug

SEQ ID NO: 2574880 - RNA, 21 nt, Coxiella burnetii RSA 493
auugaguggugguagaauucu

SEQ ID NO: 2574881 - RNA, 21 nt, Coxiella burnetii RSA 493
auugauuagcaucuugaauca

SEQ ID NO: 2574882 - RNA, 18 nt, Coxiella burnetii RSA 493
auugauugcguaaugcaa

SEQ ID NO: 2574883 - RNA, 12 nt, Coxiella burnetii RSA 493
auugauuuuguc

SEQ ID NO: 2574884 - RNA, 20 nt, Coxiella burnetii RSA 493
auugauuuuuuaaugaaaaa

SEQ ID NO: 2574885 - RNA, 15 nt, Coxiella burnetii RSA 493
auugcaaaacuuccc

SEQ ID NO: 2574886 - RNA, 20 nt, Coxiella burnetii RSA 493
auugcaguugguuuaaaaau

SEQ ID NO: 2574887 - RNA, 15 nt, Coxiella burnetii RSA 493
auugcauguuugcug

SEQ ID NO: 2574888 - RNA, 20 nt, Coxiella burnetii RSA 493
auugcauuucuuucaauaaa

SEQ ID NO: 2574889 - RNA, 13 nt, Coxiella burnetii RSA 493
auugccaaagaaa

SEQ ID NO: 2574890 - RNA, 15 nt, Coxiella burnetii RSA 493
auugccaaagaaaug

SEQ ID NO: 2574891 - RNA, 17 nt, Coxiella burnetii RSA 493
auugccaaaguucauua

SEQ ID NO: 2574892 - RNA, 18 nt, Coxiella burnetii RSA 493
auugccgauauucuuuuu

SEQ ID NO: 2574893 - RNA, 18 nt, Coxiella burnetii RSA 493
auugcgccgguuuaaaac

SEQ ID NO: 2574894 - RNA, 16 nt, Coxiella burnetii RSA 493
auugcgcguaaaauuc

SEQ ID NO: 2574895 - RNA, 17 nt, Coxiella burnetii RSA 493
auugcgcguaaaauucc

SEQ ID NO: 2574896 - RNA, 15 nt, Coxiella burnetii RSA 493
auugcggaaauuuca

SEQ ID NO: 2574897 - RNA, 16 nt, Coxiella burnetii RSA 493
auugcggaaauuucac

SEQ ID NO: 2574898 - RNA, 18 nt, Coxiella burnetii RSA 493
auugcggcucaauuauua

SEQ ID NO: 2574899 - RNA, 18 nt, Coxiella burnetii RSA 493
auugcucaauauugaaua

SEQ ID NO: 2574900 - RNA, 15 nt, Coxiella burnetii RSA 493
auugcugaauugaua

SEQ ID NO: 2574901 - RNA, 17 nt, Coxiella burnetii RSA 493
auugcugauauuuuuua

SEQ ID NO: 2574902 - RNA, 18 nt, Coxiella burnetii RSA 493
auuggagucgcuuucaau

SEQ ID NO: 2574903 - RNA, 20 nt, Coxiella burnetii RSA 493
auuggccuagccgaauguuu

SEQ ID NO: 2574904 - RNA, 21 nt, Coxiella burnetii RSA 493
auugggccauuuaacaaaaau

SEQ ID NO: 2574905 - RNA, 22 nt, Coxiella burnetii RSA 493
auuggucuugauuccuucaauc

SEQ ID NO: 2574906 - RNA, 22 nt, Coxiella burnetii RSA 493
auuguaaacagacccccauuuu

SEQ ID NO: 2574907 - RNA, 21 nt, Coxiella burnetii RSA 493
auuguaauuugggcugucuuc

SEQ ID NO: 2574908 - RNA, 16 nt, Coxiella burnetii RSA 493
auugucaaaauuagaa

SEQ ID NO: 2574909 - RNA, 12 nt, Coxiella burnetii RSA 493
auuguccuuuuc

SEQ ID NO: 2574910 - RNA, 16 nt, Coxiella burnetii RSA 493
auugucuaacauuugg

SEQ ID NO: 2574911 - RNA, 19 nt, Coxiella burnetii RSA 493
auuguuaacaccuuuuuca

SEQ ID NO: 2574912 - RNA, 13 nt, Coxiella burnetii RSA 493
auuguuaauccac

SEQ ID NO: 2574913 - RNA, 17 nt, Coxiella burnetii RSA 493
auuguucauaaaauaau

SEQ ID NO: 2574914 - RNA, 19 nt, Coxiella burnetii RSA 493
auuguucggcugcgcauuc

SEQ ID NO: 2574915 - RNA, 17 nt, Coxiella burnetii RSA 493
auuguugauuuaacuuc

SEQ ID NO: 2574916 - RNA, 19 nt, Coxiella burnetii RSA 493
auuguuguggauaaaggag

SEQ ID NO: 2574917 - RNA, 20 nt, Coxiella burnetii RSA 493
auuguuguggauaaaggaga

SEQ ID NO: 2574918 - RNA, 17 nt, Coxiella burnetii RSA 493
auuguuucaugaaguuc

SEQ ID NO: 2574919 - RNA, 15 nt, Coxiella burnetii RSA 493
auuguuugaaaaaau

SEQ ID NO: 2574920 - RNA, 18 nt, Coxiella burnetii RSA 493
auuguuugaaaaaauacc

SEQ ID NO: 2574921 - RNA, 13 nt, Coxiella burnetii RSA 493
auuuaaaaaacua

SEQ ID NO: 2574922 - RNA, 21 nt, Coxiella burnetii RSA 493
auuuaaaaaacuagaaauauu

SEQ ID NO: 2574923 - RNA, 18 nt, Coxiella burnetii RSA 493
auuuaaacaaacugcugg

SEQ ID NO: 2574924 - RNA, 14 nt, Coxiella burnetii RSA 493
auuuaaauugaauc

SEQ ID NO: 2574925 - RNA, 15 nt, Coxiella burnetii RSA 493
auuuaacacuuuaau

SEQ ID NO: 2574926 - RNA, 19 nt, Coxiella burnetii RSA 493
auuuaacgauuuuaaguaa

SEQ ID NO: 2574927 - RNA, 20 nt, Coxiella burnetii RSA 493
auuuaaggguacaaaccacc

SEQ ID NO: 2574928 - RNA, 20 nt, Coxiella burnetii RSA 493
auuuaauaagucuuugcuaa

SEQ ID NO: 2574929 - RNA, 17 nt, Coxiella burnetii RSA 493
auuuaauaaucaauagc

SEQ ID NO: 2574930 - RNA, 17 nt, Coxiella burnetii RSA 493
auuuaaucuacucuacu

SEQ ID NO: 2574931 - RNA, 16 nt, Coxiella burnetii RSA 493
auuuucacuauuugua

SEQ ID NO: 2574932 - RNA, 16 nt, Coxiella burnetii RSA 493
auuuucaugagaggau

SEQ ID NO: 2574933 - RNA, 12 nt, Coxiella burnetii RSA 493
auuuucauucuc

SEQ ID NO: 2574934 - RNA, 16 nt, Coxiella burnetii RSA 493
auuuucauuuucucua

SEQ ID NO: 2574935 - RNA, 18 nt, Coxiella burnetii RSA 493
auuuucccaggaaagaaa

SEQ ID NO: 2574936 - RNA, 19 nt, Coxiella burnetii RSA 493
auuuuccgcaggacuuaag

SEQ ID NO: 2574937 - RNA, 16 nt, Coxiella burnetii RSA 493
auuuucucuaaugaua

SEQ ID NO: 2574938 - RNA, 22 nt, Coxiella burnetii RSA 493
auuuucugugguuaauucuucu

SEQ ID NO: 2574939 - RNA, 18 nt, Coxiella burnetii RSA 493
auuuugaauccucaguaa

SEQ ID NO: 2574940 - RNA, 16 nt, Coxiella burnetii RSA 493
auuuugaauuuugccu

SEQ ID NO: 2574941 - RNA, 16 nt, Coxiella burnetii RSA 493
auuuugacuuauuacc

SEQ ID NO: 2574942 - RNA, 10 nt, Coxiella burnetii RSA 493
auuuugauuc

SEQ ID NO: 2574943 - RNA, 13 nt, Coxiella burnetii RSA 493
auuuugauucucu

SEQ ID NO: 2574944 - RNA, 14 nt, Coxiella burnetii RSA 493
auuuugauuuuuua

SEQ ID NO: 2574945 - RNA, 15 nt, Coxiella burnetii RSA 493
auuuugcaaaugaau

SEQ ID NO: 2574946 - RNA, 24 nt, Coxiella burnetii RSA 493
auuuugcagaugcuccaucaugau

SEQ ID NO: 2574947 - RNA, 15 nt, Coxiella burnetii RSA 493
auuuugcuuaauacg

SEQ ID NO: 2574948 - RNA, 15 nt, Coxiella burnetii RSA 493
auuuugcuuaucaug

SEQ ID NO: 2574949 - RNA, 18 nt, Coxiella burnetii RSA 493
auuuuguagauuagaaaa

SEQ ID NO: 2574950 - RNA, 19 nt, Coxiella burnetii RSA 493
auuuuguagauuagaaaaa

SEQ ID NO: 2574951 - RNA, 13 nt, Coxiella burnetii RSA 493
auuuugugaugca

SEQ ID NO: 2574952 - RNA, 22 nt, Coxiella burnetii RSA 493
auuuuguuuuagagugaaccaa

SEQ ID NO: 2574953 - RNA, 17 nt, Coxiella burnetii RSA 493
auuuuuaaaagauuuua

SEQ ID NO: 2574954 - RNA, 18 nt, Coxiella burnetii RSA 493
auuuuuaaaagauuuuau

SEQ ID NO: 2574955 - RNA, 12 nt, Coxiella burnetii RSA 493
auuuuuaaaagu

SEQ ID NO: 2574956 - RNA, 13 nt, Coxiella burnetii RSA 493
auuuuuaugaaaa

SEQ ID NO: 2574957 - RNA, 22 nt, Coxiella burnetii RSA 493
auuuuuaugcuucaauaaaaaa

SEQ ID NO: 2574958 - RNA, 14 nt, Coxiella burnetii RSA 493
auuuuuauucuucu

SEQ ID NO: 2574959 - RNA, 14 nt, Coxiella burnetii RSA 493
auuuuucauuuccu

SEQ ID NO: 2574960 - RNA, 16 nt, Coxiella burnetii RSA 493
auuuuucauuuccuga

SEQ ID NO: 2574961 - RNA, 18 nt, Coxiella burnetii RSA 493
auuuuuccgauuuugaau

SEQ ID NO: 2574962 - RNA, 21 nt, Coxiella burnetii RSA 493
auuuuucgcagcaaaaugagg

SEQ ID NO: 2574963 - RNA, 15 nt, Coxiella burnetii RSA 493
auuuuucucaucauu

SEQ ID NO: 2574964 - RNA, 18 nt, Coxiella burnetii RSA 493
auuuuugccaggacuuua

SEQ ID NO: 2574965 - RNA, 20 nt, Coxiella burnetii RSA 493
auuuuugugcguaucuuuca

SEQ ID NO: 2574966 - RNA, 14 nt, Coxiella burnetii RSA 493
auuuuuuaaugaaa

SEQ ID NO: 2574967 - RNA, 14 nt, Coxiella burnetii RSA 493
auuuuuuaauuggu

SEQ ID NO: 2574968 - RNA, 13 nt, Coxiella burnetii RSA 493
auuuuuuauccaa

SEQ ID NO: 2574969 - RNA, 19 nt, Coxiella burnetii RSA 493
auuuuuugcugauccucau

SEQ ID NO: 2574970 - RNA, 18 nt, Coxiella burnetii RSA 493
auuuuuuggaaugagcau

SEQ ID NO: 2574971 - RNA, 20 nt, Coxiella burnetii RSA 493
auuuuuuggaaugagcauaa

SEQ ID NO: 2574972 - RNA, 23 nt, Coxiella burnetii RSA 493
auuuuuuggcauccucaucaaac

SEQ ID NO: 2574973 - RNA, 15 nt, Coxiella burnetii RSA 493
auuuuuuucuuaaaa

SEQ ID NO: 2574974 - RNA, 13 nt, Coxiella burnetii RSA 493
auuuuuuugccag

SEQ ID NO: 2574975 - RNA, 22 nt, Coxiella burnetii RSA 493
auuuuuuugccggacuuuuuca

SEQ ID NO: 2574976 - RNA, 13 nt, Coxiella burnetii RSA 493
auuuuuuuuaaaa

SEQ ID NO: 2574977 - RNA, 19 nt, Coxiella burnetii RSA 493
auuuuuuuuaaaauuacuu

SEQ ID NO: 2574978 - RNA, 14 nt, Coxiella burnetii RSA 493
auuuuuuuucuucu

SEQ ID NO: 2574979 - RNA, 13 nt, Coxiella burnetii RSA 493
auuuuuuuucuuu

SEQ ID NO: 2574980 - RNA, 11 nt, Coxiella burnetii RSA 493
caaaaaaagaa

SEQ ID NO: 2574981 - RNA, 17 nt, Coxiella burnetii RSA 493
caaaaaaagaaaaucca

SEQ ID NO: 2574982 - RNA, 19 nt, Coxiella burnetii RSA 493
caaaaaaguuuagaaagcg

SEQ ID NO: 2574983 - RNA, 23 nt, Coxiella burnetii RSA 493
caaaaacccauaacgaaaauugu

SEQ ID NO: 2574984 - RNA, 23 nt, Coxiella burnetii RSA 493
caaaaacgugccgccgaaauuua

SEQ ID NO: 2574985 - RNA, 19 nt, Coxiella burnetii RSA 493
caaaaacuucaugcaaaaa

SEQ ID NO: 2574986 - RNA, 11 nt, Coxiella burnetii RSA 493
caaaaagauaa

SEQ ID NO: 2574987 - RNA, 23 nt, Coxiella burnetii RSA 493
caaaaagauaaucccaauaaaac

SEQ ID NO: 2574988 - RNA, 16 nt, Coxiella burnetii RSA 493
caaaaauaaaacgauc

SEQ ID NO: 2574989 - RNA, 20 nt, Coxiella burnetii RSA 493
caaaaauacaagcugacaau

SEQ ID NO: 2574990 - RNA, 15 nt, Coxiella burnetii RSA 493
caaaaauuucauuua

SEQ ID NO: 2574991 - RNA, 13 nt, Coxiella burnetii RSA 493
caaaacagcccca

SEQ ID NO: 2574992 - RNA, 17 nt, Coxiella burnetii RSA 493
caaaacgaaaagcugaa

SEQ ID NO: 2574993 - RNA, 21 nt, Coxiella burnetii RSA 493
caaaacgggcauuggaaaaaa

SEQ ID NO: 2574994 - RNA, 22 nt, Coxiella burnetii RSA 493
caaaacgggcauuggaaaaaac

SEQ ID NO: 2574995 - RNA, 23 nt, Coxiella burnetii RSA 493
caaaacgggcauuggaaaaaacu

SEQ ID NO: 2574996 - RNA, 16 nt, Coxiella burnetii RSA 493
caaaacucccaucaaa

SEQ ID NO: 2574997 - RNA, 17 nt, Coxiella burnetii RSA 493
caaaagaggguauuuug

SEQ ID NO: 2574998 - RNA, 15 nt, Coxiella burnetii RSA 493
caaaagguaaaaaac

SEQ ID NO: 2574999 - RNA, 17 nt, Coxiella burnetii RSA 493
caaaagguaaaaaacua

SEQ ID NO: 2575000 - RNA, 23 nt, Coxiella burnetii RSA 493
caaaaguggggauaauugaaaug

SEQ ID NO: 2575001 - RNA, 22 nt, Coxiella burnetii RSA 493
caaaauaagucgcaauuugaug

SEQ ID NO: 2575002 - RNA, 14 nt, Coxiella burnetii RSA 493
caaaauaauaaccc

SEQ ID NO: 2575003 - RNA, 15 nt, Coxiella burnetii RSA 493
caaaauaauaaccca

SEQ ID NO: 2575004 - RNA, 12 nt, Coxiella burnetii RSA 493
caaaauaauaau

SEQ ID NO: 2575005 - RNA, 17 nt, Coxiella burnetii RSA 493
caaaauacaguaaauaa

SEQ ID NO: 2575006 - RNA, 18 nt, Coxiella burnetii RSA 493
caaaauacaguaaauaau

SEQ ID NO: 2575007 - RNA, 17 nt, Coxiella burnetii RSA 493
caaaaucaccagaaaac

SEQ ID NO: 2575008 - RNA, 20 nt, Coxiella burnetii RSA 493
caaaaucaccagaaaacguu

SEQ ID NO: 2575009 - RNA, 14 nt, Coxiella burnetii RSA 493
caaaauucuccuua

SEQ ID NO: 2575010 - RNA, 13 nt, Coxiella burnetii RSA 493
caaaauuuacuuu

SEQ ID NO: 2575011 - RNA, 13 nt, Coxiella burnetii RSA 493
caaaauuuuucau

SEQ ID NO: 2575012 - RNA, 16 nt, Coxiella burnetii RSA 493
caaacagcgaaaacaa

SEQ ID NO: 2575013 - RNA, 11 nt, Coxiella burnetii RSA 493
caaaccaauca

SEQ ID NO: 2575014 - RNA, 18 nt, Coxiella burnetii RSA 493
caaacccacggcaaauaa

SEQ ID NO: 2575015 - RNA, 19 nt, Coxiella burnetii RSA 493
caaacccacggcaaauaaa

SEQ ID NO: 2575016 - RNA, 15 nt, Coxiella burnetii RSA 493
caaaccgcgcugaag

SEQ ID NO: 2575017 - RNA, 16 nt, Coxiella burnetii RSA 493
caaaccggccgcaccu

SEQ ID NO: 2575018 - RNA, 19 nt, Coxiella burnetii RSA 493
caaacgaauggcccaauaa

SEQ ID NO: 2575019 - RNA, 20 nt, Coxiella burnetii RSA 493
caaacgaauggcccaauaaa

SEQ ID NO: 2575020 - RNA, 19 nt, Coxiella burnetii RSA 493
caaacgccaucgauuuugu

SEQ ID NO: 2575021 - RNA, 18 nt, Coxiella burnetii RSA 493
caaacuucauuaaauccg

SEQ ID NO: 2575022 - RNA, 16 nt, Coxiella burnetii RSA 493
caaacuugccuugaga

SEQ ID NO: 2575023 - RNA, 18 nt, Coxiella burnetii RSA 493
caaagacuuugcuguucc

SEQ ID NO: 2575024 - RNA, 20 nt, Coxiella burnetii RSA 493
caaagaucuccccuucuuua

SEQ ID NO: 2575025 - RNA, 15 nt, Coxiella burnetii RSA 493
caaagcaaaaauaca

SEQ ID NO: 2575026 - RNA, 13 nt, Coxiella burnetii RSA 493
caaagcagauaaa

SEQ ID NO: 2575027 - RNA, 14 nt, Coxiella burnetii RSA 493
caaagcagauaaau

SEQ ID NO: 2575028 - RNA, 15 nt, Coxiella burnetii RSA 493
caaagcagauaaaug

SEQ ID NO: 2575029 - RNA, 16 nt, Coxiella burnetii RSA 493
caaagccgcuauuucu

SEQ ID NO: 2575030 - RNA, 21 nt, Coxiella burnetii RSA 493
caaaggccuuggguaagugaa

SEQ ID NO: 2575031 - RNA, 23 nt, Coxiella burnetii RSA 493
caaaguccuguuccgcagccuaa

SEQ ID NO: 2575032 - RNA, 21 nt, Coxiella burnetii RSA 493
caaagugaucauaguggauga

SEQ ID NO: 2575033 - RNA, 21 nt, Coxiella burnetii RSA 493
caaaguucauuaaguauauuu

SEQ ID NO: 2575034 - RNA, 23 nt, Coxiella burnetii RSA 493
caaauaaacaaguuaacaaaauc

SEQ ID NO: 2575035 - RNA, 22 nt, Coxiella burnetii RSA 493
caaauaaaccuauccaaaaaga

SEQ ID NO: 2575036 - RNA, 18 nt, Coxiella burnetii RSA 493
caaauaagccaauacgaa

SEQ ID NO: 2575037 - RNA, 20 nt, Coxiella burnetii RSA 493
caauauccuuguaauucaaa

SEQ ID NO: 2575038 - RNA, 16 nt, Coxiella burnetii RSA 493
caauauggaacccguu

SEQ ID NO: 2575039 - RNA, 15 nt, Coxiella burnetii RSA 493
caauauuucuugaaa

SEQ ID NO: 2575040 - RNA, 13 nt, Coxiella burnetii RSA 493
caaucaaaacagc

SEQ ID NO: 2575041 - RNA, 23 nt, Coxiella burnetii RSA 493
caaucaacgaacacauacagccg

SEQ ID NO: 2575042 - RNA, 17 nt, Coxiella burnetii RSA 493
caaucaaugcaguuaac

SEQ ID NO: 2575043 - RNA, 22 nt, Coxiella burnetii RSA 493
caaucaauuuaccaauuaaaga

SEQ ID NO: 2575044 - RNA, 18 nt, Coxiella burnetii RSA 493
caaucacaaguucuucua

SEQ ID NO: 2575045 - RNA, 17 nt, Coxiella burnetii RSA 493
caaucaucaauucggau

SEQ ID NO: 2575046 - RNA, 14 nt, Coxiella burnetii RSA 493
caaucaucauccuu

SEQ ID NO: 2575047 - RNA, 13 nt, Coxiella burnetii RSA 493
caaucauuuuugu

SEQ ID NO: 2575048 - RNA, 14 nt, Coxiella burnetii RSA 493
caaucgaaaaaaau

SEQ ID NO: 2575049 - RNA, 15 nt, Coxiella burnetii RSA 493
caaucgaaaaaaauc

SEQ ID NO: 2575050 - RNA, 22 nt, Coxiella burnetii RSA 493
caaucgauuaagcgucaugaaa

SEQ ID NO: 2575051 - RNA, 18 nt, Coxiella burnetii RSA 493
caaucgcacccuucuguu

SEQ ID NO: 2575052 - RNA, 19 nt, Coxiella burnetii RSA 493
caaucguguagaaagaaag

SEQ ID NO: 2575053 - RNA, 17 nt, Coxiella burnetii RSA 493
caaucuauuagcuggca

SEQ ID NO: 2575054 - RNA, 20 nt, Coxiella burnetii RSA 493
caaucugggaauguguguca

SEQ ID NO: 2575055 - RNA, 17 nt, Coxiella burnetii RSA 493
caaugaaacaaacaaaa

SEQ ID NO: 2575056 - RNA, 18 nt, Coxiella burnetii RSA 493
caaugaaacaaacaaaaa

SEQ ID NO: 2575057 - RNA, 20 nt, Coxiella burnetii RSA 493
caaugaaacaaacaaaaaau

SEQ ID NO: 2575058 - RNA, 19 nt, Coxiella burnetii RSA 493
caaugaacacuugaguagg

SEQ ID NO: 2575059 - RNA, 13 nt, Coxiella burnetii RSA 493
caaugacauuggc

SEQ ID NO: 2575060 - RNA, 16 nt, Coxiella burnetii RSA 493
caaugacgcagaauau

SEQ ID NO: 2575061 - RNA, 19 nt, Coxiella burnetii RSA 493
caaugagugcuuuuaacca

SEQ ID NO: 2575062 - RNA, 19 nt, Coxiella burnetii RSA 493
caaugaugucaucuaucgu

SEQ ID NO: 2575063 - RNA, 16 nt, Coxiella burnetii RSA 493
caaugcaccauuuucc

SEQ ID NO: 2575064 - RNA, 16 nt, Coxiella burnetii RSA 493
caaugcaguuaaccaa

SEQ ID NO: 2575065 - RNA, 15 nt, Coxiella burnetii RSA 493
caaugccagugcauc

SEQ ID NO: 2575066 - RNA, 16 nt, Coxiella burnetii RSA 493
caaugcccgaaaagga

SEQ ID NO: 2575067 - RNA, 15 nt, Coxiella burnetii RSA 493
caaugcguuuuaaau

SEQ ID NO: 2575068 - RNA, 19 nt, Coxiella burnetii RSA 493
caaugcguuuuaaaugcuu

SEQ ID NO: 2575069 - RNA, 19 nt, Coxiella burnetii RSA 493
caaugcuuucuuuuaauuc

SEQ ID NO: 2575070 - RNA, 15 nt, Coxiella burnetii RSA 493
caaugcuuuucucaa

SEQ ID NO: 2575071 - RNA, 13 nt, Coxiella burnetii RSA 493
caauggcauuaca

SEQ ID NO: 2575072 - RNA, 20 nt, Coxiella burnetii RSA 493
caauggguuagggugcaauu

SEQ ID NO: 2575073 - RNA, 19 nt, Coxiella burnetii RSA 493
caaugguggucggcaccaa

SEQ ID NO: 2575074 - RNA, 15 nt, Coxiella burnetii RSA 493
caauguauccgggcc

SEQ ID NO: 2575075 - RNA, 22 nt, Coxiella burnetii RSA 493
caauguucuucgaguaacuuca

SEQ ID NO: 2575076 - RNA, 14 nt, Coxiella burnetii RSA 493
caauguuucaaucu

SEQ ID NO: 2575077 - RNA, 16 nt, Coxiella burnetii RSA 493
caauguuuccaaauaa

SEQ ID NO: 2575078 - RNA, 17 nt, Coxiella burnetii RSA 493
caauguuuccaaauaau

SEQ ID NO: 2575079 - RNA, 18 nt, Coxiella burnetii RSA 493
caauuaaagaaucguaau

SEQ ID NO: 2575080 - RNA, 17 nt, Coxiella burnetii RSA 493
caauuaacuuugcaaag

SEQ ID NO: 2575081 - RNA, 19 nt, Coxiella burnetii RSA 493
caauuaaggucugggugau

SEQ ID NO: 2575082 - RNA, 19 nt, Coxiella burnetii RSA 493
caauuaauuuauaaaauuu

SEQ ID NO: 2575083 - RNA, 15 nt, Coxiella burnetii RSA 493
caauuacuuaaauua

SEQ ID NO: 2575084 - RNA, 24 nt, Coxiella burnetii RSA 493
caauuauccuggccugaucauaaa

SEQ ID NO: 2575085 - RNA, 21 nt, Coxiella burnetii RSA 493
caauuaucuuaaugaaauuuc

SEQ ID NO: 2575086 - RNA, 22 nt, Coxiella burnetii RSA 493
caauuaugaaaacgacuuauuu

SEQ ID NO: 2575087 - RNA, 13 nt, Coxiella burnetii RSA 493
caauucaaauaau

SEQ ID NO: 2575088 - RNA, 15 nt, Coxiella burnetii RSA 493
caauuccaauaauug

SEQ ID NO: 2575089 - RNA, 17 nt, Coxiella burnetii RSA 493
caauuccauuaaaaaca

SEQ ID NO: 2575090 - RNA, 17 nt, Coxiella burnetii RSA 493
caauucccccaaaaacu

SEQ ID NO: 2575091 - RNA, 21 nt, Coxiella burnetii RSA 493
caauucccccaaaaacuaaau

SEQ ID NO: 2575092 - RNA, 19 nt, Coxiella burnetii RSA 493
caauucccguauuucgcuu

SEQ ID NO: 2575093 - RNA, 22 nt, Coxiella burnetii RSA 493
caauuccgauaagcguuugguu

SEQ ID NO: 2575094 - RNA, 17 nt, Coxiella burnetii RSA 493
caauuccgguuucaaau

SEQ ID NO: 2575095 - RNA, 18 nt, Coxiella burnetii RSA 493
caauucgcuuaaauuuug

SEQ ID NO: 2575096 - RNA, 16 nt, Coxiella burnetii RSA 493
caauucgucgcuguau

SEQ ID NO: 2575097 - RNA, 23 nt, Coxiella burnetii RSA 493
caauucucauaauucguuagcau

SEQ ID NO: 2575098 - RNA, 21 nt, Coxiella burnetii RSA 493
caauugaaaaaccauucaaug

SEQ ID NO: 2575099 - RNA, 20 nt, Coxiella burnetii RSA 493
caauugagcggcuuuuucaa

SEQ ID NO: 2575100 - RNA, 17 nt, Coxiella burnetii RSA 493
caauugcuuucccuuuu

SEQ ID NO: 2575101 - RNA, 20 nt, Coxiella burnetii RSA 493
caauuggagguucucuuuau

SEQ ID NO: 2575102 - RNA, 16 nt, Coxiella burnetii RSA 493
caauuguucaauggcu

SEQ ID NO: 2575103 - RNA, 16 nt, Coxiella burnetii RSA 493
caauuguugauuuaac

SEQ ID NO: 2575104 - RNA, 16 nt, Coxiella burnetii RSA 493
caauuguuugaaaaaa

SEQ ID NO: 2575105 - RNA, 17 nt, Coxiella burnetii RSA 493
caauuguuugaaaaaau

SEQ ID NO: 2575106 - RNA, 18 nt, Coxiella burnetii RSA 493
caauuguuugaaaaaaua

SEQ ID NO: 2575107 - RNA, 11 nt, Coxiella burnetii RSA 493
caauuuaauug

SEQ ID NO: 2575108 - RNA, 20 nt, Coxiella burnetii RSA 493
caauuuaccaauuaaagaau

SEQ ID NO: 2575109 - RNA, 20 nt, Coxiella burnetii RSA 493
caauuuaccuccaaaaccca

SEQ ID NO: 2575110 - RNA, 22 nt, Coxiella burnetii RSA 493
caauuuaggcucaauuuauccg

SEQ ID NO: 2575111 - RNA, 17 nt, Coxiella burnetii RSA 493
caauuucaacgccucuc

SEQ ID NO: 2575112 - RNA, 16 nt, Coxiella burnetii RSA 493
caauuucaaugacuuu

SEQ ID NO: 2575113 - RNA, 19 nt, Coxiella burnetii RSA 493
caauuucauucauucgcuu

SEQ ID NO: 2575114 - RNA, 22 nt, Coxiella burnetii RSA 493
caauuucuuuucuaaauaauga

SEQ ID NO: 2575115 - RNA, 15 nt, Coxiella burnetii RSA 493
caauuuuucuuuuuu

SEQ ID NO: 2575116 - RNA, 11 nt, Coxiella burnetii RSA 493
cacaaaauaag

SEQ ID NO: 2575117 - RNA, 22 nt, Coxiella burnetii RSA 493
cacaaaauaagucgcaauuuga

SEQ ID NO: 2575118 - RNA, 22 nt, Coxiella burnetii RSA 493
cacaaauuauaucauugggcca

SEQ ID NO: 2575119 - RNA, 13 nt, Coxiella burnetii RSA 493
cacaagucucaga

SEQ ID NO: 2575120 - RNA, 17 nt, Coxiella burnetii RSA 493
cacaagucucagaaucu

SEQ ID NO: 2575121 - RNA, 19 nt, Coxiella burnetii RSA 493
cacaagucucagaaucugu

SEQ ID NO: 2575122 - RNA, 21 nt, Coxiella burnetii RSA 493
cacaauuaacguauaaauaac

SEQ ID NO: 2575123 - RNA, 19 nt, Coxiella burnetii RSA 493
cacaauuucaacuucaguu

SEQ ID NO: 2575124 - RNA, 22 nt, Coxiella burnetii RSA 493
cacaccccucgguucaagcacu

SEQ ID NO: 2575125 - RNA, 22 nt, Coxiella burnetii RSA 493
cacacguaucugcuaaaaagcu

SEQ ID NO: 2575126 - RNA, 16 nt, Coxiella burnetii RSA 493
cacagagccaccguau

SEQ ID NO: 2575127 - RNA, 18 nt, Coxiella burnetii RSA 493
cacagcccuaauaaaaca

SEQ ID NO: 2575128 - RNA, 13 nt, Coxiella burnetii RSA 493
cacaucuguuaac

SEQ ID NO: 2575129 - RNA, 15 nt, Coxiella burnetii RSA 493
cacaucuucacgcau

SEQ ID NO: 2575130 - RNA, 18 nt, Coxiella burnetii RSA 493
cacauuucggacaacaaa

SEQ ID NO: 2575131 - RNA, 22 nt, Coxiella burnetii RSA 493
cacauuucggacaacaaauaaa

SEQ ID NO: 2575132 - RNA, 16 nt, Coxiella burnetii RSA 493
cacauuuguucgauac

SEQ ID NO: 2575133 - RNA, 14 nt, Coxiella burnetii RSA 493
caccaaaucacgcu

SEQ ID NO: 2575134 - RNA, 20 nt, Coxiella burnetii RSA 493
caccacaauuaaugcgccua

SEQ ID NO: 2575135 - RNA, 15 nt, Coxiella burnetii RSA 493
caccacuuugccccg

SEQ ID NO: 2575136 - RNA, 20 nt, Coxiella burnetii RSA 493
caccauauccaacauauggc

SEQ ID NO: 2575137 - RNA, 17 nt, Coxiella burnetii RSA 493
cacccaaccaauaagcu

SEQ ID NO: 2575138 - RNA, 21 nt, Coxiella burnetii RSA 493
cacccacggcgccaucaacca

SEQ ID NO: 2575139 - RNA, 17 nt, Coxiella burnetii RSA 493
cacccccccguuaccaa

SEQ ID NO: 2575140 - RNA, 17 nt, Coxiella burnetii RSA 493
caccgacaucgcuccca

SEQ ID NO: 2575141 - RNA, 13 nt, Coxiella burnetii RSA 493
caccuaaaucaau

SEQ ID NO: 2575142 - RNA, 19 nt, Coxiella burnetii RSA 493
caguaaaccgcuuucuaga

SEQ ID NO: 2575143 - RNA, 17 nt, Coxiella burnetii RSA 493
caguaaauaaucauuuu

SEQ ID NO: 2575144 - RNA, 19 nt, Coxiella burnetii RSA 493
caguaacucuaauuuuccu

SEQ ID NO: 2575145 - RNA, 18 nt, Coxiella burnetii RSA 493
caguaccgucauaaggaa

SEQ ID NO: 2575146 - RNA, 14 nt, Coxiella burnetii RSA 493
caguaguacccagg

SEQ ID NO: 2575147 - RNA, 12 nt, Coxiella burnetii RSA 493
caguaucuauuc

SEQ ID NO: 2575148 - RNA, 14 nt, Coxiella burnetii RSA 493
cagucaugggguaa

SEQ ID NO: 2575149 - RNA, 12 nt, Coxiella burnetii RSA 493
cagucauuuucg

SEQ ID NO: 2575150 - RNA, 20 nt, Coxiella burnetii RSA 493
cagucauuuucguccaauuc

SEQ ID NO: 2575151 - RNA, 14 nt, Coxiella burnetii RSA 493
cagucgccguugcu

SEQ ID NO: 2575152 - RNA, 18 nt, Coxiella burnetii RSA 493
cagucucauuuuguauug

SEQ ID NO: 2575153 - RNA, 15 nt, Coxiella burnetii RSA 493
cagucucuuagcaua

SEQ ID NO: 2575154 - RNA, 22 nt, Coxiella burnetii RSA 493
cagucugucguuucugauuuuu

SEQ ID NO: 2575155 - RNA, 20 nt, Coxiella burnetii RSA 493
cagugaaaacccgagcggau

SEQ ID NO: 2575156 - RNA, 17 nt, Coxiella burnetii RSA 493
cagugacucaucuccuu

SEQ ID NO: 2575157 - RNA, 14 nt, Coxiella burnetii RSA 493
cagugccccuccuc

SEQ ID NO: 2575158 - RNA, 20 nt, Coxiella burnetii RSA 493
cagugugcacgauuuuauaa

SEQ ID NO: 2575159 - RNA, 14 nt, Coxiella burnetii RSA 493
caguuaaaauaaug

SEQ ID NO: 2575160 - RNA, 24 nt, Coxiella burnetii RSA 493
caguuaaaauaaugagaugaucau

SEQ ID NO: 2575161 - RNA, 22 nt, Coxiella burnetii RSA 493
caguuaaccaauugauuaauua

SEQ ID NO: 2575162 - RNA, 21 nt, Coxiella burnetii RSA 493
caguuaggccuauccuauucu

SEQ ID NO: 2575163 - RNA, 15 nt, Coxiella burnetii RSA 493
caguuccugaaacgc

SEQ ID NO: 2575164 - RNA, 19 nt, Coxiella burnetii RSA 493
caguucgcuaaauaacagu

SEQ ID NO: 2575165 - RNA, 23 nt, Coxiella burnetii RSA 493
caguuguuagcuuuucuuuaaac

SEQ ID NO: 2575166 - RNA, 17 nt, Coxiella burnetii RSA 493
caguuuaucguccaggu

SEQ ID NO: 2575167 - RNA, 24 nt, Coxiella burnetii RSA 493
caguuuuauuuauaauuuauaaca

SEQ ID NO: 2575168 - RNA, 21 nt, Coxiella burnetii RSA 493
cauaaaaacccauuaaguacu

SEQ ID NO: 2575169 - RNA, 23 nt, Coxiella burnetii RSA 493
cauaaaauuagguaauuuauaac

SEQ ID NO: 2575170 - RNA, 21 nt, Coxiella burnetii RSA 493
cauaaaauugaauauaacuuu

SEQ ID NO: 2575171 - RNA, 18 nt, Coxiella burnetii RSA 493
cauaaagcuuauauaaag

SEQ ID NO: 2575172 - RNA, 22 nt, Coxiella burnetii RSA 493
cauaaagcuuauauaaagggcc

SEQ ID NO: 2575173 - RNA, 13 nt, Coxiella burnetii RSA 493
cauaaauaaaagc

SEQ ID NO: 2575174 - RNA, 11 nt, Coxiella burnetii RSA 493
cauaaauaauu

SEQ ID NO: 2575175 - RNA, 15 nt, Coxiella burnetii RSA 493
cauaaauagcauuaa

SEQ ID NO: 2575176 - RNA, 19 nt, Coxiella burnetii RSA 493
cauaacaauggacacuuaa

SEQ ID NO: 2575177 - RNA, 20 nt, Coxiella burnetii RSA 493
cauaacgggaauguuuuuua

SEQ ID NO: 2575178 - RNA, 21 nt, Coxiella burnetii RSA 493
cauaauaaggcuaauuuuccu

SEQ ID NO: 2575179 - RNA, 22 nt, Coxiella burnetii RSA 493
cauaauaaggcuaauuuuccuu

SEQ ID NO: 2575180 - RNA, 14 nt, Coxiella burnetii RSA 493
cauaauauuuucug

SEQ ID NO: 2575181 - RNA, 22 nt, Coxiella burnetii RSA 493
cauaaucacaaaagguaaaaaa

SEQ ID NO: 2575182 - RNA, 18 nt, Coxiella burnetii RSA 493
cauaauccuucuuuuguc

SEQ ID NO: 2575183 - RNA, 15 nt, Coxiella burnetii RSA 493
cauaaucuuuuuaga

SEQ ID NO: 2575184 - RNA, 20 nt, Coxiella burnetii RSA 493
cauaaugaucgacaagcagg

SEQ ID NO: 2575185 - RNA, 17 nt, Coxiella burnetii RSA 493
cauaauucguuagcauu

SEQ ID NO: 2575186 - RNA, 14 nt, Coxiella burnetii RSA 493
cauaauugccgaua

SEQ ID NO: 2575187 - RNA, 14 nt, Coxiella burnetii RSA 493
cauacagaaugaua

SEQ ID NO: 2575188 - RNA, 19 nt, Coxiella burnetii RSA 493
cauacagaauuucuuugua

SEQ ID NO: 2575189 - RNA, 21 nt, Coxiella burnetii RSA 493
cauacagccgaaugaucugcu

SEQ ID NO: 2575190 - RNA, 14 nt, Coxiella burnetii RSA 493
cauacgacuucauu

SEQ ID NO: 2575191 - RNA, 14 nt, Coxiella burnetii RSA 493
cauacgauauaaaa

SEQ ID NO: 2575192 - RNA, 15 nt, Coxiella burnetii RSA 493
cauacgauauaaaag

SEQ ID NO: 2575193 - RNA, 13 nt, Coxiella burnetii RSA 493
cauacguggaacg

SEQ ID NO: 2575194 - RNA, 16 nt, Coxiella burnetii RSA 493
cauacuuaauuucgcu

SEQ ID NO: 2575195 - RNA, 14 nt, Coxiella burnetii RSA 493
cauagcaagaacau

SEQ ID NO: 2575196 - RNA, 19 nt, Coxiella burnetii RSA 493
cauagccucuauaaauaac

SEQ ID NO: 2575197 - RNA, 21 nt, Coxiella burnetii RSA 493
cauagcuggacucgaugggaa

SEQ ID NO: 2575198 - RNA, 17 nt, Coxiella burnetii RSA 493
cauaggagauuuuuaug

SEQ ID NO: 2575199 - RNA, 22 nt, Coxiella burnetii RSA 493
cauaggagauuuuuaugaaaaa

SEQ ID NO: 2575200 - RNA, 22 nt, Coxiella burnetii RSA 493
cauagguuuuuuuaaacguuuu

SEQ ID NO: 2575201 - RNA, 22 nt, Coxiella burnetii RSA 493
cauaguaauucaucauuuucca

SEQ ID NO: 2575202 - RNA, 20 nt, Coxiella burnetii RSA 493
cauauaaagucgcauagcca

SEQ ID NO: 2575203 - RNA, 19 nt, Coxiella burnetii RSA 493
cauauaacugcaaauaaua

SEQ ID NO: 2575204 - RNA, 20 nt, Coxiella burnetii RSA 493
cauauaaucgcaaaauucag

SEQ ID NO: 2575205 - RNA, 22 nt, Coxiella burnetii RSA 493
cauauauuuaccucuaaaaauu

SEQ ID NO: 2575206 - RNA, 16 nt, Coxiella burnetii RSA 493
cauaucgccauauaaa

SEQ ID NO: 2575207 - RNA, 16 nt, Coxiella burnetii RSA 493
cauaucgcuccccuug

SEQ ID NO: 2575208 - RNA, 17 nt, Coxiella burnetii RSA 493
cauaucgcuccccuugc

SEQ ID NO: 2575209 - RNA, 20 nt, Coxiella burnetii RSA 493
cauaucgggauaaguaaaug

SEQ ID NO: 2575210 - RNA, 22 nt, Coxiella burnetii RSA 493
cauaucuucaacaucaacccca

SEQ ID NO: 2575211 - RNA, 16 nt, Coxiella burnetii RSA 493
cauauugcaauaauaa

SEQ ID NO: 2575212 - RNA, 23 nt, Coxiella burnetii RSA 493
cauauugcaauaauaacgcuugc

SEQ ID NO: 2575213 - RNA, 13 nt, Coxiella burnetii RSA 493
cauauuucuuuuc

SEQ ID NO: 2575214 - RNA, 13 nt, Coxiella burnetii RSA 493
caucaaaauuaaa

SEQ ID NO: 2575215 - RNA, 20 nt, Coxiella burnetii RSA 493
caucaaacuugccuugagaa

SEQ ID NO: 2575216 - RNA, 18 nt, Coxiella burnetii RSA 493
caucaagggcaaaaacau

SEQ ID NO: 2575217 - RNA, 21 nt, Coxiella burnetii RSA 493
caucaagggcaaaaacauuau

SEQ ID NO: 2575218 - RNA, 12 nt, Coxiella burnetii RSA 493
caucaauaaugc

SEQ ID NO: 2575219 - RNA, 21 nt, Coxiella burnetii RSA 493
caucaauaccaagcucaugaa

SEQ ID NO: 2575220 - RNA, 16 nt, Coxiella burnetii RSA 493
caucaaucaaaugaac

SEQ ID NO: 2575221 - RNA, 11 nt, Coxiella burnetii RSA 493
caucaccuuca

SEQ ID NO: 2575222 - RNA, 16 nt, Coxiella burnetii RSA 493
caucacgauuuaaauu

SEQ ID NO: 2575223 - RNA, 15 nt, Coxiella burnetii RSA 493
caucagccugaucaa

SEQ ID NO: 2575224 - RNA, 18 nt, Coxiella burnetii RSA 493
caucagccugaucaaguu

SEQ ID NO: 2575225 - RNA, 16 nt, Coxiella burnetii RSA 493
caucaguuuugauuug

SEQ ID NO: 2575226 - RNA, 21 nt, Coxiella burnetii RSA 493
caucaguuuugauuugaguaa

SEQ ID NO: 2575227 - RNA, 19 nt, Coxiella burnetii RSA 493
caucaucgccggauaauca

SEQ ID NO: 2575228 - RNA, 13 nt, Coxiella burnetii RSA 493
caucaucuucaaa

SEQ ID NO: 2575229 - RNA, 18 nt, Coxiella burnetii RSA 493
caucauuuuccaaaaaau

SEQ ID NO: 2575230 - RNA, 12 nt, Coxiella burnetii RSA 493
caucauuuuugu

SEQ ID NO: 2575231 - RNA, 21 nt, Coxiella burnetii RSA 493
cauccaauuacuccaauuuca

SEQ ID NO: 2575232 - RNA, 14 nt, Coxiella burnetii RSA 493
cauccauucuuuca

SEQ ID NO: 2575233 - RNA, 22 nt, Coxiella burnetii RSA 493
cauccggaugucauaaucacaa

SEQ ID NO: 2575234 - RNA, 14 nt, Coxiella burnetii RSA 493
caucgauuggguag

SEQ ID NO: 2575235 - RNA, 16 nt, Coxiella burnetii RSA 493
caucgcgcguuuuuuu

SEQ ID NO: 2575236 - RNA, 18 nt, Coxiella burnetii RSA 493
caucgcgcguuuuuuuau

SEQ ID NO: 2575237 - RNA, 14 nt, Coxiella burnetii RSA 493
caucggccuuuuuc

SEQ ID NO: 2575238 - RNA, 15 nt, Coxiella burnetii RSA 493
caucggccuuuuuca

SEQ ID NO: 2575239 - RNA, 21 nt, Coxiella burnetii RSA 493
caucguuaaacucggcuuuau

SEQ ID NO: 2575240 - RNA, 16 nt, Coxiella burnetii RSA 493
caucguugggaugauc

SEQ ID NO: 2575241 - RNA, 22 nt, Coxiella burnetii RSA 493
caucguuucaaacacuuguuug

SEQ ID NO: 2575242 - RNA, 18 nt, Coxiella burnetii RSA 493
caucuaucguccccguau

SEQ ID NO: 2575243 - RNA, 16 nt, Coxiella burnetii RSA 493
caucuccgucggcuuc

SEQ ID NO: 2575244 - RNA, 13 nt, Coxiella burnetii RSA 493
caucuccuuuucg

SEQ ID NO: 2575245 - RNA, 22 nt, Coxiella burnetii RSA 493
caucugagauaucaauagcgca

SEQ ID NO: 2575246 - RNA, 22 nt, Coxiella burnetii RSA 493
caucuggaaucaaguagccaaa

SEQ ID NO: 2575247 - RNA, 20 nt, Coxiella burnetii RSA 493
ccaaaaacagauuuaaauag

SEQ ID NO: 2575248 - RNA, 22 nt, Coxiella burnetii RSA 493
ccaaaaacagauuuaaauagcu

SEQ ID NO: 2575249 - RNA, 16 nt, Coxiella burnetii RSA 493
ccaaaaaguuuauaaa

SEQ ID NO: 2575250 - RNA, 19 nt, Coxiella burnetii RSA 493
ccaaaaaguuuauaaaaau

SEQ ID NO: 2575251 - RNA, 19 nt, Coxiella burnetii RSA 493
ccaaaaauucguuaaaacc

SEQ ID NO: 2575252 - RNA, 18 nt, Coxiella burnetii RSA 493
ccaaaaauuucauuuaau

SEQ ID NO: 2575253 - RNA, 12 nt, Coxiella burnetii RSA 493
ccaaaaccgccg

SEQ ID NO: 2575254 - RNA, 16 nt, Coxiella burnetii RSA 493
ccaaaagcaccccgug

SEQ ID NO: 2575255 - RNA, 23 nt, Coxiella burnetii RSA 493
ccaaaagcaucgucaucguuuga

SEQ ID NO: 2575256 - RNA, 19 nt, Coxiella burnetii RSA 493
ccaaaauacaguaaauaau

SEQ ID NO: 2575257 - RNA, 12 nt, Coxiella burnetii RSA 493
ccaaaauagaau

SEQ ID NO: 2575258 - RNA, 11 nt, Coxiella burnetii RSA 493
ccaaacaaaag

SEQ ID NO: 2575259 - RNA, 11 nt, Coxiella burnetii RSA 493
ccaaaccguuc

SEQ ID NO: 2575260 - RNA, 17 nt, Coxiella burnetii RSA 493
ccaaacgccaucgauuu

SEQ ID NO: 2575261 - RNA, 20 nt, Coxiella burnetii RSA 493
ccaaagaguugagcgaagaa

SEQ ID NO: 2575262 - RNA, 15 nt, Coxiella burnetii RSA 493
ccaaagcaaaaauac

SEQ ID NO: 2575263 - RNA, 21 nt, Coxiella burnetii RSA 493
ccaaaggugucaaaauuauuc

SEQ ID NO: 2575264 - RNA, 16 nt, Coxiella burnetii RSA 493
ccaaauaaaaaaacau

SEQ ID NO: 2575265 - RNA, 15 nt, Coxiella burnetii RSA 493
ccaaauaagccaaua

SEQ ID NO: 2575266 - RNA, 16 nt, Coxiella burnetii RSA 493
ccaaauaaugaguaug

SEQ ID NO: 2575267 - RNA, 20 nt, Coxiella burnetii RSA 493
ccaaauccgcauaaaaaccc

SEQ ID NO: 2575268 - RNA, 19 nt, Coxiella burnetii RSA 493
ccaaaucguugcauaauau

SEQ ID NO: 2575269 - RNA, 22 nt, Coxiella burnetii RSA 493
ccaaaugaucggcgcauuuuua

SEQ ID NO: 2575270 - RNA, 23 nt, Coxiella burnetii RSA 493
ccaaaugaucggcgcauuuuuau

SEQ ID NO: 2575271 - RNA, 23 nt, Coxiella burnetii RSA 493
ccaaaugcgacaaucauuuuugu

SEQ ID NO: 2575272 - RNA, 13 nt, Coxiella burnetii RSA 493
ccaacauucuuug

SEQ ID NO: 2575273 - RNA, 18 nt, Coxiella burnetii RSA 493
ccaacauucuuugaucuu

SEQ ID NO: 2575274 - RNA, 12 nt, Coxiella burnetii RSA 493
ccaaccaauaag

SEQ ID NO: 2575275 - RNA, 20 nt, Coxiella burnetii RSA 493
ccaaccauaauccuucuuuu

SEQ ID NO: 2575276 - RNA, 13 nt, Coxiella burnetii RSA 493
ccaacccaaggaa

SEQ ID NO: 2575277 - RNA, 21 nt, Coxiella burnetii RSA 493
ccaacccaaggaaccaccaaa

SEQ ID NO: 2575278 - RNA, 14 nt, Coxiella burnetii RSA 493
ccaacgaacgccaa

SEQ ID NO: 2575279 - RNA, 20 nt, Coxiella burnetii RSA 493
ccaacgcuuguuuuauaccu

SEQ ID NO: 2575280 - RNA, 20 nt, Coxiella burnetii RSA 493
ccaacgguauaaaauuuuau

SEQ ID NO: 2575281 - RNA, 18 nt, Coxiella burnetii RSA 493
ccaagcggaccacagauc

SEQ ID NO: 2575282 - RNA, 19 nt, Coxiella burnetii RSA 493
ccaagcgggguuaaggaaa

SEQ ID NO: 2575283 - RNA, 20 nt, Coxiella burnetii RSA 493
ccaagcgggguuaaggaaaa

SEQ ID NO: 2575284 - RNA, 22 nt, Coxiella burnetii RSA 493
ccaagucgagguugucaacaaa

SEQ ID NO: 2575285 - RNA, 14 nt, Coxiella burnetii RSA 493
ccaagucgcccgua

SEQ ID NO: 2575286 - RNA, 13 nt, Coxiella burnetii RSA 493
ccaauaauaaaac

SEQ ID NO: 2575287 - RNA, 18 nt, Coxiella burnetii RSA 493
ccaauacuagcuuuugaa

SEQ ID NO: 2575288 - RNA, 13 nt, Coxiella burnetii RSA 493
ccaauaguaaaac

SEQ ID NO: 2575289 - RNA, 20 nt, Coxiella burnetii RSA 493
ccaaucuagcauaaucuuuu

SEQ ID NO: 2575290 - RNA, 19 nt, Coxiella burnetii RSA 493
ccaaugacgcagaauauaa

SEQ ID NO: 2575291 - RNA, 18 nt, Coxiella burnetii RSA 493
ccaauguuuccaaauaau

SEQ ID NO: 2575292 - RNA, 20 nt, Coxiella burnetii RSA 493
ccaauguuuccaaauaauga

SEQ ID NO: 2575293 - RNA, 20 nt, Coxiella burnetii RSA 493
ccaauuaaagaaucguaaua

SEQ ID NO: 2575294 - RNA, 21 nt, Coxiella burnetii RSA 493
ccaauuauaacuauuuuaaau

SEQ ID NO: 2575295 - RNA, 23 nt, Coxiella burnetii RSA 493
ccaauuauaacuauuuuaaaucu

SEQ ID NO: 2575296 - RNA, 20 nt, Coxiella burnetii RSA 493
ccaauugucuuugaugugaa

SEQ ID NO: 2575297 - RNA, 13 nt, Coxiella burnetii RSA 493
ccaauuguuugaa

SEQ ID NO: 2575298 - RNA, 18 nt, Coxiella burnetii RSA 493
ccaauuguuugaaaaaau

SEQ ID NO: 2575299 - RNA, 19 nt, Coxiella burnetii RSA 493
ccaauuguuugaaaaaaua

SEQ ID NO: 2575300 - RNA, 12 nt, Coxiella burnetii RSA 493
ccaauuucuaau

SEQ ID NO: 2575301 - RNA, 16 nt, Coxiella burnetii RSA 493
ccacaacuuucuucca

SEQ ID NO: 2575302 - RNA, 23 nt, Coxiella burnetii RSA 493
ccacaauuaaugcgccuacaaau

SEQ ID NO: 2575303 - RNA, 10 nt, Coxiella burnetii RSA 493
ccacacuguc

SEQ ID NO: 2575304 - RNA, 22 nt, Coxiella burnetii RSA 493
ccacacugucgaauaaccggcu

SEQ ID NO: 2575305 - RNA, 21 nt, Coxiella burnetii RSA 493
ccacagccgcuuuuuauugga

SEQ ID NO: 2575306 - RNA, 17 nt, Coxiella burnetii RSA 493
ccacaucuggaaucaag

SEQ ID NO: 2575307 - RNA, 14 nt, Coxiella burnetii RSA 493
ccaccgauguggca

SEQ ID NO: 2575308 - RNA, 20 nt, Coxiella burnetii RSA 493
ccaccgauguggcaaaucuc

SEQ ID NO: 2575309 - RNA, 13 nt, Coxiella burnetii RSA 493
ccacgcauacgau

SEQ ID NO: 2575310 - RNA, 22 nt, Coxiella burnetii RSA 493
ccacguugcaauaacaaauaaa

SEQ ID NO: 2575311 - RNA, 12 nt, Coxiella burnetii RSA 493
ccacucggaaag

SEQ ID NO: 2575312 - RNA, 19 nt, Coxiella burnetii RSA 493
ccacucucuuuauuuuuuc

SEQ ID NO: 2575313 - RNA, 15 nt, Coxiella burnetii RSA 493
ccacuggaaucaauc

SEQ ID NO: 2575314 - RNA, 21 nt, Coxiella burnetii RSA 493
ccacuggguuuuccccaucaa

SEQ ID NO: 2575315 - RNA, 13 nt, Coxiella burnetii RSA 493
ccacuguccucug

SEQ ID NO: 2575316 - RNA, 23 nt, Coxiella burnetii RSA 493
ccacuucauacgggcuacucuaa

SEQ ID NO: 2575317 - RNA, 21 nt, Coxiella burnetii RSA 493
ccacuuucgauaaauuuugaa

SEQ ID NO: 2575318 - RNA, 23 nt, Coxiella burnetii RSA 493
ccagaaaacguuucaucaaaauu

SEQ ID NO: 2575319 - RNA, 12 nt, Coxiella burnetii RSA 493
ccagaaacaacu

SEQ ID NO: 2575320 - RNA, 18 nt, Coxiella burnetii RSA 493
ccagaaauucauuuuuca

SEQ ID NO: 2575321 - RNA, 19 nt, Coxiella burnetii RSA 493
ccagaaauucauuuuucag

SEQ ID NO: 2575322 - RNA, 17 nt, Coxiella burnetii RSA 493
ccagaagcguaccaaug

SEQ ID NO: 2575323 - RNA, 21 nt, Coxiella burnetii RSA 493
ccagaccuguuaaaaacgccu

SEQ ID NO: 2575324 - RNA, 17 nt, Coxiella burnetii RSA 493
ccagagauuuuuuucuu

SEQ ID NO: 2575325 - RNA, 22 nt, Coxiella burnetii RSA 493
ccagcaguaaugagcaucuuuu

SEQ ID NO: 2575326 - RNA, 11 nt, Coxiella burnetii RSA 493
ccagcagugaa

SEQ ID NO: 2575327 - RNA, 13 nt, Coxiella burnetii RSA 493
ccagcagugaaau

SEQ ID NO: 2575328 - RNA, 20 nt, Coxiella burnetii RSA 493
ccagccaaaucgcagugccc

SEQ ID NO: 2575329 - RNA, 19 nt, Coxiella burnetii RSA 493
ccagcccccucuacaauaa

SEQ ID NO: 2575330 - RNA, 17 nt, Coxiella burnetii RSA 493
ccagcgcacuacgugcg

SEQ ID NO: 2575331 - RNA, 22 nt, Coxiella burnetii RSA 493
ccaguauuuuucuuuggguugg

SEQ ID NO: 2575332 - RNA, 13 nt, Coxiella burnetii RSA 493
ccaguuuuaugcg

SEQ ID NO: 2575333 - RNA, 20 nt, Coxiella burnetii RSA 493
ccauaaauggauagacaauu

SEQ ID NO: 2575334 - RNA, 23 nt, Coxiella burnetii RSA 493
ccauaacaagguauugauuaacu

SEQ ID NO: 2575335 - RNA, 12 nt, Coxiella burnetii RSA 493
ccauaaccguuu

SEQ ID NO: 2575336 - RNA, 15 nt, Coxiella burnetii RSA 493
ccauaaccguuuaau

SEQ ID NO: 2575337 - RNA, 15 nt, Coxiella burnetii RSA 493
ccauaauccuucuuu

SEQ ID NO: 2575338 - RNA, 21 nt, Coxiella burnetii RSA 493
ccauaauugccgauauucuuu

SEQ ID NO: 2575339 - RNA, 14 nt, Coxiella burnetii RSA 493
ccauagaagaacaa

SEQ ID NO: 2575340 - RNA, 19 nt, Coxiella burnetii RSA 493
ccauaucgccauauaaagu

SEQ ID NO: 2575341 - RNA, 20 nt, Coxiella burnetii RSA 493
ccauaucgccauauaaaguc

SEQ ID NO: 2575342 - RNA, 12 nt, Coxiella burnetii RSA 493
ccauauucaaca

SEQ ID NO: 2575343 - RNA, 20 nt, Coxiella burnetii RSA 493
ccauauuugcugaauuuuau

SEQ ID NO: 2575344 - RNA, 23 nt, Coxiella burnetii RSA 493
ccaucacggggucgguaaaacgc

SEQ ID NO: 2575345 - RNA, 20 nt, Coxiella burnetii RSA 493
ccauccaacuuccuaucaau

SEQ ID NO: 2575346 - RNA, 14 nt, Coxiella burnetii RSA 493
ccauccaauaacga

SEQ ID NO: 2575347 - RNA, 17 nt, Coxiella burnetii RSA 493
ccauccgacauucuucu

SEQ ID NO: 2575348 - RNA, 16 nt, Coxiella burnetii RSA 493
ccaucgcccaguacug

SEQ ID NO: 2575349 - RNA, 17 nt, Coxiella burnetii RSA 493
ccaucucgaaauuauuu

SEQ ID NO: 2575350 - RNA, 15 nt, Coxiella burnetii RSA 493
ccaucuugccacaca

SEQ ID NO: 2575351 - RNA, 18 nt, Coxiella burnetii RSA 493
ccaugacaugcgccacua

SEQ ID NO: 2575352 - RNA, 20 nt, Coxiella burnetii RSA 493
ccguauuucgcuucgcugca

SEQ ID NO: 2575353 - RNA, 11 nt, Coxiella burnetii RSA 493
ccguauuugca

SEQ ID NO: 2575354 - RNA, 20 nt, Coxiella burnetii RSA 493
ccgucaauuuaggcucaauu

SEQ ID NO: 2575355 - RNA, 14 nt, Coxiella burnetii RSA 493
ccgucaauuuuuca

SEQ ID NO: 2575356 - RNA, 17 nt, Coxiella burnetii RSA 493
ccgucacuucuucucca

SEQ ID NO: 2575357 - RNA, 19 nt, Coxiella burnetii RSA 493
ccgucgcuuugcggccucg

SEQ ID NO: 2575358 - RNA, 12 nt, Coxiella burnetii RSA 493
ccgucuuuuucu

SEQ ID NO: 2575359 - RNA, 13 nt, Coxiella burnetii RSA 493
ccgugaauaaaga

SEQ ID NO: 2575360 - RNA, 16 nt, Coxiella burnetii RSA 493
ccguuaugaaaacaua

SEQ ID NO: 2575361 - RNA, 17 nt, Coxiella burnetii RSA 493
ccguucaccccauuuca

SEQ ID NO: 2575362 - RNA, 20 nt, Coxiella burnetii RSA 493
ccguucaccccauuucaaca

SEQ ID NO: 2575363 - RNA, 22 nt, Coxiella burnetii RSA 493
ccguucggaaacaaagguucca

SEQ ID NO: 2575364 - RNA, 17 nt, Coxiella burnetii RSA 493
ccguugagcaagcagaa

SEQ ID NO: 2575365 - RNA, 18 nt, Coxiella burnetii RSA 493
ccguuuugaaaaauaaaa

SEQ ID NO: 2575366 - RNA, 22 nt, Coxiella burnetii RSA 493
ccguuuugaaaaauaaaaggag

SEQ ID NO: 2575367 - RNA, 12 nt, Coxiella burnetii RSA 493
ccuaaaaugaua

SEQ ID NO: 2575368 - RNA, 17 nt, Coxiella burnetii RSA 493
ccuaaagaaagaagaag

SEQ ID NO: 2575369 - RNA, 24 nt, Coxiella burnetii RSA 493
ccuaagagaaaaaaccucaccaga

SEQ ID NO: 2575370 - RNA, 13 nt, Coxiella burnetii RSA 493
ccuaagcuuucuc

SEQ ID NO: 2575371 - RNA, 20 nt, Coxiella burnetii RSA 493
ccuaaguuuaacagacagac

SEQ ID NO: 2575372 - RNA, 20 nt, Coxiella burnetii RSA 493
ccuaaucggccuacuuuuuc

SEQ ID NO: 2575373 - RNA, 17 nt, Coxiella burnetii RSA 493
ccuacaaauagagaggg

SEQ ID NO: 2575374 - RNA, 14 nt, Coxiella burnetii RSA 493
ccuacacuuuuaau

SEQ ID NO: 2575375 - RNA, 20 nt, Coxiella burnetii RSA 493
ccuacacuuuuaaucacauc

SEQ ID NO: 2575376 - RNA, 15 nt, Coxiella burnetii RSA 493
ccuacugcaugaaug

SEQ ID NO: 2575377 - RNA, 18 nt, Coxiella burnetii RSA 493
ccuacuuucguaaagacc

SEQ ID NO: 2575378 - RNA, 13 nt, Coxiella burnetii RSA 493
ccuacuuuuucug

SEQ ID NO: 2575379 - RNA, 18 nt, Coxiella burnetii RSA 493
ccuagugaggcuucuucc

SEQ ID NO: 2575380 - RNA, 18 nt, Coxiella burnetii RSA 493
ccuauagugucaaaggcc

SEQ ID NO: 2575381 - RNA, 15 nt, Coxiella burnetii RSA 493
ccuaucaaucaaauc

SEQ ID NO: 2575382 - RNA, 16 nt, Coxiella burnetii RSA 493
ccuauccuauucuuuu

SEQ ID NO: 2575383 - RNA, 21 nt, Coxiella burnetii RSA 493
ccuaugcgggguuuuuuguag

SEQ ID NO: 2575384 - RNA, 22 nt, Coxiella burnetii RSA 493
ccuauuagucuuaauuuuaaaa

SEQ ID NO: 2575385 - RNA, 21 nt, Coxiella burnetii RSA 493
ccuauugcggaauucaggacu

SEQ ID NO: 2575386 - RNA, 17 nt, Coxiella burnetii RSA 493
ccuauuuuugauuacuu

SEQ ID NO: 2575387 - RNA, 23 nt, Coxiella burnetii RSA 493
ccucacgauagccagcaauauca

SEQ ID NO: 2575388 - RNA, 23 nt, Coxiella burnetii RSA 493
ccucaguugucauguaaucaauu

SEQ ID NO: 2575389 - RNA, 19 nt, Coxiella burnetii RSA 493
ccuccacggaauuugaaau

SEQ ID NO: 2575390 - RNA, 19 nt, Coxiella burnetii RSA 493
ccucccggcuuuaaaaccc

SEQ ID NO: 2575391 - RNA, 18 nt, Coxiella burnetii RSA 493
ccuccucgcgauuuucgu

SEQ ID NO: 2575392 - RNA, 14 nt, Coxiella burnetii RSA 493
ccuccuugcaagcu

SEQ ID NO: 2575393 - RNA, 18 nt, Coxiella burnetii RSA 493
ccucgauagaccaaaucc

SEQ ID NO: 2575394 - RNA, 14 nt, Coxiella burnetii RSA 493
ccucgccuucuucg

SEQ ID NO: 2575395 - RNA, 17 nt, Coxiella burnetii RSA 493
ccucgcguuuuaucauu

SEQ ID NO: 2575396 - RNA, 14 nt, Coxiella burnetii RSA 493
ccucuacaaaauag

SEQ ID NO: 2575397 - RNA, 21 nt, Coxiella burnetii RSA 493
ccucuacaucuucauuuucug

SEQ ID NO: 2575398 - RNA, 15 nt, Coxiella burnetii RSA 493
ccucuauaaauaaca

SEQ ID NO: 2575399 - RNA, 21 nt, Coxiella burnetii RSA 493
ccucucgucggguauuuucau

SEQ ID NO: 2575400 - RNA, 22 nt, Coxiella burnetii RSA 493
ccucuucuaaaguacuagcauc

SEQ ID NO: 2575401 - RNA, 21 nt, Coxiella burnetii RSA 493
ccucuugcaacguuugauuuu

SEQ ID NO: 2575402 - RNA, 22 nt, Coxiella burnetii RSA 493
ccucuugcaacguuugauuuuc

SEQ ID NO: 2575403 - RNA, 13 nt, Coxiella burnetii RSA 493
ccucuuuaccucc

SEQ ID NO: 2575404 - RNA, 22 nt, Coxiella burnetii RSA 493
ccugaacaggauuuucauuaau

SEQ ID NO: 2575405 - RNA, 20 nt, Coxiella burnetii RSA 493
ccugaaccuaaauuauaaau

SEQ ID NO: 2575406 - RNA, 16 nt, Coxiella burnetii RSA 493
ccugaaugagauaacu

SEQ ID NO: 2575407 - RNA, 22 nt, Coxiella burnetii RSA 493
ccugaaugcuuuuaaagugaug

SEQ ID NO: 2575408 - RNA, 15 nt, Coxiella burnetii RSA 493
ccugauaaaauaaca

SEQ ID NO: 2575409 - RNA, 17 nt, Coxiella burnetii RSA 493
ccugaucaaguuucucc

SEQ ID NO: 2575410 - RNA, 19 nt, Coxiella burnetii RSA 493
ccugcaacggucauuuguu

SEQ ID NO: 2575411 - RNA, 22 nt, Coxiella burnetii RSA 493
ccugccauuugcggaaaaggag

SEQ ID NO: 2575412 - RNA, 19 nt, Coxiella burnetii RSA 493
ccuguaaucuuuuggcaua

SEQ ID NO: 2575413 - RNA, 19 nt, Coxiella burnetii RSA 493
ccuguccgauauaacaccc

SEQ ID NO: 2575414 - RNA, 20 nt, Coxiella burnetii RSA 493
ccuguggcaauuaugaaaac

SEQ ID NO: 2575415 - RNA, 15 nt, Coxiella burnetii RSA 493
ccuguucuuuucaac

SEQ ID NO: 2575416 - RNA, 17 nt, Coxiella burnetii RSA 493
ccuguucuuuuuccaug

SEQ ID NO: 2575417 - RNA, 20 nt, Coxiella burnetii RSA 493
ccuuaacgccuaucuuuuuc

SEQ ID NO: 2575418 - RNA, 22 nt, Coxiella burnetii RSA 493
ccuuaacgccuaucuuuuucaa

SEQ ID NO: 2575419 - RNA, 17 nt, Coxiella burnetii RSA 493
ccuuaauaaaguuuuag

SEQ ID NO: 2575420 - RNA, 17 nt, Coxiella burnetii RSA 493
ccuuaauguuuuuucua

SEQ ID NO: 2575421 - RNA, 15 nt, Coxiella burnetii RSA 493
ccuuacaaaaauacu

SEQ ID NO: 2575422 - RNA, 15 nt, Coxiella burnetii RSA 493
ccuuagcguaaucau

SEQ ID NO: 2575423 - RNA, 17 nt, Coxiella burnetii RSA 493
ccuuagcguaaucauca

SEQ ID NO: 2575424 - RNA, 14 nt, Coxiella burnetii RSA 493
ccuuauagcgugag

SEQ ID NO: 2575425 - RNA, 19 nt, Coxiella burnetii RSA 493
ccuucaacggcgcgcgugu

SEQ ID NO: 2575426 - RNA, 12 nt, Coxiella burnetii RSA 493
ccuucacuuuuc

SEQ ID NO: 2575427 - RNA, 17 nt, Coxiella burnetii RSA 493
ccuucaugaauauuuuu

SEQ ID NO: 2575428 - RNA, 15 nt, Coxiella burnetii RSA 493
ccuucgcuuuuucca

SEQ ID NO: 2575429 - RNA, 21 nt, Coxiella burnetii RSA 493
ccuucucaguuaaaauaauga

SEQ ID NO: 2575430 - RNA, 22 nt, Coxiella burnetii RSA 493
ccuucuguuuaagacgugaaau

SEQ ID NO: 2575431 - RNA, 16 nt, Coxiella burnetii RSA 493
ccuucuugccgcccuu

SEQ ID NO: 2575432 - RNA, 19 nt, Coxiella burnetii RSA 493
ccuucuugucauucccuuu

SEQ ID NO: 2575433 - RNA, 20 nt, Coxiella burnetii RSA 493
ccuucuuuuaaagugauuuu

SEQ ID NO: 2575434 - RNA, 18 nt, Coxiella burnetii RSA 493
ccuucuuuuuuauguuug

SEQ ID NO: 2575435 - RNA, 21 nt, Coxiella burnetii RSA 493
ccuugagcgaaagccaaguuu

SEQ ID NO: 2575436 - RNA, 14 nt, Coxiella burnetii RSA 493
ccuugcaagcugcu

SEQ ID NO: 2575437 - RNA, 13 nt, Coxiella burnetii RSA 493
ccuugcaauaagc

SEQ ID NO: 2575438 - RNA, 20 nt, Coxiella burnetii RSA 493
ccuugcauaauagcgaucag

SEQ ID NO: 2575439 - RNA, 19 nt, Coxiella burnetii RSA 493
ccuugcucaaguccuugcu

SEQ ID NO: 2575440 - RNA, 22 nt, Coxiella burnetii RSA 493
ccuugggaucgcugauuucggg

SEQ ID NO: 2575441 - RNA, 16 nt, Coxiella burnetii RSA 493
ccuuggguaagugaau

SEQ ID NO: 2575442 - RNA, 22 nt, Coxiella burnetii RSA 493
ccuuguaauucaaauuuuaaag

SEQ ID NO: 2575443 - RNA, 18 nt, Coxiella burnetii RSA 493
ccuuguugaauuccuugu

SEQ ID NO: 2575444 - RNA, 22 nt, Coxiella burnetii RSA 493
ccuuguugaauuccuuguugaa

SEQ ID NO: 2575445 - RNA, 22 nt, Coxiella burnetii RSA 493
ccuuuaccuugggccacauaac

SEQ ID NO: 2575446 - RNA, 18 nt, Coxiella burnetii RSA 493
ccuuuaguuuuauuugaa

SEQ ID NO: 2575447 - RNA, 23 nt, Coxiella burnetii RSA 493
ccuuuccgguucagcauaacuaa

SEQ ID NO: 2575448 - RNA, 13 nt, Coxiella burnetii RSA 493
ccuuucgcgcgcu

SEQ ID NO: 2575449 - RNA, 17 nt, Coxiella burnetii RSA 493
ccuuucgcuuguuuaua

SEQ ID NO: 2575450 - RNA, 17 nt, Coxiella burnetii RSA 493
ccuuucuaacgucgcaa

SEQ ID NO: 2575451 - RNA, 14 nt, Coxiella burnetii RSA 493
ccuuucuuucuuca

SEQ ID NO: 2575452 - RNA, 19 nt, Coxiella burnetii RSA 493
ccuuucuuucuucacuuuc

SEQ ID NO: 2575453 - RNA, 11 nt, Coxiella burnetii RSA 493
ccuuugcaaac

SEQ ID NO: 2575454 - RNA, 22 nt, Coxiella burnetii RSA 493
ccuuuucauuaagcaauuuuuu

SEQ ID NO: 2575455 - RNA, 16 nt, Coxiella burnetii RSA 493
ccuuuucccuaggaaa

SEQ ID NO: 2575456 - RNA, 20 nt, Coxiella burnetii RSA 493
ccuuuuucguguuuuuacga

SEQ ID NO: 2575457 - RNA, 20 nt, Coxiella burnetii RSA 493
cgcagccagcuugugcaauu

SEQ ID NO: 2575458 - RNA, 19 nt, Coxiella burnetii RSA 493
cgcagcgacggauuuugcu

SEQ ID NO: 2575459 - RNA, 16 nt, Coxiella burnetii RSA 493
cgcaggauaauguuug

SEQ ID NO: 2575460 - RNA, 20 nt, Coxiella burnetii RSA 493
cgcaggcgggaauccagcgc

SEQ ID NO: 2575461 - RNA, 14 nt, Coxiella burnetii RSA 493
cgcaggcggggacg

SEQ ID NO: 2575462 - RNA, 20 nt, Coxiella burnetii RSA 493
cgcauaaaaacccauuaagu

SEQ ID NO: 2575463 - RNA, 12 nt, Coxiella burnetii RSA 493
cgcauaauaauc

SEQ ID NO: 2575464 - RNA, 13 nt, Coxiella burnetii RSA 493
cgcaucaaaaaaa

SEQ ID NO: 2575465 - RNA, 19 nt, Coxiella burnetii RSA 493
cgcaucacgcucgagggaa

SEQ ID NO: 2575466 - RNA, 21 nt, Coxiella burnetii RSA 493
cgcauccgccccgaaauauga

SEQ ID NO: 2575467 - RNA, 22 nt, Coxiella burnetii RSA 493
cgcauuaguuuaaauuuuucau

SEQ ID NO: 2575468 - RNA, 20 nt, Coxiella burnetii RSA 493
cgcauucuauuagcugccau

SEQ ID NO: 2575469 - RNA, 19 nt, Coxiella burnetii RSA 493
cgccagaaacaacuaccug

SEQ ID NO: 2575470 - RNA, 14 nt, Coxiella burnetii RSA 493
cgccaggcuaugau

SEQ ID NO: 2575471 - RNA, 21 nt, Coxiella burnetii RSA 493
cgccauauuugcugaauuuua

SEQ ID NO: 2575472 - RNA, 13 nt, Coxiella burnetii RSA 493
cgccauugucuca

SEQ ID NO: 2575473 - RNA, 12 nt, Coxiella burnetii RSA 493
cgccauuuccca

SEQ ID NO: 2575474 - RNA, 21 nt, Coxiella burnetii RSA 493
cgccauuucgcuuuuauuucc

SEQ ID NO: 2575475 - RNA, 12 nt, Coxiella burnetii RSA 493
cgccauuuuuua

SEQ ID NO: 2575476 - RNA, 19 nt, Coxiella burnetii RSA 493
cgcccaaaugaucggcgca

SEQ ID NO: 2575477 - RNA, 21 nt, Coxiella burnetii RSA 493
cgccccaaaguuccgcugggg

SEQ ID NO: 2575478 - RNA, 14 nt, Coxiella burnetii RSA 493
cgcccccccaaaca

SEQ ID NO: 2575479 - RNA, 14 nt, Coxiella burnetii RSA 493
cgccggguuuuuug

SEQ ID NO: 2575480 - RNA, 16 nt, Coxiella burnetii RSA 493
cgccgguaccccauga

SEQ ID NO: 2575481 - RNA, 11 nt, Coxiella burnetii RSA 493
cgccuacaaau

SEQ ID NO: 2575482 - RNA, 16 nt, Coxiella burnetii RSA 493
cgccuaucuuuuucaa

SEQ ID NO: 2575483 - RNA, 21 nt, Coxiella burnetii RSA 493
cgccuuugcugaccuuuuccu

SEQ ID NO: 2575484 - RNA, 21 nt, Coxiella burnetii RSA 493
cgccuuuuuuaaauuucucau

SEQ ID NO: 2575485 - RNA, 15 nt, Coxiella burnetii RSA 493
cgcgaaauuguauug

SEQ ID NO: 2575486 - RNA, 18 nt, Coxiella burnetii RSA 493
cgcgaacucagcccaaca

SEQ ID NO: 2575487 - RNA, 18 nt, Coxiella burnetii RSA 493
cgcgacaagaauuuuuuu

SEQ ID NO: 2575488 - RNA, 21 nt, Coxiella burnetii RSA 493
cgcgaccccguuaucccgcuu

SEQ ID NO: 2575489 - RNA, 18 nt, Coxiella burnetii RSA 493
cgcgauuuucucuucaac

SEQ ID NO: 2575490 - RNA, 13 nt, Coxiella burnetii RSA 493
cgcgcaccagggg

SEQ ID NO: 2575491 - RNA, 18 nt, Coxiella burnetii RSA 493
cgcgcacgguaauaauau

SEQ ID NO: 2575492 - RNA, 16 nt, Coxiella burnetii RSA 493
cgcgccacaagcggcg

SEQ ID NO: 2575493 - RNA, 23 nt, Coxiella burnetii RSA 493
cgcgcguuuuuuuaucuggccag

SEQ ID NO: 2575494 - RNA, 20 nt, Coxiella burnetii RSA 493
cgcgcuggauucccgccugc

SEQ ID NO: 2575495 - RNA, 13 nt, Coxiella burnetii RSA 493
cgcgcuucuuuua

SEQ ID NO: 2575496 - RNA, 18 nt, Coxiella burnetii RSA 493
cgcggaucucccgccucc

SEQ ID NO: 2575497 - RNA, 14 nt, Coxiella burnetii RSA 493
cgcgguaaggaaca

SEQ ID NO: 2575498 - RNA, 23 nt, Coxiella burnetii RSA 493
cgcggugguaaacaacgcacgaa

SEQ ID NO: 2575499 - RNA, 13 nt, Coxiella burnetii RSA 493
cgcguaaaauucc

SEQ ID NO: 2575500 - RNA, 16 nt, Coxiella burnetii RSA 493
cgcguacaguuuuuuu

SEQ ID NO: 2575501 - RNA, 19 nt, Coxiella burnetii RSA 493
cgcuaaauaacauaacgaa

SEQ ID NO: 2575502 - RNA, 14 nt, Coxiella burnetii RSA 493
cgcuaacgccacac

SEQ ID NO: 2575503 - RNA, 13 nt, Coxiella burnetii RSA 493
cgcuaagcgaaaa

SEQ ID NO: 2575504 - RNA, 22 nt, Coxiella burnetii RSA 493
cgcuaaguugggccaaaauaga

SEQ ID NO: 2575505 - RNA, 18 nt, Coxiella burnetii RSA 493
cgcuaauuaacuucgcca

SEQ ID NO: 2575506 - RNA, 10 nt, Coxiella burnetii RSA 493
cgcuaugaaa

SEQ ID NO: 2575507 - RNA, 11 nt, Coxiella burnetii RSA 493
cgcucauacgg

SEQ ID NO: 2575508 - RNA, 13 nt, Coxiella burnetii RSA 493
cgcucauacgggc

SEQ ID NO: 2575509 - RNA, 23 nt, Coxiella burnetii RSA 493
cgcucaugggaugucgcuuuauu

SEQ ID NO: 2575510 - RNA, 22 nt, Coxiella burnetii RSA 493
cgcucccuuaaguugacgccua

SEQ ID NO: 2575511 - RNA, 20 nt, Coxiella burnetii RSA 493
cgcucgauucuuugucuguc

SEQ ID NO: 2575512 - RNA, 17 nt, Coxiella burnetii RSA 493
cgcugaguggaaaacca

SEQ ID NO: 2575513 - RNA, 17 nt, Coxiella burnetii RSA 493
cgcugauacuucuucau

SEQ ID NO: 2575514 - RNA, 22 nt, Coxiella burnetii RSA 493
cgcugauacuucuucauuaaau

SEQ ID NO: 2575515 - RNA, 11 nt, Coxiella burnetii RSA 493
cgcugcaauaa

SEQ ID NO: 2575516 - RNA, 21 nt, Coxiella burnetii RSA 493
cgcuguuuucagauuuuuuau

SEQ ID NO: 2575517 - RNA, 22 nt, Coxiella burnetii RSA 493
cgcuuaaacccagaaaaguaaa

SEQ ID NO: 2575518 - RNA, 21 nt, Coxiella burnetii RSA 493
cgcuucaaacaauugagcggc

SEQ ID NO: 2575519 - RNA, 15 nt, Coxiella burnetii RSA 493
cgcuucaauucuuuu

SEQ ID NO: 2575520 - RNA, 16 nt, Coxiella burnetii RSA 493
cgcuucgaaaaucgaa

SEQ ID NO: 2575521 - RNA, 19 nt, Coxiella burnetii RSA 493
cgcuucgaaaaucgaauuc

SEQ ID NO: 2575522 - RNA, 22 nt, Coxiella burnetii RSA 493
cgcuucgaaaaucgaauuccaa

SEQ ID NO: 2575523 - RNA, 18 nt, Coxiella burnetii RSA 493
cgcuucgcucauacgggc

SEQ ID NO: 2575524 - RNA, 19 nt, Coxiella burnetii RSA 493
cgcuucgcugcauacggac

SEQ ID NO: 2575525 - RNA, 21 nt, Coxiella burnetii RSA 493
cgcuugcacgggaaugacgaa

SEQ ID NO: 2575526 - RNA, 12 nt, Coxiella burnetii RSA 493
cgcuuguuuaua

SEQ ID NO: 2575527 - RNA, 13 nt, Coxiella burnetii RSA 493
cgcuuugcggccu

SEQ ID NO: 2575528 - RNA, 14 nt, Coxiella burnetii RSA 493
cgcuuuuauuuccu

SEQ ID NO: 2575529 - RNA, 15 nt, Coxiella burnetii RSA 493
cgcuuuuuccaccaa

SEQ ID NO: 2575530 - RNA, 13 nt, Coxiella burnetii RSA 493
cgcuuuuuugcuu

SEQ ID NO: 2575531 - RNA, 24 nt, Coxiella burnetii RSA 493
cggaaaaaggcucgugcauagcau

SEQ ID NO: 2575532 - RNA, 20 nt, Coxiella burnetii RSA 493
cggaaaaucuuguuuaagcu

SEQ ID NO: 2575533 - RNA, 16 nt, Coxiella burnetii RSA 493
cggaaaauggaaacga

SEQ ID NO: 2575534 - RNA, 23 nt, Coxiella burnetii RSA 493
cggaaauuucgauuuuacaauaa

SEQ ID NO: 2575535 - RNA, 15 nt, Coxiella burnetii RSA 493
cggaaguucuauuuc

SEQ ID NO: 2575536 - RNA, 20 nt, Coxiella burnetii RSA 493
cggaauacggagaaaaugau

SEQ ID NO: 2575537 - RNA, 16 nt, Coxiella burnetii RSA 493
cggaauuugaaauaaa

SEQ ID NO: 2575538 - RNA, 17 nt, Coxiella burnetii RSA 493
cggaauuugaaauaaac

SEQ ID NO: 2575539 - RNA, 23 nt, Coxiella burnetii RSA 493
cggaauuugauaucgaccauuaa

SEQ ID NO: 2575540 - RNA, 19 nt, Coxiella burnetii RSA 493
cggacaauaagagcuccaa

SEQ ID NO: 2575541 - RNA, 15 nt, Coxiella burnetii RSA 493
cggacauuuuuucaa

SEQ ID NO: 2575542 - RNA, 12 nt, Coxiella burnetii RSA 493
cggacuuuuuca

SEQ ID NO: 2575543 - RNA, 16 nt, Coxiella burnetii RSA 493
cggagacaccaauaau

SEQ ID NO: 2575544 - RNA, 17 nt, Coxiella burnetii RSA 493
cggagacaccaauaauu

SEQ ID NO: 2575545 - RNA, 15 nt, Coxiella burnetii RSA 493
cggaggaugagaggu

SEQ ID NO: 2575546 - RNA, 18 nt, Coxiella burnetii RSA 493
cggaguccccaaaguuuc

SEQ ID NO: 2575547 - RNA, 20 nt, Coxiella burnetii RSA 493
cggauaagccauuaaaagca

SEQ ID NO: 2575548 - RNA, 20 nt, Coxiella burnetii RSA 493
cggauaaugcuugcucuucu

SEQ ID NO: 2575549 - RNA, 15 nt, Coxiella burnetii RSA 493
cggauauaacgccaa

SEQ ID NO: 2575550 - RNA, 12 nt, Coxiella burnetii RSA 493
cggauuaaaaaa

SEQ ID NO: 2575551 - RNA, 13 nt, Coxiella burnetii RSA 493
cggauuguaaaca

SEQ ID NO: 2575552 - RNA, 18 nt, Coxiella burnetii RSA 493
cggauuuuaauugaauuu

SEQ ID NO: 2575553 - RNA, 15 nt, Coxiella burnetii RSA 493
cggcaaacccaucuc

SEQ ID NO: 2575554 - RNA, 23 nt, Coxiella burnetii RSA 493
cggcaaaugauugggcucaaaaa

SEQ ID NO: 2575555 - RNA, 19 nt, Coxiella burnetii RSA 493
cggcaaucagaaugcugau

SEQ ID NO: 2575556 - RNA, 14 nt, Coxiella burnetii RSA 493
cggcauaaggaugg

SEQ ID NO: 2575557 - RNA, 21 nt, Coxiella burnetii RSA 493
cggcaucaacggaaaaacaaa

SEQ ID NO: 2575558 - RNA, 15 nt, Coxiella burnetii RSA 493
cggccuacuuuuucu

SEQ ID NO: 2575559 - RNA, 17 nt, Coxiella burnetii RSA 493
cggcgauaaucauuaac

SEQ ID NO: 2575560 - RNA, 13 nt, Coxiella burnetii RSA 493
cggcucucucuaa

SEQ ID NO: 2575561 - RNA, 22 nt, Coxiella burnetii RSA 493
cggcuugagggcuguccucugc

SEQ ID NO: 2575562 - RNA, 14 nt, Coxiella burnetii RSA 493
cguucggcuucaua

SEQ ID NO: 2575563 - RNA, 14 nt, Coxiella burnetii RSA 493
cguucugaaauuuu

SEQ ID NO: 2575564 - RNA, 13 nt, Coxiella burnetii RSA 493
cguucuuuuccug

SEQ ID NO: 2575565 - RNA, 23 nt, Coxiella burnetii RSA 493
cguugaauagcaguuugccauua

SEQ ID NO: 2575566 - RNA, 19 nt, Coxiella burnetii RSA 493
cguugauaaagauucugua

SEQ ID NO: 2575567 - RNA, 16 nt, Coxiella burnetii RSA 493
cguugauuaauaaugu

SEQ ID NO: 2575568 - RNA, 19 nt, Coxiella burnetii RSA 493
cguugcaagcguuuuucau

SEQ ID NO: 2575569 - RNA, 21 nt, Coxiella burnetii RSA 493
cguugcaagcguuuuucaucc

SEQ ID NO: 2575570 - RNA, 12 nt, Coxiella burnetii RSA 493
cguugcuuuaaa

SEQ ID NO: 2575571 - RNA, 16 nt, Coxiella burnetii RSA 493
cguugcuuuaaauccc

SEQ ID NO: 2575572 - RNA, 17 nt, Coxiella burnetii RSA 493
cguuguggacuuguucg

SEQ ID NO: 2575573 - RNA, 22 nt, Coxiella burnetii RSA 493
cguuguuuucccguauuucgcu

SEQ ID NO: 2575574 - RNA, 15 nt, Coxiella burnetii RSA 493
cguuuaaauaacaaa

SEQ ID NO: 2575575 - RNA, 19 nt, Coxiella burnetii RSA 493
cguuuauuuccgucaauuu

SEQ ID NO: 2575576 - RNA, 16 nt, Coxiella burnetii RSA 493
cguuuccaauuguuug

SEQ ID NO: 2575577 - RNA, 18 nt, Coxiella burnetii RSA 493
cguuucccgcuccagauu

SEQ ID NO: 2575578 - RNA, 18 nt, Coxiella burnetii RSA 493
cguuucgguuuucgcugc

SEQ ID NO: 2575579 - RNA, 17 nt, Coxiella burnetii RSA 493
cguuucgucgauaucca

SEQ ID NO: 2575580 - RNA, 16 nt, Coxiella burnetii RSA 493
cguuucugauuuuuga

SEQ ID NO: 2575581 - RNA, 19 nt, Coxiella burnetii RSA 493
cguuucuuauucauuaaau

SEQ ID NO: 2575582 - RNA, 20 nt, Coxiella burnetii RSA 493
cguuucuuccauuagagccu

SEQ ID NO: 2575583 - RNA, 12 nt, Coxiella burnetii RSA 493
cguuuuccgcua

SEQ ID NO: 2575584 - RNA, 19 nt, Coxiella burnetii RSA 493
cguuuuccgcuaaauauuu

SEQ ID NO: 2575585 - RNA, 22 nt, Coxiella burnetii RSA 493
cguuuuccgcuaaauauuuagc

SEQ ID NO: 2575586 - RNA, 13 nt, Coxiella burnetii RSA 493
cguuuucuaucca

SEQ ID NO: 2575587 - RNA, 17 nt, Coxiella burnetii RSA 493
cguuuugucguuuucau

SEQ ID NO: 2575588 - RNA, 20 nt, Coxiella burnetii RSA 493
cguuuuucgagcgacuucau

SEQ ID NO: 2575589 - RNA, 23 nt, Coxiella burnetii RSA 493
cguuuuugcuagaucguuuuuug

SEQ ID NO: 2575590 - RNA, 16 nt, Coxiella burnetii RSA 493
cuaaaaaauuacgaua

SEQ ID NO: 2575591 - RNA, 18 nt, Coxiella burnetii RSA 493
cuaaaaagcuagcgaaau

SEQ ID NO: 2575592 - RNA, 19 nt, Coxiella burnetii RSA 493
cuaaaaagcuagcgaaauu

SEQ ID NO: 2575593 - RNA, 17 nt, Coxiella burnetii RSA 493
cuaaaauacuuaaaauu

SEQ ID NO: 2575594 - RNA, 14 nt, Coxiella burnetii RSA 493
cuaaacaaaauaau

SEQ ID NO: 2575595 - RNA, 16 nt, Coxiella burnetii RSA 493
cuaaacaaaauaauaa

SEQ ID NO: 2575596 - RNA, 18 nt, Coxiella burnetii RSA 493
cuaaacaaaauaauaaug

SEQ ID NO: 2575597 - RNA, 22 nt, Coxiella burnetii RSA 493
cuaaaccaacgaacgccaagcu

SEQ ID NO: 2575598 - RNA, 19 nt, Coxiella burnetii RSA 493
cuaaaccacgcuauaauuu

SEQ ID NO: 2575599 - RNA, 15 nt, Coxiella burnetii RSA 493
cuaaagcaaaaguaa

SEQ ID NO: 2575600 - RNA, 22 nt, Coxiella burnetii RSA 493
cuaaagcggaagcagcuaauuu

SEQ ID NO: 2575601 - RNA, 15 nt, Coxiella burnetii RSA 493
cuaaauaaggagcau

SEQ ID NO: 2575602 - RNA, 17 nt, Coxiella burnetii RSA 493
cuaaauauuuagcaacu

SEQ ID NO: 2575603 - RNA, 23 nt, Coxiella burnetii RSA 493
cuaaauauuuagcaacuccgucu

SEQ ID NO: 2575604 - RNA, 14 nt, Coxiella burnetii RSA 493
cuaaaucaauuuuc

SEQ ID NO: 2575605 - RNA, 18 nt, Coxiella burnetii RSA 493
cuaaaucgguugaagaaa

SEQ ID NO: 2575606 - RNA, 20 nt, Coxiella burnetii RSA 493
cuaaaugacguaaugucuca

SEQ ID NO: 2575607 - RNA, 16 nt, Coxiella burnetii RSA 493
cuaaaugcgucaugaa

SEQ ID NO: 2575608 - RNA, 16 nt, Coxiella burnetii RSA 493
cuaaauggucuguuuc

SEQ ID NO: 2575609 - RNA, 16 nt, Coxiella burnetii RSA 493
cuaaauguuuagcuaa

SEQ ID NO: 2575610 - RNA, 12 nt, Coxiella burnetii RSA 493
cuaaauuaaaaa

SEQ ID NO: 2575611 - RNA, 15 nt, Coxiella burnetii RSA 493
cuaaauuaguaauau

SEQ ID NO: 2575612 - RNA, 16 nt, Coxiella burnetii RSA 493
cuaaauuguccuuuuc

SEQ ID NO: 2575613 - RNA, 15 nt, Coxiella burnetii RSA 493
cuaaccacccuguca

SEQ ID NO: 2575614 - RNA, 14 nt, Coxiella burnetii RSA 493
cuaacgccacacaa

SEQ ID NO: 2575615 - RNA, 20 nt, Coxiella burnetii RSA 493
cuaacgcguacaguuuuuuu

SEQ ID NO: 2575616 - RNA, 13 nt, Coxiella burnetii RSA 493
cuaacggcuagag

SEQ ID NO: 2575617 - RNA, 19 nt, Coxiella burnetii RSA 493
cuaacguuaguuucuuuua

SEQ ID NO: 2575618 - RNA, 19 nt, Coxiella burnetii RSA 493
cuaacguuuugucguuuuc

SEQ ID NO: 2575619 - RNA, 14 nt, Coxiella burnetii RSA 493
cuaacuacgacccu

SEQ ID NO: 2575620 - RNA, 18 nt, Coxiella burnetii RSA 493
cuaacucacuuuuuucag

SEQ ID NO: 2575621 - RNA, 13 nt, Coxiella burnetii RSA 493
cuaagagaaaaaa

SEQ ID NO: 2575622 - RNA, 14 nt, Coxiella burnetii RSA 493
cuaagagaaaaaac

SEQ ID NO: 2575623 - RNA, 15 nt, Coxiella burnetii RSA 493
cuaagauagggaaag

SEQ ID NO: 2575624 - RNA, 22 nt, Coxiella burnetii RSA 493
cuaagauagggaaagagcggau

SEQ ID NO: 2575625 - RNA, 14 nt, Coxiella burnetii RSA 493
cuaagauaugaaug

SEQ ID NO: 2575626 - RNA, 16 nt, Coxiella burnetii RSA 493
cuaagccaguucucua

SEQ ID NO: 2575627 - RNA, 22 nt, Coxiella burnetii RSA 493
cuaaguaaacagcauuagcuuc

SEQ ID NO: 2575628 - RNA, 20 nt, Coxiella burnetii RSA 493
cuaaguugggccaaaauaga

SEQ ID NO: 2575629 - RNA, 12 nt, Coxiella burnetii RSA 493
cuaauaaaaaua

SEQ ID NO: 2575630 - RNA, 13 nt, Coxiella burnetii RSA 493
cuaauaaaaauau

SEQ ID NO: 2575631 - RNA, 17 nt, Coxiella burnetii RSA 493
cuaauacuaaacaaaau

SEQ ID NO: 2575632 - RNA, 20 nt, Coxiella burnetii RSA 493
cuaauacuaaacaaaauaau

SEQ ID NO: 2575633 - RNA, 18 nt, Coxiella burnetii RSA 493
cuaauaggaaaaaugauu

SEQ ID NO: 2575634 - RNA, 21 nt, Coxiella burnetii RSA 493
cuaauaggaaaaaugauuaua

SEQ ID NO: 2575635 - RNA, 14 nt, Coxiella burnetii RSA 493
cuaaucccgcccca

SEQ ID NO: 2575636 - RNA, 20 nt, Coxiella burnetii RSA 493
cuaaucgcaaugcuucuuca

SEQ ID NO: 2575637 - RNA, 22 nt, Coxiella burnetii RSA 493
cuaaucgcaaugcuucuucaau

SEQ ID NO: 2575638 - RNA, 20 nt, Coxiella burnetii RSA 493
cuaaugauaauccacaauuu

SEQ ID NO: 2575639 - RNA, 18 nt, Coxiella burnetii RSA 493
cuaauucuuuuuuaauau

SEQ ID NO: 2575640 - RNA, 14 nt, Coxiella burnetii RSA 493
cuaauuuuccuuuu

SEQ ID NO: 2575641 - RNA, 15 nt, Coxiella burnetii RSA 493
cuaauuuuuuauccu

SEQ ID NO: 2575642 - RNA, 15 nt, Coxiella burnetii RSA 493
cuacacuuucaaucg

SEQ ID NO: 2575643 - RNA, 18 nt, Coxiella burnetii RSA 493
cuaccgagucaaaaauaa

SEQ ID NO: 2575644 - RNA, 18 nt, Coxiella burnetii RSA 493
cuaccgggcgaugauaaa

SEQ ID NO: 2575645 - RNA, 17 nt, Coxiella burnetii RSA 493
cuaccuuccgucaauuu

SEQ ID NO: 2575646 - RNA, 14 nt, Coxiella burnetii RSA 493
cuacgaagcggcuc

SEQ ID NO: 2575647 - RNA, 20 nt, Coxiella burnetii RSA 493
cuacguuuuuugcauuuuua

SEQ ID NO: 2575648 - RNA, 21 nt, Coxiella burnetii RSA 493
cuacguuuuuugcauuuuuaa

SEQ ID NO: 2575649 - RNA, 22 nt, Coxiella burnetii RSA 493
cuacguuuuuugcauuuuuaaa

SEQ ID NO: 2575650 - RNA, 14 nt, Coxiella burnetii RSA 493
cuacucuaauuuuc

SEQ ID NO: 2575651 - RNA, 22 nt, Coxiella burnetii RSA 493
cuacucuaauuuucuuuccauc

SEQ ID NO: 2575652 - RNA, 12 nt, Coxiella burnetii RSA 493
cuacucuuuuuc

SEQ ID NO: 2575653 - RNA, 18 nt, Coxiella burnetii RSA 493
cuacuuagcugauuucuc

SEQ ID NO: 2575654 - RNA, 17 nt, Coxiella burnetii RSA 493
cuacuuagcuucggccg

SEQ ID NO: 2575655 - RNA, 15 nt, Coxiella burnetii RSA 493
cuacuuuacuuuuug

SEQ ID NO: 2575656 - RNA, 12 nt, Coxiella burnetii RSA 493
cuacuuuauuua

SEQ ID NO: 2575657 - RNA, 12 nt, Coxiella burnetii RSA 493
cuagaaaauaac

SEQ ID NO: 2575658 - RNA, 21 nt, Coxiella burnetii RSA 493
cuagaaaauaaccuaaaauag

SEQ ID NO: 2575659 - RNA, 16 nt, Coxiella burnetii RSA 493
cuagaaauauuagaaa

SEQ ID NO: 2575660 - RNA, 21 nt, Coxiella burnetii RSA 493
cuagaaauauuagaaauaaua

SEQ ID NO: 2575661 - RNA, 18 nt, Coxiella burnetii RSA 493
cuagaaguauuuccauuu

SEQ ID NO: 2575662 - RNA, 22 nt, Coxiella burnetii RSA 493
cuagaucguuuuuugauaaaac

SEQ ID NO: 2575663 - RNA, 14 nt, Coxiella burnetii RSA 493
cuagauuuuccugc

SEQ ID NO: 2575664 - RNA, 23 nt, Coxiella burnetii RSA 493
cuagauuuuggcucccuaauacu

SEQ ID NO: 2575665 - RNA, 17 nt, Coxiella burnetii RSA 493
cuagcauaaucuuuuua

SEQ ID NO: 2575666 - RNA, 18 nt, Coxiella burnetii RSA 493
cuagcauaaucuuuuuag

SEQ ID NO: 2575667 - RNA, 18 nt, Coxiella burnetii RSA 493
cucgcucuuguuucuggc

SEQ ID NO: 2575668 - RNA, 14 nt, Coxiella burnetii RSA 493
cucggggacagcaa

SEQ ID NO: 2575669 - RNA, 16 nt, Coxiella burnetii RSA 493
cucgguuggugugucu

SEQ ID NO: 2575670 - RNA, 22 nt, Coxiella burnetii RSA 493
cucgguuggugugucuccuuuu

SEQ ID NO: 2575671 - RNA, 23 nt, Coxiella burnetii RSA 493
cucguagcaccacuacuucugac

SEQ ID NO: 2575672 - RNA, 21 nt, Coxiella burnetii RSA 493
cucguauuccgcuucgcugca

SEQ ID NO: 2575673 - RNA, 21 nt, Coxiella burnetii RSA 493
cucgucuggggauacacccau

SEQ ID NO: 2575674 - RNA, 15 nt, Coxiella burnetii RSA 493
cucgugcauagcauc

SEQ ID NO: 2575675 - RNA, 18 nt, Coxiella burnetii RSA 493
cucguucuuuuauuucuu

SEQ ID NO: 2575676 - RNA, 23 nt, Coxiella burnetii RSA 493
cucguuguccccgcgaaggcgca

SEQ ID NO: 2575677 - RNA, 22 nt, Coxiella burnetii RSA 493
cucguuucggauuuugaacagu

SEQ ID NO: 2575678 - RNA, 13 nt, Coxiella burnetii RSA 493
cucuaaaaauuaa

SEQ ID NO: 2575679 - RNA, 17 nt, Coxiella burnetii RSA 493
cucuaagauaucuguuu

SEQ ID NO: 2575680 - RNA, 21 nt, Coxiella burnetii RSA 493
cucuaagcguaacgucacaaa

SEQ ID NO: 2575681 - RNA, 20 nt, Coxiella burnetii RSA 493
cucuaaugauaauccacaau

SEQ ID NO: 2575682 - RNA, 19 nt, Coxiella burnetii RSA 493
cucuacaaaauagguggau

SEQ ID NO: 2575683 - RNA, 17 nt, Coxiella burnetii RSA 493
cucuacaucuucauuuu

SEQ ID NO: 2575684 - RNA, 22 nt, Coxiella burnetii RSA 493
cucuacaucuucauuuucugua

SEQ ID NO: 2575685 - RNA, 17 nt, Coxiella burnetii RSA 493
cucuagcuguuuuuucu

SEQ ID NO: 2575686 - RNA, 19 nt, Coxiella burnetii RSA 493
cucucaaagaaacgauuaa

SEQ ID NO: 2575687 - RNA, 23 nt, Coxiella burnetii RSA 493
cucucaaagaaacgauuaaaaau

SEQ ID NO: 2575688 - RNA, 18 nt, Coxiella burnetii RSA 493
cucucaacaaagaggcaa

SEQ ID NO: 2575689 - RNA, 20 nt, Coxiella burnetii RSA 493
cucucauaaucgauaaucaa

SEQ ID NO: 2575690 - RNA, 17 nt, Coxiella burnetii RSA 493
cucucuuuauuuuuucu

SEQ ID NO: 2575691 - RNA, 21 nt, Coxiella burnetii RSA 493
cucugaaaaauauucuaacca

SEQ ID NO: 2575692 - RNA, 21 nt, Coxiella burnetii RSA 493
cucugcuucauugacagccag

SEQ ID NO: 2575693 - RNA, 18 nt, Coxiella burnetii RSA 493
cucuguuagauauugaac

SEQ ID NO: 2575694 - RNA, 18 nt, Coxiella burnetii RSA 493
cucuguucccccacuuca

SEQ ID NO: 2575695 - RNA, 22 nt, Coxiella burnetii RSA 493
cucuuaaaagacguaccauuaa

SEQ ID NO: 2575696 - RNA, 21 nt, Coxiella burnetii RSA 493
cucuuaccaugguuccagaaa

SEQ ID NO: 2575697 - RNA, 16 nt, Coxiella burnetii RSA 493
cucuuaucuuaaaccu

SEQ ID NO: 2575698 - RNA, 16 nt, Coxiella burnetii RSA 493
cucuucuuaaaccaaa

SEQ ID NO: 2575699 - RNA, 22 nt, Coxiella burnetii RSA 493
cucuugucggccggauuuuaau

SEQ ID NO: 2575700 - RNA, 20 nt, Coxiella burnetii RSA 493
cucuuuagauucaugaaaau

SEQ ID NO: 2575701 - RNA, 18 nt, Coxiella burnetii RSA 493
cucuuuauuauaaaaaaa

SEQ ID NO: 2575702 - RNA, 14 nt, Coxiella burnetii RSA 493
cucuuuauuuuuuc

SEQ ID NO: 2575703 - RNA, 19 nt, Coxiella burnetii RSA 493
cucuuuggcgccgcuggau

SEQ ID NO: 2575704 - RNA, 14 nt, Coxiella burnetii RSA 493
cucuuuuucauuuc

SEQ ID NO: 2575705 - RNA, 12 nt, Coxiella burnetii RSA 493
cucuuuuuucca

SEQ ID NO: 2575706 - RNA, 13 nt, Coxiella burnetii RSA 493
cucuuuuuuccaa

SEQ ID NO: 2575707 - RNA, 13 nt, Coxiella burnetii RSA 493
cugaaaaaauuaa

SEQ ID NO: 2575708 - RNA, 16 nt, Coxiella burnetii RSA 493
cugaaaaaauuaaaua

SEQ ID NO: 2575709 - RNA, 17 nt, Coxiella burnetii RSA 493
cugaaaaaauuaauaua

SEQ ID NO: 2575710 - RNA, 13 nt, Coxiella burnetii RSA 493
cugaaaaauaauu

SEQ ID NO: 2575711 - RNA, 12 nt, Coxiella burnetii RSA 493
cugaaauuuuau

SEQ ID NO: 2575712 - RNA, 17 nt, Coxiella burnetii RSA 493
cugaacaggauuuucau

SEQ ID NO: 2575713 - RNA, 22 nt, Coxiella burnetii RSA 493
cugaacauuaagaaagcgagca

SEQ ID NO: 2575714 - RNA, 17 nt, Coxiella burnetii RSA 493
cugaacgcucuuccaac

SEQ ID NO: 2575715 - RNA, 12 nt, Coxiella burnetii RSA 493
cugaagaaucau

SEQ ID NO: 2575716 - RNA, 17 nt, Coxiella burnetii RSA 493
cugaagacguauuugga

SEQ ID NO: 2575717 - RNA, 20 nt, Coxiella burnetii RSA 493
cugaagaggcugaauaagcu

SEQ ID NO: 2575718 - RNA, 17 nt, Coxiella burnetii RSA 493
cugaaucacuucuucca

SEQ ID NO: 2575719 - RNA, 13 nt, Coxiella burnetii RSA 493
cugaauucccuuu

SEQ ID NO: 2575720 - RNA, 20 nt, Coxiella burnetii RSA 493
cugaauugaugauguuuauu

SEQ ID NO: 2575721 - RNA, 22 nt, Coxiella burnetii RSA 493
cugacaaugcguuuuaaaugcu

SEQ ID NO: 2575722 - RNA, 23 nt, Coxiella burnetii RSA 493
cugacgcuuuuucccucucaguu

SEQ ID NO: 2575723 - RNA, 18 nt, Coxiella burnetii RSA 493
cugacgucccgugaugaa

SEQ ID NO: 2575724 - RNA, 19 nt, Coxiella burnetii RSA 493
cugagaaaacuuuucaucc

SEQ ID NO: 2575725 - RNA, 20 nt, Coxiella burnetii RSA 493
cugagcgccuuuuuuaaauu

SEQ ID NO: 2575726 - RNA, 21 nt, Coxiella burnetii RSA 493
cugagcucauugccaaagaaa

SEQ ID NO: 2575727 - RNA, 17 nt, Coxiella burnetii RSA 493
cugagggaauuuuuugc

SEQ ID NO: 2575728 - RNA, 18 nt, Coxiella burnetii RSA 493
cugagugucugagauggc

SEQ ID NO: 2575729 - RNA, 13 nt, Coxiella burnetii RSA 493
cugauaaaauaac

SEQ ID NO: 2575730 - RNA, 17 nt, Coxiella burnetii RSA 493
cugauacuucuucauua

SEQ ID NO: 2575731 - RNA, 21 nt, Coxiella burnetii RSA 493
cugauacuucuucauuaaauc

SEQ ID NO: 2575732 - RNA, 13 nt, Coxiella burnetii RSA 493
cugauauuuuuua

SEQ ID NO: 2575733 - RNA, 15 nt, Coxiella burnetii RSA 493
cugaucgauaaaaau

SEQ ID NO: 2575734 - RNA, 16 nt, Coxiella burnetii RSA 493
cugaucgauaaaaaua

SEQ ID NO: 2575735 - RNA, 18 nt, Coxiella burnetii RSA 493
cugaucgauaaaaauaau

SEQ ID NO: 2575736 - RNA, 21 nt, Coxiella burnetii RSA 493
cugaucgauaaaaauaaugau

SEQ ID NO: 2575737 - RNA, 14 nt, Coxiella burnetii RSA 493
cugauggaugaaag

SEQ ID NO: 2575738 - RNA, 22 nt, Coxiella burnetii RSA 493
cugauguaaggcaucuuuuucu

SEQ ID NO: 2575739 - RNA, 17 nt, Coxiella burnetii RSA 493
cugauugcggcucaauu

SEQ ID NO: 2575740 - RNA, 20 nt, Coxiella burnetii RSA 493
cugauuuacaauaacaaaug

SEQ ID NO: 2575741 - RNA, 23 nt, Coxiella burnetii RSA 493
cugauuuuacgcuauuuuuuaaa

SEQ ID NO: 2575742 - RNA, 18 nt, Coxiella burnetii RSA 493
cugcaacggcagaaacga

SEQ ID NO: 2575743 - RNA, 14 nt, Coxiella burnetii RSA 493
cugcaauaauucuu

SEQ ID NO: 2575744 - RNA, 16 nt, Coxiella burnetii RSA 493
cugcaccauaacuaaa

SEQ ID NO: 2575745 - RNA, 23 nt, Coxiella burnetii RSA 493
cugcaguuguuagauuggugaag

SEQ ID NO: 2575746 - RNA, 21 nt, Coxiella burnetii RSA 493
cugccauuugcggaaaaggag

SEQ ID NO: 2575747 - RNA, 20 nt, Coxiella burnetii RSA 493
cugccauuuucauuuucucu

SEQ ID NO: 2575748 - RNA, 23 nt, Coxiella burnetii RSA 493
cugccauuuucauuuucucuaau

SEQ ID NO: 2575749 - RNA, 12 nt, Coxiella burnetii RSA 493
cugcccagccgg

SEQ ID NO: 2575750 - RNA, 16 nt, Coxiella burnetii RSA 493
cugcccgggugguuaa

SEQ ID NO: 2575751 - RNA, 20 nt, Coxiella burnetii RSA 493
cugccugcuaggauuuccuu

SEQ ID NO: 2575752 - RNA, 20 nt, Coxiella burnetii RSA 493
cugccuuaagagauagugcu

SEQ ID NO: 2575753 - RNA, 15 nt, Coxiella burnetii RSA 493
cugccuucuguccuc

SEQ ID NO: 2575754 - RNA, 19 nt, Coxiella burnetii RSA 493
cugcgauuguuuucuuacu

SEQ ID NO: 2575755 - RNA, 21 nt, Coxiella burnetii RSA 493
cugcgcgaaacgacgaaagag

SEQ ID NO: 2575756 - RNA, 16 nt, Coxiella burnetii RSA 493
cugcgcuccagaugau

SEQ ID NO: 2575757 - RNA, 19 nt, Coxiella burnetii RSA 493
cugcgcuccagaugauauc

SEQ ID NO: 2575758 - RNA, 16 nt, Coxiella burnetii RSA 493
cugcgguauuguucaa

SEQ ID NO: 2575759 - RNA, 13 nt, Coxiella burnetii RSA 493
cugcguuuuucag

SEQ ID NO: 2575760 - RNA, 20 nt, Coxiella burnetii RSA 493
cugcuaggauuuccuuuuca

SEQ ID NO: 2575761 - RNA, 14 nt, Coxiella burnetii RSA 493
cugcuccuuuucuu

SEQ ID NO: 2575762 - RNA, 21 nt, Coxiella burnetii RSA 493
cugcuguauaaacaguucagu

SEQ ID NO: 2575763 - RNA, 17 nt, Coxiella burnetii RSA 493
cugcuuguaccugccau

SEQ ID NO: 2575764 - RNA, 22 nt, Coxiella burnetii RSA 493
cuggaaaaaggugcccaagaac

SEQ ID NO: 2575765 - RNA, 17 nt, Coxiella burnetii RSA 493
cuggaaaaauaaaucca

SEQ ID NO: 2575766 - RNA, 18 nt, Coxiella burnetii RSA 493
cuggaaacuuuccuguuu

SEQ ID NO: 2575767 - RNA, 14 nt, Coxiella burnetii RSA 493
cuggaauucauaau

SEQ ID NO: 2575768 - RNA, 22 nt, Coxiella burnetii RSA 493
cuggaccaccacguguauugau

SEQ ID NO: 2575769 - RNA, 20 nt, Coxiella burnetii RSA 493
cuggaugggcgcguggauuu

SEQ ID NO: 2575770 - RNA, 16 nt, Coxiella burnetii RSA 493
cuggauuuuuuaauug

SEQ ID NO: 2575771 - RNA, 18 nt, Coxiella burnetii RSA 493
cuucuauucccuuuugga

SEQ ID NO: 2575772 - RNA, 13 nt, Coxiella burnetii RSA 493
cuucucguaacaa

SEQ ID NO: 2575773 - RNA, 17 nt, Coxiella burnetii RSA 493
cuucucguaacaaaaga

SEQ ID NO: 2575774 - RNA, 15 nt, Coxiella burnetii RSA 493
cuucugcugaagcag

SEQ ID NO: 2575775 - RNA, 21 nt, Coxiella burnetii RSA 493
cuucuuaaaccaaaucgaauc

SEQ ID NO: 2575776 - RNA, 12 nt, Coxiella burnetii RSA 493
cuucuucauuaa

SEQ ID NO: 2575777 - RNA, 17 nt, Coxiella burnetii RSA 493
cuucuuccaauaacaua

SEQ ID NO: 2575778 - RNA, 15 nt, Coxiella burnetii RSA 493
cuucuuguaaggauu

SEQ ID NO: 2575779 - RNA, 18 nt, Coxiella burnetii RSA 493
cuucuuguaaggauucua

SEQ ID NO: 2575780 - RNA, 16 nt, Coxiella burnetii RSA 493
cuucuugucauucccu

SEQ ID NO: 2575781 - RNA, 13 nt, Coxiella burnetii RSA 493
cuucuuuaaaaua

SEQ ID NO: 2575782 - RNA, 17 nt, Coxiella burnetii RSA 493
cuucuuuuaaagugauu

SEQ ID NO: 2575783 - RNA, 15 nt, Coxiella burnetii RSA 493
cuucuuuuaagugga

SEQ ID NO: 2575784 - RNA, 11 nt, Coxiella burnetii RSA 493
cuucuuuucua

SEQ ID NO: 2575785 - RNA, 16 nt, Coxiella burnetii RSA 493
cuucuuuuucgauuuu

SEQ ID NO: 2575786 - RNA, 15 nt, Coxiella burnetii RSA 493
cuugaacuucaaauc

SEQ ID NO: 2575787 - RNA, 24 nt, Coxiella burnetii RSA 493
cuugaauaaacgccacauuuguuc

SEQ ID NO: 2575788 - RNA, 15 nt, Coxiella burnetii RSA 493
cuugaaucauugaag

SEQ ID NO: 2575789 - RNA, 18 nt, Coxiella burnetii RSA 493
cuugacgcucagauaaau

SEQ ID NO: 2575790 - RNA, 20 nt, Coxiella burnetii RSA 493
cuugacgcucagauaaauga

SEQ ID NO: 2575791 - RNA, 14 nt, Coxiella burnetii RSA 493
cuugaggaauugcu

SEQ ID NO: 2575792 - RNA, 22 nt, Coxiella burnetii RSA 493
cuugaguauuuggcagaauuug

SEQ ID NO: 2575793 - RNA, 14 nt, Coxiella burnetii RSA 493
cuugauaaucaaug

SEQ ID NO: 2575794 - RNA, 14 nt, Coxiella burnetii RSA 493
cuugauauucccuc

SEQ ID NO: 2575795 - RNA, 17 nt, Coxiella burnetii RSA 493
cuugauauucccucuuu

SEQ ID NO: 2575796 - RNA, 20 nt, Coxiella burnetii RSA 493
cuugaucuugggcaaaaaaa

SEQ ID NO: 2575797 - RNA, 22 nt, Coxiella burnetii RSA 493
cuugaucuugggcaaaaaaaga

SEQ ID NO: 2575798 - RNA, 23 nt, Coxiella burnetii RSA 493
cuugcaacguuugauuuucaagu

SEQ ID NO: 2575799 - RNA, 13 nt, Coxiella burnetii RSA 493
cuugcauaauagc

SEQ ID NO: 2575800 - RNA, 15 nt, Coxiella burnetii RSA 493
cuugccgauuuguuu

SEQ ID NO: 2575801 - RNA, 14 nt, Coxiella burnetii RSA 493
cuugcgaagcccaa

SEQ ID NO: 2575802 - RNA, 15 nt, Coxiella burnetii RSA 493
cuugcgaagcccaac

SEQ ID NO: 2575803 - RNA, 14 nt, Coxiella burnetii RSA 493
cuugcgagcgcaaa

SEQ ID NO: 2575804 - RNA, 16 nt, Coxiella burnetii RSA 493
cuugcgccuuaauaug

SEQ ID NO: 2575805 - RNA, 16 nt, Coxiella burnetii RSA 493
cuugcgggaaugacgu

SEQ ID NO: 2575806 - RNA, 14 nt, Coxiella burnetii RSA 493
cuugcucuucuuca

SEQ ID NO: 2575807 - RNA, 12 nt, Coxiella burnetii RSA 493
cuugcugaauuc

SEQ ID NO: 2575808 - RNA, 14 nt, Coxiella burnetii RSA 493
cuugcuucaucgau

SEQ ID NO: 2575809 - RNA, 23 nt, Coxiella burnetii RSA 493
cuugcuuucgcaggauaauguuu

SEQ ID NO: 2575810 - RNA, 16 nt, Coxiella burnetii RSA 493
cuuggaacaaaccauu

SEQ ID NO: 2575811 - RNA, 18 nt, Coxiella burnetii RSA 493
cuuggacaaaucaucaaa

SEQ ID NO: 2575812 - RNA, 18 nt, Coxiella burnetii RSA 493
cuuggagauuuagccaaa

SEQ ID NO: 2575813 - RNA, 16 nt, Coxiella burnetii RSA 493
cuuggaugaccgcuga

SEQ ID NO: 2575814 - RNA, 13 nt, Coxiella burnetii RSA 493
cuugggaacaacg

SEQ ID NO: 2575815 - RNA, 14 nt, Coxiella burnetii RSA 493
cuugguugauucaa

SEQ ID NO: 2575816 - RNA, 19 nt, Coxiella burnetii RSA 493
cuugucauucccuuuuucg

SEQ ID NO: 2575817 - RNA, 21 nt, Coxiella burnetii RSA 493
cuugugcaauuccauuaaaaa

SEQ ID NO: 2575818 - RNA, 22 nt, Coxiella burnetii RSA 493
cuugugcaauuccauuaaaaac

SEQ ID NO: 2575819 - RNA, 23 nt, Coxiella burnetii RSA 493
cuugugcaauuccauuaaaaaca

SEQ ID NO: 2575820 - RNA, 13 nt, Coxiella burnetii RSA 493
cuuguuaaguaga

SEQ ID NO: 2575821 - RNA, 22 nt, Coxiella burnetii RSA 493
cuuguuaaguagauagucuuug

SEQ ID NO: 2575822 - RNA, 12 nt, Coxiella burnetii RSA 493
cuuguugaauuc

SEQ ID NO: 2575823 - RNA, 16 nt, Coxiella burnetii RSA 493
cuuguugaauuccuug

SEQ ID NO: 2575824 - RNA, 12 nt, Coxiella burnetii RSA 493
cuuguugcaauc

SEQ ID NO: 2575825 - RNA, 17 nt, Coxiella burnetii RSA 493
cuuguugcaauccuuuu

SEQ ID NO: 2575826 - RNA, 19 nt, Coxiella burnetii RSA 493
cuuguugcaauccuuuuug

SEQ ID NO: 2575827 - RNA, 14 nt, Coxiella burnetii RSA 493
cuuguuuaucacuc

SEQ ID NO: 2575828 - RNA, 22 nt, Coxiella burnetii RSA 493
cuuuaaaauaaguauccauccc

SEQ ID NO: 2575829 - RNA, 15 nt, Coxiella burnetii RSA 493
cuuuaacauuaucau

SEQ ID NO: 2575830 - RNA, 20 nt, Coxiella burnetii RSA 493
cuuuaacauuaucauguuca

SEQ ID NO: 2575831 - RNA, 19 nt, Coxiella burnetii RSA 493
cuuuaacuuuagcuaauuc

SEQ ID NO: 2575832 - RNA, 18 nt, Coxiella burnetii RSA 493
cuuuaauacaguuuaucg

SEQ ID NO: 2575833 - RNA, 22 nt, Coxiella burnetii RSA 493
cuuuaaucgcuccgaaaauaaa

SEQ ID NO: 2575834 - RNA, 17 nt, Coxiella burnetii RSA 493
cuuuaauugcuuccuua

SEQ ID NO: 2575835 - RNA, 16 nt, Coxiella burnetii RSA 493
cuuuaccuccucccca

SEQ ID NO: 2575836 - RNA, 20 nt, Coxiella burnetii RSA 493
cuuuacuuuuuguagguuaa

SEQ ID NO: 2575837 - RNA, 23 nt, Coxiella burnetii RSA 493
cuuuauaguucauuaaauuuaau

SEQ ID NO: 2575838 - RNA, 21 nt, Coxiella burnetii RSA 493
cuuuauauguguaacaaaaac

SEQ ID NO: 2575839 - RNA, 14 nt, Coxiella burnetii RSA 493
cuuuauuauaaaaa

SEQ ID NO: 2575840 - RNA, 15 nt, Coxiella burnetii RSA 493
cuuuauuauaaaaaa

SEQ ID NO: 2575841 - RNA, 12 nt, Coxiella burnetii RSA 493
cuuuauucauua

SEQ ID NO: 2575842 - RNA, 20 nt, Coxiella burnetii RSA 493
cuuuauucccgauggggaua

SEQ ID NO: 2575843 - RNA, 16 nt, Coxiella burnetii RSA 493
cuuuauuuuucgcuca

SEQ ID NO: 2575844 - RNA, 14 nt, Coxiella burnetii RSA 493
cuuuauuuuuucuu

SEQ ID NO: 2575845 - RNA, 23 nt, Coxiella burnetii RSA 493
cuuucaauaaauaaaucaagugu

SEQ ID NO: 2575846 - RNA, 23 nt, Coxiella burnetii RSA 493
cuuucaauuacuuuuauaaucaa

SEQ ID NO: 2575847 - RNA, 14 nt, Coxiella burnetii RSA 493
cuuucauuaucuag

SEQ ID NO: 2575848 - RNA, 20 nt, Coxiella burnetii RSA 493
cuuucauuuaauuuuaaauc

SEQ ID NO: 2575849 - RNA, 12 nt, Coxiella burnetii RSA 493
cuuucgauaaau

SEQ ID NO: 2575850 - RNA, 22 nt, Coxiella burnetii RSA 493
cuuucgauaaauuuugaauccu

SEQ ID NO: 2575851 - RNA, 16 nt, Coxiella burnetii RSA 493
cuuucguugugcucuc

SEQ ID NO: 2575852 - RNA, 18 nt, Coxiella burnetii RSA 493
cuuucuagaaggggagcg

SEQ ID NO: 2575853 - RNA, 20 nt, Coxiella burnetii RSA 493
cuuucugacgcuuuuucccu

SEQ ID NO: 2575854 - RNA, 15 nt, Coxiella burnetii RSA 493
cuuucuuugaaccac

SEQ ID NO: 2575855 - RNA, 12 nt, Coxiella burnetii RSA 493
cuuucuuuuaau

SEQ ID NO: 2575856 - RNA, 23 nt, Coxiella burnetii RSA 493
cuuugaaaaaacggcguauuuuu

SEQ ID NO: 2575857 - RNA, 19 nt, Coxiella burnetii RSA 493
cuuugauaaauuaaaaaaa

SEQ ID NO: 2575858 - RNA, 22 nt, Coxiella burnetii RSA 493
cuuugauaagcauaauucauca

SEQ ID NO: 2575859 - RNA, 22 nt, Coxiella burnetii RSA 493
cuuugccccguuccaauauuuu

SEQ ID NO: 2575860 - RNA, 20 nt, Coxiella burnetii RSA 493
cuuugcgcguucaauauguu

SEQ ID NO: 2575861 - RNA, 20 nt, Coxiella burnetii RSA 493
cuuugcuccauacgggcuac

SEQ ID NO: 2575862 - RNA, 14 nt, Coxiella burnetii RSA 493
cuuugcucuaaauu

SEQ ID NO: 2575863 - RNA, 16 nt, Coxiella burnetii RSA 493
cuuugcugaccuuuuc

SEQ ID NO: 2575864 - RNA, 16 nt, Coxiella burnetii RSA 493
cuuuggauaauuuuua

SEQ ID NO: 2575865 - RNA, 17 nt, Coxiella burnetii RSA 493
cuuuggguauaaauaac

SEQ ID NO: 2575866 - RNA, 14 nt, Coxiella burnetii RSA 493
cuuuggguuggcuu

SEQ ID NO: 2575867 - RNA, 23 nt, Coxiella burnetii RSA 493
cuuugugaguucccgugcaauug

SEQ ID NO: 2575868 - RNA, 17 nt, Coxiella burnetii RSA 493
cuuuguuccuugagagu

SEQ ID NO: 2575869 - RNA, 18 nt, Coxiella burnetii RSA 493
cuuuuaaacagucuucac

SEQ ID NO: 2575870 - RNA, 19 nt, Coxiella burnetii RSA 493
cuuuuaaacgcuucaaagu

SEQ ID NO: 2575871 - RNA, 18 nt, Coxiella burnetii RSA 493
cuuuuaaagugauuuuuu

SEQ ID NO: 2575872 - RNA, 19 nt, Coxiella burnetii RSA 493
cuuuuaaagugauuuuuuu

SEQ ID NO: 2575873 - RNA, 15 nt, Coxiella burnetii RSA 493
cuuuuaaauaaggga

SEQ ID NO: 2575874 - RNA, 18 nt, Coxiella burnetii RSA 493
cuuuuaacuucucuugaa

SEQ ID NO: 2575875 - RNA, 20 nt, Coxiella burnetii RSA 493
cuuuuaauugacuuauuuuu

SEQ ID NO: 2575876 - RNA, 23 nt, Coxiella burnetii RSA 493
cuuuuagcgaccaccaugugaau

SEQ ID NO: 2575877 - RNA, 16 nt, Coxiella burnetii RSA 493
gaaauucuuguccuuu

SEQ ID NO: 2575878 - RNA, 15 nt, Coxiella burnetii RSA 493
gaaauugacaaauaa

SEQ ID NO: 2575879 - RNA, 16 nt, Coxiella burnetii RSA 493
gaaauugacaaauaaa

SEQ ID NO: 2575880 - RNA, 18 nt, Coxiella burnetii RSA 493
gaaauugacaaauaaaga

SEQ ID NO: 2575881 - RNA, 18 nt, Coxiella burnetii RSA 493
gaaauugauguguuuucu

SEQ ID NO: 2575882 - RNA, 18 nt, Coxiella burnetii RSA 493
gaaauugcgcguaaaauu

SEQ ID NO: 2575883 - RNA, 19 nt, Coxiella burnetii RSA 493
gaaauuggucaggaacaac

SEQ ID NO: 2575884 - RNA, 16 nt, Coxiella burnetii RSA 493
gaaauuuaauaaaauu

SEQ ID NO: 2575885 - RNA, 18 nt, Coxiella burnetii RSA 493
gaaauuuaauaaaauuaa

SEQ ID NO: 2575886 - RNA, 14 nt, Coxiella burnetii RSA 493
gaaauuucucucuc

SEQ ID NO: 2575887 - RNA, 18 nt, Coxiella burnetii RSA 493
gaaauuuguuauugcuaa

SEQ ID NO: 2575888 - RNA, 13 nt, Coxiella burnetii RSA 493
gaaauuuuauaag

SEQ ID NO: 2575889 - RNA, 20 nt, Coxiella burnetii RSA 493
gaacaccuaaaucaauuuuc

SEQ ID NO: 2575890 - RNA, 21 nt, Coxiella burnetii RSA 493
gaacaggggcuaaauaaggag

SEQ ID NO: 2575891 - RNA, 22 nt, Coxiella burnetii RSA 493
gaaccaaaagcaucgucaucgu

SEQ ID NO: 2575892 - RNA, 14 nt, Coxiella burnetii RSA 493
gaaccaaucuauua

SEQ ID NO: 2575893 - RNA, 14 nt, Coxiella burnetii RSA 493
gaaccaccaaauca

SEQ ID NO: 2575894 - RNA, 22 nt, Coxiella burnetii RSA 493
gaaccgucacuucuucuccauu

SEQ ID NO: 2575895 - RNA, 16 nt, Coxiella burnetii RSA 493
gaaccuaaauuauaaa

SEQ ID NO: 2575896 - RNA, 18 nt, Coxiella burnetii RSA 493
gaacgaauacggggacga

SEQ ID NO: 2575897 - RNA, 21 nt, Coxiella burnetii RSA 493
gaacgacuuuuuuuaccauuu

SEQ ID NO: 2575898 - RNA, 22 nt, Coxiella burnetii RSA 493
gaacgacuuuuuuuaccauuuc

SEQ ID NO: 2575899 - RNA, 17 nt, Coxiella burnetii RSA 493
gaacgcgaaaagauucc

SEQ ID NO: 2575900 - RNA, 18 nt, Coxiella burnetii RSA 493
gaacgcgaaaagauucca

SEQ ID NO: 2575901 - RNA, 15 nt, Coxiella burnetii RSA 493
gaacucagcccaaca

SEQ ID NO: 2575902 - RNA, 16 nt, Coxiella burnetii RSA 493
gaacuuuuuuuaaugc

SEQ ID NO: 2575903 - RNA, 14 nt, Coxiella burnetii RSA 493
gaagaacgauaaug

SEQ ID NO: 2575904 - RNA, 15 nt, Coxiella burnetii RSA 493
gaagaagccaguauu

SEQ ID NO: 2575905 - RNA, 20 nt, Coxiella burnetii RSA 493
gaagaaggcucuucauaucc

SEQ ID NO: 2575906 - RNA, 18 nt, Coxiella burnetii RSA 493
gaagaagucguguuuuua

SEQ ID NO: 2575907 - RNA, 20 nt, Coxiella burnetii RSA 493
gaagagaguaagucucugcu

SEQ ID NO: 2575908 - RNA, 15 nt, Coxiella burnetii RSA 493
gaagaguaaaaaacc

SEQ ID NO: 2575909 - RNA, 21 nt, Coxiella burnetii RSA 493
gaagcaacuuuaacauuauca

SEQ ID NO: 2575910 - RNA, 21 nt, Coxiella burnetii RSA 493
gaagcaauugucuaacauuug

SEQ ID NO: 2575911 - RNA, 19 nt, Coxiella burnetii RSA 493
gaagcaugcugauuuucac

SEQ ID NO: 2575912 - RNA, 20 nt, Coxiella burnetii RSA 493
gaagcgaaauacggggacga

SEQ ID NO: 2575913 - RNA, 15 nt, Coxiella burnetii RSA 493
gaagcgaaguacggg

SEQ ID NO: 2575914 - RNA, 14 nt, Coxiella burnetii RSA 493
gaagcggaauacgg

SEQ ID NO: 2575915 - RNA, 15 nt, Coxiella burnetii RSA 493
gaaggaaauuugcau

SEQ ID NO: 2575916 - RNA, 15 nt, Coxiella burnetii RSA 493
gaaggaauagccuuc

SEQ ID NO: 2575917 - RNA, 14 nt, Coxiella burnetii RSA 493
gaaggcucuucaua

SEQ ID NO: 2575918 - RNA, 22 nt, Coxiella burnetii RSA 493
gaaggcucuucauauccuuucu

SEQ ID NO: 2575919 - RNA, 18 nt, Coxiella burnetii RSA 493
gaaggguuuugugcauaa

SEQ ID NO: 2575920 - RNA, 21 nt, Coxiella burnetii RSA 493
gaaguccuuaucacuagcuau

SEQ ID NO: 2575921 - RNA, 23 nt, Coxiella burnetii RSA 493
gaagugaccaacgcacucugugc

SEQ ID NO: 2575922 - RNA, 16 nt, Coxiella burnetii RSA 493
gaaguucuauuuccgc

SEQ ID NO: 2575923 - RNA, 16 nt, Coxiella burnetii RSA 493
gaaguucucaaauuuu

SEQ ID NO: 2575924 - RNA, 18 nt, Coxiella burnetii RSA 493
gaaguugacgaaugugcu

SEQ ID NO: 2575925 - RNA, 23 nt, Coxiella burnetii RSA 493
gaaguugccgauaaaaaggcaaa

SEQ ID NO: 2575926 - RNA, 15 nt, Coxiella burnetii RSA 493
gaaguuuaaaguuau

SEQ ID NO: 2575927 - RNA, 13 nt, Coxiella burnetii RSA 493
gaauaaaacggcu

SEQ ID NO: 2575928 - RNA, 19 nt, Coxiella burnetii RSA 493
gaauaacaucaguuuugau

SEQ ID NO: 2575929 - RNA, 22 nt, Coxiella burnetii RSA 493
gaauaaccggcuucuaaguaaa

SEQ ID NO: 2575930 - RNA, 16 nt, Coxiella burnetii RSA 493
gaauaacggaaaaugg

SEQ ID NO: 2575931 - RNA, 14 nt, Coxiella burnetii RSA 493
gaauaagaauaagg

SEQ ID NO: 2575932 - RNA, 20 nt, Coxiella burnetii RSA 493
gaauaauugccgguaaugag

SEQ ID NO: 2575933 - RNA, 21 nt, Coxiella burnetii RSA 493
gaauacaacgcuguuaaaauc

SEQ ID NO: 2575934 - RNA, 21 nt, Coxiella burnetii RSA 493
gaauagccuucucaauuucaa

SEQ ID NO: 2575935 - RNA, 19 nt, Coxiella burnetii RSA 493
gaauagggagaagaagcca

SEQ ID NO: 2575936 - RNA, 22 nt, Coxiella burnetii RSA 493
gaauauaaugggaguaaugaca

SEQ ID NO: 2575937 - RNA, 13 nt, Coxiella burnetii RSA 493
gaauauccagcac

SEQ ID NO: 2575938 - RNA, 16 nt, Coxiella burnetii RSA 493
gaaucaaauuaaaaua

SEQ ID NO: 2575939 - RNA, 22 nt, Coxiella burnetii RSA 493
gaaucaaguagccaaaauaaua

SEQ ID NO: 2575940 - RNA, 17 nt, Coxiella burnetii RSA 493
gaaucacuuguccuucu

SEQ ID NO: 2575941 - RNA, 24 nt, Coxiella burnetii RSA 493
gaaucauccaaucaacgaacacau

SEQ ID NO: 2575942 - RNA, 13 nt, Coxiella burnetii RSA 493
gaaucauugaaga

SEQ ID NO: 2575943 - RNA, 14 nt, Coxiella burnetii RSA 493
gaaucugcuuccuc

SEQ ID NO: 2575944 - RNA, 22 nt, Coxiella burnetii RSA 493
gaaugaauuuaaugucuuuuau

SEQ ID NO: 2575945 - RNA, 18 nt, Coxiella burnetii RSA 493
gaaugagcauaacgaauc

SEQ ID NO: 2575946 - RNA, 14 nt, Coxiella burnetii RSA 493
gaaugaucugcucu

SEQ ID NO: 2575947 - RNA, 21 nt, Coxiella burnetii RSA 493
gaaugauucgacauaaggcug

SEQ ID NO: 2575948 - RNA, 23 nt, Coxiella burnetii RSA 493
gaaugauucgacauaaggcugcg

SEQ ID NO: 2575949 - RNA, 13 nt, Coxiella burnetii RSA 493
gaaugcguucuuu

SEQ ID NO: 2575950 - RNA, 19 nt, Coxiella burnetii RSA 493
gaauggacgugcaaaugag

SEQ ID NO: 2575951 - RNA, 21 nt, Coxiella burnetii RSA 493
gaauggccuuacuuaccguuu

SEQ ID NO: 2575952 - RNA, 21 nt, Coxiella burnetii RSA 493
gaaugggauugaaccacgauu

SEQ ID NO: 2575953 - RNA, 15 nt, Coxiella burnetii RSA 493
gaaugguugaaagaa

SEQ ID NO: 2575954 - RNA, 19 nt, Coxiella burnetii RSA 493
gaaugguugaaagaaaaaa

SEQ ID NO: 2575955 - RNA, 23 nt, Coxiella burnetii RSA 493
gaauguuuuuuaauaaauagcau

SEQ ID NO: 2575956 - RNA, 12 nt, Coxiella burnetii RSA 493
gaauuaaaaaua

SEQ ID NO: 2575957 - RNA, 13 nt, Coxiella burnetii RSA 493
gaauuaaaaauau

SEQ ID NO: 2575958 - RNA, 14 nt, Coxiella burnetii RSA 493
gaauuaaaaauauu

SEQ ID NO: 2575959 - RNA, 14 nt, Coxiella burnetii RSA 493
gaauuaaauauccg

SEQ ID NO: 2575960 - RNA, 21 nt, Coxiella burnetii RSA 493
gaauuagagguucaucgccuu

SEQ ID NO: 2575961 - RNA, 16 nt, Coxiella burnetii RSA 493
gaauuauuuuaucgcc

SEQ ID NO: 2575962 - RNA, 17 nt, Coxiella burnetii RSA 493
gaauuauuuuaucgccc

SEQ ID NO: 2575963 - RNA, 13 nt, Coxiella burnetii RSA 493
gaauucaaaccaa

SEQ ID NO: 2575964 - RNA, 22 nt, Coxiella burnetii RSA 493
gaauucauaaucaaaaucagaa

SEQ ID NO: 2575965 - RNA, 18 nt, Coxiella burnetii RSA 493
gaauucauugaaagcgca

SEQ ID NO: 2575966 - RNA, 18 nt, Coxiella burnetii RSA 493
gaauucccuuuugaauuc

SEQ ID NO: 2575967 - RNA, 20 nt, Coxiella burnetii RSA 493
gaauuccuugcucaaguccu

SEQ ID NO: 2575968 - RNA, 18 nt, Coxiella burnetii RSA 493
gaauuccuuguugaauuc

SEQ ID NO: 2575969 - RNA, 20 nt, Coxiella burnetii RSA 493
gaauucgggguucuguaagu

SEQ ID NO: 2575970 - RNA, 17 nt, Coxiella burnetii RSA 493
gaauucuaauuaaauua

SEQ ID NO: 2575971 - RNA, 12 nt, Coxiella burnetii RSA 493
gaauucucccau

SEQ ID NO: 2575972 - RNA, 17 nt, Coxiella burnetii RSA 493
gaauugaaguccuuauc

SEQ ID NO: 2575973 - RNA, 15 nt, Coxiella burnetii RSA 493
gaauugcuaccugcu

SEQ ID NO: 2575974 - RNA, 14 nt, Coxiella burnetii RSA 493
gaauuguaaaaaga

SEQ ID NO: 2575975 - RNA, 15 nt, Coxiella burnetii RSA 493
gaauuucaccguuuu

SEQ ID NO: 2575976 - RNA, 15 nt, Coxiella burnetii RSA 493
gaauuugaaauaaac

SEQ ID NO: 2575977 - RNA, 18 nt, Coxiella burnetii RSA 493
gaauuugaaauaaacugg

SEQ ID NO: 2575978 - RNA, 23 nt, Coxiella burnetii RSA 493
gaauuugagaacguuucccaagg

SEQ ID NO: 2575979 - RNA, 15 nt, Coxiella burnetii RSA 493
gaauuugugauuuua

SEQ ID NO: 2575980 - RNA, 21 nt, Coxiella burnetii RSA 493
gaauuuuauugucauguucaa

SEQ ID NO: 2575981 - RNA, 15 nt, Coxiella burnetii RSA 493
gaauuuuuugaaaaa

SEQ ID NO: 2575982 - RNA, 19 nt, Coxiella burnetii RSA 493
gaggaccagcucggggaca

SEQ ID NO: 2575983 - RNA, 19 nt, Coxiella burnetii RSA 493
gaggagccagauaaaucaa

SEQ ID NO: 2575984 - RNA, 15 nt, Coxiella burnetii RSA 493
gaggaugaugaaaag

SEQ ID NO: 2575985 - RNA, 22 nt, Coxiella burnetii RSA 493
gaggcaauacaucuugauccuu

SEQ ID NO: 2575986 - RNA, 14 nt, Coxiella burnetii RSA 493
gaggcaccucauug

SEQ ID NO: 2575987 - RNA, 16 nt, Coxiella burnetii RSA 493
gaggcugaauaagcug

SEQ ID NO: 2575988 - RNA, 19 nt, Coxiella burnetii RSA 493
gaggcugaguagggugcga

SEQ ID NO: 2575989 - RNA, 11 nt, Coxiella burnetii RSA 493
gagggaaaccu

SEQ ID NO: 2575990 - RNA, 20 nt, Coxiella burnetii RSA 493
gaggguugcacgaugucuuu

SEQ ID NO: 2575991 - RNA, 16 nt, Coxiella burnetii RSA 493
gaggucaucauuuuug

SEQ ID NO: 2575992 - RNA, 13 nt, Coxiella burnetii RSA 493
gagguuaauaaaa

SEQ ID NO: 2575993 - RNA, 14 nt, Coxiella burnetii RSA 493
gagguuaauaaaaa

SEQ ID NO: 2575994 - RNA, 16 nt, Coxiella burnetii RSA 493
gaguagggaguugggc

SEQ ID NO: 2575995 - RNA, 19 nt, Coxiella burnetii RSA 493
gaguauccaacucucuagc

SEQ ID NO: 2575996 - RNA, 20 nt, Coxiella burnetii RSA 493
gagucggaaguucuauuucc

SEQ ID NO: 2575997 - RNA, 19 nt, Coxiella burnetii RSA 493
gagucgggaaauaaaauua

SEQ ID NO: 2575998 - RNA, 21 nt, Coxiella burnetii RSA 493
gagucgggaaauaaaauuaau

SEQ ID NO: 2575999 - RNA, 16 nt, Coxiella burnetii RSA 493
gagucguauuccuuuu

SEQ ID NO: 2576000 - RNA, 12 nt, Coxiella burnetii RSA 493
gagugccacaaa

SEQ ID NO: 2576001 - RNA, 20 nt, Coxiella burnetii RSA 493
gagugcguuaaggccucuuu

SEQ ID NO: 2576002 - RNA, 13 nt, Coxiella burnetii RSA 493
gagugguaaugac

SEQ ID NO: 2576003 - RNA, 14 nt, Coxiella burnetii RSA 493
gaguuaauuucaua

SEQ ID NO: 2576004 - RNA, 13 nt, Coxiella burnetii RSA 493
gaguucauuaaug

SEQ ID NO: 2576005 - RNA, 18 nt, Coxiella burnetii RSA 493
gaguucgcuaguggcucg

SEQ ID NO: 2576006 - RNA, 16 nt, Coxiella burnetii RSA 493
gaguucuugcucccaa

SEQ ID NO: 2576007 - RNA, 20 nt, Coxiella burnetii RSA 493
gauaaaaacaaagugaaaua

SEQ ID NO: 2576008 - RNA, 14 nt, Coxiella burnetii RSA 493
gauaaaaauaauga

SEQ ID NO: 2576009 - RNA, 14 nt, Coxiella burnetii RSA 493
gauaaaacuugauu

SEQ ID NO: 2576010 - RNA, 12 nt, Coxiella burnetii RSA 493
gauaaaucaaac

SEQ ID NO: 2576011 - RNA, 17 nt, Coxiella burnetii RSA 493
gauaaauuuugaauccu

SEQ ID NO: 2576012 - RNA, 19 nt, Coxiella burnetii RSA 493
gauaacggggucgcggaaa

SEQ ID NO: 2576013 - RNA, 18 nt, Coxiella burnetii RSA 493
gauaacuauuauuaaaag

SEQ ID NO: 2576014 - RNA, 19 nt, Coxiella burnetii RSA 493
gauaacuauuauuaaaaga

SEQ ID NO: 2576015 - RNA, 23 nt, Coxiella burnetii RSA 493
gauaacuauuauuaaaagagcga

SEQ ID NO: 2576016 - RNA, 15 nt, Coxiella burnetii RSA 493
gauaagcauaauuca

SEQ ID NO: 2576017 - RNA, 20 nt, Coxiella burnetii RSA 493
gauaagcauauugcaauaau

SEQ ID NO: 2576018 - RNA, 20 nt, Coxiella burnetii RSA 493
gauaauaguuacgagcuguu

SEQ ID NO: 2576019 - RNA, 20 nt, Coxiella burnetii RSA 493
gauaauaucuagauuuaaaa

SEQ ID NO: 2576020 - RNA, 10 nt, Coxiella burnetii RSA 493
gauaaucaac

SEQ ID NO: 2576021 - RNA, 18 nt, Coxiella burnetii RSA 493
gauaauccgccuaaauua

SEQ ID NO: 2576022 - RNA, 19 nt, Coxiella burnetii RSA 493
gauaauccgccuaaauuaa

SEQ ID NO: 2576023 - RNA, 22 nt, Coxiella burnetii RSA 493
gauaaucggcgguguaauuacu

SEQ ID NO: 2576024 - RNA, 15 nt, Coxiella burnetii RSA 493
gauaauuuuggugcu

SEQ ID NO: 2576025 - RNA, 13 nt, Coxiella burnetii RSA 493
gauacaaauuuuu

SEQ ID NO: 2576026 - RNA, 17 nt, Coxiella burnetii RSA 493
gauacacauaaugaucg

SEQ ID NO: 2576027 - RNA, 13 nt, Coxiella burnetii RSA 493
gauacagccuuca

SEQ ID NO: 2576028 - RNA, 17 nt, Coxiella burnetii RSA 493
gauaccaucaggauaau

SEQ ID NO: 2576029 - RNA, 16 nt, Coxiella burnetii RSA 493
gauacgaccuucugaa

SEQ ID NO: 2576030 - RNA, 16 nt, Coxiella burnetii RSA 493
gauacggugcagaagg

SEQ ID NO: 2576031 - RNA, 14 nt, Coxiella burnetii RSA 493
gauacuaaauuagu

SEQ ID NO: 2576032 - RNA, 20 nt, Coxiella burnetii RSA 493
gauacuaaauuaguaauauu

SEQ ID NO: 2576033 - RNA, 12 nt, Coxiella burnetii RSA 493
gauacuucuuca

SEQ ID NO: 2576034 - RNA, 18 nt, Coxiella burnetii RSA 493
gauagacaauuuuuuuug

SEQ ID NO: 2576035 - RNA, 23 nt, Coxiella burnetii RSA 493
gauagcauuguuggaaauaaugg

SEQ ID NO: 2576036 - RNA, 15 nt, Coxiella burnetii RSA 493
gauagucauuugcca

SEQ ID NO: 2576037 - RNA, 16 nt, Coxiella burnetii RSA 493
gauagugcuauuuuuc

SEQ ID NO: 2576038 - RNA, 17 nt, Coxiella burnetii RSA 493
gauauauuaagccgaug

SEQ ID NO: 2576039 - RNA, 17 nt, Coxiella burnetii RSA 493
gauaucaauagcgcaau

SEQ ID NO: 2576040 - RNA, 19 nt, Coxiella burnetii RSA 493
gauaucaaucgaaaaaaau

SEQ ID NO: 2576041 - RNA, 16 nt, Coxiella burnetii RSA 493
gauaucgccuaucuuu

SEQ ID NO: 2576042 - RNA, 22 nt, Coxiella burnetii RSA 493
gauaucugacgauguaguuuug

SEQ ID NO: 2576043 - RNA, 17 nt, Coxiella burnetii RSA 493
gauaucuguuuuauccc

SEQ ID NO: 2576044 - RNA, 14 nt, Coxiella burnetii RSA 493
gauaugggggccca

SEQ ID NO: 2576045 - RNA, 21 nt, Coxiella burnetii RSA 493
gauauucccucuuuaccuccu

SEQ ID NO: 2576046 - RNA, 18 nt, Coxiella burnetii RSA 493
gauauucuaucucaaagg

SEQ ID NO: 2576047 - RNA, 21 nt, Coxiella burnetii RSA 493
gauauucuaucucaaguggcu

SEQ ID NO: 2576048 - RNA, 20 nt, Coxiella burnetii RSA 493
gauauuuuuuaacuccgcaa

SEQ ID NO: 2576049 - RNA, 14 nt, Coxiella burnetii RSA 493
gaucaacaaaauau

SEQ ID NO: 2576050 - RNA, 15 nt, Coxiella burnetii RSA 493
gaucaaguuucuccc

SEQ ID NO: 2576051 - RNA, 15 nt, Coxiella burnetii RSA 493
gaucaaugaaacaaa

SEQ ID NO: 2576052 - RNA, 17 nt, Coxiella burnetii RSA 493
gaucaaugaaacaaaca

SEQ ID NO: 2576053 - RNA, 13 nt, Coxiella burnetii RSA 493
gaucacaccccuc

SEQ ID NO: 2576054 - RNA, 16 nt, Coxiella burnetii RSA 493
gauccaagauuuuuuu

SEQ ID NO: 2576055 - RNA, 21 nt, Coxiella burnetii RSA 493
gauccaagugugggaaaaaua

SEQ ID NO: 2576056 - RNA, 22 nt, Coxiella burnetii RSA 493
gaucccucggccaaagaaaauu

SEQ ID NO: 2576057 - RNA, 12 nt, Coxiella burnetii RSA 493
gauccucaacag

SEQ ID NO: 2576058 - RNA, 15 nt, Coxiella burnetii RSA 493
gauccuugcaauaag

SEQ ID NO: 2576059 - RNA, 23 nt, Coxiella burnetii RSA 493
gaucgaaaugucugguauuguug

SEQ ID NO: 2576060 - RNA, 15 nt, Coxiella burnetii RSA 493
gaucgauaaaaauaa

SEQ ID NO: 2576061 - RNA, 24 nt, Coxiella burnetii RSA 493
gaucguuaaaucgggugcauaacg

SEQ ID NO: 2576062 - RNA, 16 nt, Coxiella burnetii RSA 493
gaucuaacguuuuguc

SEQ ID NO: 2576063 - RNA, 13 nt, Coxiella burnetii RSA 493
gaucuaagucuau

SEQ ID NO: 2576064 - RNA, 13 nt, Coxiella burnetii RSA 493
gaucuaaucgucu

SEQ ID NO: 2576065 - RNA, 16 nt, Coxiella burnetii RSA 493
gaucuccuugaggaau

SEQ ID NO: 2576066 - RNA, 23 nt, Coxiella burnetii RSA 493
gaucuuaagaagagacaaaguuu

SEQ ID NO: 2576067 - RNA, 16 nt, Coxiella burnetii RSA 493
gaucuugggcaaaaaa

SEQ ID NO: 2576068 - RNA, 20 nt, Coxiella burnetii RSA 493
gaugaaaucguuuuguuuua

SEQ ID NO: 2576069 - RNA, 17 nt, Coxiella burnetii RSA 493
gaugaagcugacgcuuc

SEQ ID NO: 2576070 - RNA, 19 nt, Coxiella burnetii RSA 493
gaugaauaacaaugccaac

SEQ ID NO: 2576071 - RNA, 12 nt, Coxiella burnetii RSA 493
gaugacaaauaa

SEQ ID NO: 2576072 - RNA, 14 nt, Coxiella burnetii RSA 493
gaugaucaucauca

SEQ ID NO: 2576073 - RNA, 18 nt, Coxiella burnetii RSA 493
gaugaucuuaugcguuau

SEQ ID NO: 2576074 - RNA, 17 nt, Coxiella burnetii RSA 493
gaugauuaaaucaacac

SEQ ID NO: 2576075 - RNA, 13 nt, Coxiella burnetii RSA 493
gaugauuugcgcu

SEQ ID NO: 2576076 - RNA, 19 nt, Coxiella burnetii RSA 493
gaugcagcuucgugcaauu

SEQ ID NO: 2576077 - RNA, 23 nt, Coxiella burnetii RSA 493
gaugcauuaaucauuacagacaa

SEQ ID NO: 2576078 - RNA, 20 nt, Coxiella burnetii RSA 493
gauggaacugauauacgcca

SEQ ID NO: 2576079 - RNA, 22 nt, Coxiella burnetii RSA 493
gauggaacugauauacgccaug

SEQ ID NO: 2576080 - RNA, 16 nt, Coxiella burnetii RSA 493
gauggaagaacauuug

SEQ ID NO: 2576081 - RNA, 16 nt, Coxiella burnetii RSA 493
gauggauuaaaugcaa

SEQ ID NO: 2576082 - RNA, 17 nt, Coxiella burnetii RSA 493
gaugggauaaaaaaccc

SEQ ID NO: 2576083 - RNA, 19 nt, Coxiella burnetii RSA 493
gauguauccuaauaaaaau

SEQ ID NO: 2576084 - RNA, 16 nt, Coxiella burnetii RSA 493
gaugucauaaucacaa

SEQ ID NO: 2576085 - RNA, 18 nt, Coxiella burnetii RSA 493
gaugugaaacaugcugcu

SEQ ID NO: 2576086 - RNA, 20 nt, Coxiella burnetii RSA 493
gauguucggcgaaugcgcuu

SEQ ID NO: 2576087 - RNA, 17 nt, Coxiella burnetii RSA 493
gauguucucagcgucuu

SEQ ID NO: 2576088 - RNA, 19 nt, Coxiella burnetii RSA 493
gcagugaaugaagguguuu

SEQ ID NO: 2576089 - RNA, 22 nt, Coxiella burnetii RSA 493
gcaguuuuuuacuugcuucauc

SEQ ID NO: 2576090 - RNA, 12 nt, Coxiella burnetii RSA 493
gcauaaaaaccc

SEQ ID NO: 2576091 - RNA, 13 nt, Coxiella burnetii RSA 493
gcauaacuaauug

SEQ ID NO: 2576092 - RNA, 13 nt, Coxiella burnetii RSA 493
gcauaaucuuuuu

SEQ ID NO: 2576093 - RNA, 15 nt, Coxiella burnetii RSA 493
gcauacgauauaaaa

SEQ ID NO: 2576094 - RNA, 18 nt, Coxiella burnetii RSA 493
gcauacgauauaaaagca

SEQ ID NO: 2576095 - RNA, 15 nt, Coxiella burnetii RSA 493
gcauagggaucauua

SEQ ID NO: 2576096 - RNA, 12 nt, Coxiella burnetii RSA 493
gcauauaaaagu

SEQ ID NO: 2576097 - RNA, 14 nt, Coxiella burnetii RSA 493
gcauauauuccaca

SEQ ID NO: 2576098 - RNA, 23 nt, Coxiella burnetii RSA 493
gcauauauuccacaauuuuccgg

SEQ ID NO: 2576099 - RNA, 22 nt, Coxiella burnetii RSA 493
gcauauucgccuucuugccgcc

SEQ ID NO: 2576100 - RNA, 15 nt, Coxiella burnetii RSA 493
gcaucaaaaaaaccu

SEQ ID NO: 2576101 - RNA, 14 nt, Coxiella burnetii RSA 493
gcaucaggcuaucg

SEQ ID NO: 2576102 - RNA, 14 nt, Coxiella burnetii RSA 493
gcaucccccaagag

SEQ ID NO: 2576103 - RNA, 20 nt, Coxiella burnetii RSA 493
gcauccgccccgaaauauga

SEQ ID NO: 2576104 - RNA, 21 nt, Coxiella burnetii RSA 493
gcauccgguuaauagcaucaa

SEQ ID NO: 2576105 - RNA, 16 nt, Coxiella burnetii RSA 493
gcaucgagaagucgcu

SEQ ID NO: 2576106 - RNA, 18 nt, Coxiella burnetii RSA 493
gcaucuucgccuggccaa

SEQ ID NO: 2576107 - RNA, 13 nt, Coxiella burnetii RSA 493
gcaugaaauuuuu

SEQ ID NO: 2576108 - RNA, 19 nt, Coxiella burnetii RSA 493
gcaugaauuaaauauaauu

SEQ ID NO: 2576109 - RNA, 23 nt, Coxiella burnetii RSA 493
gcaugauacaaauuuuuaagacg

SEQ ID NO: 2576110 - RNA, 23 nt, Coxiella burnetii RSA 493
gcaugauuuaggcagccuaauuu

SEQ ID NO: 2576111 - RNA, 14 nt, Coxiella burnetii RSA 493
gcauuaaaaaauaa

SEQ ID NO: 2576112 - RNA, 16 nt, Coxiella burnetii RSA 493
gcauuaaaaaauaaga

SEQ ID NO: 2576113 - RNA, 14 nt, Coxiella burnetii RSA 493
gcauuaaaagauuu

SEQ ID NO: 2576114 - RNA, 15 nt, Coxiella burnetii RSA 493
gcauuaaaagauuua

SEQ ID NO: 2576115 - RNA, 12 nt, Coxiella burnetii RSA 493
gcauuaauaaga

SEQ ID NO: 2576116 - RNA, 13 nt, Coxiella burnetii RSA 493
gcauuaauaagac

SEQ ID NO: 2576117 - RNA, 14 nt, Coxiella burnetii RSA 493
gcauuaaucauuac

SEQ ID NO: 2576118 - RNA, 20 nt, Coxiella burnetii RSA 493
gcauuaaucuuccauuaauu

SEQ ID NO: 2576119 - RNA, 16 nt, Coxiella burnetii RSA 493
gcauuaucggaugaug

SEQ ID NO: 2576120 - RNA, 19 nt, Coxiella burnetii RSA 493
gcauucauucuuuuuucaa

SEQ ID NO: 2576121 - RNA, 18 nt, Coxiella burnetii RSA 493
gcauucccauagaagaac

SEQ ID NO: 2576122 - RNA, 21 nt, Coxiella burnetii RSA 493
gcauucccauagaagaacaau

SEQ ID NO: 2576123 - RNA, 14 nt, Coxiella burnetii RSA 493
gcauucuugcaacg

SEQ ID NO: 2576124 - RNA, 17 nt, Coxiella burnetii RSA 493
gcauugcauuucuuuca

SEQ ID NO: 2576125 - RNA, 20 nt, Coxiella burnetii RSA 493
gcauuucaauggauucuucu

SEQ ID NO: 2576126 - RNA, 18 nt, Coxiella burnetii RSA 493
gcauuucccaaucaucaa

SEQ ID NO: 2576127 - RNA, 19 nt, Coxiella burnetii RSA 493
gcauuucccaaucaucaau

SEQ ID NO: 2576128 - RNA, 21 nt, Coxiella burnetii RSA 493
gcauuuuuuugucgaauuuuu

SEQ ID NO: 2576129 - RNA, 17 nt, Coxiella burnetii RSA 493
gccaaaaauucguuaaa

SEQ ID NO: 2576130 - RNA, 15 nt, Coxiella burnetii RSA 493
gccaaaaccgccggc

SEQ ID NO: 2576131 - RNA, 19 nt, Coxiella burnetii RSA 493
gccaaaacggcgaaaggga

SEQ ID NO: 2576132 - RNA, 12 nt, Coxiella burnetii RSA 493
gccaaaauaaua

SEQ ID NO: 2576133 - RNA, 21 nt, Coxiella burnetii RSA 493
gccaaacaacgcguucuugcu

SEQ ID NO: 2576134 - RNA, 16 nt, Coxiella burnetii RSA 493
gccaaagcaaaaauac

SEQ ID NO: 2576135 - RNA, 13 nt, Coxiella burnetii RSA 493
gccaaagcauucc

SEQ ID NO: 2576136 - RNA, 20 nt, Coxiella burnetii RSA 493
gccaacauucuuugaucuua

SEQ ID NO: 2576137 - RNA, 16 nt, Coxiella burnetii RSA 493
gccaaccgccauuucg

SEQ ID NO: 2576138 - RNA, 23 nt, Coxiella burnetii RSA 493
gccaacuuauagcccacacuaaa

SEQ ID NO: 2576139 - RNA, 20 nt, Coxiella burnetii RSA 493
gccaauacgaacaauuguuc

SEQ ID NO: 2576140 - RNA, 18 nt, Coxiella burnetii RSA 493
gccacaaagaauuuuucc

SEQ ID NO: 2576141 - RNA, 22 nt, Coxiella burnetii RSA 493
gccacaauauacgcaauuguuc

SEQ ID NO: 2576142 - RNA, 17 nt, Coxiella burnetii RSA 493
gccacauuucggacaac

SEQ ID NO: 2576143 - RNA, 22 nt, Coxiella burnetii RSA 493
gccaccuuuuggcaauuuauuc

SEQ ID NO: 2576144 - RNA, 19 nt, Coxiella burnetii RSA 493
gccagaagcguaccaaugu

SEQ ID NO: 2576145 - RNA, 21 nt, Coxiella burnetii RSA 493
gccagacuucuuuaagcguuu

SEQ ID NO: 2576146 - RNA, 16 nt, Coxiella burnetii RSA 493
gccagauacacauaau

SEQ ID NO: 2576147 - RNA, 18 nt, Coxiella burnetii RSA 493
gccagcgauuuauuucuu

SEQ ID NO: 2576148 - RNA, 18 nt, Coxiella burnetii RSA 493
gccaggacuuuaagauuu

SEQ ID NO: 2576149 - RNA, 21 nt, Coxiella burnetii RSA 493
gccaggugggggagaucgaaa

SEQ ID NO: 2576150 - RNA, 19 nt, Coxiella burnetii RSA 493
gccagugccugugcaacac

SEQ ID NO: 2576151 - RNA, 23 nt, Coxiella burnetii RSA 493
gccauauaauuuaaugagguuaa

SEQ ID NO: 2576152 - RNA, 14 nt, Coxiella burnetii RSA 493
gccauccaaaugag

SEQ ID NO: 2576153 - RNA, 15 nt, Coxiella burnetii RSA 493
gccauccaaaugagc

SEQ ID NO: 2576154 - RNA, 15 nt, Coxiella burnetii RSA 493
gccaucuugccacac

SEQ ID NO: 2576155 - RNA, 23 nt, Coxiella burnetii RSA 493
gccaugcguuuccgccucaauuu

SEQ ID NO: 2576156 - RNA, 19 nt, Coxiella burnetii RSA 493
gccauugagaauggcgguc

SEQ ID NO: 2576157 - RNA, 21 nt, Coxiella burnetii RSA 493
gccauugguuuaaaaaguuca

SEQ ID NO: 2576158 - RNA, 20 nt, Coxiella burnetii RSA 493
gccauuugcggaaaaggaga

SEQ ID NO: 2576159 - RNA, 21 nt, Coxiella burnetii RSA 493
gccauuuguauggcgccugac

SEQ ID NO: 2576160 - RNA, 23 nt, Coxiella burnetii RSA 493
gccauuuucauuuucucuaauga

SEQ ID NO: 2576161 - RNA, 17 nt, Coxiella burnetii RSA 493
gccauuuuuuagcaccg

SEQ ID NO: 2576162 - RNA, 16 nt, Coxiella burnetii RSA 493
gcccaguaacuaagua

SEQ ID NO: 2576163 - RNA, 22 nt, Coxiella burnetii RSA 493
gcccauagcuggacucgauggg

SEQ ID NO: 2576164 - RNA, 18 nt, Coxiella burnetii RSA 493
gccccaugaguucuguca

SEQ ID NO: 2576165 - RNA, 17 nt, Coxiella burnetii RSA 493
gccccauuuuuguaaau

SEQ ID NO: 2576166 - RNA, 17 nt, Coxiella burnetii RSA 493
gcccccgaaacaggcgg

SEQ ID NO: 2576167 - RNA, 12 nt, Coxiella burnetii RSA 493
gccccuccucua

SEQ ID NO: 2576168 - RNA, 23 nt, Coxiella burnetii RSA 493
gcccgcuauacugcuuguaccug

SEQ ID NO: 2576169 - RNA, 18 nt, Coxiella burnetii RSA 493
gcccguaugagcgaacga

SEQ ID NO: 2576170 - RNA, 19 nt, Coxiella burnetii RSA 493
gcccguaugagcgaagcga

SEQ ID NO: 2576171 - RNA, 20 nt, Coxiella burnetii RSA 493
gcccguaugcagcgaagcgg

SEQ ID NO: 2576172 - RNA, 23 nt, Coxiella burnetii RSA 493
gcccuaacauucaaagaacgcca

SEQ ID NO: 2576173 - RNA, 17 nt, Coxiella burnetii RSA 493
gcccuuuagccacgcuu

SEQ ID NO: 2576174 - RNA, 15 nt, Coxiella burnetii RSA 493
gcccuuucucuuuuu

SEQ ID NO: 2576175 - RNA, 16 nt, Coxiella burnetii RSA 493
gcccuuuugaauccca

SEQ ID NO: 2576176 - RNA, 22 nt, Coxiella burnetii RSA 493
gcccuuuuuuuccauaauaacg

SEQ ID NO: 2576177 - RNA, 21 nt, Coxiella burnetii RSA 493
gccgaagugcuaaaaaauuac

SEQ ID NO: 2576178 - RNA, 14 nt, Coxiella burnetii RSA 493
gccgaccaaaagcc

SEQ ID NO: 2576179 - RNA, 18 nt, Coxiella burnetii RSA 493
gccgagcuuuucacccaa

SEQ ID NO: 2576180 - RNA, 15 nt, Coxiella burnetii RSA 493
gccgauaaguuuuua

SEQ ID NO: 2576181 - RNA, 16 nt, Coxiella burnetii RSA 493
gccgaugacaaauaaa

SEQ ID NO: 2576182 - RNA, 13 nt, Coxiella burnetii RSA 493
gccgcaagugacc

SEQ ID NO: 2576183 - RNA, 15 nt, Coxiella burnetii RSA 493
gccgccuuaauaacc

SEQ ID NO: 2576184 - RNA, 19 nt, Coxiella burnetii RSA 493
gccgcuaacagagggagca

SEQ ID NO: 2576185 - RNA, 23 nt, Coxiella burnetii RSA 493
gccgcuauuucuagcguugaaaa

SEQ ID NO: 2576186 - RNA, 18 nt, Coxiella burnetii RSA 493
gccgcugcgguauuguuc

SEQ ID NO: 2576187 - RNA, 13 nt, Coxiella burnetii RSA 493
gccgcugugccug

SEQ ID NO: 2576188 - RNA, 18 nt, Coxiella burnetii RSA 493
gccggacuuuuucaaugc

SEQ ID NO: 2576189 - RNA, 20 nt, Coxiella burnetii RSA 493
gccggaguuaacagcuguuc

SEQ ID NO: 2576190 - RNA, 17 nt, Coxiella burnetii RSA 493
gccggaugauuugcgcu

SEQ ID NO: 2576191 - RNA, 20 nt, Coxiella burnetii RSA 493
gccggauuuuaauugaauuu

SEQ ID NO: 2576192 - RNA, 15 nt, Coxiella burnetii RSA 493
gccggcuaauuuuuu

SEQ ID NO: 2576193 - RNA, 16 nt, Coxiella burnetii RSA 493
gcuaagcgaaaaauga

SEQ ID NO: 2576194 - RNA, 17 nt, Coxiella burnetii RSA 493
gcuaagugauugauuuu

SEQ ID NO: 2576195 - RNA, 20 nt, Coxiella burnetii RSA 493
gcuaauacuaaacaaaauaa

SEQ ID NO: 2576196 - RNA, 13 nt, Coxiella burnetii RSA 493
gcuaauucuuuuu

SEQ ID NO: 2576197 - RNA, 16 nt, Coxiella burnetii RSA 493
gcuaauucuuuuuuaa

SEQ ID NO: 2576198 - RNA, 18 nt, Coxiella burnetii RSA 493
gcuaauuuagguguaagu

SEQ ID NO: 2576199 - RNA, 13 nt, Coxiella burnetii RSA 493
gcuacauacgggc

SEQ ID NO: 2576200 - RNA, 15 nt, Coxiella burnetii RSA 493
gcuacguuuuuugca

SEQ ID NO: 2576201 - RNA, 21 nt, Coxiella burnetii RSA 493
gcuacguuuuuugcauuuuua

SEQ ID NO: 2576202 - RNA, 14 nt, Coxiella burnetii RSA 493
gcuacucuuuuucu

SEQ ID NO: 2576203 - RNA, 17 nt, Coxiella burnetii RSA 493
gcuacucuuuuucuuag

SEQ ID NO: 2576204 - RNA, 17 nt, Coxiella burnetii RSA 493
gcuacuugaaaaccuac

SEQ ID NO: 2576205 - RNA, 21 nt, Coxiella burnetii RSA 493
gcuagaaaauaaccuaaaaua

SEQ ID NO: 2576206 - RNA, 16 nt, Coxiella burnetii RSA 493
gcuagaaguauuucca

SEQ ID NO: 2576207 - RNA, 18 nt, Coxiella burnetii RSA 493
gcuagcuggaauucauaa

SEQ ID NO: 2576208 - RNA, 20 nt, Coxiella burnetii RSA 493
gcuagcuggaauucauaauc

SEQ ID NO: 2576209 - RNA, 22 nt, Coxiella burnetii RSA 493
gcuagcuggaauucauaaucaa

SEQ ID NO: 2576210 - RNA, 15 nt, Coxiella burnetii RSA 493
gcuaguaugcuauaa

SEQ ID NO: 2576211 - RNA, 15 nt, Coxiella burnetii RSA 493
gcuaucggcuucaca

SEQ ID NO: 2576212 - RNA, 22 nt, Coxiella burnetii RSA 493
gcuauggaguucuugcucccaa

SEQ ID NO: 2576213 - RNA, 18 nt, Coxiella burnetii RSA 493
gcuauuaggaucaagcgc

SEQ ID NO: 2576214 - RNA, 20 nt, Coxiella burnetii RSA 493
gcucaagcgaacgcggccuu

SEQ ID NO: 2576215 - RNA, 12 nt, Coxiella burnetii RSA 493
gcucaaguccuu

SEQ ID NO: 2576216 - RNA, 22 nt, Coxiella burnetii RSA 493
gcucagcccaaccuacgggcua

SEQ ID NO: 2576217 - RNA, 18 nt, Coxiella burnetii RSA 493
gcucauacgggcuacuuu

SEQ ID NO: 2576218 - RNA, 15 nt, Coxiella burnetii RSA 493
gcucauugaaaucaa

SEQ ID NO: 2576219 - RNA, 16 nt, Coxiella burnetii RSA 493
gcucauuuucacuauu

SEQ ID NO: 2576220 - RNA, 12 nt, Coxiella burnetii RSA 493
gcuccagaugau

SEQ ID NO: 2576221 - RNA, 13 nt, Coxiella burnetii RSA 493
gcuccauacgggc

SEQ ID NO: 2576222 - RNA, 16 nt, Coxiella burnetii RSA 493
gcuccauagaugggug

SEQ ID NO: 2576223 - RNA, 17 nt, Coxiella burnetii RSA 493
gcuccauuguuucgaaa

SEQ ID NO: 2576224 - RNA, 16 nt, Coxiella burnetii RSA 493
gcuccgcguuuuucca

SEQ ID NO: 2576225 - RNA, 14 nt, Coxiella burnetii RSA 493
gcuccuaaauuuuc

SEQ ID NO: 2576226 - RNA, 19 nt, Coxiella burnetii RSA 493
gcuccuaaauuuucuuguu

SEQ ID NO: 2576227 - RNA, 21 nt, Coxiella burnetii RSA 493
gcuccucaauuuccuauuuua

SEQ ID NO: 2576228 - RNA, 14 nt, Coxiella burnetii RSA 493
gcuccucuauauaa

SEQ ID NO: 2576229 - RNA, 17 nt, Coxiella burnetii RSA 493
gcucgauucuuugucug

SEQ ID NO: 2576230 - RNA, 23 nt, Coxiella burnetii RSA 493
gcucgcgaaauuuaauaaaauua

SEQ ID NO: 2576231 - RNA, 20 nt, Coxiella burnetii RSA 493
gcucgcuaaucgcaaugcuu

SEQ ID NO: 2576232 - RNA, 18 nt, Coxiella burnetii RSA 493
gcucuaauucugauuguu

SEQ ID NO: 2576233 - RNA, 17 nt, Coxiella burnetii RSA 493
gcucuccuaccaaauaa

SEQ ID NO: 2576234 - RNA, 15 nt, Coxiella burnetii RSA 493
gcucucucuaagaua

SEQ ID NO: 2576235 - RNA, 23 nt, Coxiella burnetii RSA 493
gcucugaccuaauuugauuuuuu

SEQ ID NO: 2576236 - RNA, 14 nt, Coxiella burnetii RSA 493
gcugaacaaaagcc

SEQ ID NO: 2576237 - RNA, 14 nt, Coxiella burnetii RSA 493
gcugaagaggcuga

SEQ ID NO: 2576238 - RNA, 19 nt, Coxiella burnetii RSA 493
gcugaagaggcugaauaag

SEQ ID NO: 2576239 - RNA, 14 nt, Coxiella burnetii RSA 493
gcugaaguccuugu

SEQ ID NO: 2576240 - RNA, 16 nt, Coxiella burnetii RSA 493
gcugaaguccuuguug

SEQ ID NO: 2576241 - RNA, 21 nt, Coxiella burnetii RSA 493
gcugaaguugacgcaacaaaa

SEQ ID NO: 2576242 - RNA, 14 nt, Coxiella burnetii RSA 493
gcugaauaagcuga

SEQ ID NO: 2576243 - RNA, 13 nt, Coxiella burnetii RSA 493
gcugaauucaaac

SEQ ID NO: 2576244 - RNA, 11 nt, Coxiella burnetii RSA 493
gcugacaccua

SEQ ID NO: 2576245 - RNA, 13 nt, Coxiella burnetii RSA 493
gcugacaucuuua

SEQ ID NO: 2576246 - RNA, 15 nt, Coxiella burnetii RSA 493
gcugacgucagaaaa

SEQ ID NO: 2576247 - RNA, 22 nt, Coxiella burnetii RSA 493
gcugacgucagaaaacagccuc

SEQ ID NO: 2576248 - RNA, 17 nt, Coxiella burnetii RSA 493
gcugacuagucaacaaa

SEQ ID NO: 2576249 - RNA, 19 nt, Coxiella burnetii RSA 493
gcugagcuugcgaagccca

SEQ ID NO: 2576250 - RNA, 20 nt, Coxiella burnetii RSA 493
gcugagcuugcgaagcccaa

SEQ ID NO: 2576251 - RNA, 13 nt, Coxiella burnetii RSA 493
gcugauaauugaa

SEQ ID NO: 2576252 - RNA, 13 nt, Coxiella burnetii RSA 493
gcugauauuuuuu

SEQ ID NO: 2576253 - RNA, 21 nt, Coxiella burnetii RSA 493
gcugauuucugguugaaucaa

SEQ ID NO: 2576254 - RNA, 19 nt, Coxiella burnetii RSA 493
gcugcacgccuccagggcu

SEQ ID NO: 2576255 - RNA, 16 nt, Coxiella burnetii RSA 493
gcugcgguauuguuca

SEQ ID NO: 2576256 - RNA, 14 nt, Coxiella burnetii RSA 493
gcugcuaucugcaa

SEQ ID NO: 2576257 - RNA, 20 nt, Coxiella burnetii RSA 493
gcugcuccacaaugcauuug

SEQ ID NO: 2576258 - RNA, 14 nt, Coxiella burnetii RSA 493
gcugcuuuuuaaaa

SEQ ID NO: 2576259 - RNA, 13 nt, Coxiella burnetii RSA 493
gcuggaaaaauaa

SEQ ID NO: 2576260 - RNA, 14 nt, Coxiella burnetii RSA 493
gcuggaaaaauaaa

SEQ ID NO: 2576261 - RNA, 15 nt, Coxiella burnetii RSA 493
gcuggaaaaauaaau

SEQ ID NO: 2576262 - RNA, 20 nt, Coxiella burnetii RSA 493
gcuguaaccgccuuuaagau

SEQ ID NO: 2576263 - RNA, 18 nt, Coxiella burnetii RSA 493
gcuguacauuuuucaagg

SEQ ID NO: 2576264 - RNA, 20 nt, Coxiella burnetii RSA 493
gcuguacuuucacuaauuau

SEQ ID NO: 2576265 - RNA, 12 nt, Coxiella burnetii RSA 493
gcugucaaaaaa

SEQ ID NO: 2576266 - RNA, 19 nt, Coxiella burnetii RSA 493
gcuguucgggcacaaaaaa

SEQ ID NO: 2576267 - RNA, 14 nt, Coxiella burnetii RSA 493
gcuuaaacccagaa

SEQ ID NO: 2576268 - RNA, 19 nt, Coxiella burnetii RSA 493
gcuuaccgaggucuuuuau

SEQ ID NO: 2576269 - RNA, 12 nt, Coxiella burnetii RSA 493
gcuucaaacaaa

SEQ ID NO: 2576270 - RNA, 14 nt, Coxiella burnetii RSA 493
gcuucaauaaaaaa

SEQ ID NO: 2576271 - RNA, 14 nt, Coxiella burnetii RSA 493
gcuucaauucuuuu

SEQ ID NO: 2576272 - RNA, 18 nt, Coxiella burnetii RSA 493
gcuucaucgauugcuaaa

SEQ ID NO: 2576273 - RNA, 22 nt, Coxiella burnetii RSA 493
gcuuccccaauuuauucaacuc

SEQ ID NO: 2576274 - RNA, 16 nt, Coxiella burnetii RSA 493
gcuuccuuaaagcaac

SEQ ID NO: 2576275 - RNA, 17 nt, Coxiella burnetii RSA 493
gcuucgcgaacucagcc

SEQ ID NO: 2576276 - RNA, 13 nt, Coxiella burnetii RSA 493
gcuucgcugcaua

SEQ ID NO: 2576277 - RNA, 22 nt, Coxiella burnetii RSA 493
gcuucgucauuuccgugcaggg

SEQ ID NO: 2576278 - RNA, 17 nt, Coxiella burnetii RSA 493
gcuucgugcaauuucug

SEQ ID NO: 2576279 - RNA, 13 nt, Coxiella burnetii RSA 493
gcuucuuuaaaau

SEQ ID NO: 2576280 - RNA, 15 nt, Coxiella burnetii RSA 493
gcuucuuuaaaauaa

SEQ ID NO: 2576281 - RNA, 16 nt, Coxiella burnetii RSA 493
gcuucuuuuaauugac

SEQ ID NO: 2576282 - RNA, 17 nt, Coxiella burnetii RSA 493
gcuugacgauauugauu

SEQ ID NO: 2576283 - RNA, 14 nt, Coxiella burnetii RSA 493
gcuugcguaaaguu

SEQ ID NO: 2576284 - RNA, 23 nt, Coxiella burnetii RSA 493
gcuugcuaugaugccgcuccaua

SEQ ID NO: 2576285 - RNA, 16 nt, Coxiella burnetii RSA 493
gcuugcucuucuucau

SEQ ID NO: 2576286 - RNA, 15 nt, Coxiella burnetii RSA 493
gcuugguuaacgaaa

SEQ ID NO: 2576287 - RNA, 22 nt, Coxiella burnetii RSA 493
gcuuuaaucgcuccgaaaauaa

SEQ ID NO: 2576288 - RNA, 22 nt, Coxiella burnetii RSA 493
gcuuuacaccuaagagaaaaaa

SEQ ID NO: 2576289 - RNA, 22 nt, Coxiella burnetii RSA 493
gcuuuacauagccucuauaaau

SEQ ID NO: 2576290 - RNA, 24 nt, Coxiella burnetii RSA 493
gcuuuacauagccucuauaaauaa

SEQ ID NO: 2576291 - RNA, 22 nt, Coxiella burnetii RSA 493
gcuuuauuauuuuuuucuauua

SEQ ID NO: 2576292 - RNA, 12 nt, Coxiella burnetii RSA 493
gcuuuauucauu

SEQ ID NO: 2576293 - RNA, 15 nt, Coxiella burnetii RSA 493
gcuuucaauaaauaa

SEQ ID NO: 2576294 - RNA, 19 nt, Coxiella burnetii RSA 493
gcuuucccuuuuugauuuc

SEQ ID NO: 2576295 - RNA, 21 nt, Coxiella burnetii RSA 493
gcuuucgcaggauaauguuug

SEQ ID NO: 2576296 - RNA, 14 nt, Coxiella burnetii RSA 493
gcuuucuuuuucuu

SEQ ID NO: 2576297 - RNA, 21 nt, Coxiella burnetii RSA 493
gcuuugggugggugagaagaa

SEQ ID NO: 2576298 - RNA, 17 nt, Coxiella burnetii RSA 493
gcuuuuaaacgcuucaa

SEQ ID NO: 2576299 - RNA, 23 nt, Coxiella burnetii RSA 493
gggagguuaaaauggugaaaagc

SEQ ID NO: 2576300 - RNA, 17 nt, Coxiella burnetii RSA 493
gggaguaaugacagaaa

SEQ ID NO: 2576301 - RNA, 18 nt, Coxiella burnetii RSA 493
gggagucggugacgagga

SEQ ID NO: 2576302 - RNA, 23 nt, Coxiella burnetii RSA 493
gggaucguuucugguuuccuuuc

SEQ ID NO: 2576303 - RNA, 18 nt, Coxiella burnetii RSA 493
gggauugggauaauaacu

SEQ ID NO: 2576304 - RNA, 18 nt, Coxiella burnetii RSA 493
gggcaaaaaaagaaaauc

SEQ ID NO: 2576305 - RNA, 20 nt, Coxiella burnetii RSA 493
gggcauucuuacggcucacg

SEQ ID NO: 2576306 - RNA, 19 nt, Coxiella burnetii RSA 493
gggcgauuggcgcaucaaa

SEQ ID NO: 2576307 - RNA, 21 nt, Coxiella burnetii RSA 493
gggcuacucuaauuuucuuuc

SEQ ID NO: 2576308 - RNA, 19 nt, Coxiella burnetii RSA 493
gggcuacuuccuucuuguc

SEQ ID NO: 2576309 - RNA, 18 nt, Coxiella burnetii RSA 493
gggcuacuugaaaaccua

SEQ ID NO: 2576310 - RNA, 19 nt, Coxiella burnetii RSA 493
gggcuacuugaaaaccuac

SEQ ID NO: 2576311 - RNA, 21 nt, Coxiella burnetii RSA 493
gggcuacuuguugaaaaccua

SEQ ID NO: 2576312 - RNA, 22 nt, Coxiella burnetii RSA 493
gggcuacuuuacuuguugaaaa

SEQ ID NO: 2576313 - RNA, 19 nt, Coxiella burnetii RSA 493
gggcuaguaugcuauaauu

SEQ ID NO: 2576314 - RNA, 15 nt, Coxiella burnetii RSA 493
gggcugucuucucuu

SEQ ID NO: 2576315 - RNA, 21 nt, Coxiella burnetii RSA 493
gggcuuugggugauagacaga

SEQ ID NO: 2576316 - RNA, 11 nt, Coxiella burnetii RSA 493
ggggaaauaau

SEQ ID NO: 2576317 - RNA, 14 nt, Coxiella burnetii RSA 493
ggggugaauuuuug

SEQ ID NO: 2576318 - RNA, 15 nt, Coxiella burnetii RSA 493
gggguuagcuuccau

SEQ ID NO: 2576319 - RNA, 16 nt, Coxiella burnetii RSA 493
gggguuagcuuccauu

SEQ ID NO: 2576320 - RNA, 16 nt, Coxiella burnetii RSA 493
gggguuuaauugcaug

SEQ ID NO: 2576321 - RNA, 12 nt, Coxiella burnetii RSA 493
ggguaaauuuau

SEQ ID NO: 2576322 - RNA, 14 nt, Coxiella burnetii RSA 493
ggguaagaauaaac

SEQ ID NO: 2576323 - RNA, 22 nt, Coxiella burnetii RSA 493
gggucaauugcaaaacagcccc

SEQ ID NO: 2576324 - RNA, 13 nt, Coxiella burnetii RSA 493
gggugagaagaau

SEQ ID NO: 2576325 - RNA, 19 nt, Coxiella burnetii RSA 493
gggugcaguuugggggcgu

SEQ ID NO: 2576326 - RNA, 23 nt, Coxiella burnetii RSA 493
ggguuacguuauaauuucuuuuu

SEQ ID NO: 2576327 - RNA, 18 nt, Coxiella burnetii RSA 493
ggguuguccuuggaacaa

SEQ ID NO: 2576328 - RNA, 19 nt, Coxiella burnetii RSA 493
ggguuguccuuggaacaaa

SEQ ID NO: 2576329 - RNA, 22 nt, Coxiella burnetii RSA 493
ggguugucugauugcggcucaa

SEQ ID NO: 2576330 - RNA, 14 nt, Coxiella burnetii RSA 493
gguaaaaaaauagu

SEQ ID NO: 2576331 - RNA, 13 nt, Coxiella burnetii RSA 493
gguaaaaaacuaa

SEQ ID NO: 2576332 - RNA, 19 nt, Coxiella burnetii RSA 493
gguaaagagggacuauaaa

SEQ ID NO: 2576333 - RNA, 18 nt, Coxiella burnetii RSA 493
gguaaagccguuauccau

SEQ ID NO: 2576334 - RNA, 22 nt, Coxiella burnetii RSA 493
gguaagaaaaaguuaaguauau

SEQ ID NO: 2576335 - RNA, 19 nt, Coxiella burnetii RSA 493
gguacugaagaguaaaaaa

SEQ ID NO: 2576336 - RNA, 22 nt, Coxiella burnetii RSA 493
gguagagcacaaccuugccaag

SEQ ID NO: 2576337 - RNA, 22 nt, Coxiella burnetii RSA 493
gguagagcccgucauguaauuu

SEQ ID NO: 2576338 - RNA, 15 nt, Coxiella burnetii RSA 493
gguagcccgaaaaag

SEQ ID NO: 2576339 - RNA, 17 nt, Coxiella burnetii RSA 493
gguagcccgaaaaagua

SEQ ID NO: 2576340 - RNA, 18 nt, Coxiella burnetii RSA 493
gguauuuccuugcgcuga

SEQ ID NO: 2576341 - RNA, 17 nt, Coxiella burnetii RSA 493
ggucauccauucuuuca

SEQ ID NO: 2576342 - RNA, 17 nt, Coxiella burnetii RSA 493
ggucauuuguucuauca

SEQ ID NO: 2576343 - RNA, 14 nt, Coxiella burnetii RSA 493
ggucgcauucuauu

SEQ ID NO: 2576344 - RNA, 16 nt, Coxiella burnetii RSA 493
ggucgcggaaaauuua

SEQ ID NO: 2576345 - RNA, 23 nt, Coxiella burnetii RSA 493
ggucggggguucaagucccuccc

SEQ ID NO: 2576346 - RNA, 14 nt, Coxiella burnetii RSA 493
ggucucaacagccu

SEQ ID NO: 2576347 - RNA, 14 nt, Coxiella burnetii RSA 493
ggucuucaucuuua

SEQ ID NO: 2576348 - RNA, 12 nt, Coxiella burnetii RSA 493
ggugacgaggaa

SEQ ID NO: 2576349 - RNA, 15 nt, Coxiella burnetii RSA 493
ggugagaagaauaag

SEQ ID NO: 2576350 - RNA, 21 nt, Coxiella burnetii RSA 493
ggugagagcaggcugacucag

SEQ ID NO: 2576351 - RNA, 21 nt, Coxiella burnetii RSA 493
ggugauaaugagaucaaagcg

SEQ ID NO: 2576352 - RNA, 22 nt, Coxiella burnetii RSA 493
ggugauaauugauaguucauau

SEQ ID NO: 2576353 - RNA, 23 nt, Coxiella burnetii RSA 493
ggugcagaaggcccgcuaauugu

SEQ ID NO: 2576354 - RNA, 19 nt, Coxiella burnetii RSA 493
ggugcauaacgggaauguu

SEQ ID NO: 2576355 - RNA, 15 nt, Coxiella burnetii RSA 493
ggugcgaauaacaaa

SEQ ID NO: 2576356 - RNA, 20 nt, Coxiella burnetii RSA 493
ggugcgaauaacaaagacuu

SEQ ID NO: 2576357 - RNA, 12 nt, Coxiella burnetii RSA 493
gguggaacaaua

SEQ ID NO: 2576358 - RNA, 14 nt, Coxiella burnetii RSA 493
gguggguaaugaua

SEQ ID NO: 2576359 - RNA, 15 nt, Coxiella burnetii RSA 493
ggugguuaaguagcu

SEQ ID NO: 2576360 - RNA, 12 nt, Coxiella burnetii RSA 493
gguuaacucuuu

SEQ ID NO: 2576361 - RNA, 14 nt, Coxiella burnetii RSA 493
gguuaauaaaaagg

SEQ ID NO: 2576362 - RNA, 17 nt, Coxiella burnetii RSA 493
gguuaauucuucuucau

SEQ ID NO: 2576363 - RNA, 17 nt, Coxiella burnetii RSA 493
gguucauuuuuuuugcc

SEQ ID NO: 2576364 - RNA, 14 nt, Coxiella burnetii RSA 493
gguucguguuuauu

SEQ ID NO: 2576365 - RNA, 21 nt, Coxiella burnetii RSA 493
gguucuaacgcaaucggauua

SEQ ID NO: 2576366 - RNA, 22 nt, Coxiella burnetii RSA 493
gguucucaaauugcuccaaaca

SEQ ID NO: 2576367 - RNA, 22 nt, Coxiella burnetii RSA 493
gguugaaaacgauagucucuau

SEQ ID NO: 2576368 - RNA, 21 nt, Coxiella burnetii RSA 493
gguugaaagccgagucucugu

SEQ ID NO: 2576369 - RNA, 17 nt, Coxiella burnetii RSA 493
gguuggacuacaucaaa

SEQ ID NO: 2576370 - RNA, 14 nt, Coxiella burnetii RSA 493
gguugucaacaaaa

SEQ ID NO: 2576371 - RNA, 18 nt, Coxiella burnetii RSA 493
gguugucaacaaaauuuu

SEQ ID NO: 2576372 - RNA, 20 nt, Coxiella burnetii RSA 493
gguuguguggcuucgccaca

SEQ ID NO: 2576373 - RNA, 12 nt, Coxiella burnetii RSA 493
gguuuuccauga

SEQ ID NO: 2576374 - RNA, 12 nt, Coxiella burnetii RSA 493
gguuuucuuccg

SEQ ID NO: 2576375 - RNA, 21 nt, Coxiella burnetii RSA 493
gguuuugugcauaaauuauuu

SEQ ID NO: 2576376 - RNA, 12 nt, Coxiella burnetii RSA 493
gguuuuuuuaaa

SEQ ID NO: 2576377 - RNA, 22 nt, Coxiella burnetii RSA 493
gguuuuuuuaaaaaagaaaaua

SEQ ID NO: 2576378 - RNA, 18 nt, Coxiella burnetii RSA 493
gguuuuuuucuuuuugcc

SEQ ID NO: 2576379 - RNA, 12 nt, Coxiella burnetii RSA 493
guaaaacaaugc

SEQ ID NO: 2576380 - RNA, 18 nt, Coxiella burnetii RSA 493
guaaaacgauauuaucaa

SEQ ID NO: 2576381 - RNA, 13 nt, Coxiella burnetii RSA 493
guaaauauuuuua

SEQ ID NO: 2576382 - RNA, 18 nt, Coxiella burnetii RSA 493
guaaauguuucuuuuaua

SEQ ID NO: 2576383 - RNA, 21 nt, Coxiella burnetii RSA 493
guaaauguuucuuuuauaaaa

SEQ ID NO: 2576384 - RNA, 14 nt, Coxiella burnetii RSA 493
guaaauuuucccau

SEQ ID NO: 2576385 - RNA, 13 nt, Coxiella burnetii RSA 493
guaaauuuugccc

SEQ ID NO: 2576386 - RNA, 22 nt, Coxiella burnetii RSA 493
guaacccuuucauuuaauuuua

SEQ ID NO: 2576387 - RNA, 13 nt, Coxiella burnetii RSA 493
guaaccucuccau

SEQ ID NO: 2576388 - RNA, 12 nt, Coxiella burnetii RSA 493
guaacgauuucu

SEQ ID NO: 2576389 - RNA, 15 nt, Coxiella burnetii RSA 493
guaacuuuuccaucu

SEQ ID NO: 2576390 - RNA, 19 nt, Coxiella burnetii RSA 493
guaagaauucuccugcgcc

SEQ ID NO: 2576391 - RNA, 16 nt, Coxiella burnetii RSA 493
guaagcgugcaacaag

SEQ ID NO: 2576392 - RNA, 16 nt, Coxiella burnetii RSA 493
guaagucugaacaggc

SEQ ID NO: 2576393 - RNA, 15 nt, Coxiella burnetii RSA 493
guaaucgcgggauca

SEQ ID NO: 2576394 - RNA, 18 nt, Coxiella burnetii RSA 493
guaaucgcugauacuucu

SEQ ID NO: 2576395 - RNA, 21 nt, Coxiella burnetii RSA 493
guaaucguucggcuucauaua

SEQ ID NO: 2576396 - RNA, 21 nt, Coxiella burnetii RSA 493
guaaugacagaaaaagcggau

SEQ ID NO: 2576397 - RNA, 14 nt, Coxiella burnetii RSA 493
guaaugaugccuua

SEQ ID NO: 2576398 - RNA, 15 nt, Coxiella burnetii RSA 493
guaaugguuuugauc

SEQ ID NO: 2576399 - RNA, 15 nt, Coxiella burnetii RSA 493
guaauucaaauuuua

SEQ ID NO: 2576400 - RNA, 13 nt, Coxiella burnetii RSA 493
guaauucaucauu

SEQ ID NO: 2576401 - RNA, 17 nt, Coxiella burnetii RSA 493
guaauucaucauuuucc

SEQ ID NO: 2576402 - RNA, 19 nt, Coxiella burnetii RSA 493
guaauugcuugggaacaac

SEQ ID NO: 2576403 - RNA, 21 nt, Coxiella burnetii RSA 493
guaauugcuugguugauucaa

SEQ ID NO: 2576404 - RNA, 14 nt, Coxiella burnetii RSA 493
gucugcauuuuuaa

SEQ ID NO: 2576405 - RNA, 21 nt, Coxiella burnetii RSA 493
gucugcgacgacgcuuugguu

SEQ ID NO: 2576406 - RNA, 21 nt, Coxiella burnetii RSA 493
gucuggccugccacaaucacu

SEQ ID NO: 2576407 - RNA, 22 nt, Coxiella burnetii RSA 493
gucugggaugguaaucucacuu

SEQ ID NO: 2576408 - RNA, 22 nt, Coxiella burnetii RSA 493
gucugggugauaaggauuaucu

SEQ ID NO: 2576409 - RNA, 23 nt, Coxiella burnetii RSA 493
gucugucguuucugauuuuugaa

SEQ ID NO: 2576410 - RNA, 16 nt, Coxiella burnetii RSA 493
gucuuaauuuuaaaaa

SEQ ID NO: 2576411 - RNA, 17 nt, Coxiella burnetii RSA 493
gucuuaauuuuaaaaaa

SEQ ID NO: 2576412 - RNA, 15 nt, Coxiella burnetii RSA 493
gucuugcacauugca

SEQ ID NO: 2576413 - RNA, 15 nt, Coxiella burnetii RSA 493
gucuuuaauacaagg

SEQ ID NO: 2576414 - RNA, 21 nt, Coxiella burnetii RSA 493
gucuuugcuaagauaauuaca

SEQ ID NO: 2576415 - RNA, 17 nt, Coxiella burnetii RSA 493
gucuuugguuuuccaug

SEQ ID NO: 2576416 - RNA, 18 nt, Coxiella burnetii RSA 493
gucuuugguuuuccauga

SEQ ID NO: 2576417 - RNA, 18 nt, Coxiella burnetii RSA 493
gucuuuguagauucuuuc

SEQ ID NO: 2576418 - RNA, 13 nt, Coxiella burnetii RSA 493
gucuuuuuuucuu

SEQ ID NO: 2576419 - RNA, 14 nt, Coxiella burnetii RSA 493
gugaaaacgcucga

SEQ ID NO: 2576420 - RNA, 17 nt, Coxiella burnetii RSA 493
gugaaccgauucauaaa

SEQ ID NO: 2576421 - RNA, 15 nt, Coxiella burnetii RSA 493
gugaaugaucgaugg

SEQ ID NO: 2576422 - RNA, 17 nt, Coxiella burnetii RSA 493
gugagacucaguggcag

SEQ ID NO: 2576423 - RNA, 23 nt, Coxiella burnetii RSA 493
gugaugcacgggcaccauuuuuc

SEQ ID NO: 2576424 - RNA, 13 nt, Coxiella burnetii RSA 493
gugauuucuucca

SEQ ID NO: 2576425 - RNA, 22 nt, Coxiella burnetii RSA 493
gugcaaaaaaggcggaccuuug

SEQ ID NO: 2576426 - RNA, 21 nt, Coxiella burnetii RSA 493
gugcaauuccauuaaaaacaa

SEQ ID NO: 2576427 - RNA, 15 nt, Coxiella burnetii RSA 493
gugcaauuucuggcu

SEQ ID NO: 2576428 - RNA, 21 nt, Coxiella burnetii RSA 493
gugcagcugauuucugguuga

SEQ ID NO: 2576429 - RNA, 17 nt, Coxiella burnetii RSA 493
gugcauaaauuauuuua

SEQ ID NO: 2576430 - RNA, 14 nt, Coxiella burnetii RSA 493
gugccuugaugaau

SEQ ID NO: 2576431 - RNA, 19 nt, Coxiella burnetii RSA 493
gugcguuccagcggggaca

SEQ ID NO: 2576432 - RNA, 20 nt, Coxiella burnetii RSA 493
gugcugcaacggcagaaacg

SEQ ID NO: 2576433 - RNA, 15 nt, Coxiella burnetii RSA 493
guggaagguugagaa

SEQ ID NO: 2576434 - RNA, 19 nt, Coxiella burnetii RSA 493
guggagcaaguuuucuaua

SEQ ID NO: 2576435 - RNA, 20 nt, Coxiella burnetii RSA 493
guggcagcuucuuuaaaaua

SEQ ID NO: 2576436 - RNA, 15 nt, Coxiella burnetii RSA 493
guggcaguuaaauuu

SEQ ID NO: 2576437 - RNA, 17 nt, Coxiella burnetii RSA 493
guggcaguuaaauuuuu

SEQ ID NO: 2576438 - RNA, 23 nt, Coxiella burnetii RSA 493
guggcguacaagugcuuccaagu

SEQ ID NO: 2576439 - RNA, 15 nt, Coxiella burnetii RSA 493
guggggauaauugaa

SEQ ID NO: 2576440 - RNA, 20 nt, Coxiella burnetii RSA 493
gugggggaacagaggacaga

SEQ ID NO: 2576441 - RNA, 17 nt, Coxiella burnetii RSA 493
guggucugaaaauaauu

SEQ ID NO: 2576442 - RNA, 20 nt, Coxiella burnetii RSA 493
gugguggccucgauagacca

SEQ ID NO: 2576443 - RNA, 16 nt, Coxiella burnetii RSA 493
gugguuaacuucauua

SEQ ID NO: 2576444 - RNA, 22 nt, Coxiella burnetii RSA 493
gugguuaauucuucuucauuua

SEQ ID NO: 2576445 - RNA, 16 nt, Coxiella burnetii RSA 493
gugguuguguggcuuc

SEQ ID NO: 2576446 - RNA, 14 nt, Coxiella burnetii RSA 493
guguagaaagaaag

SEQ ID NO: 2576447 - RNA, 19 nt, Coxiella burnetii RSA 493
gugucuccuuuuguuaauu

SEQ ID NO: 2576448 - RNA, 21 nt, Coxiella burnetii RSA 493
gugucuccuuuuguuaauucu

SEQ ID NO: 2576449 - RNA, 16 nt, Coxiella burnetii RSA 493
gugucucuauaccaua

SEQ ID NO: 2576450 - RNA, 14 nt, Coxiella burnetii RSA 493
gugugauaaucaug

SEQ ID NO: 2576451 - RNA, 18 nt, Coxiella burnetii RSA 493
gugugauucauuaucaug

SEQ ID NO: 2576452 - RNA, 16 nt, Coxiella burnetii RSA 493
gugugucucuauacca

SEQ ID NO: 2576453 - RNA, 20 nt, Coxiella burnetii RSA 493
guguucacaagucucagaau

SEQ ID NO: 2576454 - RNA, 12 nt, Coxiella burnetii RSA 493
guguugagagaa

SEQ ID NO: 2576455 - RNA, 14 nt, Coxiella burnetii RSA 493
guguuguagaauug

SEQ ID NO: 2576456 - RNA, 23 nt, Coxiella burnetii RSA 493
guguugucggcgauacggugcag

SEQ ID NO: 2576457 - RNA, 11 nt, Coxiella burnetii RSA 493
guguuuuuacg

SEQ ID NO: 2576458 - RNA, 11 nt, Coxiella burnetii RSA 493
guguuuuucaa

SEQ ID NO: 2576459 - RNA, 13 nt, Coxiella burnetii RSA 493
guuaaaauaauga

SEQ ID NO: 2576460 - RNA, 16 nt, Coxiella burnetii RSA 493
guuaaguagcuaaaaa

SEQ ID NO: 2576461 - RNA, 20 nt, Coxiella burnetii RSA 493
guuaauucgagcaucuuuuu

SEQ ID NO: 2576462 - RNA, 20 nt, Coxiella burnetii RSA 493
guuaauucuucuucauuuau

SEQ ID NO: 2576463 - RNA, 21 nt, Coxiella burnetii RSA 493
guuaauucuucuucauuuauu

SEQ ID NO: 2576464 - RNA, 17 nt, Coxiella burnetii RSA 493
guuaauuucauaaauca

SEQ ID NO: 2576465 - RNA, 18 nt, Coxiella burnetii RSA 493
guuaauuucauaaaucaa

SEQ ID NO: 2576466 - RNA, 15 nt, Coxiella burnetii RSA 493
guuaccgaugaguug

SEQ ID NO: 2576467 - RNA, 20 nt, Coxiella burnetii RSA 493
guuaccggcaaacccaucuc

SEQ ID NO: 2576468 - RNA, 16 nt, Coxiella burnetii RSA 493
guuacuucuuuuucga

SEQ ID NO: 2576469 - RNA, 19 nt, Coxiella burnetii RSA 493
guuagaguuaauuucauaa

SEQ ID NO: 2576470 - RNA, 13 nt, Coxiella burnetii RSA 493
guuauagccgcgu

SEQ ID NO: 2576471 - RNA, 13 nt, Coxiella burnetii RSA 493
guuauauuagaca

SEQ ID NO: 2576472 - RNA, 16 nt, Coxiella burnetii RSA 493
guuauccaugagcagu

SEQ ID NO: 2576473 - RNA, 15 nt, Coxiella burnetii RSA 493
guuauguacucagcu

SEQ ID NO: 2576474 - RNA, 17 nt, Coxiella burnetii RSA 493
guuauugggauuuaccu

SEQ ID NO: 2576475 - RNA, 13 nt, Coxiella burnetii RSA 493
guuauuuuuaaaa

SEQ ID NO: 2576476 - RNA, 23 nt, Coxiella burnetii RSA 493
guuauuuuuaaaagauuuuaucu

SEQ ID NO: 2576477 - RNA, 16 nt, Coxiella burnetii RSA 493
guuauuuuucaucuug

SEQ ID NO: 2576478 - RNA, 16 nt, Coxiella burnetii RSA 493
guuauuuuuuccuauu

SEQ ID NO: 2576479 - RNA, 19 nt, Coxiella burnetii RSA 493
guucaagcacuaguuuuac

SEQ ID NO: 2576480 - RNA, 21 nt, Coxiella burnetii RSA 493
guucacaagucucagaaucug

SEQ ID NO: 2576481 - RNA, 16 nt, Coxiella burnetii RSA 493
guucaccccauuucaa

SEQ ID NO: 2576482 - RNA, 20 nt, Coxiella burnetii RSA 493
guucacguggcccaucgucc

SEQ ID NO: 2576483 - RNA, 16 nt, Coxiella burnetii RSA 493
guucacucgcaaaaau

SEQ ID NO: 2576484 - RNA, 19 nt, Coxiella burnetii RSA 493
guucacucgcaaaaauuuc

SEQ ID NO: 2576485 - RNA, 23 nt, Coxiella burnetii RSA 493
guucagacgcuaauugauuaaug

SEQ ID NO: 2576486 - RNA, 12 nt, Coxiella burnetii RSA 493
guucaugaaaaa

SEQ ID NO: 2576487 - RNA, 14 nt, Coxiella burnetii RSA 493
guucaugaaaaaga

SEQ ID NO: 2576488 - RNA, 18 nt, Coxiella burnetii RSA 493
guuccaauauuuucggau

SEQ ID NO: 2576489 - RNA, 13 nt, Coxiella burnetii RSA 493
guuccagaaacau

SEQ ID NO: 2576490 - RNA, 22 nt, Coxiella burnetii RSA 493
guucccccacuucauacgggcu

SEQ ID NO: 2576491 - RNA, 17 nt, Coxiella burnetii RSA 493
guuccgcagccuaaauc

SEQ ID NO: 2576492 - RNA, 15 nt, Coxiella burnetii RSA 493
guuccgccauuuccc

SEQ ID NO: 2576493 - RNA, 12 nt, Coxiella burnetii RSA 493
guuccuuacucc

SEQ ID NO: 2576494 - RNA, 20 nt, Coxiella burnetii RSA 493
guuccuuacucccgaaaaag

SEQ ID NO: 2576495 - RNA, 14 nt, Coxiella burnetii RSA 493
guuccuugaauaaa

SEQ ID NO: 2576496 - RNA, 17 nt, Coxiella burnetii RSA 493
guucggaauauaauucu

SEQ ID NO: 2576497 - RNA, 23 nt, Coxiella burnetii RSA 493
guucuaucaauauggaacccguu

SEQ ID NO: 2576498 - RNA, 14 nt, Coxiella burnetii RSA 493
guucucaaauuuuc

SEQ ID NO: 2576499 - RNA, 18 nt, Coxiella burnetii RSA 493
guucugaaauuuuauaag

SEQ ID NO: 2576500 - RNA, 19 nt, Coxiella burnetii RSA 493
guucugaaauuuuauaagg

SEQ ID NO: 2576501 - RNA, 12 nt, Coxiella burnetii RSA 493
guucuugcugcu

SEQ ID NO: 2576502 - RNA, 18 nt, Coxiella burnetii RSA 493
guucuugggcaauuugug

SEQ ID NO: 2576503 - RNA, 14 nt, Coxiella burnetii RSA 493
guucuuuaauccaa

SEQ ID NO: 2576504 - RNA, 12 nt, Coxiella burnetii RSA 493
guucuuuuauuu

SEQ ID NO: 2576505 - RNA, 11 nt, Coxiella burnetii RSA 493
guucuuuucaa

SEQ ID NO: 2576506 - RNA, 23 nt, Coxiella burnetii RSA 493
guugaaaaccuacacuuucaauc

SEQ ID NO: 2576507 - RNA, 13 nt, Coxiella burnetii RSA 493
guugaaaacgcga

SEQ ID NO: 2576508 - RNA, 22 nt, Coxiella burnetii RSA 493
guugaaccacuucaagaaagac

SEQ ID NO: 2576509 - RNA, 15 nt, Coxiella burnetii RSA 493
guugaaucaaauuaa

SEQ ID NO: 2576510 - RNA, 21 nt, Coxiella burnetii RSA 493
uaaaaguccuguucuuuucaa

SEQ ID NO: 2576511 - RNA, 22 nt, Coxiella burnetii RSA 493
uaaaaguuacgccccaaaguuc

SEQ ID NO: 2576512 - RNA, 15 nt, Coxiella burnetii RSA 493
uaaaauacuuaaaau

SEQ ID NO: 2576513 - RNA, 17 nt, Coxiella burnetii RSA 493
uaaaauccgcuuuauuu

SEQ ID NO: 2576514 - RNA, 21 nt, Coxiella burnetii RSA 493
uaaaaugaccaugguuucuuu

SEQ ID NO: 2576515 - RNA, 22 nt, Coxiella burnetii RSA 493
uaaaauuccgauuguuguggau

SEQ ID NO: 2576516 - RNA, 15 nt, Coxiella burnetii RSA 493
uaaaauuuaauaagu

SEQ ID NO: 2576517 - RNA, 18 nt, Coxiella burnetii RSA 493
uaaaauuuaauaagucuu

SEQ ID NO: 2576518 - RNA, 23 nt, Coxiella burnetii RSA 493
uaaaauuuuauucucccaaacaa

SEQ ID NO: 2576519 - RNA, 13 nt, Coxiella burnetii RSA 493
uaaacaaaauaau

SEQ ID NO: 2576520 - RNA, 16 nt, Coxiella burnetii RSA 493
uaaacaaaauaauaau

SEQ ID NO: 2576521 - RNA, 20 nt, Coxiella burnetii RSA 493
uaaacaaguuaacaaaauca

SEQ ID NO: 2576522 - RNA, 20 nt, Coxiella burnetii RSA 493
uaaacagacccccauuuuuu

SEQ ID NO: 2576523 - RNA, 16 nt, Coxiella burnetii RSA 493
uaaaccaacgaacgcc

SEQ ID NO: 2576524 - RNA, 13 nt, Coxiella burnetii RSA 493
uaaaccauaagca

SEQ ID NO: 2576525 - RNA, 14 nt, Coxiella burnetii RSA 493
uaaacccauuugau

SEQ ID NO: 2576526 - RNA, 15 nt, Coxiella burnetii RSA 493
uaaaccgcuuucuag

SEQ ID NO: 2576527 - RNA, 17 nt, Coxiella burnetii RSA 493
uaaaccuauccaaaaag

SEQ ID NO: 2576528 - RNA, 19 nt, Coxiella burnetii RSA 493
uaaaccuauccaaaaagau

SEQ ID NO: 2576529 - RNA, 14 nt, Coxiella burnetii RSA 493
uaaaccuuuaauug

SEQ ID NO: 2576530 - RNA, 18 nt, Coxiella burnetii RSA 493
uaaacgcgauaucuccau

SEQ ID NO: 2576531 - RNA, 17 nt, Coxiella burnetii RSA 493
uaaacguauugaguuuu

SEQ ID NO: 2576532 - RNA, 13 nt, Coxiella burnetii RSA 493
uaaacuggaaaaa

SEQ ID NO: 2576533 - RNA, 14 nt, Coxiella burnetii RSA 493
uaaacuggaaaaag

SEQ ID NO: 2576534 - RNA, 13 nt, Coxiella burnetii RSA 493
uaaagaaagccua

SEQ ID NO: 2576535 - RNA, 17 nt, Coxiella burnetii RSA 493
uaaagaauuugacaagc

SEQ ID NO: 2576536 - RNA, 18 nt, Coxiella burnetii RSA 493
uaaagagccgucauccaa

SEQ ID NO: 2576537 - RNA, 22 nt, Coxiella burnetii RSA 493
uaaagauaucgucacccaaauc

SEQ ID NO: 2576538 - RNA, 23 nt, Coxiella burnetii RSA 493
uaaagauaucgucacccaaauca

SEQ ID NO: 2576539 - RNA, 18 nt, Coxiella burnetii RSA 493
uaaagcagcgugcagcug

SEQ ID NO: 2576540 - RNA, 18 nt, Coxiella burnetii RSA 493
uaaagcagguugcuuuug

SEQ ID NO: 2576541 - RNA, 22 nt, Coxiella burnetii RSA 493
uaaagccagugcuauucccgcc

SEQ ID NO: 2576542 - RNA, 15 nt, Coxiella burnetii RSA 493
uaaagccauagaauu

SEQ ID NO: 2576543 - RNA, 22 nt, Coxiella burnetii RSA 493
uaaagcgcgcuggauucccgcc

SEQ ID NO: 2576544 - RNA, 15 nt, Coxiella burnetii RSA 493
uaaagcgcuuacagc

SEQ ID NO: 2576545 - RNA, 22 nt, Coxiella burnetii RSA 493
uaaagcguuucucgauauucua

SEQ ID NO: 2576546 - RNA, 15 nt, Coxiella burnetii RSA 493
uaaagcuuauauaaa

SEQ ID NO: 2576547 - RNA, 22 nt, Coxiella burnetii RSA 493
uaaaggcgaccaaaaaucgcca

SEQ ID NO: 2576548 - RNA, 21 nt, Coxiella burnetii RSA 493
uaaaggcguaagcacaaaagu

SEQ ID NO: 2576549 - RNA, 19 nt, Coxiella burnetii RSA 493
uaaaggcuaauaggaaaaa

SEQ ID NO: 2576550 - RNA, 18 nt, Coxiella burnetii RSA 493
uaaagggccguuccuaua

SEQ ID NO: 2576551 - RNA, 15 nt, Coxiella burnetii RSA 493
uaaagguaaaaagau

SEQ ID NO: 2576552 - RNA, 20 nt, Coxiella burnetii RSA 493
uaaagguggcgcuuuaauuu

SEQ ID NO: 2576553 - RNA, 13 nt, Coxiella burnetii RSA 493
uaaagguuuucuu

SEQ ID NO: 2576554 - RNA, 15 nt, Coxiella burnetii RSA 493
uaaaguaauuuuaaa

SEQ ID NO: 2576555 - RNA, 21 nt, Coxiella burnetii RSA 493
uaaaguagcccguaugcagcg

SEQ ID NO: 2576556 - RNA, 15 nt, Coxiella burnetii RSA 493
uaaaguaguugaaaa

SEQ ID NO: 2576557 - RNA, 22 nt, Coxiella burnetii RSA 493
uaaagucagcuuuggaaaaaca

SEQ ID NO: 2576558 - RNA, 16 nt, Coxiella burnetii RSA 493
uaaaguguuuuuuuga

SEQ ID NO: 2576559 - RNA, 14 nt, Coxiella burnetii RSA 493
uaaaguuauuucuu

SEQ ID NO: 2576560 - RNA, 22 nt, Coxiella burnetii RSA 493
uaaaguugccgguauuuugcaa

SEQ ID NO: 2576561 - RNA, 15 nt, Coxiella burnetii RSA 493
uaaauaacucaucga

SEQ ID NO: 2576562 - RNA, 14 nt, Coxiella burnetii RSA 493
uaaauaacuuuacu

SEQ ID NO: 2576563 - RNA, 14 nt, Coxiella burnetii RSA 493
uaaauaaggagcau

SEQ ID NO: 2576564 - RNA, 15 nt, Coxiella burnetii RSA 493
uaaauaaucuuccca

SEQ ID NO: 2576565 - RNA, 13 nt, Coxiella burnetii RSA 493
uaaauaaugaaua

SEQ ID NO: 2576566 - RNA, 16 nt, Coxiella burnetii RSA 493
uaaauacauacauaaa

SEQ ID NO: 2576567 - RNA, 15 nt, Coxiella burnetii RSA 493
uaaauaccauuuucc

SEQ ID NO: 2576568 - RNA, 17 nt, Coxiella burnetii RSA 493
uaaauaccauuuuccuu

SEQ ID NO: 2576569 - RNA, 23 nt, Coxiella burnetii RSA 493
uaaauagcauuucguauaauuca

SEQ ID NO: 2576570 - RNA, 22 nt, Coxiella burnetii RSA 493
uaaauauccgcaauaugcagcc

SEQ ID NO: 2576571 - RNA, 16 nt, Coxiella burnetii RSA 493
uaaaucaacaccccaa

SEQ ID NO: 2576572 - RNA, 18 nt, Coxiella burnetii RSA 493
uaaaucaauuaaauuuac

SEQ ID NO: 2576573 - RNA, 19 nt, Coxiella burnetii RSA 493
uaaaucauugguuuuugau

SEQ ID NO: 2576574 - RNA, 17 nt, Coxiella burnetii RSA 493
uaaauccuuaauuaacu

SEQ ID NO: 2576575 - RNA, 13 nt, Coxiella burnetii RSA 493
uaaaugaauaaua

SEQ ID NO: 2576576 - RNA, 14 nt, Coxiella burnetii RSA 493
uaaaugaauuacuu

SEQ ID NO: 2576577 - RNA, 21 nt, Coxiella burnetii RSA 493
uaaaugcaccuuggcguccug

SEQ ID NO: 2576578 - RNA, 14 nt, Coxiella burnetii RSA 493
uaaaugcgguacuu

SEQ ID NO: 2576579 - RNA, 20 nt, Coxiella burnetii RSA 493
uaaaugcgguacuuaagaaa

SEQ ID NO: 2576580 - RNA, 19 nt, Coxiella burnetii RSA 493
uaaaugcgucaugaaauaa

SEQ ID NO: 2576581 - RNA, 14 nt, Coxiella burnetii RSA 493
uaaaugcuuuucuu

SEQ ID NO: 2576582 - RNA, 19 nt, Coxiella burnetii RSA 493
uaaaugcuuuucuuucauu

SEQ ID NO: 2576583 - RNA, 15 nt, Coxiella burnetii RSA 493
uaaaugcuuuuuaaa

SEQ ID NO: 2576584 - RNA, 12 nt, Coxiella burnetii RSA 493
uaaauuaauauu

SEQ ID NO: 2576585 - RNA, 20 nt, Coxiella burnetii RSA 493
uaaauuaauuauccaaaauc

SEQ ID NO: 2576586 - RNA, 16 nt, Coxiella burnetii RSA 493
uaaauuaguaauauuu

SEQ ID NO: 2576587 - RNA, 12 nt, Coxiella burnetii RSA 493
uaaauuauaaau

SEQ ID NO: 2576588 - RNA, 14 nt, Coxiella burnetii RSA 493
uaaauuauaaaugg

SEQ ID NO: 2576589 - RNA, 16 nt, Coxiella burnetii RSA 493
uaaauuauuuuaauau

SEQ ID NO: 2576590 - RNA, 18 nt, Coxiella burnetii RSA 493
uaaauugcucuuuuucca

SEQ ID NO: 2576591 - RNA, 19 nt, Coxiella burnetii RSA 493
uaaauuguccuuuucuauu

SEQ ID NO: 2576592 - RNA, 17 nt, Coxiella burnetii RSA 493
uaaauuuaaucuuuauc

SEQ ID NO: 2576593 - RNA, 20 nt, Coxiella burnetii RSA 493
uaaauuuaaucuuuauccaa

SEQ ID NO: 2576594 - RNA, 19 nt, Coxiella burnetii RSA 493
uaaauuucucaucugucau

SEQ ID NO: 2576595 - RNA, 15 nt, Coxiella burnetii RSA 493
uaaauuuuauaaauu

SEQ ID NO: 2576596 - RNA, 16 nt, Coxiella burnetii RSA 493
uaaauuuuuaauggaa

SEQ ID NO: 2576597 - RNA, 14 nt, Coxiella burnetii RSA 493
uaacaaaaacgaca

SEQ ID NO: 2576598 - RNA, 14 nt, Coxiella burnetii RSA 493
uaacaaaauuaaaa

SEQ ID NO: 2576599 - RNA, 21 nt, Coxiella burnetii RSA 493
uaacaaaugaugaauuuauuu

SEQ ID NO: 2576600 - RNA, 13 nt, Coxiella burnetii RSA 493
uaacaacaaaacc

SEQ ID NO: 2576601 - RNA, 23 nt, Coxiella burnetii RSA 493
uaacaacgaaaccuuguuauaaa

SEQ ID NO: 2576602 - RNA, 17 nt, Coxiella burnetii RSA 493
uaacacccuuuaguaaa

SEQ ID NO: 2576603 - RNA, 21 nt, Coxiella burnetii RSA 493
uaacacccuuuaguaaaacua

SEQ ID NO: 2576604 - RNA, 18 nt, Coxiella burnetii RSA 493
uaacacggccuucauuau

SEQ ID NO: 2576605 - RNA, 21 nt, Coxiella burnetii RSA 493
uaacacggccuucauuauuga

SEQ ID NO: 2576606 - RNA, 22 nt, Coxiella burnetii RSA 493
uaacagugccgguucccgcuuc

SEQ ID NO: 2576607 - RNA, 16 nt, Coxiella burnetii RSA 493
uaacaguguuuaacuc

SEQ ID NO: 2576608 - RNA, 19 nt, Coxiella burnetii RSA 493
uaacaguugguuagcaaug

SEQ ID NO: 2576609 - RNA, 22 nt, Coxiella burnetii RSA 493
uaacauacgacuucauuucuac

SEQ ID NO: 2576610 - RNA, 13 nt, Coxiella burnetii RSA 493
uaacauuaucaug

SEQ ID NO: 2576611 - RNA, 14 nt, Coxiella burnetii RSA 493
uaacauuaucaugu

SEQ ID NO: 2576612 - RNA, 21 nt, Coxiella burnetii RSA 493
uaacauuauuacauauuucuu

SEQ ID NO: 2576613 - RNA, 16 nt, Coxiella burnetii RSA 493
uaacauuuggccaaac

SEQ ID NO: 2576614 - RNA, 13 nt, Coxiella burnetii RSA 493
uaaccaaaacuau

SEQ ID NO: 2576615 - RNA, 22 nt, Coxiella burnetii RSA 493
uaauacggcuuuauuuuggaua

SEQ ID NO: 2576616 - RNA, 16 nt, Coxiella burnetii RSA 493
uaauaggaaaaaugau

SEQ ID NO: 2576617 - RNA, 23 nt, Coxiella burnetii RSA 493
uaauaggaaaaaugauuauagaa

SEQ ID NO: 2576618 - RNA, 20 nt, Coxiella burnetii RSA 493
uaauaggucauuuuuuauaa

SEQ ID NO: 2576619 - RNA, 22 nt, Coxiella burnetii RSA 493
uaauaguacuguauugagcagc

SEQ ID NO: 2576620 - RNA, 21 nt, Coxiella burnetii RSA 493
uaauaguuugcaauaccauuu

SEQ ID NO: 2576621 - RNA, 13 nt, Coxiella burnetii RSA 493
uaauauaauugag

SEQ ID NO: 2576622 - RNA, 15 nt, Coxiella burnetii RSA 493
uaauauaauugaggu

SEQ ID NO: 2576623 - RNA, 20 nt, Coxiella burnetii RSA 493
uaauauguuuuuuauacauu

SEQ ID NO: 2576624 - RNA, 14 nt, Coxiella burnetii RSA 493
uaauauuaaaacaa

SEQ ID NO: 2576625 - RNA, 22 nt, Coxiella burnetii RSA 493
uaauauuaaaacaagacaacaa

SEQ ID NO: 2576626 - RNA, 20 nt, Coxiella burnetii RSA 493
uaauauuaucguuuucauuc

SEQ ID NO: 2576627 - RNA, 15 nt, Coxiella burnetii RSA 493
uaauauuauugagaa

SEQ ID NO: 2576628 - RNA, 11 nt, Coxiella burnetii RSA 493
uaaucaucaau

SEQ ID NO: 2576629 - RNA, 11 nt, Coxiella burnetii RSA 493
uaaucauuaac

SEQ ID NO: 2576630 - RNA, 15 nt, Coxiella burnetii RSA 493
uaaucauuaacgaau

SEQ ID NO: 2576631 - RNA, 14 nt, Coxiella burnetii RSA 493
uaaucauuuuuccu

SEQ ID NO: 2576632 - RNA, 19 nt, Coxiella burnetii RSA 493
uaauccaaggaaaggucag

SEQ ID NO: 2576633 - RNA, 16 nt, Coxiella burnetii RSA 493
uaauccacauauuuuu

SEQ ID NO: 2576634 - RNA, 22 nt, Coxiella burnetii RSA 493
uaauccgcauugcauuucuuuc

SEQ ID NO: 2576635 - RNA, 23 nt, Coxiella burnetii RSA 493
uaauccguuuugaaaaauaaaag

SEQ ID NO: 2576636 - RNA, 13 nt, Coxiella burnetii RSA 493
uaauccuucuuuu

SEQ ID NO: 2576637 - RNA, 22 nt, Coxiella burnetii RSA 493
uaauccuuguugaauuccuugu

SEQ ID NO: 2576638 - RNA, 14 nt, Coxiella burnetii RSA 493
uaaucgcgggauca

SEQ ID NO: 2576639 - RNA, 22 nt, Coxiella burnetii RSA 493
uaaucgcuccgaaaauaaauac

SEQ ID NO: 2576640 - RNA, 20 nt, Coxiella burnetii RSA 493
uaaucgcugauacuucuuca

SEQ ID NO: 2576641 - RNA, 14 nt, Coxiella burnetii RSA 493
uaaucgcuguuaau

SEQ ID NO: 2576642 - RNA, 19 nt, Coxiella burnetii RSA 493
uaaucgcuguuaauaauag

SEQ ID NO: 2576643 - RNA, 16 nt, Coxiella burnetii RSA 493
uaaucgguuauuucuc

SEQ ID NO: 2576644 - RNA, 18 nt, Coxiella burnetii RSA 493
uaaucgguuauuucucga

SEQ ID NO: 2576645 - RNA, 18 nt, Coxiella burnetii RSA 493
uaaucguucggcuucaua

SEQ ID NO: 2576646 - RNA, 16 nt, Coxiella burnetii RSA 493
uaaucucaauagaggu

SEQ ID NO: 2576647 - RNA, 20 nt, Coxiella burnetii RSA 493
uaaucucacuuggauuuuau

SEQ ID NO: 2576648 - RNA, 13 nt, Coxiella burnetii RSA 493
uaaucucaucauc

SEQ ID NO: 2576649 - RNA, 19 nt, Coxiella burnetii RSA 493
uaaucucaucaucuucaaa

SEQ ID NO: 2576650 - RNA, 22 nt, Coxiella burnetii RSA 493
uaaucuggguuucuuucuucua

SEQ ID NO: 2576651 - RNA, 17 nt, Coxiella burnetii RSA 493
uaaucuuaucaauggga

SEQ ID NO: 2576652 - RNA, 11 nt, Coxiella burnetii RSA 493
uaaucuuccau

SEQ ID NO: 2576653 - RNA, 14 nt, Coxiella burnetii RSA 493
uaaucuuuuggcau

SEQ ID NO: 2576654 - RNA, 13 nt, Coxiella burnetii RSA 493
uaaugaaaaauag

SEQ ID NO: 2576655 - RNA, 16 nt, Coxiella burnetii RSA 493
uaaugaaauuucucau

SEQ ID NO: 2576656 - RNA, 14 nt, Coxiella burnetii RSA 493
uaaugacuuugaua

SEQ ID NO: 2576657 - RNA, 18 nt, Coxiella burnetii RSA 493
uaaugagcaucuuuucug

SEQ ID NO: 2576658 - RNA, 15 nt, Coxiella burnetii RSA 493
uaaugagguuaauaa

SEQ ID NO: 2576659 - RNA, 16 nt, Coxiella burnetii RSA 493
uaaugaguucauuaau

SEQ ID NO: 2576660 - RNA, 18 nt, Coxiella burnetii RSA 493
uaaugaugccuuaaauag

SEQ ID NO: 2576661 - RNA, 21 nt, Coxiella burnetii RSA 493
uaaugcaaaaccaaugaggau

SEQ ID NO: 2576662 - RNA, 17 nt, Coxiella burnetii RSA 493
uaaugcuucuaauuuga

SEQ ID NO: 2576663 - RNA, 20 nt, Coxiella burnetii RSA 493
uaauggacauucucgaaucc

SEQ ID NO: 2576664 - RNA, 20 nt, Coxiella burnetii RSA 493
uaauggaucgcgcgccauug

SEQ ID NO: 2576665 - RNA, 21 nt, Coxiella burnetii RSA 493
uaauggauucccauaaccguu

SEQ ID NO: 2576666 - RNA, 21 nt, Coxiella burnetii RSA 493
uaaugucacguuaucauucuu

SEQ ID NO: 2576667 - RNA, 14 nt, Coxiella burnetii RSA 493
uaauguuugaauau

SEQ ID NO: 2576668 - RNA, 19 nt, Coxiella burnetii RSA 493
uaauguuugauaucaaucg

SEQ ID NO: 2576669 - RNA, 21 nt, Coxiella burnetii RSA 493
uaauguuugauccuugcaaua

SEQ ID NO: 2576670 - RNA, 13 nt, Coxiella burnetii RSA 493
uaauuaaauuacu

SEQ ID NO: 2576671 - RNA, 16 nt, Coxiella burnetii RSA 493
uaauuaagcuugaaaa

SEQ ID NO: 2576672 - RNA, 14 nt, Coxiella burnetii RSA 493
uaauuacaauccaa

SEQ ID NO: 2576673 - RNA, 16 nt, Coxiella burnetii RSA 493
uaauuauccaaaaucc

SEQ ID NO: 2576674 - RNA, 16 nt, Coxiella burnetii RSA 493
uaauucaaauuuuaaa

SEQ ID NO: 2576675 - RNA, 21 nt, Coxiella burnetii RSA 493
uaauucacggauacgcuuuau

SEQ ID NO: 2576676 - RNA, 14 nt, Coxiella burnetii RSA 493
uaauucauaaauaa

SEQ ID NO: 2576677 - RNA, 21 nt, Coxiella burnetii RSA 493
uaauucgagcaucuuuuugca

SEQ ID NO: 2576678 - RNA, 15 nt, Coxiella burnetii RSA 493
uaauucguuagcauu

SEQ ID NO: 2576679 - RNA, 15 nt, Coxiella burnetii RSA 493
uaauucuucuucauu

SEQ ID NO: 2576680 - RNA, 22 nt, Coxiella burnetii RSA 493
uaauucuugcagugaaauaacc

SEQ ID NO: 2576681 - RNA, 15 nt, Coxiella burnetii RSA 493
uaauucuuuuuuaau

SEQ ID NO: 2576682 - RNA, 17 nt, Coxiella burnetii RSA 493
uaauugaagaauugauu

SEQ ID NO: 2576683 - RNA, 22 nt, Coxiella burnetii RSA 493
uaauugagcaucgcgguuagca

SEQ ID NO: 2576684 - RNA, 22 nt, Coxiella burnetii RSA 493
uaauugaggugccgcuaaaauu

SEQ ID NO: 2576685 - RNA, 16 nt, Coxiella burnetii RSA 493
uaauugagguuuuaau

SEQ ID NO: 2576686 - RNA, 22 nt, Coxiella burnetii RSA 493
uaauugauagcgauuuccaucg

SEQ ID NO: 2576687 - RNA, 23 nt, Coxiella burnetii RSA 493
uaauugccgauauucuuuuucuu

SEQ ID NO: 2576688 - RNA, 16 nt, Coxiella burnetii RSA 493
uaauugcugaacaaaa

SEQ ID NO: 2576689 - RNA, 17 nt, Coxiella burnetii RSA 493
uaauugcugaacaaaag

SEQ ID NO: 2576690 - RNA, 23 nt, Coxiella burnetii RSA 493
uaauugcuucaaucguuuuaauu

SEQ ID NO: 2576691 - RNA, 15 nt, Coxiella burnetii RSA 493
uaauugcuuccaaua

SEQ ID NO: 2576692 - RNA, 18 nt, Coxiella burnetii RSA 493
uaauugcuuccuuaaagc

SEQ ID NO: 2576693 - RNA, 20 nt, Coxiella burnetii RSA 493
uaauugcuugggaacaacga

SEQ ID NO: 2576694 - RNA, 23 nt, Coxiella burnetii RSA 493
uaauugcuugguugauucaauaa

SEQ ID NO: 2576695 - RNA, 19 nt, Coxiella burnetii RSA 493
uaauuggaggacugcucuu

SEQ ID NO: 2576696 - RNA, 13 nt, Coxiella burnetii RSA 493
uaauugggaagca

SEQ ID NO: 2576697 - RNA, 18 nt, Coxiella burnetii RSA 493
uaauugguauauuucauu

SEQ ID NO: 2576698 - RNA, 20 nt, Coxiella burnetii RSA 493
uaauuguacggcaagucccu

SEQ ID NO: 2576699 - RNA, 14 nt, Coxiella burnetii RSA 493
uaauuguuuugcca

SEQ ID NO: 2576700 - RNA, 13 nt, Coxiella burnetii RSA 493
uaauuuaaacuca

SEQ ID NO: 2576701 - RNA, 14 nt, Coxiella burnetii RSA 493
uaauuuaggccuua

SEQ ID NO: 2576702 - RNA, 15 nt, Coxiella burnetii RSA 493
uaauuucagggaacu

SEQ ID NO: 2576703 - RNA, 17 nt, Coxiella burnetii RSA 493
uaauuuccguguaauaa

SEQ ID NO: 2576704 - RNA, 14 nt, Coxiella burnetii RSA 493
uaauuugaaaaacc

SEQ ID NO: 2576705 - RNA, 16 nt, Coxiella burnetii RSA 493
uaauuugaaaaaccca

SEQ ID NO: 2576706 - RNA, 13 nt, Coxiella burnetii RSA 493
uaauuugauuuuu

SEQ ID NO: 2576707 - RNA, 12 nt, Coxiella burnetii RSA 493
uaauuuguuuga

SEQ ID NO: 2576708 - RNA, 12 nt, Coxiella burnetii RSA 493
uaauuuuaaaaa

SEQ ID NO: 2576709 - RNA, 22 nt, Coxiella burnetii RSA 493
uaauuuuccuuuucuauuuuuu

SEQ ID NO: 2576710 - RNA, 12 nt, Coxiella burnetii RSA 493
uaauuuuuccuu

SEQ ID NO: 2576711 - RNA, 12 nt, Coxiella burnetii RSA 493
uacaaaaauacu

SEQ ID NO: 2576712 - RNA, 21 nt, Coxiella burnetii RSA 493
uacaaagagaagcaacuuuaa

SEQ ID NO: 2576713 - RNA, 13 nt, Coxiella burnetii RSA 493
uacaauaauccac

SEQ ID NO: 2576714 - RNA, 18 nt, Coxiella burnetii RSA 493
uacaauaucccaugacga

SEQ ID NO: 2576715 - RNA, 12 nt, Coxiella burnetii RSA 493
uacaauucgcua

SEQ ID NO: 2576716 - RNA, 20 nt, Coxiella burnetii RSA 493
uacacauaaugaucgacaag

SEQ ID NO: 2576717 - RNA, 18 nt, Coxiella burnetii RSA 493
uacacaucuuuuaaaacg

SEQ ID NO: 2576718 - RNA, 20 nt, Coxiella burnetii RSA 493
uacaccggaaauuuuuugcu

SEQ ID NO: 2576719 - RNA, 17 nt, Coxiella burnetii RSA 493
uacacguuaaauagcca

SEQ ID NO: 2576720 - RNA, 21 nt, Coxiella burnetii RSA 493
uagaggucguaccuucaauuc

SEQ ID NO: 2576721 - RNA, 22 nt, Coxiella burnetii RSA 493
uagaggucguaccuucaauucc

SEQ ID NO: 2576722 - RNA, 20 nt, Coxiella burnetii RSA 493
uagaguaaauacucuaaguu

SEQ ID NO: 2576723 - RNA, 20 nt, Coxiella burnetii RSA 493
uagagucgggaaauaaaauu

SEQ ID NO: 2576724 - RNA, 22 nt, Coxiella burnetii RSA 493
uagagucgggaaauaaaauuaa

SEQ ID NO: 2576725 - RNA, 19 nt, Coxiella burnetii RSA 493
uagauacucgagguagacu

SEQ ID NO: 2576726 - RNA, 23 nt, Coxiella burnetii RSA 493
uagauagucuuugguuuuccaug

SEQ ID NO: 2576727 - RNA, 19 nt, Coxiella burnetii RSA 493
uagaugacaucauuguuuu

SEQ ID NO: 2576728 - RNA, 13 nt, Coxiella burnetii RSA 493
uagauuagaaaaa

SEQ ID NO: 2576729 - RNA, 17 nt, Coxiella burnetii RSA 493
uagauuagaaaaagcga

SEQ ID NO: 2576730 - RNA, 11 nt, Coxiella burnetii RSA 493
uagauuuuaaa

SEQ ID NO: 2576731 - RNA, 14 nt, Coxiella burnetii RSA 493
uagauuuuccugcu

SEQ ID NO: 2576732 - RNA, 16 nt, Coxiella burnetii RSA 493
uagauuuuccugcuga

SEQ ID NO: 2576733 - RNA, 21 nt, Coxiella burnetii RSA 493
uagcaucaagggcaaaaacau

SEQ ID NO: 2576734 - RNA, 19 nt, Coxiella burnetii RSA 493
uagcauuguuggaaauaau

SEQ ID NO: 2576735 - RNA, 21 nt, Coxiella burnetii RSA 493
uagcauuguuggaaauaaugg

SEQ ID NO: 2576736 - RNA, 22 nt, Coxiella burnetii RSA 493
uagcauuguuggaaauaaugga

SEQ ID NO: 2576737 - RNA, 14 nt, Coxiella burnetii RSA 493
uagcauuugucgcc

SEQ ID NO: 2576738 - RNA, 23 nt, Coxiella burnetii RSA 493
uagccagcgaauacgaauuucaa

SEQ ID NO: 2576739 - RNA, 15 nt, Coxiella burnetii RSA 493
uagccauuaauaaag

SEQ ID NO: 2576740 - RNA, 17 nt, Coxiella burnetii RSA 493
uagccauugguuuaaaa

SEQ ID NO: 2576741 - RNA, 19 nt, Coxiella burnetii RSA 493
uagccauugguuuaaaaag

SEQ ID NO: 2576742 - RNA, 14 nt, Coxiella burnetii RSA 493
uagcccaacaaaau

SEQ ID NO: 2576743 - RNA, 20 nt, Coxiella burnetii RSA 493
uagccccgggggcauaagua

SEQ ID NO: 2576744 - RNA, 11 nt, Coxiella burnetii RSA 493
uagcccuugcg

SEQ ID NO: 2576745 - RNA, 16 nt, Coxiella burnetii RSA 493
uagccgaauguuuaaa

SEQ ID NO: 2576746 - RNA, 17 nt, Coxiella burnetii RSA 493
uagccgaauguuuaaau

SEQ ID NO: 2576747 - RNA, 21 nt, Coxiella burnetii RSA 493
uagccgaauguuuaaauuaau

SEQ ID NO: 2576748 - RNA, 13 nt, Coxiella burnetii RSA 493
uagccuuaauuuc

SEQ ID NO: 2576749 - RNA, 14 nt, Coxiella burnetii RSA 493
uagcgauuuccauc

SEQ ID NO: 2576750 - RNA, 15 nt, Coxiella burnetii RSA 493
uagcgauuuugacgu

SEQ ID NO: 2576751 - RNA, 23 nt, Coxiella burnetii RSA 493
uagcgcuaaugagaaacgugaga

SEQ ID NO: 2576752 - RNA, 14 nt, Coxiella burnetii RSA 493
uagcggaauacggg

SEQ ID NO: 2576753 - RNA, 15 nt, Coxiella burnetii RSA 493
uagcguaaucaucaa

SEQ ID NO: 2576754 - RNA, 15 nt, Coxiella burnetii RSA 493
uagcguguaauugau

SEQ ID NO: 2576755 - RNA, 14 nt, Coxiella burnetii RSA 493
uagcuauucuuuug

SEQ ID NO: 2576756 - RNA, 19 nt, Coxiella burnetii RSA 493
uagcuauucuuuuggcauu

SEQ ID NO: 2576757 - RNA, 14 nt, Coxiella burnetii RSA 493
uagcucauugaaau

SEQ ID NO: 2576758 - RNA, 16 nt, Coxiella burnetii RSA 493
uagcugccauuuucau

SEQ ID NO: 2576759 - RNA, 20 nt, Coxiella burnetii RSA 493
uagcuuccauugcucaaagg

SEQ ID NO: 2576760 - RNA, 16 nt, Coxiella burnetii RSA 493
uagcuuguuccuuuuu

SEQ ID NO: 2576761 - RNA, 20 nt, Coxiella burnetii RSA 493
uagcuuucgucauucccgug

SEQ ID NO: 2576762 - RNA, 11 nt, Coxiella burnetii RSA 493
uagcuuuucuu

SEQ ID NO: 2576763 - RNA, 19 nt, Coxiella burnetii RSA 493
uagcuuuucuuuaaacuga

SEQ ID NO: 2576764 - RNA, 18 nt, Coxiella burnetii RSA 493
uagcuuuuuucaaaauuu

SEQ ID NO: 2576765 - RNA, 22 nt, Coxiella burnetii RSA 493
uagcuuuuuucaaaauuuacuu

SEQ ID NO: 2576766 - RNA, 14 nt, Coxiella burnetii RSA 493
uaggaaaaaauaau

SEQ ID NO: 2576767 - RNA, 19 nt, Coxiella burnetii RSA 493
uaggaacauucuaauaaaa

SEQ ID NO: 2576768 - RNA, 20 nt, Coxiella burnetii RSA 493
uaggaauucuuuuucauuua

SEQ ID NO: 2576769 - RNA, 20 nt, Coxiella burnetii RSA 493
uaggagauaacgcuucuuuu

SEQ ID NO: 2576770 - RNA, 21 nt, Coxiella burnetii RSA 493
uaggagauaacgcuucuuuua

SEQ ID NO: 2576771 - RNA, 19 nt, Coxiella burnetii RSA 493
uaggagauuuuuaugaaaa

SEQ ID NO: 2576772 - RNA, 18 nt, Coxiella burnetii RSA 493
uaggauauugcauuguuu

SEQ ID NO: 2576773 - RNA, 17 nt, Coxiella burnetii RSA 493
uaggauuuuuuauccaa

SEQ ID NO: 2576774 - RNA, 14 nt, Coxiella burnetii RSA 493
uaggccgcuuuuug

SEQ ID NO: 2576775 - RNA, 21 nt, Coxiella burnetii RSA 493
uaggccuauccuauucuuuua

SEQ ID NO: 2576776 - RNA, 16 nt, Coxiella burnetii RSA 493
uaggcgaaucaucuuu

SEQ ID NO: 2576777 - RNA, 14 nt, Coxiella burnetii RSA 493
uaggcuuucuuuuu

SEQ ID NO: 2576778 - RNA, 19 nt, Coxiella burnetii RSA 493
uagggcaucaggcuaucgc

SEQ ID NO: 2576779 - RNA, 14 nt, Coxiella burnetii RSA 493
uagggcugaaaaaa

SEQ ID NO: 2576780 - RNA, 20 nt, Coxiella burnetii RSA 493
uagggcugaaaaaauuaaau

SEQ ID NO: 2576781 - RNA, 15 nt, Coxiella burnetii RSA 493
uaggguagauaacgc

SEQ ID NO: 2576782 - RNA, 23 nt, Coxiella burnetii RSA 493
uagggugacggcggauuaaaaaa

SEQ ID NO: 2576783 - RNA, 14 nt, Coxiella burnetii RSA 493
uagguaauuuauaa

SEQ ID NO: 2576784 - RNA, 13 nt, Coxiella burnetii RSA 493
uagguuuucgcug

SEQ ID NO: 2576785 - RNA, 14 nt, Coxiella burnetii RSA 493
uaguaauucaucau

SEQ ID NO: 2576786 - RNA, 22 nt, Coxiella burnetii RSA 493
uaguaugagcggcaauuuugau

SEQ ID NO: 2576787 - RNA, 16 nt, Coxiella burnetii RSA 493
uagucauagcuaagau

SEQ ID NO: 2576788 - RNA, 19 nt, Coxiella burnetii RSA 493
uagucgcguauaaaugaau

SEQ ID NO: 2576789 - RNA, 18 nt, Coxiella burnetii RSA 493
uagucuuugguuuuccau

SEQ ID NO: 2576790 - RNA, 14 nt, Coxiella burnetii RSA 493
uagucuuuuuauau

SEQ ID NO: 2576791 - RNA, 18 nt, Coxiella burnetii RSA 493
uagucuuuuuauauuccu

SEQ ID NO: 2576792 - RNA, 14 nt, Coxiella burnetii RSA 493
uagugaggcuucuu

SEQ ID NO: 2576793 - RNA, 17 nt, Coxiella burnetii RSA 493
uagugaggcuucuucca

SEQ ID NO: 2576794 - RNA, 20 nt, Coxiella burnetii RSA 493
uaguuugguggaugaucauc

SEQ ID NO: 2576795 - RNA, 13 nt, Coxiella burnetii RSA 493
uaguuuuccccca

SEQ ID NO: 2576796 - RNA, 15 nt, Coxiella burnetii RSA 493
uaguuuuucccucua

SEQ ID NO: 2576797 - RNA, 16 nt, Coxiella burnetii RSA 493
uauaaaaauccucacg

SEQ ID NO: 2576798 - RNA, 12 nt, Coxiella burnetii RSA 493
uauaaaaccugc

SEQ ID NO: 2576799 - RNA, 17 nt, Coxiella burnetii RSA 493
uauaaaagcaucaauaa

SEQ ID NO: 2576800 - RNA, 18 nt, Coxiella burnetii RSA 493
uauaaaagcaucaauaau

SEQ ID NO: 2576801 - RNA, 20 nt, Coxiella burnetii RSA 493
uauaaaagcaucaauaaugc

SEQ ID NO: 2576802 - RNA, 15 nt, Coxiella burnetii RSA 493
uauaaaauuuaauaa

SEQ ID NO: 2576803 - RNA, 20 nt, Coxiella burnetii RSA 493
uauaaaauuuaauaagucuu

SEQ ID NO: 2576804 - RNA, 15 nt, Coxiella burnetii RSA 493
uauaaagguuuuucc

SEQ ID NO: 2576805 - RNA, 17 nt, Coxiella burnetii RSA 493
uauaaagguuuuuccuu

SEQ ID NO: 2576806 - RNA, 18 nt, Coxiella burnetii RSA 493
uauaaagguuuuuccuuu

SEQ ID NO: 2576807 - RNA, 23 nt, Coxiella burnetii RSA 493
uauaaaguguuuuuuugaagcau

SEQ ID NO: 2576808 - RNA, 18 nt, Coxiella burnetii RSA 493
uauaaauaacuuuaguuu

SEQ ID NO: 2576809 - RNA, 13 nt, Coxiella burnetii RSA 493
uauaaauuuuccc

SEQ ID NO: 2576810 - RNA, 17 nt, Coxiella burnetii RSA 493
uauaacaaaauuaaaaa

SEQ ID NO: 2576811 - RNA, 23 nt, Coxiella burnetii RSA 493
uauaacaagguuuuauuguuaau

SEQ ID NO: 2576812 - RNA, 11 nt, Coxiella burnetii RSA 493
uauaacuauuu

SEQ ID NO: 2576813 - RNA, 22 nt, Coxiella burnetii RSA 493
uauaaggucuuaauuucuaaaa

SEQ ID NO: 2576814 - RNA, 22 nt, Coxiella burnetii RSA 493
uauaaguugucagcguuuuccg

SEQ ID NO: 2576815 - RNA, 17 nt, Coxiella burnetii RSA 493
uauaaucauuuuuccua

SEQ ID NO: 2576816 - RNA, 19 nt, Coxiella burnetii RSA 493
uauaaucuuaucaauggga

SEQ ID NO: 2576817 - RNA, 23 nt, Coxiella burnetii RSA 493
uauaauugagguuuuaauuugcc

SEQ ID NO: 2576818 - RNA, 19 nt, Coxiella burnetii RSA 493
uauaauugcggcaaccagc

SEQ ID NO: 2576819 - RNA, 12 nt, Coxiella burnetii RSA 493
uauaauuuucca

SEQ ID NO: 2576820 - RNA, 16 nt, Coxiella burnetii RSA 493
uauacccaaaaaccca

SEQ ID NO: 2576821 - RNA, 21 nt, Coxiella burnetii RSA 493
uauacgggaaguugguuugaa

SEQ ID NO: 2576822 - RNA, 13 nt, Coxiella burnetii RSA 493
uauacucacccac

SEQ ID NO: 2576823 - RNA, 13 nt, Coxiella burnetii RSA 493
uauacuccccuac

SEQ ID NO: 2576824 - RNA, 17 nt, Coxiella burnetii RSA 493
uauacugcccaagaaau

SEQ ID NO: 2576825 - RNA, 13 nt, Coxiella burnetii RSA 493
uauacuuuuuuga

SEQ ID NO: 2576826 - RNA, 19 nt, Coxiella burnetii RSA 493
uauagacaaugcuuucuuu

SEQ ID NO: 2576827 - RNA, 20 nt, Coxiella burnetii RSA 493
uauagcuuguuccuuuuuau

SEQ ID NO: 2576828 - RNA, 17 nt, Coxiella burnetii RSA 493
uauaguucauuaaauuu

SEQ ID NO: 2576829 - RNA, 18 nt, Coxiella burnetii RSA 493
uauauaagcuuucaauaa

SEQ ID NO: 2576830 - RNA, 19 nt, Coxiella burnetii RSA 493
uauauugggguucauuuuu

SEQ ID NO: 2576831 - RNA, 18 nt, Coxiella burnetii RSA 493
uauauuucgcaauccucu

SEQ ID NO: 2576832 - RNA, 21 nt, Coxiella burnetii RSA 493
uaucaaguguucacaagucuc

SEQ ID NO: 2576833 - RNA, 19 nt, Coxiella burnetii RSA 493
uaucaauauggaacccguu

SEQ ID NO: 2576834 - RNA, 15 nt, Coxiella burnetii RSA 493
uaucaaucaaauccu

SEQ ID NO: 2576835 - RNA, 15 nt, Coxiella burnetii RSA 493
uaucaaucgaaaaaa

SEQ ID NO: 2576836 - RNA, 15 nt, Coxiella burnetii RSA 493
uaucaccaaaauaca

SEQ ID NO: 2576837 - RNA, 19 nt, Coxiella burnetii RSA 493
uaucacgccaaucuagcau

SEQ ID NO: 2576838 - RNA, 20 nt, Coxiella burnetii RSA 493
uaucacuagcuauucuuuug

SEQ ID NO: 2576839 - RNA, 14 nt, Coxiella burnetii RSA 493
uaucagaaaccguu

SEQ ID NO: 2576840 - RNA, 16 nt, Coxiella burnetii RSA 493
uaucaucaacagaaca

SEQ ID NO: 2576841 - RNA, 19 nt, Coxiella burnetii RSA 493
uaucauggucagcccaacu

SEQ ID NO: 2576842 - RNA, 20 nt, Coxiella burnetii RSA 493
uaucauggucagcccaacua

SEQ ID NO: 2576843 - RNA, 14 nt, Coxiella burnetii RSA 493
uauccaaaaagaua

SEQ ID NO: 2576844 - RNA, 18 nt, Coxiella burnetii RSA 493
uauccaaauauuuaaauu

SEQ ID NO: 2576845 - RNA, 18 nt, Coxiella burnetii RSA 493
uauccaacauauggccca

SEQ ID NO: 2576846 - RNA, 15 nt, Coxiella burnetii RSA 493
uauccaacucucuag

SEQ ID NO: 2576847 - RNA, 18 nt, Coxiella burnetii RSA 493
uauccagcacccaauuaa

SEQ ID NO: 2576848 - RNA, 23 nt, Coxiella burnetii RSA 493
uauccaugccauaaugccuccuu

SEQ ID NO: 2576849 - RNA, 16 nt, Coxiella burnetii RSA 493
uaucccaauaguaaaa

SEQ ID NO: 2576850 - RNA, 16 nt, Coxiella burnetii RSA 493
uaucccgaaaacccgu

SEQ ID NO: 2576851 - RNA, 17 nt, Coxiella burnetii RSA 493
uaucccuguuacgggau

SEQ ID NO: 2576852 - RNA, 14 nt, Coxiella burnetii RSA 493
uaucccuuaaauca

SEQ ID NO: 2576853 - RNA, 20 nt, Coxiella burnetii RSA 493
uauccgguuuugauuuuugc

SEQ ID NO: 2576854 - RNA, 15 nt, Coxiella burnetii RSA 493
uauccuaauaaaaau

SEQ ID NO: 2576855 - RNA, 18 nt, Coxiella burnetii RSA 493
uauccuaauaaaaauauu

SEQ ID NO: 2576856 - RNA, 13 nt, Coxiella burnetii RSA 493
uauccuauucuuu

SEQ ID NO: 2576857 - RNA, 18 nt, Coxiella burnetii RSA 493
uauccucacaaauuauau

SEQ ID NO: 2576858 - RNA, 12 nt, Coxiella burnetii RSA 493
uauccucagaag

SEQ ID NO: 2576859 - RNA, 15 nt, Coxiella burnetii RSA 493
uauccucagaaguuu

SEQ ID NO: 2576860 - RNA, 15 nt, Coxiella burnetii RSA 493
uauccuuacaaaaau

SEQ ID NO: 2576861 - RNA, 21 nt, Coxiella burnetii RSA 493
uaucgaaggaauagccuucuc

SEQ ID NO: 2576862 - RNA, 16 nt, Coxiella burnetii RSA 493
uaucgaccauuaacca

SEQ ID NO: 2576863 - RNA, 14 nt, Coxiella burnetii RSA 493
uaucgccguuucug

SEQ ID NO: 2576864 - RNA, 16 nt, Coxiella burnetii RSA 493
uaucgguaauuuguuu

SEQ ID NO: 2576865 - RNA, 21 nt, Coxiella burnetii RSA 493
uaucguccccguauuucgcuu

SEQ ID NO: 2576866 - RNA, 12 nt, Coxiella burnetii RSA 493
uaucguuuucac

SEQ ID NO: 2576867 - RNA, 12 nt, Coxiella burnetii RSA 493
uaucguuuucau

SEQ ID NO: 2576868 - RNA, 15 nt, Coxiella burnetii RSA 493
uaucuagauuuaaaa

SEQ ID NO: 2576869 - RNA, 11 nt, Coxiella burnetii RSA 493
uaucuccauuu

SEQ ID NO: 2576870 - RNA, 19 nt, Coxiella burnetii RSA 493
uaucucuuaaggcagcaua

SEQ ID NO: 2576871 - RNA, 16 nt, Coxiella burnetii RSA 493
uaucugaucaaaaaua

SEQ ID NO: 2576872 - RNA, 23 nt, Coxiella burnetii RSA 493
uaucugaucaaaaauaaugcuaa

SEQ ID NO: 2576873 - RNA, 13 nt, Coxiella burnetii RSA 493
uaucugcuaaaaa

SEQ ID NO: 2576874 - RNA, 15 nt, Coxiella burnetii RSA 493
uaucugcuaaaaagc

SEQ ID NO: 2576875 - RNA, 12 nt, Coxiella burnetii RSA 493
uaucuguuuuau

SEQ ID NO: 2576876 - RNA, 20 nt, Coxiella burnetii RSA 493
uaucuguuuucgauaaaugc

SEQ ID NO: 2576877 - RNA, 23 nt, Coxiella burnetii RSA 493
uaucuguuuucgauaaaugcaau

SEQ ID NO: 2576878 - RNA, 14 nt, Coxiella burnetii RSA 493
uaucuuauuauuca

SEQ ID NO: 2576879 - RNA, 14 nt, Coxiella burnetii RSA 493
uaucuuuuaaauua

SEQ ID NO: 2576880 - RNA, 12 nt, Coxiella burnetii RSA 493
uaugaaaacaua

SEQ ID NO: 2576881 - RNA, 13 nt, Coxiella burnetii RSA 493
uaugaaaacauac

SEQ ID NO: 2576882 - RNA, 22 nt, Coxiella burnetii RSA 493
uaugaaaacgacuuauuuuaua

SEQ ID NO: 2576883 - RNA, 22 nt, Coxiella burnetii RSA 493
uaugaagcgcggcgaaauacag

SEQ ID NO: 2576884 - RNA, 22 nt, Coxiella burnetii RSA 493
uaugaagugggggaacagagga

SEQ ID NO: 2576885 - RNA, 13 nt, Coxiella burnetii RSA 493
uaugaaugcugga

SEQ ID NO: 2576886 - RNA, 19 nt, Coxiella burnetii RSA 493
uaugagcgaacgaauacgg

SEQ ID NO: 2576887 - RNA, 21 nt, Coxiella burnetii RSA 493
uaugagcgaagcgaaauacgg

SEQ ID NO: 2576888 - RNA, 17 nt, Coxiella burnetii RSA 493
uaugaucauuuucucag

SEQ ID NO: 2576889 - RNA, 19 nt, Coxiella burnetii RSA 493
uaugcagcgaagcgaaaua

SEQ ID NO: 2576890 - RNA, 21 nt, Coxiella burnetii RSA 493
uaugcagcgaagcgaaauacg

SEQ ID NO: 2576891 - RNA, 22 nt, Coxiella burnetii RSA 493
uaugcagcgaagcgaaauacgg

SEQ ID NO: 2576892 - RNA, 23 nt, Coxiella burnetii RSA 493
uaugcagcgaagcgaaauacggg

SEQ ID NO: 2576893 - RNA, 15 nt, Coxiella burnetii RSA 493
uaugcgggguuuuuu

SEQ ID NO: 2576894 - RNA, 16 nt, Coxiella burnetii RSA 493
uaugcuucaauaaaaa

SEQ ID NO: 2576895 - RNA, 14 nt, Coxiella burnetii RSA 493
uauggauaguuuca

SEQ ID NO: 2576896 - RNA, 20 nt, Coxiella burnetii RSA 493
uaugggggcccauccaguaa

SEQ ID NO: 2576897 - RNA, 17 nt, Coxiella burnetii RSA 493
uauguauuucaaggaau

SEQ ID NO: 2576898 - RNA, 18 nt, Coxiella burnetii RSA 493
uaugucguucaauucugg

SEQ ID NO: 2576899 - RNA, 19 nt, Coxiella burnetii RSA 493
uauguuucaauaacagaga

SEQ ID NO: 2576900 - RNA, 23 nt, Coxiella burnetii RSA 493
uauuaaaagagcgaauaaaaaau

SEQ ID NO: 2576901 - RNA, 22 nt, Coxiella burnetii RSA 493
uauuaauacaggaaaaagauaa

SEQ ID NO: 2576902 - RNA, 17 nt, Coxiella burnetii RSA 493
uauuaaucauucuccag

SEQ ID NO: 2576903 - RNA, 13 nt, Coxiella burnetii RSA 493
uauuaaucgauuu

SEQ ID NO: 2576904 - RNA, 19 nt, Coxiella burnetii RSA 493
uauuacauauuucuuuucu

SEQ ID NO: 2576905 - RNA, 14 nt, Coxiella burnetii RSA 493
uauuagccuuaauu

SEQ ID NO: 2576906 - RNA, 17 nt, Coxiella burnetii RSA 493
uauuagccuuaauuucu

SEQ ID NO: 2576907 - RNA, 19 nt, Coxiella burnetii RSA 493
uauuagccuuaauuucuaa

SEQ ID NO: 2576908 - RNA, 14 nt, Coxiella burnetii RSA 493
uauuagcugccauu

SEQ ID NO: 2576909 - RNA, 14 nt, Coxiella burnetii RSA 493
uauuagucuuaauu

SEQ ID NO: 2576910 - RNA, 19 nt, Coxiella burnetii RSA 493
uauuaguggaauuaaauau

SEQ ID NO: 2576911 - RNA, 21 nt, Coxiella burnetii RSA 493
uauuaucaaaacguagaaguu

SEQ ID NO: 2576912 - RNA, 15 nt, Coxiella burnetii RSA 493
uauuaucccuuuaac

SEQ ID NO: 2576913 - RNA, 16 nt, Coxiella burnetii RSA 493
uauuauucauaucuuu

SEQ ID NO: 2576914 - RNA, 21 nt, Coxiella burnetii RSA 493
uauuauucauaucuuuuucaa

SEQ ID NO: 2576915 - RNA, 23 nt, Coxiella burnetii RSA 493
uauucaacacaauaucguagccu

SEQ ID NO: 2576916 - RNA, 21 nt, Coxiella burnetii RSA 493
uauucaauaggguagucagga

SEQ ID NO: 2576917 - RNA, 19 nt, Coxiella burnetii RSA 493
uauucauuaaauauuucuu

SEQ ID NO: 2576918 - RNA, 17 nt, Coxiella burnetii RSA 493
uauucccgccaucacca

SEQ ID NO: 2576919 - RNA, 21 nt, Coxiella burnetii RSA 493
uauucccgccaucaccacaau

SEQ ID NO: 2576920 - RNA, 19 nt, Coxiella burnetii RSA 493
uauuccgcuucgcugcaua

SEQ ID NO: 2576921 - RNA, 20 nt, Coxiella burnetii RSA 493
uauuccgcuucgcugcauac

SEQ ID NO: 2576922 - RNA, 19 nt, Coxiella burnetii RSA 493
uauuccgcuuugcuccaua

SEQ ID NO: 2576923 - RNA, 20 nt, Coxiella burnetii RSA 493
uauuccgcuuugcuccauac

SEQ ID NO: 2576924 - RNA, 21 nt, Coxiella burnetii RSA 493
uauuccugccccgacaauucc

SEQ ID NO: 2576925 - RNA, 14 nt, Coxiella burnetii RSA 493
uauuccuuuuucuu

SEQ ID NO: 2576926 - RNA, 15 nt, Coxiella burnetii RSA 493
uauuccuuuuucuuu

SEQ ID NO: 2576927 - RNA, 11 nt, Coxiella burnetii RSA 493
uauucgcucca

SEQ ID NO: 2576928 - RNA, 19 nt, Coxiella burnetii RSA 493
uauucggcaacaugggaau

SEQ ID NO: 2576929 - RNA, 21 nt, Coxiella burnetii RSA 493
uauucgguuuuuuuaaaaaag

SEQ ID NO: 2576930 - RNA, 13 nt, Coxiella burnetii RSA 493
ucaauaacccaca

SEQ ID NO: 2576931 - RNA, 17 nt, Coxiella burnetii RSA 493
ucaauaccaagcucaug

SEQ ID NO: 2576932 - RNA, 18 nt, Coxiella burnetii RSA 493
ucaauaccgauuaauucu

SEQ ID NO: 2576933 - RNA, 19 nt, Coxiella burnetii RSA 493
ucaauaccgauuaauucuu

SEQ ID NO: 2576934 - RNA, 16 nt, Coxiella burnetii RSA 493
ucaauauauucgcuaa

SEQ ID NO: 2576935 - RNA, 22 nt, Coxiella burnetii RSA 493
ucaauauauucgcuaagcuuag

SEQ ID NO: 2576936 - RNA, 15 nt, Coxiella burnetii RSA 493
ucaauauggaacccg

SEQ ID NO: 2576937 - RNA, 14 nt, Coxiella burnetii RSA 493
ucaauauugaauaa

SEQ ID NO: 2576938 - RNA, 15 nt, Coxiella burnetii RSA 493
ucaaucaaauccuuu

SEQ ID NO: 2576939 - RNA, 16 nt, Coxiella burnetii RSA 493
ucaaucaaauccuuua

SEQ ID NO: 2576940 - RNA, 17 nt, Coxiella burnetii RSA 493
ucaauccggugaauagc

SEQ ID NO: 2576941 - RNA, 14 nt, Coxiella burnetii RSA 493
ucaaucgaaaaaaa

SEQ ID NO: 2576942 - RNA, 17 nt, Coxiella burnetii RSA 493
ucaaucgaguccgcccc

SEQ ID NO: 2576943 - RNA, 15 nt, Coxiella burnetii RSA 493
ucaaucguguagaaa

SEQ ID NO: 2576944 - RNA, 21 nt, Coxiella burnetii RSA 493
ucaaucugggaauguguguca

SEQ ID NO: 2576945 - RNA, 14 nt, Coxiella burnetii RSA 493
ucaaugaaacaaac

SEQ ID NO: 2576946 - RNA, 19 nt, Coxiella burnetii RSA 493
ucaaugagugcuuuuaacc

SEQ ID NO: 2576947 - RNA, 22 nt, Coxiella burnetii RSA 493
ucaaugcgccauccgacauucu

SEQ ID NO: 2576948 - RNA, 18 nt, Coxiella burnetii RSA 493
ucaaugggcaguuuucuu

SEQ ID NO: 2576949 - RNA, 21 nt, Coxiella burnetii RSA 493
ucaauguaggcguaaucgcgg

SEQ ID NO: 2576950 - RNA, 17 nt, Coxiella burnetii RSA 493
ucaauuagcauuuucuc

SEQ ID NO: 2576951 - RNA, 17 nt, Coxiella burnetii RSA 493
ucaauucgcuuaaauuu

SEQ ID NO: 2576952 - RNA, 22 nt, Coxiella burnetii RSA 493
ucaauucggauacgaccuucug

SEQ ID NO: 2576953 - RNA, 23 nt, Coxiella burnetii RSA 493
ucaauugcuuucccuuuuugauu

SEQ ID NO: 2576954 - RNA, 14 nt, Coxiella burnetii RSA 493
ucaauuguuucaug

SEQ ID NO: 2576955 - RNA, 20 nt, Coxiella burnetii RSA 493
ucaauuucaacgccucucuc

SEQ ID NO: 2576956 - RNA, 13 nt, Coxiella burnetii RSA 493
ucaauuucaauua

SEQ ID NO: 2576957 - RNA, 17 nt, Coxiella burnetii RSA 493
ucaauuucaauuagaau

SEQ ID NO: 2576958 - RNA, 18 nt, Coxiella burnetii RSA 493
ucaauuucgggugauaau

SEQ ID NO: 2576959 - RNA, 23 nt, Coxiella burnetii RSA 493
ucaauuucgggugauaauugaua

SEQ ID NO: 2576960 - RNA, 12 nt, Coxiella burnetii RSA 493
ucaauuuugguu

SEQ ID NO: 2576961 - RNA, 21 nt, Coxiella burnetii RSA 493
ucaauuuuucagucuggccug

SEQ ID NO: 2576962 - RNA, 20 nt, Coxiella burnetii RSA 493
ucacaaaagguaaaaaacua

SEQ ID NO: 2576963 - RNA, 21 nt, Coxiella burnetii RSA 493
ucacaaaagguaaaaaacuaa

SEQ ID NO: 2576964 - RNA, 15 nt, Coxiella burnetii RSA 493
ucacaaagauuuagg

SEQ ID NO: 2576965 - RNA, 20 nt, Coxiella burnetii RSA 493
ucacaaguguggauuaucuu

SEQ ID NO: 2576966 - RNA, 18 nt, Coxiella burnetii RSA 493
ucacaaguucuucuaaag

SEQ ID NO: 2576967 - RNA, 22 nt, Coxiella burnetii RSA 493
ucacaaguucuucuaaagaauu

SEQ ID NO: 2576968 - RNA, 14 nt, Coxiella burnetii RSA 493
ucacaccaagaaau

SEQ ID NO: 2576969 - RNA, 13 nt, Coxiella burnetii RSA 493
ucacaugauuuuu

SEQ ID NO: 2576970 - RNA, 23 nt, Coxiella burnetii RSA 493
ucacauuggcaguguaaauugug

SEQ ID NO: 2576971 - RNA, 14 nt, Coxiella burnetii RSA 493
ucaccaaaauacag

SEQ ID NO: 2576972 - RNA, 21 nt, Coxiella burnetii RSA 493
ucaccagacguacaaggaaug

SEQ ID NO: 2576973 - RNA, 12 nt, Coxiella burnetii RSA 493
ucacccaaauca

SEQ ID NO: 2576974 - RNA, 19 nt, Coxiella burnetii RSA 493
ucacccagacuuuugcagc

SEQ ID NO: 2576975 - RNA, 21 nt, Coxiella burnetii RSA 493
ucacccagacuuuugcagcua

SEQ ID NO: 2576976 - RNA, 18 nt, Coxiella burnetii RSA 493
ucaccguuuucuauccag

SEQ ID NO: 2576977 - RNA, 18 nt, Coxiella burnetii RSA 493
ucaccuuugcuaacaauu

SEQ ID NO: 2576978 - RNA, 21 nt, Coxiella burnetii RSA 493
ucaccuuuucccuaggaaacg

SEQ ID NO: 2576979 - RNA, 13 nt, Coxiella burnetii RSA 493
ucacgaauuaaaa

SEQ ID NO: 2576980 - RNA, 14 nt, Coxiella burnetii RSA 493
ucacgaauuaaaaa

SEQ ID NO: 2576981 - RNA, 16 nt, Coxiella burnetii RSA 493
ucacgaauuuuuucag

SEQ ID NO: 2576982 - RNA, 21 nt, Coxiella burnetii RSA 493
ucacgauuuuucucaucauuu

SEQ ID NO: 2576983 - RNA, 18 nt, Coxiella burnetii RSA 493
ucacgccgcaucacgcuc

SEQ ID NO: 2576984 - RNA, 14 nt, Coxiella burnetii RSA 493
ucacgcgaaaaaag

SEQ ID NO: 2576985 - RNA, 14 nt, Coxiella burnetii RSA 493
ucacuacaaauucu

SEQ ID NO: 2576986 - RNA, 16 nt, Coxiella burnetii RSA 493
ucacuagcuauucuuu

SEQ ID NO: 2576987 - RNA, 16 nt, Coxiella burnetii RSA 493
ucacuaucgugauucu

SEQ ID NO: 2576988 - RNA, 14 nt, Coxiella burnetii RSA 493
ucacuaugaucaug

SEQ ID NO: 2576989 - RNA, 20 nt, Coxiella burnetii RSA 493
ucacuaugaucaugccuuuu

SEQ ID NO: 2576990 - RNA, 21 nt, Coxiella burnetii RSA 493
ucacuaugaucaugccuuuuu

SEQ ID NO: 2576991 - RNA, 18 nt, Coxiella burnetii RSA 493
ucacucgcaaaaauuuca

SEQ ID NO: 2576992 - RNA, 22 nt, Coxiella burnetii RSA 493
ucacucggccugggcaaggcau

SEQ ID NO: 2576993 - RNA, 12 nt, Coxiella burnetii RSA 493
ucacuugauaau

SEQ ID NO: 2576994 - RNA, 14 nt, Coxiella burnetii RSA 493
ucacuugauaauca

SEQ ID NO: 2576995 - RNA, 14 nt, Coxiella burnetii RSA 493
ucacuuggauuuua

SEQ ID NO: 2576996 - RNA, 14 nt, Coxiella burnetii RSA 493
ucacuuuauuuuca

SEQ ID NO: 2576997 - RNA, 16 nt, Coxiella burnetii RSA 493
ucacuuuauuuucaua

SEQ ID NO: 2576998 - RNA, 15 nt, Coxiella burnetii RSA 493
ucacuuuccuuaucc

SEQ ID NO: 2576999 - RNA, 11 nt, Coxiella burnetii RSA 493
ucacuuuucug

SEQ ID NO: 2577000 - RNA, 17 nt, Coxiella burnetii RSA 493
ucacuuuuuucagcguu

SEQ ID NO: 2577001 - RNA, 18 nt, Coxiella burnetii RSA 493
ucagcagaggugagagca

SEQ ID NO: 2577002 - RNA, 20 nt, Coxiella burnetii RSA 493
ucagcauucccauagaagaa

SEQ ID NO: 2577003 - RNA, 17 nt, Coxiella burnetii RSA 493
ucagcccaacuacggac

SEQ ID NO: 2577004 - RNA, 15 nt, Coxiella burnetii RSA 493
ucagcguugauaggg

SEQ ID NO: 2577005 - RNA, 22 nt, Coxiella burnetii RSA 493
ucagcugguagagcacaaccuu

SEQ ID NO: 2577006 - RNA, 20 nt, Coxiella burnetii RSA 493
ucagcuuuccccccaacuac

SEQ ID NO: 2577007 - RNA, 20 nt, Coxiella burnetii RSA 493
ucagcuuuggaaaaacauuc

SEQ ID NO: 2577008 - RNA, 18 nt, Coxiella burnetii RSA 493
ucaggaagcaaaguaggu

SEQ ID NO: 2577009 - RNA, 14 nt, Coxiella burnetii RSA 493
ucagggaauuuaau

SEQ ID NO: 2577010 - RNA, 15 nt, Coxiella burnetii RSA 493
ucagggaauuuaaua

SEQ ID NO: 2577011 - RNA, 17 nt, Coxiella burnetii RSA 493
ucaggggcaaucaaucg

SEQ ID NO: 2577012 - RNA, 23 nt, Coxiella burnetii RSA 493
ucagucugucguuucugauuuuu

SEQ ID NO: 2577013 - RNA, 22 nt, Coxiella burnetii RSA 493
ucaguggcagcuucuuuaaaau

SEQ ID NO: 2577014 - RNA, 13 nt, Coxiella burnetii RSA 493
ucaguuaaaauaa

SEQ ID NO: 2577015 - RNA, 16 nt, Coxiella burnetii RSA 493
ucaguuaaaauaauga

SEQ ID NO: 2577016 - RNA, 19 nt, Coxiella burnetii RSA 493
ucaguucgggccuucacuu

SEQ ID NO: 2577017 - RNA, 16 nt, Coxiella burnetii RSA 493
ucaguuuugaugaaaa

SEQ ID NO: 2577018 - RNA, 19 nt, Coxiella burnetii RSA 493
ucauaaguccgcuuuuccc

SEQ ID NO: 2577019 - RNA, 20 nt, Coxiella burnetii RSA 493
ucauaaucaaaaucagaaac

SEQ ID NO: 2577020 - RNA, 16 nt, Coxiella burnetii RSA 493
ucauacgggcuacuug

SEQ ID NO: 2577021 - RNA, 17 nt, Coxiella burnetii RSA 493
ucauacgggcuacuugu

SEQ ID NO: 2577022 - RNA, 16 nt, Coxiella burnetii RSA 493
ucauacgguacaggua

SEQ ID NO: 2577023 - RNA, 17 nt, Coxiella burnetii RSA 493
ucauagguuuuuuuaaa

SEQ ID NO: 2577024 - RNA, 14 nt, Coxiella burnetii RSA 493
ucauauauuuaccu

SEQ ID NO: 2577025 - RNA, 16 nt, Coxiella burnetii RSA 493
ucauauccuuucuaac

SEQ ID NO: 2577026 - RNA, 17 nt, Coxiella burnetii RSA 493
ucauauuaauauuaaaa

SEQ ID NO: 2577027 - RNA, 21 nt, Coxiella burnetii RSA 493
ucaucaaaacggcaaaugauu

SEQ ID NO: 2577028 - RNA, 18 nt, Coxiella burnetii RSA 493
ucaucaaacuugccuuga

SEQ ID NO: 2577029 - RNA, 20 nt, Coxiella burnetii RSA 493
ucaucauuuuccaaaaaauu

SEQ ID NO: 2577030 - RNA, 19 nt, Coxiella burnetii RSA 493
ucaucauuuugauacgcua

SEQ ID NO: 2577031 - RNA, 12 nt, Coxiella burnetii RSA 493
ucaucauuuuug

SEQ ID NO: 2577032 - RNA, 19 nt, Coxiella burnetii RSA 493
ucauccaaaauuugagguu

SEQ ID NO: 2577033 - RNA, 19 nt, Coxiella burnetii RSA 493
ucauccaaacgcacgauaa

SEQ ID NO: 2577034 - RNA, 17 nt, Coxiella burnetii RSA 493
ucauccagugaaaaccc

SEQ ID NO: 2577035 - RNA, 21 nt, Coxiella burnetii RSA 493
uccccuuauagcgugagagga

SEQ ID NO: 2577036 - RNA, 14 nt, Coxiella burnetii RSA 493
ucccgauuccagcc

SEQ ID NO: 2577037 - RNA, 14 nt, Coxiella burnetii RSA 493
ucccgcaaaugauc

SEQ ID NO: 2577038 - RNA, 15 nt, Coxiella burnetii RSA 493
ucccgccuacccuuu

SEQ ID NO: 2577039 - RNA, 23 nt, Coxiella burnetii RSA 493
ucccgcuuaaacccagaaaagua

SEQ ID NO: 2577040 - RNA, 21 nt, Coxiella burnetii RSA 493
ucccgcuugcacgggaaugac

SEQ ID NO: 2577041 - RNA, 20 nt, Coxiella burnetii RSA 493
ucccggauaaaguguugucg

SEQ ID NO: 2577042 - RNA, 14 nt, Coxiella burnetii RSA 493
ucccggcuuuaaaa

SEQ ID NO: 2577043 - RNA, 17 nt, Coxiella burnetii RSA 493
ucccguauuucgcuucg

SEQ ID NO: 2577044 - RNA, 20 nt, Coxiella burnetii RSA 493
ucccgugcaauuguggcccg

SEQ ID NO: 2577045 - RNA, 22 nt, Coxiella burnetii RSA 493
ucccuaaagugggggaaaacag

SEQ ID NO: 2577046 - RNA, 14 nt, Coxiella burnetii RSA 493
ucccucugcagcag

SEQ ID NO: 2577047 - RNA, 15 nt, Coxiella burnetii RSA 493
ucccucugcagcagg

SEQ ID NO: 2577048 - RNA, 16 nt, Coxiella burnetii RSA 493
ucccucuuuaccuccu

SEQ ID NO: 2577049 - RNA, 16 nt, Coxiella burnetii RSA 493
ucccuggauaauuaaa

SEQ ID NO: 2577050 - RNA, 16 nt, Coxiella burnetii RSA 493
ucccuuaaaucaugcu

SEQ ID NO: 2577051 - RNA, 23 nt, Coxiella burnetii RSA 493
ucccuuaaguugacgccuauugc

SEQ ID NO: 2577052 - RNA, 17 nt, Coxiella burnetii RSA 493
ucccuuuuaauuuaggc

SEQ ID NO: 2577053 - RNA, 19 nt, Coxiella burnetii RSA 493
ucccuuuucauuaagcaau

SEQ ID NO: 2577054 - RNA, 19 nt, Coxiella burnetii RSA 493
ucccuuuuccugaacagga

SEQ ID NO: 2577055 - RNA, 12 nt, Coxiella burnetii RSA 493
ucccuuuuucgu

SEQ ID NO: 2577056 - RNA, 16 nt, Coxiella burnetii RSA 493
uccgacauucuucucc

SEQ ID NO: 2577057 - RNA, 17 nt, Coxiella burnetii RSA 493
uccgauuguuguggaua

SEQ ID NO: 2577058 - RNA, 23 nt, Coxiella burnetii RSA 493
uccgcaaaucggaaaagccaauu

SEQ ID NO: 2577059 - RNA, 14 nt, Coxiella burnetii RSA 493
uccgcauaaaaacc

SEQ ID NO: 2577060 - RNA, 13 nt, Coxiella burnetii RSA 493
uccgcauagguau

SEQ ID NO: 2577061 - RNA, 18 nt, Coxiella burnetii RSA 493
uccgcauugcauuucuuu

SEQ ID NO: 2577062 - RNA, 19 nt, Coxiella burnetii RSA 493
uccgcccccguaucaccaa

SEQ ID NO: 2577063 - RNA, 12 nt, Coxiella burnetii RSA 493
uccgccuaaauu

SEQ ID NO: 2577064 - RNA, 15 nt, Coxiella burnetii RSA 493
uccgccuaaauuaau

SEQ ID NO: 2577065 - RNA, 23 nt, Coxiella burnetii RSA 493
uccgccucaauuucaauuagaau

SEQ ID NO: 2577066 - RNA, 14 nt, Coxiella burnetii RSA 493
uccgccuuuauuag

SEQ ID NO: 2577067 - RNA, 21 nt, Coxiella burnetii RSA 493
uccgcuacaucuaagcuagua

SEQ ID NO: 2577068 - RNA, 17 nt, Coxiella burnetii RSA 493
uccgcuacguuuuuugc

SEQ ID NO: 2577069 - RNA, 18 nt, Coxiella burnetii RSA 493
uccggcguugauuuuuua

SEQ ID NO: 2577070 - RNA, 18 nt, Coxiella burnetii RSA 493
uccgguucagcauaacua

SEQ ID NO: 2577071 - RNA, 17 nt, Coxiella burnetii RSA 493
uccguaauuaccugaau

SEQ ID NO: 2577072 - RNA, 19 nt, Coxiella burnetii RSA 493
uccgucaauuuuucuuuuu

SEQ ID NO: 2577073 - RNA, 17 nt, Coxiella burnetii RSA 493
uccgugcagaaacaaua

SEQ ID NO: 2577074 - RNA, 14 nt, Coxiella burnetii RSA 493
uccguucauucggg

SEQ ID NO: 2577075 - RNA, 18 nt, Coxiella burnetii RSA 493
uccguucggaaacaaagg

SEQ ID NO: 2577076 - RNA, 19 nt, Coxiella burnetii RSA 493
uccguuuugaaaaauaaaa

SEQ ID NO: 2577077 - RNA, 23 nt, Coxiella burnetii RSA 493
uccguuuugaaaaauaaaaggag

SEQ ID NO: 2577078 - RNA, 18 nt, Coxiella burnetii RSA 493
uccuaagcuuucucccaa

SEQ ID NO: 2577079 - RNA, 16 nt, Coxiella burnetii RSA 493
uccuaauaaaaauauu

SEQ ID NO: 2577080 - RNA, 20 nt, Coxiella burnetii RSA 493
uccuauccccaaagguguca

SEQ ID NO: 2577081 - RNA, 22 nt, Coxiella burnetii RSA 493
uccuauccccaaaggugucaaa

SEQ ID NO: 2577082 - RNA, 14 nt, Coxiella burnetii RSA 493
uccuaucgaagaag

SEQ ID NO: 2577083 - RNA, 14 nt, Coxiella burnetii RSA 493
uccucaacgguaug

SEQ ID NO: 2577084 - RNA, 16 nt, Coxiella burnetii RSA 493
uccucagaaguuuuag

SEQ ID NO: 2577085 - RNA, 23 nt, Coxiella burnetii RSA 493
uccucaguaaaaacauccuccau

SEQ ID NO: 2577086 - RNA, 15 nt, Coxiella burnetii RSA 493
uccuccccacucucu

SEQ ID NO: 2577087 - RNA, 15 nt, Coxiella burnetii RSA 493
uccucucucucacaa

SEQ ID NO: 2577088 - RNA, 17 nt, Coxiella burnetii RSA 493
uccucucucucacaaaa

SEQ ID NO: 2577089 - RNA, 20 nt, Coxiella burnetii RSA 493
uccucuguccucugccuucu

SEQ ID NO: 2577090 - RNA, 15 nt, Coxiella burnetii RSA 493
uccugaaaaauaauu

SEQ ID NO: 2577091 - RNA, 20 nt, Coxiella burnetii RSA 493
uccuggccugaucauaaagc

SEQ ID NO: 2577092 - RNA, 21 nt, Coxiella burnetii RSA 493
uccuguggaagguugagaagu

SEQ ID NO: 2577093 - RNA, 13 nt, Coxiella burnetii RSA 493
uccuguucuuuuc

SEQ ID NO: 2577094 - RNA, 13 nt, Coxiella burnetii RSA 493
uccuguucuuuuu

SEQ ID NO: 2577095 - RNA, 16 nt, Coxiella burnetii RSA 493
uccuguucuuuuucca

SEQ ID NO: 2577096 - RNA, 23 nt, Coxiella burnetii RSA 493
uccuuaaagcaacgacuucucuu

SEQ ID NO: 2577097 - RNA, 17 nt, Coxiella burnetii RSA 493
uccuuaauaaaguuuua

SEQ ID NO: 2577098 - RNA, 20 nt, Coxiella burnetii RSA 493
uccuuaaugaguucauuaau

SEQ ID NO: 2577099 - RNA, 13 nt, Coxiella burnetii RSA 493
uccuuacuauucg

SEQ ID NO: 2577100 - RNA, 13 nt, Coxiella burnetii RSA 493
uccuuauacuaaa

SEQ ID NO: 2577101 - RNA, 22 nt, Coxiella burnetii RSA 493
uccuucuuuuaaagugauuuuu

SEQ ID NO: 2577102 - RNA, 11 nt, Coxiella burnetii RSA 493
uccuucuuuug

SEQ ID NO: 2577103 - RNA, 15 nt, Coxiella burnetii RSA 493
uccuucuuuugucuu

SEQ ID NO: 2577104 - RNA, 22 nt, Coxiella burnetii RSA 493
uccuugacgcucagauaaauga

SEQ ID NO: 2577105 - RNA, 11 nt, Coxiella burnetii RSA 493
uccuugagagu

SEQ ID NO: 2577106 - RNA, 13 nt, Coxiella burnetii RSA 493
uccuugcaauaag

SEQ ID NO: 2577107 - RNA, 23 nt, Coxiella burnetii RSA 493
uccuugcaauaagcuaucagcag

SEQ ID NO: 2577108 - RNA, 17 nt, Coxiella burnetii RSA 493
uccuugcucaaguccuu

SEQ ID NO: 2577109 - RNA, 20 nt, Coxiella burnetii RSA 493
uccuugcugaauucccuuuu

SEQ ID NO: 2577110 - RNA, 20 nt, Coxiella burnetii RSA 493
uccuuguaauucaaauuuua

SEQ ID NO: 2577111 - RNA, 23 nt, Coxiella burnetii RSA 493
uccuuguugaauuccuuguugaa

SEQ ID NO: 2577112 - RNA, 19 nt, Coxiella burnetii RSA 493
uccuuguugcaauccuuuu

SEQ ID NO: 2577113 - RNA, 13 nt, Coxiella burnetii RSA 493
uccuuucuuucuu

SEQ ID NO: 2577114 - RNA, 23 nt, Coxiella burnetii RSA 493
uccuuugguaacaaacugggagc

SEQ ID NO: 2577115 - RNA, 17 nt, Coxiella burnetii RSA 493
uccuuuucauuuugauu

SEQ ID NO: 2577116 - RNA, 18 nt, Coxiella burnetii RSA 493
uccuuuuguuaauucuuu

SEQ ID NO: 2577117 - RNA, 22 nt, Coxiella burnetii RSA 493
uccuuuuguuuuuaagauuuuu

SEQ ID NO: 2577118 - RNA, 12 nt, Coxiella burnetii RSA 493
uccuuuuucuuu

SEQ ID NO: 2577119 - RNA, 15 nt, Coxiella burnetii RSA 493
uccuuuuucuuuuaa

SEQ ID NO: 2577120 - RNA, 14 nt, Coxiella burnetii RSA 493
uccuuuuuuuaaug

SEQ ID NO: 2577121 - RNA, 23 nt, Coxiella burnetii RSA 493
ucgaaaaaaaucguuuugaaauu

SEQ ID NO: 2577122 - RNA, 17 nt, Coxiella burnetii RSA 493
ucgaaaaacuuuuuagg

SEQ ID NO: 2577123 - RNA, 16 nt, Coxiella burnetii RSA 493
ucgaaaaauuauuaau

SEQ ID NO: 2577124 - RNA, 16 nt, Coxiella burnetii RSA 493
ucgaaaacuaguuauu

SEQ ID NO: 2577125 - RNA, 21 nt, Coxiella burnetii RSA 493
ucgaacgacuuuuuuuaccau

SEQ ID NO: 2577126 - RNA, 19 nt, Coxiella burnetii RSA 493
ucgaaugcagcucuuucaa

SEQ ID NO: 2577127 - RNA, 20 nt, Coxiella burnetii RSA 493
ucgacauaggagauuuuuau

SEQ ID NO: 2577128 - RNA, 22 nt, Coxiella burnetii RSA 493
ucgacuuugauaaauuaaaaaa

SEQ ID NO: 2577129 - RNA, 20 nt, Coxiella burnetii RSA 493
ucgagaaggccacauuucga

SEQ ID NO: 2577130 - RNA, 15 nt, Coxiella burnetii RSA 493
ucgagcgacuucauu

SEQ ID NO: 2577131 - RNA, 22 nt, Coxiella burnetii RSA 493
ucgaggaagaccgcuaauuuua

SEQ ID NO: 2577132 - RNA, 17 nt, Coxiella burnetii RSA 493
ucgagguugucaacaaa

SEQ ID NO: 2577133 - RNA, 16 nt, Coxiella burnetii RSA 493
ucgauaaaaauaauga

SEQ ID NO: 2577134 - RNA, 14 nt, Coxiella burnetii RSA 493
ucgauaaauuuuga

SEQ ID NO: 2577135 - RNA, 17 nt, Coxiella burnetii RSA 493
ucgauaagaucaauuac

SEQ ID NO: 2577136 - RNA, 21 nt, Coxiella burnetii RSA 493
ucgauccgagcccaauaacaa

SEQ ID NO: 2577137 - RNA, 19 nt, Coxiella burnetii RSA 493
ucgaugcacucuuuaauuu

SEQ ID NO: 2577138 - RNA, 23 nt, Coxiella burnetii RSA 493
ucgaugggaauuuuugaauacca

SEQ ID NO: 2577139 - RNA, 21 nt, Coxiella burnetii RSA 493
ucgauugcuaaagcggaagca

SEQ ID NO: 2577140 - RNA, 17 nt, Coxiella burnetii RSA 493
ucuauagcuucaaguuc

SEQ ID NO: 2577141 - RNA, 19 nt, Coxiella burnetii RSA 493
ucuauauaagcuuucaaua

SEQ ID NO: 2577142 - RNA, 21 nt, Coxiella burnetii RSA 493
ucuauauaagcuuucaauaaa

SEQ ID NO: 2577143 - RNA, 13 nt, Coxiella burnetii RSA 493
ucuauccaauaaa

SEQ ID NO: 2577144 - RNA, 19 nt, Coxiella burnetii RSA 493
ucuaucgugccaguauuuu

SEQ ID NO: 2577145 - RNA, 14 nt, Coxiella burnetii RSA 493
ucuauugucaucca

SEQ ID NO: 2577146 - RNA, 17 nt, Coxiella burnetii RSA 493
ucuauuucgagauuauu

SEQ ID NO: 2577147 - RNA, 18 nt, Coxiella burnetii RSA 493
ucuauuucgagauuauua

SEQ ID NO: 2577148 - RNA, 13 nt, Coxiella burnetii RSA 493
ucuauuuuuuugc

SEQ ID NO: 2577149 - RNA, 23 nt, Coxiella burnetii RSA 493
ucucaacagccuucgcauaaaac

SEQ ID NO: 2577150 - RNA, 19 nt, Coxiella burnetii RSA 493
ucucacuuggauuuuauuu

SEQ ID NO: 2577151 - RNA, 17 nt, Coxiella burnetii RSA 493
ucucagcgucuuuuuua

SEQ ID NO: 2577152 - RNA, 14 nt, Coxiella burnetii RSA 493
ucucaguuaaaaua

SEQ ID NO: 2577153 - RNA, 15 nt, Coxiella burnetii RSA 493
ucucaguuaaaauaa

SEQ ID NO: 2577154 - RNA, 16 nt, Coxiella burnetii RSA 493
ucucaguuaaaauaau

SEQ ID NO: 2577155 - RNA, 22 nt, Coxiella burnetii RSA 493
ucucauauauuuaccucuaaaa

SEQ ID NO: 2577156 - RNA, 16 nt, Coxiella burnetii RSA 493
ucucaucaucuucaaa

SEQ ID NO: 2577157 - RNA, 22 nt, Coxiella burnetii RSA 493
ucuccaaagggaccuuuuuugc

SEQ ID NO: 2577158 - RNA, 22 nt, Coxiella burnetii RSA 493
ucuccaaauugggugcauugcu

SEQ ID NO: 2577159 - RNA, 15 nt, Coxiella burnetii RSA 493
ucuccaccacuuugc

SEQ ID NO: 2577160 - RNA, 18 nt, Coxiella burnetii RSA 493
ucuccagcuuauacugcc

SEQ ID NO: 2577161 - RNA, 15 nt, Coxiella burnetii RSA 493
ucuccauuuagaaaa

SEQ ID NO: 2577162 - RNA, 12 nt, Coxiella burnetii RSA 493
ucuccguaauaa

SEQ ID NO: 2577163 - RNA, 20 nt, Coxiella burnetii RSA 493
ucuccuuaauaaaguuuuag

SEQ ID NO: 2577164 - RNA, 21 nt, Coxiella burnetii RSA 493
ucuccuugaggaauuuuucaa

SEQ ID NO: 2577165 - RNA, 20 nt, Coxiella burnetii RSA 493
ucucgauauucuaucucaaa

SEQ ID NO: 2577166 - RNA, 15 nt, Coxiella burnetii RSA 493
ucucguaacaaaaga

SEQ ID NO: 2577167 - RNA, 17 nt, Coxiella burnetii RSA 493
ucucguuagaaaagcgc

SEQ ID NO: 2577168 - RNA, 13 nt, Coxiella burnetii RSA 493
ucucuaaugauaa

SEQ ID NO: 2577169 - RNA, 18 nt, Coxiella burnetii RSA 493
ucucuaaugauaauccac

SEQ ID NO: 2577170 - RNA, 20 nt, Coxiella burnetii RSA 493
ucucuucaacgccagcuucc

SEQ ID NO: 2577171 - RNA, 21 nt, Coxiella burnetii RSA 493
ucucuugaauaagccgcgcca

SEQ ID NO: 2577172 - RNA, 16 nt, Coxiella burnetii RSA 493
ucucuugcccccauug

SEQ ID NO: 2577173 - RNA, 18 nt, Coxiella burnetii RSA 493
ucucuuuuuuugcgcccg

SEQ ID NO: 2577174 - RNA, 16 nt, Coxiella burnetii RSA 493
ucugaacgcucuucca

SEQ ID NO: 2577175 - RNA, 18 nt, Coxiella burnetii RSA 493
ucugaaucacuucuucca

SEQ ID NO: 2577176 - RNA, 23 nt, Coxiella burnetii RSA 493
ucugaauugaaguccuuaucacu

SEQ ID NO: 2577177 - RNA, 18 nt, Coxiella burnetii RSA 493
ucugaauuuaugaaugcu

SEQ ID NO: 2577178 - RNA, 15 nt, Coxiella burnetii RSA 493
ucugaccuaauuuga

SEQ ID NO: 2577179 - RNA, 22 nt, Coxiella burnetii RSA 493
ucugauaggaauucuuuuucau

SEQ ID NO: 2577180 - RNA, 14 nt, Coxiella burnetii RSA 493
ucugaucaaaaaua

SEQ ID NO: 2577181 - RNA, 15 nt, Coxiella burnetii RSA 493
ucugaucaaaaauaa

SEQ ID NO: 2577182 - RNA, 18 nt, Coxiella burnetii RSA 493
ucugauccgccuuuauua

SEQ ID NO: 2577183 - RNA, 16 nt, Coxiella burnetii RSA 493
ucugaucgauaaaaau

SEQ ID NO: 2577184 - RNA, 15 nt, Coxiella burnetii RSA 493
ucugauggaugaaag

SEQ ID NO: 2577185 - RNA, 22 nt, Coxiella burnetii RSA 493
ucugauugcggcucaauuauua

SEQ ID NO: 2577186 - RNA, 19 nt, Coxiella burnetii RSA 493
ucugauuuuacgcuauuuu

SEQ ID NO: 2577187 - RNA, 14 nt, Coxiella burnetii RSA 493
ucugcauuuuuaau

SEQ ID NO: 2577188 - RNA, 23 nt, Coxiella burnetii RSA 493
ucugcgcuaauuaacuucgccau

SEQ ID NO: 2577189 - RNA, 17 nt, Coxiella burnetii RSA 493
ucugcuaggauuuuuua

SEQ ID NO: 2577190 - RNA, 19 nt, Coxiella burnetii RSA 493
ucugcuaggauuuuuuauc

SEQ ID NO: 2577191 - RNA, 19 nt, Coxiella burnetii RSA 493
ucugcuggcgaucgcccac

SEQ ID NO: 2577192 - RNA, 16 nt, Coxiella burnetii RSA 493
ucugcuuuuauuuaag

SEQ ID NO: 2577193 - RNA, 23 nt, Coxiella burnetii RSA 493
ucuggcggugcgaauaacaaaga

SEQ ID NO: 2577194 - RNA, 18 nt, Coxiella burnetii RSA 493
ucuggcuguacuuucacu

SEQ ID NO: 2577195 - RNA, 21 nt, Coxiella burnetii RSA 493
ucugggagauuuauuccugug

SEQ ID NO: 2577196 - RNA, 13 nt, Coxiella burnetii RSA 493
ucugguauuguug

SEQ ID NO: 2577197 - RNA, 19 nt, Coxiella burnetii RSA 493
ucugguugaaucaaauuaa

SEQ ID NO: 2577198 - RNA, 13 nt, Coxiella burnetii RSA 493
ucuguaacuuuuc

SEQ ID NO: 2577199 - RNA, 17 nt, Coxiella burnetii RSA 493
ucugucaucaucgucaa

SEQ ID NO: 2577200 - RNA, 19 nt, Coxiella burnetii RSA 493
ucuguccuaaggauaggau

SEQ ID NO: 2577201 - RNA, 17 nt, Coxiella burnetii RSA 493
ucugugaaauaaacaga

SEQ ID NO: 2577202 - RNA, 14 nt, Coxiella burnetii RSA 493
ucuguuauacuguu

SEQ ID NO: 2577203 - RNA, 20 nt, Coxiella burnetii RSA 493
ucuguuuacaauucgcuagg

SEQ ID NO: 2577204 - RNA, 22 nt, Coxiella burnetii RSA 493
ucuuaagaagagacaaaguuuc

SEQ ID NO: 2577205 - RNA, 18 nt, Coxiella burnetii RSA 493
ucuuaaugaaauuucuca

SEQ ID NO: 2577206 - RNA, 14 nt, Coxiella burnetii RSA 493
ucuuaauuucuaaa

SEQ ID NO: 2577207 - RNA, 20 nt, Coxiella burnetii RSA 493
ucuuaauuucuaaaaaucau

SEQ ID NO: 2577208 - RNA, 16 nt, Coxiella burnetii RSA 493
ucuuaauuuuaaaaaa

SEQ ID NO: 2577209 - RNA, 16 nt, Coxiella burnetii RSA 493
ucuuaauuuuuccuuu

SEQ ID NO: 2577210 - RNA, 19 nt, Coxiella burnetii RSA 493
ucuuaauuuuuccuuucuu

SEQ ID NO: 2577211 - RNA, 14 nt, Coxiella burnetii RSA 493
ucuuaucaccuuug

SEQ ID NO: 2577212 - RNA, 18 nt, Coxiella burnetii RSA 493
ucuuauccuuacaaaaau

SEQ ID NO: 2577213 - RNA, 14 nt, Coxiella burnetii RSA 493
ucuuaucuaaaaac

SEQ ID NO: 2577214 - RNA, 20 nt, Coxiella burnetii RSA 493
ucuuaucuaaaaaccccaac

SEQ ID NO: 2577215 - RNA, 19 nt, Coxiella burnetii RSA 493
ucuuauuauucauaucuuu

SEQ ID NO: 2577216 - RNA, 21 nt, Coxiella burnetii RSA 493
ucuuauuuucugggagauuua

SEQ ID NO: 2577217 - RNA, 15 nt, Coxiella burnetii RSA 493
ucuucaacaucaacc

SEQ ID NO: 2577218 - RNA, 21 nt, Coxiella burnetii RSA 493
ucuucaacgccagcuuccuuc

SEQ ID NO: 2577219 - RNA, 21 nt, Coxiella burnetii RSA 493
ucuucaacuccugaaaaauaa

SEQ ID NO: 2577220 - RNA, 16 nt, Coxiella burnetii RSA 493
ucuucauauccuuucu

SEQ ID NO: 2577221 - RNA, 12 nt, Coxiella burnetii RSA 493
ucuucaucuuua

SEQ ID NO: 2577222 - RNA, 18 nt, Coxiella burnetii RSA 493
ucuucaucuuuagcaaua

SEQ ID NO: 2577223 - RNA, 13 nt, Coxiella burnetii RSA 493
ucuucauuuucug

SEQ ID NO: 2577224 - RNA, 20 nt, Coxiella burnetii RSA 493
ucuuccaauaacauaucuuc

SEQ ID NO: 2577225 - RNA, 15 nt, Coxiella burnetii RSA 493
ucuuccaauuuuuug

SEQ ID NO: 2577226 - RNA, 23 nt, Coxiella burnetii RSA 493
ucuuccauuaauuucuuuuuuug

SEQ ID NO: 2577227 - RNA, 21 nt, Coxiella burnetii RSA 493
ucuucgauccgucgcuuugcg

SEQ ID NO: 2577228 - RNA, 21 nt, Coxiella burnetii RSA 493
ucuucgccuggccaagaagca

SEQ ID NO: 2577229 - RNA, 15 nt, Coxiella burnetii RSA 493
ucuucuagaaaaccc

SEQ ID NO: 2577230 - RNA, 21 nt, Coxiella burnetii RSA 493
ucuucugaucgauaaaaauaa

SEQ ID NO: 2577231 - RNA, 21 nt, Coxiella burnetii RSA 493
ucuucugucuucugucguacg

SEQ ID NO: 2577232 - RNA, 16 nt, Coxiella burnetii RSA 493
ucuucuucaucuaaau

SEQ ID NO: 2577233 - RNA, 18 nt, Coxiella burnetii RSA 493
ucuucuucaucuaaauua

SEQ ID NO: 2577234 - RNA, 19 nt, Coxiella burnetii RSA 493
ucuucuucaucuaaauuaa

SEQ ID NO: 2577235 - RNA, 19 nt, Coxiella burnetii RSA 493
ucuucuucauuuauuucug

SEQ ID NO: 2577236 - RNA, 14 nt, Coxiella burnetii RSA 493
ucuucuuuggccgc

SEQ ID NO: 2577237 - RNA, 10 nt, Coxiella burnetii RSA 493
ucuucuuuuc

SEQ ID NO: 2577238 - RNA, 24 nt, Coxiella burnetii RSA 493
ucuucuuuuuuguaaaugacgggc

SEQ ID NO: 2577239 - RNA, 14 nt, Coxiella burnetii RSA 493
ucuugaaaaacuuc

SEQ ID NO: 2577240 - RNA, 19 nt, Coxiella burnetii RSA 493
ucuugaacggcaaaaccaa

SEQ ID NO: 2577241 - RNA, 18 nt, Coxiella burnetii RSA 493
ucuugaucuaaucgucuu

SEQ ID NO: 2577242 - RNA, 17 nt, Coxiella burnetii RSA 493
ucuugcaacguuugauu

SEQ ID NO: 2577243 - RNA, 18 nt, Coxiella burnetii RSA 493
ucuugcagugaaauaacc

SEQ ID NO: 2577244 - RNA, 21 nt, Coxiella burnetii RSA 493
ucuugcccccauugauaauaa

SEQ ID NO: 2577245 - RNA, 16 nt, Coxiella burnetii RSA 493
ugacagcucugaaagc

SEQ ID NO: 2577246 - RNA, 22 nt, Coxiella burnetii RSA 493
ugacagcucugaaagcaauagg

SEQ ID NO: 2577247 - RNA, 15 nt, Coxiella burnetii RSA 493
ugacauucugaacgc

SEQ ID NO: 2577248 - RNA, 19 nt, Coxiella burnetii RSA 493
ugacauugguaaagccguu

SEQ ID NO: 2577249 - RNA, 21 nt, Coxiella burnetii RSA 493
ugacccuuuucaauuucuuuc

SEQ ID NO: 2577250 - RNA, 22 nt, Coxiella burnetii RSA 493
ugaccgcuaaagcaaaaguaau

SEQ ID NO: 2577251 - RNA, 13 nt, Coxiella burnetii RSA 493
ugaccuuuuccuu

SEQ ID NO: 2577252 - RNA, 16 nt, Coxiella burnetii RSA 493
ugacgaaugugcucau

SEQ ID NO: 2577253 - RNA, 22 nt, Coxiella burnetii RSA 493
ugacgaucgucuaaaagcgcaa

SEQ ID NO: 2577254 - RNA, 14 nt, Coxiella burnetii RSA 493
ugacgcguggcuuu

SEQ ID NO: 2577255 - RNA, 15 nt, Coxiella burnetii RSA 493
ugacgcugcaauaau

SEQ ID NO: 2577256 - RNA, 23 nt, Coxiella burnetii RSA 493
ugacggaauuugugauuuuaaaa

SEQ ID NO: 2577257 - RNA, 17 nt, Coxiella burnetii RSA 493
ugacuagucaacaaacg

SEQ ID NO: 2577258 - RNA, 23 nt, Coxiella burnetii RSA 493
ugacuucuuugugagucgccaau

SEQ ID NO: 2577259 - RNA, 16 nt, Coxiella burnetii RSA 493
ugacuuuaucuuuuuu

SEQ ID NO: 2577260 - RNA, 17 nt, Coxiella burnetii RSA 493
ugagaacguuucccaag

SEQ ID NO: 2577261 - RNA, 23 nt, Coxiella burnetii RSA 493
ugagaacguuucccaaggaaucu

SEQ ID NO: 2577262 - RNA, 21 nt, Coxiella burnetii RSA 493
ugagacuuuaauaaagcgcuu

SEQ ID NO: 2577263 - RNA, 14 nt, Coxiella burnetii RSA 493
ugagaguaaauguu

SEQ ID NO: 2577264 - RNA, 16 nt, Coxiella burnetii RSA 493
ugagcaucuuuucuga

SEQ ID NO: 2577265 - RNA, 23 nt, Coxiella burnetii RSA 493
ugagcaucuuuucugaaacauca

SEQ ID NO: 2577266 - RNA, 17 nt, Coxiella burnetii RSA 493
ugagcgaacgaauacgg

SEQ ID NO: 2577267 - RNA, 20 nt, Coxiella burnetii RSA 493
ugagcgaacgaauacgggga

SEQ ID NO: 2577268 - RNA, 17 nt, Coxiella burnetii RSA 493
ugagcgaagcgaaauac

SEQ ID NO: 2577269 - RNA, 20 nt, Coxiella burnetii RSA 493
ugagcgaagcgaaauacggg

SEQ ID NO: 2577270 - RNA, 19 nt, Coxiella burnetii RSA 493
ugagcgaagcgaaguacgg

SEQ ID NO: 2577271 - RNA, 20 nt, Coxiella burnetii RSA 493
ugagcgaagcgaaguacggg

SEQ ID NO: 2577272 - RNA, 21 nt, Coxiella burnetii RSA 493
ugagcgaagcgaaguacggga

SEQ ID NO: 2577273 - RNA, 14 nt, Coxiella burnetii RSA 493
ugagcgccuuuuuu

SEQ ID NO: 2577274 - RNA, 17 nt, Coxiella burnetii RSA 493
ugagcggcuuuuucaau

SEQ ID NO: 2577275 - RNA, 16 nt, Coxiella burnetii RSA 493
ugagcuauaauucucu

SEQ ID NO: 2577276 - RNA, 21 nt, Coxiella burnetii RSA 493
ugagcuugcgaagcccaacag

SEQ ID NO: 2577277 - RNA, 16 nt, Coxiella burnetii RSA 493
ugaggcugauucaaau

SEQ ID NO: 2577278 - RNA, 13 nt, Coxiella burnetii RSA 493
ugagguaacuguc

SEQ ID NO: 2577279 - RNA, 20 nt, Coxiella burnetii RSA 493
ugagguugcaugaggaguca

SEQ ID NO: 2577280 - RNA, 17 nt, Coxiella burnetii RSA 493
ugaguccgugucguuca

SEQ ID NO: 2577281 - RNA, 19 nt, Coxiella burnetii RSA 493
ugagucgccaauaauaguu

SEQ ID NO: 2577282 - RNA, 13 nt, Coxiella burnetii RSA 493
ugagucugccuuu

SEQ ID NO: 2577283 - RNA, 20 nt, Coxiella burnetii RSA 493
ugagucugccuuuuuuuacu

SEQ ID NO: 2577284 - RNA, 16 nt, Coxiella burnetii RSA 493
ugagugcgaauuucgg

SEQ ID NO: 2577285 - RNA, 12 nt, Coxiella burnetii RSA 493
ugaguuagcaua

SEQ ID NO: 2577286 - RNA, 13 nt, Coxiella burnetii RSA 493
ugaguugucauau

SEQ ID NO: 2577287 - RNA, 18 nt, Coxiella burnetii RSA 493
ugaguuuuugacaagcuu

SEQ ID NO: 2577288 - RNA, 15 nt, Coxiella burnetii RSA 493
ugauaaaacuugauu

SEQ ID NO: 2577289 - RNA, 23 nt, Coxiella burnetii RSA 493
ugauaaagauucuguaacuuuuc

SEQ ID NO: 2577290 - RNA, 17 nt, Coxiella burnetii RSA 493
ugauaaagcguuucucg

SEQ ID NO: 2577291 - RNA, 16 nt, Coxiella burnetii RSA 493
ugauaacuauuauuaa

SEQ ID NO: 2577292 - RNA, 17 nt, Coxiella burnetii RSA 493
ugauaagguaucccuuc

SEQ ID NO: 2577293 - RNA, 17 nt, Coxiella burnetii RSA 493
ugauaagguguuuuacg

SEQ ID NO: 2577294 - RNA, 11 nt, Coxiella burnetii RSA 493
ugauaauaauu

SEQ ID NO: 2577295 - RNA, 14 nt, Coxiella burnetii RSA 493
ugauaauaauugcu

SEQ ID NO: 2577296 - RNA, 17 nt, Coxiella burnetii RSA 493
ugauacaaauuuuuaag

SEQ ID NO: 2577297 - RNA, 18 nt, Coxiella burnetii RSA 493
ugauacugcguuuuucag

SEQ ID NO: 2577298 - RNA, 19 nt, Coxiella burnetii RSA 493
ugauacugcguuuuucagu

SEQ ID NO: 2577299 - RNA, 14 nt, Coxiella burnetii RSA 493
ugauacuucuucau

SEQ ID NO: 2577300 - RNA, 20 nt, Coxiella burnetii RSA 493
ugauacuucuucauuaaauc

SEQ ID NO: 2577301 - RNA, 17 nt, Coxiella burnetii RSA 493
ugauauccuucuuuuaa

SEQ ID NO: 2577302 - RNA, 19 nt, Coxiella burnetii RSA 493
ugauaugagaguagauaac

SEQ ID NO: 2577303 - RNA, 16 nt, Coxiella burnetii RSA 493
ugauauucccucuuua

SEQ ID NO: 2577304 - RNA, 16 nt, Coxiella burnetii RSA 493
ugaucaaaaauaaugc

SEQ ID NO: 2577305 - RNA, 15 nt, Coxiella burnetii RSA 493
ugaucaaguuucucc

SEQ ID NO: 2577306 - RNA, 15 nt, Coxiella burnetii RSA 493
ugaucauuuucucag

SEQ ID NO: 2577307 - RNA, 14 nt, Coxiella burnetii RSA 493
ugaucgauaaaaau

SEQ ID NO: 2577308 - RNA, 19 nt, Coxiella burnetii RSA 493
ugaucggaggaaauauuua

SEQ ID NO: 2577309 - RNA, 16 nt, Coxiella burnetii RSA 493
ugaucggcggaaagau

SEQ ID NO: 2577310 - RNA, 20 nt, Coxiella burnetii RSA 493
ugaucguuaauugcuucaau

SEQ ID NO: 2577311 - RNA, 13 nt, Coxiella burnetii RSA 493
ugaucugcucuuu

SEQ ID NO: 2577312 - RNA, 11 nt, Coxiella burnetii RSA 493
ugaugaaaucg

SEQ ID NO: 2577313 - RNA, 20 nt, Coxiella burnetii RSA 493
ugaugacauuuaaaaaaacc

SEQ ID NO: 2577314 - RNA, 14 nt, Coxiella burnetii RSA 493
ugaugaucuaacgu

SEQ ID NO: 2577315 - RNA, 22 nt, Coxiella burnetii RSA 493
ugaugcauuaaucauuacagac

SEQ ID NO: 2577316 - RNA, 18 nt, Coxiella burnetii RSA 493
ugaugucaucuaucgucc

SEQ ID NO: 2577317 - RNA, 14 nt, Coxiella burnetii RSA 493
ugauguuuuaaaau

SEQ ID NO: 2577318 - RNA, 21 nt, Coxiella burnetii RSA 493
ugauuaaacguauuccaaaua

SEQ ID NO: 2577319 - RNA, 15 nt, Coxiella burnetii RSA 493
ugauuaaauugcucu

SEQ ID NO: 2577320 - RNA, 23 nt, Coxiella burnetii RSA 493
ugauuauagaaugggaaguuuua

SEQ ID NO: 2577321 - RNA, 12 nt, Coxiella burnetii RSA 493
ugauucaauaau

SEQ ID NO: 2577322 - RNA, 16 nt, Coxiella burnetii RSA 493
ugauucaauaaucuca

SEQ ID NO: 2577323 - RNA, 21 nt, Coxiella burnetii RSA 493
ugauucauuaguuugguugaa

SEQ ID NO: 2577324 - RNA, 14 nt, Coxiella burnetii RSA 493
ugauugaaaauccc

SEQ ID NO: 2577325 - RNA, 21 nt, Coxiella burnetii RSA 493
ugauugaaaaucccuuuuaau

SEQ ID NO: 2577326 - RNA, 14 nt, Coxiella burnetii RSA 493
ugauugauuuuuua

SEQ ID NO: 2577327 - RNA, 17 nt, Coxiella burnetii RSA 493
ugauugauuuuuuaaug

SEQ ID NO: 2577328 - RNA, 21 nt, Coxiella burnetii RSA 493
ugauugcggcucaauuauuaa

SEQ ID NO: 2577329 - RNA, 18 nt, Coxiella burnetii RSA 493
ugauugggcucaaaaaga

SEQ ID NO: 2577330 - RNA, 12 nt, Coxiella burnetii RSA 493
ugauuuaaauuu

SEQ ID NO: 2577331 - RNA, 15 nt, Coxiella burnetii RSA 493
ugauuuaaauuuaaa

SEQ ID NO: 2577332 - RNA, 12 nt, Coxiella burnetii RSA 493
ugauuucguaaa

SEQ ID NO: 2577333 - RNA, 17 nt, Coxiella burnetii RSA 493
ugauuuguucuaaaucg

SEQ ID NO: 2577334 - RNA, 12 nt, Coxiella burnetii RSA 493
ugauuuuaaaaa

SEQ ID NO: 2577335 - RNA, 13 nt, Coxiella burnetii RSA 493
ugauuuuaaaaau

SEQ ID NO: 2577336 - RNA, 19 nt, Coxiella burnetii RSA 493
ugauuuucugugguuaauu

SEQ ID NO: 2577337 - RNA, 14 nt, Coxiella burnetii RSA 493
ugauuuuucccaau

SEQ ID NO: 2577338 - RNA, 12 nt, Coxiella burnetii RSA 493
ugauuuuucuuu

SEQ ID NO: 2577339 - RNA, 21 nt, Coxiella burnetii RSA 493
ugauuuuugcucuaauucuga

SEQ ID NO: 2577340 - RNA, 16 nt, Coxiella burnetii RSA 493
ugauuuuuuaaaucuu

SEQ ID NO: 2577341 - RNA, 15 nt, Coxiella burnetii RSA 493
ugauuuuuuaaugaa

SEQ ID NO: 2577342 - RNA, 16 nt, Coxiella burnetii RSA 493
ugauuuuuuuugcuuu

SEQ ID NO: 2577343 - RNA, 13 nt, Coxiella burnetii RSA 493
ugcaaaaauuguu

SEQ ID NO: 2577344 - RNA, 22 nt, Coxiella burnetii RSA 493
ugcaaaccgcgcugaaguccuu

SEQ ID NO: 2577345 - RNA, 15 nt, Coxiella burnetii RSA 493
ugcaaauaaugagug

SEQ ID NO: 2577346 - RNA, 17 nt, Coxiella burnetii RSA 493
ugcaaaugaguaaaaaa

SEQ ID NO: 2577347 - RNA, 14 nt, Coxiella burnetii RSA 493
ugcaacuuccgcua

SEQ ID NO: 2577348 - RNA, 18 nt, Coxiella burnetii RSA 493
ugcaagcaccgcuggcuu

SEQ ID NO: 2577349 - RNA, 15 nt, Coxiella burnetii RSA 493
ugcaagcguuuuuca

SEQ ID NO: 2577350 - RNA, 17 nt, Coxiella burnetii RSA 493
ugcaagcguuuuucauc

SEQ ID NO: 2577351 - RNA, 12 nt, Coxiella burnetii RSA 493
ugcuauuuuucc

SEQ ID NO: 2577352 - RNA, 13 nt, Coxiella burnetii RSA 493
ugcuauuuuuccc

SEQ ID NO: 2577353 - RNA, 20 nt, Coxiella burnetii RSA 493
ugcucaagcgaacgcggccu

SEQ ID NO: 2577354 - RNA, 13 nt, Coxiella burnetii RSA 493
ugcucaaguccuu

SEQ ID NO: 2577355 - RNA, 16 nt, Coxiella burnetii RSA 493
ugcucaaguccuugcu

SEQ ID NO: 2577356 - RNA, 23 nt, Coxiella burnetii RSA 493
ugcucaaguccuugcugaauucc

SEQ ID NO: 2577357 - RNA, 22 nt, Coxiella burnetii RSA 493
ugcucauguagcccaacaaaau

SEQ ID NO: 2577358 - RNA, 17 nt, Coxiella burnetii RSA 493
ugcuccaaaauaagaaa

SEQ ID NO: 2577359 - RNA, 17 nt, Coxiella burnetii RSA 493
ugcuccgcguuuuucca

SEQ ID NO: 2577360 - RNA, 20 nt, Coxiella burnetii RSA 493
ugcuccgcguuuuuccacaa

SEQ ID NO: 2577361 - RNA, 14 nt, Coxiella burnetii RSA 493
ugcuccuuuucuuc

SEQ ID NO: 2577362 - RNA, 23 nt, Coxiella burnetii RSA 493
ugcucgcgaaauuuaauaaaauu

SEQ ID NO: 2577363 - RNA, 20 nt, Coxiella burnetii RSA 493
ugcucguaagucguuuuaau

SEQ ID NO: 2577364 - RNA, 15 nt, Coxiella burnetii RSA 493
ugcucucccuuaacu

SEQ ID NO: 2577365 - RNA, 14 nt, Coxiella burnetii RSA 493
ugcucuuuuucauu

SEQ ID NO: 2577366 - RNA, 15 nt, Coxiella burnetii RSA 493
ugcucuuuuucauuu

SEQ ID NO: 2577367 - RNA, 21 nt, Coxiella burnetii RSA 493
ugcucuuuuucauuucuucga

SEQ ID NO: 2577368 - RNA, 16 nt, Coxiella burnetii RSA 493
ugcugauagcauuguu

SEQ ID NO: 2577369 - RNA, 19 nt, Coxiella burnetii RSA 493
ugcugugcgguauuuuucc

SEQ ID NO: 2577370 - RNA, 23 nt, Coxiella burnetii RSA 493
ugcuguuucuaauauguuuuuua

SEQ ID NO: 2577371 - RNA, 14 nt, Coxiella burnetii RSA 493
ugcuuaucauguac

SEQ ID NO: 2577372 - RNA, 14 nt, Coxiella burnetii RSA 493
ugcuucaauaaaaa

SEQ ID NO: 2577373 - RNA, 18 nt, Coxiella burnetii RSA 493
ugcuucauugacagccag

SEQ ID NO: 2577374 - RNA, 19 nt, Coxiella burnetii RSA 493
ugcuuccccaauuuauuca

SEQ ID NO: 2577375 - RNA, 19 nt, Coxiella burnetii RSA 493
ugcuucuaauuugaaaaac

SEQ ID NO: 2577376 - RNA, 21 nt, Coxiella burnetii RSA 493
ugcuucuaauuugaaaaaccc

SEQ ID NO: 2577377 - RNA, 13 nt, Coxiella burnetii RSA 493
ugcuucuuugaua

SEQ ID NO: 2577378 - RNA, 18 nt, Coxiella burnetii RSA 493
ugcuugcacaucuucacg

SEQ ID NO: 2577379 - RNA, 21 nt, Coxiella burnetii RSA 493
ugcuugccgggcgcacuuuaa

SEQ ID NO: 2577380 - RNA, 15 nt, Coxiella burnetii RSA 493
ugcuugggaacaacg

SEQ ID NO: 2577381 - RNA, 13 nt, Coxiella burnetii RSA 493
ugcuuguuaagua

SEQ ID NO: 2577382 - RNA, 22 nt, Coxiella burnetii RSA 493
ugcuuuaaaucccguuucgguu

SEQ ID NO: 2577383 - RNA, 17 nt, Coxiella burnetii RSA 493
ugcuuucccuuuuugau

SEQ ID NO: 2577384 - RNA, 22 nt, Coxiella burnetii RSA 493
ugcuuucuuugaaccacuaagu

SEQ ID NO: 2577385 - RNA, 16 nt, Coxiella burnetii RSA 493
ugcuuugggauaauuc

SEQ ID NO: 2577386 - RNA, 15 nt, Coxiella burnetii RSA 493
ugcuuuuauuuaagu

SEQ ID NO: 2577387 - RNA, 23 nt, Coxiella burnetii RSA 493
ugcuuuucucaacgcuucagaau

SEQ ID NO: 2577388 - RNA, 16 nt, Coxiella burnetii RSA 493
ugcuuuugaauuuuuu

SEQ ID NO: 2577389 - RNA, 13 nt, Coxiella burnetii RSA 493
ugcuuuuuaaaua

SEQ ID NO: 2577390 - RNA, 20 nt, Coxiella burnetii RSA 493
uggaaucgcggacaauaaga

SEQ ID NO: 2577391 - RNA, 13 nt, Coxiella burnetii RSA 493
uggaauuaaauau

SEQ ID NO: 2577392 - RNA, 15 nt, Coxiella burnetii RSA 493
uggaauuuuugacgc

SEQ ID NO: 2577393 - RNA, 16 nt, Coxiella burnetii RSA 493
uggacccuguuuuuuu

SEQ ID NO: 2577394 - RNA, 17 nt, Coxiella burnetii RSA 493
uggagagaauuuucaug

SEQ ID NO: 2577395 - RNA, 19 nt, Coxiella burnetii RSA 493
uggagaggugaaccaaaag

SEQ ID NO: 2577396 - RNA, 23 nt, Coxiella burnetii RSA 493
uggagcccauaaagcggaauuag

SEQ ID NO: 2577397 - RNA, 22 nt, Coxiella burnetii RSA 493
uggagguuucuuuccagcuucc

SEQ ID NO: 2577398 - RNA, 16 nt, Coxiella burnetii RSA 493
uggagucgcuuucaau

SEQ ID NO: 2577399 - RNA, 20 nt, Coxiella burnetii RSA 493
uggauaaaggagauccacuu

SEQ ID NO: 2577400 - RNA, 13 nt, Coxiella burnetii RSA 493
uggauagacaauu

SEQ ID NO: 2577401 - RNA, 11 nt, Coxiella burnetii RSA 493
uggaugaucau

SEQ ID NO: 2577402 - RNA, 15 nt, Coxiella burnetii RSA 493
uggaugguucuuuug

SEQ ID NO: 2577403 - RNA, 14 nt, Coxiella burnetii RSA 493
uggauuaaaugcaa

SEQ ID NO: 2577404 - RNA, 17 nt, Coxiella burnetii RSA 493
uggauuuucaaaagagg

SEQ ID NO: 2577405 - RNA, 17 nt, Coxiella burnetii RSA 493
uggauuuuuuaauuggu

SEQ ID NO: 2577406 - RNA, 14 nt, Coxiella burnetii RSA 493
uggcaauuaugaaa

SEQ ID NO: 2577407 - RNA, 19 nt, Coxiella burnetii RSA 493
uggcaguggggucuucauc

SEQ ID NO: 2577408 - RNA, 22 nt, Coxiella burnetii RSA 493
uggcaguggggucuucaucuuu

SEQ ID NO: 2577409 - RNA, 16 nt, Coxiella burnetii RSA 493
uggcaguuaaauuuuu

SEQ ID NO: 2577410 - RNA, 18 nt, Coxiella burnetii RSA 493
uggcaguuaaauuuuuaa

SEQ ID NO: 2577411 - RNA, 20 nt, Coxiella burnetii RSA 493
uggcaguuaaauuuuuaaug

SEQ ID NO: 2577412 - RNA, 13 nt, Coxiella burnetii RSA 493
uggcauaagcaga

SEQ ID NO: 2577413 - RNA, 15 nt, Coxiella burnetii RSA 493
uggcaucauuucccg

SEQ ID NO: 2577414 - RNA, 19 nt, Coxiella burnetii RSA 493
uggcauccgguggaauuag

SEQ ID NO: 2577415 - RNA, 17 nt, Coxiella burnetii RSA 493
uggccaaacuaaucugc

SEQ ID NO: 2577416 - RNA, 16 nt, Coxiella burnetii RSA 493
uggccagugccugugc

SEQ ID NO: 2577417 - RNA, 23 nt, Coxiella burnetii RSA 493
uggcccgacgcucgguuccaaaa

SEQ ID NO: 2577418 - RNA, 17 nt, Coxiella burnetii RSA 493
uggccggcaaugcacca

SEQ ID NO: 2577419 - RNA, 14 nt, Coxiella burnetii RSA 493
uggcgcaucaaaaa

SEQ ID NO: 2577420 - RNA, 21 nt, Coxiella burnetii RSA 493
uggcgcucuccuaccaaauaa

SEQ ID NO: 2577421 - RNA, 17 nt, Coxiella burnetii RSA 493
uggcggcgcucauggga

SEQ ID NO: 2577422 - RNA, 23 nt, Coxiella burnetii RSA 493
uggcguaagcgccagagauuuuu

SEQ ID NO: 2577423 - RNA, 16 nt, Coxiella burnetii RSA 493
uggcguaauucuugca

SEQ ID NO: 2577424 - RNA, 21 nt, Coxiella burnetii RSA 493
uggcgugacccuuaauuugga

SEQ ID NO: 2577425 - RNA, 19 nt, Coxiella burnetii RSA 493
uggcuaacucacuuuuuuc

SEQ ID NO: 2577426 - RNA, 18 nt, Coxiella burnetii RSA 493
uggcuacuuucucaauuu

SEQ ID NO: 2577427 - RNA, 23 nt, Coxiella burnetii RSA 493
uggcuccagccgaagcgcggcca

SEQ ID NO: 2577428 - RNA, 19 nt, Coxiella burnetii RSA 493
uggcucgacuuauuuguug

SEQ ID NO: 2577429 - RNA, 20 nt, Coxiella burnetii RSA 493
uggcugcggguuuugaagaa

SEQ ID NO: 2577430 - RNA, 15 nt, Coxiella burnetii RSA 493
uggcugcuucuuuaa

SEQ ID NO: 2577431 - RNA, 22 nt, Coxiella burnetii RSA 493
uggcuggugcgauaguuuuauu

SEQ ID NO: 2577432 - RNA, 23 nt, Coxiella burnetii RSA 493
uggcuuucccuuuccggaaaaag

SEQ ID NO: 2577433 - RNA, 13 nt, Coxiella burnetii RSA 493
uggcuuuuuucuu

SEQ ID NO: 2577434 - RNA, 15 nt, Coxiella burnetii RSA 493
ugggaauguucugau

SEQ ID NO: 2577435 - RNA, 20 nt, Coxiella burnetii RSA 493
ugggaguaaugacagaaaaa

SEQ ID NO: 2577436 - RNA, 13 nt, Coxiella burnetii RSA 493
ugggauaauaacu

SEQ ID NO: 2577437 - RNA, 20 nt, Coxiella burnetii RSA 493
ugggaugcgaagcaugcuga

SEQ ID NO: 2577438 - RNA, 17 nt, Coxiella burnetii RSA 493
ugggauuguuuucgaua

SEQ ID NO: 2577439 - RNA, 22 nt, Coxiella burnetii RSA 493
ugggcaaggcaugaaauuuuug

SEQ ID NO: 2577440 - RNA, 18 nt, Coxiella burnetii RSA 493
ugggcaguuuucuucaau

SEQ ID NO: 2577441 - RNA, 20 nt, Coxiella burnetii RSA 493
ugggccuacuuuauuuauug

SEQ ID NO: 2577442 - RNA, 11 nt, Coxiella burnetii RSA 493
ugggcggaauu

SEQ ID NO: 2577443 - RNA, 22 nt, Coxiella burnetii RSA 493
uggggcgagcgcccauuuuuuc

SEQ ID NO: 2577444 - RNA, 20 nt, Coxiella burnetii RSA 493
uggggcguuagcggaauacg

SEQ ID NO: 2577445 - RNA, 13 nt, Coxiella burnetii RSA 493
uggguccucgccu

SEQ ID NO: 2577446 - RNA, 17 nt, Coxiella burnetii RSA 493
ugggugggauuguuuuc

SEQ ID NO: 2577447 - RNA, 18 nt, Coxiella burnetii RSA 493
uggguuagggugcaauuc

SEQ ID NO: 2577448 - RNA, 18 nt, Coxiella burnetii RSA 493
uggguuuucuuuugaaua

SEQ ID NO: 2577449 - RNA, 15 nt, Coxiella burnetii RSA 493
ugguaaacaacgcac

SEQ ID NO: 2577450 - RNA, 16 nt, Coxiella burnetii RSA 493
ugguaauaauuuuccg

SEQ ID NO: 2577451 - RNA, 13 nt, Coxiella burnetii RSA 493
ugguagcuaccag

SEQ ID NO: 2577452 - RNA, 14 nt, Coxiella burnetii RSA 493
ugguauauuucauu

SEQ ID NO: 2577453 - RNA, 14 nt, Coxiella burnetii RSA 493
uggucaaagagauu

SEQ ID NO: 2577454 - RNA, 19 nt, Coxiella burnetii RSA 493
uggucacaugauuuuucug

SEQ ID NO: 2577455 - RNA, 18 nt, Coxiella burnetii RSA 493
ugguccggcgaacagccg

SEQ ID NO: 2577456 - RNA, 23 nt, Coxiella burnetii RSA 493
uguuuaaucgcuccuaaauuuuc

SEQ ID NO: 2577457 - RNA, 19 nt, Coxiella burnetii RSA 493
uguuuagucggaaauuucu

SEQ ID NO: 2577458 - RNA, 15 nt, Coxiella burnetii RSA 493
uguuucaauaacaga

SEQ ID NO: 2577459 - RNA, 16 nt, Coxiella burnetii RSA 493
uguuucaauaacagag

SEQ ID NO: 2577460 - RNA, 15 nt, Coxiella burnetii RSA 493
uguuucgaaauauag

SEQ ID NO: 2577461 - RNA, 22 nt, Coxiella burnetii RSA 493
uguuucgcaacuuuuuuccuuc

SEQ ID NO: 2577462 - RNA, 19 nt, Coxiella burnetii RSA 493
uguuucuagagcaacgauu

SEQ ID NO: 2577463 - RNA, 13 nt, Coxiella burnetii RSA 493
uguuucuuuuaua

SEQ ID NO: 2577464 - RNA, 12 nt, Coxiella burnetii RSA 493
uguuugaaaaaa

SEQ ID NO: 2577465 - RNA, 18 nt, Coxiella burnetii RSA 493
uguuugagugguugaaaa

SEQ ID NO: 2577466 - RNA, 12 nt, Coxiella burnetii RSA 493
uguuugauuuac

SEQ ID NO: 2577467 - RNA, 18 nt, Coxiella burnetii RSA 493
uguuugauuuguucuaaa

SEQ ID NO: 2577468 - RNA, 24 nt, Coxiella burnetii RSA 493
uguuugcuugaguaaccucuccau

SEQ ID NO: 2577469 - RNA, 12 nt, Coxiella burnetii RSA 493
uguuuuaaaauu

SEQ ID NO: 2577470 - RNA, 16 nt, Coxiella burnetii RSA 493
uguuuuacguuuaaau

SEQ ID NO: 2577471 - RNA, 19 nt, Coxiella burnetii RSA 493
uguuuucccguauuucgcu

SEQ ID NO: 2577472 - RNA, 21 nt, Coxiella burnetii RSA 493
uguuuugaucagagaaaccca

SEQ ID NO: 2577473 - RNA, 23 nt, Coxiella burnetii RSA 493
uguuuugcauccgaacuaauggu

SEQ ID NO: 2577474 - RNA, 24 nt, Coxiella burnetii RSA 493
uguuuuggcaucgagaagucgcuc

SEQ ID NO: 2577475 - RNA, 16 nt, Coxiella burnetii RSA 493
uguuuuuauuuugacu

SEQ ID NO: 2577476 - RNA, 17 nt, Coxiella burnetii RSA 493
uguuuuucgguuucuuc

SEQ ID NO: 2577477 - RNA, 13 nt, Coxiella burnetii RSA 493
uguuuuuucacuu

SEQ ID NO: 2577478 - RNA, 14 nt, Coxiella burnetii RSA 493
uguuuuuucacuuc

SEQ ID NO: 2577479 - RNA, 15 nt, Coxiella burnetii RSA 493
uguuuuuuuguagaa

SEQ ID NO: 2577480 - RNA, 14 nt, Coxiella burnetii RSA 493
uguuuuuuuucagc

SEQ ID NO: 2577481 - RNA, 17 nt, Coxiella burnetii RSA 493
uguuuuuuuucagcaga

SEQ ID NO: 2577482 - RNA, 19 nt, Coxiella burnetii RSA 493
uuaaaaaaaaacuggagcc

SEQ ID NO: 2577483 - RNA, 20 nt, Coxiella burnetii RSA 493
uuaaaaaacuagaaauauua

SEQ ID NO: 2577484 - RNA, 11 nt, Coxiella burnetii RSA 493
uuaaaaaagaa

SEQ ID NO: 2577485 - RNA, 15 nt, Coxiella burnetii RSA 493
uuaaaaaagaaaaua

SEQ ID NO: 2577486 - RNA, 16 nt, Coxiella burnetii RSA 493
uuaaaaaagcaugauu

SEQ ID NO: 2577487 - RNA, 18 nt, Coxiella burnetii RSA 493
uuaaaaacgccugaaaua

SEQ ID NO: 2577488 - RNA, 12 nt, Coxiella burnetii RSA 493
uuaaaaauaaau

SEQ ID NO: 2577489 - RNA, 11 nt, Coxiella burnetii RSA 493
uuaaaaauauu

SEQ ID NO: 2577490 - RNA, 17 nt, Coxiella burnetii RSA 493
uuaaaaauuuuaaaaaa

SEQ ID NO: 2577491 - RNA, 19 nt, Coxiella burnetii RSA 493
uuaaaaauuuuaaaaaaau

SEQ ID NO: 2577492 - RNA, 15 nt, Coxiella burnetii RSA 493
uuaaaacaagacaac

SEQ ID NO: 2577493 - RNA, 15 nt, Coxiella burnetii RSA 493
uuaaaacgccaaaac

SEQ ID NO: 2577494 - RNA, 22 nt, Coxiella burnetii RSA 493
uuaaaagacguaccauuaaaag

SEQ ID NO: 2577495 - RNA, 16 nt, Coxiella burnetii RSA 493
uuaaaagauuuuaucu

SEQ ID NO: 2577496 - RNA, 18 nt, Coxiella burnetii RSA 493
uuaaaagcgcccaaauga

SEQ ID NO: 2577497 - RNA, 17 nt, Coxiella burnetii RSA 493
uuaaaauaauccaaggg

SEQ ID NO: 2577498 - RNA, 14 nt, Coxiella burnetii RSA 493
uuaaaauuacuuua

SEQ ID NO: 2577499 - RNA, 19 nt, Coxiella burnetii RSA 493
uuaaaauuacuuuauuacc

SEQ ID NO: 2577500 - RNA, 18 nt, Coxiella burnetii RSA 493
uuaaacgcuucaaaguga

SEQ ID NO: 2577501 - RNA, 17 nt, Coxiella burnetii RSA 493
uuaaagcccucaucucc

SEQ ID NO: 2577502 - RNA, 19 nt, Coxiella burnetii RSA 493
uuaaagucuucaaaaguga

SEQ ID NO: 2577503 - RNA, 15 nt, Coxiella burnetii RSA 493
uuaaaguuucuaacu

SEQ ID NO: 2577504 - RNA, 21 nt, Coxiella burnetii RSA 493
uuaaauaagggauaaaacaca

SEQ ID NO: 2577505 - RNA, 14 nt, Coxiella burnetii RSA 493
uuaaauaccauuuu

SEQ ID NO: 2577506 - RNA, 14 nt, Coxiella burnetii RSA 493
uuaaauauaauuga

SEQ ID NO: 2577507 - RNA, 15 nt, Coxiella burnetii RSA 493
uuaaaucaacacccc

SEQ ID NO: 2577508 - RNA, 23 nt, Coxiella burnetii RSA 493
uuaaaucaacaccccaauuuuug

SEQ ID NO: 2577509 - RNA, 19 nt, Coxiella burnetii RSA 493
uuaaaucauaggggguuaa

SEQ ID NO: 2577510 - RNA, 22 nt, Coxiella burnetii RSA 493
uuaaauccagaccuguuaaaaa

SEQ ID NO: 2577511 - RNA, 17 nt, Coxiella burnetii RSA 493
uuaaaucuuccaauuuu

SEQ ID NO: 2577512 - RNA, 18 nt, Coxiella burnetii RSA 493
uuaaaucuuccaauuuuu

SEQ ID NO: 2577513 - RNA, 18 nt, Coxiella burnetii RSA 493
uuaaaugaauuacuuuca

SEQ ID NO: 2577514 - RNA, 15 nt, Coxiella burnetii RSA 493
uuaaaugcaacgaug

SEQ ID NO: 2577515 - RNA, 18 nt, Coxiella burnetii RSA 493
uuaaaugcuuuucuuuca

SEQ ID NO: 2577516 - RNA, 19 nt, Coxiella burnetii RSA 493
uuaaaugcuuuucuuucau

SEQ ID NO: 2577517 - RNA, 12 nt, Coxiella burnetii RSA 493
uuaaauuucuca

SEQ ID NO: 2577518 - RNA, 15 nt, Coxiella burnetii RSA 493
uuaaauuuuucauuu

SEQ ID NO: 2577519 - RNA, 12 nt, Coxiella burnetii RSA 493
uuaacaaaaaug

SEQ ID NO: 2577520 - RNA, 21 nt, Coxiella burnetii RSA 493
uuaacaaaaucaccagaaaac

SEQ ID NO: 2577521 - RNA, 19 nt, Coxiella burnetii RSA 493
uuaacauuauuacauauuu

SEQ ID NO: 2577522 - RNA, 20 nt, Coxiella burnetii RSA 493
uuaacgauaaaucaaaucgg

SEQ ID NO: 2577523 - RNA, 15 nt, Coxiella burnetii RSA 493
uuaacguauaaauaa

SEQ ID NO: 2577524 - RNA, 11 nt, Coxiella burnetii RSA 493
uuaacuucauu

SEQ ID NO: 2577525 - RNA, 21 nt, Coxiella burnetii RSA 493
uuaacuucgacgggaaaaaua

SEQ ID NO: 2577526 - RNA, 22 nt, Coxiella burnetii RSA 493
uuaacuucgacgggaaaaauau

SEQ ID NO: 2577527 - RNA, 12 nt, Coxiella burnetii RSA 493
uuaagaaaaacc

SEQ ID NO: 2577528 - RNA, 12 nt, Coxiella burnetii RSA 493
uuaagaaaguau

SEQ ID NO: 2577529 - RNA, 17 nt, Coxiella burnetii RSA 493
uuaagagagcgagguaa

SEQ ID NO: 2577530 - RNA, 21 nt, Coxiella burnetii RSA 493
uuaagagauagugcuauuuuu

SEQ ID NO: 2577531 - RNA, 20 nt, Coxiella burnetii RSA 493
uuaagaggaccugugaggga

SEQ ID NO: 2577532 - RNA, 19 nt, Coxiella burnetii RSA 493
uuaagauaauaauuauacu

SEQ ID NO: 2577533 - RNA, 13 nt, Coxiella burnetii RSA 493
uuaagaucgcugu

SEQ ID NO: 2577534 - RNA, 15 nt, Coxiella burnetii RSA 493
uuaagcaauuuuuua

SEQ ID NO: 2577535 - RNA, 11 nt, Coxiella burnetii RSA 493
uuaagcgcgau

SEQ ID NO: 2577536 - RNA, 18 nt, Coxiella burnetii RSA 493
uuaagcuugaaaaaauug

SEQ ID NO: 2577537 - RNA, 14 nt, Coxiella burnetii RSA 493
uuaaggaaaagcac

SEQ ID NO: 2577538 - RNA, 21 nt, Coxiella burnetii RSA 493
uuaaggccaauuccaauaauu

SEQ ID NO: 2577539 - RNA, 22 nt, Coxiella burnetii RSA 493
uuaaggccucuuuagaaaauug

SEQ ID NO: 2577540 - RNA, 16 nt, Coxiella burnetii RSA 493
uuaaguagcuaaaaaa

SEQ ID NO: 2577541 - RNA, 17 nt, Coxiella burnetii RSA 493
uuaagucccaauuucuu

SEQ ID NO: 2577542 - RNA, 14 nt, Coxiella burnetii RSA 493
uuaagugacagcuc

SEQ ID NO: 2577543 - RNA, 17 nt, Coxiella burnetii RSA 493
uuaauaaaauuaaauaa

SEQ ID NO: 2577544 - RNA, 23 nt, Coxiella burnetii RSA 493
uuaauaaagugccgcgaauacgc

SEQ ID NO: 2577545 - RNA, 13 nt, Coxiella burnetii RSA 493
uuaauaaaguuuu

SEQ ID NO: 2577546 - RNA, 20 nt, Coxiella burnetii RSA 493
uuaauaauguuauuaaacaa

SEQ ID NO: 2577547 - RNA, 13 nt, Coxiella burnetii RSA 493
uuaauacaaggaa

SEQ ID NO: 2577548 - RNA, 15 nt, Coxiella burnetii RSA 493
uuaauacaaggaaaa

SEQ ID NO: 2577549 - RNA, 18 nt, Coxiella burnetii RSA 493
uuaauacaggaaaaagau

SEQ ID NO: 2577550 - RNA, 20 nt, Coxiella burnetii RSA 493
uuaauacaggaaaaagauaa

SEQ ID NO: 2577551 - RNA, 18 nt, Coxiella burnetii RSA 493
uuaauacauucuucagua

SEQ ID NO: 2577552 - RNA, 21 nt, Coxiella burnetii RSA 493
uuaauacccguuucuuauuca

SEQ ID NO: 2577553 - RNA, 12 nt, Coxiella burnetii RSA 493
uuaauauaauca

SEQ ID NO: 2577554 - RNA, 14 nt, Coxiella burnetii RSA 493
uuaauaucaaaaaa

SEQ ID NO: 2577555 - RNA, 19 nt, Coxiella burnetii RSA 493
uuaauauuaaaacaagaca

SEQ ID NO: 2577556 - RNA, 15 nt, Coxiella burnetii RSA 493
uuaaucauauaauuu

SEQ ID NO: 2577557 - RNA, 18 nt, Coxiella burnetii RSA 493
uuaauccguuuugaaaaa

SEQ ID NO: 2577558 - RNA, 20 nt, Coxiella burnetii RSA 493
uuaauccguuuugaaaaaua

SEQ ID NO: 2577559 - RNA, 22 nt, Coxiella burnetii RSA 493
uuaaucgcuccgaaaauaaaua

SEQ ID NO: 2577560 - RNA, 18 nt, Coxiella burnetii RSA 493
uuaaucgcuccuaaauuu

SEQ ID NO: 2577561 - RNA, 21 nt, Coxiella burnetii RSA 493
uuaaucgcuccuaaauuuucu

SEQ ID NO: 2577562 - RNA, 20 nt, Coxiella burnetii RSA 493
uuauuacccucgcccuuccc

SEQ ID NO: 2577563 - RNA, 18 nt, Coxiella burnetii RSA 493
uuauuauuuuuuucuauu

SEQ ID NO: 2577564 - RNA, 17 nt, Coxiella burnetii RSA 493
uuauucaacucuuaucu

SEQ ID NO: 2577565 - RNA, 17 nt, Coxiella burnetii RSA 493
uuauucauuaguucuau

SEQ ID NO: 2577566 - RNA, 14 nt, Coxiella burnetii RSA 493
uuauucccagauaa

SEQ ID NO: 2577567 - RNA, 20 nt, Coxiella burnetii RSA 493
uuauuccuguggaagguuga

SEQ ID NO: 2577568 - RNA, 17 nt, Coxiella burnetii RSA 493
uuauuccuuuuuuuaau

SEQ ID NO: 2577569 - RNA, 18 nt, Coxiella burnetii RSA 493
uuauuccuuuuuuuaaug

SEQ ID NO: 2577570 - RNA, 15 nt, Coxiella burnetii RSA 493
uuauucggauucucu

SEQ ID NO: 2577571 - RNA, 21 nt, Coxiella burnetii RSA 493
uuauucgguaacguuucacaa

SEQ ID NO: 2577572 - RNA, 13 nt, Coxiella burnetii RSA 493
uuauucuccauaa

SEQ ID NO: 2577573 - RNA, 19 nt, Coxiella burnetii RSA 493
uuauucuuaauuuuuccuu

SEQ ID NO: 2577574 - RNA, 15 nt, Coxiella burnetii RSA 493
uuauugagaaucucu

SEQ ID NO: 2577575 - RNA, 23 nt, Coxiella burnetii RSA 493
uuauuuccagcaguaaugagcau

SEQ ID NO: 2577576 - RNA, 20 nt, Coxiella burnetii RSA 493
uuauuucugcagauuguaaa

SEQ ID NO: 2577577 - RNA, 23 nt, Coxiella burnetii RSA 493
uuauuuuaauaugauaaaaggca

SEQ ID NO: 2577578 - RNA, 21 nt, Coxiella burnetii RSA 493
uuauuuucaaaugaauaagca

SEQ ID NO: 2577579 - RNA, 12 nt, Coxiella burnetii RSA 493
uuauuuuuaaaa

SEQ ID NO: 2577580 - RNA, 20 nt, Coxiella burnetii RSA 493
uucaaaagugauuuuucuuu

SEQ ID NO: 2577581 - RNA, 12 nt, Coxiella burnetii RSA 493
uucaaacagugc

SEQ ID NO: 2577582 - RNA, 13 nt, Coxiella burnetii RSA 493
uucaaagugauca

SEQ ID NO: 2577583 - RNA, 16 nt, Coxiella burnetii RSA 493
uucaaaugaccaaaua

SEQ ID NO: 2577584 - RNA, 19 nt, Coxiella burnetii RSA 493
uucaaaugaccaaauaauu

SEQ ID NO: 2577585 - RNA, 21 nt, Coxiella burnetii RSA 493
uucaaauugcugaauugauaa

SEQ ID NO: 2577586 - RNA, 18 nt, Coxiella burnetii RSA 493
uucaacacaguucuuaac

SEQ ID NO: 2577587 - RNA, 13 nt, Coxiella burnetii RSA 493
uucaacauauuuc

SEQ ID NO: 2577588 - RNA, 16 nt, Coxiella burnetii RSA 493
uucaacaucaacccca

SEQ ID NO: 2577589 - RNA, 20 nt, Coxiella burnetii RSA 493
uucaacgccucucucauaau

SEQ ID NO: 2577590 - RNA, 21 nt, Coxiella burnetii RSA 493
uucaacuccugaaaaauaauu

SEQ ID NO: 2577591 - RNA, 13 nt, Coxiella burnetii RSA 493
uucaagaaagaca

SEQ ID NO: 2577592 - RNA, 22 nt, Coxiella burnetii RSA 493
uucaagguuauugcuauuuucc

SEQ ID NO: 2577593 - RNA, 21 nt, Coxiella burnetii RSA 493
uucaagugcaacguccugaau

SEQ ID NO: 2577594 - RNA, 15 nt, Coxiella burnetii RSA 493
uucaauaaacccguu

SEQ ID NO: 2577595 - RNA, 21 nt, Coxiella burnetii RSA 493
uucaaucacaaguucuucuaa

SEQ ID NO: 2577596 - RNA, 22 nt, Coxiella burnetii RSA 493
uucaaucacaaguucuucuaaa

SEQ ID NO: 2577597 - RNA, 21 nt, Coxiella burnetii RSA 493
uucaaucgcacccuucuguuu

SEQ ID NO: 2577598 - RNA, 16 nt, Coxiella burnetii RSA 493
uucaaugacuuuaacu

SEQ ID NO: 2577599 - RNA, 16 nt, Coxiella burnetii RSA 493
uucaauuagcauuuuc

SEQ ID NO: 2577600 - RNA, 21 nt, Coxiella burnetii RSA 493
uucaauucuuuuuaagacgga

SEQ ID NO: 2577601 - RNA, 22 nt, Coxiella burnetii RSA 493
uucaauuucgggugauaauuga

SEQ ID NO: 2577602 - RNA, 17 nt, Coxiella burnetii RSA 493
uucaccguuuucuaucc

SEQ ID NO: 2577603 - RNA, 23 nt, Coxiella burnetii RSA 493
uucacgauuuuucucaucauuuu

SEQ ID NO: 2577604 - RNA, 13 nt, Coxiella burnetii RSA 493
uucacuaaaagaa

SEQ ID NO: 2577605 - RNA, 17 nt, Coxiella burnetii RSA 493
uucacuaauuauaagac

SEQ ID NO: 2577606 - RNA, 21 nt, Coxiella burnetii RSA 493
uucacucgcaaaaauuucauu

SEQ ID NO: 2577607 - RNA, 18 nt, Coxiella burnetii RSA 493
uucacuuuucuggcugua

SEQ ID NO: 2577608 - RNA, 23 nt, Coxiella burnetii RSA 493
uucagaauccaacgguucucaaa

SEQ ID NO: 2577609 - RNA, 13 nt, Coxiella burnetii RSA 493
uucagauuuuuua

SEQ ID NO: 2577610 - RNA, 15 nt, Coxiella burnetii RSA 493
uucagcuagccauug

SEQ ID NO: 2577611 - RNA, 17 nt, Coxiella burnetii RSA 493
uucaggauuaauuuuca

SEQ ID NO: 2577612 - RNA, 20 nt, Coxiella burnetii RSA 493
uucaguucgggccuucacuu

SEQ ID NO: 2577613 - RNA, 16 nt, Coxiella burnetii RSA 493
uucauaaaaaaugauu

SEQ ID NO: 2577614 - RNA, 13 nt, Coxiella burnetii RSA 493
uucauaaauaauu

SEQ ID NO: 2577615 - RNA, 21 nt, Coxiella burnetii RSA 493
uucauaagcgcuuuuggcuac

SEQ ID NO: 2577616 - RNA, 18 nt, Coxiella burnetii RSA 493
uucauaaggccaauuucu

SEQ ID NO: 2577617 - RNA, 20 nt, Coxiella burnetii RSA 493
uucauaaguccgcuuuuccc

SEQ ID NO: 2577618 - RNA, 20 nt, Coxiella burnetii RSA 493
uucauaaucaaaaucagaaa

SEQ ID NO: 2577619 - RNA, 14 nt, Coxiella burnetii RSA 493
uucauaucuuuuuc

SEQ ID NO: 2577620 - RNA, 18 nt, Coxiella burnetii RSA 493
uucauaucuuuuucaauu

SEQ ID NO: 2577621 - RNA, 19 nt, Coxiella burnetii RSA 493
uucaucaaaucaauaauca

SEQ ID NO: 2577622 - RNA, 16 nt, Coxiella burnetii RSA 493
uucauccaaaauuuga

SEQ ID NO: 2577623 - RNA, 17 nt, Coxiella burnetii RSA 493
uucauccagugaaaacc

SEQ ID NO: 2577624 - RNA, 19 nt, Coxiella burnetii RSA 493
uucauccagugaaaacccg

SEQ ID NO: 2577625 - RNA, 19 nt, Coxiella burnetii RSA 493
uucaucccccgcuguuuau

SEQ ID NO: 2577626 - RNA, 20 nt, Coxiella burnetii RSA 493
uucaucgccuugcaaacaaa

SEQ ID NO: 2577627 - RNA, 14 nt, Coxiella burnetii RSA 493
uucaugaaaaagau

SEQ ID NO: 2577628 - RNA, 20 nt, Coxiella burnetii RSA 493
uucaugacaauuuaauaauu

SEQ ID NO: 2577629 - RNA, 16 nt, Coxiella burnetii RSA 493
uucaugagaggaugca

SEQ ID NO: 2577630 - RNA, 13 nt, Coxiella burnetii RSA 493
uucauuaaauccg

SEQ ID NO: 2577631 - RNA, 23 nt, Coxiella burnetii RSA 493
uucauuaauccaguuuuuuaacu

SEQ ID NO: 2577632 - RNA, 21 nt, Coxiella burnetii RSA 493
uucauuaucaugcauuugauu

SEQ ID NO: 2577633 - RNA, 13 nt, Coxiella burnetii RSA 493
uucauucgcuuuu

SEQ ID NO: 2577634 - RNA, 22 nt, Coxiella burnetii RSA 493
uucauugagcgggauauuuuuu

SEQ ID NO: 2577635 - RNA, 15 nt, Coxiella burnetii RSA 493
uucauuuaauaaauc

SEQ ID NO: 2577636 - RNA, 17 nt, Coxiella burnetii RSA 493
uucauuuaauuuuaaau

SEQ ID NO: 2577637 - RNA, 23 nt, Coxiella burnetii RSA 493
uucauuuucucuaaugauaaucc

SEQ ID NO: 2577638 - RNA, 14 nt, Coxiella burnetii RSA 493
uucauuuuuuuugc

SEQ ID NO: 2577639 - RNA, 17 nt, Coxiella burnetii RSA 493
uuccaaaaaauuaagag

SEQ ID NO: 2577640 - RNA, 12 nt, Coxiella burnetii RSA 493
uuccaaaaacau

SEQ ID NO: 2577641 - RNA, 13 nt, Coxiella burnetii RSA 493
uuccaaaaacauu

SEQ ID NO: 2577642 - RNA, 14 nt, Coxiella burnetii RSA 493
uuccaaaaauuuca

SEQ ID NO: 2577643 - RNA, 22 nt, Coxiella burnetii RSA 493
uuccaaacuacucucaaaauca

SEQ ID NO: 2577644 - RNA, 14 nt, Coxiella burnetii RSA 493
uuccaaagcagaua

SEQ ID NO: 2577645 - RNA, 20 nt, Coxiella burnetii RSA 493
uuccaaagcagauaaauguu

SEQ ID NO: 2577646 - RNA, 13 nt, Coxiella burnetii RSA 493
uuccaaauaaucg

SEQ ID NO: 2577647 - RNA, 19 nt, Coxiella burnetii RSA 493
uuccaagcgauuaaauauu

SEQ ID NO: 2577648 - RNA, 17 nt, Coxiella burnetii RSA 493
uuccaauuguuugaaaa

SEQ ID NO: 2577649 - RNA, 22 nt, Coxiella burnetii RSA 493
uuccacgcauacgaucuauauu

SEQ ID NO: 2577650 - RNA, 15 nt, Coxiella burnetii RSA 493
uuccagauuuaguaa

SEQ ID NO: 2577651 - RNA, 19 nt, Coxiella burnetii RSA 493
uuccagcaguaaugagcau

SEQ ID NO: 2577652 - RNA, 15 nt, Coxiella burnetii RSA 493
uuccagugacucauc

SEQ ID NO: 2577653 - RNA, 23 nt, Coxiella burnetii RSA 493
uuccauaauaacgcuaugaaaac

SEQ ID NO: 2577654 - RNA, 15 nt, Coxiella burnetii RSA 493
uuccauaauguuuga

SEQ ID NO: 2577655 - RNA, 17 nt, Coxiella burnetii RSA 493
uuccauacuaauuucag

SEQ ID NO: 2577656 - RNA, 18 nt, Coxiella burnetii RSA 493
uuccaucaccuucaacgg

SEQ ID NO: 2577657 - RNA, 22 nt, Coxiella burnetii RSA 493
uuccauccgcgucauaccggcg

SEQ ID NO: 2577658 - RNA, 15 nt, Coxiella burnetii RSA 493
uuccaugaggccaaa

SEQ ID NO: 2577659 - RNA, 12 nt, Coxiella burnetii RSA 493
uuccauuaaaaa

SEQ ID NO: 2577660 - RNA, 14 nt, Coxiella burnetii RSA 493
uuccauuaaaaaca

SEQ ID NO: 2577661 - RNA, 11 nt, Coxiella burnetii RSA 493
uuccauuuuuu

SEQ ID NO: 2577662 - RNA, 21 nt, Coxiella burnetii RSA 493
uucccaauguuuccaaauaau

SEQ ID NO: 2577663 - RNA, 16 nt, Coxiella burnetii RSA 493
uucccacaaaauaccc

SEQ ID NO: 2577664 - RNA, 15 nt, Coxiella burnetii RSA 493
uucccaggaaagaaa

SEQ ID NO: 2577665 - RNA, 16 nt, Coxiella burnetii RSA 493
uucccaggaaagaaaa

SEQ ID NO: 2577666 - RNA, 17 nt, Coxiella burnetii RSA 493
uucccaggaaagaaaau

SEQ ID NO: 2577667 - RNA, 13 nt, Coxiella burnetii RSA 493
uucuucaucuaaa

SEQ ID NO: 2577668 - RNA, 13 nt, Coxiella burnetii RSA 493
uucuucauuugaa

SEQ ID NO: 2577669 - RNA, 19 nt, Coxiella burnetii RSA 493
uucuucuaaugauugcucu

SEQ ID NO: 2577670 - RNA, 11 nt, Coxiella burnetii RSA 493
uucuucuuuuc

SEQ ID NO: 2577671 - RNA, 23 nt, Coxiella burnetii RSA 493
uucuugaaaaacuuccgccacua

SEQ ID NO: 2577672 - RNA, 23 nt, Coxiella burnetii RSA 493
uucuugaacaggagcgauaaaau

SEQ ID NO: 2577673 - RNA, 14 nt, Coxiella burnetii RSA 493
uucuuguaaggauu

SEQ ID NO: 2577674 - RNA, 16 nt, Coxiella burnetii RSA 493
uucuugucauucccuu

SEQ ID NO: 2577675 - RNA, 13 nt, Coxiella burnetii RSA 493
uucuuucaauauc

SEQ ID NO: 2577676 - RNA, 15 nt, Coxiella burnetii RSA 493
uucuuucacuaaaag

SEQ ID NO: 2577677 - RNA, 16 nt, Coxiella burnetii RSA 493
uucuuucauuaauucc

SEQ ID NO: 2577678 - RNA, 20 nt, Coxiella burnetii RSA 493
uucuuuccagccuuuaguuu

SEQ ID NO: 2577679 - RNA, 16 nt, Coxiella burnetii RSA 493
uucuuuccagcuuccc

SEQ ID NO: 2577680 - RNA, 19 nt, Coxiella burnetii RSA 493
uucuuucuucacuuuccuu

SEQ ID NO: 2577681 - RNA, 15 nt, Coxiella burnetii RSA 493
uucuuugauaaaaga

SEQ ID NO: 2577682 - RNA, 11 nt, Coxiella burnetii RSA 493
uucuuugcuuu

SEQ ID NO: 2577683 - RNA, 19 nt, Coxiella burnetii RSA 493
uucuuuuaaagugauuuuu

SEQ ID NO: 2577684 - RNA, 12 nt, Coxiella burnetii RSA 493
uucuuuuauuaa

SEQ ID NO: 2577685 - RNA, 13 nt, Coxiella burnetii RSA 493
uucuuuuauuaaa

SEQ ID NO: 2577686 - RNA, 20 nt, Coxiella burnetii RSA 493
uucuuuuauuucuuuugccu

SEQ ID NO: 2577687 - RNA, 22 nt, Coxiella burnetii RSA 493
uucuuuuggaagcggauaaauc

SEQ ID NO: 2577688 - RNA, 18 nt, Coxiella burnetii RSA 493
uucuuuuucaaucgcuuu

SEQ ID NO: 2577689 - RNA, 14 nt, Coxiella burnetii RSA 493
uucuuuuuccaugu

SEQ ID NO: 2577690 - RNA, 19 nt, Coxiella burnetii RSA 493
uucuuuuuuagcuuucguc

SEQ ID NO: 2577691 - RNA, 13 nt, Coxiella burnetii RSA 493
uugaaaaauaaaa

SEQ ID NO: 2577692 - RNA, 17 nt, Coxiella burnetii RSA 493
uugaaaaauaaaaggag

SEQ ID NO: 2577693 - RNA, 17 nt, Coxiella burnetii RSA 493
uugaaaaauugaaagaa

SEQ ID NO: 2577694 - RNA, 16 nt, Coxiella burnetii RSA 493
uugaaaacguuauugu

SEQ ID NO: 2577695 - RNA, 19 nt, Coxiella burnetii RSA 493
uugaaaacguuauuguuaa

SEQ ID NO: 2577696 - RNA, 13 nt, Coxiella burnetii RSA 493
uugaaagaaaaaa

SEQ ID NO: 2577697 - RNA, 21 nt, Coxiella burnetii RSA 493
uugaaagaaaaaaaaccaaug

SEQ ID NO: 2577698 - RNA, 23 nt, Coxiella burnetii RSA 493
uugaaagaauuucucgauaaaaa

SEQ ID NO: 2577699 - RNA, 14 nt, Coxiella burnetii RSA 493
uugaaauagccauu

SEQ ID NO: 2577700 - RNA, 20 nt, Coxiella burnetii RSA 493
uugaacggcaaaaccaauag

SEQ ID NO: 2577701 - RNA, 15 nt, Coxiella burnetii RSA 493
uugaagcauauaacu

SEQ ID NO: 2577702 - RNA, 23 nt, Coxiella burnetii RSA 493
uugaauacaacgcuguuaaaauc

SEQ ID NO: 2577703 - RNA, 12 nt, Coxiella burnetii RSA 493
uugaaucaaauu

SEQ ID NO: 2577704 - RNA, 14 nt, Coxiella burnetii RSA 493
uugaauccucagua

SEQ ID NO: 2577705 - RNA, 19 nt, Coxiella burnetii RSA 493
uugaaugcguucuuuaauc

SEQ ID NO: 2577706 - RNA, 13 nt, Coxiella burnetii RSA 493
uugaauuccuugu

SEQ ID NO: 2577707 - RNA, 20 nt, Coxiella burnetii RSA 493
uugacaccacgcuaaauggu

SEQ ID NO: 2577708 - RNA, 20 nt, Coxiella burnetii RSA 493
uugacaccuuuggcaauaau

SEQ ID NO: 2577709 - RNA, 23 nt, Coxiella burnetii RSA 493
uugacccgaaaagucguguuagg

SEQ ID NO: 2577710 - RNA, 17 nt, Coxiella burnetii RSA 493
uugagaacguuucccaa

SEQ ID NO: 2577711 - RNA, 14 nt, Coxiella burnetii RSA 493
uugagaaguaaaaa

SEQ ID NO: 2577712 - RNA, 20 nt, Coxiella burnetii RSA 493
uugagaguccuaaaauacuu

SEQ ID NO: 2577713 - RNA, 13 nt, Coxiella burnetii RSA 493
uugaggaaaauaa

SEQ ID NO: 2577714 - RNA, 18 nt, Coxiella burnetii RSA 493
uugaggucguuaaaaaau

SEQ ID NO: 2577715 - RNA, 17 nt, Coxiella burnetii RSA 493
uugaguaaccucuccau

SEQ ID NO: 2577716 - RNA, 18 nt, Coxiella burnetii RSA 493
uugaguaaugguuuugau

SEQ ID NO: 2577717 - RNA, 18 nt, Coxiella burnetii RSA 493
uugaguaggacucuagga

SEQ ID NO: 2577718 - RNA, 23 nt, Coxiella burnetii RSA 493
uugaguggugguagaauucuccc

SEQ ID NO: 2577719 - RNA, 16 nt, Coxiella burnetii RSA 493
uugaguuagcauaucg

SEQ ID NO: 2577720 - RNA, 15 nt, Coxiella burnetii RSA 493
uugaguuuuugacaa

SEQ ID NO: 2577721 - RNA, 17 nt, Coxiella burnetii RSA 493
uugauaggauuauuauc

SEQ ID NO: 2577722 - RNA, 19 nt, Coxiella burnetii RSA 493
uugauaucaaucgaaaaaa

SEQ ID NO: 2577723 - RNA, 16 nt, Coxiella burnetii RSA 493
uugauauccuucuuuu

SEQ ID NO: 2577724 - RNA, 21 nt, Coxiella burnetii RSA 493
uugauaucgaccauuaaccaa

SEQ ID NO: 2577725 - RNA, 13 nt, Coxiella burnetii RSA 493
uugauccuugagg

SEQ ID NO: 2577726 - RNA, 15 nt, Coxiella burnetii RSA 493
uugaucuaaucgucu

SEQ ID NO: 2577727 - RNA, 22 nt, Coxiella burnetii RSA 493
uugaucuaaucgucuugaccaa

SEQ ID NO: 2577728 - RNA, 21 nt, Coxiella burnetii RSA 493
uugaugaauuaugcaagguug

SEQ ID NO: 2577729 - RNA, 21 nt, Coxiella burnetii RSA 493
uugauuaauaauguuauuaaa

SEQ ID NO: 2577730 - RNA, 13 nt, Coxiella burnetii RSA 493
uugauuaauuaau

SEQ ID NO: 2577731 - RNA, 19 nt, Coxiella burnetii RSA 493
uugauuagcaucuugaauc

SEQ ID NO: 2577732 - RNA, 14 nt, Coxiella burnetii RSA 493
uugauucaauaauc

SEQ ID NO: 2577733 - RNA, 21 nt, Coxiella burnetii RSA 493
uugauuuaaauuuaaaguuuc

SEQ ID NO: 2577734 - RNA, 15 nt, Coxiella burnetii RSA 493
uugauuuuuuaauuc

SEQ ID NO: 2577735 - RNA, 18 nt, Coxiella burnetii RSA 493
uugcaauaacaaauaaac

SEQ ID NO: 2577736 - RNA, 19 nt, Coxiella burnetii RSA 493
uugcaauaacaaauaaacc

SEQ ID NO: 2577737 - RNA, 22 nt, Coxiella burnetii RSA 493
uugcaauacaccggaaauuuuu

SEQ ID NO: 2577738 - RNA, 16 nt, Coxiella burnetii RSA 493
uugcaauagucacgag

SEQ ID NO: 2577739 - RNA, 14 nt, Coxiella burnetii RSA 493
uugcaauccuuuuu

SEQ ID NO: 2577740 - RNA, 18 nt, Coxiella burnetii RSA 493
uugcagcaucccccaaga

SEQ ID NO: 2577741 - RNA, 15 nt, Coxiella burnetii RSA 493
uugcagguugaccac

SEQ ID NO: 2577742 - RNA, 14 nt, Coxiella burnetii RSA 493
uugcagugaaauaa

SEQ ID NO: 2577743 - RNA, 17 nt, Coxiella burnetii RSA 493
uugcagugaaauaaccu

SEQ ID NO: 2577744 - RNA, 16 nt, Coxiella burnetii RSA 493
uugcauuguuuucuua

SEQ ID NO: 2577745 - RNA, 13 nt, Coxiella burnetii RSA 493
uugcauuucuuuc

SEQ ID NO: 2577746 - RNA, 15 nt, Coxiella burnetii RSA 493
uugcauuucuuucaa

SEQ ID NO: 2577747 - RNA, 18 nt, Coxiella burnetii RSA 493
uugccacacauaaaugcu

SEQ ID NO: 2577748 - RNA, 13 nt, Coxiella burnetii RSA 493
uugccauauaauu

SEQ ID NO: 2577749 - RNA, 15 nt, Coxiella burnetii RSA 493
uugccccaugaguuc

SEQ ID NO: 2577750 - RNA, 16 nt, Coxiella burnetii RSA 493
uugcccgguaacauac

SEQ ID NO: 2577751 - RNA, 15 nt, Coxiella burnetii RSA 493
uugccgaggcaaaau

SEQ ID NO: 2577752 - RNA, 17 nt, Coxiella burnetii RSA 493
uugccggacuuuuucaa

SEQ ID NO: 2577753 - RNA, 18 nt, Coxiella burnetii RSA 493
uugccggacuuuuucaau

SEQ ID NO: 2577754 - RNA, 19 nt, Coxiella burnetii RSA 493
uugcgcucauuuucacuau

SEQ ID NO: 2577755 - RNA, 15 nt, Coxiella burnetii RSA 493
uugcggaaaaggaga

SEQ ID NO: 2577756 - RNA, 15 nt, Coxiella burnetii RSA 493
uugcggaaauuucac

SEQ ID NO: 2577757 - RNA, 23 nt, Coxiella burnetii RSA 493
uugcggaauucaggacugaaaua

SEQ ID NO: 2577758 - RNA, 13 nt, Coxiella burnetii RSA 493
uugcggcgauaau

SEQ ID NO: 2577759 - RNA, 13 nt, Coxiella burnetii RSA 493
uugcguaaauggu

SEQ ID NO: 2577760 - RNA, 18 nt, Coxiella burnetii RSA 493
uugcguaaugcaaugaau

SEQ ID NO: 2577761 - RNA, 22 nt, Coxiella burnetii RSA 493
uugcguauuuguucguaauaau

SEQ ID NO: 2577762 - RNA, 14 nt, Coxiella burnetii RSA 493
uugcuaaauguuua

SEQ ID NO: 2577763 - RNA, 16 nt, Coxiella burnetii RSA 493
uugcuaacaauuguug

SEQ ID NO: 2577764 - RNA, 22 nt, Coxiella burnetii RSA 493
uugcuaacuccacgaucugagu

SEQ ID NO: 2577765 - RNA, 17 nt, Coxiella burnetii RSA 493
uugcuaagauaauuaca

SEQ ID NO: 2577766 - RNA, 16 nt, Coxiella burnetii RSA 493
uugcucaaguccuugc

SEQ ID NO: 2577767 - RNA, 15 nt, Coxiella burnetii RSA 493
uugcuccaaacagac

SEQ ID NO: 2577768 - RNA, 13 nt, Coxiella burnetii RSA 493
uugcucccaagcg

SEQ ID NO: 2577769 - RNA, 19 nt, Coxiella burnetii RSA 493
uugcucuuuguuuauuuga

SEQ ID NO: 2577770 - RNA, 14 nt, Coxiella burnetii RSA 493
uugcugaacaaaag

SEQ ID NO: 2577771 - RNA, 13 nt, Coxiella burnetii RSA 493
uugcugaccuuuu

SEQ ID NO: 2577772 - RNA, 21 nt, Coxiella burnetii RSA 493
uugcuggagaucacuggacca

SEQ ID NO: 2577773 - RNA, 14 nt, Coxiella burnetii RSA 493
uuuauauuccugaa

SEQ ID NO: 2577774 - RNA, 15 nt, Coxiella burnetii RSA 493
uuuaucaaacguuua

SEQ ID NO: 2577775 - RNA, 18 nt, Coxiella burnetii RSA 493
uuuaucacuccaauaaua

SEQ ID NO: 2577776 - RNA, 21 nt, Coxiella burnetii RSA 493
uuuauccaaaucggcaaauac

SEQ ID NO: 2577777 - RNA, 23 nt, Coxiella burnetii RSA 493
uuuaugacgguuauguacucagc

SEQ ID NO: 2577778 - RNA, 14 nt, Coxiella burnetii RSA 493
uuuauuaaaaacua

SEQ ID NO: 2577779 - RNA, 15 nt, Coxiella burnetii RSA 493
uuuauuaaaaacuau

SEQ ID NO: 2577780 - RNA, 15 nt, Coxiella burnetii RSA 493
uuuauucaacucuua

SEQ ID NO: 2577781 - RNA, 16 nt, Coxiella burnetii RSA 493
uuuauucccagauaaa

SEQ ID NO: 2577782 - RNA, 21 nt, Coxiella burnetii RSA 493
uuuauucuccauaacaaugga

SEQ ID NO: 2577783 - RNA, 17 nt, Coxiella burnetii RSA 493
uuuauucuucugccuuu

SEQ ID NO: 2577784 - RNA, 22 nt, Coxiella burnetii RSA 493
uuuauuugaaauagccauuaau

SEQ ID NO: 2577785 - RNA, 12 nt, Coxiella burnetii RSA 493
uuucaaagauau

SEQ ID NO: 2577786 - RNA, 16 nt, Coxiella burnetii RSA 493
uuucaaagauaucguc

SEQ ID NO: 2577787 - RNA, 14 nt, Coxiella burnetii RSA 493
uuucaaaugaauaa

SEQ ID NO: 2577788 - RNA, 14 nt, Coxiella burnetii RSA 493
uuucaacauauuuc

SEQ ID NO: 2577789 - RNA, 16 nt, Coxiella burnetii RSA 493
uuucaacauauuucuu

SEQ ID NO: 2577790 - RNA, 14 nt, Coxiella burnetii RSA 493
uuucaacgccucuc

SEQ ID NO: 2577791 - RNA, 19 nt, Coxiella burnetii RSA 493
uuucaacgccucucucaua

SEQ ID NO: 2577792 - RNA, 21 nt, Coxiella burnetii RSA 493
uuucaacuacuugauauuccc

SEQ ID NO: 2577793 - RNA, 19 nt, Coxiella burnetii RSA 493
uuucaagaacgauuucccg

SEQ ID NO: 2577794 - RNA, 19 nt, Coxiella burnetii RSA 493
uuucaauaaauaaaucaag

SEQ ID NO: 2577795 - RNA, 13 nt, Coxiella burnetii RSA 493
uuucaauaacaga

SEQ ID NO: 2577796 - RNA, 15 nt, Coxiella burnetii RSA 493
uuucaauauuucuug

SEQ ID NO: 2577797 - RNA, 18 nt, Coxiella burnetii RSA 493
uuucaaucgcuuuucguu

SEQ ID NO: 2577798 - RNA, 17 nt, Coxiella burnetii RSA 493
uuucaaugccauuuuua

SEQ ID NO: 2577799 - RNA, 17 nt, Coxiella burnetii RSA 493
uuucaauggauucuucu

SEQ ID NO: 2577800 - RNA, 18 nt, Coxiella burnetii RSA 493
uuucaauguauccgggcc

SEQ ID NO: 2577801 - RNA, 13 nt, Coxiella burnetii RSA 493
uuucaauuucuuu

SEQ ID NO: 2577802 - RNA, 20 nt, Coxiella burnetii RSA 493
uuucacacguaucugcuaaa

SEQ ID NO: 2577803 - RNA, 22 nt, Coxiella burnetii RSA 493
uuucacacguaucugcuaaaaa

SEQ ID NO: 2577804 - RNA, 16 nt, Coxiella burnetii RSA 493
uuucaccguuuucuau

SEQ ID NO: 2577805 - RNA, 18 nt, Coxiella burnetii RSA 493
uuucacgaauuaaaaaau

SEQ ID NO: 2577806 - RNA, 21 nt, Coxiella burnetii RSA 493
uuucacgaauuaaaaaauuca

SEQ ID NO: 2577807 - RNA, 17 nt, Coxiella burnetii RSA 493
uuucacgauuuuucuca

SEQ ID NO: 2577808 - RNA, 18 nt, Coxiella burnetii RSA 493
uuucacgauuuuucucau

SEQ ID NO: 2577809 - RNA, 14 nt, Coxiella burnetii RSA 493
uuucacuaauuaua

SEQ ID NO: 2577810 - RNA, 14 nt, Coxiella burnetii RSA 493
uuucagauuuuuua

SEQ ID NO: 2577811 - RNA, 17 nt, Coxiella burnetii RSA 493
uuucaggauuaauuuuc

SEQ ID NO: 2577812 - RNA, 20 nt, Coxiella burnetii RSA 493
uuucaggcgccugcaaaauc

SEQ ID NO: 2577813 - RNA, 15 nt, Coxiella burnetii RSA 493
uuucauaaaucaacu

SEQ ID NO: 2577814 - RNA, 14 nt, Coxiella burnetii RSA 493
uuucauccaaaaua

SEQ ID NO: 2577815 - RNA, 14 nt, Coxiella burnetii RSA 493
uuucaucuugcugc

SEQ ID NO: 2577816 - RNA, 13 nt, Coxiella burnetii RSA 493
uuucaucuuguaa

SEQ ID NO: 2577817 - RNA, 19 nt, Coxiella burnetii RSA 493
uuucauguaauuuauccca

SEQ ID NO: 2577818 - RNA, 16 nt, Coxiella burnetii RSA 493
uuucauuaagcaauuu

SEQ ID NO: 2577819 - RNA, 18 nt, Coxiella burnetii RSA 493
uuucauuaagcaauuuuu

SEQ ID NO: 2577820 - RNA, 20 nt, Coxiella burnetii RSA 493
uuucauuaagcaauuuuuua

SEQ ID NO: 2577821 - RNA, 12 nt, Coxiella burnetii RSA 493
uuucauucucuu

SEQ ID NO: 2577822 - RNA, 13 nt, Coxiella burnetii RSA 493
uuucauuuucucu

SEQ ID NO: 2577823 - RNA, 14 nt, Coxiella burnetii RSA 493
uuuccaaaaaauua

SEQ ID NO: 2577824 - RNA, 18 nt, Coxiella burnetii RSA 493
uuuccaacccagcuaugg

SEQ ID NO: 2577825 - RNA, 13 nt, Coxiella burnetii RSA 493
uuuccacgcauac

SEQ ID NO: 2577826 - RNA, 15 nt, Coxiella burnetii RSA 493
uuuccacgcauacga

SEQ ID NO: 2577827 - RNA, 19 nt, Coxiella burnetii RSA 493
uuuccaucaccuucaacgg

SEQ ID NO: 2577828 - RNA, 19 nt, Coxiella burnetii RSA 493
uuuccauguuuacauuaag

SEQ ID NO: 2577829 - RNA, 23 nt, Coxiella burnetii RSA 493
uuucccaaaugacgaucgucuaa

SEQ ID NO: 2577830 - RNA, 14 nt, Coxiella burnetii RSA 493
uuuccccccaacua

SEQ ID NO: 2577831 - RNA, 15 nt, Coxiella burnetii RSA 493
uuuccccuucuucgg

SEQ ID NO: 2577832 - RNA, 21 nt, Coxiella burnetii RSA 493
uuucccgacuguucaucugug

SEQ ID NO: 2577833 - RNA, 20 nt, Coxiella burnetii RSA 493
uuucccgcuccagauuucuu

SEQ ID NO: 2577834 - RNA, 17 nt, Coxiella burnetii RSA 493
uuucccguauuucgcuu

SEQ ID NO: 2577835 - RNA, 18 nt, Coxiella burnetii RSA 493
uuucccguauuucgcuuc

SEQ ID NO: 2577836 - RNA, 19 nt, Coxiella burnetii RSA 493
uuucccguauuucgcuucg

SEQ ID NO: 2577837 - RNA, 23 nt, Coxiella burnetii RSA 493
uuuccgaguauuuauuaaaaacu

SEQ ID NO: 2577838 - RNA, 16 nt, Coxiella burnetii RSA 493
uuuccggagugacagu

SEQ ID NO: 2577839 - RNA, 22 nt, Coxiella burnetii RSA 493
uuuccuagauuuuggcucccua

SEQ ID NO: 2577840 - RNA, 13 nt, Coxiella burnetii RSA 493
uuuccugaacagg

SEQ ID NO: 2577841 - RNA, 19 nt, Coxiella burnetii RSA 493
uuuccugucguuaauacga

SEQ ID NO: 2577842 - RNA, 20 nt, Coxiella burnetii RSA 493
uuuccugucguuaauacgau

SEQ ID NO: 2577843 - RNA, 12 nt, Coxiella burnetii RSA 493
uuuccuguuuuu

SEQ ID NO: 2577844 - RNA, 15 nt, Coxiella burnetii RSA 493
uuuccuuaaaagcgc

SEQ ID NO: 2577845 - RNA, 13 nt, Coxiella burnetii RSA 493
uuuccuucguuuc

SEQ ID NO: 2577846 - RNA, 20 nt, Coxiella burnetii RSA 493
uuuccuucguuucuuccauu

SEQ ID NO: 2577847 - RNA, 15 nt, Coxiella burnetii RSA 493
uuuccuuucuuucuu

SEQ ID NO: 2577848 - RNA, 15 nt, Coxiella burnetii RSA 493
uuucgagaauauauu

SEQ ID NO: 2577849 - RNA, 21 nt, Coxiella burnetii RSA 493
uuucgagaauauauucauauc

SEQ ID NO: 2577850 - RNA, 19 nt, Coxiella burnetii RSA 493
uuucgagauuauuauacgg

SEQ ID NO: 2577851 - RNA, 20 nt, Coxiella burnetii RSA 493
uuucgagcgcgauuuucucu

SEQ ID NO: 2577852 - RNA, 20 nt, Coxiella burnetii RSA 493
uuucgcuucgcuacauacgg

SEQ ID NO: 2577853 - RNA, 19 nt, Coxiella burnetii RSA 493
uuucgcuucgcucauacgu

SEQ ID NO: 2577854 - RNA, 19 nt, Coxiella burnetii RSA 493
uuucgcuucgcugcauacg

SEQ ID NO: 2577855 - RNA, 20 nt, Coxiella burnetii RSA 493
uuucgcuucgcugcauacgg

SEQ ID NO: 2577856 - RNA, 14 nt, Coxiella burnetii RSA 493
uuucgcuuuuauuu

SEQ ID NO: 2577857 - RNA, 15 nt, Coxiella burnetii RSA 493
uuucggacaacaaau

SEQ ID NO: 2577858 - RNA, 23 nt, Coxiella burnetii RSA 493
uuucggggcggcuuuuuucgcuu

SEQ ID NO: 2577859 - RNA, 13 nt, Coxiella burnetii RSA 493
uuucgggguuaug

SEQ ID NO: 2577860 - RNA, 19 nt, Coxiella burnetii RSA 493
uuucggugcuagcgcucca

SEQ ID NO: 2577861 - RNA, 15 nt, Coxiella burnetii RSA 493
uuucgucuguuucuu

SEQ ID NO: 2577862 - RNA, 17 nt, Coxiella burnetii RSA 493
uuucgucuguuucuugg

SEQ ID NO: 2577863 - RNA, 13 nt, Coxiella burnetii RSA 493
uuucuaaaaauca

SEQ ID NO: 2577864 - RNA, 22 nt, Coxiella burnetii RSA 493
uuucuaagacacguucuggaau

SEQ ID NO: 2577865 - RNA, 23 nt, Coxiella burnetii RSA 493
uuucuaauucguugcauucaaua

SEQ ID NO: 2577866 - RNA, 15 nt, Coxiella burnetii RSA 493
uuucuauauuuucuu

SEQ ID NO: 2577867 - RNA, 21 nt, Coxiella burnetii RSA 493
uuucuauuagccuuaauuucu

SEQ ID NO: 2577868 - RNA, 16 nt, Coxiella burnetii RSA 493
uuucucaauagaaaaa

SEQ ID NO: 2577869 - RNA, 13 nt, Coxiella burnetii RSA 493
uuucucaauuucu

SEQ ID NO: 2577870 - RNA, 16 nt, Coxiella burnetii RSA 493
uuucucaauuucucgu

SEQ ID NO: 2577871 - RNA, 14 nt, Coxiella burnetii RSA 493
uuucucaucauuuu

SEQ ID NO: 2577872 - RNA, 16 nt, Coxiella burnetii RSA 493
uuucucuuuuaacuua

SEQ ID NO: 2577873 - RNA, 19 nt, Coxiella burnetii RSA 493
uuucugagcuuguuuuugg

SEQ ID NO: 2577874 - RNA, 22 nt, Coxiella burnetii RSA 493
uuucugcgauuuuguuucuuug

SEQ ID NO: 2577875 - RNA, 23 nt, Coxiella burnetii RSA 493
uuucugggagauuuauuccugug

SEQ ID NO: 2577876 - RNA, 23 nt, Coxiella burnetii RSA 493
uuucugugguuaauucuucuuca

SEQ ID NO: 2577877 - RNA, 19 nt, Coxiella burnetii RSA 493
uuucuucacggauaauauc

SEQ ID NO: 2577878 - RNA, 22 nt, Coxiella burnetii RSA 493
uuuuauuguuaaucgucauucc

SEQ ID NO: 2577879 - RNA, 13 nt, Coxiella burnetii RSA 493
uuuuauuuaaaaa

SEQ ID NO: 2577880 - RNA, 23 nt, Coxiella burnetii RSA 493
uuuuauuuaaaaaacuagaaaua

SEQ ID NO: 2577881 - RNA, 12 nt, Coxiella burnetii RSA 493
uuuuauuuccag

SEQ ID NO: 2577882 - RNA, 14 nt, Coxiella burnetii RSA 493
uuuuauuuucaaau

SEQ ID NO: 2577883 - RNA, 13 nt, Coxiella burnetii RSA 493
uuuuauuuuuaau

SEQ ID NO: 2577884 - RNA, 22 nt, Coxiella burnetii RSA 493
uuuucaaaacaaucaaugcagu

SEQ ID NO: 2577885 - RNA, 18 nt, Coxiella burnetii RSA 493
uuuucaacaaguaaagua

SEQ ID NO: 2577886 - RNA, 19 nt, Coxiella burnetii RSA 493
uuuucaucuuguaaucgcu

SEQ ID NO: 2577887 - RNA, 16 nt, Coxiella burnetii RSA 493
uuuucaugcaaaaacc

SEQ ID NO: 2577888 - RNA, 17 nt, Coxiella burnetii RSA 493
uuuucaugcaaaaaccg

SEQ ID NO: 2577889 - RNA, 23 nt, Coxiella burnetii RSA 493
uuuucauuucuucgaguuucgug

SEQ ID NO: 2577890 - RNA, 13 nt, Coxiella burnetii RSA 493
uuuucauuuugau

SEQ ID NO: 2577891 - RNA, 13 nt, Coxiella burnetii RSA 493
uuuucauuuuuuc

SEQ ID NO: 2577892 - RNA, 16 nt, Coxiella burnetii RSA 493
uuuuccaugaggccaa

SEQ ID NO: 2577893 - RNA, 20 nt, Coxiella burnetii RSA 493
uuuuccaugaggccaaaaau

SEQ ID NO: 2577894 - RNA, 21 nt, Coxiella burnetii RSA 493
uuuuccaugaggccaaaaauu

SEQ ID NO: 2577895 - RNA, 23 nt, Coxiella burnetii RSA 493
uuuuccccccaucccgaucaaaa

SEQ ID NO: 2577896 - RNA, 19 nt, Coxiella burnetii RSA 493
uuuucccguauuucgcuuc

SEQ ID NO: 2577897 - RNA, 22 nt, Coxiella burnetii RSA 493
uuuucccguauuucgcuucgcu

SEQ ID NO: 2577898 - RNA, 16 nt, Coxiella burnetii RSA 493
uuuuccgcuaaauauu

SEQ ID NO: 2577899 - RNA, 21 nt, Coxiella burnetii RSA 493
uuuuccggguuauauuuaauu

SEQ ID NO: 2577900 - RNA, 23 nt, Coxiella burnetii RSA 493
uuuucgauaaaugcaauuuuuua

SEQ ID NO: 2577901 - RNA, 15 nt, Coxiella burnetii RSA 493
uuuucgcugcgguca

SEQ ID NO: 2577902 - RNA, 14 nt, Coxiella burnetii RSA 493
uuuucggagaaauc

SEQ ID NO: 2577903 - RNA, 16 nt, Coxiella burnetii RSA 493
uuuucguaaaccuuua

SEQ ID NO: 2577904 - RNA, 15 nt, Coxiella burnetii RSA 493
uuuucguucugaaau

SEQ ID NO: 2577905 - RNA, 14 nt, Coxiella burnetii RSA 493
uuuucguuguuugg

SEQ ID NO: 2577906 - RNA, 16 nt, Coxiella burnetii RSA 493
uuuucucaauuucuuu

SEQ ID NO: 2577907 - RNA, 20 nt, Coxiella burnetii RSA 493
uuuucugccgcugauauucc

SEQ ID NO: 2577908 - RNA, 20 nt, Coxiella burnetii RSA 493
uuuucuggcuguacuuucac

SEQ ID NO: 2577909 - RNA, 21 nt, Coxiella burnetii RSA 493
uuuucugggagauuuauuccu

SEQ ID NO: 2577910 - RNA, 21 nt, Coxiella burnetii RSA 493
uuuucugugaaauaaacagag

SEQ ID NO: 2577911 - RNA, 23 nt, Coxiella burnetii RSA 493
uuuugaagcuauccaaauaaucg

SEQ ID NO: 2577912 - RNA, 14 nt, Coxiella burnetii RSA 493
uuuugaauuuugcc

SEQ ID NO: 2577913 - RNA, 21 nt, Coxiella burnetii RSA 493
uuuugaauuuuuugaaaaacu

SEQ ID NO: 2577914 - RNA, 13 nt, Coxiella burnetii RSA 493
uuuugauuuuuua

SEQ ID NO: 2577915 - RNA, 18 nt, Coxiella burnetii RSA 493
uuuugcaacuuccgcuac

SEQ ID NO: 2577916 - RNA, 19 nt, Coxiella burnetii RSA 493
uuuugcaggggauaaagug

SEQ ID NO: 2577917 - RNA, 12 nt, Coxiella burnetii RSA 493
uuuugcauuuuu

SEQ ID NO: 2577918 - RNA, 21 nt, Coxiella burnetii RSA 493
uuuugccaauauaaauaaucu

SEQ ID NO: 2577919 - RNA, 21 nt, Coxiella burnetii RSA 493
uuuugccgcgguaaggaacag

SEQ ID NO: 2577920 - RNA, 15 nt, Coxiella burnetii RSA 493
uuuugcguaaauggu

SEQ ID NO: 2577921 - RNA, 22 nt, Coxiella burnetii RSA 493
uuuugcucuaagcguaacguca

SEQ ID NO: 2577922 - RNA, 15 nt, Coxiella burnetii RSA 493
uuuuggaaugagcau

SEQ ID NO: 2577923 - RNA, 15 nt, Coxiella burnetii RSA 493
uuuuggcauccucau

SEQ ID NO: 2577924 - RNA, 17 nt, Coxiella burnetii RSA 493
uuuuguaaauuuuccca

SEQ ID NO: 2577925 - RNA, 15 nt, Coxiella burnetii RSA 493
uuuugucgaauuuuu

SEQ ID NO: 2577926 - RNA, 12 nt, Coxiella burnetii RSA 493
uuuuguuuuaag

SEQ ID NO: 2577927 - RNA, 18 nt, Coxiella burnetii RSA 493
uuuuguuuuuaagauuuu

SEQ ID NO: 2577928 - RNA, 15 nt, Coxiella burnetii RSA 493
uuuuuaaaaaauucc

SEQ ID NO: 2577929 - RNA, 20 nt, Coxiella burnetii RSA 493
uuuuuaaaagugacaaugcc

SEQ ID NO: 2577930 - RNA, 11 nt, Coxiella burnetii RSA 493
uuuuuaaaauu

SEQ ID NO: 2577931 - RNA, 16 nt, Coxiella burnetii RSA 493
uuuuuagugcaaaaaa

SEQ ID NO: 2577932 - RNA, 12 nt, Coxiella burnetii RSA 493
uuuuuauaaaug

SEQ ID NO: 2577933 - RNA, 23 nt, Coxiella burnetii RSA 493
uuuuuauaaggucuuaauuucua

SEQ ID NO: 2577934 - RNA, 12 nt, Coxiella burnetii RSA 493
uuuuuaugcuuc

SEQ ID NO: 2577935 - RNA, 13 nt, Coxiella burnetii RSA 493
uuuuuauucuucu

SEQ ID NO: 2577936 - RNA, 11 nt, Coxiella burnetii RSA 493
uuuuuauugga

SEQ ID NO: 2577937 - RNA, 14 nt, Coxiella burnetii RSA 493
uuuuuauuuucaaa

SEQ ID NO: 2577938 - RNA, 22 nt, Coxiella burnetii RSA 493
uuuuucaagcccuuuuuuucca

SEQ ID NO: 2577939 - RNA, 18 nt, Coxiella burnetii RSA 493
uuuuucacgauucaccac

SEQ ID NO: 2577940 - RNA, 17 nt, Coxiella burnetii RSA 493
uuuuucagucaccauug

SEQ ID NO: 2577941 - RNA, 13 nt, Coxiella burnetii RSA 493
uuuuucauccagu

SEQ ID NO: 2577942 - RNA, 15 nt, Coxiella burnetii RSA 493
uuuuucccgcaacau

SEQ ID NO: 2577943 - RNA, 14 nt, Coxiella burnetii RSA 493
uuuuucuccuuuuc

SEQ ID NO: 2577944 - RNA, 18 nt, Coxiella burnetii RSA 493
uuuuucuccuuuucccag

SEQ ID NO: 2577945 - RNA, 18 nt, Coxiella burnetii RSA 493
uuuuucucugcaaucgca

SEQ ID NO: 2577946 - RNA, 23 nt, Coxiella burnetii RSA 493
uuuuucuucugaauuaauuccca

SEQ ID NO: 2577947 - RNA, 13 nt, Coxiella burnetii RSA 493
uuuuucuuugcuu

SEQ ID NO: 2577948 - RNA, 16 nt, Coxiella burnetii RSA 493
uuuuugaaaguaguuu

SEQ ID NO: 2577949 - RNA, 21 nt, Coxiella burnetii RSA 493
uuuuugauuucguaaaacgau

SEQ ID NO: 2577950 - RNA, 19 nt, Coxiella burnetii RSA 493
uuuuuggcgcgaucaagac

SEQ ID NO: 2577951 - RNA, 22 nt, Coxiella burnetii RSA 493
uuuuuggcuugcuccaaaauaa

SEQ ID NO: 2577952 - RNA, 18 nt, Coxiella burnetii RSA 493
uuuuuguaauccuuguug

SEQ ID NO: 2577953 - RNA, 11 nt, Coxiella burnetii RSA 493
uuuuuuacuuu

SEQ ID NO: 2577954 - RNA, 17 nt, Coxiella burnetii RSA 493
uuuuuuggaaugagcau

SEQ ID NO: 2577955 - RNA, 10 nt, Coxiella burnetii RSA 493
uuuuuuuaaa

SEQ ID NO: 2577956 - RNA, 11 nt, Coxiella burnetii RSA 493
uuuuuuuaaaa

SEQ ID NO: 2577957 - RNA, 13 nt, Coxiella burnetii RSA 493
uuuuuuuugaaau

SEQ ID NO: 2577958 - RNA, 21 nt, Coxiella burnetii RSA 493
aaaaaccgacuuuuuacugca

SEQ ID NO: 2577959 - RNA, 14 nt, Coxiella burnetii RSA 493
aaaaaccuuuuaaa

SEQ ID NO: 2577960 - RNA, 18 nt, Coxiella burnetii RSA 493
aaaaacgccugaaauauu

SEQ ID NO: 2577961 - RNA, 19 nt, Coxiella burnetii RSA 493
aaaaacgccugaaauauuu

SEQ ID NO: 2577962 - RNA, 21 nt, Coxiella burnetii RSA 493
aaaaacggcgacaguauuucu

SEQ ID NO: 2577963 - RNA, 23 nt, Coxiella burnetii RSA 493
aaaaacuccgcugcuccacaaug

SEQ ID NO: 2577964 - RNA, 23 nt, Coxiella burnetii RSA 493
aaaaacuucaugcaaaaauuguu

SEQ ID NO: 2577965 - RNA, 18 nt, Coxiella burnetii RSA 493
aaaaacuuccgccacuaa

SEQ ID NO: 2577966 - RNA, 10 nt, Coxiella burnetii RSA 493
aaaaagaaaa

SEQ ID NO: 2577967 - RNA, 11 nt, Coxiella burnetii RSA 493
aaaaagaaaau

SEQ ID NO: 2577968 - RNA, 22 nt, Coxiella burnetii RSA 493
aaaaagcggauaagccauuaaa

SEQ ID NO: 2577969 - RNA, 17 nt, Coxiella burnetii RSA 493
aaaaaggugcccaagaa

SEQ ID NO: 2577970 - RNA, 22 nt, Coxiella burnetii RSA 493
aaaaaguucaccgcaaaguccu

SEQ ID NO: 2577971 - RNA, 20 nt, Coxiella burnetii RSA 493
aaaaaguuuagaaaaaugcu

SEQ ID NO: 2577972 - RNA, 17 nt, Coxiella burnetii RSA 493
aaaaauaaaaauuucau

SEQ ID NO: 2577973 - RNA, 13 nt, Coxiella burnetii RSA 493
aaaaauaauuuua

SEQ ID NO: 2577974 - RNA, 22 nt, Coxiella burnetii RSA 493
aaaaauacaagcugacaauagg

SEQ ID NO: 2577975 - RNA, 20 nt, Coxiella burnetii RSA 493
aaaaauacucuuucauaaaa

SEQ ID NO: 2577976 - RNA, 12 nt, Coxiella burnetii RSA 493
aaaaauaucccu

SEQ ID NO: 2577977 - RNA, 22 nt, Coxiella burnetii RSA 493
aaaaaucuuugcucuaaauuaa

SEQ ID NO: 2577978 - RNA, 19 nt, Coxiella burnetii RSA 493
aaaaauuaauauaaucagc

SEQ ID NO: 2577979 - RNA, 22 nt, Coxiella burnetii RSA 493
aaaaauuauuaaucauauaauu

SEQ ID NO: 2577980 - RNA, 14 nt, Coxiella burnetii RSA 493
aaaaauucaauaga

SEQ ID NO: 2577981 - RNA, 16 nt, Coxiella burnetii RSA 493
aaaaauuccaaaaaca

SEQ ID NO: 2577982 - RNA, 15 nt, Coxiella burnetii RSA 493
aaaaauucguuaaaa

SEQ ID NO: 2577983 - RNA, 21 nt, Coxiella burnetii RSA 493
aaaaauuugauuaaucguuuu

SEQ ID NO: 2577984 - RNA, 19 nt, Coxiella burnetii RSA 493
aaaacaacgaguuucgcuu

SEQ ID NO: 2577985 - RNA, 15 nt, Coxiella burnetii RSA 493
aaaacacauaucgcu

SEQ ID NO: 2577986 - RNA, 14 nt, Coxiella burnetii RSA 493
aaaacagcaauuaa

SEQ ID NO: 2577987 - RNA, 20 nt, Coxiella burnetii RSA 493
aaaaccaaaaaguuuauaaa

SEQ ID NO: 2577988 - RNA, 13 nt, Coxiella burnetii RSA 493
aaaaccaauacca

SEQ ID NO: 2577989 - RNA, 14 nt, Coxiella burnetii RSA 493
aaaaccaauaccaa

SEQ ID NO: 2577990 - RNA, 17 nt, Coxiella burnetii RSA 493
aaaaccuaaagaaagaa

SEQ ID NO: 2577991 - RNA, 24 nt, Coxiella burnetii RSA 493
aaaaccuacacguuaaauagccaa

SEQ ID NO: 2577992 - RNA, 16 nt, Coxiella burnetii RSA 493
aaaaccuacuuuucua

SEQ ID NO: 2577993 - RNA, 20 nt, Coxiella burnetii RSA 493
aaaaccuuguuauaaaacuu

SEQ ID NO: 2577994 - RNA, 16 nt, Coxiella burnetii RSA 493
aaaacgccugaaauau

SEQ ID NO: 2577995 - RNA, 22 nt, Coxiella burnetii RSA 493
aaaacgcgccccucaagcaaag

SEQ ID NO: 2577996 - RNA, 17 nt, Coxiella burnetii RSA 493
aaaacggcguauuuuuu

SEQ ID NO: 2577997 - RNA, 21 nt, Coxiella burnetii RSA 493
aaaacgggcauuggaaaaaac

SEQ ID NO: 2577998 - RNA, 18 nt, Coxiella burnetii RSA 493
aaaacgucgccugcuaaa

SEQ ID NO: 2577999 - RNA, 16 nt, Coxiella burnetii RSA 493
aaaacguuucaucaaa

SEQ ID NO: 2578000 - RNA, 13 nt, Coxiella burnetii RSA 493
aaaacucccauca

SEQ ID NO: 2578001 - RNA, 20 nt, Coxiella burnetii RSA 493
aaaacuggagcccauaaagc

SEQ ID NO: 2578002 - RNA, 16 nt, Coxiella burnetii RSA 493
aaaacuuccgccacua

SEQ ID NO: 2578003 - RNA, 13 nt, Coxiella burnetii RSA 493
aaaacuugauuau

SEQ ID NO: 2578004 - RNA, 13 nt, Coxiella burnetii RSA 493
aaaacuuucagga

SEQ ID NO: 2578005 - RNA, 23 nt, Coxiella burnetii RSA 493
aaaacuuuuuagggcugaaaaaa

SEQ ID NO: 2578006 - RNA, 12 nt, Coxiella burnetii RSA 493
aaaagaaaaucc

SEQ ID NO: 2578007 - RNA, 15 nt, Coxiella burnetii RSA 493
aaaagaaccgaacaa

SEQ ID NO: 2578008 - RNA, 16 nt, Coxiella burnetii RSA 493
aaaagagugcaauuag

SEQ ID NO: 2578009 - RNA, 15 nt, Coxiella burnetii RSA 493
aaaagauaaucccaa

SEQ ID NO: 2578010 - RNA, 21 nt, Coxiella burnetii RSA 493
aaaagauaaucccaauaaaac

SEQ ID NO: 2578011 - RNA, 23 nt, Coxiella burnetii RSA 493
aaaagauauucgguuuuuuuaaa

SEQ ID NO: 2578012 - RNA, 14 nt, Coxiella burnetii RSA 493
aaaagaucuccuug

SEQ ID NO: 2578013 - RNA, 12 nt, Coxiella burnetii RSA 493
aaaagauuccaa

SEQ ID NO: 2578014 - RNA, 22 nt, Coxiella burnetii RSA 493
aaaagauuuaauggcuaacuca

SEQ ID NO: 2578015 - RNA, 13 nt, Coxiella burnetii RSA 493
aaaagauuuuauc

SEQ ID NO: 2578016 - RNA, 17 nt, Coxiella burnetii RSA 493
aaaagauuuuaucuuau

SEQ ID NO: 2578017 - RNA, 19 nt, Coxiella burnetii RSA 493
aaaagcaagccgaauaaau

SEQ ID NO: 2578018 - RNA, 22 nt, Coxiella burnetii RSA 493
aaaagcaccgacgacauuaaaa

SEQ ID NO: 2578019 - RNA, 23 nt, Coxiella burnetii RSA 493
aaaagcaccgacgacauuaaaaa

SEQ ID NO: 2578020 - RNA, 22 nt, Coxiella burnetii RSA 493
aaaagcacgcgauacuuguuga

SEQ ID NO: 2578021 - RNA, 19 nt, Coxiella burnetii RSA 493
aaaagcaucaauaaugcca

SEQ ID NO: 2578022 - RNA, 23 nt, Coxiella burnetii RSA 493
aaaagcauuuuucgcagcaaaau

SEQ ID NO: 2578023 - RNA, 19 nt, Coxiella burnetii RSA 493
aaaagcgauuccaaagcag

SEQ ID NO: 2578024 - RNA, 24 nt, Coxiella burnetii RSA 493
aaaagcgauuccaaagcagauaaa

SEQ ID NO: 2578025 - RNA, 22 nt, Coxiella burnetii RSA 493
aaaagcggauaagccauuaaaa

SEQ ID NO: 2578026 - RNA, 17 nt, Coxiella burnetii RSA 493
aaaaggaaauguaaaaa

SEQ ID NO: 2578027 - RNA, 20 nt, Coxiella burnetii RSA 493
aaaaggaaugaauagaaaaa

SEQ ID NO: 2578028 - RNA, 14 nt, Coxiella burnetii RSA 493
aaaaggaauucuaa

SEQ ID NO: 2578029 - RNA, 16 nt, Coxiella burnetii RSA 493
aaaaggagaaagugag

SEQ ID NO: 2578030 - RNA, 16 nt, Coxiella burnetii RSA 493
aaaaggagaaauugac

SEQ ID NO: 2578031 - RNA, 17 nt, Coxiella burnetii RSA 493
aaaaggagaaauugaca

SEQ ID NO: 2578032 - RNA, 15 nt, Coxiella burnetii RSA 493
aaaaguagcgauaaa

SEQ ID NO: 2578033 - RNA, 20 nt, Coxiella burnetii RSA 493
aaaaguagcgauaaauuuuu

SEQ ID NO: 2578034 - RNA, 22 nt, Coxiella burnetii RSA 493
aaaaguccucccggcuuuaaaa

SEQ ID NO: 2578035 - RNA, 14 nt, Coxiella burnetii RSA 493
aaaaguccuguucu

SEQ ID NO: 2578036 - RNA, 22 nt, Coxiella burnetii RSA 493
aaaaguccuguucuuuucaacu

SEQ ID NO: 2578037 - RNA, 24 nt, Coxiella burnetii RSA 493
aaaagugauuuuucuuuguuccuu

SEQ ID NO: 2578038 - RNA, 19 nt, Coxiella burnetii RSA 493
aaaaguuaaguauauacau

SEQ ID NO: 2578039 - RNA, 15 nt, Coxiella burnetii RSA 493
aaaaguuuagaaaaa

SEQ ID NO: 2578040 - RNA, 14 nt, Coxiella burnetii RSA 493
aaaauaaaaggaga

SEQ ID NO: 2578041 - RNA, 15 nt, Coxiella burnetii RSA 493
aaaauaaaaggagaa

SEQ ID NO: 2578042 - RNA, 12 nt, Coxiella burnetii RSA 493
aaaauaaauaca

SEQ ID NO: 2578043 - RNA, 16 nt, Coxiella burnetii RSA 493
aaaauaaauacauaca

SEQ ID NO: 2578044 - RNA, 15 nt, Coxiella burnetii RSA 493
aaaauaagaaacuuu

SEQ ID NO: 2578045 - RNA, 16 nt, Coxiella burnetii RSA 493
aaaauaagaaacuuug

SEQ ID NO: 2578046 - RNA, 12 nt, Coxiella burnetii RSA 493
aaaauaagaagg

SEQ ID NO: 2578047 - RNA, 20 nt, Coxiella burnetii RSA 493
aaaauaaguauccaucccaa

SEQ ID NO: 2578048 - RNA, 19 nt, Coxiella burnetii RSA 493
aaaauaagucgcaauuuga

SEQ ID NO: 2578049 - RNA, 13 nt, Coxiella burnetii RSA 493
aaaauaaugagau

SEQ ID NO: 2578050 - RNA, 14 nt, Coxiella burnetii RSA 493
aaaauaaugcuaag

SEQ ID NO: 2578051 - RNA, 18 nt, Coxiella burnetii RSA 493
aaaauacaguaaauaauc

SEQ ID NO: 2578052 - RNA, 15 nt, Coxiella burnetii RSA 493
aaaauaccuuugcaa

SEQ ID NO: 2578053 - RNA, 13 nt, Coxiella burnetii RSA 493
aaaauacuuaaaa

SEQ ID NO: 2578054 - RNA, 17 nt, Coxiella burnetii RSA 493
aaaauagacuucgcuaa

SEQ ID NO: 2578055 - RNA, 20 nt, Coxiella burnetii RSA 493
aaaauagacuucgcuaaaua

SEQ ID NO: 2578056 - RNA, 20 nt, Coxiella burnetii RSA 493
aaaauauuaucccgaaaacc

SEQ ID NO: 2578057 - RNA, 22 nt, Coxiella burnetii RSA 493
aaaauccaggcugcuagaagua

SEQ ID NO: 2578058 - RNA, 18 nt, Coxiella burnetii RSA 493
aaaauccugucugccgca

SEQ ID NO: 2578059 - RNA, 22 nt, Coxiella burnetii RSA 493
aaaaucgauggaagaacauuug

SEQ ID NO: 2578060 - RNA, 17 nt, Coxiella burnetii RSA 493
aaaaucuuguuuaagcu

SEQ ID NO: 2578061 - RNA, 23 nt, Coxiella burnetii RSA 493
aaaaucuuugcucuaaauuaaau

SEQ ID NO: 2578062 - RNA, 22 nt, Coxiella burnetii RSA 493
aaaaugaccaugguuucuuuau

SEQ ID NO: 2578063 - RNA, 17 nt, Coxiella burnetii RSA 493
aaaaugaccuugccauc

SEQ ID NO: 2578064 - RNA, 13 nt, Coxiella burnetii RSA 493
aaaaugaguuguc

SEQ ID NO: 2578065 - RNA, 14 nt, Coxiella burnetii RSA 493
aaaauuaaaaucuu

SEQ ID NO: 2578066 - RNA, 18 nt, Coxiella burnetii RSA 493
aaaauuaauauaaucagc

SEQ ID NO: 2578067 - RNA, 21 nt, Coxiella burnetii RSA 493
aaaauuaauauaaucagcaag

SEQ ID NO: 2578068 - RNA, 14 nt, Coxiella burnetii RSA 493
aaaauuagaauuac

SEQ ID NO: 2578069 - RNA, 15 nt, Coxiella burnetii RSA 493
aaaauuagaauugcu

SEQ ID NO: 2578070 - RNA, 22 nt, Coxiella burnetii RSA 493
aaaauuauucggauucucucgc

SEQ ID NO: 2578071 - RNA, 16 nt, Coxiella burnetii RSA 493
aaaauucaugaaaagu

SEQ ID NO: 2578072 - RNA, 20 nt, Coxiella burnetii RSA 493
aaaauucuccuuaauaaagu

SEQ ID NO: 2578073 - RNA, 13 nt, Coxiella burnetii RSA 493
aaaauugaaagaa

SEQ ID NO: 2578074 - RNA, 17 nt, Coxiella burnetii RSA 493
aaaauugaaagaauuuc

SEQ ID NO: 2578075 - RNA, 19 nt, Coxiella burnetii RSA 493
aaaauugggaguuguauaa

SEQ ID NO: 2578076 - RNA, 15 nt, Coxiella burnetii RSA 493
aaaauuguaagcucu

SEQ ID NO: 2578077 - RNA, 14 nt, Coxiella burnetii RSA 493
aaaauuuaauaagu

SEQ ID NO: 2578078 - RNA, 19 nt, Coxiella burnetii RSA 493
aaaauuuauucuaacuuug

SEQ ID NO: 2578079 - RNA, 12 nt, Coxiella burnetii RSA 493
aaaauuucaagu

SEQ ID NO: 2578080 - RNA, 15 nt, Coxiella burnetii RSA 493
aaaauuucauuuaau

SEQ ID NO: 2578081 - RNA, 19 nt, Coxiella burnetii RSA 493
aaaauuucauuuaauaaau

SEQ ID NO: 2578082 - RNA, 16 nt, Coxiella burnetii RSA 493
aaaauuuuaaaaaaau

SEQ ID NO: 2578083 - RNA, 13 nt, Coxiella burnetii RSA 493
aaaauuuuauucu

SEQ ID NO: 2578084 - RNA, 16 nt, Coxiella burnetii RSA 493
aaacaaaauaauaaug

SEQ ID NO: 2578085 - RNA, 18 nt, Coxiella burnetii RSA 493
aaacaacguaacugaugu

SEQ ID NO: 2578086 - RNA, 21 nt, Coxiella burnetii RSA 493
aaacaacguaacugauguauc

SEQ ID NO: 2578087 - RNA, 19 nt, Coxiella burnetii RSA 493
aaacaacuaccugauaaaa

SEQ ID NO: 2578088 - RNA, 13 nt, Coxiella burnetii RSA 493
aaacaagaauggc

SEQ ID NO: 2578089 - RNA, 16 nt, Coxiella burnetii RSA 493
aaacaagacaacaaaa

SEQ ID NO: 2578090 - RNA, 16 nt, Coxiella burnetii RSA 493
aaacaaguuaacaaaa

SEQ ID NO: 2578091 - RNA, 17 nt, Coxiella burnetii RSA 493
aaacaaguuaacaaaau

SEQ ID NO: 2578092 - RNA, 11 nt, Coxiella burnetii RSA 493
aaacaauuccg

SEQ ID NO: 2578093 - RNA, 21 nt, Coxiella burnetii RSA 493
aaacaauugagcggcuuuuuc

SEQ ID NO: 2578094 - RNA, 20 nt, Coxiella burnetii RSA 493
aaacacauaucgcuccccuu

SEQ ID NO: 2578095 - RNA, 14 nt, Coxiella burnetii RSA 493
aaacacuuguuugc

SEQ ID NO: 2578096 - RNA, 23 nt, Coxiella burnetii RSA 493
aaacagcaauuaaucccuuugca

SEQ ID NO: 2578097 - RNA, 13 nt, Coxiella burnetii RSA 493
aaacagccuccau

SEQ ID NO: 2578098 - RNA, 14 nt, Coxiella burnetii RSA 493
aaacagcgaaaaca

SEQ ID NO: 2578099 - RNA, 22 nt, Coxiella burnetii RSA 493
aaacauucgauauguuucaaua

SEQ ID NO: 2578100 - RNA, 17 nt, Coxiella burnetii RSA 493
aaaccaacgaacgccaa

SEQ ID NO: 2578101 - RNA, 12 nt, Coxiella burnetii RSA 493
aaaccaauacca

SEQ ID NO: 2578102 - RNA, 18 nt, Coxiella burnetii RSA 493
aaaccaaucacuaaguca

SEQ ID NO: 2578103 - RNA, 14 nt, Coxiella burnetii RSA 493
aaaccacaauuuua

SEQ ID NO: 2578104 - RNA, 15 nt, Coxiella burnetii RSA 493
aaaccacgcuauaau

SEQ ID NO: 2578105 - RNA, 13 nt, Coxiella burnetii RSA 493
aaaccaguuuuca

SEQ ID NO: 2578106 - RNA, 16 nt, Coxiella burnetii RSA 493
aaaccauaagcaagcu

SEQ ID NO: 2578107 - RNA, 14 nt, Coxiella burnetii RSA 493
aaacccagaaaagu

SEQ ID NO: 2578108 - RNA, 22 nt, Coxiella burnetii RSA 493
aaacccagcgggugaugaaauc

SEQ ID NO: 2578109 - RNA, 11 nt, Coxiella burnetii RSA 493
aaacccauuug

SEQ ID NO: 2578110 - RNA, 20 nt, Coxiella burnetii RSA 493
aaacccgauggcauucuugc

SEQ ID NO: 2578111 - RNA, 22 nt, Coxiella burnetii RSA 493
aaaccgacgccauuuuuuagca

SEQ ID NO: 2578112 - RNA, 22 nt, Coxiella burnetii RSA 493
aaaccgcagcucaaacaaauca

SEQ ID NO: 2578113 - RNA, 15 nt, Coxiella burnetii RSA 493
aaaccgcgcugaagu

SEQ ID NO: 2578114 - RNA, 22 nt, Coxiella burnetii RSA 493
aaaccgcgcugaaguccuuguu

SEQ ID NO: 2578115 - RNA, 15 nt, Coxiella burnetii RSA 493
aaaccuaaagaaaga

SEQ ID NO: 2578116 - RNA, 22 nt, Coxiella burnetii RSA 493
aaaccuacacguuaaauagcca

SEQ ID NO: 2578117 - RNA, 23 nt, Coxiella burnetii RSA 493
aaaccuacacguuaaauagccaa

SEQ ID NO: 2578118 - RNA, 22 nt, Coxiella burnetii RSA 493
aaaccuacacuuuuaaucacau

SEQ ID NO: 2578119 - RNA, 13 nt, Coxiella burnetii RSA 493
aaaccuacuuuuc

SEQ ID NO: 2578120 - RNA, 18 nt, Coxiella burnetii RSA 493
aaaccuauccaaaaagau

SEQ ID NO: 2578121 - RNA, 12 nt, Coxiella burnetii RSA 493
aaaccuucaaaa

SEQ ID NO: 2578122 - RNA, 15 nt, Coxiella burnetii RSA 493
aaaccuucaaaaaua

SEQ ID NO: 2578123 - RNA, 17 nt, Coxiella burnetii RSA 493
aaaccuucaaaaauaaa

SEQ ID NO: 2578124 - RNA, 14 nt, Coxiella burnetii RSA 493
aaaccuuuuuuuuc

SEQ ID NO: 2578125 - RNA, 17 nt, Coxiella burnetii RSA 493
aaacgaaaagcugaaau

SEQ ID NO: 2578126 - RNA, 14 nt, Coxiella burnetii RSA 493
aaacgaaguucuca

SEQ ID NO: 2578127 - RNA, 14 nt, Coxiella burnetii RSA 493
aaacgaaucgccuc

SEQ ID NO: 2578128 - RNA, 15 nt, Coxiella burnetii RSA 493
aaacgaaucuuuaca

SEQ ID NO: 2578129 - RNA, 17 nt, Coxiella burnetii RSA 493
aaacgaauggcccaaua

SEQ ID NO: 2578130 - RNA, 19 nt, Coxiella burnetii RSA 493
aaacgaauggcccaauaaa

SEQ ID NO: 2578131 - RNA, 13 nt, Coxiella burnetii RSA 493
aaacgauuaaaaa

SEQ ID NO: 2578132 - RNA, 20 nt, Coxiella burnetii RSA 493
aaacgauuaaaaauuuuaaa

SEQ ID NO: 2578133 - RNA, 14 nt, Coxiella burnetii RSA 493
aaacgccguaacca

SEQ ID NO: 2578134 - RNA, 15 nt, Coxiella burnetii RSA 493
aaacgccugaaauau

SEQ ID NO: 2578135 - RNA, 23 nt, Coxiella burnetii RSA 493
aaacggaugagcaaugacauugg

SEQ ID NO: 2578136 - RNA, 22 nt, Coxiella burnetii RSA 493
aaacggggaguggaauuuuaac

SEQ ID NO: 2578137 - RNA, 21 nt, Coxiella burnetii RSA 493
aaacguauuccaaauaaucgu

SEQ ID NO: 2578138 - RNA, 18 nt, Coxiella burnetii RSA 493
aaacguauugccaaaauu

SEQ ID NO: 2578139 - RNA, 17 nt, Coxiella burnetii RSA 493
aaacgugccgccgaaau

SEQ ID NO: 2578140 - RNA, 20 nt, Coxiella burnetii RSA 493
aaacgugccgccgaaauuua

SEQ ID NO: 2578141 - RNA, 21 nt, Coxiella burnetii RSA 493
aaacguuauuguuaacaccuu

SEQ ID NO: 2578142 - RNA, 16 nt, Coxiella burnetii RSA 493
aaacguuucaucaaaa

SEQ ID NO: 2578143 - RNA, 20 nt, Coxiella burnetii RSA 493
aaacguuucaucaaaauucu

SEQ ID NO: 2578144 - RNA, 12 nt, Coxiella burnetii RSA 493
aaacguuucugu

SEQ ID NO: 2578145 - RNA, 19 nt, Coxiella burnetii RSA 493
aaacuaagcauuaaaaaau

SEQ ID NO: 2578146 - RNA, 19 nt, Coxiella burnetii RSA 493
aaacuaguuauuuuuaaaa

SEQ ID NO: 2578147 - RNA, 16 nt, Coxiella burnetii RSA 493
aaacuauuccccugca

SEQ ID NO: 2578148 - RNA, 13 nt, Coxiella burnetii RSA 493
aaacuauucccug

SEQ ID NO: 2578149 - RNA, 20 nt, Coxiella burnetii RSA 493
aaacuggcuuggacaaauca

SEQ ID NO: 2578150 - RNA, 15 nt, Coxiella burnetii RSA 493
aaacuuacgcugaag

SEQ ID NO: 2578151 - RNA, 16 nt, Coxiella burnetii RSA 493
aaacuuacgcugaagu

SEQ ID NO: 2578152 - RNA, 23 nt, Coxiella burnetii RSA 493
aaacuuacgcugaaguaauugca

SEQ ID NO: 2578153 - RNA, 23 nt, Coxiella burnetii RSA 493
aaacuucccauucuauaaucauu

SEQ ID NO: 2578154 - RNA, 22 nt, Coxiella burnetii RSA 493
aaacuuuaccuaacucaaccuc

SEQ ID NO: 2578155 - RNA, 21 nt, Coxiella burnetii RSA 493
aaacuuuuuagggcugaaaaa

SEQ ID NO: 2578156 - RNA, 13 nt, Coxiella burnetii RSA 493
aaagaaaaaaaac

SEQ ID NO: 2578157 - RNA, 16 nt, Coxiella burnetii RSA 493
aaagaaacgauuaaaa

SEQ ID NO: 2578158 - RNA, 22 nt, Coxiella burnetii RSA 493
aaagaaacgauuaaaaauuuua

SEQ ID NO: 2578159 - RNA, 19 nt, Coxiella burnetii RSA 493
aaagaaaguuucccacaaa

SEQ ID NO: 2578160 - RNA, 22 nt, Coxiella burnetii RSA 493
aaagaacgccagucauuuucgu

SEQ ID NO: 2578161 - RNA, 22 nt, Coxiella burnetii RSA 493
aaagaauuucucgauaaaaaca

SEQ ID NO: 2578162 - RNA, 17 nt, Coxiella burnetii RSA 493
aaagacauuguucauaa

SEQ ID NO: 2578163 - RNA, 18 nt, Coxiella burnetii RSA 493
aaagacauuguucauaaa

SEQ ID NO: 2578164 - RNA, 11 nt, Coxiella burnetii RSA 493
aaagaccaauc

SEQ ID NO: 2578165 - RNA, 17 nt, Coxiella burnetii RSA 493
aaagacgcuaguuuuua

SEQ ID NO: 2578166 - RNA, 18 nt, Coxiella burnetii RSA 493
aaagacguaccauuaaaa

SEQ ID NO: 2578167 - RNA, 16 nt, Coxiella burnetii RSA 493
aaagacuuugcuguuc

SEQ ID NO: 2578168 - RNA, 22 nt, Coxiella burnetii RSA 493
aaagaggccacaaaugcucuuu

SEQ ID NO: 2578169 - RNA, 20 nt, Coxiella burnetii RSA 493
aaagaguauuuuuuuuaaaa

SEQ ID NO: 2578170 - RNA, 22 nt, Coxiella burnetii RSA 493
aaagaguauuuuuuuuaaaauu

SEQ ID NO: 2578171 - RNA, 14 nt, Coxiella burnetii RSA 493
aaagauaaucccaa

SEQ ID NO: 2578172 - RNA, 14 nt, Coxiella burnetii RSA 493
aaagauauucgguu

SEQ ID NO: 2578173 - RNA, 23 nt, Coxiella burnetii RSA 493
aaagauauucuucuagaaaaccc

SEQ ID NO: 2578174 - RNA, 18 nt, Coxiella burnetii RSA 493
aaagauccaagauuuuuu

SEQ ID NO: 2578175 - RNA, 22 nt, Coxiella burnetii RSA 493
aaagaucuccuugaggaauuuu

SEQ ID NO: 2578176 - RNA, 18 nt, Coxiella burnetii RSA 493
aaagcaacgacuucucuu

SEQ ID NO: 2578177 - RNA, 22 nt, Coxiella burnetii RSA 493
aaagcaacgacuucucuuucug

SEQ ID NO: 2578178 - RNA, 14 nt, Coxiella burnetii RSA 493
aaagcaaugaaaua

SEQ ID NO: 2578179 - RNA, 21 nt, Coxiella burnetii RSA 493
aaagcaugcccauaaauaacu

SEQ ID NO: 2578180 - RNA, 15 nt, Coxiella burnetii RSA 493
aaagcauuaccauuu

SEQ ID NO: 2578181 - RNA, 22 nt, Coxiella burnetii RSA 493
aaagcccucaucuccgcaggcg

SEQ ID NO: 2578182 - RNA, 23 nt, Coxiella burnetii RSA 493
aaagcgagcaaucaaaacagcaa

SEQ ID NO: 2578183 - RNA, 17 nt, Coxiella burnetii RSA 493
aaagcgcccaaaugauc

SEQ ID NO: 2578184 - RNA, 16 nt, Coxiella burnetii RSA 493
aaagcgcguaagcagc

SEQ ID NO: 2578185 - RNA, 18 nt, Coxiella burnetii RSA 493
aaagcggaauaagaaauc

SEQ ID NO: 2578186 - RNA, 19 nt, Coxiella burnetii RSA 493
aaagcggaauaagaaaucu

SEQ ID NO: 2578187 - RNA, 22 nt, Coxiella burnetii RSA 493
aaagcggaauuagccagcgaau

SEQ ID NO: 2578188 - RNA, 23 nt, Coxiella burnetii RSA 493
aaagcggccgcugugccugccau

SEQ ID NO: 2578189 - RNA, 22 nt, Coxiella burnetii RSA 493
aaagcuaaaaaagaaauauuuu

SEQ ID NO: 2578190 - RNA, 17 nt, Coxiella burnetii RSA 493
aaagcuagcgaaauuug

SEQ ID NO: 2578191 - RNA, 18 nt, Coxiella burnetii RSA 493
aaaggaauucuaauuaaa

SEQ ID NO: 2578192 - RNA, 19 nt, Coxiella burnetii RSA 493
aaaggaauucuaauuaaau

SEQ ID NO: 2578193 - RNA, 13 nt, Coxiella burnetii RSA 493
aaaggagaaagug

SEQ ID NO: 2578194 - RNA, 21 nt, Coxiella burnetii RSA 493
aaaggagaaauugacaaauaa

SEQ ID NO: 2578195 - RNA, 18 nt, Coxiella burnetii RSA 493
aaaggcaaauguugauaa

SEQ ID NO: 2578196 - RNA, 22 nt, Coxiella burnetii RSA 493
aaaggcagcuuccagaaauuca

SEQ ID NO: 2578197 - RNA, 16 nt, Coxiella burnetii RSA 493
aaaggcguaagcacaa

SEQ ID NO: 2578198 - RNA, 19 nt, Coxiella burnetii RSA 493
aaaggcuaauaggaaaaau

SEQ ID NO: 2578199 - RNA, 22 nt, Coxiella burnetii RSA 493
aaagggacgucauaaagguuuu

SEQ ID NO: 2578200 - RNA, 14 nt, Coxiella burnetii RSA 493
aaagguaaaaaacu

SEQ ID NO: 2578201 - RNA, 17 nt, Coxiella burnetii RSA 493
aaaggucaggcaauuuu

SEQ ID NO: 2578202 - RNA, 20 nt, Coxiella burnetii RSA 493
aaaggucaggcaauuuugau

SEQ ID NO: 2578203 - RNA, 20 nt, Coxiella burnetii RSA 493
aaagguucuggcuuucccuu

SEQ ID NO: 2578204 - RNA, 14 nt, Coxiella burnetii RSA 493
aaagguuuuuccuu

SEQ ID NO: 2578205 - RNA, 16 nt, Coxiella burnetii RSA 493
aaagguuuuuccuuuu

SEQ ID NO: 2578206 - RNA, 15 nt, Coxiella burnetii RSA 493
aaaguaaaaaauaau

SEQ ID NO: 2578207 - RNA, 13 nt, Coxiella burnetii RSA 493
aaaguaaauuuau

SEQ ID NO: 2578208 - RNA, 14 nt, Coxiella burnetii RSA 493
aaaguaauuuuaaa

SEQ ID NO: 2578209 - RNA, 18 nt, Coxiella burnetii RSA 493
aaaguaauuuuaaaaaaa

SEQ ID NO: 2578210 - RNA, 21 nt, Coxiella burnetii RSA 493
aaaguaauuuuaaaaaaaaua

SEQ ID NO: 2578211 - RNA, 11 nt, Coxiella burnetii RSA 493
aaaguagaaaa

SEQ ID NO: 2578212 - RNA, 15 nt, Coxiella burnetii RSA 493
aaaguagaaaacuuu

SEQ ID NO: 2578213 - RNA, 15 nt, Coxiella burnetii RSA 493
aaaguagaaugaauu

SEQ ID NO: 2578214 - RNA, 22 nt, Coxiella burnetii RSA 493
aaagucagacuugcuuuuuucu

SEQ ID NO: 2578215 - RNA, 21 nt, Coxiella burnetii RSA 493
aaaguccucccggcuuuaaaa

SEQ ID NO: 2578216 - RNA, 17 nt, Coxiella burnetii RSA 493
aaagucgacuuugauaa

SEQ ID NO: 2578217 - RNA, 22 nt, Coxiella burnetii RSA 493
aaagucgcauagccaaccgcca

SEQ ID NO: 2578218 - RNA, 21 nt, Coxiella burnetii RSA 493
aaagugagccgcuaauaacau

SEQ ID NO: 2578219 - RNA, 12 nt, Coxiella burnetii RSA 493
aaagugauuuuu

SEQ ID NO: 2578220 - RNA, 15 nt, Coxiella burnetii RSA 493
aaagugauuuuucuu

SEQ ID NO: 2578221 - RNA, 17 nt, Coxiella burnetii RSA 493
aaagugguaagcuugcu

SEQ ID NO: 2578222 - RNA, 17 nt, Coxiella burnetii RSA 493
aaaguguagguuuucaa

SEQ ID NO: 2578223 - RNA, 22 nt, Coxiella burnetii RSA 493
aaaguguagguuuucaacaagu

SEQ ID NO: 2578224 - RNA, 22 nt, Coxiella burnetii RSA 493
aaaguuacgccccaaaguuccg

SEQ ID NO: 2578225 - RNA, 14 nt, Coxiella burnetii RSA 493
aaaguuauuucuuu

SEQ ID NO: 2578226 - RNA, 22 nt, Coxiella burnetii RSA 493
aaaguugaugaucuaacguuuu

SEQ ID NO: 2578227 - RNA, 18 nt, Coxiella burnetii RSA 493
aaaguuuagaaaaaugcu

SEQ ID NO: 2578228 - RNA, 19 nt, Coxiella burnetii RSA 493
aaaguuucacgaauuaaaa

SEQ ID NO: 2578229 - RNA, 12 nt, Coxiella burnetii RSA 493
aaaguuucauaa

SEQ ID NO: 2578230 - RNA, 21 nt, Coxiella burnetii RSA 493
aaaguuuuagcgccagauaca

SEQ ID NO: 2578231 - RNA, 13 nt, Coxiella burnetii RSA 493
aaauaaaaggaga

SEQ ID NO: 2578232 - RNA, 14 nt, Coxiella burnetii RSA 493
aaauaaaauuaauu

SEQ ID NO: 2578233 - RNA, 19 nt, Coxiella burnetii RSA 493
aaauaaaccuauccaaaaa

SEQ ID NO: 2578234 - RNA, 14 nt, Coxiella burnetii RSA 493
aaauaaagcagcaa

SEQ ID NO: 2578235 - RNA, 21 nt, Coxiella burnetii RSA 493
aaauaaauuaauuauccaaaa

SEQ ID NO: 2578236 - RNA, 22 nt, Coxiella burnetii RSA 493
aaauaacguugucuuauuuugu

SEQ ID NO: 2578237 - RNA, 23 nt, Coxiella burnetii RSA 493
aaauaacucaucgaccucuguaa

SEQ ID NO: 2578238 - RNA, 18 nt, Coxiella burnetii RSA 493
aaauaacuuuacuaaaaa

SEQ ID NO: 2578239 - RNA, 10 nt, Coxiella burnetii RSA 493
aaauaagcca

SEQ ID NO: 2578240 - RNA, 16 nt, Coxiella burnetii RSA 493
aaauaagggauaaaac

SEQ ID NO: 2578241 - RNA, 22 nt, Coxiella burnetii RSA 493
aaauaauccaagggaucauaau

SEQ ID NO: 2578242 - RNA, 17 nt, Coxiella burnetii RSA 493
aaauaaugaauauucug

SEQ ID NO: 2578243 - RNA, 13 nt, Coxiella burnetii RSA 493
aaauaaugacaau

SEQ ID NO: 2578244 - RNA, 23 nt, Coxiella burnetii RSA 493
aaauaaugcuaagugauugauuu

SEQ ID NO: 2578245 - RNA, 15 nt, Coxiella burnetii RSA 493
aaauaaugucuccaa

SEQ ID NO: 2578246 - RNA, 20 nt, Coxiella burnetii RSA 493
aaauaaugugacucauuacu

SEQ ID NO: 2578247 - RNA, 21 nt, Coxiella burnetii RSA 493
aaauaauuauagaaugggaag

SEQ ID NO: 2578248 - RNA, 19 nt, Coxiella burnetii RSA 493
aaauacaguaaauaaucau

SEQ ID NO: 2578249 - RNA, 16 nt, Coxiella burnetii RSA 493
aaauaccggaagagca

SEQ ID NO: 2578250 - RNA, 18 nt, Coxiella burnetii RSA 493
aaauaccucuucuaaagu

SEQ ID NO: 2578251 - RNA, 16 nt, Coxiella burnetii RSA 493
aaauaccuuugcaaac

SEQ ID NO: 2578252 - RNA, 17 nt, Coxiella burnetii RSA 493
aaauaccuuugcaaaca

SEQ ID NO: 2578253 - RNA, 19 nt, Coxiella burnetii RSA 493
aaauacgggaaaacaauga

SEQ ID NO: 2578254 - RNA, 23 nt, Coxiella burnetii RSA 493
aaauacggggacgauagauggca

SEQ ID NO: 2578255 - RNA, 13 nt, Coxiella burnetii RSA 493
aaauacucuuuca

SEQ ID NO: 2578256 - RNA, 16 nt, Coxiella burnetii RSA 493
aaauacuggcaauaag

SEQ ID NO: 2578257 - RNA, 14 nt, Coxiella burnetii RSA 493
aaauagaauuuuug

SEQ ID NO: 2578258 - RNA, 18 nt, Coxiella burnetii RSA 493
aaauagagaggguugcac

SEQ ID NO: 2578259 - RNA, 15 nt, Coxiella burnetii RSA 493
aaauagcauuaauaa

SEQ ID NO: 2578260 - RNA, 23 nt, Coxiella burnetii RSA 493
aaauagcuugacgauauugauuu

SEQ ID NO: 2578261 - RNA, 16 nt, Coxiella burnetii RSA 493
aaauaguagcuauaag

SEQ ID NO: 2578262 - RNA, 18 nt, Coxiella burnetii RSA 493
aaauaucaucaacagaac

SEQ ID NO: 2578263 - RNA, 22 nt, Coxiella burnetii RSA 493
aaauaucugcuaggauuuuuua

SEQ ID NO: 2578264 - RNA, 22 nt, Coxiella burnetii RSA 493
aaauauucgcgcaaguuuugaa

SEQ ID NO: 2578265 - RNA, 12 nt, Coxiella burnetii RSA 493
aaauauuuauuu

SEQ ID NO: 2578266 - RNA, 19 nt, Coxiella burnetii RSA 493
aaauauuuauuuauugacu

SEQ ID NO: 2578267 - RNA, 22 nt, Coxiella burnetii RSA 493
aaaucaacucgcccauggaaau

SEQ ID NO: 2578268 - RNA, 18 nt, Coxiella burnetii RSA 493
aaaucaaguguauuuuca

SEQ ID NO: 2578269 - RNA, 13 nt, Coxiella burnetii RSA 493
aaaucaccagaaa

SEQ ID NO: 2578270 - RNA, 21 nt, Coxiella burnetii RSA 493
aaaucaugagcggucaguaaa

SEQ ID NO: 2578271 - RNA, 23 nt, Coxiella burnetii RSA 493
aaaucaugagcggucaguaaacc

SEQ ID NO: 2578272 - RNA, 22 nt, Coxiella burnetii RSA 493
aaauccaggcugcuagaaguau

SEQ ID NO: 2578273 - RNA, 21 nt, Coxiella burnetii RSA 493
aaauccagggagucgccguuu

SEQ ID NO: 2578274 - RNA, 15 nt, Coxiella burnetii RSA 493
aaauccguaauuuua

SEQ ID NO: 2578275 - RNA, 17 nt, Coxiella burnetii RSA 493
aaauccguaauuuuaac

SEQ ID NO: 2578276 - RNA, 14 nt, Coxiella burnetii RSA 493
aaaucgaugauaag

SEQ ID NO: 2578277 - RNA, 15 nt, Coxiella burnetii RSA 493
aaaucgccauuuugu

SEQ ID NO: 2578278 - RNA, 18 nt, Coxiella burnetii RSA 493
aaaucguuuugaaauugg

SEQ ID NO: 2578279 - RNA, 21 nt, Coxiella burnetii RSA 493
aaaucuguaacgccaugaagc

SEQ ID NO: 2578280 - RNA, 17 nt, Coxiella burnetii RSA 493
aaaucuuuuuuuugaaa

SEQ ID NO: 2578281 - RNA, 23 nt, Coxiella burnetii RSA 493
aaaugaaaucccgagccccaaaa

SEQ ID NO: 2578282 - RNA, 16 nt, Coxiella burnetii RSA 493
aaaugaccaaauaauu

SEQ ID NO: 2578283 - RNA, 18 nt, Coxiella burnetii RSA 493
aaaugaccaaauaauuga

SEQ ID NO: 2578284 - RNA, 20 nt, Coxiella burnetii RSA 493
aaaugaccaugguuucuuua

SEQ ID NO: 2578285 - RNA, 22 nt, Coxiella burnetii RSA 493
aaaugaccuugccauccaaaug

SEQ ID NO: 2578286 - RNA, 23 nt, Coxiella burnetii RSA 493
aaaugaccuugccauccaaauga

SEQ ID NO: 2578287 - RNA, 19 nt, Coxiella burnetii RSA 493
aaaugaugaauuuauuucu

SEQ ID NO: 2578288 - RNA, 16 nt, Coxiella burnetii RSA 493
aaaugaugcuucuuug

SEQ ID NO: 2578289 - RNA, 18 nt, Coxiella burnetii RSA 493
aaaugauuauagaauggg

SEQ ID NO: 2578290 - RNA, 18 nt, Coxiella burnetii RSA 493
aaaugauugggcucaaaa

SEQ ID NO: 2578291 - RNA, 23 nt, Coxiella burnetii RSA 493
aaaugauuguccggcguugauuu

SEQ ID NO: 2578292 - RNA, 17 nt, Coxiella burnetii RSA 493
aaaugcuaauuccuuug

SEQ ID NO: 2578293 - RNA, 13 nt, Coxiella burnetii RSA 493
aaaugcuuuucuu

SEQ ID NO: 2578294 - RNA, 18 nt, Coxiella burnetii RSA 493
aaauggauagacaauuuu

SEQ ID NO: 2578295 - RNA, 15 nt, Coxiella burnetii RSA 493
aaauggauuuccacu

SEQ ID NO: 2578296 - RNA, 16 nt, Coxiella burnetii RSA 493
aaauguauuuaucauc

SEQ ID NO: 2578297 - RNA, 15 nt, Coxiella burnetii RSA 493
aaauguuaggaagga

SEQ ID NO: 2578298 - RNA, 16 nt, Coxiella burnetii RSA 493
aaauguuaggaaggac

SEQ ID NO: 2578299 - RNA, 17 nt, Coxiella burnetii RSA 493
aaauguugauaauaaau

SEQ ID NO: 2578300 - RNA, 19 nt, Coxiella burnetii RSA 493
aaauguugauaauaaaugg

SEQ ID NO: 2578301 - RNA, 15 nt, Coxiella burnetii RSA 493
aaauguuugaguggu

SEQ ID NO: 2578302 - RNA, 12 nt, Coxiella burnetii RSA 493
aaauuaaaauaa

SEQ ID NO: 2578303 - RNA, 11 nt, Coxiella burnetii RSA 493
aaauuaacaug

SEQ ID NO: 2578304 - RNA, 19 nt, Coxiella burnetii RSA 493
aaauuaauauaaucagcaa

SEQ ID NO: 2578305 - RNA, 21 nt, Coxiella burnetii RSA 493
aaauuaauauuaucguuuuca

SEQ ID NO: 2578306 - RNA, 16 nt, Coxiella burnetii RSA 493
aaauuacuuggggguu

SEQ ID NO: 2578307 - RNA, 21 nt, Coxiella burnetii RSA 493
aaauuacuuggggguuuugaa

SEQ ID NO: 2578308 - RNA, 23 nt, Coxiella burnetii RSA 493
aaauuagaauuacuguaaacuag

SEQ ID NO: 2578309 - RNA, 22 nt, Coxiella burnetii RSA 493
aaauuagcgaugucagccgcuu

SEQ ID NO: 2578310 - RNA, 22 nt, Coxiella burnetii RSA 493
aaauuaggagaucuuuuaauuu

SEQ ID NO: 2578311 - RNA, 17 nt, Coxiella burnetii RSA 493
aaauuagguaauuuaua

SEQ ID NO: 2578312 - RNA, 18 nt, Coxiella burnetii RSA 493
aaauuagguaauuuauaa

SEQ ID NO: 2578313 - RNA, 19 nt, Coxiella burnetii RSA 493
aaauuagguaauuuauaac

SEQ ID NO: 2578314 - RNA, 13 nt, Coxiella burnetii RSA 493
aaauuauaaaugg

SEQ ID NO: 2578315 - RNA, 19 nt, Coxiella burnetii RSA 493
aaauuauucggauucucuc

SEQ ID NO: 2578316 - RNA, 12 nt, Coxiella burnetii RSA 493
aaauuauuugau

SEQ ID NO: 2578317 - RNA, 15 nt, Coxiella burnetii RSA 493
aaauuauuuuaauau

SEQ ID NO: 2578318 - RNA, 14 nt, Coxiella burnetii RSA 493
aaauucauuuuuca

SEQ ID NO: 2578319 - RNA, 16 nt, Coxiella burnetii RSA 493
aaauucguuaaaaccu

SEQ ID NO: 2578320 - RNA, 17 nt, Coxiella burnetii RSA 493
aaauucuagugugauaa

SEQ ID NO: 2578321 - RNA, 21 nt, Coxiella burnetii RSA 493
aaauucuagugugauaaucau

SEQ ID NO: 2578322 - RNA, 17 nt, Coxiella burnetii RSA 493
aaauucucccuuuuccu

SEQ ID NO: 2578323 - RNA, 16 nt, Coxiella burnetii RSA 493
aaauucuuguccuuua

SEQ ID NO: 2578324 - RNA, 19 nt, Coxiella burnetii RSA 493
aaauugaaagaauuucucg

SEQ ID NO: 2578325 - RNA, 18 nt, Coxiella burnetii RSA 493
aaauugaauauaacuuuc

SEQ ID NO: 2578326 - RNA, 12 nt, Coxiella burnetii RSA 493
aaauugacaaau

SEQ ID NO: 2578327 - RNA, 14 nt, Coxiella burnetii RSA 493
aaauugacaaauaa

SEQ ID NO: 2578328 - RNA, 14 nt, Coxiella burnetii RSA 493
aaauugacccuuuu

SEQ ID NO: 2578329 - RNA, 22 nt, Coxiella burnetii RSA 493
aaauugauaaucuggguuucuu

SEQ ID NO: 2578330 - RNA, 22 nt, Coxiella burnetii RSA 493
aaauugauuagcaucuugaauc

SEQ ID NO: 2578331 - RNA, 19 nt, Coxiella burnetii RSA 493
aaauugcggaaauuucaca

SEQ ID NO: 2578332 - RNA, 21 nt, Coxiella burnetii RSA 493
aaauugggaguuguauaaagg

SEQ ID NO: 2578333 - RNA, 14 nt, Coxiella burnetii RSA 493
aaauuuaaucuuua

SEQ ID NO: 2578334 - RNA, 17 nt, Coxiella burnetii RSA 493
aaauuucguugauuaau

SEQ ID NO: 2578335 - RNA, 14 nt, Coxiella burnetii RSA 493
aaauuucucucuca

SEQ ID NO: 2578336 - RNA, 11 nt, Coxiella burnetii RSA 493
aaauuuuccca

SEQ ID NO: 2578337 - RNA, 22 nt, Coxiella burnetii RSA 493
aaauuuucccaggaaagaaaau

SEQ ID NO: 2578338 - RNA, 14 nt, Coxiella burnetii RSA 493
aaauuuucucaauu

SEQ ID NO: 2578339 - RNA, 18 nt, Coxiella burnetii RSA 493
aaauuuugaauccucagu

SEQ ID NO: 2578340 - RNA, 14 nt, Coxiella burnetii RSA 493
aaauuuuucauuuc

SEQ ID NO: 2578341 - RNA, 12 nt, Coxiella burnetii RSA 493
aacaaaaaauag

SEQ ID NO: 2578342 - RNA, 18 nt, Coxiella burnetii RSA 493
aacaaacguucaucguca

SEQ ID NO: 2578343 - RNA, 17 nt, Coxiella burnetii RSA 493
aacaaaggcacaaagau

SEQ ID NO: 2578344 - RNA, 20 nt, Coxiella burnetii RSA 493
aacaaagguuccaucgcaca

SEQ ID NO: 2578345 - RNA, 11 nt, Coxiella burnetii RSA 493
aacaaagugaa

SEQ ID NO: 2578346 - RNA, 22 nt, Coxiella burnetii RSA 493
aacaacguuucgacaucggcuu

SEQ ID NO: 2578347 - RNA, 23 nt, Coxiella burnetii RSA 493
aacaacugcgccgcaaaguaaaa

SEQ ID NO: 2578348 - RNA, 16 nt, Coxiella burnetii RSA 493
aacaagacaacaaaau

SEQ ID NO: 2578349 - RNA, 23 nt, Coxiella burnetii RSA 493
aacaagauacccuucaauugcuu

SEQ ID NO: 2578350 - RNA, 15 nt, Coxiella burnetii RSA 493
aacaagcucccagac

SEQ ID NO: 2578351 - RNA, 19 nt, Coxiella burnetii RSA 493
aacaagggaaucgacuuuc

SEQ ID NO: 2578352 - RNA, 21 nt, Coxiella burnetii RSA 493
aacaagguauugauuaacuuu

SEQ ID NO: 2578353 - RNA, 17 nt, Coxiella burnetii RSA 493
aacaaguauaacaaaau

SEQ ID NO: 2578354 - RNA, 20 nt, Coxiella burnetii RSA 493
aacaaguuaacaaaaucacc

SEQ ID NO: 2578355 - RNA, 15 nt, Coxiella burnetii RSA 493
aacaaugcucccuuu

SEQ ID NO: 2578356 - RNA, 20 nt, Coxiella burnetii RSA 493
aacaauuaacuuugcaaagc

SEQ ID NO: 2578357 - RNA, 22 nt, Coxiella burnetii RSA 493
aacaauuaacuuugcaaagcgc

SEQ ID NO: 2578358 - RNA, 21 nt, Coxiella burnetii RSA 493
aacaccccaauuuuuggcuug

SEQ ID NO: 2578359 - RNA, 17 nt, Coxiella burnetii RSA 493
aacaccguuggaaaagg

SEQ ID NO: 2578360 - RNA, 16 nt, Coxiella burnetii RSA 493
aacaccuaaaucaauu

SEQ ID NO: 2578361 - RNA, 13 nt, Coxiella burnetii RSA 493
aacacgaagcugc

SEQ ID NO: 2578362 - RNA, 16 nt, Coxiella burnetii RSA 493
aacacgaucaacaaaa

SEQ ID NO: 2578363 - RNA, 23 nt, Coxiella burnetii RSA 493
aacagacagacgcuggaaaaaua

SEQ ID NO: 2578364 - RNA, 17 nt, Coxiella burnetii RSA 493
aacagaggacagaaggc

SEQ ID NO: 2578365 - RNA, 19 nt, Coxiella burnetii RSA 493
aacagccgaugacaaauaa

SEQ ID NO: 2578366 - RNA, 12 nt, Coxiella burnetii RSA 493
aacagcgaaaac

SEQ ID NO: 2578367 - RNA, 14 nt, Coxiella burnetii RSA 493
aacagcgaaaacaa

SEQ ID NO: 2578368 - RNA, 21 nt, Coxiella burnetii RSA 493
aacagcgcccaauaaggauga

SEQ ID NO: 2578369 - RNA, 19 nt, Coxiella burnetii RSA 493
aacaggagcgauaaaauaa

SEQ ID NO: 2578370 - RNA, 18 nt, Coxiella burnetii RSA 493
aacaggcagaugauuaaa

SEQ ID NO: 2578371 - RNA, 14 nt, Coxiella burnetii RSA 493
aacaguauaaaauu

SEQ ID NO: 2578372 - RNA, 16 nt, Coxiella burnetii RSA 493
aacaguauaaaauuuu

SEQ ID NO: 2578373 - RNA, 21 nt, Coxiella burnetii RSA 493
aacagucaugggguaaaauau

SEQ ID NO: 2578374 - RNA, 23 nt, Coxiella burnetii RSA 493
aacagugccgguucccgcuucca

SEQ ID NO: 2578375 - RNA, 19 nt, Coxiella burnetii RSA 493
aacaguguuuaacucuguu

SEQ ID NO: 2578376 - RNA, 18 nt, Coxiella burnetii RSA 493
aacauacgacuucauuuc

SEQ ID NO: 2578377 - RNA, 20 nt, Coxiella burnetii RSA 493
aacauauggcccacuuggaa

SEQ ID NO: 2578378 - RNA, 21 nt, Coxiella burnetii RSA 493
aacauauggcccacuuggaaa

SEQ ID NO: 2578379 - RNA, 20 nt, Coxiella burnetii RSA 493
aacauccgcucgucuugcac

SEQ ID NO: 2578380 - RNA, 13 nt, Coxiella burnetii RSA 493
aacauccuccauu

SEQ ID NO: 2578381 - RNA, 15 nt, Coxiella burnetii RSA 493
aacaugcgaaagcaa

SEQ ID NO: 2578382 - RNA, 15 nt, Coxiella burnetii RSA 493
aacauuaucauguuc

SEQ ID NO: 2578383 - RNA, 21 nt, Coxiella burnetii RSA 493
aacauuauuacauauuucuuu

SEQ ID NO: 2578384 - RNA, 23 nt, Coxiella burnetii RSA 493
aacauuauuacauauuucuuuuc

SEQ ID NO: 2578385 - RNA, 14 nt, Coxiella burnetii RSA 493
aacauuauugaugu

SEQ ID NO: 2578386 - RNA, 20 nt, Coxiella burnetii RSA 493
aacauucgauauguuucaau

SEQ ID NO: 2578387 - RNA, 16 nt, Coxiella burnetii RSA 493
aacauucuaauaaaau

SEQ ID NO: 2578388 - RNA, 17 nt, Coxiella burnetii RSA 493
aacauucuaauaaaaua

SEQ ID NO: 2578389 - RNA, 14 nt, Coxiella burnetii RSA 493
aacauuuguuuaaa

SEQ ID NO: 2578390 - RNA, 20 nt, Coxiella burnetii RSA 493
aaccaaaaaguuuauaaaaa

SEQ ID NO: 2578391 - RNA, 22 nt, Coxiella burnetii RSA 493
aaccacagacucuuuuuauccg

SEQ ID NO: 2578392 - RNA, 16 nt, Coxiella burnetii RSA 493
aaccaccaaaucacgc

SEQ ID NO: 2578393 - RNA, 14 nt, Coxiella burnetii RSA 493
aaccacccgccgag

SEQ ID NO: 2578394 - RNA, 20 nt, Coxiella burnetii RSA 493
aaccaccuggcuaguaaaua

SEQ ID NO: 2578395 - RNA, 20 nt, Coxiella burnetii RSA 493
aaccacgauuuaaacaaacu

SEQ ID NO: 2578396 - RNA, 14 nt, Coxiella burnetii RSA 493
aaccacucggaaag

SEQ ID NO: 2578397 - RNA, 22 nt, Coxiella burnetii RSA 493
aaccacucggaaagcaucaacc

SEQ ID NO: 2578398 - RNA, 20 nt, Coxiella burnetii RSA 493
aaccacuguccucuguccuc

SEQ ID NO: 2578399 - RNA, 20 nt, Coxiella burnetii RSA 493
aaccacuucaagaaagacau

SEQ ID NO: 2578400 - RNA, 19 nt, Coxiella burnetii RSA 493
aaccauuaguguaaggcug

SEQ ID NO: 2578401 - RNA, 21 nt, Coxiella burnetii RSA 493
aaccauugucucguuagaaaa

SEQ ID NO: 2578402 - RNA, 22 nt, Coxiella burnetii RSA 493
aacccaaggaaccaccaaauca

SEQ ID NO: 2578403 - RNA, 17 nt, Coxiella burnetii RSA 493
aacccacggcaaauaaa

SEQ ID NO: 2578404 - RNA, 18 nt, Coxiella burnetii RSA 493
aacccagaaaaguaaaaa

SEQ ID NO: 2578405 - RNA, 20 nt, Coxiella burnetii RSA 493
aacccauuugccgccaggcu

SEQ ID NO: 2578406 - RNA, 14 nt, Coxiella burnetii RSA 493
aacccgcaaaccag

SEQ ID NO: 2578407 - RNA, 19 nt, Coxiella burnetii RSA 493
aacccguuuuaauguugcc

SEQ ID NO: 2578408 - RNA, 22 nt, Coxiella burnetii RSA 493
aacccuuucauuuaauuuuaaa

SEQ ID NO: 2578409 - RNA, 16 nt, Coxiella burnetii RSA 493
aaccgacaauuuuaua

SEQ ID NO: 2578410 - RNA, 13 nt, Coxiella burnetii RSA 493
aaccgacgaauaa

SEQ ID NO: 2578411 - RNA, 15 nt, Coxiella burnetii RSA 493
aaccgacgaauaacg

SEQ ID NO: 2578412 - RNA, 22 nt, Coxiella burnetii RSA 493
aaccgacgaauaacggaaaaug

SEQ ID NO: 2578413 - RNA, 23 nt, Coxiella burnetii RSA 493
aaccgacgccauuuuuuagcacc

SEQ ID NO: 2578414 - RNA, 18 nt, Coxiella burnetii RSA 493
aaccgauucauaaaaaau

SEQ ID NO: 2578415 - RNA, 14 nt, Coxiella burnetii RSA 493
aaccgcaugaauua

SEQ ID NO: 2578416 - RNA, 21 nt, Coxiella burnetii RSA 493
aaccgccggccauaucgccau

SEQ ID NO: 2578417 - RNA, 14 nt, Coxiella burnetii RSA 493
aaccgccuuuaaga

SEQ ID NO: 2578418 - RNA, 21 nt, Coxiella burnetii RSA 493
aaccgcugacgucagaaaaca

SEQ ID NO: 2578419 - RNA, 15 nt, Coxiella burnetii RSA 493
aaccggcccguugca

SEQ ID NO: 2578420 - RNA, 17 nt, Coxiella burnetii RSA 493
aaccgucacuucuucuc

SEQ ID NO: 2578421 - RNA, 15 nt, Coxiella burnetii RSA 493
aaccgugcggggacg

SEQ ID NO: 2578422 - RNA, 21 nt, Coxiella burnetii RSA 493
aaccuaaagaaagaagaaggu

SEQ ID NO: 2578423 - RNA, 17 nt, Coxiella burnetii RSA 493
aaccuacacguuaaaua

SEQ ID NO: 2578424 - RNA, 20 nt, Coxiella burnetii RSA 493
aaccuauccaaaaagauaau

SEQ ID NO: 2578425 - RNA, 18 nt, Coxiella burnetii RSA 493
aaccucagccguuaacuc

SEQ ID NO: 2578426 - RNA, 13 nt, Coxiella burnetii RSA 493
aaccuucucgugc

SEQ ID NO: 2578427 - RNA, 21 nt, Coxiella burnetii RSA 493
aaccuuguuauaaauuuuccc

SEQ ID NO: 2578428 - RNA, 22 nt, Coxiella burnetii RSA 493
aacgaaaauugucgauaauaua

SEQ ID NO: 2578429 - RNA, 12 nt, Coxiella burnetii RSA 493
aacgaacggcga

SEQ ID NO: 2578430 - RNA, 15 nt, Coxiella burnetii RSA 493
aacgaacggcgauac

SEQ ID NO: 2578431 - RNA, 18 nt, Coxiella burnetii RSA 493
aacgaauacggggacgau

SEQ ID NO: 2578432 - RNA, 23 nt, Coxiella burnetii RSA 493
aacgaaucguuuguaauaauuca

SEQ ID NO: 2578433 - RNA, 20 nt, Coxiella burnetii RSA 493
aacgaauggcccaauaaaga

SEQ ID NO: 2578434 - RNA, 20 nt, Coxiella burnetii RSA 493
aacgacagguauuuuaagua

SEQ ID NO: 2578435 - RNA, 16 nt, Coxiella burnetii RSA 493
aacgaccgugccuucg

SEQ ID NO: 2578436 - RNA, 17 nt, Coxiella burnetii RSA 493
aacgacggacauuuuuu

SEQ ID NO: 2578437 - RNA, 16 nt, Coxiella burnetii RSA 493
aacgacuuauuuuaua

SEQ ID NO: 2578438 - RNA, 17 nt, Coxiella burnetii RSA 493
aacgacuuauuuuauag

SEQ ID NO: 2578439 - RNA, 23 nt, Coxiella burnetii RSA 493
aacgagggcugcaaccgacgaau

SEQ ID NO: 2578440 - RNA, 15 nt, Coxiella burnetii RSA 493
aacgaggugcaaacc

SEQ ID NO: 2578441 - RNA, 19 nt, Coxiella burnetii RSA 493
aacgauagaccaucguuuu

SEQ ID NO: 2578442 - RNA, 17 nt, Coxiella burnetii RSA 493
aacgauugcuaaaccac

SEQ ID NO: 2578443 - RNA, 16 nt, Coxiella burnetii RSA 493
aacgcaaucggauuaa

SEQ ID NO: 2578444 - RNA, 17 nt, Coxiella burnetii RSA 493
aacgcacgaaccgccgg

SEQ ID NO: 2578445 - RNA, 21 nt, Coxiella burnetii RSA 493
aacgcaucggccuuuuucauu

SEQ ID NO: 2578446 - RNA, 19 nt, Coxiella burnetii RSA 493
aacgcgacaagaauuuuuu

SEQ ID NO: 2578447 - RNA, 13 nt, Coxiella burnetii RSA 493
aacgcgggacgac

SEQ ID NO: 2578448 - RNA, 17 nt, Coxiella burnetii RSA 493
aacgcguacaguuuuuu

SEQ ID NO: 2578449 - RNA, 15 nt, Coxiella burnetii RSA 493
aacgcuaucaaggcc

SEQ ID NO: 2578450 - RNA, 17 nt, Coxiella burnetii RSA 493
aacgcuaugaaaaccac

SEQ ID NO: 2578451 - RNA, 21 nt, Coxiella burnetii RSA 493
aacgcugcguuaucgaaaauu

SEQ ID NO: 2578452 - RNA, 20 nt, Coxiella burnetii RSA 493
aacggaaaugcuuucacuuc

SEQ ID NO: 2578453 - RNA, 23 nt, Coxiella burnetii RSA 493
aacggauagucgcguauaaauga

SEQ ID NO: 2578454 - RNA, 18 nt, Coxiella burnetii RSA 493
aacggaugagcaaugaca

SEQ ID NO: 2578455 - RNA, 17 nt, Coxiella burnetii RSA 493
aacggcagaaacgaggg

SEQ ID NO: 2578456 - RNA, 14 nt, Coxiella burnetii RSA 493
aacggcgaaaggga

SEQ ID NO: 2578457 - RNA, 23 nt, Coxiella burnetii RSA 493
aacggcuaacccgcaaaccaggc

SEQ ID NO: 2578458 - RNA, 22 nt, Coxiella burnetii RSA 493
aacgggaauguuuuuuaauaaa

SEQ ID NO: 2578459 - RNA, 17 nt, Coxiella burnetii RSA 493
aacgguaugucggauuu

SEQ ID NO: 2578460 - RNA, 21 nt, Coxiella burnetii RSA 493
aacgguaugucggauuucuuu

SEQ ID NO: 2578461 - RNA, 20 nt, Coxiella burnetii RSA 493
aacguaaaccuccaaaaacu

SEQ ID NO: 2578462 - RNA, 14 nt, Coxiella burnetii RSA 493
aacguagaaguuua

SEQ ID NO: 2578463 - RNA, 16 nt, Coxiella burnetii RSA 493
aacguauaaauaacau

SEQ ID NO: 2578464 - RNA, 21 nt, Coxiella burnetii RSA 493
aacguauugaguuuuugacaa

SEQ ID NO: 2578465 - RNA, 12 nt, Coxiella burnetii RSA 493
aacgucuuugua

SEQ ID NO: 2578466 - RNA, 11 nt, Coxiella burnetii RSA 493
aacgugagaga

SEQ ID NO: 2578467 - RNA, 18 nt, Coxiella burnetii RSA 493
aacguuauuguuaacacc

SEQ ID NO: 2578468 - RNA, 12 nt, Coxiella burnetii RSA 493
aacuaaaagagg

SEQ ID NO: 2578469 - RNA, 16 nt, Coxiella burnetii RSA 493
aacuaaaucaauugcc

SEQ ID NO: 2578470 - RNA, 16 nt, Coxiella burnetii RSA 493
aacuaagcauuaaaaa

SEQ ID NO: 2578471 - RNA, 17 nt, Coxiella burnetii RSA 493
aacuagaaauauuagaa

SEQ ID NO: 2578472 - RNA, 21 nt, Coxiella burnetii RSA 493
aacuauuauuaaaagagcgaa

SEQ ID NO: 2578473 - RNA, 24 nt, Coxiella burnetii RSA 493
aacuauucccugcgcuccagauga

SEQ ID NO: 2578474 - RNA, 14 nt, Coxiella burnetii RSA 493
aacuauuuuaaauc

SEQ ID NO: 2578475 - RNA, 11 nt, Coxiella burnetii RSA 493
aacucauaacg

SEQ ID NO: 2578476 - RNA, 13 nt, Coxiella burnetii RSA 493
aacuccuucgcuu

SEQ ID NO: 2578477 - RNA, 19 nt, Coxiella burnetii RSA 493
aacucuguuagauauugaa

SEQ ID NO: 2578478 - RNA, 22 nt, Coxiella burnetii RSA 493
aacucuuaucuuaaaccucaac

SEQ ID NO: 2578479 - RNA, 15 nt, Coxiella burnetii RSA 493
aacucuugccggauu

SEQ ID NO: 2578480 - RNA, 17 nt, Coxiella burnetii RSA 493
aacugaugaauaacaau

SEQ ID NO: 2578481 - RNA, 19 nt, Coxiella burnetii RSA 493
aacugaugaauaacaaugc

SEQ ID NO: 2578482 - RNA, 22 nt, Coxiella burnetii RSA 493
aacugauguauccuaauaaaaa

SEQ ID NO: 2578483 - RNA, 22 nt, Coxiella burnetii RSA 493
aacugccugcuaggauuuccuu

SEQ ID NO: 2578484 - RNA, 22 nt, Coxiella burnetii RSA 493
aacuggcuuggacaaaucauca

SEQ ID NO: 2578485 - RNA, 13 nt, Coxiella burnetii RSA 493
aacuguuugcauu

SEQ ID NO: 2578486 - RNA, 16 nt, Coxiella burnetii RSA 493
aacuuaagagagcgag

SEQ ID NO: 2578487 - RNA, 13 nt, Coxiella burnetii RSA 493
aacuuauccaugc

SEQ ID NO: 2578488 - RNA, 16 nt, Coxiella burnetii RSA 493
aacuucaccgcuguga

SEQ ID NO: 2578489 - RNA, 17 nt, Coxiella burnetii RSA 493
aacuucgacgggaaaaa

SEQ ID NO: 2578490 - RNA, 23 nt, Coxiella burnetii RSA 493
aacuucgcacaucauugaaaacc

SEQ ID NO: 2578491 - RNA, 14 nt, Coxiella burnetii RSA 493
aacuucucuugaau

SEQ ID NO: 2578492 - RNA, 18 nt, Coxiella burnetii RSA 493
aacuuuaguuuuucccuc

SEQ ID NO: 2578493 - RNA, 17 nt, Coxiella burnetii RSA 493
aacuuuauaguucauua

SEQ ID NO: 2578494 - RNA, 22 nt, Coxiella burnetii RSA 493
aacuuucguugugcucucccuu

SEQ ID NO: 2578495 - RNA, 18 nt, Coxiella burnetii RSA 493
aacuuugauaagcauaau

SEQ ID NO: 2578496 - RNA, 22 nt, Coxiella burnetii RSA 493
aacuuugauaagcauaauucau

SEQ ID NO: 2578497 - RNA, 23 nt, Coxiella burnetii RSA 493
aacuuuucggagaaaucuuuuuu

SEQ ID NO: 2578498 - RNA, 19 nt, Coxiella burnetii RSA 493
aagaaaaaccaguuuucag

SEQ ID NO: 2578499 - RNA, 17 nt, Coxiella burnetii RSA 493
aagaaaaagaaauuguu

SEQ ID NO: 2578500 - RNA, 19 nt, Coxiella burnetii RSA 493
aagaaacgauuaaaaauuu

SEQ ID NO: 2578501 - RNA, 12 nt, Coxiella burnetii RSA 493
aagaaagaagaa

SEQ ID NO: 2578502 - RNA, 22 nt, Coxiella burnetii RSA 493
aagaaagacauuguucauaaaa

SEQ ID NO: 2578503 - RNA, 12 nt, Coxiella burnetii RSA 493
aagaaagcagau

SEQ ID NO: 2578504 - RNA, 12 nt, Coxiella burnetii RSA 493
aagaaagccuaa

SEQ ID NO: 2578505 - RNA, 18 nt, Coxiella burnetii RSA 493
aagaaagcgagcaaucaa

SEQ ID NO: 2578506 - RNA, 19 nt, Coxiella burnetii RSA 493
aagaaagcgagcaaucaaa

SEQ ID NO: 2578507 - RNA, 19 nt, Coxiella burnetii RSA 493
aagaaagggugagguaacu

SEQ ID NO: 2578508 - RNA, 18 nt, Coxiella burnetii RSA 493
aagaaaguuucccacaaa

SEQ ID NO: 2578509 - RNA, 13 nt, Coxiella burnetii RSA 493
aagaaauugaucu

SEQ ID NO: 2578510 - RNA, 13 nt, Coxiella burnetii RSA 493
aagaaccgcgacu

SEQ ID NO: 2578511 - RNA, 19 nt, Coxiella burnetii RSA 493
aagaacgccagucauuuuc

SEQ ID NO: 2578512 - RNA, 13 nt, Coxiella burnetii RSA 493
aagaaggcgauca

SEQ ID NO: 2578513 - RNA, 17 nt, Coxiella burnetii RSA 493
aagaaggucguuuauuu

SEQ ID NO: 2578514 - RNA, 20 nt, Coxiella burnetii RSA 493
aagaauaaacuuuauuccca

SEQ ID NO: 2578515 - RNA, 19 nt, Coxiella burnetii RSA 493
aagaauuucucgauaaaaa

SEQ ID NO: 2578516 - RNA, 13 nt, Coxiella burnetii RSA 493
aagacaauguuaa

SEQ ID NO: 2578517 - RNA, 19 nt, Coxiella burnetii RSA 493
aagacaauguuaaaacaca

SEQ ID NO: 2578518 - RNA, 19 nt, Coxiella burnetii RSA 493
aagacauuguucauaaaau

SEQ ID NO: 2578519 - RNA, 20 nt, Coxiella burnetii RSA 493
aagacauuguucauaaaaua

SEQ ID NO: 2578520 - RNA, 22 nt, Coxiella burnetii RSA 493
aagaccaaucguaaagaucauc

SEQ ID NO: 2578521 - RNA, 15 nt, Coxiella burnetii RSA 493
aagacgcuuucaaca

SEQ ID NO: 2578522 - RNA, 17 nt, Coxiella burnetii RSA 493
aagacguaccauuaaaa

SEQ ID NO: 2578523 - RNA, 18 nt, Coxiella burnetii RSA 493
aagacguaccauuaaaag

SEQ ID NO: 2578524 - RNA, 12 nt, Coxiella burnetii RSA 493
aagacuaagaau

SEQ ID NO: 2578525 - RNA, 16 nt, Coxiella burnetii RSA 493
aagacuaggaaaaaau

SEQ ID NO: 2578526 - RNA, 12 nt, Coxiella burnetii RSA 493
aagagaaaaaac

SEQ ID NO: 2578527 - RNA, 13 nt, Coxiella burnetii RSA 493
aagagaaaaaacc

SEQ ID NO: 2578528 - RNA, 14 nt, Coxiella burnetii RSA 493
aagagacaaaguuu

SEQ ID NO: 2578529 - RNA, 12 nt, Coxiella burnetii RSA 493
aagagauaagcu

SEQ ID NO: 2578530 - RNA, 15 nt, Coxiella burnetii RSA 493
aagaguaaaaaacca

SEQ ID NO: 2578531 - RNA, 19 nt, Coxiella burnetii RSA 493
aagaguauuuuuuuuaaaa

SEQ ID NO: 2578532 - RNA, 21 nt, Coxiella burnetii RSA 493
aagaguauuuuuuuuaaaauu

SEQ ID NO: 2578533 - RNA, 17 nt, Coxiella burnetii RSA 493
aagagugcaauuagggu

SEQ ID NO: 2578534 - RNA, 20 nt, Coxiella burnetii RSA 493
aagaguugagcgaagaaaaa

SEQ ID NO: 2578535 - RNA, 22 nt, Coxiella burnetii RSA 493
aagaguugagcgaagaaaaaga

SEQ ID NO: 2578536 - RNA, 21 nt, Coxiella burnetii RSA 493
aagauaucgucacccaaauca

SEQ ID NO: 2578537 - RNA, 21 nt, Coxiella burnetii RSA 493
aagaucaauaccgguaaucau

SEQ ID NO: 2578538 - RNA, 16 nt, Coxiella burnetii RSA 493
aagaucaauuacgaag

SEQ ID NO: 2578539 - RNA, 13 nt, Coxiella burnetii RSA 493
aagauucuugaac

SEQ ID NO: 2578540 - RNA, 15 nt, Coxiella burnetii RSA 493
aagauuucuucacgg

SEQ ID NO: 2578541 - RNA, 21 nt, Coxiella burnetii RSA 493
aagcaaaaauacaagcugaca

SEQ ID NO: 2578542 - RNA, 22 nt, Coxiella burnetii RSA 493
aagcaacuuuaacauuaucaug

SEQ ID NO: 2578543 - RNA, 17 nt, Coxiella burnetii RSA 493
aagcaagcuuacucaca

SEQ ID NO: 2578544 - RNA, 22 nt, Coxiella burnetii RSA 493
aagcacaguuacguaauuauua

SEQ ID NO: 2578545 - RNA, 22 nt, Coxiella burnetii RSA 493
aagcaccccgugaauaauugcc

SEQ ID NO: 2578546 - RNA, 22 nt, Coxiella burnetii RSA 493
aagcaccgacgacauuaaaaau

SEQ ID NO: 2578547 - RNA, 21 nt, Coxiella burnetii RSA 493
aagcaccgcuggcuuugauuc

SEQ ID NO: 2578548 - RNA, 18 nt, Coxiella burnetii RSA 493
aagcacuaguuuuacuac

SEQ ID NO: 2578549 - RNA, 20 nt, Coxiella burnetii RSA 493
aagcacugcaccauaacuaa

SEQ ID NO: 2578550 - RNA, 14 nt, Coxiella burnetii RSA 493
aagcaguagcugaa

SEQ ID NO: 2578551 - RNA, 20 nt, Coxiella burnetii RSA 493
aagcauauaacugcaaauaa

SEQ ID NO: 2578552 - RNA, 21 nt, Coxiella burnetii RSA 493
aagcauauaacugcaaauaau

SEQ ID NO: 2578553 - RNA, 20 nt, Coxiella burnetii RSA 493
aagcaugcugauuuucacga

SEQ ID NO: 2578554 - RNA, 19 nt, Coxiella burnetii RSA 493
aagcaugggccuacuuuau

SEQ ID NO: 2578555 - RNA, 21 nt, Coxiella burnetii RSA 493
aagcauuaaaaaauaagaaag

SEQ ID NO: 2578556 - RNA, 14 nt, Coxiella burnetii RSA 493
aagcauuuuuuugu

SEQ ID NO: 2578557 - RNA, 20 nt, Coxiella burnetii RSA 493
aagccaaguuuuaagaaaaa

SEQ ID NO: 2578558 - RNA, 17 nt, Coxiella burnetii RSA 493
aagccacacaaccacug

SEQ ID NO: 2578559 - RNA, 22 nt, Coxiella burnetii RSA 493
aagccccuuuaaugcauuugaa

SEQ ID NO: 2578560 - RNA, 21 nt, Coxiella burnetii RSA 493
aagcccucaucuccgcaggcg

SEQ ID NO: 2578561 - RNA, 16 nt, Coxiella burnetii RSA 493
aagccgcuauuucuag

SEQ ID NO: 2578562 - RNA, 16 nt, Coxiella burnetii RSA 493
aagccguuauccauga

SEQ ID NO: 2578563 - RNA, 15 nt, Coxiella burnetii RSA 493
aagccguucacccca

SEQ ID NO: 2578564 - RNA, 16 nt, Coxiella burnetii RSA 493
aagccguucaccccau

SEQ ID NO: 2578565 - RNA, 20 nt, Coxiella burnetii RSA 493
aagcgaaauacggggacgau

SEQ ID NO: 2578566 - RNA, 20 nt, Coxiella burnetii RSA 493
aagcgauugacuucuuugug

SEQ ID NO: 2578567 - RNA, 15 nt, Coxiella burnetii RSA 493
aagcgcaauuuccag

SEQ ID NO: 2578568 - RNA, 16 nt, Coxiella burnetii RSA 493
aagcgcccaaaugauc

SEQ ID NO: 2578569 - RNA, 22 nt, Coxiella burnetii RSA 493
aagcgccugccgcaacaagaaa

SEQ ID NO: 2578570 - RNA, 20 nt, Coxiella burnetii RSA 493
aagcgccugucuaaucugcg

SEQ ID NO: 2578571 - RNA, 14 nt, Coxiella burnetii RSA 493
aagcgcggcgaaau

SEQ ID NO: 2578572 - RNA, 22 nt, Coxiella burnetii RSA 493
aagcgcuuacagcaggaaccag

SEQ ID NO: 2578573 - RNA, 22 nt, Coxiella burnetii RSA 493
aagcgcuuuuggcuacuuucuc

SEQ ID NO: 2578574 - RNA, 18 nt, Coxiella burnetii RSA 493
aagcggaauaagaaaucu

SEQ ID NO: 2578575 - RNA, 22 nt, Coxiella burnetii RSA 493
aagcggauggagcaaacagucc

SEQ ID NO: 2578576 - RNA, 16 nt, Coxiella burnetii RSA 493
aagcggccgcugugcc

SEQ ID NO: 2578577 - RNA, 18 nt, Coxiella burnetii RSA 493
aagcgggguuaaggaaaa

SEQ ID NO: 2578578 - RNA, 21 nt, Coxiella burnetii RSA 493
aagcgggguuaaggaaaagca

SEQ ID NO: 2578579 - RNA, 23 nt, Coxiella burnetii RSA 493
aagcgucugcgacgacgcuuugg

SEQ ID NO: 2578580 - RNA, 17 nt, Coxiella burnetii RSA 493
aagcguucuuaaagucu

SEQ ID NO: 2578581 - RNA, 23 nt, Coxiella burnetii RSA 493
aagcguucuuaaagucuucaaaa

SEQ ID NO: 2578582 - RNA, 15 nt, Coxiella burnetii RSA 493
aagcuagaaaauaac

SEQ ID NO: 2578583 - RNA, 14 nt, Coxiella burnetii RSA 493
aagcuagcgaaauu

SEQ ID NO: 2578584 - RNA, 16 nt, Coxiella burnetii RSA 493
aagcuagcgaaauuug

SEQ ID NO: 2578585 - RNA, 16 nt, Coxiella burnetii RSA 493
aagcucaugaaaagca

SEQ ID NO: 2578586 - RNA, 19 nt, Coxiella burnetii RSA 493
aagcucgauaucuguuuua

SEQ ID NO: 2578587 - RNA, 19 nt, Coxiella burnetii RSA 493
aagcugauuccgaucuugg

SEQ ID NO: 2578588 - RNA, 19 nt, Coxiella burnetii RSA 493
aagcugcuuuuuaaaacgc

SEQ ID NO: 2578589 - RNA, 15 nt, Coxiella burnetii RSA 493
aagcuguuucuuuua

SEQ ID NO: 2578590 - RNA, 13 nt, Coxiella burnetii RSA 493
aagcuugaaaaaa

SEQ ID NO: 2578591 - RNA, 22 nt, Coxiella burnetii RSA 493
aagcuuucaauaaauaaaucaa

SEQ ID NO: 2578592 - RNA, 15 nt, Coxiella burnetii RSA 493
aagcuuuugccuugg

SEQ ID NO: 2578593 - RNA, 21 nt, Coxiella burnetii RSA 493
aaggaaaggucaggcaauuuu

SEQ ID NO: 2578594 - RNA, 12 nt, Coxiella burnetii RSA 493
aaggaauaaaac

SEQ ID NO: 2578595 - RNA, 20 nt, Coxiella burnetii RSA 493
aaggaauacaaucgacagga

SEQ ID NO: 2578596 - RNA, 17 nt, Coxiella burnetii RSA 493
aaggaauucuaauuaaa

SEQ ID NO: 2578597 - RNA, 19 nt, Coxiella burnetii RSA 493
aaggacccgccggcaaaca

SEQ ID NO: 2578598 - RNA, 19 nt, Coxiella burnetii RSA 493
aaggagaaauugacaaaua

SEQ ID NO: 2578599 - RNA, 22 nt, Coxiella burnetii RSA 493
aaggagaaauugacaaauaaag

SEQ ID NO: 2578600 - RNA, 15 nt, Coxiella burnetii RSA 493
aaggagcggcugaau

SEQ ID NO: 2578601 - RNA, 22 nt, Coxiella burnetii RSA 493
aaggcaaauguugauaauaaau

SEQ ID NO: 2578602 - RNA, 17 nt, Coxiella burnetii RSA 493
aaggcagcuuccagaaa

SEQ ID NO: 2578603 - RNA, 19 nt, Coxiella burnetii RSA 493
aaggcagcuuccagaaauu

SEQ ID NO: 2578604 - RNA, 18 nt, Coxiella burnetii RSA 493
aaggcaugaaauuuuugg

SEQ ID NO: 2578605 - RNA, 18 nt, Coxiella burnetii RSA 493
aaggccccauugggcugg

SEQ ID NO: 2578606 - RNA, 15 nt, Coxiella burnetii RSA 493
aaggccggcccuaac

SEQ ID NO: 2578607 - RNA, 11 nt, Coxiella burnetii RSA 493
aaggucaucca

SEQ ID NO: 2578608 - RNA, 21 nt, Coxiella burnetii RSA 493
aaggucauccauucuuucauu

SEQ ID NO: 2578609 - RNA, 16 nt, Coxiella burnetii RSA 493
aaggucucaacagccu

SEQ ID NO: 2578610 - RNA, 23 nt, Coxiella burnetii RSA 493
aaggucuuaauuucuaaaaauca

SEQ ID NO: 2578611 - RNA, 22 nt, Coxiella burnetii RSA 493
aaggugauucucucaaagaaac

SEQ ID NO: 2578612 - RNA, 19 nt, Coxiella burnetii RSA 493
aagguggcgcuuuaauuua

SEQ ID NO: 2578613 - RNA, 15 nt, Coxiella burnetii RSA 493
aaggugggcucauga

SEQ ID NO: 2578614 - RNA, 21 nt, Coxiella burnetii RSA 493
aagguguuuuacguuuaaaua

SEQ ID NO: 2578615 - RNA, 19 nt, Coxiella burnetii RSA 493
aagguucuggcuuucccuu

SEQ ID NO: 2578616 - RNA, 15 nt, Coxiella burnetii RSA 493
aaguaauuuuaaaaa

SEQ ID NO: 2578617 - RNA, 21 nt, Coxiella burnetii RSA 493
aaguacugaugcaaaucauga

SEQ ID NO: 2578618 - RNA, 19 nt, Coxiella burnetii RSA 493
aaguagaaaacuuucagga

SEQ ID NO: 2578619 - RNA, 17 nt, Coxiella burnetii RSA 493
aaguagccaaaauaaua

SEQ ID NO: 2578620 - RNA, 15 nt, Coxiella burnetii RSA 493
aaguagcuaaaaaau

SEQ ID NO: 2578621 - RNA, 19 nt, Coxiella burnetii RSA 493
aaguagcuaaaaaauucau

SEQ ID NO: 2578622 - RNA, 17 nt, Coxiella burnetii RSA 493
aaguagcucuuaaaaga

SEQ ID NO: 2578623 - RNA, 13 nt, Coxiella burnetii RSA 493
aaguaguugaaaa

SEQ ID NO: 2578624 - RNA, 14 nt, Coxiella burnetii RSA 493
aaguaugaucauuu

SEQ ID NO: 2578625 - RNA, 20 nt, Coxiella burnetii RSA 493
aaguaugugggcucacuugc

SEQ ID NO: 2578626 - RNA, 15 nt, Coxiella burnetii RSA 493
aagucagacuugcuu

SEQ ID NO: 2578627 - RNA, 20 nt, Coxiella burnetii RSA 493
aagucagcuuuggaaaaaca

SEQ ID NO: 2578628 - RNA, 15 nt, Coxiella burnetii RSA 493
aaguccaauuauaac

SEQ ID NO: 2578629 - RNA, 18 nt, Coxiella burnetii RSA 493
aagucccucccgaggagc

SEQ ID NO: 2578630 - RNA, 19 nt, Coxiella burnetii RSA 493
aaguccggacgcaauaccc

SEQ ID NO: 2578631 - RNA, 18 nt, Coxiella burnetii RSA 493
aaguccuugcugaauucc

SEQ ID NO: 2578632 - RNA, 20 nt, Coxiella burnetii RSA 493
aaguccuugcugaauucccu

SEQ ID NO: 2578633 - RNA, 19 nt, Coxiella burnetii RSA 493
aagucgcccguaugcagcg

SEQ ID NO: 2578634 - RNA, 15 nt, Coxiella burnetii RSA 493
aagucgcguaaagau

SEQ ID NO: 2578635 - RNA, 19 nt, Coxiella burnetii RSA 493
aagucggggccgguucuuu

SEQ ID NO: 2578636 - RNA, 18 nt, Coxiella burnetii RSA 493
aagucgggugauugaaaa

SEQ ID NO: 2578637 - RNA, 15 nt, Coxiella burnetii RSA 493
aagucuauugaaaaa

SEQ ID NO: 2578638 - RNA, 19 nt, Coxiella burnetii RSA 493
aagucuauugaaaaaaacg

SEQ ID NO: 2578639 - RNA, 15 nt, Coxiella burnetii RSA 493
aagucugaacaggca

SEQ ID NO: 2578640 - RNA, 20 nt, Coxiella burnetii RSA 493
aagucugguuaaacccauuu

SEQ ID NO: 2578641 - RNA, 23 nt, Coxiella burnetii RSA 493
aagucuucaaaagugauuuuucu

SEQ ID NO: 2578642 - RNA, 15 nt, Coxiella burnetii RSA 493
aagucuuugacauau

SEQ ID NO: 2578643 - RNA, 13 nt, Coxiella burnetii RSA 493
aagugcuaaaaaa

SEQ ID NO: 2578644 - RNA, 14 nt, Coxiella burnetii RSA 493
aagugcuaaaaaau

SEQ ID NO: 2578645 - RNA, 14 nt, Coxiella burnetii RSA 493
aagugggggaacag

SEQ ID NO: 2578646 - RNA, 22 nt, Coxiella burnetii RSA 493
aagugugauucauuaucaugca

SEQ ID NO: 2578647 - RNA, 16 nt, Coxiella burnetii RSA 493
aagugugggaaaaaua

SEQ ID NO: 2578648 - RNA, 19 nt, Coxiella burnetii RSA 493
aaguguucacaagucucag

SEQ ID NO: 2578649 - RNA, 20 nt, Coxiella burnetii RSA 493
aaguguucacaagucucaga

SEQ ID NO: 2578650 - RNA, 22 nt, Coxiella burnetii RSA 493
aaguguucacaagucucagaau

SEQ ID NO: 2578651 - RNA, 15 nt, Coxiella burnetii RSA 493
aaguuaagauaauaa

SEQ ID NO: 2578652 - RNA, 17 nt, Coxiella burnetii RSA 493
aaguuaagauaauaauu

SEQ ID NO: 2578653 - RNA, 17 nt, Coxiella burnetii RSA 493
aaguucuucuaaagaau

SEQ ID NO: 2578654 - RNA, 21 nt, Coxiella burnetii RSA 493
aaguucuucuaaagaauuuuu

SEQ ID NO: 2578655 - RNA, 17 nt, Coxiella burnetii RSA 493
aaguucuuugccacccc

SEQ ID NO: 2578656 - RNA, 16 nt, Coxiella burnetii RSA 493
aaguugccgauaaaaa

SEQ ID NO: 2578657 - RNA, 17 nt, Coxiella burnetii RSA 493
aaguugggccaaaauag

SEQ ID NO: 2578658 - RNA, 22 nt, Coxiella burnetii RSA 493
aaguugggccaaaauagaauug

SEQ ID NO: 2578659 - RNA, 19 nt, Coxiella burnetii RSA 493
aaguugggguuuaauugca

SEQ ID NO: 2578660 - RNA, 22 nt, Coxiella burnetii RSA 493
aaguuuauaaaaauccucacga

SEQ ID NO: 2578661 - RNA, 20 nt, Coxiella burnetii RSA 493
aaguuucacgaauuaaaaaa

SEQ ID NO: 2578662 - RNA, 15 nt, Coxiella burnetii RSA 493
aaguuucccacaaaa

SEQ ID NO: 2578663 - RNA, 17 nt, Coxiella burnetii RSA 493
aaguuucccacaaaaua

SEQ ID NO: 2578664 - RNA, 16 nt, Coxiella burnetii RSA 493
aaguuuuaagaaaaac

SEQ ID NO: 2578665 - RNA, 19 nt, Coxiella burnetii RSA 493
aaguuuuaagaaaaaccag

SEQ ID NO: 2578666 - RNA, 13 nt, Coxiella burnetii RSA 493
aaguuuuagguuu

SEQ ID NO: 2578667 - RNA, 21 nt, Coxiella burnetii RSA 493
aaguuuucacuguugagcaaa

SEQ ID NO: 2578668 - RNA, 20 nt, Coxiella burnetii RSA 493
aaguuuucuauauuuucuuu

SEQ ID NO: 2578669 - RNA, 12 nt, Coxiella burnetii RSA 493
aaguuuuucacg

SEQ ID NO: 2578670 - RNA, 16 nt, Coxiella burnetii RSA 493
aaguuuuuugcucuuu

SEQ ID NO: 2578671 - RNA, 18 nt, Coxiella burnetii RSA 493
aauaaaaaauuacugaaa

SEQ ID NO: 2578672 - RNA, 19 nt, Coxiella burnetii RSA 493
aauaaaaccuucaaaaaua

SEQ ID NO: 2578673 - RNA, 22 nt, Coxiella burnetii RSA 493
aauaaaaccuucaaaaauaaaa

SEQ ID NO: 2578674 - RNA, 11 nt, Coxiella burnetii RSA 493
aauaaaagccc

SEQ ID NO: 2578675 - RNA, 13 nt, Coxiella burnetii RSA 493
aauaaaauuaaau

SEQ ID NO: 2578676 - RNA, 21 nt, Coxiella burnetii RSA 493
aauaaaccuauccaaaaagau

SEQ ID NO: 2578677 - RNA, 22 nt, Coxiella burnetii RSA 493
aauaaaccuauccaaaaagaua

SEQ ID NO: 2578678 - RNA, 20 nt, Coxiella burnetii RSA 493
aauaaacgggcuaaagguuu

SEQ ID NO: 2578679 - RNA, 13 nt, Coxiella burnetii RSA 493
aauaaacuggaaa

SEQ ID NO: 2578680 - RNA, 15 nt, Coxiella burnetii RSA 493
aauaaacuggaaaaa

SEQ ID NO: 2578681 - RNA, 18 nt, Coxiella burnetii RSA 493
aauaaacuggaaaaaggu

SEQ ID NO: 2578682 - RNA, 13 nt, Coxiella burnetii RSA 493
aauaaagaaagcc

SEQ ID NO: 2578683 - RNA, 16 nt, Coxiella burnetii RSA 493
aauaaagaaagccuaa

SEQ ID NO: 2578684 - RNA, 14 nt, Coxiella burnetii RSA 493
aauaaaggcgacca

SEQ ID NO: 2578685 - RNA, 23 nt, Coxiella burnetii RSA 493
aauaaaggcgaccaaaaaucgcc

SEQ ID NO: 2578686 - RNA, 11 nt, Coxiella burnetii RSA 493
aauaaaguaau

SEQ ID NO: 2578687 - RNA, 13 nt, Coxiella burnetii RSA 493
aauaaauagcauu

SEQ ID NO: 2578688 - RNA, 13 nt, Coxiella burnetii RSA 493
aauaaauggcguu

SEQ ID NO: 2578689 - RNA, 12 nt, Coxiella burnetii RSA 493
aauaaauuaauu

SEQ ID NO: 2578690 - RNA, 11 nt, Coxiella burnetii RSA 493
aauaacaaaga

SEQ ID NO: 2578691 - RNA, 14 nt, Coxiella burnetii RSA 493
aauaacaaagacuu

SEQ ID NO: 2578692 - RNA, 11 nt, Coxiella burnetii RSA 493
aauaacaaaug

SEQ ID NO: 2578693 - RNA, 14 nt, Coxiella burnetii RSA 493
aauaacaaugccaa

SEQ ID NO: 2578694 - RNA, 19 nt, Coxiella burnetii RSA 493
aauaacgcuaugaaaacca

SEQ ID NO: 2578695 - RNA, 14 nt, Coxiella burnetii RSA 493
aauaacggaaaaug

SEQ ID NO: 2578696 - RNA, 17 nt, Coxiella burnetii RSA 493
aauaacucggaacugau

SEQ ID NO: 2578697 - RNA, 23 nt, Coxiella burnetii RSA 493
aauaacuucuucuuuuaagugga

SEQ ID NO: 2578698 - RNA, 12 nt, Coxiella burnetii RSA 493
aauaagaauaag

SEQ ID NO: 2578699 - RNA, 21 nt, Coxiella burnetii RSA 493
aauaagacccgccaaagcaaa

SEQ ID NO: 2578700 - RNA, 21 nt, Coxiella burnetii RSA 493
aauaagagcuccaaacggucc

SEQ ID NO: 2578701 - RNA, 24 nt, Coxiella burnetii RSA 493
aauaagccaauacgaacaauuguu

SEQ ID NO: 2578702 - RNA, 19 nt, Coxiella burnetii RSA 493
aauaagccguucaccccau

SEQ ID NO: 2578703 - RNA, 17 nt, Coxiella burnetii RSA 493
aauaaggagcaucuguu

SEQ ID NO: 2578704 - RNA, 17 nt, Coxiella burnetii RSA 493
aauaaggauaaggauaa

SEQ ID NO: 2578705 - RNA, 18 nt, Coxiella burnetii RSA 493
aauaagggauaaaacaca

SEQ ID NO: 2578706 - RNA, 17 nt, Coxiella burnetii RSA 493
aauaagguuaaaucccu

SEQ ID NO: 2578707 - RNA, 11 nt, Coxiella burnetii RSA 493
aauaauaaaac

SEQ ID NO: 2578708 - RNA, 12 nt, Coxiella burnetii RSA 493
aauaauaaccca

SEQ ID NO: 2578709 - RNA, 14 nt, Coxiella burnetii RSA 493
aauaauaagcgucc

SEQ ID NO: 2578710 - RNA, 13 nt, Coxiella burnetii RSA 493
aauaauaguuugc

SEQ ID NO: 2578711 - RNA, 18 nt, Coxiella burnetii RSA 493
aauaauaguuugcaauac

SEQ ID NO: 2578712 - RNA, 14 nt, Coxiella burnetii RSA 493
aauaaucauuucga

SEQ ID NO: 2578713 - RNA, 15 nt, Coxiella burnetii RSA 493
aauaaucauuuuuau

SEQ ID NO: 2578714 - RNA, 22 nt, Coxiella burnetii RSA 493
aauaaucguaucgauuucuuuu

SEQ ID NO: 2578715 - RNA, 20 nt, Coxiella burnetii RSA 493
aauaaucucacacaacucca

SEQ ID NO: 2578716 - RNA, 21 nt, Coxiella burnetii RSA 493
aaucauuuuuguacugcugua

SEQ ID NO: 2578717 - RNA, 23 nt, Coxiella burnetii RSA 493
aauccaacgguucucaaauugcu

SEQ ID NO: 2578718 - RNA, 22 nt, Coxiella burnetii RSA 493
aauccagcgauuguaauugcuu

SEQ ID NO: 2578719 - RNA, 17 nt, Coxiella burnetii RSA 493
aauccaggguugauuga

SEQ ID NO: 2578720 - RNA, 13 nt, Coxiella burnetii RSA 493
aauccaguuuuuu

SEQ ID NO: 2578721 - RNA, 18 nt, Coxiella burnetii RSA 493
aauccaguuuuuuaacuc

SEQ ID NO: 2578722 - RNA, 16 nt, Coxiella burnetii RSA 493
aaucccaauaaaacgc

SEQ ID NO: 2578723 - RNA, 17 nt, Coxiella burnetii RSA 493
aauccgccgguacccca

SEQ ID NO: 2578724 - RNA, 18 nt, Coxiella burnetii RSA 493
aauccgccgguaccccau

SEQ ID NO: 2578725 - RNA, 21 nt, Coxiella burnetii RSA 493
aauccgcuuuauuuuucgcuc

SEQ ID NO: 2578726 - RNA, 19 nt, Coxiella burnetii RSA 493
aauccguuuugaaaaauaa

SEQ ID NO: 2578727 - RNA, 22 nt, Coxiella burnetii RSA 493
aauccguuuugaaaaauaaaag

SEQ ID NO: 2578728 - RNA, 13 nt, Coxiella burnetii RSA 493
aauccucaguaaa

SEQ ID NO: 2578729 - RNA, 21 nt, Coxiella burnetii RSA 493
aauccucaguaaaaacauccu

SEQ ID NO: 2578730 - RNA, 15 nt, Coxiella burnetii RSA 493
aauccucucucucac

SEQ ID NO: 2578731 - RNA, 13 nt, Coxiella burnetii RSA 493
aauccuucuuuug

SEQ ID NO: 2578732 - RNA, 19 nt, Coxiella burnetii RSA 493
aauccuuguugaauuccuu

SEQ ID NO: 2578733 - RNA, 13 nt, Coxiella burnetii RSA 493
aauccuuuaauuc

SEQ ID NO: 2578734 - RNA, 14 nt, Coxiella burnetii RSA 493
aauccuuuuuguaa

SEQ ID NO: 2578735 - RNA, 15 nt, Coxiella burnetii RSA 493
aaucgacaggacaaa

SEQ ID NO: 2578736 - RNA, 14 nt, Coxiella burnetii RSA 493
aaucgauggaagaa

SEQ ID NO: 2578737 - RNA, 16 nt, Coxiella burnetii RSA 493
aaucgauggaagaaca

SEQ ID NO: 2578738 - RNA, 20 nt, Coxiella burnetii RSA 493
aaucgcuaagcgaaaaauga

SEQ ID NO: 2578739 - RNA, 14 nt, Coxiella burnetii RSA 493
aaucggaaaagcca

SEQ ID NO: 2578740 - RNA, 19 nt, Coxiella burnetii RSA 493
aaucgugaaauaccucuuc

SEQ ID NO: 2578741 - RNA, 15 nt, Coxiella burnetii RSA 493
aaucguggccggcuu

SEQ ID NO: 2578742 - RNA, 17 nt, Coxiella burnetii RSA 493
aaucguuuuacccuuug

SEQ ID NO: 2578743 - RNA, 21 nt, Coxiella burnetii RSA 493
aaucuagcauaaucuuuuuag

SEQ ID NO: 2578744 - RNA, 20 nt, Coxiella burnetii RSA 493
aaucucacacaacuccacga

SEQ ID NO: 2578745 - RNA, 22 nt, Coxiella burnetii RSA 493
aaucucaucaucuucaaaaccu

SEQ ID NO: 2578746 - RNA, 14 nt, Coxiella burnetii RSA 493
aaucugcuuccucu

SEQ ID NO: 2578747 - RNA, 20 nt, Coxiella burnetii RSA 493
aaucuggguuucuuucuucu

SEQ ID NO: 2578748 - RNA, 21 nt, Coxiella burnetii RSA 493
aaucugugggaauguucugau

SEQ ID NO: 2578749 - RNA, 23 nt, Coxiella burnetii RSA 493
aaucuucugaucgauaaaaauaa

SEQ ID NO: 2578750 - RNA, 11 nt, Coxiella burnetii RSA 493
aaucuugcugc

SEQ ID NO: 2578751 - RNA, 19 nt, Coxiella burnetii RSA 493
aaugaaauuucucauauau

SEQ ID NO: 2578752 - RNA, 14 nt, Coxiella burnetii RSA 493
aaugaacaaaguag

SEQ ID NO: 2578753 - RNA, 17 nt, Coxiella burnetii RSA 493
aaugaauaagcaaagau

SEQ ID NO: 2578754 - RNA, 15 nt, Coxiella burnetii RSA 493
aaugaauagaaaaac

SEQ ID NO: 2578755 - RNA, 16 nt, Coxiella burnetii RSA 493
aaugaauagaaaaacu

SEQ ID NO: 2578756 - RNA, 14 nt, Coxiella burnetii RSA 493
aaugaccaaauaau

SEQ ID NO: 2578757 - RNA, 17 nt, Coxiella burnetii RSA 493
aaugaccaccacccccc

SEQ ID NO: 2578758 - RNA, 17 nt, Coxiella burnetii RSA 493
aaugacgaucgucuaaa

SEQ ID NO: 2578759 - RNA, 22 nt, Coxiella burnetii RSA 493
aaugacgauuaaaaauaaaacc

SEQ ID NO: 2578760 - RNA, 16 nt, Coxiella burnetii RSA 493
aaugacgauuaacaac

SEQ ID NO: 2578761 - RNA, 20 nt, Coxiella burnetii RSA 493
aaugacggaauuugugauuu

SEQ ID NO: 2578762 - RNA, 22 nt, Coxiella burnetii RSA 493
aaugacguauugucaaaauuag

SEQ ID NO: 2578763 - RNA, 14 nt, Coxiella burnetii RSA 493
aaugacuuuaacuc

SEQ ID NO: 2578764 - RNA, 18 nt, Coxiella burnetii RSA 493
aaugagcaucuuuucuga

SEQ ID NO: 2578765 - RNA, 14 nt, Coxiella burnetii RSA 493
aaugagggggagcc

SEQ ID NO: 2578766 - RNA, 20 nt, Coxiella burnetii RSA 493
aaugaucugcucuuuuguau

SEQ ID NO: 2578767 - RNA, 14 nt, Coxiella burnetii RSA 493
aaugauuuuaucga

SEQ ID NO: 2578768 - RNA, 18 nt, Coxiella burnetii RSA 493
aaugcagcacaaagcuga

SEQ ID NO: 2578769 - RNA, 13 nt, Coxiella burnetii RSA 493
aaugcaguuaacc

SEQ ID NO: 2578770 - RNA, 22 nt, Coxiella burnetii RSA 493
aaugcaguuaaccaauugauua

SEQ ID NO: 2578771 - RNA, 20 nt, Coxiella burnetii RSA 493
aaugccaacccaaggaacca

SEQ ID NO: 2578772 - RNA, 16 nt, Coxiella burnetii RSA 493
aaugccagauugauug

SEQ ID NO: 2578773 - RNA, 21 nt, Coxiella burnetii RSA 493
aaugccagauugauugcguaa

SEQ ID NO: 2578774 - RNA, 14 nt, Coxiella burnetii RSA 493
aaugccauuuuuau

SEQ ID NO: 2578775 - RNA, 13 nt, Coxiella burnetii RSA 493
aaugccgcuaaau

SEQ ID NO: 2578776 - RNA, 17 nt, Coxiella burnetii RSA 493
aaugccggcuaauuuuu

SEQ ID NO: 2578777 - RNA, 18 nt, Coxiella burnetii RSA 493
aaugccggcuaauuuuuu

SEQ ID NO: 2578778 - RNA, 15 nt, Coxiella burnetii RSA 493
aaugcgauucuuuuu

SEQ ID NO: 2578779 - RNA, 19 nt, Coxiella burnetii RSA 493
aaugcgguacuuaagaaag

SEQ ID NO: 2578780 - RNA, 23 nt, Coxiella burnetii RSA 493
aaugcugagaucggcugaaacgu

SEQ ID NO: 2578781 - RNA, 21 nt, Coxiella burnetii RSA 493
aaugcugaugaaauugcacau

SEQ ID NO: 2578782 - RNA, 18 nt, Coxiella burnetii RSA 493
aaugcuuucuuuuaauuc

SEQ ID NO: 2578783 - RNA, 18 nt, Coxiella burnetii RSA 493
aaugcuuuuuaaauaacu

SEQ ID NO: 2578784 - RNA, 15 nt, Coxiella burnetii RSA 493
aauggauauuuuaag

SEQ ID NO: 2578785 - RNA, 19 nt, Coxiella burnetii RSA 493
aauggauucuucuuuugcc

SEQ ID NO: 2578786 - RNA, 14 nt, Coxiella burnetii RSA 493
aauggauuuccacu

SEQ ID NO: 2578787 - RNA, 16 nt, Coxiella burnetii RSA 493
aauggcgggaaaaaau

SEQ ID NO: 2578788 - RNA, 17 nt, Coxiella burnetii RSA 493
aaugggaguaaugacag

SEQ ID NO: 2578789 - RNA, 22 nt, Coxiella burnetii RSA 493
aaugggcguacaaagagaagca

SEQ ID NO: 2578790 - RNA, 17 nt, Coxiella burnetii RSA 493
aaugguugaaagaaaaa

SEQ ID NO: 2578791 - RNA, 21 nt, Coxiella burnetii RSA 493
aaugguugaaagaaaaaaaac

SEQ ID NO: 2578792 - RNA, 22 nt, Coxiella burnetii RSA 493
aaugucagguucggauuucacu

SEQ ID NO: 2578793 - RNA, 21 nt, Coxiella burnetii RSA 493
aaugugugucauaaauaaaag

SEQ ID NO: 2578794 - RNA, 14 nt, Coxiella burnetii RSA 493
aauguuaaaacaca

SEQ ID NO: 2578795 - RNA, 15 nt, Coxiella burnetii RSA 493
aauguuauccgguuu

SEQ ID NO: 2578796 - RNA, 20 nt, Coxiella burnetii RSA 493
aauguuauuuauuuuucucu

SEQ ID NO: 2578797 - RNA, 21 nt, Coxiella burnetii RSA 493
aauguuauuuauuuuucucuu

SEQ ID NO: 2578798 - RNA, 15 nt, Coxiella burnetii RSA 493
aauguugauaauaaa

SEQ ID NO: 2578799 - RNA, 16 nt, Coxiella burnetii RSA 493
aauguugggcgaaaag

SEQ ID NO: 2578800 - RNA, 12 nt, Coxiella burnetii RSA 493
aauguuuaaauu

SEQ ID NO: 2578801 - RNA, 15 nt, Coxiella burnetii RSA 493
aauguuucuuuuaua

SEQ ID NO: 2578802 - RNA, 12 nt, Coxiella burnetii RSA 493
aauguuugauau

SEQ ID NO: 2578803 - RNA, 20 nt, Coxiella burnetii RSA 493
aauguuugauaucaaucgaa

SEQ ID NO: 2578804 - RNA, 14 nt, Coxiella burnetii RSA 493
aauguuuuuuaaua

SEQ ID NO: 2578805 - RNA, 17 nt, Coxiella burnetii RSA 493
aauguuuuuuaauaaau

SEQ ID NO: 2578806 - RNA, 13 nt, Coxiella burnetii RSA 493
aauuaaaaauauu

SEQ ID NO: 2578807 - RNA, 13 nt, Coxiella burnetii RSA 493
aauuaaauugcuc

SEQ ID NO: 2578808 - RNA, 14 nt, Coxiella burnetii RSA 493
aauuaaauuuacaa

SEQ ID NO: 2578809 - RNA, 13 nt, Coxiella burnetii RSA 493
aauuaacuuugca

SEQ ID NO: 2578810 - RNA, 14 nt, Coxiella burnetii RSA 493
aauuaagagaaauu

SEQ ID NO: 2578811 - RNA, 18 nt, Coxiella burnetii RSA 493
aauuaauuuauaaaauuu

SEQ ID NO: 2578812 - RNA, 14 nt, Coxiella burnetii RSA 493
aauuacaacuacua

SEQ ID NO: 2578813 - RNA, 13 nt, Coxiella burnetii RSA 493
aauuacaauccaa

SEQ ID NO: 2578814 - RNA, 19 nt, Coxiella burnetii RSA 493
aauuaccugaaugcuuuua

SEQ ID NO: 2578815 - RNA, 14 nt, Coxiella burnetii RSA 493
aauuacuuuuauaa

SEQ ID NO: 2578816 - RNA, 13 nt, Coxiella burnetii RSA 493
aauuagcauuuuc

SEQ ID NO: 2578817 - RNA, 16 nt, Coxiella burnetii RSA 493
aauuaggagaucuuuu

SEQ ID NO: 2578818 - RNA, 21 nt, Coxiella burnetii RSA 493
aauuaguaauauuuugcagau

SEQ ID NO: 2578819 - RNA, 19 nt, Coxiella burnetii RSA 493
aauuaucguacgaagauua

SEQ ID NO: 2578820 - RNA, 20 nt, Coxiella burnetii RSA 493
aauuaugcaagguugaugcu

SEQ ID NO: 2578821 - RNA, 14 nt, Coxiella burnetii RSA 493
aauucaaauuuuaa

SEQ ID NO: 2578822 - RNA, 18 nt, Coxiella burnetii RSA 493
aauucaggacugaaauaa

SEQ ID NO: 2578823 - RNA, 13 nt, Coxiella burnetii RSA 493
aauuccaaaaaca

SEQ ID NO: 2578824 - RNA, 22 nt, Coxiella burnetii RSA 493
aauuccaucacuuggugaacgu

SEQ ID NO: 2578825 - RNA, 16 nt, Coxiella burnetii RSA 493
aauuccauuaaaaaca

SEQ ID NO: 2578826 - RNA, 18 nt, Coxiella burnetii RSA 493
aauuccauuaaaaacaau

SEQ ID NO: 2578827 - RNA, 19 nt, Coxiella burnetii RSA 493
aauuccccguauuucgcuu

SEQ ID NO: 2578828 - RNA, 14 nt, Coxiella burnetii RSA 493
aauuccgccauuaa

SEQ ID NO: 2578829 - RNA, 19 nt, Coxiella burnetii RSA 493
aauuccgccauuaaugaua

SEQ ID NO: 2578830 - RNA, 24 nt, Coxiella burnetii RSA 493
aauuccuugcucaaguccuugcug

SEQ ID NO: 2578831 - RNA, 13 nt, Coxiella burnetii RSA 493
aauucgaaagaaa

SEQ ID NO: 2578832 - RNA, 19 nt, Coxiella burnetii RSA 493
aauucgcuuaaauuuugac

SEQ ID NO: 2578833 - RNA, 20 nt, Coxiella burnetii RSA 493
aauucguugcauucaauaca

SEQ ID NO: 2578834 - RNA, 10 nt, Coxiella burnetii RSA 493
aauucuaagg

SEQ ID NO: 2578835 - RNA, 23 nt, Coxiella burnetii RSA 493
aauucucccuuuuccugaacagg

SEQ ID NO: 2578836 - RNA, 20 nt, Coxiella burnetii RSA 493
aauucuccuuaauaaaguuu

SEQ ID NO: 2578837 - RNA, 13 nt, Coxiella burnetii RSA 493
aauucugaaucac

SEQ ID NO: 2578838 - RNA, 15 nt, Coxiella burnetii RSA 493
aauucuugcagugaa

SEQ ID NO: 2578839 - RNA, 19 nt, Coxiella burnetii RSA 493
aauucuugcagugaaauaa

SEQ ID NO: 2578840 - RNA, 13 nt, Coxiella burnetii RSA 493
aauucuuuuuaag

SEQ ID NO: 2578841 - RNA, 14 nt, Coxiella burnetii RSA 493
aauucuuuuuaaga

SEQ ID NO: 2578842 - RNA, 18 nt, Coxiella burnetii RSA 493
aauugaaaaaccauucaa

SEQ ID NO: 2578843 - RNA, 16 nt, Coxiella burnetii RSA 493
aauugaagaauugauu

SEQ ID NO: 2578844 - RNA, 15 nt, Coxiella burnetii RSA 493
aauugacaaauaaag

SEQ ID NO: 2578845 - RNA, 23 nt, Coxiella burnetii RSA 493
aauugaggucgagcguaaaacac

SEQ ID NO: 2578846 - RNA, 21 nt, Coxiella burnetii RSA 493
aauugccgauauucuuuuucu

SEQ ID NO: 2578847 - RNA, 15 nt, Coxiella burnetii RSA 493
aauugcgacucguuu

SEQ ID NO: 2578848 - RNA, 23 nt, Coxiella burnetii RSA 493
aauugcgccgguuuaaaacgacu

SEQ ID NO: 2578849 - RNA, 17 nt, Coxiella burnetii RSA 493
aauugcuaaauguuuag

SEQ ID NO: 2578850 - RNA, 23 nt, Coxiella burnetii RSA 493
aauugcuaccugcuucgcuucau

SEQ ID NO: 2578851 - RNA, 14 nt, Coxiella burnetii RSA 493
aauugcuccaaaca

SEQ ID NO: 2578852 - RNA, 17 nt, Coxiella burnetii RSA 493
aauugcuccaaacagac

SEQ ID NO: 2578853 - RNA, 18 nt, Coxiella burnetii RSA 493
aauugcugaacaaaagcc

SEQ ID NO: 2578854 - RNA, 20 nt, Coxiella burnetii RSA 493
aauugcugaacaaaagccau

SEQ ID NO: 2578855 - RNA, 21 nt, Coxiella burnetii RSA 493
aauugcugacaccuagccaaa

SEQ ID NO: 2578856 - RNA, 15 nt, Coxiella burnetii RSA 493
aauugcugauauuuu

SEQ ID NO: 2578857 - RNA, 17 nt, Coxiella burnetii RSA 493
aauugcuugggaacaac

SEQ ID NO: 2578858 - RNA, 23 nt, Coxiella burnetii RSA 493
aauugcuugguugauucaauaau

SEQ ID NO: 2578859 - RNA, 11 nt, Coxiella burnetii RSA 493
aauugcuuucc

SEQ ID NO: 2578860 - RNA, 18 nt, Coxiella burnetii RSA 493
aauuggaggacugcucuu

SEQ ID NO: 2578861 - RNA, 18 nt, Coxiella burnetii RSA 493
aauugggaguuguauaaa

SEQ ID NO: 2578862 - RNA, 17 nt, Coxiella burnetii RSA 493
aauuggucaggaacaac

SEQ ID NO: 2578863 - RNA, 13 nt, Coxiella burnetii RSA 493
aauuguguuuuaa

SEQ ID NO: 2578864 - RNA, 22 nt, Coxiella burnetii RSA 493
aauuguuucaugaaguuccauu

SEQ ID NO: 2578865 - RNA, 18 nt, Coxiella burnetii RSA 493
aauuguuugaaaaaauac

SEQ ID NO: 2578866 - RNA, 14 nt, Coxiella burnetii RSA 493
aauuuaaaccacua

SEQ ID NO: 2578867 - RNA, 20 nt, Coxiella burnetii RSA 493
aauuuaaacucaauucgcuu

SEQ ID NO: 2578868 - RNA, 22 nt, Coxiella burnetii RSA 493
aauuuaaacucaauucgcuuaa

SEQ ID NO: 2578869 - RNA, 19 nt, Coxiella burnetii RSA 493
aauuuaaaguuucuaacuc

SEQ ID NO: 2578870 - RNA, 15 nt, Coxiella burnetii RSA 493
aauuuaacacuuuaa

SEQ ID NO: 2578871 - RNA, 16 nt, Coxiella burnetii RSA 493
aauuuaaucuacucua

SEQ ID NO: 2578872 - RNA, 19 nt, Coxiella burnetii RSA 493
aauuuacuuuacgcucaau

SEQ ID NO: 2578873 - RNA, 19 nt, Coxiella burnetii RSA 493
aauuuagcuuuuuucaaaa

SEQ ID NO: 2578874 - RNA, 15 nt, Coxiella burnetii RSA 493
aauuuaggccuuaau

SEQ ID NO: 2578875 - RNA, 10 nt, Coxiella burnetii RSA 493
aauuuauuca

SEQ ID NO: 2578876 - RNA, 16 nt, Coxiella burnetii RSA 493
aauuuauuuucccauc

SEQ ID NO: 2578877 - RNA, 18 nt, Coxiella burnetii RSA 493
aauuucaacgccucucuc

SEQ ID NO: 2578878 - RNA, 19 nt, Coxiella burnetii RSA 493
aauuucaaugacuuuaacu

SEQ ID NO: 2578879 - RNA, 14 nt, Coxiella burnetii RSA 493
aauuucauaaauca

SEQ ID NO: 2578880 - RNA, 15 nt, Coxiella burnetii RSA 493
aauuucauuaucgca

SEQ ID NO: 2578881 - RNA, 13 nt, Coxiella burnetii RSA 493
aauuucgauuuua

SEQ ID NO: 2578882 - RNA, 17 nt, Coxiella burnetii RSA 493
aauuucggguucaaaaa

SEQ ID NO: 2578883 - RNA, 16 nt, Coxiella burnetii RSA 493
aauuucguugauuaau

SEQ ID NO: 2578884 - RNA, 13 nt, Coxiella burnetii RSA 493
aauuucuaaaaau

SEQ ID NO: 2578885 - RNA, 18 nt, Coxiella burnetii RSA 493
aauuucucgaaugacaac

SEQ ID NO: 2578886 - RNA, 19 nt, Coxiella burnetii RSA 493
aauuucucgccauauuugc

SEQ ID NO: 2578887 - RNA, 22 nt, Coxiella burnetii RSA 493
aauuucuggcuugcuaugaugc

SEQ ID NO: 2578888 - RNA, 23 nt, Coxiella burnetii RSA 493
aauuugaaauaaacuggaaaaag

SEQ ID NO: 2578889 - RNA, 23 nt, Coxiella burnetii RSA 493
aauuugagguugaauauccagca

SEQ ID NO: 2578890 - RNA, 15 nt, Coxiella burnetii RSA 493
aauuugaugccauaa

SEQ ID NO: 2578891 - RNA, 20 nt, Coxiella burnetii RSA 493
aauuugcauuaaucuuccau

SEQ ID NO: 2578892 - RNA, 19 nt, Coxiella burnetii RSA 493
aauuuguaauugcuuccaa

SEQ ID NO: 2578893 - RNA, 19 nt, Coxiella burnetii RSA 493
aauuugugaaauaugcacu

SEQ ID NO: 2578894 - RNA, 17 nt, Coxiella burnetii RSA 493
aauuugugauuuuaaaa

SEQ ID NO: 2578895 - RNA, 21 nt, Coxiella burnetii RSA 493
aauuuguuauugcuaaaaucg

SEQ ID NO: 2578896 - RNA, 16 nt, Coxiella burnetii RSA 493
aauuuuaaaaaacccu

SEQ ID NO: 2578897 - RNA, 11 nt, Coxiella burnetii RSA 493
aauuuuaaauc

SEQ ID NO: 2578898 - RNA, 13 nt, Coxiella burnetii RSA 493
aauuuuaaaucca

SEQ ID NO: 2578899 - RNA, 14 nt, Coxiella burnetii RSA 493
aauuuuauuauuua

SEQ ID NO: 2578900 - RNA, 20 nt, Coxiella burnetii RSA 493
aauuuuccagggaaguugcc

SEQ ID NO: 2578901 - RNA, 15 nt, Coxiella burnetii RSA 493
aauuuucccauucua

SEQ ID NO: 2578902 - RNA, 22 nt, Coxiella burnetii RSA 493
aauuuuccgugcagaaacaaua

SEQ ID NO: 2578903 - RNA, 13 nt, Coxiella burnetii RSA 493
aauuuucuuguuc

SEQ ID NO: 2578904 - RNA, 19 nt, Coxiella burnetii RSA 493
aauuuugaauccucaguaa

SEQ ID NO: 2578905 - RNA, 21 nt, Coxiella burnetii RSA 493
aauuuugggguuugucucuaa

SEQ ID NO: 2578906 - RNA, 13 nt, Coxiella burnetii RSA 493
aauuuuuccuuuc

SEQ ID NO: 2578907 - RNA, 23 nt, Coxiella burnetii RSA 493
aauuuuuccuuucuuucuucacu

SEQ ID NO: 2578908 - RNA, 16 nt, Coxiella burnetii RSA 493
aauuuuugaauaccag

SEQ ID NO: 2578909 - RNA, 17 nt, Coxiella burnetii RSA 493
aauuuuugaguucuuua

SEQ ID NO: 2578910 - RNA, 14 nt, Coxiella burnetii RSA 493
aauuuuuucauaac

SEQ ID NO: 2578911 - RNA, 15 nt, Coxiella burnetii RSA 493
aauuuuuucauaacg

SEQ ID NO: 2578912 - RNA, 14 nt, Coxiella burnetii RSA 493
aauuuuuugaaaaa

SEQ ID NO: 2578913 - RNA, 14 nt, Coxiella burnetii RSA 493
acaaaaaaauuauu

SEQ ID NO: 2578914 - RNA, 16 nt, Coxiella burnetii RSA 493
acaaaaaaauuauuuu

SEQ ID NO: 2578915 - RNA, 11 nt, Coxiella burnetii RSA 493
acaaaaauacu

SEQ ID NO: 2578916 - RNA, 17 nt, Coxiella burnetii RSA 493
acaaacaaaaaauagcg

SEQ ID NO: 2578917 - RNA, 12 nt, Coxiella burnetii RSA 493
acaaaccauuca

SEQ ID NO: 2578918 - RNA, 19 nt, Coxiella burnetii RSA 493
acaaaccuggcggcauuga

SEQ ID NO: 2578919 - RNA, 19 nt, Coxiella burnetii RSA 493
acaaacgauaaucucauca

SEQ ID NO: 2578920 - RNA, 14 nt, Coxiella burnetii RSA 493
acaaacgauuaccu

SEQ ID NO: 2578921 - RNA, 16 nt, Coxiella burnetii RSA 493
acaaagaauuuuucca

SEQ ID NO: 2578922 - RNA, 18 nt, Coxiella burnetii RSA 493
acaaaggcaaagccucuu

SEQ ID NO: 2578923 - RNA, 22 nt, Coxiella burnetii RSA 493
acaaaguaaguagcucuuaaaa

SEQ ID NO: 2578924 - RNA, 22 nt, Coxiella burnetii RSA 493
acaaagucagacuugcuuuuuu

SEQ ID NO: 2578925 - RNA, 14 nt, Coxiella burnetii RSA 493
acaaagugaaauau

SEQ ID NO: 2578926 - RNA, 20 nt, Coxiella burnetii RSA 493
acaaaguuucuucauauucu

SEQ ID NO: 2578927 - RNA, 20 nt, Coxiella burnetii RSA 493
acaaauaaacaaguuaacaa

SEQ ID NO: 2578928 - RNA, 18 nt, Coxiella burnetii RSA 493
accaaacguaagauugca

SEQ ID NO: 2578929 - RNA, 20 nt, Coxiella burnetii RSA 493
accaaagcggcgauggcugc

SEQ ID NO: 2578930 - RNA, 12 nt, Coxiella burnetii RSA 493
accaaauaauug

SEQ ID NO: 2578931 - RNA, 15 nt, Coxiella burnetii RSA 493
accaaauaauugauu

SEQ ID NO: 2578932 - RNA, 22 nt, Coxiella burnetii RSA 493
accaauaacucggaacugauga

SEQ ID NO: 2578933 - RNA, 19 nt, Coxiella burnetii RSA 493
accaauaagcuagaaaaua

SEQ ID NO: 2578934 - RNA, 15 nt, Coxiella burnetii RSA 493
accaauaauucuuca

SEQ ID NO: 2578935 - RNA, 18 nt, Coxiella burnetii RSA 493
accaaucaauaaaaauau

SEQ ID NO: 2578936 - RNA, 11 nt, Coxiella burnetii RSA 493
accaaugaaac

SEQ ID NO: 2578937 - RNA, 21 nt, Coxiella burnetii RSA 493
accaaugaaacgcgccaaaca

SEQ ID NO: 2578938 - RNA, 15 nt, Coxiella burnetii RSA 493
accaauucaaauaau

SEQ ID NO: 2578939 - RNA, 21 nt, Coxiella burnetii RSA 493
accaccuggcuaguaaauaaa

SEQ ID NO: 2578940 - RNA, 14 nt, Coxiella burnetii RSA 493
accacgcuaaaugg

SEQ ID NO: 2578941 - RNA, 22 nt, Coxiella burnetii RSA 493
accacuguccucuguccucugc

SEQ ID NO: 2578942 - RNA, 15 nt, Coxiella burnetii RSA 493
accacugucuucugu

SEQ ID NO: 2578943 - RNA, 23 nt, Coxiella burnetii RSA 493
accacuuccauacuaauuucagg

SEQ ID NO: 2578944 - RNA, 20 nt, Coxiella burnetii RSA 493
accagaaauauuuucucaau

SEQ ID NO: 2578945 - RNA, 23 nt, Coxiella burnetii RSA 493
accaggacguuauagaguaaaua

SEQ ID NO: 2578946 - RNA, 16 nt, Coxiella burnetii RSA 493
accagggguuauaaaa

SEQ ID NO: 2578947 - RNA, 18 nt, Coxiella burnetii RSA 493
accagggguuauaaaauu

SEQ ID NO: 2578948 - RNA, 15 nt, Coxiella burnetii RSA 493
accauaacuaaaucg

SEQ ID NO: 2578949 - RNA, 16 nt, Coxiella burnetii RSA 493
accaucaaucaaauga

SEQ ID NO: 2578950 - RNA, 11 nt, Coxiella burnetii RSA 493
accaucgccac

SEQ ID NO: 2578951 - RNA, 22 nt, Coxiella burnetii RSA 493
accaucgccaguuuuuugggau

SEQ ID NO: 2578952 - RNA, 14 nt, Coxiella burnetii RSA 493
accaugguuucuuu

SEQ ID NO: 2578953 - RNA, 15 nt, Coxiella burnetii RSA 493
accauugggauucga

SEQ ID NO: 2578954 - RNA, 14 nt, Coxiella burnetii RSA 493
accauuuugacaaa

SEQ ID NO: 2578955 - RNA, 12 nt, Coxiella burnetii RSA 493
accauuuuuaaa

SEQ ID NO: 2578956 - RNA, 21 nt, Coxiella burnetii RSA 493
acccacagccgcuuuuuauug

SEQ ID NO: 2578957 - RNA, 21 nt, Coxiella burnetii RSA 493
acccacgaugauuaaaucaac

SEQ ID NO: 2578958 - RNA, 16 nt, Coxiella burnetii RSA 493
acccacggcaaauaaa

SEQ ID NO: 2578959 - RNA, 20 nt, Coxiella burnetii RSA 493
acccacggcgccaucaacca

SEQ ID NO: 2578960 - RNA, 17 nt, Coxiella burnetii RSA 493
acccaggcguagauuuu

SEQ ID NO: 2578961 - RNA, 21 nt, Coxiella burnetii RSA 493
acccaggcguagauuuuaaau

SEQ ID NO: 2578962 - RNA, 19 nt, Coxiella burnetii RSA 493
acccagggcuauuuuaagc

SEQ ID NO: 2578963 - RNA, 17 nt, Coxiella burnetii RSA 493
acccaguuguuuuaaau

SEQ ID NO: 2578964 - RNA, 14 nt, Coxiella burnetii RSA 493
acccauaacgaaaa

SEQ ID NO: 2578965 - RNA, 12 nt, Coxiella burnetii RSA 493
acccauccaucc

SEQ ID NO: 2578966 - RNA, 15 nt, Coxiella burnetii RSA 493
acccauuuuuuugau

SEQ ID NO: 2578967 - RNA, 18 nt, Coxiella burnetii RSA 493
acccauuuuuuugauucu

SEQ ID NO: 2578968 - RNA, 15 nt, Coxiella burnetii RSA 493
accccaaucgauuaa

SEQ ID NO: 2578969 - RNA, 21 nt, Coxiella burnetii RSA 493
accccacaucguuucaaacac

SEQ ID NO: 2578970 - RNA, 19 nt, Coxiella burnetii RSA 493
accccaucuacuucccgca

SEQ ID NO: 2578971 - RNA, 18 nt, Coxiella burnetii RSA 493
accccgauuuaauaauca

SEQ ID NO: 2578972 - RNA, 18 nt, Coxiella burnetii RSA 493
acccgaggaugaugaaaa

SEQ ID NO: 2578973 - RNA, 19 nt, Coxiella burnetii RSA 493
acccgccaaagcaaaaaua

SEQ ID NO: 2578974 - RNA, 18 nt, Coxiella burnetii RSA 493
acccgucuuuaauacaag

SEQ ID NO: 2578975 - RNA, 22 nt, Coxiella burnetii RSA 493
acccguuuaaauuugccuugau

SEQ ID NO: 2578976 - RNA, 17 nt, Coxiella burnetii RSA 493
acccucuuuuuaaaaaa

SEQ ID NO: 2578977 - RNA, 18 nt, Coxiella burnetii RSA 493
acccucuuuuuaaaaaau

SEQ ID NO: 2578978 - RNA, 19 nt, Coxiella burnetii RSA 493
acccugaacauuaagaaag

SEQ ID NO: 2578979 - RNA, 12 nt, Coxiella burnetii RSA 493
acccuggguucc

SEQ ID NO: 2578980 - RNA, 14 nt, Coxiella burnetii RSA 493
acccuucuguuuaa

SEQ ID NO: 2578981 - RNA, 20 nt, Coxiella burnetii RSA 493
acccuugaccgcuuagcaau

SEQ ID NO: 2578982 - RNA, 18 nt, Coxiella burnetii RSA 493
acccuuucauuuaauuuu

SEQ ID NO: 2578983 - RNA, 20 nt, Coxiella burnetii RSA 493
acccuuucauuuaauuuuaa

SEQ ID NO: 2578984 - RNA, 16 nt, Coxiella burnetii RSA 493
acccuuuucaauuucu

SEQ ID NO: 2578985 - RNA, 23 nt, Coxiella burnetii RSA 493
acccuuuugcaaaccgcgcugaa

SEQ ID NO: 2578986 - RNA, 22 nt, Coxiella burnetii RSA 493
accgacgaauaacggaaaaugg

SEQ ID NO: 2578987 - RNA, 22 nt, Coxiella burnetii RSA 493
accgacgacauuaaaaaugaua

SEQ ID NO: 2578988 - RNA, 15 nt, Coxiella burnetii RSA 493
accgagauuuuuccg

SEQ ID NO: 2578989 - RNA, 18 nt, Coxiella burnetii RSA 493
accgagcuucauggcuug

SEQ ID NO: 2578990 - RNA, 19 nt, Coxiella burnetii RSA 493
accgaggucuuuuauuuca

SEQ ID NO: 2578991 - RNA, 23 nt, Coxiella burnetii RSA 493
accgauacuuuguuuuuuuucag

SEQ ID NO: 2578992 - RNA, 13 nt, Coxiella burnetii RSA 493
accgauuaauucu

SEQ ID NO: 2578993 - RNA, 21 nt, Coxiella burnetii RSA 493
accgauucauaaaaaaugauu

SEQ ID NO: 2578994 - RNA, 20 nt, Coxiella burnetii RSA 493
accgccaaaagggaacaaug

SEQ ID NO: 2578995 - RNA, 14 nt, Coxiella burnetii RSA 493
accgccuuuaagau

SEQ ID NO: 2578996 - RNA, 20 nt, Coxiella burnetii RSA 493
accgcugacgucagaaaaca

SEQ ID NO: 2578997 - RNA, 21 nt, Coxiella burnetii RSA 493
accgcugacgucagaaaacag

SEQ ID NO: 2578998 - RNA, 13 nt, Coxiella burnetii RSA 493
accgcuggugaga

SEQ ID NO: 2578999 - RNA, 15 nt, Coxiella burnetii RSA 493
accgcuugcgggaga

SEQ ID NO: 2579000 - RNA, 14 nt, Coxiella burnetii RSA 493
accggcaaacccau

SEQ ID NO: 2579001 - RNA, 17 nt, Coxiella burnetii RSA 493
accgguuaggaugcgaa

SEQ ID NO: 2579002 - RNA, 16 nt, Coxiella burnetii RSA 493
accgguuuuucuucau

SEQ ID NO: 2579003 - RNA, 18 nt, Coxiella burnetii RSA 493
accguaaaacgaaucuuu

SEQ ID NO: 2579004 - RNA, 14 nt, Coxiella burnetii RSA 493
accgucacuucuuc

SEQ ID NO: 2579005 - RNA, 20 nt, Coxiella burnetii RSA 493
accguuuaaaccaaaaccaa

SEQ ID NO: 2579006 - RNA, 13 nt, Coxiella burnetii RSA 493
accguuuugagua

SEQ ID NO: 2579007 - RNA, 17 nt, Coxiella burnetii RSA 493
accuaaagaaagaagaa

SEQ ID NO: 2579008 - RNA, 15 nt, Coxiella burnetii RSA 493
accuaauuugauuuu

SEQ ID NO: 2579009 - RNA, 16 nt, Coxiella burnetii RSA 493
accuaauuugauuuuu

SEQ ID NO: 2579010 - RNA, 13 nt, Coxiella burnetii RSA 493
accuacuuuucua

SEQ ID NO: 2579011 - RNA, 14 nt, Coxiella burnetii RSA 493
accuagcaauaacu

SEQ ID NO: 2579012 - RNA, 16 nt, Coxiella burnetii RSA 493
accuauccaaaaagau

SEQ ID NO: 2579013 - RNA, 20 nt, Coxiella burnetii RSA 493
accucauuggcgguuaaggu

SEQ ID NO: 2579014 - RNA, 16 nt, Coxiella burnetii RSA 493
accucuaaaaauuaaa

SEQ ID NO: 2579015 - RNA, 19 nt, Coxiella burnetii RSA 493
accucuucgaagugugauu

SEQ ID NO: 2579016 - RNA, 17 nt, Coxiella burnetii RSA 493
accugauaaaauaacag

SEQ ID NO: 2579017 - RNA, 19 nt, Coxiella burnetii RSA 493
accugcuccuuuucuucga

SEQ ID NO: 2579018 - RNA, 15 nt, Coxiella burnetii RSA 493
accuggcggcauuga

SEQ ID NO: 2579019 - RNA, 11 nt, Coxiella burnetii RSA 493
accugugaggg

SEQ ID NO: 2579020 - RNA, 13 nt, Coxiella burnetii RSA 493
accuguuaaaaac

SEQ ID NO: 2579021 - RNA, 17 nt, Coxiella burnetii RSA 493
accuuaacgccuaucuu

SEQ ID NO: 2579022 - RNA, 20 nt, Coxiella burnetii RSA 493
accuuaacgccuaucuuuuu

SEQ ID NO: 2579023 - RNA, 17 nt, Coxiella burnetii RSA 493
accuuaaucgugaaaua

SEQ ID NO: 2579024 - RNA, 15 nt, Coxiella burnetii RSA 493
accuucaaaaauaaa

SEQ ID NO: 2579025 - RNA, 18 nt, Coxiella burnetii RSA 493
accuuccgucaauuuuuc

SEQ ID NO: 2579026 - RNA, 23 nt, Coxiella burnetii RSA 493
accuuccgucaauuuuucuuuuu

SEQ ID NO: 2579027 - RNA, 19 nt, Coxiella burnetii RSA 493
accuugccauccaaaugag

SEQ ID NO: 2579028 - RNA, 15 nt, Coxiella burnetii RSA 493
accuugucacaagug

SEQ ID NO: 2579029 - RNA, 21 nt, Coxiella burnetii RSA 493
accuuucgcuuguuuauauuu

SEQ ID NO: 2579030 - RNA, 22 nt, Coxiella burnetii RSA 493
accuuucgcuuguuuauauuua

SEQ ID NO: 2579031 - RNA, 11 nt, Coxiella burnetii RSA 493
accuuugcaaa

SEQ ID NO: 2579032 - RNA, 14 nt, Coxiella burnetii RSA 493
accuuuguucgguu

SEQ ID NO: 2579033 - RNA, 15 nt, Coxiella burnetii RSA 493
acuaaucgcuguuaa

SEQ ID NO: 2579034 - RNA, 19 nt, Coxiella burnetii RSA 493
acuaaucgcuguuaauaau

SEQ ID NO: 2579035 - RNA, 17 nt, Coxiella burnetii RSA 493
acuaaucgucgacaaaa

SEQ ID NO: 2579036 - RNA, 20 nt, Coxiella burnetii RSA 493
acuaaugguuggacuacauc

SEQ ID NO: 2579037 - RNA, 23 nt, Coxiella burnetii RSA 493
acuaccuuccgucaauuuuucuu

SEQ ID NO: 2579038 - RNA, 14 nt, Coxiella burnetii RSA 493
acuacgaauagcca

SEQ ID NO: 2579039 - RNA, 17 nt, Coxiella burnetii RSA 493
acuacgaauagccaaug

SEQ ID NO: 2579040 - RNA, 14 nt, Coxiella burnetii RSA 493
acuacuaagccacc

SEQ ID NO: 2579041 - RNA, 14 nt, Coxiella burnetii RSA 493
acuagaaauauuag

SEQ ID NO: 2579042 - RNA, 13 nt, Coxiella burnetii RSA 493
acuagucaacaaa

SEQ ID NO: 2579043 - RNA, 16 nt, Coxiella burnetii RSA 493
acuagucaacaaacga

SEQ ID NO: 2579044 - RNA, 15 nt, Coxiella burnetii RSA 493
acuaguuauuuuuaa

SEQ ID NO: 2579045 - RNA, 16 nt, Coxiella burnetii RSA 493
acuaguuauuuuuaaa

SEQ ID NO: 2579046 - RNA, 18 nt, Coxiella burnetii RSA 493
acuaucgugauucuguuc

SEQ ID NO: 2579047 - RNA, 22 nt, Coxiella burnetii RSA 493
acuaugaucaugccuuuuuugc

SEQ ID NO: 2579048 - RNA, 15 nt, Coxiella burnetii RSA 493
acuauuauuaaaaga

SEQ ID NO: 2579049 - RNA, 20 nt, Coxiella burnetii RSA 493
acuauugaagucugguuaaa

SEQ ID NO: 2579050 - RNA, 21 nt, Coxiella burnetii RSA 493
acuauugcgcaaauugcaaaa

SEQ ID NO: 2579051 - RNA, 17 nt, Coxiella burnetii RSA 493
acuauuugcuuucuuug

SEQ ID NO: 2579052 - RNA, 15 nt, Coxiella burnetii RSA 493
acucaaccagaaaua

SEQ ID NO: 2579053 - RNA, 15 nt, Coxiella burnetii RSA 493
acucagcccaacaua

SEQ ID NO: 2579054 - RNA, 17 nt, Coxiella burnetii RSA 493
acucauaacgcguuucc

SEQ ID NO: 2579055 - RNA, 18 nt, Coxiella burnetii RSA 493
acucauuauucagacguu

SEQ ID NO: 2579056 - RNA, 20 nt, Coxiella burnetii RSA 493
acuccgcccccccaaacaaa

SEQ ID NO: 2579057 - RNA, 22 nt, Coxiella burnetii RSA 493
acuccgcccccccaaacaaaag

SEQ ID NO: 2579058 - RNA, 23 nt, Coxiella burnetii RSA 493
acuccgcugcuccacaaugcauu

SEQ ID NO: 2579059 - RNA, 17 nt, Coxiella burnetii RSA 493
acuccugggguaaugau

SEQ ID NO: 2579060 - RNA, 13 nt, Coxiella burnetii RSA 493
acucgaauuuguu

SEQ ID NO: 2579061 - RNA, 15 nt, Coxiella burnetii RSA 493
acucggcuuuauaug

SEQ ID NO: 2579062 - RNA, 20 nt, Coxiella burnetii RSA 493
acucgucuggggauacaccc

SEQ ID NO: 2579063 - RNA, 19 nt, Coxiella burnetii RSA 493
acucguuucggauuuugaa

SEQ ID NO: 2579064 - RNA, 22 nt, Coxiella burnetii RSA 493
acucguuucggauuuugaacag

SEQ ID NO: 2579065 - RNA, 23 nt, Coxiella burnetii RSA 493
acucguuucggauuuugaacagu

SEQ ID NO: 2579066 - RNA, 18 nt, Coxiella burnetii RSA 493
acucuaaguuauggauac

SEQ ID NO: 2579067 - RNA, 14 nt, Coxiella burnetii RSA 493
acucuaauuuucuu

SEQ ID NO: 2579068 - RNA, 16 nt, Coxiella burnetii RSA 493
acucuaggauauugca

SEQ ID NO: 2579069 - RNA, 20 nt, Coxiella burnetii RSA 493
acucucuagcuguuuuuucu

SEQ ID NO: 2579070 - RNA, 16 nt, Coxiella burnetii RSA 493
acucucuuuauuuuuu

SEQ ID NO: 2579071 - RNA, 18 nt, Coxiella burnetii RSA 493
acucucuuuauuuuuucu

SEQ ID NO: 2579072 - RNA, 21 nt, Coxiella burnetii RSA 493
acucuguuagauauugaacag

SEQ ID NO: 2579073 - RNA, 21 nt, Coxiella burnetii RSA 493
acucuugccggauugauaaag

SEQ ID NO: 2579074 - RNA, 14 nt, Coxiella burnetii RSA 493
acucuuuauuauaa

SEQ ID NO: 2579075 - RNA, 11 nt, Coxiella burnetii RSA 493
acucuuuggcg

SEQ ID NO: 2579076 - RNA, 18 nt, Coxiella burnetii RSA 493
acugaaaaguaaaagucc

SEQ ID NO: 2579077 - RNA, 15 nt, Coxiella burnetii RSA 493
acugaagaguaaaaa

SEQ ID NO: 2579078 - RNA, 19 nt, Coxiella burnetii RSA 493
acugaagaguaaaaaacca

SEQ ID NO: 2579079 - RNA, 22 nt, Coxiella burnetii RSA 493
acugagucugccuuuuuuuacu

SEQ ID NO: 2579080 - RNA, 21 nt, Coxiella burnetii RSA 493
acugauaacuauuauuaaaag

SEQ ID NO: 2579081 - RNA, 15 nt, Coxiella burnetii RSA 493
acugaugcaaaucau

SEQ ID NO: 2579082 - RNA, 22 nt, Coxiella burnetii RSA 493
acugauguauccuaauaaaaau

SEQ ID NO: 2579083 - RNA, 15 nt, Coxiella burnetii RSA 493
acugcccaagaaauu

SEQ ID NO: 2579084 - RNA, 22 nt, Coxiella burnetii RSA 493
acugcucuuaauacccguuucu

SEQ ID NO: 2579085 - RNA, 20 nt, Coxiella burnetii RSA 493
acugcuuguaccugccauuu

SEQ ID NO: 2579086 - RNA, 19 nt, Coxiella burnetii RSA 493
acugggccaggaccaaaga

SEQ ID NO: 2579087 - RNA, 14 nt, Coxiella burnetii RSA 493
acuguaaccuucuc

SEQ ID NO: 2579088 - RNA, 13 nt, Coxiella burnetii RSA 493
acuguuuguugcu

SEQ ID NO: 2579089 - RNA, 15 nt, Coxiella burnetii RSA 493
acuuacgcugaagua

SEQ ID NO: 2579090 - RNA, 15 nt, Coxiella burnetii RSA 493
acuuacgcugaaguu

SEQ ID NO: 2579091 - RNA, 17 nt, Coxiella burnetii RSA 493
acuuacgcugaaguuga

SEQ ID NO: 2579092 - RNA, 20 nt, Coxiella burnetii RSA 493
acuuagcugauuucucuuuu

SEQ ID NO: 2579093 - RNA, 22 nt, Coxiella burnetii RSA 493
acuuagucgcguaccacgcuga

SEQ ID NO: 2579094 - RNA, 19 nt, Coxiella burnetii RSA 493
acuuauaaauuaaauugcu

SEQ ID NO: 2579095 - RNA, 12 nt, Coxiella burnetii RSA 493
acuuauccaugc

SEQ ID NO: 2579096 - RNA, 19 nt, Coxiella burnetii RSA 493
acuuauuuguugaacagag

SEQ ID NO: 2579097 - RNA, 12 nt, Coxiella burnetii RSA 493
acuuauuuuuau

SEQ ID NO: 2579098 - RNA, 23 nt, Coxiella burnetii RSA 493
acuucaguuggcucauuguuaau

SEQ ID NO: 2579099 - RNA, 22 nt, Coxiella burnetii RSA 493
acuucauacgggcuacucuaau

SEQ ID NO: 2579100 - RNA, 22 nt, Coxiella burnetii RSA 493
acuucaugcaaaaauuguuuau

SEQ ID NO: 2579101 - RNA, 22 nt, Coxiella burnetii RSA 493
acuucccauucaaggaauuauu

SEQ ID NO: 2579102 - RNA, 12 nt, Coxiella burnetii RSA 493
acuucccgcaaa

SEQ ID NO: 2579103 - RNA, 22 nt, Coxiella burnetii RSA 493
acuucugacaagaccccuauca

SEQ ID NO: 2579104 - RNA, 22 nt, Coxiella burnetii RSA 493
acuucuggcggugcgaauaaca

SEQ ID NO: 2579105 - RNA, 19 nt, Coxiella burnetii RSA 493
acuucuucauuaaauccuc

SEQ ID NO: 2579106 - RNA, 19 nt, Coxiella burnetii RSA 493
acuucuuuuucgauuuuuu

SEQ ID NO: 2579107 - RNA, 15 nt, Coxiella burnetii RSA 493
acuugauauucccuc

SEQ ID NO: 2579108 - RNA, 21 nt, Coxiella burnetii RSA 493
acuugauauucccucuuuacc

SEQ ID NO: 2579109 - RNA, 22 nt, Coxiella burnetii RSA 493
acuugauauucccucuuuaccu

SEQ ID NO: 2579110 - RNA, 20 nt, Coxiella burnetii RSA 493
acuugcuuccccaauuuauu

SEQ ID NO: 2579111 - RNA, 10 nt, Coxiella burnetii RSA 493
acuugggggu

SEQ ID NO: 2579112 - RNA, 16 nt, Coxiella burnetii RSA 493
acuugucaauuuaccu

SEQ ID NO: 2579113 - RNA, 14 nt, Coxiella burnetii RSA 493
acuuguccuucuuc

SEQ ID NO: 2579114 - RNA, 15 nt, Coxiella burnetii RSA 493
acuuguugaaaaccu

SEQ ID NO: 2579115 - RNA, 17 nt, Coxiella burnetii RSA 493
acuuuaagauuucuuca

SEQ ID NO: 2579116 - RNA, 17 nt, Coxiella burnetii RSA 493
acuuuaagcacuucuuu

SEQ ID NO: 2579117 - RNA, 14 nt, Coxiella burnetii RSA 493
acuuuaccuaacuc

SEQ ID NO: 2579118 - RNA, 19 nt, Coxiella burnetii RSA 493
acuuuaccuaacucaaccu

SEQ ID NO: 2579119 - RNA, 15 nt, Coxiella burnetii RSA 493
acuuuacuuuuugua

SEQ ID NO: 2579120 - RNA, 18 nt, Coxiella burnetii RSA 493
acuuuaguuuuucccucu

SEQ ID NO: 2579121 - RNA, 19 nt, Coxiella burnetii RSA 493
acuuuauaguucauuaaau

SEQ ID NO: 2579122 - RNA, 17 nt, Coxiella burnetii RSA 493
acuuucacuaauuauaa

SEQ ID NO: 2579123 - RNA, 15 nt, Coxiella burnetii RSA 493
acuuuccuuauccuc

SEQ ID NO: 2579124 - RNA, 17 nt, Coxiella burnetii RSA 493
acuuucucgcuuaauuc

SEQ ID NO: 2579125 - RNA, 18 nt, Coxiella burnetii RSA 493
acuuucuuagcaucgauc

SEQ ID NO: 2579126 - RNA, 22 nt, Coxiella burnetii RSA 493
acuuucuuagcaucgaucccuc

SEQ ID NO: 2579127 - RNA, 23 nt, Coxiella burnetii RSA 493
acuuugcuguuccaggaauugca

SEQ ID NO: 2579128 - RNA, 18 nt, Coxiella burnetii RSA 493
acuuugguaguccugagu

SEQ ID NO: 2579129 - RNA, 16 nt, Coxiella burnetii RSA 493
acuuuucggagaaauc

SEQ ID NO: 2579130 - RNA, 21 nt, Coxiella burnetii RSA 493
acuuuucuggcuguacuuuca

SEQ ID NO: 2579131 - RNA, 19 nt, Coxiella burnetii RSA 493
acuuuugcgcuuauagcuu

SEQ ID NO: 2579132 - RNA, 18 nt, Coxiella burnetii RSA 493
acuuuuuagggcugaaaa

SEQ ID NO: 2579133 - RNA, 16 nt, Coxiella burnetii RSA 493
acuuuuucaaagauau

SEQ ID NO: 2579134 - RNA, 18 nt, Coxiella burnetii RSA 493
acuuuuucaaugccauuu

SEQ ID NO: 2579135 - RNA, 22 nt, Coxiella burnetii RSA 493
acuuuuucaaugccauuuuuau

SEQ ID NO: 2579136 - RNA, 14 nt, Coxiella burnetii RSA 493
acuuuuuuccuucg

SEQ ID NO: 2579137 - RNA, 12 nt, Coxiella burnetii RSA 493
acuuuuuucuuu

SEQ ID NO: 2579138 - RNA, 16 nt, Coxiella burnetii RSA 493
agaugguuggcgaagg

SEQ ID NO: 2579139 - RNA, 13 nt, Coxiella burnetii RSA 493
agauuagaaaaag

SEQ ID NO: 2579140 - RNA, 21 nt, Coxiella burnetii RSA 493
agauuagaaaaagcgauucca

SEQ ID NO: 2579141 - RNA, 16 nt, Coxiella burnetii RSA 493
agauuauucaagguua

SEQ ID NO: 2579142 - RNA, 14 nt, Coxiella burnetii RSA 493
agauucaugaaaau

SEQ ID NO: 2579143 - RNA, 13 nt, Coxiella burnetii RSA 493
agauucccgcugc

SEQ ID NO: 2579144 - RNA, 23 nt, Coxiella burnetii RSA 493
agauucccgcugccuuuaccuug

SEQ ID NO: 2579145 - RNA, 21 nt, Coxiella burnetii RSA 493
agauugccacucuuuauuaua

SEQ ID NO: 2579146 - RNA, 13 nt, Coxiella burnetii RSA 493
agauuuagccaaa

SEQ ID NO: 2579147 - RNA, 16 nt, Coxiella burnetii RSA 493
agauuuuaaauaccau

SEQ ID NO: 2579148 - RNA, 17 nt, Coxiella burnetii RSA 493
agauuuuaaauaccauu

SEQ ID NO: 2579149 - RNA, 13 nt, Coxiella burnetii RSA 493
agcaaaaugaggg

SEQ ID NO: 2579150 - RNA, 15 nt, Coxiella burnetii RSA 493
agcaaacccauuuca

SEQ ID NO: 2579151 - RNA, 16 nt, Coxiella burnetii RSA 493
agcaaacccauuucau

SEQ ID NO: 2579152 - RNA, 21 nt, Coxiella burnetii RSA 493
agcaaccguugagcaagcaga

SEQ ID NO: 2579153 - RNA, 15 nt, Coxiella burnetii RSA 493
agcaacgccuuuccc

SEQ ID NO: 2579154 - RNA, 14 nt, Coxiella burnetii RSA 493
agcaagcaaccguu

SEQ ID NO: 2579155 - RNA, 19 nt, Coxiella burnetii RSA 493
agcaaggcgcuuuuauucc

SEQ ID NO: 2579156 - RNA, 13 nt, Coxiella burnetii RSA 493
agcaauggguuag

SEQ ID NO: 2579157 - RNA, 11 nt, Coxiella burnetii RSA 493
agcaauguuuc

SEQ ID NO: 2579158 - RNA, 11 nt, Coxiella burnetii RSA 493
agcaauuuuuu

SEQ ID NO: 2579159 - RNA, 17 nt, Coxiella burnetii RSA 493
agcacaaccuugccaag

SEQ ID NO: 2579160 - RNA, 21 nt, Coxiella burnetii RSA 493
agcaccgacgacauuaaaaau

SEQ ID NO: 2579161 - RNA, 21 nt, Coxiella burnetii RSA 493
agcacgcgauacuuguugaca

SEQ ID NO: 2579162 - RNA, 19 nt, Coxiella burnetii RSA 493
agcacgggaugauuuuucc

SEQ ID NO: 2579163 - RNA, 21 nt, Coxiella burnetii RSA 493
agcacuuaacuccuucgcuuu

SEQ ID NO: 2579164 - RNA, 21 nt, Coxiella burnetii RSA 493
agcagcgugcagcugauuucu

SEQ ID NO: 2579165 - RNA, 17 nt, Coxiella burnetii RSA 493
agcagcuucuaaagcca

SEQ ID NO: 2579166 - RNA, 23 nt, Coxiella burnetii RSA 493
agcaggacauacggggaguuuag

SEQ ID NO: 2579167 - RNA, 23 nt, Coxiella burnetii RSA 493
agcaggagggugcgauuaaaagu

SEQ ID NO: 2579168 - RNA, 22 nt, Coxiella burnetii RSA 493
agcaggugacuguuaaucacuu

SEQ ID NO: 2579169 - RNA, 14 nt, Coxiella burnetii RSA 493
agcaguaaugagca

SEQ ID NO: 2579170 - RNA, 15 nt, Coxiella burnetii RSA 493
agcaguuuuuuacuu

SEQ ID NO: 2579171 - RNA, 13 nt, Coxiella burnetii RSA 493
agcauauaaaagu

SEQ ID NO: 2579172 - RNA, 23 nt, Coxiella burnetii RSA 493
agcauauaaaaguuacgccccaa

SEQ ID NO: 2579173 - RNA, 20 nt, Coxiella burnetii RSA 493
agcaucaagggcaaaaacau

SEQ ID NO: 2579174 - RNA, 15 nt, Coxiella burnetii RSA 493
agcaucaauaagccg

SEQ ID NO: 2579175 - RNA, 19 nt, Coxiella burnetii RSA 493
agcaucaauaagccguuca

SEQ ID NO: 2579176 - RNA, 15 nt, Coxiella burnetii RSA 493
agcaucaauaaugcc

SEQ ID NO: 2579177 - RNA, 11 nt, Coxiella burnetii RSA 493
agcaugcccau

SEQ ID NO: 2579178 - RNA, 15 nt, Coxiella burnetii RSA 493
agcauuaaaaaauaa

SEQ ID NO: 2579179 - RNA, 17 nt, Coxiella burnetii RSA 493
agcauucccauagaaga

SEQ ID NO: 2579180 - RNA, 18 nt, Coxiella burnetii RSA 493
agcauuguuggaaauaau

SEQ ID NO: 2579181 - RNA, 19 nt, Coxiella burnetii RSA 493
agcauuguuggaaauaaug

SEQ ID NO: 2579182 - RNA, 21 nt, Coxiella burnetii RSA 493
agcauuguuggaaauaaugga

SEQ ID NO: 2579183 - RNA, 18 nt, Coxiella burnetii RSA 493
agcauuucguauaauuca

SEQ ID NO: 2579184 - RNA, 20 nt, Coxiella burnetii RSA 493
agcauuuucuccaaagggac

SEQ ID NO: 2579185 - RNA, 23 nt, Coxiella burnetii RSA 493
agcauuuuuuugucgaauuuuug

SEQ ID NO: 2579186 - RNA, 20 nt, Coxiella burnetii RSA 493
agccaaguuuuaagaaaaac

SEQ ID NO: 2579187 - RNA, 13 nt, Coxiella burnetii RSA 493
agccacaaagaau

SEQ ID NO: 2579188 - RNA, 17 nt, Coxiella burnetii RSA 493
agccacacaaccacugu

SEQ ID NO: 2579189 - RNA, 21 nt, Coxiella burnetii RSA 493
agccacauuucggacaacaaa

SEQ ID NO: 2579190 - RNA, 16 nt, Coxiella burnetii RSA 493
agccagcgaauacgaa

SEQ ID NO: 2579191 - RNA, 18 nt, Coxiella burnetii RSA 493
agccaucacaccaagaaa

SEQ ID NO: 2579192 - RNA, 21 nt, Coxiella burnetii RSA 493
agccauuguuuugcauccgaa

SEQ ID NO: 2579193 - RNA, 19 nt, Coxiella burnetii RSA 493
agcccaacgguauaaaauu

SEQ ID NO: 2579194 - RNA, 14 nt, Coxiella burnetii RSA 493
agcccgcaauccuc

SEQ ID NO: 2579195 - RNA, 17 nt, Coxiella burnetii RSA 493
agcccgcagcgcccacu

SEQ ID NO: 2579196 - RNA, 12 nt, Coxiella burnetii RSA 493
agcccucauugu

SEQ ID NO: 2579197 - RNA, 15 nt, Coxiella burnetii RSA 493
agcccuugcgguaca

SEQ ID NO: 2579198 - RNA, 15 nt, Coxiella burnetii RSA 493
agccgaauaaauccu

SEQ ID NO: 2579199 - RNA, 14 nt, Coxiella burnetii RSA 493
agccgaauguuuaa

SEQ ID NO: 2579200 - RNA, 21 nt, Coxiella burnetii RSA 493
agccgaccaaggguauuuuuu

SEQ ID NO: 2579201 - RNA, 15 nt, Coxiella burnetii RSA 493
agccgaugacaaaua

SEQ ID NO: 2579202 - RNA, 15 nt, Coxiella burnetii RSA 493
agccgccaauuuugu

SEQ ID NO: 2579203 - RNA, 15 nt, Coxiella burnetii RSA 493
agccgguguuauauu

SEQ ID NO: 2579204 - RNA, 23 nt, Coxiella burnetii RSA 493
agccuaucgauaagaucaauuac

SEQ ID NO: 2579205 - RNA, 15 nt, Coxiella burnetii RSA 493
agccuguugagcuuc

SEQ ID NO: 2579206 - RNA, 13 nt, Coxiella burnetii RSA 493
agcgaaauacgag

SEQ ID NO: 2579207 - RNA, 14 nt, Coxiella burnetii RSA 493
agcgaaauacggga

SEQ ID NO: 2579208 - RNA, 14 nt, Coxiella burnetii RSA 493
agcgaaauacgggg

SEQ ID NO: 2579209 - RNA, 19 nt, Coxiella burnetii RSA 493
agcgaaauacggggaaaua

SEQ ID NO: 2579210 - RNA, 18 nt, Coxiella burnetii RSA 493
agcgaacgaauacgggga

SEQ ID NO: 2579211 - RNA, 19 nt, Coxiella burnetii RSA 493
agcgaagcgaaauacgggg

SEQ ID NO: 2579212 - RNA, 20 nt, Coxiella burnetii RSA 493
agcgaagcgaaauacgggga

SEQ ID NO: 2579213 - RNA, 20 nt, Coxiella burnetii RSA 493
agcgaagcggaauacggaga

SEQ ID NO: 2579214 - RNA, 14 nt, Coxiella burnetii RSA 493
agcgaaguacggga

SEQ ID NO: 2579215 - RNA, 17 nt, Coxiella burnetii RSA 493
agcgaaguacgggaaaa

SEQ ID NO: 2579216 - RNA, 20 nt, Coxiella burnetii RSA 493
agcgaaguacgggaaaacaa

SEQ ID NO: 2579217 - RNA, 14 nt, Coxiella burnetii RSA 493
agcgaauaaaaaau

SEQ ID NO: 2579218 - RNA, 22 nt, Coxiella burnetii RSA 493
agcgaggaccguuaugaaaaca

SEQ ID NO: 2579219 - RNA, 17 nt, Coxiella burnetii RSA 493
agcgagguaaagaggga

SEQ ID NO: 2579220 - RNA, 16 nt, Coxiella burnetii RSA 493
agcgauuccaaagcag

SEQ ID NO: 2579221 - RNA, 16 nt, Coxiella burnetii RSA 493
agcgauuguaauugcu

SEQ ID NO: 2579222 - RNA, 17 nt, Coxiella burnetii RSA 493
agcgauuguaauugcuu

SEQ ID NO: 2579223 - RNA, 16 nt, Coxiella burnetii RSA 493
agcgccagagauuuuu

SEQ ID NO: 2579224 - RNA, 17 nt, Coxiella burnetii RSA 493
agcgccugccgcaacaa

SEQ ID NO: 2579225 - RNA, 17 nt, Coxiella burnetii RSA 493
agcgcggccgcggcugg

SEQ ID NO: 2579226 - RNA, 13 nt, Coxiella burnetii RSA 493
agcgcuuuuggcu

SEQ ID NO: 2579227 - RNA, 23 nt, Coxiella burnetii RSA 493
agcgcuuuuggcuacuuucucaa

SEQ ID NO: 2579228 - RNA, 12 nt, Coxiella burnetii RSA 493
agcgggaauuuu

SEQ ID NO: 2579229 - RNA, 15 nt, Coxiella burnetii RSA 493
agcggggacaaguuc

SEQ ID NO: 2579230 - RNA, 12 nt, Coxiella burnetii RSA 493
agcguaaaacac

SEQ ID NO: 2579231 - RNA, 18 nt, Coxiella burnetii RSA 493
agcguacaacaacaaagu

SEQ ID NO: 2579232 - RNA, 18 nt, Coxiella burnetii RSA 493
agcgucaugaaaagcgga

SEQ ID NO: 2579233 - RNA, 20 nt, Coxiella burnetii RSA 493
agcgugaugggauaaaaaac

SEQ ID NO: 2579234 - RNA, 21 nt, Coxiella burnetii RSA 493
agcgugcucuuuuucauuucu

SEQ ID NO: 2579235 - RNA, 17 nt, Coxiella burnetii RSA 493
agcguuccuuucaucaa

SEQ ID NO: 2579236 - RNA, 14 nt, Coxiella burnetii RSA 493
agcguucuuaaagu

SEQ ID NO: 2579237 - RNA, 18 nt, Coxiella burnetii RSA 493
agcguuguaaauuuugcc

SEQ ID NO: 2579238 - RNA, 14 nt, Coxiella burnetii RSA 493
agcguuuuccgcua

SEQ ID NO: 2579239 - RNA, 14 nt, Coxiella burnetii RSA 493
agcuaaaaaauuca

SEQ ID NO: 2579240 - RNA, 16 nt, Coxiella burnetii RSA 493
agcuaagaucaagaaa

SEQ ID NO: 2579241 - RNA, 23 nt, Coxiella burnetii RSA 493
gcuuugcggccucgccuucuucg

SEQ ID NO: 2579242 - RNA, 16 nt, Coxiella burnetii RSA 493
gcuuuuaaacagucuu

SEQ ID NO: 2579243 - RNA, 14 nt, Coxiella burnetii RSA 493
gcuuuuaaacgcuu

SEQ ID NO: 2579244 - RNA, 14 nt, Coxiella burnetii RSA 493
gcuuuucuuucauu

SEQ ID NO: 2579245 - RNA, 18 nt, Coxiella burnetii RSA 493
gcuuuuggcuacuuucuc

SEQ ID NO: 2579246 - RNA, 14 nt, Coxiella burnetii RSA 493
gcuuuuuguuugau

SEQ ID NO: 2579247 - RNA, 22 nt, Coxiella burnetii RSA 493
gcuuuuuuauaaggucuuaauu

SEQ ID NO: 2579248 - RNA, 13 nt, Coxiella burnetii RSA 493
gcuuuuuucgcuu

SEQ ID NO: 2579249 - RNA, 20 nt, Coxiella burnetii RSA 493
gcuuuuuucgcuucaauucu

SEQ ID NO: 2579250 - RNA, 22 nt, Coxiella burnetii RSA 493
gcuuuuuuuacuuuuucaaaga

SEQ ID NO: 2579251 - RNA, 20 nt, Coxiella burnetii RSA 493
ggaaaaaaaccuaaagaaag

SEQ ID NO: 2579252 - RNA, 23 nt, Coxiella burnetii RSA 493
ggaaaaauagcacuaucucuuaa

SEQ ID NO: 2579253 - RNA, 14 nt, Coxiella burnetii RSA 493
ggaaaaauauccuu

SEQ ID NO: 2579254 - RNA, 17 nt, Coxiella burnetii RSA 493
ggaaaaaugauuauaga

SEQ ID NO: 2579255 - RNA, 17 nt, Coxiella burnetii RSA 493
ggaaaaggagaaaguga

SEQ ID NO: 2579256 - RNA, 12 nt, Coxiella burnetii RSA 493
ggaaaauaagau

SEQ ID NO: 2579257 - RNA, 18 nt, Coxiella burnetii RSA 493
ggaaacgaaguucucaaa

SEQ ID NO: 2579258 - RNA, 23 nt, Coxiella burnetii RSA 493
ggaaagauccaagauuuuuuuaa

SEQ ID NO: 2579259 - RNA, 12 nt, Coxiella burnetii RSA 493
ggaaauaaaauu

SEQ ID NO: 2579260 - RNA, 20 nt, Coxiella burnetii RSA 493
ggaaauauuuaauugggaag

SEQ ID NO: 2579261 - RNA, 14 nt, Coxiella burnetii RSA 493
ggaaauccaggguu

SEQ ID NO: 2579262 - RNA, 18 nt, Coxiella burnetii RSA 493
ggaaauuucgauuuuaca

SEQ ID NO: 2579263 - RNA, 21 nt, Coxiella burnetii RSA 493
ggaaauuucgauuuuacaaua

SEQ ID NO: 2579264 - RNA, 17 nt, Coxiella burnetii RSA 493
ggaacaacgaaaucuac

SEQ ID NO: 2579265 - RNA, 14 nt, Coxiella burnetii RSA 493
ggaacagaggacag

SEQ ID NO: 2579266 - RNA, 18 nt, Coxiella burnetii RSA 493
ggaacauucuaauaaaau

SEQ ID NO: 2579267 - RNA, 14 nt, Coxiella burnetii RSA 493
ggaaccgccaaaag

SEQ ID NO: 2579268 - RNA, 17 nt, Coxiella burnetii RSA 493
ggaaggcaaugauaauu

SEQ ID NO: 2579269 - RNA, 12 nt, Coxiella burnetii RSA 493
ggaaguucuauu

SEQ ID NO: 2579270 - RNA, 22 nt, Coxiella burnetii RSA 493
ggaaguuguucggaauauaauu

SEQ ID NO: 2579271 - RNA, 16 nt, Coxiella burnetii RSA 493
ggaauagccuucucaa

SEQ ID NO: 2579272 - RNA, 18 nt, Coxiella burnetii RSA 493
ggaaucacuccuaagcaa

SEQ ID NO: 2579273 - RNA, 20 nt, Coxiella burnetii RSA 493
ggaaucgcggacaauaagag

SEQ ID NO: 2579274 - RNA, 22 nt, Coxiella burnetii RSA 493
ggaaugacgaaagcuaaaaaag

SEQ ID NO: 2579275 - RNA, 18 nt, Coxiella burnetii RSA 493
ggaaugcuaccagcaucc

SEQ ID NO: 2579276 - RNA, 23 nt, Coxiella burnetii RSA 493
ggaaugugugucauaaauaaaag

SEQ ID NO: 2579277 - RNA, 13 nt, Coxiella burnetii RSA 493
ggaauguucugau

SEQ ID NO: 2579278 - RNA, 19 nt, Coxiella burnetii RSA 493
ggaauguuuuuuaauaaau

SEQ ID NO: 2579279 - RNA, 22 nt, Coxiella burnetii RSA 493
ggaauucauaaucaaaaucaga

SEQ ID NO: 2579280 - RNA, 15 nt, Coxiella burnetii RSA 493
ggaauuugaaauaaa

SEQ ID NO: 2579281 - RNA, 23 nt, Coxiella burnetii RSA 493
ggaauuugugauuuuaaaaauaa

SEQ ID NO: 2579282 - RNA, 13 nt, Coxiella burnetii RSA 493
ggaauuuuuugcg

SEQ ID NO: 2579283 - RNA, 15 nt, Coxiella burnetii RSA 493
ggacaacaaauaaau

SEQ ID NO: 2579284 - RNA, 23 nt, Coxiella burnetii RSA 493
ggacaaguucuuugccacccccu

SEQ ID NO: 2579285 - RNA, 17 nt, Coxiella burnetii RSA 493
ggacacauuuuuucaaa

SEQ ID NO: 2579286 - RNA, 23 nt, Coxiella burnetii RSA 493
ggacacauuuuuucaaauugcug

SEQ ID NO: 2579287 - RNA, 13 nt, Coxiella burnetii RSA 493
ggacagaggacag

SEQ ID NO: 2579288 - RNA, 14 nt, Coxiella burnetii RSA 493
ggacauucucgaau

SEQ ID NO: 2579289 - RNA, 17 nt, Coxiella burnetii RSA 493
ggaccguuaugaaaaca

SEQ ID NO: 2579290 - RNA, 14 nt, Coxiella burnetii RSA 493
ggaccuuuuuugca

SEQ ID NO: 2579291 - RNA, 21 nt, Coxiella burnetii RSA 493
ggacgagggguuuuuuuugaa

SEQ ID NO: 2579292 - RNA, 13 nt, Coxiella burnetii RSA 493
ggacgauagaugg

SEQ ID NO: 2579293 - RNA, 12 nt, Coxiella burnetii RSA 493
ggacgugcaaau

SEQ ID NO: 2579294 - RNA, 22 nt, Coxiella burnetii RSA 493
ggacuacacgguuagugggaag

SEQ ID NO: 2579295 - RNA, 23 nt, Coxiella burnetii RSA 493
ggacuacacgguuagugggaagc

SEQ ID NO: 2579296 - RNA, 17 nt, Coxiella burnetii RSA 493
gguugaaagaaaaaaaa

SEQ ID NO: 2579297 - RNA, 15 nt, Coxiella burnetii RSA 493
gguugggcugagcuu

SEQ ID NO: 2579298 - RNA, 20 nt, Coxiella burnetii RSA 493
gguugugucgcuacgcgaca

SEQ ID NO: 2579299 - RNA, 14 nt, Coxiella burnetii RSA 493
gguuuacauaagaa

SEQ ID NO: 2579300 - RNA, 21 nt, Coxiella burnetii RSA 493
gguuuugaagaagagcggcuu

SEQ ID NO: 2579301 - RNA, 15 nt, Coxiella burnetii RSA 493
gguuuuucuucauuu

SEQ ID NO: 2579302 - RNA, 18 nt, Coxiella burnetii RSA 493
gguuuuuuuaaaaaagaa

SEQ ID NO: 2579303 - RNA, 17 nt, Coxiella burnetii RSA 493
gguuuuuuuugaaauua

SEQ ID NO: 2579304 - RNA, 18 nt, Coxiella burnetii RSA 493
guaaaaaaauaguuucaa

SEQ ID NO: 2579305 - RNA, 22 nt, Coxiella burnetii RSA 493
guaaaaacauccuccauuacau

SEQ ID NO: 2579306 - RNA, 18 nt, Coxiella burnetii RSA 493
guaaaacgaaucuuuaca

SEQ ID NO: 2579307 - RNA, 14 nt, Coxiella burnetii RSA 493
guaaaauaagaagg

SEQ ID NO: 2579308 - RNA, 23 nt, Coxiella burnetii RSA 493
guaaaauuccaccggcgucugaa

SEQ ID NO: 2579309 - RNA, 22 nt, Coxiella burnetii RSA 493
guaaacuucgcacaucauugaa

SEQ ID NO: 2579310 - RNA, 19 nt, Coxiella burnetii RSA 493
guaaagccguuauccauga

SEQ ID NO: 2579311 - RNA, 22 nt, Coxiella burnetii RSA 493
guaaaguugccgguauuuugca

SEQ ID NO: 2579312 - RNA, 23 nt, Coxiella burnetii RSA 493
guaaaguugccgguauuuugcaa

SEQ ID NO: 2579313 - RNA, 22 nt, Coxiella burnetii RSA 493
guaaauaaucauuuuuaugcuu

SEQ ID NO: 2579314 - RNA, 15 nt, Coxiella burnetii RSA 493
guaaaucguuuuacc

SEQ ID NO: 2579315 - RNA, 19 nt, Coxiella burnetii RSA 493
guaaauggcuuuuuucuua

SEQ ID NO: 2579316 - RNA, 14 nt, Coxiella burnetii RSA 493
guaaauguuucuuu

SEQ ID NO: 2579317 - RNA, 23 nt, Coxiella burnetii RSA 493
guaaauuucguugauuaauaaug

SEQ ID NO: 2579318 - RNA, 12 nt, Coxiella burnetii RSA 493
guaacaaaagau

SEQ ID NO: 2579319 - RNA, 14 nt, Coxiella burnetii RSA 493
guaaccaaaacuau

SEQ ID NO: 2579320 - RNA, 17 nt, Coxiella burnetii RSA 493
guaacccuuucauuuaa

SEQ ID NO: 2579321 - RNA, 22 nt, Coxiella burnetii RSA 493
guaacgauggucaaaccaauca

SEQ ID NO: 2579322 - RNA, 15 nt, Coxiella burnetii RSA 493
guaacgauuucucuu

SEQ ID NO: 2579323 - RNA, 16 nt, Coxiella burnetii RSA 493
guaacucuaauuuucc

SEQ ID NO: 2579324 - RNA, 22 nt, Coxiella burnetii RSA 493
guaacugauguauccuaauaaa

SEQ ID NO: 2579325 - RNA, 13 nt, Coxiella burnetii RSA 493
guaacuuuuccau

SEQ ID NO: 2579326 - RNA, 18 nt, Coxiella burnetii RSA 493
guaagcuugcuugcuaau

SEQ ID NO: 2579327 - RNA, 17 nt, Coxiella burnetii RSA 493
guaaggcaacucuuugg

SEQ ID NO: 2579328 - RNA, 21 nt, Coxiella burnetii RSA 493
guaauaaaguaauuuuaaaaa

SEQ ID NO: 2579329 - RNA, 16 nt, Coxiella burnetii RSA 493
guaauaauauaauuga

SEQ ID NO: 2579330 - RNA, 15 nt, Coxiella burnetii RSA 493
guaaucaauaaaacu

SEQ ID NO: 2579331 - RNA, 13 nt, Coxiella burnetii RSA 493
guaaucaauugcu

SEQ ID NO: 2579332 - RNA, 23 nt, Coxiella burnetii RSA 493
guaauccuuguugaauuccuugu

SEQ ID NO: 2579333 - RNA, 22 nt, Coxiella burnetii RSA 493
guaaucgcuaagcgaaaaauga

SEQ ID NO: 2579334 - RNA, 19 nt, Coxiella burnetii RSA 493
guaaucgcugauacuucuu

SEQ ID NO: 2579335 - RNA, 19 nt, Coxiella burnetii RSA 493
guaaucguucggcuucaua

SEQ ID NO: 2579336 - RNA, 18 nt, Coxiella burnetii RSA 493
guaaucucacuuggauuu

SEQ ID NO: 2579337 - RNA, 23 nt, Coxiella burnetii RSA 493
guaaucucacuuggauuuuauuu

SEQ ID NO: 2579338 - RNA, 16 nt, Coxiella burnetii RSA 493
guaaugagcaucuuuu

SEQ ID NO: 2579339 - RNA, 17 nt, Coxiella burnetii RSA 493
guaaugcaaugaauuca

SEQ ID NO: 2579340 - RNA, 17 nt, Coxiella burnetii RSA 493
guaauggucguugcaua

SEQ ID NO: 2579341 - RNA, 22 nt, Coxiella burnetii RSA 493
guaauuaccugaaugcuuuuaa

SEQ ID NO: 2579342 - RNA, 16 nt, Coxiella burnetii RSA 493
guaauucacgauuuuc

SEQ ID NO: 2579343 - RNA, 21 nt, Coxiella burnetii RSA 493
guaauucuugcagugaaauaa

SEQ ID NO: 2579344 - RNA, 14 nt, Coxiella burnetii RSA 493
guaauugcaacaau

SEQ ID NO: 2579345 - RNA, 18 nt, Coxiella burnetii RSA 493
guaauugcgccgguuuaa

SEQ ID NO: 2579346 - RNA, 19 nt, Coxiella burnetii RSA 493
guaauuucucgaaugacaa

SEQ ID NO: 2579347 - RNA, 20 nt, Coxiella burnetii RSA 493
guaauuucucgaaugacaac

SEQ ID NO: 2579348 - RNA, 19 nt, Coxiella burnetii RSA 493
guaauuuuaaaaaaaauac

SEQ ID NO: 2579349 - RNA, 20 nt, Coxiella burnetii RSA 493
guaauuuuaaaaaaaauacu

SEQ ID NO: 2579350 - RNA, 16 nt, Coxiella burnetii RSA 493
guacacaaaauuucaa

SEQ ID NO: 2579351 - RNA, 13 nt, Coxiella burnetii RSA 493
guacauuuuucaa

SEQ ID NO: 2579352 - RNA, 18 nt, Coxiella burnetii RSA 493
guaccaaugucuucccau

SEQ ID NO: 2579353 - RNA, 21 nt, Coxiella burnetii RSA 493
guaccaaugucuucccauguc

SEQ ID NO: 2579354 - RNA, 12 nt, Coxiella burnetii RSA 493
guaccugccauu

SEQ ID NO: 2579355 - RNA, 23 nt, Coxiella burnetii RSA 493
guacucagcuuuccccccaacua

SEQ ID NO: 2579356 - RNA, 16 nt, Coxiella burnetii RSA 493
guacugugcggauuaa

SEQ ID NO: 2579357 - RNA, 15 nt, Coxiella burnetii RSA 493
guagaauucucccau

SEQ ID NO: 2579358 - RNA, 18 nt, Coxiella burnetii RSA 493
guagaauucucccaugag

SEQ ID NO: 2579359 - RNA, 16 nt, Coxiella burnetii RSA 493
guagacaguuuagaau

SEQ ID NO: 2579360 - RNA, 23 nt, Coxiella burnetii RSA 493
guagagacaauagaauaaugaac

SEQ ID NO: 2579361 - RNA, 19 nt, Coxiella burnetii RSA 493
guagauuuuaaauaccauu

SEQ ID NO: 2579362 - RNA, 17 nt, Coxiella burnetii RSA 493
guagcccgaaaaaguag

SEQ ID NO: 2579363 - RNA, 13 nt, Coxiella burnetii RSA 493
guagccuaaccaa

SEQ ID NO: 2579364 - RNA, 17 nt, Coxiella burnetii RSA 493
guagccuucuuuuucaa

SEQ ID NO: 2579365 - RNA, 17 nt, Coxiella burnetii RSA 493
guagcgacacaaccacu

SEQ ID NO: 2579366 - RNA, 16 nt, Coxiella burnetii RSA 493
guagcuaaaaaauuca

SEQ ID NO: 2579367 - RNA, 23 nt, Coxiella burnetii RSA 493
guagcuaaguagcccguaugagc

SEQ ID NO: 2579368 - RNA, 16 nt, Coxiella burnetii RSA 493
guagcucuuaaaagac

SEQ ID NO: 2579369 - RNA, 15 nt, Coxiella burnetii RSA 493
guaggugauaaugag

SEQ ID NO: 2579370 - RNA, 20 nt, Coxiella burnetii RSA 493
guagguugggcugagcuugc

SEQ ID NO: 2579371 - RNA, 12 nt, Coxiella burnetii RSA 493
guagucaggaag

SEQ ID NO: 2579372 - RNA, 18 nt, Coxiella burnetii RSA 493
guaguuugguggaugauc

SEQ ID NO: 2579373 - RNA, 16 nt, Coxiella burnetii RSA 493
guauaaagguuuuucc

SEQ ID NO: 2579374 - RNA, 15 nt, Coxiella burnetii RSA 493
guauaaauaacuuua

SEQ ID NO: 2579375 - RNA, 13 nt, Coxiella burnetii RSA 493
guauaaaugaucc

SEQ ID NO: 2579376 - RNA, 11 nt, Coxiella burnetii RSA 493
guauaguucua

SEQ ID NO: 2579377 - RNA, 15 nt, Coxiella burnetii RSA 493
guauaguucuaauaa

SEQ ID NO: 2579378 - RNA, 22 nt, Coxiella burnetii RSA 493
guaucuauuugcauaggagaua

SEQ ID NO: 2579379 - RNA, 20 nt, Coxiella burnetii RSA 493
guaugaagcgcggcgaaaua

SEQ ID NO: 2579380 - RNA, 16 nt, Coxiella burnetii RSA 493
guaugaauaauuuuuu

SEQ ID NO: 2579381 - RNA, 15 nt, Coxiella burnetii RSA 493
guaugaaucagcuua

SEQ ID NO: 2579382 - RNA, 15 nt, Coxiella burnetii RSA 493
guauuaacauuugga

SEQ ID NO: 2579383 - RNA, 23 nt, Coxiella burnetii RSA 493
guauuauuauccgguuuugauuu

SEQ ID NO: 2579384 - RNA, 19 nt, Coxiella burnetii RSA 493
guauuccgccuuaaaacau

SEQ ID NO: 2579385 - RNA, 21 nt, Coxiella burnetii RSA 493
guauuccgcuuugcuccauac

SEQ ID NO: 2579386 - RNA, 20 nt, Coxiella burnetii RSA 493
guauuccuuuuucuuuuaau

SEQ ID NO: 2579387 - RNA, 15 nt, Coxiella burnetii RSA 493
guauucgccuucccg

SEQ ID NO: 2579388 - RNA, 20 nt, Coxiella burnetii RSA 493
guauugaggucguuaaaaaa

SEQ ID NO: 2579389 - RNA, 17 nt, Coxiella burnetii RSA 493
guauugucaaaauuaga

SEQ ID NO: 2579390 - RNA, 17 nt, Coxiella burnetii RSA 493
guauuuaaucucgauuu

SEQ ID NO: 2579391 - RNA, 22 nt, Coxiella burnetii RSA 493
guauuuaggggugaauuuuugc

SEQ ID NO: 2579392 - RNA, 15 nt, Coxiella burnetii RSA 493
guauuuaucauccug

SEQ ID NO: 2579393 - RNA, 16 nt, Coxiella burnetii RSA 493
guauuucgcuucgcuc

SEQ ID NO: 2579394 - RNA, 19 nt, Coxiella burnetii RSA 493
guauuucgcuucgcucaua

SEQ ID NO: 2579395 - RNA, 20 nt, Coxiella burnetii RSA 493
guauuucgcuucgcucauac

SEQ ID NO: 2579396 - RNA, 20 nt, Coxiella burnetii RSA 493
guauuucgcuucgcuccaua

SEQ ID NO: 2579397 - RNA, 20 nt, Coxiella burnetii RSA 493
guauuucgcuucgcugcaua

SEQ ID NO: 2579398 - RNA, 17 nt, Coxiella burnetii RSA 493
guauuuguguaaaauac

SEQ ID NO: 2579399 - RNA, 21 nt, Coxiella burnetii RSA 493
guauuuguguaaaauacuggc

SEQ ID NO: 2579400 - RNA, 20 nt, Coxiella burnetii RSA 493
guauuuguucguaauaauaa

SEQ ID NO: 2579401 - RNA, 14 nt, Coxiella burnetii RSA 493
guggaauuaaauau

SEQ ID NO: 2579402 - RNA, 20 nt, Coxiella burnetii RSA 493
guggauaaaggagauccacu

SEQ ID NO: 2579403 - RNA, 17 nt, Coxiella burnetii RSA 493
guggauuuucaaagucg

SEQ ID NO: 2579404 - RNA, 19 nt, Coxiella burnetii RSA 493
guggcagcuucuuuaaaau

SEQ ID NO: 2579405 - RNA, 13 nt, Coxiella burnetii RSA 493
guggcaguuaaau

SEQ ID NO: 2579406 - RNA, 18 nt, Coxiella burnetii RSA 493
guggcauuaaaagauuua

SEQ ID NO: 2579407 - RNA, 17 nt, Coxiella burnetii RSA 493
guggggucuucaucuuu

SEQ ID NO: 2579408 - RNA, 12 nt, Coxiella burnetii RSA 493
guggguaaugau

SEQ ID NO: 2579409 - RNA, 23 nt, Coxiella burnetii RSA 493
guggucucuuuuuuugcgcccgc

SEQ ID NO: 2579410 - RNA, 12 nt, Coxiella burnetii RSA 493
gugguuaauucu

SEQ ID NO: 2579411 - RNA, 15 nt, Coxiella burnetii RSA 493
gugguuauaauuuug

SEQ ID NO: 2579412 - RNA, 18 nt, Coxiella burnetii RSA 493
guguaacaaaaacgacaa

SEQ ID NO: 2579413 - RNA, 11 nt, Coxiella burnetii RSA 493
guguaauugau

SEQ ID NO: 2579414 - RNA, 13 nt, Coxiella burnetii RSA 493
guguagaaagaaa

SEQ ID NO: 2579415 - RNA, 13 nt, Coxiella burnetii RSA 493
guguauucgccuu

SEQ ID NO: 2579416 - RNA, 15 nt, Coxiella burnetii RSA 493
gugucauaaauaaaa

SEQ ID NO: 2579417 - RNA, 20 nt, Coxiella burnetii RSA 493
gugucgcuacgcgacaacua

SEQ ID NO: 2579418 - RNA, 22 nt, Coxiella burnetii RSA 493
gugugcccccccaauuccucga

SEQ ID NO: 2579419 - RNA, 18 nt, Coxiella burnetii RSA 493
guguuaagucguuaacag

SEQ ID NO: 2579420 - RNA, 12 nt, Coxiella burnetii RSA 493
guguuuuuauuu

SEQ ID NO: 2579421 - RNA, 12 nt, Coxiella burnetii RSA 493
guuaaaacacau

SEQ ID NO: 2579422 - RNA, 12 nt, Coxiella burnetii RSA 493
guuaaaagcgcc

SEQ ID NO: 2579423 - RNA, 16 nt, Coxiella burnetii RSA 493
guuaaacccauuugau

SEQ ID NO: 2579424 - RNA, 18 nt, Coxiella burnetii RSA 493
guuaaacccauuugaucu

SEQ ID NO: 2579425 - RNA, 18 nt, Coxiella burnetii RSA 493
guuaagauaauaauuaua

SEQ ID NO: 2579426 - RNA, 15 nt, Coxiella burnetii RSA 493
guuaaggaaaagcac

SEQ ID NO: 2579427 - RNA, 23 nt, Coxiella burnetii RSA 493
guuaaguagcuaaaaaauucauc

SEQ ID NO: 2579428 - RNA, 11 nt, Coxiella burnetii RSA 493
guuaauaguca

SEQ ID NO: 2579429 - RNA, 12 nt, Coxiella burnetii RSA 493
guuaauucuucu

SEQ ID NO: 2579430 - RNA, 14 nt, Coxiella burnetii RSA 493
guuaauuuaucauu

SEQ ID NO: 2579431 - RNA, 18 nt, Coxiella burnetii RSA 493
guuaauuuaucauuuuuc

SEQ ID NO: 2579432 - RNA, 15 nt, Coxiella burnetii RSA 493
guuacaguaaaacac

SEQ ID NO: 2579433 - RNA, 23 nt, Coxiella burnetii RSA 493
guuacuccgcccccccaaacaaa

SEQ ID NO: 2579434 - RNA, 21 nt, Coxiella burnetii RSA 493
guuagcaaugggaacuuuuaa

SEQ ID NO: 2579435 - RNA, 17 nt, Coxiella burnetii RSA 493
guuagcggaauacggga

SEQ ID NO: 2579436 - RNA, 14 nt, Coxiella burnetii RSA 493
guuagcuuccauug

SEQ ID NO: 2579437 - RNA, 12 nt, Coxiella burnetii RSA 493
guuagcuuuucu

SEQ ID NO: 2579438 - RNA, 16 nt, Coxiella burnetii RSA 493
guuagcuuuucuuuaa

SEQ ID NO: 2579439 - RNA, 22 nt, Coxiella burnetii RSA 493
guuaggagcaaguacagguugu

SEQ ID NO: 2579440 - RNA, 13 nt, Coxiella burnetii RSA 493
guuagugggaagc

SEQ ID NO: 2579441 - RNA, 15 nt, Coxiella burnetii RSA 493
guuaguuucuuuuau

SEQ ID NO: 2579442 - RNA, 14 nt, Coxiella burnetii RSA 493
guuauaauuucuuu

SEQ ID NO: 2579443 - RNA, 23 nt, Coxiella burnetii RSA 493
guuauauuuaauuuuauuauuua

SEQ ID NO: 2579444 - RNA, 22 nt, Coxiella burnetii RSA 493
guuaucgaaggaauagccuucu

SEQ ID NO: 2579445 - RNA, 23 nt, Coxiella burnetii RSA 493
guuaucuuaauuuaaucuacucu

SEQ ID NO: 2579446 - RNA, 12 nt, Coxiella burnetii RSA 493
guuaugagacuu

SEQ ID NO: 2579447 - RNA, 17 nt, Coxiella burnetii RSA 493
guuaugauguuuuaaaa

SEQ ID NO: 2579448 - RNA, 19 nt, Coxiella burnetii RSA 493
guuaugauguuuuaaaauu

SEQ ID NO: 2579449 - RNA, 20 nt, Coxiella burnetii RSA 493
guuaugggaauuaaacacaa

SEQ ID NO: 2579450 - RNA, 15 nt, Coxiella burnetii RSA 493
guuauuaagcguucc

SEQ ID NO: 2579451 - RNA, 22 nt, Coxiella burnetii RSA 493
guuauuaagcguuccuuucauc

SEQ ID NO: 2579452 - RNA, 19 nt, Coxiella burnetii RSA 493
guuauuaucaaguuuauaa

SEQ ID NO: 2579453 - RNA, 14 nt, Coxiella burnetii RSA 493
guuauuguuaacac

SEQ ID NO: 2579454 - RNA, 14 nt, Coxiella burnetii RSA 493
guuauuuauuuuuc

SEQ ID NO: 2579455 - RNA, 18 nt, Coxiella burnetii RSA 493
guuauuuauuuuucucuu

SEQ ID NO: 2579456 - RNA, 20 nt, Coxiella burnetii RSA 493
guucaagcacuaguuuuacu

SEQ ID NO: 2579457 - RNA, 13 nt, Coxiella burnetii RSA 493
guucauaaaauaa

SEQ ID NO: 2579458 - RNA, 13 nt, Coxiella burnetii RSA 493
guucauuaaauuu

SEQ ID NO: 2579459 - RNA, 22 nt, Coxiella burnetii RSA 493
guuccauaauguuugauccuug

SEQ ID NO: 2579460 - RNA, 23 nt, Coxiella burnetii RSA 493
guuccaugacaugcgccacuaaa

SEQ ID NO: 2579461 - RNA, 16 nt, Coxiella burnetii RSA 493
guuccaugucuugaac

SEQ ID NO: 2579462 - RNA, 21 nt, Coxiella burnetii RSA 493
guuccuugagaguaaauguuu

SEQ ID NO: 2579463 - RNA, 20 nt, Coxiella burnetii RSA 493
guuccuuuuuauaaaugauu

SEQ ID NO: 2579464 - RNA, 15 nt, Coxiella burnetii RSA 493
guucgagauuauuca

SEQ ID NO: 2579465 - RNA, 21 nt, Coxiella burnetii RSA 493
guucggauuucacuuuauuuu

SEQ ID NO: 2579466 - RNA, 19 nt, Coxiella burnetii RSA 493
guucgggucguucuuuucc

SEQ ID NO: 2579467 - RNA, 14 nt, Coxiella burnetii RSA 493
guucguaauaauaa

SEQ ID NO: 2579468 - RNA, 14 nt, Coxiella burnetii RSA 493
guucuaaaaaauug

SEQ ID NO: 2579469 - RNA, 14 nt, Coxiella burnetii RSA 493
guucuaaggcuucc

SEQ ID NO: 2579470 - RNA, 12 nt, Coxiella burnetii RSA 493
guucuaauaauu

SEQ ID NO: 2579471 - RNA, 19 nt, Coxiella burnetii RSA 493
guucuaauaauuuuuuauc

SEQ ID NO: 2579472 - RNA, 21 nt, Coxiella burnetii RSA 493
guucucuccauuuagaaaaaa

SEQ ID NO: 2579473 - RNA, 22 nt, Coxiella burnetii RSA 493
guucuuaaagucuucaaaagug

SEQ ID NO: 2579474 - RNA, 15 nt, Coxiella burnetii RSA 493
guucuuucaauaucu

SEQ ID NO: 2579475 - RNA, 15 nt, Coxiella burnetii RSA 493
guucuuuuauuucuu

SEQ ID NO: 2579476 - RNA, 15 nt, Coxiella burnetii RSA 493
guucuuuuuccaugu

SEQ ID NO: 2579477 - RNA, 22 nt, Coxiella burnetii RSA 493
guugaaaaccuacacuuuuaau

SEQ ID NO: 2579478 - RNA, 23 nt, Coxiella burnetii RSA 493
guugaaaaccuacacuuuuaauc

SEQ ID NO: 2579479 - RNA, 16 nt, Coxiella burnetii RSA 493
guugaaagaaaaaaaa

SEQ ID NO: 2579480 - RNA, 13 nt, Coxiella burnetii RSA 493
guugaaccacuuc

SEQ ID NO: 2579481 - RNA, 23 nt, Coxiella burnetii RSA 493
guugaaucaaauuaaaauaaucc

SEQ ID NO: 2579482 - RNA, 18 nt, Coxiella burnetii RSA 493
guugauucaauaaucuca

SEQ ID NO: 2579483 - RNA, 16 nt, Coxiella burnetii RSA 493
guugauuuuuuaaauc

SEQ ID NO: 2579484 - RNA, 18 nt, Coxiella burnetii RSA 493
guugcaagcguuuuucau

SEQ ID NO: 2579485 - RNA, 19 nt, Coxiella burnetii RSA 493
guugcagaguuauuauccc

SEQ ID NO: 2579486 - RNA, 13 nt, Coxiella burnetii RSA 493
guugcauaauauu

SEQ ID NO: 2579487 - RNA, 19 nt, Coxiella burnetii RSA 493
guugccaguguuaauggau

SEQ ID NO: 2579488 - RNA, 14 nt, Coxiella burnetii RSA 493
guugccgauaaaaa

SEQ ID NO: 2579489 - RNA, 18 nt, Coxiella burnetii RSA 493
guugccgguauuuugcaa

SEQ ID NO: 2579490 - RNA, 15 nt, Coxiella burnetii RSA 493
guugcuuuugcucuu

SEQ ID NO: 2579491 - RNA, 16 nt, Coxiella burnetii RSA 493
guuggcaggaaaaaua

SEQ ID NO: 2579492 - RNA, 15 nt, Coxiella burnetii RSA 493
guugggcugagcuug

SEQ ID NO: 2579493 - RNA, 22 nt, Coxiella burnetii RSA 493
guuguauccagucguuuuuuaa

SEQ ID NO: 2579494 - RNA, 23 nt, Coxiella burnetii RSA 493
guuguauccagucguuuuuuaau

SEQ ID NO: 2579495 - RNA, 21 nt, Coxiella burnetii RSA 493
guugucaacaaaauuuuucau

SEQ ID NO: 2579496 - RNA, 19 nt, Coxiella burnetii RSA 493
guugucaacaaucaguuuu

SEQ ID NO: 2579497 - RNA, 23 nt, Coxiella burnetii RSA 493
guugucaacaaucaguuuugaug

SEQ ID NO: 2579498 - RNA, 22 nt, Coxiella burnetii RSA 493
guugucauguaaucaauugcua

SEQ ID NO: 2579499 - RNA, 16 nt, Coxiella burnetii RSA 493
guugucuuggaaaaaa

SEQ ID NO: 2579500 - RNA, 16 nt, Coxiella burnetii RSA 493
guuguggcugaaaagu

SEQ ID NO: 2579501 - RNA, 16 nt, Coxiella burnetii RSA 493
guuguuagcuuuucuu

SEQ ID NO: 2579502 - RNA, 21 nt, Coxiella burnetii RSA 493
guuguuagcuuuucuuuaaac

SEQ ID NO: 2579503 - RNA, 12 nt, Coxiella burnetii RSA 493
guuguuuuaaau

SEQ ID NO: 2579504 - RNA, 16 nt, Coxiella burnetii RSA 493
guuguuuuaaauccuu

SEQ ID NO: 2579505 - RNA, 21 nt, Coxiella burnetii RSA 493
guuuaaagcugcuuuuuaaaa

SEQ ID NO: 2579506 - RNA, 17 nt, Coxiella burnetii RSA 493
guuuaaauaacaaaugc

SEQ ID NO: 2579507 - RNA, 18 nt, Coxiella burnetii RSA 493
uaaagagggacuauaaag

SEQ ID NO: 2579508 - RNA, 20 nt, Coxiella burnetii RSA 493
uaaagauaucgucacccaaa

SEQ ID NO: 2579509 - RNA, 19 nt, Coxiella burnetii RSA 493
uaaagcaaaaguaauauuu

SEQ ID NO: 2579510 - RNA, 14 nt, Coxiella burnetii RSA 493
uaaagcagcaauug

SEQ ID NO: 2579511 - RNA, 18 nt, Coxiella burnetii RSA 493
uaaagccguuauccauga

SEQ ID NO: 2579512 - RNA, 17 nt, Coxiella burnetii RSA 493
uaaagcugcuuuuuaaa

SEQ ID NO: 2579513 - RNA, 15 nt, Coxiella burnetii RSA 493
uaaagguuuuuccuu

SEQ ID NO: 2579514 - RNA, 16 nt, Coxiella burnetii RSA 493
uaaaguaauuuuaaaa

SEQ ID NO: 2579515 - RNA, 15 nt, Coxiella burnetii RSA 493
uaaagucuucaaaag

SEQ ID NO: 2579516 - RNA, 16 nt, Coxiella burnetii RSA 493
uaaagugccgcgaaua

SEQ ID NO: 2579517 - RNA, 18 nt, Coxiella burnetii RSA 493
uaaagugggggaaaacag

SEQ ID NO: 2579518 - RNA, 12 nt, Coxiella burnetii RSA 493
uaaaguuauuuc

SEQ ID NO: 2579519 - RNA, 13 nt, Coxiella burnetii RSA 493
uaaaguuauuucu

SEQ ID NO: 2579520 - RNA, 17 nt, Coxiella burnetii RSA 493
uaaaguuauuucuuuug

SEQ ID NO: 2579521 - RNA, 20 nt, Coxiella burnetii RSA 493
uaaaguuauuucuuuugauu

SEQ ID NO: 2579522 - RNA, 13 nt, Coxiella burnetii RSA 493
uaaaguuucuaac

SEQ ID NO: 2579523 - RNA, 23 nt, Coxiella burnetii RSA 493
uaaauaacuuuacuaaaaaacga

SEQ ID NO: 2579524 - RNA, 17 nt, Coxiella burnetii RSA 493
uaaauacauacauaaag

SEQ ID NO: 2579525 - RNA, 16 nt, Coxiella burnetii RSA 493
uaaauagcauuaauaa

SEQ ID NO: 2579526 - RNA, 19 nt, Coxiella burnetii RSA 493
uaaauagcauuaauaagac

SEQ ID NO: 2579527 - RNA, 15 nt, Coxiella burnetii RSA 493
uaaauaguucacgaa

SEQ ID NO: 2579528 - RNA, 16 nt, Coxiella burnetii RSA 493
uaaauaguucacgaau

SEQ ID NO: 2579529 - RNA, 21 nt, Coxiella burnetii RSA 493
uaaauauccgcaauaugcagc

SEQ ID NO: 2579530 - RNA, 14 nt, Coxiella burnetii RSA 493
uaaauauuuagcaa

SEQ ID NO: 2579531 - RNA, 18 nt, Coxiella burnetii RSA 493
uaaauauuuuuauuucca

SEQ ID NO: 2579532 - RNA, 13 nt, Coxiella burnetii RSA 493
uaaaucaauugcc

SEQ ID NO: 2579533 - RNA, 13 nt, Coxiella burnetii RSA 493
uaaaucauugguu

SEQ ID NO: 2579534 - RNA, 23 nt, Coxiella burnetii RSA 493
uaaauccauccggaugucauaau

SEQ ID NO: 2579535 - RNA, 21 nt, Coxiella burnetii RSA 493
uaaaucccuggugguuauuua

SEQ ID NO: 2579536 - RNA, 15 nt, Coxiella burnetii RSA 493
uaaauccuuaauuaa

SEQ ID NO: 2579537 - RNA, 18 nt, Coxiella burnetii RSA 493
uaaauccuuaauuaacug

SEQ ID NO: 2579538 - RNA, 18 nt, Coxiella burnetii RSA 493
uaaaucgguugaagaaau

SEQ ID NO: 2579539 - RNA, 22 nt, Coxiella burnetii RSA 493
uaaaucgguugaagaaauacga

SEQ ID NO: 2579540 - RNA, 21 nt, Coxiella burnetii RSA 493
uaaaucuuuggguauaaauaa

SEQ ID NO: 2579541 - RNA, 23 nt, Coxiella burnetii RSA 493
uaaaucuuuggguauaaauaacu

SEQ ID NO: 2579542 - RNA, 13 nt, Coxiella burnetii RSA 493
uaaaugaauuacu

SEQ ID NO: 2579543 - RNA, 20 nt, Coxiella burnetii RSA 493
uaaaugaauuacuuucagua

SEQ ID NO: 2579544 - RNA, 18 nt, Coxiella burnetii RSA 493
uaaaugcuuuucuuucau

SEQ ID NO: 2579545 - RNA, 20 nt, Coxiella burnetii RSA 493
uaaaugcuuuucuuucauua

SEQ ID NO: 2579546 - RNA, 20 nt, Coxiella burnetii RSA 493
uaaaugcuuuuuaaauaacu

SEQ ID NO: 2579547 - RNA, 19 nt, Coxiella burnetii RSA 493
uaaauguuucuuuuauaaa

SEQ ID NO: 2579548 - RNA, 16 nt, Coxiella burnetii RSA 493
uaaauuaaaaaucggu

SEQ ID NO: 2579549 - RNA, 17 nt, Coxiella burnetii RSA 493
uaaauuaaaugcuuuuu

SEQ ID NO: 2579550 - RNA, 23 nt, Coxiella burnetii RSA 493
uaaauuaaaugcuuuuuaaauaa

SEQ ID NO: 2579551 - RNA, 13 nt, Coxiella burnetii RSA 493
uaaauuaauauua

SEQ ID NO: 2579552 - RNA, 14 nt, Coxiella burnetii RSA 493
uaaauuaauauuau

SEQ ID NO: 2579553 - RNA, 22 nt, Coxiella burnetii RSA 493
uaaauuaauuauccaaaaucca

SEQ ID NO: 2579554 - RNA, 14 nt, Coxiella burnetii RSA 493
uaaauuauuuuaau

SEQ ID NO: 2579555 - RNA, 23 nt, Coxiella burnetii RSA 493
uaaauuauuuuaauaugauaaaa

SEQ ID NO: 2579556 - RNA, 22 nt, Coxiella burnetii RSA 493
uaaauuugccuugaucaaagac

SEQ ID NO: 2579557 - RNA, 12 nt, Coxiella burnetii RSA 493
uaaauuuuccca

SEQ ID NO: 2579558 - RNA, 15 nt, Coxiella burnetii RSA 493
uaaauuuucccaugu

SEQ ID NO: 2579559 - RNA, 17 nt, Coxiella burnetii RSA 493
uaaauuuuucauuuccu

SEQ ID NO: 2579560 - RNA, 14 nt, Coxiella burnetii RSA 493
uaaauuuuuguaau

SEQ ID NO: 2579561 - RNA, 11 nt, Coxiella burnetii RSA 493
uaacaaaaaug

SEQ ID NO: 2579562 - RNA, 14 nt, Coxiella burnetii RSA 493
uaacaaaagauauu

SEQ ID NO: 2579563 - RNA, 16 nt, Coxiella burnetii RSA 493
uaacaaaauuaaaaaa

SEQ ID NO: 2579564 - RNA, 15 nt, Coxiella burnetii RSA 493
uaacaaaccaucgcc

SEQ ID NO: 2579565 - RNA, 20 nt, Coxiella burnetii RSA 493
uaacaaaugaugaauuuauu

SEQ ID NO: 2579566 - RNA, 21 nt, Coxiella burnetii RSA 493
uaacaacagcgcccaauaagg

SEQ ID NO: 2579567 - RNA, 12 nt, Coxiella burnetii RSA 493
uaacaacgaaac

SEQ ID NO: 2579568 - RNA, 16 nt, Coxiella burnetii RSA 493
uaacaacgaaaccuug

SEQ ID NO: 2579569 - RNA, 16 nt, Coxiella burnetii RSA 493
uaacaagaucaauacc

SEQ ID NO: 2579570 - RNA, 21 nt, Coxiella burnetii RSA 493
uaacaagcucccagacacaug

SEQ ID NO: 2579571 - RNA, 23 nt, Coxiella burnetii RSA 493
uaacaagcuggcauugaaaauca

SEQ ID NO: 2579572 - RNA, 16 nt, Coxiella burnetii RSA 493
uaacaagguauugauu

SEQ ID NO: 2579573 - RNA, 21 nt, Coxiella burnetii RSA 493
uaacaagguauugauuaacuu

SEQ ID NO: 2579574 - RNA, 20 nt, Coxiella burnetii RSA 493
uaacaagguuuuauuuuuaa

SEQ ID NO: 2579575 - RNA, 21 nt, Coxiella burnetii RSA 493
uaacaauuguugauuuaacuu

SEQ ID NO: 2579576 - RNA, 22 nt, Coxiella burnetii RSA 493
uaacacggccuucauuauugaa

SEQ ID NO: 2579577 - RNA, 23 nt, Coxiella burnetii RSA 493
uaacagacagacgcuggaaaaau

SEQ ID NO: 2579578 - RNA, 14 nt, Coxiella burnetii RSA 493
uaacagcaagagga

SEQ ID NO: 2579579 - RNA, 23 nt, Coxiella burnetii RSA 493
uaacagcaagaggaguucuaaaa

SEQ ID NO: 2579580 - RNA, 21 nt, Coxiella burnetii RSA 493
uaacagcgaacauccaauuac

SEQ ID NO: 2579581 - RNA, 22 nt, Coxiella burnetii RSA 493
uaacaguaacucuaauuuuccu

SEQ ID NO: 2579582 - RNA, 17 nt, Coxiella burnetii RSA 493
uaacaguguuuaacucu

SEQ ID NO: 2579583 - RNA, 17 nt, Coxiella burnetii RSA 493
uaacauacgacuucauu

SEQ ID NO: 2579584 - RNA, 22 nt, Coxiella burnetii RSA 493
uaacaucaguuuugauuugagu

SEQ ID NO: 2579585 - RNA, 22 nt, Coxiella burnetii RSA 493
uaacauuauuacauauuucuuu

SEQ ID NO: 2579586 - RNA, 23 nt, Coxiella burnetii RSA 493
uaacauucaaagaacgccaguca

SEQ ID NO: 2579587 - RNA, 15 nt, Coxiella burnetii RSA 493
uaaccaaucaauaaa

SEQ ID NO: 2579588 - RNA, 17 nt, Coxiella burnetii RSA 493
uaaccaaucaauaaaaa

SEQ ID NO: 2579589 - RNA, 22 nt, Coxiella burnetii RSA 493
uaaccacagacucuuuuuaucc

SEQ ID NO: 2579590 - RNA, 17 nt, Coxiella burnetii RSA 493
uaacccuuucauuuaau

SEQ ID NO: 2579591 - RNA, 18 nt, Coxiella burnetii RSA 493
uaacccuuucauuuaauu

SEQ ID NO: 2579592 - RNA, 20 nt, Coxiella burnetii RSA 493
uaaccgcugacgucagaaaa

SEQ ID NO: 2579593 - RNA, 17 nt, Coxiella burnetii RSA 493
uaaccugagggaauuuu

SEQ ID NO: 2579594 - RNA, 14 nt, Coxiella burnetii RSA 493
uaaccuugcauaau

SEQ ID NO: 2579595 - RNA, 12 nt, Coxiella burnetii RSA 493
uaacgauuucuc

SEQ ID NO: 2579596 - RNA, 15 nt, Coxiella burnetii RSA 493
uaacgauuucucuua

SEQ ID NO: 2579597 - RNA, 19 nt, Coxiella burnetii RSA 493
uaacgcgaucgaaaugucu

SEQ ID NO: 2579598 - RNA, 13 nt, Coxiella burnetii RSA 493
uaacgcuucuuuu

SEQ ID NO: 2579599 - RNA, 23 nt, Coxiella burnetii RSA 493
uaacgggaauguuuuuuaauaaa

SEQ ID NO: 2579600 - RNA, 23 nt, Coxiella burnetii RSA 493
uaacggggucgcggaaaauuuaa

SEQ ID NO: 2579601 - RNA, 16 nt, Coxiella burnetii RSA 493
uaacgucgcaaauaau

SEQ ID NO: 2579602 - RNA, 19 nt, Coxiella burnetii RSA 493
uaacguuaguuucuuuuau

SEQ ID NO: 2579603 - RNA, 15 nt, Coxiella burnetii RSA 493
uaacuauuauuaaaa

SEQ ID NO: 2579604 - RNA, 17 nt, Coxiella burnetii RSA 493
uaacuccacgaucugag

SEQ ID NO: 2579605 - RNA, 19 nt, Coxiella burnetii RSA 493
uaacuccuuguuuuaaccu

SEQ ID NO: 2579606 - RNA, 21 nt, Coxiella burnetii RSA 493
uaacuccuuguuuuaaccuga

SEQ ID NO: 2579607 - RNA, 14 nt, Coxiella burnetii RSA 493
uaacucuaauuuuc

SEQ ID NO: 2579608 - RNA, 19 nt, Coxiella burnetii RSA 493
uaacucuaauuuuccugac

SEQ ID NO: 2579609 - RNA, 15 nt, Coxiella burnetii RSA 493
uaacugauuagcuga

SEQ ID NO: 2579610 - RNA, 21 nt, Coxiella burnetii RSA 493
uaacugauuagcugacaucuu

SEQ ID NO: 2579611 - RNA, 18 nt, Coxiella burnetii RSA 493
uaacuguguuccuuacuc

SEQ ID NO: 2579612 - RNA, 15 nt, Coxiella burnetii RSA 493
uaaugacuuugauau

SEQ ID NO: 2579613 - RNA, 20 nt, Coxiella burnetii RSA 493
uaaugaucaaugaaacaaac

SEQ ID NO: 2579614 - RNA, 17 nt, Coxiella burnetii RSA 493
uaaugaugccuuaaaua

SEQ ID NO: 2579615 - RNA, 14 nt, Coxiella burnetii RSA 493
uaaugcaaaaccaa

SEQ ID NO: 2579616 - RNA, 13 nt, Coxiella burnetii RSA 493
uaaugcgccuaca

SEQ ID NO: 2579617 - RNA, 20 nt, Coxiella burnetii RSA 493
uaaugcgccuacaaauacca

SEQ ID NO: 2579618 - RNA, 21 nt, Coxiella burnetii RSA 493
uaaugcgccuacaaauaccaa

SEQ ID NO: 2579619 - RNA, 19 nt, Coxiella burnetii RSA 493
uaaugcggcauucaauggc

SEQ ID NO: 2579620 - RNA, 11 nt, Coxiella burnetii RSA 493
uaaugcuuuuu

SEQ ID NO: 2579621 - RNA, 22 nt, Coxiella burnetii RSA 493
uaaugguagcuaccagucuguu

SEQ ID NO: 2579622 - RNA, 15 nt, Coxiella burnetii RSA 493
uaauguuauuaaaca

SEQ ID NO: 2579623 - RNA, 18 nt, Coxiella burnetii RSA 493
uaauguuauuaaacaaga

SEQ ID NO: 2579624 - RNA, 14 nt, Coxiella burnetii RSA 493
uaauguuauuuauu

SEQ ID NO: 2579625 - RNA, 17 nt, Coxiella burnetii RSA 493
uaauguuugauaucaau

SEQ ID NO: 2579626 - RNA, 15 nt, Coxiella burnetii RSA 493
uaauguuuuuucuaa

SEQ ID NO: 2579627 - RNA, 16 nt, Coxiella burnetii RSA 493
uaauguuuuuucuaau

SEQ ID NO: 2579628 - RNA, 17 nt, Coxiella burnetii RSA 493
uaauuaagcuugaaaaa

SEQ ID NO: 2579629 - RNA, 18 nt, Coxiella burnetii RSA 493
uaauuaagcuugaaaaaa

SEQ ID NO: 2579630 - RNA, 19 nt, Coxiella burnetii RSA 493
uaauuaagcuugaaaaaau

SEQ ID NO: 2579631 - RNA, 14 nt, Coxiella burnetii RSA 493
uaauuacaacuacu

SEQ ID NO: 2579632 - RNA, 20 nt, Coxiella burnetii RSA 493
uaauucaaauuuuaaagguu

SEQ ID NO: 2579633 - RNA, 15 nt, Coxiella burnetii RSA 493
uaauucauaaauaau

SEQ ID NO: 2579634 - RNA, 20 nt, Coxiella burnetii RSA 493
uaauuccccguauuucgcuu

SEQ ID NO: 2579635 - RNA, 17 nt, Coxiella burnetii RSA 493
uaauucgagcaucuuuu

SEQ ID NO: 2579636 - RNA, 16 nt, Coxiella burnetii RSA 493
uaauucguugcauuca

SEQ ID NO: 2579637 - RNA, 20 nt, Coxiella burnetii RSA 493
uaauucuugcagugaaauaa

SEQ ID NO: 2579638 - RNA, 12 nt, Coxiella burnetii RSA 493
uaauucuuuuuu

SEQ ID NO: 2579639 - RNA, 18 nt, Coxiella burnetii RSA 493
uaauucuuuuuuaauauu

SEQ ID NO: 2579640 - RNA, 22 nt, Coxiella burnetii RSA 493
uaauugaauuugagaacguuuc

SEQ ID NO: 2579641 - RNA, 14 nt, Coxiella burnetii RSA 493
uaauugaauuugcu

SEQ ID NO: 2579642 - RNA, 16 nt, Coxiella burnetii RSA 493
uaauugaggaaaauaa

SEQ ID NO: 2579643 - RNA, 19 nt, Coxiella burnetii RSA 493
uaauugaggaaaauaagau

SEQ ID NO: 2579644 - RNA, 17 nt, Coxiella burnetii RSA 493
uaauugagguuuuaauu

SEQ ID NO: 2579645 - RNA, 21 nt, Coxiella burnetii RSA 493
uaauugagguuuuaauuugcc

SEQ ID NO: 2579646 - RNA, 22 nt, Coxiella burnetii RSA 493
uaauugagguuuuaauuugccg

SEQ ID NO: 2579647 - RNA, 23 nt, Coxiella burnetii RSA 493
uaauugaucacgcaauucgcggg

SEQ ID NO: 2579648 - RNA, 16 nt, Coxiella burnetii RSA 493
uaauugcauguuugcu

SEQ ID NO: 2579649 - RNA, 20 nt, Coxiella burnetii RSA 493
uaauuggaggacugcucuua

SEQ ID NO: 2579650 - RNA, 23 nt, Coxiella burnetii RSA 493
uaauugggaagcaauuucauuca

SEQ ID NO: 2579651 - RNA, 19 nt, Coxiella burnetii RSA 493
uaauuuauaacaaaccauc

SEQ ID NO: 2579652 - RNA, 17 nt, Coxiella burnetii RSA 493
uaauuucuuagguuuua

SEQ ID NO: 2579653 - RNA, 21 nt, Coxiella burnetii RSA 493
uaauuucuucuuauaaucuua

SEQ ID NO: 2579654 - RNA, 17 nt, Coxiella burnetii RSA 493
uaauuugaauuucuguu

SEQ ID NO: 2579655 - RNA, 21 nt, Coxiella burnetii RSA 493
uaauuugccggcauauucaua

SEQ ID NO: 2579656 - RNA, 18 nt, Coxiella burnetii RSA 493
uaauuuuaaaaaaaauac

SEQ ID NO: 2579657 - RNA, 19 nt, Coxiella burnetii RSA 493
uaauuuuaaaaaaaauacu

SEQ ID NO: 2579658 - RNA, 18 nt, Coxiella burnetii RSA 493
uaauuuuaaaaaacccuc

SEQ ID NO: 2579659 - RNA, 11 nt, Coxiella burnetii RSA 493
uaauuuuaaau

SEQ ID NO: 2579660 - RNA, 13 nt, Coxiella burnetii RSA 493
uaauuuuauuauu

SEQ ID NO: 2579661 - RNA, 18 nt, Coxiella burnetii RSA 493
uaauuuuccuuuucuauu

SEQ ID NO: 2579662 - RNA, 13 nt, Coxiella burnetii RSA 493
uaauuuuuaaagc

SEQ ID NO: 2579663 - RNA, 22 nt, Coxiella burnetii RSA 493
uaauuuuugaguucuuuaagau

SEQ ID NO: 2579664 - RNA, 13 nt, Coxiella burnetii RSA 493
uaauuuuuucaua

SEQ ID NO: 2579665 - RNA, 13 nt, Coxiella burnetii RSA 493
uaauuuuuuuaau

SEQ ID NO: 2579666 - RNA, 14 nt, Coxiella burnetii RSA 493
uaauuuuuuuaauu

SEQ ID NO: 2579667 - RNA, 19 nt, Coxiella burnetii RSA 493
uacaaaagcgccgaaaucc

SEQ ID NO: 2579668 - RNA, 16 nt, Coxiella burnetii RSA 493
uacaaauaccaaaugg

SEQ ID NO: 2579669 - RNA, 15 nt, Coxiella burnetii RSA 493
uacaaauuuuuaaga

SEQ ID NO: 2579670 - RNA, 17 nt, Coxiella burnetii RSA 493
uacaacgcuguuaaaau

SEQ ID NO: 2579671 - RNA, 16 nt, Coxiella burnetii RSA 493
uacaaggaaugucagg

SEQ ID NO: 2579672 - RNA, 15 nt, Coxiella burnetii RSA 493
uacaaggccggcccu

SEQ ID NO: 2579673 - RNA, 21 nt, Coxiella burnetii RSA 493
uacaagugcuuccaaguaagc

SEQ ID NO: 2579674 - RNA, 23 nt, Coxiella burnetii RSA 493
uacaaugcguagucauagcuaag

SEQ ID NO: 2579675 - RNA, 21 nt, Coxiella burnetii RSA 493
uacagaaugauagaaacagua

SEQ ID NO: 2579676 - RNA, 14 nt, Coxiella burnetii RSA 493
uacaggaaaaagau

SEQ ID NO: 2579677 - RNA, 17 nt, Coxiella burnetii RSA 493
uacaggaaaaagauaau

SEQ ID NO: 2579678 - RNA, 22 nt, Coxiella burnetii RSA 493
uacagguuguuugcuuauuuug

SEQ ID NO: 2579679 - RNA, 22 nt, Coxiella burnetii RSA 493
uacagugugcacgauuuuauaa

SEQ ID NO: 2579680 - RNA, 15 nt, Coxiella burnetii RSA 493
uacauaauuuaaacu

SEQ ID NO: 2579681 - RNA, 18 nt, Coxiella burnetii RSA 493
uacauaauuuaaacucaa

SEQ ID NO: 2579682 - RNA, 13 nt, Coxiella burnetii RSA 493
uacauauuucuuu

SEQ ID NO: 2579683 - RNA, 19 nt, Coxiella burnetii RSA 493
uacaucuaagcuaguaguc

SEQ ID NO: 2579684 - RNA, 16 nt, Coxiella burnetii RSA 493
uacaucuucauuuucu

SEQ ID NO: 2579685 - RNA, 16 nt, Coxiella burnetii RSA 493
uacauucuucaguaau

SEQ ID NO: 2579686 - RNA, 19 nt, Coxiella burnetii RSA 493
uaccaaaaagcguuuaaau

SEQ ID NO: 2579687 - RNA, 16 nt, Coxiella burnetii RSA 493
uaccaagcucaugaaa

SEQ ID NO: 2579688 - RNA, 16 nt, Coxiella burnetii RSA 493
uaccaauuaaagaauc

SEQ ID NO: 2579689 - RNA, 17 nt, Coxiella burnetii RSA 493
uaccaugguuccagaaa

SEQ ID NO: 2579690 - RNA, 13 nt, Coxiella burnetii RSA 493
uaccauuuuccuu

SEQ ID NO: 2579691 - RNA, 15 nt, Coxiella burnetii RSA 493
uacccaaaaacccau

SEQ ID NO: 2579692 - RNA, 15 nt, Coxiella burnetii RSA 493
uacccguuuaaauuu

SEQ ID NO: 2579693 - RNA, 23 nt, Coxiella burnetii RSA 493
uaccgacauggcgguaaugagaa

SEQ ID NO: 2579694 - RNA, 11 nt, Coxiella burnetii RSA 493
uaccgauuaau

SEQ ID NO: 2579695 - RNA, 13 nt, Coxiella burnetii RSA 493
uaccgugaauaaa

SEQ ID NO: 2579696 - RNA, 19 nt, Coxiella burnetii RSA 493
uaccguggccggcaaugca

SEQ ID NO: 2579697 - RNA, 15 nt, Coxiella burnetii RSA 493
uaccuccgucauuga

SEQ ID NO: 2579698 - RNA, 17 nt, Coxiella burnetii RSA 493
uaccuccgucauugaaa

SEQ ID NO: 2579699 - RNA, 14 nt, Coxiella burnetii RSA 493
uaccuccuccccau

SEQ ID NO: 2579700 - RNA, 14 nt, Coxiella burnetii RSA 493
uaccugauaaaaua

SEQ ID NO: 2579701 - RNA, 17 nt, Coxiella burnetii RSA 493
uaccuugucacaagugu

SEQ ID NO: 2579702 - RNA, 17 nt, Coxiella burnetii RSA 493
uaccuuuuucccauuca

SEQ ID NO: 2579703 - RNA, 19 nt, Coxiella burnetii RSA 493
uacgaaccacuggaaucaa

SEQ ID NO: 2579704 - RNA, 13 nt, Coxiella burnetii RSA 493
uacgaagcggcuc

SEQ ID NO: 2579705 - RNA, 12 nt, Coxiella burnetii RSA 493
uacgaauuucaa

SEQ ID NO: 2579706 - RNA, 14 nt, Coxiella burnetii RSA 493
uacgagcggccuca

SEQ ID NO: 2579707 - RNA, 16 nt, Coxiella burnetii RSA 493
uacgauagaggcgcau

SEQ ID NO: 2579708 - RNA, 16 nt, Coxiella burnetii RSA 493
uacgcccuuucucuuu

SEQ ID NO: 2579709 - RNA, 17 nt, Coxiella burnetii RSA 493
uacgcgagcggcggaac

SEQ ID NO: 2579710 - RNA, 15 nt, Coxiella burnetii RSA 493
uacgcgcuucuuuua

SEQ ID NO: 2579711 - RNA, 14 nt, Coxiella burnetii RSA 493
uacgcugaaguaau

SEQ ID NO: 2579712 - RNA, 16 nt, Coxiella burnetii RSA 493
uacggagaaaaugauu

SEQ ID NO: 2579713 - RNA, 13 nt, Coxiella burnetii RSA 493
uacggcuuuauuu

SEQ ID NO: 2579714 - RNA, 17 nt, Coxiella burnetii RSA 493
uacgggauucaauuuca

SEQ ID NO: 2579715 - RNA, 15 nt, Coxiella burnetii RSA 493
uacggugcagaaggc

SEQ ID NO: 2579716 - RNA, 15 nt, Coxiella burnetii RSA 493
uacguaauuauuaag

SEQ ID NO: 2579717 - RNA, 15 nt, Coxiella burnetii RSA 493
uacguauucaugaca

SEQ ID NO: 2579718 - RNA, 24 nt, Coxiella burnetii RSA 493
uagucauagcuaagaucaagaaag

SEQ ID NO: 2579719 - RNA, 17 nt, Coxiella burnetii RSA 493
uagucuuaauuuuaaaa

SEQ ID NO: 2579720 - RNA, 19 nt, Coxiella burnetii RSA 493
uagucuuaauuuuaaaaaa

SEQ ID NO: 2579721 - RNA, 19 nt, Coxiella burnetii RSA 493
uagucuuugguuuuccaug

SEQ ID NO: 2579722 - RNA, 15 nt, Coxiella burnetii RSA 493
uagugaaaguuucau

SEQ ID NO: 2579723 - RNA, 18 nt, Coxiella burnetii RSA 493
uagugcuauuuuucccac

SEQ ID NO: 2579724 - RNA, 19 nt, Coxiella burnetii RSA 493
uagugcuauuuuucccaca

SEQ ID NO: 2579725 - RNA, 19 nt, Coxiella burnetii RSA 493
uagugcuuuuaaacagucu

SEQ ID NO: 2579726 - RNA, 20 nt, Coxiella burnetii RSA 493
uagugcuuuuaaacagucuu

SEQ ID NO: 2579727 - RNA, 15 nt, Coxiella burnetii RSA 493
uagugucaaaggccg

SEQ ID NO: 2579728 - RNA, 17 nt, Coxiella burnetii RSA 493
uaguuauuuuucaucuu

SEQ ID NO: 2579729 - RNA, 18 nt, Coxiella burnetii RSA 493
uaguuauuuuucaucuug

SEQ ID NO: 2579730 - RNA, 17 nt, Coxiella burnetii RSA 493
uaguucauuaaauuuaa

SEQ ID NO: 2579731 - RNA, 20 nt, Coxiella burnetii RSA 493
uaguuucccguauuucgcuu

SEQ ID NO: 2579732 - RNA, 15 nt, Coxiella burnetii RSA 493
uaguuugcaauacca

SEQ ID NO: 2579733 - RNA, 11 nt, Coxiella burnetii RSA 493
uaguuuuacua

SEQ ID NO: 2579734 - RNA, 15 nt, Coxiella burnetii RSA 493
uaguuuuauuugaaa

SEQ ID NO: 2579735 - RNA, 22 nt, Coxiella burnetii RSA 493
uaguuuuucccucuacaaaaua

SEQ ID NO: 2579736 - RNA, 15 nt, Coxiella burnetii RSA 493
uauaaaauuuaguug

SEQ ID NO: 2579737 - RNA, 13 nt, Coxiella burnetii RSA 493
uauaaaauuuuau

SEQ ID NO: 2579738 - RNA, 15 nt, Coxiella burnetii RSA 493
uauaaaauuuuauuc

SEQ ID NO: 2579739 - RNA, 16 nt, Coxiella burnetii RSA 493
uauaaagguuuuuccu

SEQ ID NO: 2579740 - RNA, 19 nt, Coxiella burnetii RSA 493
uauaaagguuuuuccuuuu

SEQ ID NO: 2579741 - RNA, 23 nt, Coxiella burnetii RSA 493
uauaaagguuuuuccuuuuauuc

SEQ ID NO: 2579742 - RNA, 19 nt, Coxiella burnetii RSA 493
uauaaagucgcauagccaa

SEQ ID NO: 2579743 - RNA, 13 nt, Coxiella burnetii RSA 493
uauaaauaaucuu

SEQ ID NO: 2579744 - RNA, 23 nt, Coxiella burnetii RSA 493
uauaaaucccgaguccguaauag

SEQ ID NO: 2579745 - RNA, 22 nt, Coxiella burnetii RSA 493
uauaaaugauuuccaacgcuug

SEQ ID NO: 2579746 - RNA, 16 nt, Coxiella burnetii RSA 493
uauaaauuaaauugcu

SEQ ID NO: 2579747 - RNA, 14 nt, Coxiella burnetii RSA 493
uauaaauuuuccca

SEQ ID NO: 2579748 - RNA, 18 nt, Coxiella burnetii RSA 493
uauaacaaaauuaaaaaa

SEQ ID NO: 2579749 - RNA, 19 nt, Coxiella burnetii RSA 493
uauaacuauuuuaaaucuu

SEQ ID NO: 2579750 - RNA, 23 nt, Coxiella burnetii RSA 493
uauaacugaccggguuuacauaa

SEQ ID NO: 2579751 - RNA, 14 nt, Coxiella burnetii RSA 493
uauaacuuucgaga

SEQ ID NO: 2579752 - RNA, 23 nt, Coxiella burnetii RSA 493
uauaagacgcuuucaacauauuu

SEQ ID NO: 2579753 - RNA, 16 nt, Coxiella burnetii RSA 493
uauaaggucuuaauuu

SEQ ID NO: 2579754 - RNA, 19 nt, Coxiella burnetii RSA 493
uauaaggucuuaauuucua

SEQ ID NO: 2579755 - RNA, 17 nt, Coxiella burnetii RSA 493
uauaaguccaagacuga

SEQ ID NO: 2579756 - RNA, 22 nt, Coxiella burnetii RSA 493
uauaaguguggucugaaaauaa

SEQ ID NO: 2579757 - RNA, 17 nt, Coxiella burnetii RSA 493
uauaauuagauaaagac

SEQ ID NO: 2579758 - RNA, 13 nt, Coxiella burnetii RSA 493
uauaauucucuau

SEQ ID NO: 2579759 - RNA, 19 nt, Coxiella burnetii RSA 493
uauaauuucuuuuugaaua

SEQ ID NO: 2579760 - RNA, 14 nt, Coxiella burnetii RSA 493
uauacacaucuuuu

SEQ ID NO: 2579761 - RNA, 14 nt, Coxiella burnetii RSA 493
uauaccaaaaaguu

SEQ ID NO: 2579762 - RNA, 15 nt, Coxiella burnetii RSA 493
uauaccaaaaaguug

SEQ ID NO: 2579763 - RNA, 23 nt, Coxiella burnetii RSA 493
uauaccauacagaauuucuuugu

SEQ ID NO: 2579764 - RNA, 13 nt, Coxiella burnetii RSA 493
uauaccuuuuucc

SEQ ID NO: 2579765 - RNA, 23 nt, Coxiella burnetii RSA 493
uauacugacaaugcguuuuaaau

SEQ ID NO: 2579766 - RNA, 18 nt, Coxiella burnetii RSA 493
uauacugcccaagaaauu

SEQ ID NO: 2579767 - RNA, 14 nt, Coxiella burnetii RSA 493
uauacuuuuuugaa

SEQ ID NO: 2579768 - RNA, 14 nt, Coxiella burnetii RSA 493
uauaguucauuaaa

SEQ ID NO: 2579769 - RNA, 19 nt, Coxiella burnetii RSA 493
uauaguucauuaaauuuaa

SEQ ID NO: 2579770 - RNA, 20 nt, Coxiella burnetii RSA 493
uauaguucauuaaauuuaau

SEQ ID NO: 2579771 - RNA, 21 nt, Coxiella burnetii RSA 493
uauauaagcuuucaauaaaua

SEQ ID NO: 2579772 - RNA, 23 nt, Coxiella burnetii RSA 493
uauauaagcuuucaauaaauaaa

SEQ ID NO: 2579773 - RNA, 14 nt, Coxiella burnetii RSA 493
uauauuaauuugau

SEQ ID NO: 2579774 - RNA, 20 nt, Coxiella burnetii RSA 493
uauauugggguucauuuuuu

SEQ ID NO: 2579775 - RNA, 15 nt, Coxiella burnetii RSA 493
uauauuuaauuuuau

SEQ ID NO: 2579776 - RNA, 18 nt, Coxiella burnetii RSA 493
uauauuuacugagaaaac

SEQ ID NO: 2579777 - RNA, 14 nt, Coxiella burnetii RSA 493
uauauuucauucgg

SEQ ID NO: 2579778 - RNA, 18 nt, Coxiella burnetii RSA 493
uauauuuguauccgcuuu

SEQ ID NO: 2579779 - RNA, 16 nt, Coxiella burnetii RSA 493
uauauuuucuuucuuu

SEQ ID NO: 2579780 - RNA, 20 nt, Coxiella burnetii RSA 493
uaucaacgauuuuaagaauc

SEQ ID NO: 2579781 - RNA, 16 nt, Coxiella burnetii RSA 493
uaucaaguuuauaaga

SEQ ID NO: 2579782 - RNA, 15 nt, Coxiella burnetii RSA 493
uaucaauagcgcaau

SEQ ID NO: 2579783 - RNA, 16 nt, Coxiella burnetii RSA 493
uaucaauagcgcaauu

SEQ ID NO: 2579784 - RNA, 17 nt, Coxiella burnetii RSA 493
uaucaaucgaaaaaaau

SEQ ID NO: 2579785 - RNA, 22 nt, Coxiella burnetii RSA 493
uaucaccuuugcuaacaauugu

SEQ ID NO: 2579786 - RNA, 18 nt, Coxiella burnetii RSA 493
uaucacuagcuauucuuu

SEQ ID NO: 2579787 - RNA, 19 nt, Coxiella burnetii RSA 493
uaucacuccaauaauaaaa

SEQ ID NO: 2579788 - RNA, 13 nt, Coxiella burnetii RSA 493
uaucauacuuaau

SEQ ID NO: 2579789 - RNA, 14 nt, Coxiella burnetii RSA 493
uaucauacuuaauu

SEQ ID NO: 2579790 - RNA, 20 nt, Coxiella burnetii RSA 493
uaucauacuuaauuucgcuc

SEQ ID NO: 2579791 - RNA, 21 nt, Coxiella burnetii RSA 493
uaucaugcauuugauuuucug

SEQ ID NO: 2579792 - RNA, 22 nt, Coxiella burnetii RSA 493
uaucauucacuaaucgucgaca

SEQ ID NO: 2579793 - RNA, 22 nt, Coxiella burnetii RSA 493
uaucauucuuauccuuacaaaa

SEQ ID NO: 2579794 - RNA, 23 nt, Coxiella burnetii RSA 493
uaucauugggccauuuaacaaaa

SEQ ID NO: 2579795 - RNA, 15 nt, Coxiella burnetii RSA 493
uauccaaaaagauaa

SEQ ID NO: 2579796 - RNA, 22 nt, Coxiella burnetii RSA 493
uauccaaaauccaggcugcuag

SEQ ID NO: 2579797 - RNA, 11 nt, Coxiella burnetii RSA 493
uauccaaauag

SEQ ID NO: 2579798 - RNA, 13 nt, Coxiella burnetii RSA 493
uauccaaauagau

SEQ ID NO: 2579799 - RNA, 14 nt, Coxiella burnetii RSA 493
uauccaugaaagga

SEQ ID NO: 2579800 - RNA, 21 nt, Coxiella burnetii RSA 493
uauccccgaaggcgccuaaua

SEQ ID NO: 2579801 - RNA, 14 nt, Coxiella burnetii RSA 493
uaucccgaaaaccc

SEQ ID NO: 2579802 - RNA, 18 nt, Coxiella burnetii RSA 493
uauccgguuuugauuuuu

SEQ ID NO: 2579803 - RNA, 14 nt, Coxiella burnetii RSA 493
uauccuuacaaaaa

SEQ ID NO: 2579804 - RNA, 21 nt, Coxiella burnetii RSA 493
uaucgaugaagcugacgcuuc

SEQ ID NO: 2579805 - RNA, 17 nt, Coxiella burnetii RSA 493
uaucgccguuucugcuu

SEQ ID NO: 2579806 - RNA, 13 nt, Coxiella burnetii RSA 493
uaucggcuucaca

SEQ ID NO: 2579807 - RNA, 16 nt, Coxiella burnetii RSA 493
uaucguaaauauuuuu

SEQ ID NO: 2579808 - RNA, 20 nt, Coxiella burnetii RSA 493
uaucguccccguauuucgcu

SEQ ID NO: 2579809 - RNA, 14 nt, Coxiella burnetii RSA 493
uaucucuuaaaauu

SEQ ID NO: 2579810 - RNA, 11 nt, Coxiella burnetii RSA 493
uaucuggccag

SEQ ID NO: 2579811 - RNA, 23 nt, Coxiella burnetii RSA 493
uaucuguuuuaucccaauaguaa

SEQ ID NO: 2579812 - RNA, 15 nt, Coxiella burnetii RSA 493
uaucuuaaugaaauu

SEQ ID NO: 2579813 - RNA, 21 nt, Coxiella burnetii RSA 493
uaucuuaaugaaauuucucau

SEQ ID NO: 2579814 - RNA, 17 nt, Coxiella burnetii RSA 493
uaucuuucauguaauuu

SEQ ID NO: 2579815 - RNA, 16 nt, Coxiella burnetii RSA 493
uaucuuuuucaauuau

SEQ ID NO: 2579816 - RNA, 19 nt, Coxiella burnetii RSA 493
uaugaagcgcggcgaaaua

SEQ ID NO: 2579817 - RNA, 20 nt, Coxiella burnetii RSA 493
uaugaagcgcggcgaaauac

SEQ ID NO: 2579818 - RNA, 21 nt, Coxiella burnetii RSA 493
uaugaagcgcggcgaaauaca

SEQ ID NO: 2579819 - RNA, 20 nt, Coxiella burnetii RSA 493
uaugaauaauuuuuuuaauu

SEQ ID NO: 2579820 - RNA, 21 nt, Coxiella burnetii RSA 493
uaugaauaauuuuuuuaauuu

SEQ ID NO: 2579821 - RNA, 19 nt, Coxiella burnetii RSA 493
uaugaauauagacaaugcu

SEQ ID NO: 2579822 - RNA, 12 nt, Coxiella burnetii RSA 493
uaugaaucagcu

SEQ ID NO: 2579823 - RNA, 12 nt, Coxiella burnetii RSA 493
ucaaaauuaaaa

SEQ ID NO: 2579824 - RNA, 17 nt, Coxiella burnetii RSA 493
ucaaaauucuccuuaau

SEQ ID NO: 2579825 - RNA, 13 nt, Coxiella burnetii RSA 493
ucaaaauuuacuu

SEQ ID NO: 2579826 - RNA, 13 nt, Coxiella burnetii RSA 493
ucaaacaaaucaa

SEQ ID NO: 2579827 - RNA, 14 nt, Coxiella burnetii RSA 493
ucaaacaaaucaau

SEQ ID NO: 2579828 - RNA, 12 nt, Coxiella burnetii RSA 493
ucaaacacuugu

SEQ ID NO: 2579829 - RNA, 20 nt, Coxiella burnetii RSA 493
ucaaaccaacgaugcugaua

SEQ ID NO: 2579830 - RNA, 11 nt, Coxiella burnetii RSA 493
ucaaaccaauc

SEQ ID NO: 2579831 - RNA, 15 nt, Coxiella burnetii RSA 493
ucaaacgguaaucgu

SEQ ID NO: 2579832 - RNA, 15 nt, Coxiella burnetii RSA 493
ucaaacuguuugcau

SEQ ID NO: 2579833 - RNA, 18 nt, Coxiella burnetii RSA 493
ucaaagaaacgauuaaaa

SEQ ID NO: 2579834 - RNA, 13 nt, Coxiella burnetii RSA 493
ucaaagaaauaau

SEQ ID NO: 2579835 - RNA, 14 nt, Coxiella burnetii RSA 493
ucaaagaaauaauc

SEQ ID NO: 2579836 - RNA, 16 nt, Coxiella burnetii RSA 493
ucaaagaaauaaucau

SEQ ID NO: 2579837 - RNA, 22 nt, Coxiella burnetii RSA 493
ucaaagaacgccagucauuuuc

SEQ ID NO: 2579838 - RNA, 21 nt, Coxiella burnetii RSA 493
ucaaagacaucggauaaugcu

SEQ ID NO: 2579839 - RNA, 16 nt, Coxiella burnetii RSA 493
ucaaagauaucgucca

SEQ ID NO: 2579840 - RNA, 19 nt, Coxiella burnetii RSA 493
ucaaagcgccuaagccgcu

SEQ ID NO: 2579841 - RNA, 21 nt, Coxiella burnetii RSA 493
ucaaaguuuuuggcauaaaua

SEQ ID NO: 2579842 - RNA, 20 nt, Coxiella burnetii RSA 493
ucaaauagauuagugaaucu

SEQ ID NO: 2579843 - RNA, 14 nt, Coxiella burnetii RSA 493
ucaaauccuuuaau

SEQ ID NO: 2579844 - RNA, 15 nt, Coxiella burnetii RSA 493
ucaaauccuuuaauu

SEQ ID NO: 2579845 - RNA, 17 nt, Coxiella burnetii RSA 493
ucaaaugaacuuucuua

SEQ ID NO: 2579846 - RNA, 13 nt, Coxiella burnetii RSA 493
ucaaaugaccaaa

SEQ ID NO: 2579847 - RNA, 13 nt, Coxiella burnetii RSA 493
ucaaauuaaaaua

SEQ ID NO: 2579848 - RNA, 14 nt, Coxiella burnetii RSA 493
ucaaauuaaaauaa

SEQ ID NO: 2579849 - RNA, 14 nt, Coxiella burnetii RSA 493
ucaaauuuuaaagg

SEQ ID NO: 2579850 - RNA, 13 nt, Coxiella burnetii RSA 493
ucaaauuuuccca

SEQ ID NO: 2579851 - RNA, 20 nt, Coxiella burnetii RSA 493
ucaaauuuucccaggaaaga

SEQ ID NO: 2579852 - RNA, 23 nt, Coxiella burnetii RSA 493
ucaaauuuuccgugcagaaacaa

SEQ ID NO: 2579853 - RNA, 17 nt, Coxiella burnetii RSA 493
ucaacaaaauuuuucau

SEQ ID NO: 2579854 - RNA, 21 nt, Coxiella burnetii RSA 493
ucaacaaaauuuuucaugccu

SEQ ID NO: 2579855 - RNA, 18 nt, Coxiella burnetii RSA 493
ucaacaaacgaauggccc

SEQ ID NO: 2579856 - RNA, 17 nt, Coxiella burnetii RSA 493
ucaacaacuauccccau

SEQ ID NO: 2579857 - RNA, 11 nt, Coxiella burnetii RSA 493
ucaacaaucag

SEQ ID NO: 2579858 - RNA, 13 nt, Coxiella burnetii RSA 493
ucaacaccccaau

SEQ ID NO: 2579859 - RNA, 21 nt, Coxiella burnetii RSA 493
ucaacaccccaauuuuuggcu

SEQ ID NO: 2579860 - RNA, 14 nt, Coxiella burnetii RSA 493
ucaacagaacaacu

SEQ ID NO: 2579861 - RNA, 18 nt, Coxiella burnetii RSA 493
ucaacagaacaacugcgc

SEQ ID NO: 2579862 - RNA, 12 nt, Coxiella burnetii RSA 493
ucaacauauuuc

SEQ ID NO: 2579863 - RNA, 21 nt, Coxiella burnetii RSA 493
ucaaccaauccuacuuucgua

SEQ ID NO: 2579864 - RNA, 13 nt, Coxiella burnetii RSA 493
ucaaccagaaaua

SEQ ID NO: 2579865 - RNA, 22 nt, Coxiella burnetii RSA 493
ucaaccgcaugaauuaaauaua

SEQ ID NO: 2579866 - RNA, 16 nt, Coxiella burnetii RSA 493
ucaaccgguuuuucuu

SEQ ID NO: 2579867 - RNA, 19 nt, Coxiella burnetii RSA 493
ucaaccgguuuuucuucau

SEQ ID NO: 2579868 - RNA, 22 nt, Coxiella burnetii RSA 493
ucaaccgguuuuucuucauuug

SEQ ID NO: 2579869 - RNA, 15 nt, Coxiella burnetii RSA 493
ucaaccucagucugu

SEQ ID NO: 2579870 - RNA, 16 nt, Coxiella burnetii RSA 493
ucaacgcuucagaauc

SEQ ID NO: 2579871 - RNA, 17 nt, Coxiella burnetii RSA 493
ucaacggaaaaacaaaa

SEQ ID NO: 2579872 - RNA, 14 nt, Coxiella burnetii RSA 493
ucaacgucaaaacc

SEQ ID NO: 2579873 - RNA, 17 nt, Coxiella burnetii RSA 493
ucaacuacuugauauuc

SEQ ID NO: 2579874 - RNA, 20 nt, Coxiella burnetii RSA 493
ucaacuacuugauauucccu

SEQ ID NO: 2579875 - RNA, 13 nt, Coxiella burnetii RSA 493
ucaacuuaagaga

SEQ ID NO: 2579876 - RNA, 16 nt, Coxiella burnetii RSA 493
ucaagaacgauuuccc

SEQ ID NO: 2579877 - RNA, 22 nt, Coxiella burnetii RSA 493
ucaagacucaaagaaauaauca

SEQ ID NO: 2579878 - RNA, 17 nt, Coxiella burnetii RSA 493
ucaagagagguauugcu

SEQ ID NO: 2579879 - RNA, 13 nt, Coxiella burnetii RSA 493
ucaagaugcccag

SEQ ID NO: 2579880 - RNA, 21 nt, Coxiella burnetii RSA 493
ucaagcccgcagcgcccacuu

SEQ ID NO: 2579881 - RNA, 18 nt, Coxiella burnetii RSA 493
ucaagcgaacgcggccuu

SEQ ID NO: 2579882 - RNA, 23 nt, Coxiella burnetii RSA 493
ucaagggcaaaaacauuauugau

SEQ ID NO: 2579883 - RNA, 16 nt, Coxiella burnetii RSA 493
ucaaguguauuuucac

SEQ ID NO: 2579884 - RNA, 20 nt, Coxiella burnetii RSA 493
ucaaguguucacaagucuca

SEQ ID NO: 2579885 - RNA, 12 nt, Coxiella burnetii RSA 493
ucaauaaacccg

SEQ ID NO: 2579886 - RNA, 18 nt, Coxiella burnetii RSA 493
ucaauaagccguucaccc

SEQ ID NO: 2579887 - RNA, 21 nt, Coxiella burnetii RSA 493
ucaauaaucucacacaacucc

SEQ ID NO: 2579888 - RNA, 16 nt, Coxiella burnetii RSA 493
ucaauaaugccagauu

SEQ ID NO: 2579889 - RNA, 16 nt, Coxiella burnetii RSA 493
aucauauaauuuuuga

SEQ ID NO: 2579890 - RNA, 14 nt, Coxiella burnetii RSA 493
aucaucaaaauuaa

SEQ ID NO: 2579891 - RNA, 21 nt, Coxiella burnetii RSA 493
aucaucaaaggccgcgcagaa

SEQ ID NO: 2579892 - RNA, 15 nt, Coxiella burnetii RSA 493
aucauccgcagaaca

SEQ ID NO: 2579893 - RNA, 16 nt, Coxiella burnetii RSA 493
aucaucgcacuugcuu

SEQ ID NO: 2579894 - RNA, 23 nt, Coxiella burnetii RSA 493
aucaucugagauaucaauagcgc

SEQ ID NO: 2579895 - RNA, 13 nt, Coxiella burnetii RSA 493
aucaucuuuuuug

SEQ ID NO: 2579896 - RNA, 15 nt, Coxiella burnetii RSA 493
aucaugccuuuuuug

SEQ ID NO: 2579897 - RNA, 20 nt, Coxiella burnetii RSA 493
aucauugggccauuuaacaa

SEQ ID NO: 2579898 - RNA, 21 nt, Coxiella burnetii RSA 493
aucauugggccauuuaacaaa

SEQ ID NO: 2579899 - RNA, 23 nt, Coxiella burnetii RSA 493
aucauugggccauuuaacaaaaa

SEQ ID NO: 2579900 - RNA, 22 nt, Coxiella burnetii RSA 493
aucauuucgagcgcgauuuucu

SEQ ID NO: 2579901 - RNA, 13 nt, Coxiella burnetii RSA 493
aucauuuucucag

SEQ ID NO: 2579902 - RNA, 21 nt, Coxiella burnetii RSA 493
aucauuuugauacgcuaacca

SEQ ID NO: 2579903 - RNA, 17 nt, Coxiella burnetii RSA 493
aucauuuugauuuuuua

SEQ ID NO: 2579904 - RNA, 19 nt, Coxiella burnetii RSA 493
aucauuuugauuuuuuaau

SEQ ID NO: 2579905 - RNA, 23 nt, Coxiella burnetii RSA 493
aucauuuuugugcguaucuuuca

SEQ ID NO: 2579906 - RNA, 12 nt, Coxiella burnetii RSA 493
auccaaaaucca

SEQ ID NO: 2579907 - RNA, 12 nt, Coxiella burnetii RSA 493
auccaaauagau

SEQ ID NO: 2579908 - RNA, 17 nt, Coxiella burnetii RSA 493
auccaacgguucucaaa

SEQ ID NO: 2579909 - RNA, 13 nt, Coxiella burnetii RSA 493
auccaagucuucc

SEQ ID NO: 2579910 - RNA, 20 nt, Coxiella burnetii RSA 493
auccaagugugggaaaaaua

SEQ ID NO: 2579911 - RNA, 16 nt, Coxiella burnetii RSA 493
auccacaaaggcucga

SEQ ID NO: 2579912 - RNA, 16 nt, Coxiella burnetii RSA 493
auccaggcugcuagaa

SEQ ID NO: 2579913 - RNA, 23 nt, Coxiella burnetii RSA 493
auccaggcugcuagaaguauuuc

SEQ ID NO: 2579914 - RNA, 23 nt, Coxiella burnetii RSA 493
auccaggguugauugauuuuguc

SEQ ID NO: 2579915 - RNA, 22 nt, Coxiella burnetii RSA 493
auccauccggaugucauaauca

SEQ ID NO: 2579916 - RNA, 18 nt, Coxiella burnetii RSA 493
auccaugccauaaugccu

SEQ ID NO: 2579917 - RNA, 16 nt, Coxiella burnetii RSA 493
auccauucuuucauua

SEQ ID NO: 2579918 - RNA, 15 nt, Coxiella burnetii RSA 493
aucccaauaguaaaa

SEQ ID NO: 2579919 - RNA, 14 nt, Coxiella burnetii RSA 493
aucccacguuguuu

SEQ ID NO: 2579920 - RNA, 17 nt, Coxiella burnetii RSA 493
aucccacguuguuugau

SEQ ID NO: 2579921 - RNA, 22 nt, Coxiella burnetii RSA 493
auccccaaaggugucaaaauua

SEQ ID NO: 2579922 - RNA, 19 nt, Coxiella burnetii RSA 493
auccccgaaggcgccuaau

SEQ ID NO: 2579923 - RNA, 20 nt, Coxiella burnetii RSA 493
aucccgaaacggaugagcaa

SEQ ID NO: 2579924 - RNA, 22 nt, Coxiella burnetii RSA 493
aucccgccagcgaugaaaaagu

SEQ ID NO: 2579925 - RNA, 16 nt, Coxiella burnetii RSA 493
aucccguuaaauuaaa

SEQ ID NO: 2579926 - RNA, 18 nt, Coxiella burnetii RSA 493
aucccucggccaaagaaa

SEQ ID NO: 2579927 - RNA, 13 nt, Coxiella burnetii RSA 493
aucccuuuaaccg

SEQ ID NO: 2579928 - RNA, 20 nt, Coxiella burnetii RSA 493
auccgagcccaauaacaagc

SEQ ID NO: 2579929 - RNA, 18 nt, Coxiella burnetii RSA 493
auccgaugagaaaggagu

SEQ ID NO: 2579930 - RNA, 14 nt, Coxiella burnetii RSA 493
auccgccccgaaau

SEQ ID NO: 2579931 - RNA, 20 nt, Coxiella burnetii RSA 493
auccgcgucauaccggcgac

SEQ ID NO: 2579932 - RNA, 15 nt, Coxiella burnetii RSA 493
auccggcaucacgau

SEQ ID NO: 2579933 - RNA, 22 nt, Coxiella burnetii RSA 493
auccgucgucguugacaaaccg

SEQ ID NO: 2579934 - RNA, 17 nt, Coxiella burnetii RSA 493
auccguuuugaaaaaua

SEQ ID NO: 2579935 - RNA, 14 nt, Coxiella burnetii RSA 493
auccuauucuuuua

SEQ ID NO: 2579936 - RNA, 16 nt, Coxiella burnetii RSA 493
auccuauucuuuuauu

SEQ ID NO: 2579937 - RNA, 17 nt, Coxiella burnetii RSA 493
auccucagaaguuuuag

SEQ ID NO: 2579938 - RNA, 12 nt, Coxiella burnetii RSA 493
auccucaucaaa

SEQ ID NO: 2579939 - RNA, 22 nt, Coxiella burnetii RSA 493
auccucaucaaacuugccuuga

SEQ ID NO: 2579940 - RNA, 17 nt, Coxiella burnetii RSA 493
auccuccccacucucuu

SEQ ID NO: 2579941 - RNA, 16 nt, Coxiella burnetii RSA 493
auccuggccugaucau

SEQ ID NO: 2579942 - RNA, 12 nt, Coxiella burnetii RSA 493
auccuucuuuua

SEQ ID NO: 2579943 - RNA, 12 nt, Coxiella burnetii RSA 493
auccuucuuuug

SEQ ID NO: 2579944 - RNA, 12 nt, Coxiella burnetii RSA 493
auccuugaggaa

SEQ ID NO: 2579945 - RNA, 21 nt, Coxiella burnetii RSA 493
auccuuuaauucgcgcugcaa

SEQ ID NO: 2579946 - RNA, 21 nt, Coxiella burnetii RSA 493
auccuuuuuguaauccuuguu

SEQ ID NO: 2579947 - RNA, 16 nt, Coxiella burnetii RSA 493
aucgaccgagaauuaa

SEQ ID NO: 2579948 - RNA, 14 nt, Coxiella burnetii RSA 493
aucgauaaaaauaa

SEQ ID NO: 2579949 - RNA, 20 nt, Coxiella burnetii RSA 493
aucgauaaaaauaaugaucc

SEQ ID NO: 2579950 - RNA, 17 nt, Coxiella burnetii RSA 493
aucgauaagaucaauua

SEQ ID NO: 2579951 - RNA, 22 nt, Coxiella burnetii RSA 493
aucgauccgagcccaauaacaa

SEQ ID NO: 2579952 - RNA, 13 nt, Coxiella burnetii RSA 493
aucgcaaaauuca

SEQ ID NO: 2579953 - RNA, 22 nt, Coxiella burnetii RSA 493
aucgcaauuaauacauucuuca

SEQ ID NO: 2579954 - RNA, 14 nt, Coxiella burnetii RSA 493
aucgcacuugcuuc

SEQ ID NO: 2579955 - RNA, 16 nt, Coxiella burnetii RSA 493
aucgcagcauuuuucg

SEQ ID NO: 2579956 - RNA, 18 nt, Coxiella burnetii RSA 493
aucgcauacagcggaaca

SEQ ID NO: 2579957 - RNA, 22 nt, Coxiella burnetii RSA 493
aucgcauacagcggaacaccau

SEQ ID NO: 2579958 - RNA, 20 nt, Coxiella burnetii RSA 493
aucgccaaaagguauguugu

SEQ ID NO: 2579959 - RNA, 22 nt, Coxiella burnetii RSA 493
aucgccaaaagguauguuguca

SEQ ID NO: 2579960 - RNA, 16 nt, Coxiella burnetii RSA 493
aucgccguuucugcuu

SEQ ID NO: 2579961 - RNA, 20 nt, Coxiella burnetii RSA 493
aucgccguuucugcuuuuau

SEQ ID NO: 2579962 - RNA, 16 nt, Coxiella burnetii RSA 493
aucgccuaucuuuccc

SEQ ID NO: 2579963 - RNA, 17 nt, Coxiella burnetii RSA 493
aucgccugacagcccgg

SEQ ID NO: 2579964 - RNA, 15 nt, Coxiella burnetii RSA 493
aucgcgcgccauuga

SEQ ID NO: 2579965 - RNA, 16 nt, Coxiella burnetii RSA 493
aucgcggacaauaaga

SEQ ID NO: 2579966 - RNA, 13 nt, Coxiella burnetii RSA 493
aucgcuccuaaau

SEQ ID NO: 2579967 - RNA, 21 nt, Coxiella burnetii RSA 493
aucgcugccggcguuucgguu

SEQ ID NO: 2579968 - RNA, 14 nt, Coxiella burnetii RSA 493
aucgcugugaaaau

SEQ ID NO: 2579969 - RNA, 15 nt, Coxiella burnetii RSA 493
aucgcugugaaaaug

SEQ ID NO: 2579970 - RNA, 18 nt, Coxiella burnetii RSA 493
aucggauaaugcuugcuc

SEQ ID NO: 2579971 - RNA, 20 nt, Coxiella burnetii RSA 493
aucggaucaauuuugguugu

SEQ ID NO: 2579972 - RNA, 17 nt, Coxiella burnetii RSA 493
aucggaugaugcauuaa

SEQ ID NO: 2579973 - RNA, 23 nt, Coxiella burnetii RSA 493
aucggccuuuuucauuuccgcuu

SEQ ID NO: 2579974 - RNA, 15 nt, Coxiella burnetii RSA 493
aucggcuucacagag

SEQ ID NO: 2579975 - RNA, 13 nt, Coxiella burnetii RSA 493
aucgguugaagaa

SEQ ID NO: 2579976 - RNA, 18 nt, Coxiella burnetii RSA 493
aucgguugaagaaauacg

SEQ ID NO: 2579977 - RNA, 16 nt, Coxiella burnetii RSA 493
aucguaaagaucauca

SEQ ID NO: 2579978 - RNA, 14 nt, Coxiella burnetii RSA 493
aucgucaaauggag

SEQ ID NO: 2579979 - RNA, 17 nt, Coxiella burnetii RSA 493
aucgucccaucaucuga

SEQ ID NO: 2579980 - RNA, 19 nt, Coxiella burnetii RSA 493
aucguccccguauuucgcu

SEQ ID NO: 2579981 - RNA, 21 nt, Coxiella burnetii RSA 493
aucguccuauccccaaaggug

SEQ ID NO: 2579982 - RNA, 23 nt, Coxiella burnetii RSA 493
aucgucuaaaagcgcaauuucca

SEQ ID NO: 2579983 - RNA, 16 nt, Coxiella burnetii RSA 493
aucgucuugaccaaua

SEQ ID NO: 2579984 - RNA, 13 nt, Coxiella burnetii RSA 493
aucguuaaaucgg

SEQ ID NO: 2579985 - RNA, 13 nt, Coxiella burnetii RSA 493
aucguucggcuuc

SEQ ID NO: 2579986 - RNA, 19 nt, Coxiella burnetii RSA 493
aucguucggcuucauauaa

SEQ ID NO: 2579987 - RNA, 18 nt, Coxiella burnetii RSA 493
aucguugccuuuuugaau

SEQ ID NO: 2579988 - RNA, 18 nt, Coxiella burnetii RSA 493
augcagcgaagcgaaaua

SEQ ID NO: 2579989 - RNA, 20 nt, Coxiella burnetii RSA 493
augcagcgaagcgaaauacg

SEQ ID NO: 2579990 - RNA, 22 nt, Coxiella burnetii RSA 493
augcagcgaagcgaaauacggg

SEQ ID NO: 2579991 - RNA, 20 nt, Coxiella burnetii RSA 493
augcagcgaagcggaauacg

SEQ ID NO: 2579992 - RNA, 21 nt, Coxiella burnetii RSA 493
augcagcgaagcggaauacgg

SEQ ID NO: 2579993 - RNA, 15 nt, Coxiella burnetii RSA 493
augccaaaauuagaa

SEQ ID NO: 2579994 - RNA, 22 nt, Coxiella burnetii RSA 493
augccaacccaaggaaccacca

SEQ ID NO: 2579995 - RNA, 13 nt, Coxiella burnetii RSA 493
augccauaaugcc

SEQ ID NO: 2579996 - RNA, 14 nt, Coxiella burnetii RSA 493
augcccgaaaagga

SEQ ID NO: 2579997 - RNA, 17 nt, Coxiella burnetii RSA 493
augccgcuugaaaaauu

SEQ ID NO: 2579998 - RNA, 19 nt, Coxiella burnetii RSA 493
augccgcuugaaaaauuga

SEQ ID NO: 2579999 - RNA, 17 nt, Coxiella burnetii RSA 493
augccuccuugcaagcu

SEQ ID NO: 2580000 - RNA, 21 nt, Coxiella burnetii RSA 493
augcgaaauagaauuuuugac

SEQ ID NO: 2580001 - RNA, 20 nt, Coxiella burnetii RSA 493
augcgacuuuuugcaaugcc

SEQ ID NO: 2580002 - RNA, 14 nt, Coxiella burnetii RSA 493
augcgccuacaaau

SEQ ID NO: 2580003 - RNA, 20 nt, Coxiella burnetii RSA 493
augcgguacuuaagaaagua

SEQ ID NO: 2580004 - RNA, 17 nt, Coxiella burnetii RSA 493
augcguuuuaaaugcuu

SEQ ID NO: 2580005 - RNA, 13 nt, Coxiella burnetii RSA 493
augcuaaaugcgu

SEQ ID NO: 2580006 - RNA, 22 nt, Coxiella burnetii RSA 493
augcucuuuauagaguucggua

SEQ ID NO: 2580007 - RNA, 13 nt, Coxiella burnetii RSA 493
augcugauuuuca

SEQ ID NO: 2580008 - RNA, 22 nt, Coxiella burnetii RSA 493
augcugcgaccuucuuuuuuau

SEQ ID NO: 2580009 - RNA, 19 nt, Coxiella burnetii RSA 493
augcuucuaauuugaaaaa

SEQ ID NO: 2580010 - RNA, 17 nt, Coxiella burnetii RSA 493
augcuucuuugauaaaa

SEQ ID NO: 2580011 - RNA, 12 nt, Coxiella burnetii RSA 493
augcuugcucuu

SEQ ID NO: 2580012 - RNA, 16 nt, Coxiella burnetii RSA 493
augcuugcucuucuuc

SEQ ID NO: 2580013 - RNA, 15 nt, Coxiella burnetii RSA 493
augcuuucuuuuaau

SEQ ID NO: 2580014 - RNA, 22 nt, Coxiella burnetii RSA 493
augcuuucuuuuaauucauaaa

SEQ ID NO: 2580015 - RNA, 12 nt, Coxiella burnetii RSA 493
augcuuuuaaag

SEQ ID NO: 2580016 - RNA, 14 nt, Coxiella burnetii RSA 493
augcuuuucuuuca

SEQ ID NO: 2580017 - RNA, 16 nt, Coxiella burnetii RSA 493
augcuuuuuuauaagg

SEQ ID NO: 2580018 - RNA, 20 nt, Coxiella burnetii RSA 493
auggaaguucuauccaauaa

SEQ ID NO: 2580019 - RNA, 20 nt, Coxiella burnetii RSA 493
auggacacuuaacuaggacu

SEQ ID NO: 2580020 - RNA, 22 nt, Coxiella burnetii RSA 493
auggacuacacgguuaguggga

SEQ ID NO: 2580021 - RNA, 14 nt, Coxiella burnetii RSA 493
auggauauuuuaag

SEQ ID NO: 2580022 - RNA, 17 nt, Coxiella burnetii RSA 493
auggaugcgacuuuuug

SEQ ID NO: 2580023 - RNA, 20 nt, Coxiella burnetii RSA 493
auggauucccauaaccguuu

SEQ ID NO: 2580024 - RNA, 15 nt, Coxiella burnetii RSA 493
auggcaucauuuccc

SEQ ID NO: 2580025 - RNA, 12 nt, Coxiella burnetii RSA 493
auggcauucuug

SEQ ID NO: 2580026 - RNA, 18 nt, Coxiella burnetii RSA 493
auggccggcagcguaaua

SEQ ID NO: 2580027 - RNA, 20 nt, Coxiella burnetii RSA 493
auggccuuugcgguuaaaaa

SEQ ID NO: 2580028 - RNA, 14 nt, Coxiella burnetii RSA 493
auggcgccugacaa

SEQ ID NO: 2580029 - RNA, 14 nt, Coxiella burnetii RSA 493
auggcuaacucacu

SEQ ID NO: 2580030 - RNA, 21 nt, Coxiella burnetii RSA 493
auggcuaacucacuuuuuuca

SEQ ID NO: 2580031 - RNA, 16 nt, Coxiella burnetii RSA 493
auggcuccagccgaag

SEQ ID NO: 2580032 - RNA, 22 nt, Coxiella burnetii RSA 493
auggcuuguuccgccauuuccc

SEQ ID NO: 2580033 - RNA, 23 nt, Coxiella burnetii RSA 493
augggaagauuuauaacaagguu

SEQ ID NO: 2580034 - RNA, 18 nt, Coxiella burnetii RSA 493
augggaauuuuugaauac

SEQ ID NO: 2580035 - RNA, 15 nt, Coxiella burnetii RSA 493
auggggccgcccaac

SEQ ID NO: 2580036 - RNA, 21 nt, Coxiella burnetii RSA 493
auggggcguuagcggaauacg

SEQ ID NO: 2580037 - RNA, 17 nt, Coxiella burnetii RSA 493
augguccggcgaacagc

SEQ ID NO: 2580038 - RNA, 19 nt, Coxiella burnetii RSA 493
auggucuguuucuucuuug

SEQ ID NO: 2580039 - RNA, 20 nt, Coxiella burnetii RSA 493
augguggucggcaccaaaau

SEQ ID NO: 2580040 - RNA, 21 nt, Coxiella burnetii RSA 493
augguuccagaaacauaacug

SEQ ID NO: 2580041 - RNA, 20 nt, Coxiella burnetii RSA 493
augguugaaagaaaaaaaac

SEQ ID NO: 2580042 - RNA, 12 nt, Coxiella burnetii RSA 493
augguugauuuu

SEQ ID NO: 2580043 - RNA, 17 nt, Coxiella burnetii RSA 493
augguugauuuuuuaau

SEQ ID NO: 2580044 - RNA, 16 nt, Coxiella burnetii RSA 493
auguaaggcaucuuuu

SEQ ID NO: 2580045 - RNA, 22 nt, Coxiella burnetii RSA 493
auguaaggcaucuuuuucuccu

SEQ ID NO: 2580046 - RNA, 16 nt, Coxiella burnetii RSA 493
auguaaucaauugcua

SEQ ID NO: 2580047 - RNA, 17 nt, Coxiella burnetii RSA 493
auguagcccaacaaaau

SEQ ID NO: 2580048 - RNA, 21 nt, Coxiella burnetii RSA 493
auguagcccaacaaaaugguu

SEQ ID NO: 2580049 - RNA, 15 nt, Coxiella burnetii RSA 493
auguaggugaaaacg

SEQ ID NO: 2580050 - RNA, 21 nt, Coxiella burnetii RSA 493
auguaugggucgcauucuauu

SEQ ID NO: 2580051 - RNA, 21 nt, Coxiella burnetii RSA 493
auguauuuuuuggaaugagca

SEQ ID NO: 2580052 - RNA, 22 nt, Coxiella burnetii RSA 493
augucaauaacccacagccgcu

SEQ ID NO: 2580053 - RNA, 17 nt, Coxiella burnetii RSA 493
augucagcuuccgacaa

SEQ ID NO: 2580054 - RNA, 22 nt, Coxiella burnetii RSA 493
augucagguucggauuucacuu

SEQ ID NO: 2580055 - RNA, 12 nt, Coxiella burnetii RSA 493
augucauaauca

SEQ ID NO: 2580056 - RNA, 19 nt, Coxiella burnetii RSA 493
augucauaaucacaaaagg

SEQ ID NO: 2580057 - RNA, 23 nt, Coxiella burnetii RSA 493
augucauaaucacaaaagguaaa

SEQ ID NO: 2580058 - RNA, 18 nt, Coxiella burnetii RSA 493
auguccauccgcuaacgu

SEQ ID NO: 2580059 - RNA, 20 nt, Coxiella burnetii RSA 493
augucguuaccgaugaguug

SEQ ID NO: 2580060 - RNA, 14 nt, Coxiella burnetii RSA 493
augucucaaggcuc

SEQ ID NO: 2580061 - RNA, 17 nt, Coxiella burnetii RSA 493
auguuaauuauaaagaa

SEQ ID NO: 2580062 - RNA, 21 nt, Coxiella burnetii RSA 493
auguuaggaaggacaaaaaua

SEQ ID NO: 2580063 - RNA, 22 nt, Coxiella burnetii RSA 493
auguuaggaaggacaaaaauau

SEQ ID NO: 2580064 - RNA, 17 nt, Coxiella burnetii RSA 493
auguuauuuauuuuucu

SEQ ID NO: 2580065 - RNA, 21 nt, Coxiella burnetii RSA 493
auguuauuuuccucccauuga

SEQ ID NO: 2580066 - RNA, 17 nt, Coxiella burnetii RSA 493
auguucugauuggagua

SEQ ID NO: 2580067 - RNA, 15 nt, Coxiella burnetii RSA 493
auguucuugaucuaa

SEQ ID NO: 2580068 - RNA, 19 nt, Coxiella burnetii RSA 493
auguugggcgaaaagcauu

SEQ ID NO: 2580069 - RNA, 21 nt, Coxiella burnetii RSA 493
auguuuagucggaaauuucuc

SEQ ID NO: 2580070 - RNA, 17 nt, Coxiella burnetii RSA 493
auguuucaauaacagag

SEQ ID NO: 2580071 - RNA, 15 nt, Coxiella burnetii RSA 493
auguuuccaaauaau

SEQ ID NO: 2580072 - RNA, 15 nt, Coxiella burnetii RSA 493
auguuugaauauuuu

SEQ ID NO: 2580073 - RNA, 12 nt, Coxiella burnetii RSA 493
auguuuuuuaau

SEQ ID NO: 2580074 - RNA, 16 nt, Coxiella burnetii RSA 493
auguuuuuuaauaaau

SEQ ID NO: 2580075 - RNA, 16 nt, Coxiella burnetii RSA 493
auguuuuuuaaucgag

SEQ ID NO: 2580076 - RNA, 17 nt, Coxiella burnetii RSA 493
auuaaaaaauaagaaag

SEQ ID NO: 2580077 - RNA, 16 nt, Coxiella burnetii RSA 493
auuaaaaauaaaaccu

SEQ ID NO: 2580078 - RNA, 13 nt, Coxiella burnetii RSA 493
auuaaaaauuuga

SEQ ID NO: 2580079 - RNA, 18 nt, Coxiella burnetii RSA 493
auuaaaaauuugauuaau

SEQ ID NO: 2580080 - RNA, 20 nt, Coxiella burnetii RSA 493
auuaaaacaagacaacaaaa

SEQ ID NO: 2580081 - RNA, 19 nt, Coxiella burnetii RSA 493
auuaaaagagcgaauaaaa

SEQ ID NO: 2580082 - RNA, 13 nt, Coxiella burnetii RSA 493
auuaaaagcagcu

SEQ ID NO: 2580083 - RNA, 21 nt, Coxiella burnetii RSA 493
auuaaacgcgauaucuccauu

SEQ ID NO: 2580084 - RNA, 23 nt, Coxiella burnetii RSA 493
auuaaacgcgauaucuccauuuu

SEQ ID NO: 2580085 - RNA, 19 nt, Coxiella burnetii RSA 493
auuaaacguauuccaaaua

SEQ ID NO: 2580086 - RNA, 17 nt, Coxiella burnetii RSA 493
auuaaauauuucuucca

SEQ ID NO: 2580087 - RNA, 23 nt, Coxiella burnetii RSA 493
auuaaauccagaccuguuaaaaa

SEQ ID NO: 2580088 - RNA, 17 nt, Coxiella burnetii RSA 493
auuaaauccucuuuaga

SEQ ID NO: 2580089 - RNA, 19 nt, Coxiella burnetii RSA 493
auuaaaugcuuuuuaaaua

SEQ ID NO: 2580090 - RNA, 23 nt, Coxiella burnetii RSA 493
auuaaauuacuuggggguuuuga

SEQ ID NO: 2580091 - RNA, 18 nt, Coxiella burnetii RSA 493
auuaaauuuaaucuuuau

SEQ ID NO: 2580092 - RNA, 21 nt, Coxiella burnetii RSA 493
auuaaauuuaaucuuuaucca

SEQ ID NO: 2580093 - RNA, 20 nt, Coxiella burnetii RSA 493
auucuauaaucauuuuuccu

SEQ ID NO: 2580094 - RNA, 15 nt, Coxiella burnetii RSA 493
auucuaucucaagug

SEQ ID NO: 2580095 - RNA, 22 nt, Coxiella burnetii RSA 493
auucuauuagcugccauuuuca

SEQ ID NO: 2580096 - RNA, 17 nt, Coxiella burnetii RSA 493
auucucccaaacaauca

SEQ ID NO: 2580097 - RNA, 16 nt, Coxiella burnetii RSA 493
auucucccuuuuccug

SEQ ID NO: 2580098 - RNA, 18 nt, Coxiella burnetii RSA 493
auucucgccuacuuuugu

SEQ ID NO: 2580099 - RNA, 19 nt, Coxiella burnetii RSA 493
auucucucgcucaauggcg

SEQ ID NO: 2580100 - RNA, 21 nt, Coxiella burnetii RSA 493
auucucugcgaggaccucucc

SEQ ID NO: 2580101 - RNA, 22 nt, Coxiella burnetii RSA 493
auucuguaacuuuuccaucucc

SEQ ID NO: 2580102 - RNA, 16 nt, Coxiella burnetii RSA 493
auucuuaauuuuuccu

SEQ ID NO: 2580103 - RNA, 12 nt, Coxiella burnetii RSA 493
auucuuauccuu

SEQ ID NO: 2580104 - RNA, 14 nt, Coxiella burnetii RSA 493
auucuucaauacua

SEQ ID NO: 2580105 - RNA, 11 nt, Coxiella burnetii RSA 493
auucuucauac

SEQ ID NO: 2580106 - RNA, 15 nt, Coxiella burnetii RSA 493
auucuucuaaugagu

SEQ ID NO: 2580107 - RNA, 13 nt, Coxiella burnetii RSA 493
auucuucugccuu

SEQ ID NO: 2580108 - RNA, 15 nt, Coxiella burnetii RSA 493
auucuucuuuugcca

SEQ ID NO: 2580109 - RNA, 17 nt, Coxiella burnetii RSA 493
auucuugcagugaaaua

SEQ ID NO: 2580110 - RNA, 19 nt, Coxiella burnetii RSA 493
auucuuucauuaucuagau

SEQ ID NO: 2580111 - RNA, 14 nt, Coxiella burnetii RSA 493
auucuuuuggcauu

SEQ ID NO: 2580112 - RNA, 13 nt, Coxiella burnetii RSA 493
auucuuuuucuuu

SEQ ID NO: 2580113 - RNA, 17 nt, Coxiella burnetii RSA 493
auugaaaccgacaauuu

SEQ ID NO: 2580114 - RNA, 16 nt, Coxiella burnetii RSA 493
auugaaagaauuucuc

SEQ ID NO: 2580115 - RNA, 19 nt, Coxiella burnetii RSA 493
auugaauuauacuuuuuug

SEQ ID NO: 2580116 - RNA, 14 nt, Coxiella burnetii RSA 493
auugaauuugcuug

SEQ ID NO: 2580117 - RNA, 11 nt, Coxiella burnetii RSA 493
auugacaaaua

SEQ ID NO: 2580118 - RNA, 14 nt, Coxiella burnetii RSA 493
auugacaaauaaag

SEQ ID NO: 2580119 - RNA, 13 nt, Coxiella burnetii RSA 493
auugacccuuuuc

SEQ ID NO: 2580120 - RNA, 17 nt, Coxiella burnetii RSA 493
auugacccuuuucaauu

SEQ ID NO: 2580121 - RNA, 17 nt, Coxiella burnetii RSA 493
auugacuucuuugugag

SEQ ID NO: 2580122 - RNA, 20 nt, Coxiella burnetii RSA 493
auugagaaucucuucgaguu

SEQ ID NO: 2580123 - RNA, 16 nt, Coxiella burnetii RSA 493
auugagcggcuuuuuc

SEQ ID NO: 2580124 - RNA, 20 nt, Coxiella burnetii RSA 493
auugaggucguuaaaaaauu

SEQ ID NO: 2580125 - RNA, 23 nt, Coxiella burnetii RSA 493
auugaguaaugguuuugaucaca

SEQ ID NO: 2580126 - RNA, 18 nt, Coxiella burnetii RSA 493
auugaguauccaacucuc

SEQ ID NO: 2580127 - RNA, 19 nt, Coxiella burnetii RSA 493
auugaguauccaacucucu

SEQ ID NO: 2580128 - RNA, 14 nt, Coxiella burnetii RSA 493
auugaguuuuugac

SEQ ID NO: 2580129 - RNA, 17 nt, Coxiella burnetii RSA 493
auugauaaaccguuucu

SEQ ID NO: 2580130 - RNA, 13 nt, Coxiella burnetii RSA 493
auugauaauaauu

SEQ ID NO: 2580131 - RNA, 16 nt, Coxiella burnetii RSA 493
auugauaguucauaug

SEQ ID NO: 2580132 - RNA, 17 nt, Coxiella burnetii RSA 493
auugauccggcuuuuga

SEQ ID NO: 2580133 - RNA, 19 nt, Coxiella burnetii RSA 493
auugaucgcccauauucaa

SEQ ID NO: 2580134 - RNA, 18 nt, Coxiella burnetii RSA 493
auugaucuucuugugcua

SEQ ID NO: 2580135 - RNA, 16 nt, Coxiella burnetii RSA 493
auugaugcguuuuuuu

SEQ ID NO: 2580136 - RNA, 23 nt, Coxiella burnetii RSA 493
auugaugucacaauuaucuuaau

SEQ ID NO: 2580137 - RNA, 17 nt, Coxiella burnetii RSA 493
auugauguguuuucucg

SEQ ID NO: 2580138 - RNA, 20 nt, Coxiella burnetii RSA 493
auugauuuuguccuguucuu

SEQ ID NO: 2580139 - RNA, 18 nt, Coxiella burnetii RSA 493
auugauuuuuuaaugaaa

SEQ ID NO: 2580140 - RNA, 19 nt, Coxiella burnetii RSA 493
auugauuuuuuaaugaaaa

SEQ ID NO: 2580141 - RNA, 13 nt, Coxiella burnetii RSA 493
auugccaaaauuu

SEQ ID NO: 2580142 - RNA, 18 nt, Coxiella burnetii RSA 493
auugccaaaguucauuaa

SEQ ID NO: 2580143 - RNA, 17 nt, Coxiella burnetii RSA 493
auugccaauugucuuug

SEQ ID NO: 2580144 - RNA, 13 nt, Coxiella burnetii RSA 493
auugccacucuuu

SEQ ID NO: 2580145 - RNA, 19 nt, Coxiella burnetii RSA 493
auugccacucuuuauuaua

SEQ ID NO: 2580146 - RNA, 18 nt, Coxiella burnetii RSA 493
auugcccucguuuuaucg

SEQ ID NO: 2580147 - RNA, 14 nt, Coxiella burnetii RSA 493
auugcgcguaaauu

SEQ ID NO: 2580148 - RNA, 19 nt, Coxiella burnetii RSA 493
auugcgcguaaauuucguu

SEQ ID NO: 2580149 - RNA, 23 nt, Coxiella burnetii RSA 493
auugcucugaccuaauuugauuu

SEQ ID NO: 2580150 - RNA, 14 nt, Coxiella burnetii RSA 493
auugcugaacaaaa

SEQ ID NO: 2580151 - RNA, 17 nt, Coxiella burnetii RSA 493
auuggcaguaucuauuc

SEQ ID NO: 2580152 - RNA, 20 nt, Coxiella burnetii RSA 493
auuggcgagauugauacugc

SEQ ID NO: 2580153 - RNA, 16 nt, Coxiella burnetii RSA 493
auugggauaauaacua

SEQ ID NO: 2580154 - RNA, 20 nt, Coxiella burnetii RSA 493
auugggggucuuuuuuucuu

SEQ ID NO: 2580155 - RNA, 17 nt, Coxiella burnetii RSA 493
auugguuuaaaaaguuc

SEQ ID NO: 2580156 - RNA, 14 nt, Coxiella burnetii RSA 493
auuguaauugcuug

SEQ ID NO: 2580157 - RNA, 13 nt, Coxiella burnetii RSA 493
auuguccuuuucu

SEQ ID NO: 2580158 - RNA, 16 nt, Coxiella burnetii RSA 493
auuguccuuuucuauu

SEQ ID NO: 2580159 - RNA, 20 nt, Coxiella burnetii RSA 493
auugucucacaacauuccuu

SEQ ID NO: 2580160 - RNA, 19 nt, Coxiella burnetii RSA 493
auuguggcgaagccacaca

SEQ ID NO: 2580161 - RNA, 12 nt, Coxiella burnetii RSA 493
auuguguuuuaa

SEQ ID NO: 2580162 - RNA, 16 nt, Coxiella burnetii RSA 493
auuguguuuuaauucc

SEQ ID NO: 2580163 - RNA, 12 nt, Coxiella burnetii RSA 493
auuguugauuua

SEQ ID NO: 2580164 - RNA, 18 nt, Coxiella burnetii RSA 493
auuguuucgaacucgguu

SEQ ID NO: 2580165 - RNA, 17 nt, Coxiella burnetii RSA 493
auuguuugaaaaaauac

SEQ ID NO: 2580166 - RNA, 13 nt, Coxiella burnetii RSA 493
auuguuuucgaua

SEQ ID NO: 2580167 - RNA, 16 nt, Coxiella burnetii RSA 493
auuuaaacaaacugcu

SEQ ID NO: 2580168 - RNA, 18 nt, Coxiella burnetii RSA 493
auuuaacacuuuaauauc

SEQ ID NO: 2580169 - RNA, 17 nt, Coxiella burnetii RSA 493
auuuaagugauaauuau

SEQ ID NO: 2580170 - RNA, 16 nt, Coxiella burnetii RSA 493
auuuaauaaaauuaaa

SEQ ID NO: 2580171 - RNA, 15 nt, Coxiella burnetii RSA 493
auuuaauaaaucaau

SEQ ID NO: 2580172 - RNA, 21 nt, Coxiella burnetii RSA 493
auuuaauaaaucaauuaaauu

SEQ ID NO: 2580173 - RNA, 19 nt, Coxiella burnetii RSA 493
auuuaauugggaagcaauu

SEQ ID NO: 2580174 - RNA, 20 nt, Coxiella burnetii RSA 493
auuuaauugggaagcaauuu

SEQ ID NO: 2580175 - RNA, 20 nt, Coxiella burnetii RSA 493
auuuaccuccaaaacccauc

SEQ ID NO: 2580176 - RNA, 15 nt, Coxiella burnetii RSA 493
auuuagaaaaaauac

SEQ ID NO: 2580177 - RNA, 21 nt, Coxiella burnetii RSA 493
auuuaggcucaauuuauccgc

SEQ ID NO: 2580178 - RNA, 20 nt, Coxiella burnetii RSA 493
auuuaggggugaauuuuugc

SEQ ID NO: 2580179 - RNA, 22 nt, Coxiella burnetii RSA 493
auuuauaacaaaccaucgccac

SEQ ID NO: 2580180 - RNA, 20 nt, Coxiella burnetii RSA 493
auuuaucauguggucucuuu

SEQ ID NO: 2580181 - RNA, 17 nt, Coxiella burnetii RSA 493
auuuaucauuuuuccgc

SEQ ID NO: 2580182 - RNA, 14 nt, Coxiella burnetii RSA 493
auuuauuaaaaacu

SEQ ID NO: 2580183 - RNA, 11 nt, Coxiella burnetii RSA 493
auuuauuucug

SEQ ID NO: 2580184 - RNA, 20 nt, Coxiella burnetii RSA 493
auuuauuuuucucuucuuuu

SEQ ID NO: 2580185 - RNA, 19 nt, Coxiella burnetii RSA 493
auuucaauggauucuucuu

SEQ ID NO: 2580186 - RNA, 13 nt, Coxiella burnetii RSA 493
auuucaauuagaa

SEQ ID NO: 2580187 - RNA, 23 nt, Coxiella burnetii RSA 493
auuucacacguaucugcuaaaaa

SEQ ID NO: 2580188 - RNA, 14 nt, Coxiella burnetii RSA 493
auuucaccgaugcg

SEQ ID NO: 2580189 - RNA, 19 nt, Coxiella burnetii RSA 493
auuucaccuucuucuuugg

SEQ ID NO: 2580190 - RNA, 17 nt, Coxiella burnetii RSA 493
auuucacgcgaaaaaag

SEQ ID NO: 2580191 - RNA, 17 nt, Coxiella burnetii RSA 493
auuucacuuuauuuuca

SEQ ID NO: 2580192 - RNA, 23 nt, Coxiella burnetii RSA 493
auuucagggaacugccguucuug

SEQ ID NO: 2580193 - RNA, 18 nt, Coxiella burnetii RSA 493
auuucauucauucgcuuu

SEQ ID NO: 2580194 - RNA, 15 nt, Coxiella burnetii RSA 493
auuucauuuaauaaa

SEQ ID NO: 2580195 - RNA, 16 nt, Coxiella burnetii RSA 493
auuucauuuaauaaau

SEQ ID NO: 2580196 - RNA, 21 nt, Coxiella burnetii RSA 493
auuuccaaacgccaucgauuu

SEQ ID NO: 2580197 - RNA, 14 nt, Coxiella burnetii RSA 493
auuuccaacgcuug

SEQ ID NO: 2580198 - RNA, 23 nt, Coxiella burnetii RSA 493
auuuccaacgcuuguuuuauacc

SEQ ID NO: 2580199 - RNA, 14 nt, Coxiella burnetii RSA 493
caaaaaaagaaaau

SEQ ID NO: 2580200 - RNA, 19 nt, Coxiella burnetii RSA 493
caaaaaauagcgagaaaac

SEQ ID NO: 2580201 - RNA, 16 nt, Coxiella burnetii RSA 493
caaaaacagauuuaaa

SEQ ID NO: 2580202 - RNA, 17 nt, Coxiella burnetii RSA 493
caaaaacagauuuaaau

SEQ ID NO: 2580203 - RNA, 13 nt, Coxiella burnetii RSA 493
caaaaacauuauu

SEQ ID NO: 2580204 - RNA, 20 nt, Coxiella burnetii RSA 493
caaaaacccauaacgaaaau

SEQ ID NO: 2580205 - RNA, 17 nt, Coxiella burnetii RSA 493
caaaaacgacaagcccc

SEQ ID NO: 2580206 - RNA, 15 nt, Coxiella burnetii RSA 493
caaaaacuaaauuuc

SEQ ID NO: 2580207 - RNA, 17 nt, Coxiella burnetii RSA 493
caaaaacuucaugcaaa

SEQ ID NO: 2580208 - RNA, 16 nt, Coxiella burnetii RSA 493
caaaaaguuuauaaaa

SEQ ID NO: 2580209 - RNA, 15 nt, Coxiella burnetii RSA 493
caaaaauaaaacgau

SEQ ID NO: 2580210 - RNA, 23 nt, Coxiella burnetii RSA 493
caaaaauacaagcugacaauagg

SEQ ID NO: 2580211 - RNA, 18 nt, Coxiella burnetii RSA 493
caaaaaucgccauuuugu

SEQ ID NO: 2580212 - RNA, 22 nt, Coxiella burnetii RSA 493
caaaacaaucaaugcaguuaac

SEQ ID NO: 2580213 - RNA, 18 nt, Coxiella burnetii RSA 493
caaaacccauccaucccg

SEQ ID NO: 2580214 - RNA, 13 nt, Coxiella burnetii RSA 493
caaaacgaaaagc

SEQ ID NO: 2580215 - RNA, 19 nt, Coxiella burnetii RSA 493
caaaacgaaaagcugaaau

SEQ ID NO: 2580216 - RNA, 21 nt, Coxiella burnetii RSA 493
caaaacguagaaguuuaaagu

SEQ ID NO: 2580217 - RNA, 18 nt, Coxiella burnetii RSA 493
caaaagauauucgguuuu

SEQ ID NO: 2580218 - RNA, 22 nt, Coxiella burnetii RSA 493
caaaaggaaugaauagaaaaac

SEQ ID NO: 2580219 - RNA, 13 nt, Coxiella burnetii RSA 493
caaaagguaaaaa

SEQ ID NO: 2580220 - RNA, 16 nt, Coxiella burnetii RSA 493
caaaaguaauauuucg

SEQ ID NO: 2580221 - RNA, 19 nt, Coxiella burnetii RSA 493
caaaagugauuuuucuuug

SEQ ID NO: 2580222 - RNA, 12 nt, Coxiella burnetii RSA 493
caaaauaagaaa

SEQ ID NO: 2580223 - RNA, 13 nt, Coxiella burnetii RSA 493
caaaauaauaacc

SEQ ID NO: 2580224 - RNA, 19 nt, Coxiella burnetii RSA 493
caaaauacaguaaauaauc

SEQ ID NO: 2580225 - RNA, 20 nt, Coxiella burnetii RSA 493
caaaauacaguaaauaauca

SEQ ID NO: 2580226 - RNA, 20 nt, Coxiella burnetii RSA 493
caaaauagaauuguaaacag

SEQ ID NO: 2580227 - RNA, 13 nt, Coxiella burnetii RSA 493
caaaauaugauaa

SEQ ID NO: 2580228 - RNA, 12 nt, Coxiella burnetii RSA 493
caaaaucaccag

SEQ ID NO: 2580229 - RNA, 15 nt, Coxiella burnetii RSA 493
caaaaucaccagaaa

SEQ ID NO: 2580230 - RNA, 23 nt, Coxiella burnetii RSA 493
caaaaugagggggagccuguaau

SEQ ID NO: 2580231 - RNA, 17 nt, Coxiella burnetii RSA 493
caaaauuaggagaucuu

SEQ ID NO: 2580232 - RNA, 16 nt, Coxiella burnetii RSA 493
caaacaaaucaauccc

SEQ ID NO: 2580233 - RNA, 17 nt, Coxiella burnetii RSA 493
caaacagcgaaaacaaa

SEQ ID NO: 2580234 - RNA, 19 nt, Coxiella burnetii RSA 493
caaacagugccccuccucu

SEQ ID NO: 2580235 - RNA, 15 nt, Coxiella burnetii RSA 493
caaaccaaucacuaa

SEQ ID NO: 2580236 - RNA, 16 nt, Coxiella burnetii RSA 493
caaaccgcgcugaagu

SEQ ID NO: 2580237 - RNA, 16 nt, Coxiella burnetii RSA 493
caaacgauuaccuuug

SEQ ID NO: 2580238 - RNA, 14 nt, Coxiella burnetii RSA 493
caaacguucaucgu

SEQ ID NO: 2580239 - RNA, 15 nt, Coxiella burnetii RSA 493
caaacuacucucaaa

SEQ ID NO: 2580240 - RNA, 19 nt, Coxiella burnetii RSA 493
caaacuacucucaaaauca

SEQ ID NO: 2580241 - RNA, 18 nt, Coxiella burnetii RSA 493
caaacuguuugcauuuaa

SEQ ID NO: 2580242 - RNA, 19 nt, Coxiella burnetii RSA 493
caaacuguuugcauuuaau

SEQ ID NO: 2580243 - RNA, 15 nt, Coxiella burnetii RSA 493
caaacuucauuaaau

SEQ ID NO: 2580244 - RNA, 13 nt, Coxiella burnetii RSA 493
caaagaaauaauc

SEQ ID NO: 2580245 - RNA, 21 nt, Coxiella burnetii RSA 493
caaagaaggcgaucaguuugu

SEQ ID NO: 2580246 - RNA, 14 nt, Coxiella burnetii RSA 493
caaagaauuuuucc

SEQ ID NO: 2580247 - RNA, 24 nt, Coxiella burnetii RSA 493
caaagacaucggauaaugcuugcu

SEQ ID NO: 2580248 - RNA, 13 nt, Coxiella burnetii RSA 493
caaagaccaaucg

SEQ ID NO: 2580249 - RNA, 21 nt, Coxiella burnetii RSA 493
caaagaccaaucguaaagauc

SEQ ID NO: 2580250 - RNA, 14 nt, Coxiella burnetii RSA 493
caaagcaaaaauac

SEQ ID NO: 2580251 - RNA, 18 nt, Coxiella burnetii RSA 493
caaagcagauaaauguuu

SEQ ID NO: 2580252 - RNA, 22 nt, Coxiella burnetii RSA 493
caaagccucuucgcgcaagcac

SEQ ID NO: 2580253 - RNA, 16 nt, Coxiella burnetii RSA 493
caaagcgcugcucgaa

SEQ ID NO: 2580254 - RNA, 14 nt, Coxiella burnetii RSA 493
caaaggcauauuca

SEQ ID NO: 2580255 - RNA, 20 nt, Coxiella burnetii RSA 493
caaaggccuuggguaaguga

SEQ ID NO: 2580256 - RNA, 17 nt, Coxiella burnetii RSA 493
caaaguaaaaaugaaau

SEQ ID NO: 2580257 - RNA, 18 nt, Coxiella burnetii RSA 493
caaaguagggcaggaucu

SEQ ID NO: 2580258 - RNA, 20 nt, Coxiella burnetii RSA 493
caaagucgcguaaagauaaa

SEQ ID NO: 2580259 - RNA, 22 nt, Coxiella burnetii RSA 493
caaagucgcguaaagauaaaau

SEQ ID NO: 2580260 - RNA, 14 nt, Coxiella burnetii RSA 493
caaaguucauuaag

SEQ ID NO: 2580261 - RNA, 11 nt, Coxiella burnetii RSA 493
caaaguuucac

SEQ ID NO: 2580262 - RNA, 15 nt, Coxiella burnetii RSA 493
caaaguuucuucaua

SEQ ID NO: 2580263 - RNA, 16 nt, Coxiella burnetii RSA 493
caaaguuucuucauau

SEQ ID NO: 2580264 - RNA, 21 nt, Coxiella burnetii RSA 493
caaauaaacaaguuaacaaaa

SEQ ID NO: 2580265 - RNA, 19 nt, Coxiella burnetii RSA 493
caaauaaucguaucgauuu

SEQ ID NO: 2580266 - RNA, 17 nt, Coxiella burnetii RSA 493
caaaucggaaaagccaa

SEQ ID NO: 2580267 - RNA, 22 nt, Coxiella burnetii RSA 493
caaaucguugcauaauauuuuc

SEQ ID NO: 2580268 - RNA, 20 nt, Coxiella burnetii RSA 493
caaaugaauaagcaaagauc

SEQ ID NO: 2580269 - RNA, 16 nt, Coxiella burnetii RSA 493
caaaugaccaaauaau

SEQ ID NO: 2580270 - RNA, 17 nt, Coxiella burnetii RSA 493
caaaugaccaaauaauu

SEQ ID NO: 2580271 - RNA, 18 nt, Coxiella burnetii RSA 493
caaaugaguaaaaaagag

SEQ ID NO: 2580272 - RNA, 19 nt, Coxiella burnetii RSA 493
caaaugaugaauuuauuuc

SEQ ID NO: 2580273 - RNA, 21 nt, Coxiella burnetii RSA 493
caaaugaugaauuuauuucug

SEQ ID NO: 2580274 - RNA, 21 nt, Coxiella burnetii RSA 493
caaaugguugcugucaaaaaa

SEQ ID NO: 2580275 - RNA, 20 nt, Coxiella burnetii RSA 493
caaauuauaucauugggcca

SEQ ID NO: 2580276 - RNA, 12 nt, Coxiella burnetii RSA 493
caaauucaaugu

SEQ ID NO: 2580277 - RNA, 18 nt, Coxiella burnetii RSA 493
caaauugcuccaaacaga

SEQ ID NO: 2580278 - RNA, 13 nt, Coxiella burnetii RSA 493
caaauuuuaaagg

SEQ ID NO: 2580279 - RNA, 17 nt, Coxiella burnetii RSA 493
caaauuuuaaagguucu

SEQ ID NO: 2580280 - RNA, 19 nt, Coxiella burnetii RSA 493
caaauuuucccaggaaaga

SEQ ID NO: 2580281 - RNA, 22 nt, Coxiella burnetii RSA 493
caaauuuuccgugcagaaacaa

SEQ ID NO: 2580282 - RNA, 23 nt, Coxiella burnetii RSA 493
caaauuuuccgugcagaaacaau

SEQ ID NO: 2580283 - RNA, 15 nt, Coxiella burnetii RSA 493
caacaaaaccgugcg

SEQ ID NO: 2580284 - RNA, 17 nt, Coxiella burnetii RSA 493
caacaaaauauacucac

SEQ ID NO: 2580285 - RNA, 12 nt, Coxiella burnetii RSA 493
caacaacaaagu

SEQ ID NO: 2580286 - RNA, 23 nt, Coxiella burnetii RSA 493
caacaagcguuguaaauuuugcc

SEQ ID NO: 2580287 - RNA, 18 nt, Coxiella burnetii RSA 493
caacacgaucaacaaaau

SEQ ID NO: 2580288 - RNA, 16 nt, Coxiella burnetii RSA 493
caacacguauuuucau

SEQ ID NO: 2580289 - RNA, 21 nt, Coxiella burnetii RSA 493
caacaguauaaaauuuuauuc

SEQ ID NO: 2580290 - RNA, 23 nt, Coxiella burnetii RSA 493
caacauauggcccacuuggaaau

SEQ ID NO: 2580291 - RNA, 12 nt, Coxiella burnetii RSA 493
caacauucuuug

SEQ ID NO: 2580292 - RNA, 15 nt, Coxiella burnetii RSA 493
caaccacuguccucu

SEQ ID NO: 2580293 - RNA, 20 nt, Coxiella burnetii RSA 493
caaccauaauccuucuuuug

SEQ ID NO: 2580294 - RNA, 20 nt, Coxiella burnetii RSA 493
caacccggaccugcugcccg

SEQ ID NO: 2580295 - RNA, 16 nt, Coxiella burnetii RSA 493
caaccgauagacugga

SEQ ID NO: 2580296 - RNA, 19 nt, Coxiella burnetii RSA 493
caaccgcaugaauuaaaua

SEQ ID NO: 2580297 - RNA, 22 nt, Coxiella burnetii RSA 493
caacgaaaauaccuuugcaaac

SEQ ID NO: 2580298 - RNA, 17 nt, Coxiella burnetii RSA 493
caacgauaaaauuacua

SEQ ID NO: 2580299 - RNA, 19 nt, Coxiella burnetii RSA 493
caacgaugcugauagcauu

SEQ ID NO: 2580300 - RNA, 15 nt, Coxiella burnetii RSA 493
caacggaaaaacaaa

SEQ ID NO: 2580301 - RNA, 13 nt, Coxiella burnetii RSA 493
caacggcgcguga

SEQ ID NO: 2580302 - RNA, 14 nt, Coxiella burnetii RSA 493
caacgguauaaaau

SEQ ID NO: 2580303 - RNA, 13 nt, Coxiella burnetii RSA 493
caacggucauuug

SEQ ID NO: 2580304 - RNA, 20 nt, Coxiella burnetii RSA 493
caauucgucgcuguaucagc

SEQ ID NO: 2580305 - RNA, 20 nt, Coxiella burnetii RSA 493
caauucuggauaagcauauu

SEQ ID NO: 2580306 - RNA, 11 nt, Coxiella burnetii RSA 493
caauucuuuuu

SEQ ID NO: 2580307 - RNA, 12 nt, Coxiella burnetii RSA 493
caauucuuuuua

SEQ ID NO: 2580308 - RNA, 13 nt, Coxiella burnetii RSA 493
caauucuuuuuaa

SEQ ID NO: 2580309 - RNA, 15 nt, Coxiella burnetii RSA 493
caauugaguuagcau

SEQ ID NO: 2580310 - RNA, 16 nt, Coxiella burnetii RSA 493
caauugaguuagcaua

SEQ ID NO: 2580311 - RNA, 22 nt, Coxiella burnetii RSA 493
caauugcuuucccuuuuugauu

SEQ ID NO: 2580312 - RNA, 20 nt, Coxiella burnetii RSA 493
caauuguuugaaaaaauacc

SEQ ID NO: 2580313 - RNA, 23 nt, Coxiella burnetii RSA 493
caauuguuuguuguguugagaga

SEQ ID NO: 2580314 - RNA, 18 nt, Coxiella burnetii RSA 493
caauuuaccaauuaaaga

SEQ ID NO: 2580315 - RNA, 17 nt, Coxiella burnetii RSA 493
caauuuauucaacucuu

SEQ ID NO: 2580316 - RNA, 13 nt, Coxiella burnetii RSA 493
caauuucauuauc

SEQ ID NO: 2580317 - RNA, 12 nt, Coxiella burnetii RSA 493
caauuucuaauc

SEQ ID NO: 2580318 - RNA, 19 nt, Coxiella burnetii RSA 493
caauuucucgccauauuug

SEQ ID NO: 2580319 - RNA, 23 nt, Coxiella burnetii RSA 493
caauuucucguugauaaagauuc

SEQ ID NO: 2580320 - RNA, 13 nt, Coxiella burnetii RSA 493
caauuucuuuucu

SEQ ID NO: 2580321 - RNA, 23 nt, Coxiella burnetii RSA 493
caauuugaugaucggaggaaaua

SEQ ID NO: 2580322 - RNA, 14 nt, Coxiella burnetii RSA 493
caauuuuaaaacau

SEQ ID NO: 2580323 - RNA, 19 nt, Coxiella burnetii RSA 493
caauuuuauaaacgcccuc

SEQ ID NO: 2580324 - RNA, 23 nt, Coxiella burnetii RSA 493
caauuuuucuuuuuuuucuucuu

SEQ ID NO: 2580325 - RNA, 17 nt, Coxiella burnetii RSA 493
caauuuuuuagaaagaa

SEQ ID NO: 2580326 - RNA, 21 nt, Coxiella burnetii RSA 493
caauuuuuuugauaggauuau

SEQ ID NO: 2580327 - RNA, 12 nt, Coxiella burnetii RSA 493
cacaaaaaaauu

SEQ ID NO: 2580328 - RNA, 16 nt, Coxiella burnetii RSA 493
cacaaaagguaaaaaa

SEQ ID NO: 2580329 - RNA, 21 nt, Coxiella burnetii RSA 493
cacaaagauuuagggcuuuac

SEQ ID NO: 2580330 - RNA, 17 nt, Coxiella burnetii RSA 493
cacaaccacuguccucu

SEQ ID NO: 2580331 - RNA, 16 nt, Coxiella burnetii RSA 493
cacaaccuugccaagg

SEQ ID NO: 2580332 - RNA, 15 nt, Coxiella burnetii RSA 493
cacaacuuucuucca

SEQ ID NO: 2580333 - RNA, 16 nt, Coxiella burnetii RSA 493
cacaacuuucuuccaa

SEQ ID NO: 2580334 - RNA, 15 nt, Coxiella burnetii RSA 493
cacaaugcuuuucuc

SEQ ID NO: 2580335 - RNA, 16 nt, Coxiella burnetii RSA 493
cacaaugcuuuucuca

SEQ ID NO: 2580336 - RNA, 20 nt, Coxiella burnetii RSA 493
cacaggcuccgggaauagga

SEQ ID NO: 2580337 - RNA, 13 nt, Coxiella burnetii RSA 493
cacaguucuuaac

SEQ ID NO: 2580338 - RNA, 21 nt, Coxiella burnetii RSA 493
cacaguucuuaacgaagguuu

SEQ ID NO: 2580339 - RNA, 23 nt, Coxiella burnetii RSA 493
cacaguucuuaacgaagguuuca

SEQ ID NO: 2580340 - RNA, 13 nt, Coxiella burnetii RSA 493
cacauaagcgaau

SEQ ID NO: 2580341 - RNA, 13 nt, Coxiella burnetii RSA 493
cacauaucgcucc

SEQ ID NO: 2580342 - RNA, 19 nt, Coxiella burnetii RSA 493
cacaucguuucaaacacuu

SEQ ID NO: 2580343 - RNA, 12 nt, Coxiella burnetii RSA 493
cacaugauuuuu

SEQ ID NO: 2580344 - RNA, 13 nt, Coxiella burnetii RSA 493
cacauuuguucga

SEQ ID NO: 2580345 - RNA, 13 nt, Coxiella burnetii RSA 493
caccaaaucacgc

SEQ ID NO: 2580346 - RNA, 20 nt, Coxiella burnetii RSA 493
caccaagaaauugaucuucu

SEQ ID NO: 2580347 - RNA, 13 nt, Coxiella burnetii RSA 493
caccacuacuucu

SEQ ID NO: 2580348 - RNA, 14 nt, Coxiella burnetii RSA 493
caccacucacagcc

SEQ ID NO: 2580349 - RNA, 16 nt, Coxiella burnetii RSA 493
caccacucacagcccu

SEQ ID NO: 2580350 - RNA, 22 nt, Coxiella burnetii RSA 493
caccagaaaacguuucaucaaa

SEQ ID NO: 2580351 - RNA, 15 nt, Coxiella burnetii RSA 493
caccagggguuauaa

SEQ ID NO: 2580352 - RNA, 21 nt, Coxiella burnetii RSA 493
cacccacaucuggaaucaagu

SEQ ID NO: 2580353 - RNA, 18 nt, Coxiella burnetii RSA 493
cacccaguuguuuuaaau

SEQ ID NO: 2580354 - RNA, 23 nt, Coxiella burnetii RSA 493
caccccacaucguuucaaacacu

SEQ ID NO: 2580355 - RNA, 22 nt, Coxiella burnetii RSA 493
cacccgcaaacuucauuaaauc

SEQ ID NO: 2580356 - RNA, 17 nt, Coxiella burnetii RSA 493
cacccuucuguuuaaga

SEQ ID NO: 2580357 - RNA, 14 nt, Coxiella burnetii RSA 493
caccgcaaaguccu

SEQ ID NO: 2580358 - RNA, 17 nt, Coxiella burnetii RSA 493
caccggcgucugaaugg

SEQ ID NO: 2580359 - RNA, 16 nt, Coxiella burnetii RSA 493
caccguuggaaaagga

SEQ ID NO: 2580360 - RNA, 15 nt, Coxiella burnetii RSA 493
caccuaaaucaauuu

SEQ ID NO: 2580361 - RNA, 17 nt, Coxiella burnetii RSA 493
caccuggcuaguaaaua

SEQ ID NO: 2580362 - RNA, 22 nt, Coxiella burnetii RSA 493
caccuucuucuuuggauugcuc

SEQ ID NO: 2580363 - RNA, 21 nt, Coxiella burnetii RSA 493
cacgaccccaaugcuccgcgu

SEQ ID NO: 2580364 - RNA, 22 nt, Coxiella burnetii RSA 493
cacgauaauccgccuaaauuaa

SEQ ID NO: 2580365 - RNA, 18 nt, Coxiella burnetii RSA 493
cacgauauguuguuugcu

SEQ ID NO: 2580366 - RNA, 17 nt, Coxiella burnetii RSA 493
cacgaucaacaaaauau

SEQ ID NO: 2580367 - RNA, 16 nt, Coxiella burnetii RSA 493
cacgaugauuaaauca

SEQ ID NO: 2580368 - RNA, 16 nt, Coxiella burnetii RSA 493
cacgauuuucguugua

SEQ ID NO: 2580369 - RNA, 20 nt, Coxiella burnetii RSA 493
cacgauuuucguuguaaguc

SEQ ID NO: 2580370 - RNA, 18 nt, Coxiella burnetii RSA 493
cacgauuuuucucaucau

SEQ ID NO: 2580371 - RNA, 13 nt, Coxiella burnetii RSA 493
cacgccaaagcau

SEQ ID NO: 2580372 - RNA, 22 nt, Coxiella burnetii RSA 493
cacgcguucuugggcaauuugu

SEQ ID NO: 2580373 - RNA, 19 nt, Coxiella burnetii RSA 493
cacggaauuugaaauaaac

SEQ ID NO: 2580374 - RNA, 13 nt, Coxiella burnetii RSA 493
cacggcaaauaaa

SEQ ID NO: 2580375 - RNA, 18 nt, Coxiella burnetii RSA 493
cacguauugcaauauuua

SEQ ID NO: 2580376 - RNA, 19 nt, Coxiella burnetii RSA 493
cacguuaaauagccaacuu

SEQ ID NO: 2580377 - RNA, 21 nt, Coxiella burnetii RSA 493
cacuaaggugggcucaugaaa

SEQ ID NO: 2580378 - RNA, 20 nt, Coxiella burnetii RSA 493
cacuacgaauagccaauguu

SEQ ID NO: 2580379 - RNA, 17 nt, Coxiella burnetii RSA 493
cacuaguuuuacuacau

SEQ ID NO: 2580380 - RNA, 21 nt, Coxiella burnetii RSA 493
cacuauauacuccccuacuuu

SEQ ID NO: 2580381 - RNA, 16 nt, Coxiella burnetii RSA 493
cacucuuuaauuugca

SEQ ID NO: 2580382 - RNA, 18 nt, Coxiella burnetii RSA 493
cacugucccuugcauuuc

SEQ ID NO: 2580383 - RNA, 21 nt, Coxiella burnetii RSA 493
cacuguccucuguccucugcc

SEQ ID NO: 2580384 - RNA, 20 nt, Coxiella burnetii RSA 493
cacuguugagcaaagcguuu

SEQ ID NO: 2580385 - RNA, 19 nt, Coxiella burnetii RSA 493
cacuuaacuccuucgcuuu

SEQ ID NO: 2580386 - RNA, 11 nt, Coxiella burnetii RSA 493
cacuucuuuua

SEQ ID NO: 2580387 - RNA, 14 nt, Coxiella burnetii RSA 493
cacuuuaauaucgc

SEQ ID NO: 2580388 - RNA, 15 nt, Coxiella burnetii RSA 493
cacuuucgauaaauu

SEQ ID NO: 2580389 - RNA, 21 nt, Coxiella burnetii RSA 493
cagaaaaaguaucacggcccc

SEQ ID NO: 2580390 - RNA, 13 nt, Coxiella burnetii RSA 493
cagaaaacagccu

SEQ ID NO: 2580391 - RNA, 16 nt, Coxiella burnetii RSA 493
cagaaauucauuuuuc

SEQ ID NO: 2580392 - RNA, 19 nt, Coxiella burnetii RSA 493
cagaagaaggcucuucaua

SEQ ID NO: 2580393 - RNA, 20 nt, Coxiella burnetii RSA 493
cagaagaaggcucuucauau

SEQ ID NO: 2580394 - RNA, 21 nt, Coxiella burnetii RSA 493
cagaaugcugauaauugaaug

SEQ ID NO: 2580395 - RNA, 21 nt, Coxiella burnetii RSA 493
cagaaugcuuuuuuauaaggu

SEQ ID NO: 2580396 - RNA, 18 nt, Coxiella burnetii RSA 493
cagacaagucguuuauau

SEQ ID NO: 2580397 - RNA, 21 nt, Coxiella burnetii RSA 493
cagacaagucguuuauaucau

SEQ ID NO: 2580398 - RNA, 18 nt, Coxiella burnetii RSA 493
cagacccgcauucuuuua

SEQ ID NO: 2580399 - RNA, 22 nt, Coxiella burnetii RSA 493
cagaccuguuaaaaacgccuga

SEQ ID NO: 2580400 - RNA, 19 nt, Coxiella burnetii RSA 493
cagacgcuaauugauuaau

SEQ ID NO: 2580401 - RNA, 19 nt, Coxiella burnetii RSA 493
cagacgcuggaaaaauaaa

SEQ ID NO: 2580402 - RNA, 17 nt, Coxiella burnetii RSA 493
cagacggggcuacuuag

SEQ ID NO: 2580403 - RNA, 21 nt, Coxiella burnetii RSA 493
cagacucuuuuuauccguuuu

SEQ ID NO: 2580404 - RNA, 23 nt, Coxiella burnetii RSA 493
cagagaaguaugaucauuuucuc

SEQ ID NO: 2580405 - RNA, 13 nt, Coxiella burnetii RSA 493
cagagauaaauua

SEQ ID NO: 2580406 - RNA, 19 nt, Coxiella burnetii RSA 493
cagagauuuuuuucuuaaa

SEQ ID NO: 2580407 - RNA, 23 nt, Coxiella burnetii RSA 493
cagagauuuuuuucuuaaaauac

SEQ ID NO: 2580408 - RNA, 14 nt, Coxiella burnetii RSA 493
cagaggacagagga

SEQ ID NO: 2580409 - RNA, 14 nt, Coxiella burnetii RSA 493
cauaauuuuauaaa

SEQ ID NO: 2580410 - RNA, 17 nt, Coxiella burnetii RSA 493
cauacagaauuucuuug

SEQ ID NO: 2580411 - RNA, 21 nt, Coxiella burnetii RSA 493
cauacagcggaacaccauucg

SEQ ID NO: 2580412 - RNA, 16 nt, Coxiella burnetii RSA 493
cauacgacuucauuuc

SEQ ID NO: 2580413 - RNA, 15 nt, Coxiella burnetii RSA 493
cauacggacgacuua

SEQ ID NO: 2580414 - RNA, 17 nt, Coxiella burnetii RSA 493
cauacgggcuacucuuu

SEQ ID NO: 2580415 - RNA, 14 nt, Coxiella burnetii RSA 493
cauacgguacaggu

SEQ ID NO: 2580416 - RNA, 13 nt, Coxiella burnetii RSA 493
cauagaauuaaug

SEQ ID NO: 2580417 - RNA, 13 nt, Coxiella burnetii RSA 493
cauagcgaaaauu

SEQ ID NO: 2580418 - RNA, 20 nt, Coxiella burnetii RSA 493
cauaggcgucaacuuaagag

SEQ ID NO: 2580419 - RNA, 16 nt, Coxiella burnetii RSA 493
cauagguauuuccuug

SEQ ID NO: 2580420 - RNA, 17 nt, Coxiella burnetii RSA 493
cauaguaauucaucauu

SEQ ID NO: 2580421 - RNA, 19 nt, Coxiella burnetii RSA 493
cauauaaucgcaaaauuca

SEQ ID NO: 2580422 - RNA, 19 nt, Coxiella burnetii RSA 493
cauauaggguagauaacgc

SEQ ID NO: 2580423 - RNA, 13 nt, Coxiella burnetii RSA 493
cauauauuccaca

SEQ ID NO: 2580424 - RNA, 18 nt, Coxiella burnetii RSA 493
cauaucgccauauaaagu

SEQ ID NO: 2580425 - RNA, 18 nt, Coxiella burnetii RSA 493
cauaucgggauaaguaaa

SEQ ID NO: 2580426 - RNA, 19 nt, Coxiella burnetii RSA 493
cauaucgggauaaguaaau

SEQ ID NO: 2580427 - RNA, 20 nt, Coxiella burnetii RSA 493
cauaugaauauuaguggaau

SEQ ID NO: 2580428 - RNA, 21 nt, Coxiella burnetii RSA 493
cauaugaauauuaguggaauu

SEQ ID NO: 2580429 - RNA, 16 nt, Coxiella burnetii RSA 493
cauauuaauauuaaaa

SEQ ID NO: 2580430 - RNA, 18 nt, Coxiella burnetii RSA 493
cauauuaauauuaaaaca

SEQ ID NO: 2580431 - RNA, 19 nt, Coxiella burnetii RSA 493
cauauuaauauuaaaacaa

SEQ ID NO: 2580432 - RNA, 17 nt, Coxiella burnetii RSA 493
cauauucgccuucuugc

SEQ ID NO: 2580433 - RNA, 12 nt, Coxiella burnetii RSA 493
cauauucgcucc

SEQ ID NO: 2580434 - RNA, 14 nt, Coxiella burnetii RSA 493
cauauucgcuccau

SEQ ID NO: 2580435 - RNA, 15 nt, Coxiella burnetii RSA 493
cauauucgcuccauu

SEQ ID NO: 2580436 - RNA, 14 nt, Coxiella burnetii RSA 493
caucaaaaaaaccu

SEQ ID NO: 2580437 - RNA, 14 nt, Coxiella burnetii RSA 493
caucaaaauuaaaa

SEQ ID NO: 2580438 - RNA, 16 nt, Coxiella burnetii RSA 493
caucaaaauuaaaauc

SEQ ID NO: 2580439 - RNA, 17 nt, Coxiella burnetii RSA 493
caucaaccaauaacucg

SEQ ID NO: 2580440 - RNA, 21 nt, Coxiella burnetii RSA 493
caucaaccaauccuacuuucg

SEQ ID NO: 2580441 - RNA, 19 nt, Coxiella burnetii RSA 493
caucaacggaaaaacaaaa

SEQ ID NO: 2580442 - RNA, 20 nt, Coxiella burnetii RSA 493
caucaauaccgauuaauucu

SEQ ID NO: 2580443 - RNA, 15 nt, Coxiella burnetii RSA 493
caucacaccaagaaa

SEQ ID NO: 2580444 - RNA, 16 nt, Coxiella burnetii RSA 493
caucagauaccagaua

SEQ ID NO: 2580445 - RNA, 22 nt, Coxiella burnetii RSA 493
caucaucgccggauaaucacgc

SEQ ID NO: 2580446 - RNA, 23 nt, Coxiella burnetii RSA 493
caucauugaaaaccuacuuuucu

SEQ ID NO: 2580447 - RNA, 19 nt, Coxiella burnetii RSA 493
caucauuguuuucccguau

SEQ ID NO: 2580448 - RNA, 12 nt, Coxiella burnetii RSA 493
caucauuucccg

SEQ ID NO: 2580449 - RNA, 12 nt, Coxiella burnetii RSA 493
caucauuuucca

SEQ ID NO: 2580450 - RNA, 19 nt, Coxiella burnetii RSA 493
caucauuuuccaaaaaauu

SEQ ID NO: 2580451 - RNA, 12 nt, Coxiella burnetii RSA 493
caucauuuugau

SEQ ID NO: 2580452 - RNA, 11 nt, Coxiella burnetii RSA 493
cauccaucccg

SEQ ID NO: 2580453 - RNA, 18 nt, Coxiella burnetii RSA 493
cauccgcucgucuugcac

SEQ ID NO: 2580454 - RNA, 21 nt, Coxiella burnetii RSA 493
cauccgguuucgguuucguuc

SEQ ID NO: 2580455 - RNA, 12 nt, Coxiella burnetii RSA 493
cauccuccauua

SEQ ID NO: 2580456 - RNA, 20 nt, Coxiella burnetii RSA 493
cauccuccauuacauaauuu

SEQ ID NO: 2580457 - RNA, 22 nt, Coxiella burnetii RSA 493
cauccuuaaugaguucauuaau

SEQ ID NO: 2580458 - RNA, 14 nt, Coxiella burnetii RSA 493
caucgauaggcuuu

SEQ ID NO: 2580459 - RNA, 17 nt, Coxiella burnetii RSA 493
caucgcaagaugaggaa

SEQ ID NO: 2580460 - RNA, 21 nt, Coxiella burnetii RSA 493
caucguuugauucauuaguuu

SEQ ID NO: 2580461 - RNA, 21 nt, Coxiella burnetii RSA 493
caucguuuuauacacaucuuu

SEQ ID NO: 2580462 - RNA, 18 nt, Coxiella burnetii RSA 493
caucuccgcaggcgggga

SEQ ID NO: 2580463 - RNA, 22 nt, Coxiella burnetii RSA 493
caucucuaaccauaacaaugaa

SEQ ID NO: 2580464 - RNA, 16 nt, Coxiella burnetii RSA 493
caucucucguucuuuu

SEQ ID NO: 2580465 - RNA, 21 nt, Coxiella burnetii RSA 493
caucugcgggauuaauuuucc

SEQ ID NO: 2580466 - RNA, 15 nt, Coxiella burnetii RSA 493
caucuucaaaaccua

SEQ ID NO: 2580467 - RNA, 16 nt, Coxiella burnetii RSA 493
caucuucauuuucugu

SEQ ID NO: 2580468 - RNA, 16 nt, Coxiella burnetii RSA 493
caucuucuauucccuu

SEQ ID NO: 2580469 - RNA, 15 nt, Coxiella burnetii RSA 493
caucuugauccuuuu

SEQ ID NO: 2580470 - RNA, 22 nt, Coxiella burnetii RSA 493
caucuugaucuugggcaaaaaa

SEQ ID NO: 2580471 - RNA, 17 nt, Coxiella burnetii RSA 493
caucuuuuucuccuuuu

SEQ ID NO: 2580472 - RNA, 21 nt, Coxiella burnetii RSA 493
caugaaaggaauccuuuuucu

SEQ ID NO: 2580473 - RNA, 22 nt, Coxiella burnetii RSA 493
caugaaaggaauccuuuuucua

SEQ ID NO: 2580474 - RNA, 21 nt, Coxiella burnetii RSA 493
caugaaguuccauuccaaaaa

SEQ ID NO: 2580475 - RNA, 16 nt, Coxiella burnetii RSA 493
caugaauauuuuucuc

SEQ ID NO: 2580476 - RNA, 15 nt, Coxiella burnetii RSA 493
caugacaauuuaaua

SEQ ID NO: 2580477 - RNA, 16 nt, Coxiella burnetii RSA 493
caugacaugcgccacu

SEQ ID NO: 2580478 - RNA, 23 nt, Coxiella burnetii RSA 493
caugacgauuuuaauuuuuucuc

SEQ ID NO: 2580479 - RNA, 11 nt, Coxiella burnetii RSA 493
caugagaggau

SEQ ID NO: 2580480 - RNA, 22 nt, Coxiella burnetii RSA 493
caugagcggucaguaaaccgcu

SEQ ID NO: 2580481 - RNA, 23 nt, Coxiella burnetii RSA 493
caugauauccagguguuuuucaa

SEQ ID NO: 2580482 - RNA, 20 nt, Coxiella burnetii RSA 493
caugcaaaaauuguuuauca

SEQ ID NO: 2580483 - RNA, 16 nt, Coxiella burnetii RSA 493
caugcccauaaauaac

SEQ ID NO: 2580484 - RNA, 14 nt, Coxiella burnetii RSA 493
caugccuaggcccu

SEQ ID NO: 2580485 - RNA, 15 nt, Coxiella burnetii RSA 493
caugcgaaagcaaua

SEQ ID NO: 2580486 - RNA, 15 nt, Coxiella burnetii RSA 493
caugcucaagcgaac

SEQ ID NO: 2580487 - RNA, 18 nt, Coxiella burnetii RSA 493
caugcugauuuucacgaa

SEQ ID NO: 2580488 - RNA, 15 nt, Coxiella burnetii RSA 493
caugcugcacgccuc

SEQ ID NO: 2580489 - RNA, 16 nt, Coxiella burnetii RSA 493
caugggaugucgcuuu

SEQ ID NO: 2580490 - RNA, 20 nt, Coxiella burnetii RSA 493
caugggaugucgcuuuauuc

SEQ ID NO: 2580491 - RNA, 20 nt, Coxiella burnetii RSA 493
caugguaaauggcuuuuuuc

SEQ ID NO: 2580492 - RNA, 21 nt, Coxiella burnetii RSA 493
cauguauuccgccuuaaaaca

SEQ ID NO: 2580493 - RNA, 15 nt, Coxiella burnetii RSA 493
caugucaauaaccca

SEQ ID NO: 2580494 - RNA, 17 nt, Coxiella burnetii RSA 493
caugucuuugagauugc

SEQ ID NO: 2580495 - RNA, 17 nt, Coxiella burnetii RSA 493
caugugaauacggcccc

SEQ ID NO: 2580496 - RNA, 16 nt, Coxiella burnetii RSA 493
cauguuggauuucauc

SEQ ID NO: 2580497 - RNA, 14 nt, Coxiella burnetii RSA 493
cauguuugcuggca

SEQ ID NO: 2580498 - RNA, 16 nt, Coxiella burnetii RSA 493
cauguuugcuggcaaa

SEQ ID NO: 2580499 - RNA, 16 nt, Coxiella burnetii RSA 493
cauuaaaagauuuaau

SEQ ID NO: 2580500 - RNA, 12 nt, Coxiella burnetii RSA 493
cauuaaauuuaa

SEQ ID NO: 2580501 - RNA, 18 nt, Coxiella burnetii RSA 493
cauuaagcaauuuuuuau

SEQ ID NO: 2580502 - RNA, 20 nt, Coxiella burnetii RSA 493
cauuaagcaauuuuuuauca

SEQ ID NO: 2580503 - RNA, 20 nt, Coxiella burnetii RSA 493
cauuaauaaagugccgcgaa

SEQ ID NO: 2580504 - RNA, 19 nt, Coxiella burnetii RSA 493
cauuaauccaguuuuuuaa

SEQ ID NO: 2580505 - RNA, 15 nt, Coxiella burnetii RSA 493
cauuaaucuuccauu

SEQ ID NO: 2580506 - RNA, 18 nt, Coxiella burnetii RSA 493
cauuaaugcggcauucaa

SEQ ID NO: 2580507 - RNA, 16 nt, Coxiella burnetii RSA 493
cauuaauuuccgauuu

SEQ ID NO: 2580508 - RNA, 15 nt, Coxiella burnetii RSA 493
cauuaauuucuuuuu

SEQ ID NO: 2580509 - RNA, 17 nt, Coxiella burnetii RSA 493
cauuaauuucuuuuuuu

SEQ ID NO: 2580510 - RNA, 17 nt, Coxiella burnetii RSA 493
cauuacauaauuuaaac

SEQ ID NO: 2580511 - RNA, 19 nt, Coxiella burnetii RSA 493
cauuacauaauuuaaacuc

SEQ ID NO: 2580512 - RNA, 23 nt, Coxiella burnetii RSA 493
cauuaccauuuugacaaacaguu

SEQ ID NO: 2580513 - RNA, 17 nt, Coxiella burnetii RSA 493
cauuauauuuguauccg

SEQ ID NO: 2580514 - RNA, 16 nt, Coxiella burnetii RSA 493
cauuguauuauuaucc

SEQ ID NO: 2580515 - RNA, 16 nt, Coxiella burnetii RSA 493
cauugucucacaacau

SEQ ID NO: 2580516 - RNA, 19 nt, Coxiella burnetii RSA 493
cauugucucacaacauucc

SEQ ID NO: 2580517 - RNA, 20 nt, Coxiella burnetii RSA 493
cauugucucguuagaaaagc

SEQ ID NO: 2580518 - RNA, 18 nt, Coxiella burnetii RSA 493
cauuguucauaaaauaau

SEQ ID NO: 2580519 - RNA, 18 nt, Coxiella burnetii RSA 493
cauuguuggaaauaaugg

SEQ ID NO: 2580520 - RNA, 23 nt, Coxiella burnetii RSA 493
cauuguuucgaaauauaggcgaa

SEQ ID NO: 2580521 - RNA, 16 nt, Coxiella burnetii RSA 493
cauuuaauaaaucaau

SEQ ID NO: 2580522 - RNA, 17 nt, Coxiella burnetii RSA 493
cauuuaauaccccugca

SEQ ID NO: 2580523 - RNA, 14 nt, Coxiella burnetii RSA 493
cauuuaauuuuaaa

SEQ ID NO: 2580524 - RNA, 19 nt, Coxiella burnetii RSA 493
cauuucaacgucaaaaccc

SEQ ID NO: 2580525 - RNA, 22 nt, Coxiella burnetii RSA 493
cauuucaauauuucuugaaaaa

SEQ ID NO: 2580526 - RNA, 14 nt, Coxiella burnetii RSA 493
cauuucccaaauga

SEQ ID NO: 2580527 - RNA, 20 nt, Coxiella burnetii RSA 493
cauuucccguauuucgcuuc

SEQ ID NO: 2580528 - RNA, 12 nt, Coxiella burnetii RSA 493
cauuucgcuuuu

SEQ ID NO: 2580529 - RNA, 19 nt, Coxiella burnetii RSA 493
cauuucgcuuuuauuuccu

SEQ ID NO: 2580530 - RNA, 18 nt, Coxiella burnetii RSA 493
cauuucggacaacaaaua

SEQ ID NO: 2580531 - RNA, 17 nt, Coxiella burnetii RSA 493
cauuucuuucaauaaac

SEQ ID NO: 2580532 - RNA, 21 nt, Coxiella burnetii RSA 493
cauuugccgccaggcuucaua

SEQ ID NO: 2580533 - RNA, 19 nt, Coxiella burnetii RSA 493
cauuugcggaaaaggagaa

SEQ ID NO: 2580534 - RNA, 22 nt, Coxiella burnetii RSA 493
cauuugggucuccguaauaagg

SEQ ID NO: 2580535 - RNA, 15 nt, Coxiella burnetii RSA 493
cauuuggucaaggcc

SEQ ID NO: 2580536 - RNA, 22 nt, Coxiella burnetii RSA 493
cauuuguucuaucaauauggaa

SEQ ID NO: 2580537 - RNA, 23 nt, Coxiella burnetii RSA 493
cauuuucuccaaagggaccuuuu

SEQ ID NO: 2580538 - RNA, 20 nt, Coxiella burnetii RSA 493
cauuuugauucucuauuucg

SEQ ID NO: 2580539 - RNA, 14 nt, Coxiella burnetii RSA 493
cauuuugauuuuuu

SEQ ID NO: 2580540 - RNA, 22 nt, Coxiella burnetii RSA 493
cauuuuuaaaagugacaaugcc

SEQ ID NO: 2580541 - RNA, 17 nt, Coxiella burnetii RSA 493
cauuuuuaugcuucaau

SEQ ID NO: 2580542 - RNA, 18 nt, Coxiella burnetii RSA 493
cauuuuuuacagugugca

SEQ ID NO: 2580543 - RNA, 17 nt, Coxiella burnetii RSA 493
cauuuuuucaaauugcu

SEQ ID NO: 2580544 - RNA, 22 nt, Coxiella burnetii RSA 493
cauuuuuucguuauagccgcgu

SEQ ID NO: 2580545 - RNA, 17 nt, Coxiella burnetii RSA 493
cauuuuuuugauucuau

SEQ ID NO: 2580546 - RNA, 14 nt, Coxiella burnetii RSA 493
ccaaaaaaaaaccu

SEQ ID NO: 2580547 - RNA, 18 nt, Coxiella burnetii RSA 493
ccaaaaaacuuagccaau

SEQ ID NO: 2580548 - RNA, 18 nt, Coxiella burnetii RSA 493
ccaaaaaauuaagagaaa

SEQ ID NO: 2580549 - RNA, 19 nt, Coxiella burnetii RSA 493
ccaaaaacagauuuaaaua

SEQ ID NO: 2580550 - RNA, 13 nt, Coxiella burnetii RSA 493
ccaaaaacauugg

SEQ ID NO: 2580551 - RNA, 10 nt, Coxiella burnetii RSA 493
ccaaaaaccc

SEQ ID NO: 2580552 - RNA, 15 nt, Coxiella burnetii RSA 493
ccaaaaacccauaac

SEQ ID NO: 2580553 - RNA, 18 nt, Coxiella burnetii RSA 493
ccaaaaaguuuauaaaaa

SEQ ID NO: 2580554 - RNA, 23 nt, Coxiella burnetii RSA 493
ccaaaaggaaugaauagaaaaac

SEQ ID NO: 2580555 - RNA, 21 nt, Coxiella burnetii RSA 493
ccaaaauaauaacccacuaac

SEQ ID NO: 2580556 - RNA, 22 nt, Coxiella burnetii RSA 493
ccaaaauacaguaaauaaucau

SEQ ID NO: 2580557 - RNA, 18 nt, Coxiella burnetii RSA 493
ccaaacgguccgccuaaa

SEQ ID NO: 2580558 - RNA, 20 nt, Coxiella burnetii RSA 493
ccaaacuucucgggcuaaga

SEQ ID NO: 2580559 - RNA, 12 nt, Coxiella burnetii RSA 493
ccaaagcaaaaa

SEQ ID NO: 2580560 - RNA, 15 nt, Coxiella burnetii RSA 493
ccaaagcagauaaau

SEQ ID NO: 2580561 - RNA, 12 nt, Coxiella burnetii RSA 493
ccaaaguucauu

SEQ ID NO: 2580562 - RNA, 23 nt, Coxiella burnetii RSA 493
ccaaaguuccgcuggggccgccg

SEQ ID NO: 2580563 - RNA, 13 nt, Coxiella burnetii RSA 493
ccaaauaagccaa

SEQ ID NO: 2580564 - RNA, 13 nt, Coxiella burnetii RSA 493
ccaaauaauugau

SEQ ID NO: 2580565 - RNA, 13 nt, Coxiella burnetii RSA 493
ccaaauccgcaua

SEQ ID NO: 2580566 - RNA, 22 nt, Coxiella burnetii RSA 493
ccaaaugcgacaaucauuuuug

SEQ ID NO: 2580567 - RNA, 13 nt, Coxiella burnetii RSA 493
ccaacaauaaaac

SEQ ID NO: 2580568 - RNA, 23 nt, Coxiella burnetii RSA 493
ccaacccagcuauggaguucuug

SEQ ID NO: 2580569 - RNA, 15 nt, Coxiella burnetii RSA 493
ccaacgguaacccuc

SEQ ID NO: 2580570 - RNA, 15 nt, Coxiella burnetii RSA 493
ccaacgguauaaaau

SEQ ID NO: 2580571 - RNA, 21 nt, Coxiella burnetii RSA 493
ccaacgguauaaaauuuuauu

SEQ ID NO: 2580572 - RNA, 17 nt, Coxiella burnetii RSA 493
ccaacuguuuagugcuu

SEQ ID NO: 2580573 - RNA, 15 nt, Coxiella burnetii RSA 493
ccaagcucaugaaaa

SEQ ID NO: 2580574 - RNA, 18 nt, Coxiella burnetii RSA 493
ccaagcucaugaaaagca

SEQ ID NO: 2580575 - RNA, 17 nt, Coxiella burnetii RSA 493
ccaagugugggaaaaau

SEQ ID NO: 2580576 - RNA, 19 nt, Coxiella burnetii RSA 493
ccaagugugggaaaaauag

SEQ ID NO: 2580577 - RNA, 15 nt, Coxiella burnetii RSA 493
ccaauaaaacgccca

SEQ ID NO: 2580578 - RNA, 18 nt, Coxiella burnetii RSA 493
ccaauaacucggaacuga

SEQ ID NO: 2580579 - RNA, 21 nt, Coxiella burnetii RSA 493
ccaauaagcuagaaaauaacc

SEQ ID NO: 2580580 - RNA, 15 nt, Coxiella burnetii RSA 493
ccaauaauaaaaccc

SEQ ID NO: 2580581 - RNA, 21 nt, Coxiella burnetii RSA 493
ccaauaauugcugaacaaaag

SEQ ID NO: 2580582 - RNA, 19 nt, Coxiella burnetii RSA 493
ccaaucaauucgaaagaaa

SEQ ID NO: 2580583 - RNA, 19 nt, Coxiella burnetii RSA 493
ccaaucacuaagucacuga

SEQ ID NO: 2580584 - RNA, 11 nt, Coxiella burnetii RSA 493
ccaaucuauua

SEQ ID NO: 2580585 - RNA, 20 nt, Coxiella burnetii RSA 493
ccaauguaggugaaaacguc

SEQ ID NO: 2580586 - RNA, 14 nt, Coxiella burnetii RSA 493
ccaauguuugcuca

SEQ ID NO: 2580587 - RNA, 20 nt, Coxiella burnetii RSA 493
ccaauuaaggucugggugau

SEQ ID NO: 2580588 - RNA, 13 nt, Coxiella burnetii RSA 493
ccaauucaaauaa

SEQ ID NO: 2580589 - RNA, 20 nt, Coxiella burnetii RSA 493
ccaauuguuugaaaaaauac

SEQ ID NO: 2580590 - RNA, 19 nt, Coxiella burnetii RSA 493
ccaauuucuuuucuaaaua

SEQ ID NO: 2580591 - RNA, 23 nt, Coxiella burnetii RSA 493
ccaauuucuuuucuaaauaauga

SEQ ID NO: 2580592 - RNA, 17 nt, Coxiella burnetii RSA 493
ccacaaucacuacaaau

SEQ ID NO: 2580593 - RNA, 17 nt, Coxiella burnetii RSA 493
ccacagacucuuuuuau

SEQ ID NO: 2580594 - RNA, 20 nt, Coxiella burnetii RSA 493
ccacagacucuuuuuauccg

SEQ ID NO: 2580595 - RNA, 23 nt, Coxiella burnetii RSA 493
ccacauaaccguugaauagcagu

SEQ ID NO: 2580596 - RNA, 21 nt, Coxiella burnetii RSA 493
ccacauuucggacaacaaaua

SEQ ID NO: 2580597 - RNA, 12 nt, Coxiella burnetii RSA 493
ccaccaaugguc

SEQ ID NO: 2580598 - RNA, 14 nt, Coxiella burnetii RSA 493
ccaccacguguauu

SEQ ID NO: 2580599 - RNA, 18 nt, Coxiella burnetii RSA 493
ccaccuuugauuuugcug

SEQ ID NO: 2580600 - RNA, 22 nt, Coxiella burnetii RSA 493
ccacgauucaaccaacuguuua

SEQ ID NO: 2580601 - RNA, 14 nt, Coxiella burnetii RSA 493
ccacggcaaauaaa

SEQ ID NO: 2580602 - RNA, 12 nt, Coxiella burnetii RSA 493
ccacuaaaacgc

SEQ ID NO: 2580603 - RNA, 12 nt, Coxiella burnetii RSA 493
ccacuaaggugg

SEQ ID NO: 2580604 - RNA, 12 nt, Coxiella burnetii RSA 493
ccacuacuucug

SEQ ID NO: 2580605 - RNA, 22 nt, Coxiella burnetii RSA 493
ccacuacuucugacaagacccc

SEQ ID NO: 2580606 - RNA, 16 nt, Coxiella burnetii RSA 493
ccacucggaaagcauc

SEQ ID NO: 2580607 - RNA, 18 nt, Coxiella burnetii RSA 493
ccacucucuuuauuuuuu

SEQ ID NO: 2580608 - RNA, 14 nt, Coxiella burnetii RSA 493
ccacuggaaucaau

SEQ ID NO: 2580609 - RNA, 16 nt, Coxiella burnetii RSA 493
ccacuggguuuucccc

SEQ ID NO: 2580610 - RNA, 15 nt, Coxiella burnetii RSA 493
ccagaaaaguaaaaa

SEQ ID NO: 2580611 - RNA, 21 nt, Coxiella burnetii RSA 493
ccagaaacaacuaccugauaa

SEQ ID NO: 2580612 - RNA, 13 nt, Coxiella burnetii RSA 493
ccagaaacauaac

SEQ ID NO: 2580613 - RNA, 15 nt, Coxiella burnetii RSA 493
ccagaaauucauuuu

SEQ ID NO: 2580614 - RNA, 18 nt, Coxiella burnetii RSA 493
ccagaccuguuaaaaacg

SEQ ID NO: 2580615 - RNA, 18 nt, Coxiella burnetii RSA 493
ccagacguacaaggaaug

SEQ ID NO: 2580616 - RNA, 16 nt, Coxiella burnetii RSA 493
ccagagauuuuuuucu

SEQ ID NO: 2580617 - RNA, 17 nt, Coxiella burnetii RSA 493
ccagccgaagcgcggcc

SEQ ID NO: 2580618 - RNA, 21 nt, Coxiella burnetii RSA 493
ccagcguuuccaauuguuuga

SEQ ID NO: 2580619 - RNA, 22 nt, Coxiella burnetii RSA 493
ccagcucggggacagcaaaacu

SEQ ID NO: 2580620 - RNA, 18 nt, Coxiella burnetii RSA 493
ccagcuugugcaauucca

SEQ ID NO: 2580621 - RNA, 15 nt, Coxiella burnetii RSA 493
ccaggaaagauauuc

SEQ ID NO: 2580622 - RNA, 15 nt, Coxiella burnetii RSA 493
ccaggcgggccuucg

SEQ ID NO: 2580623 - RNA, 14 nt, Coxiella burnetii RSA 493
ccaggcugcuagaa

SEQ ID NO: 2580624 - RNA, 14 nt, Coxiella burnetii RSA 493
ccaguauuuuucuu

SEQ ID NO: 2580625 - RNA, 16 nt, Coxiella burnetii RSA 493
ccaguauuuuucuuug

SEQ ID NO: 2580626 - RNA, 23 nt, Coxiella burnetii RSA 493
ccagucguuuuuuaauauuuggg

SEQ ID NO: 2580627 - RNA, 18 nt, Coxiella burnetii RSA 493
ccagucuguuauacuguu

SEQ ID NO: 2580628 - RNA, 23 nt, Coxiella burnetii RSA 493
ccagucuguuauacuguucuuuc

SEQ ID NO: 2580629 - RNA, 19 nt, Coxiella burnetii RSA 493
ccagugccugugcaacacc

SEQ ID NO: 2580630 - RNA, 23 nt, Coxiella burnetii RSA 493
ccaguucucuauucuuaaacccu

SEQ ID NO: 2580631 - RNA, 15 nt, Coxiella burnetii RSA 493
ccaguuguuuuaaau

SEQ ID NO: 2580632 - RNA, 12 nt, Coxiella burnetii RSA 493
ccaguuuuuugg

SEQ ID NO: 2580633 - RNA, 18 nt, Coxiella burnetii RSA 493
ccauaaauaacuucuacc

SEQ ID NO: 2580634 - RNA, 18 nt, Coxiella burnetii RSA 493
ccauaauguuugauccuu

SEQ ID NO: 2580635 - RNA, 17 nt, Coxiella burnetii RSA 493
ccauacagaauuucuuu

SEQ ID NO: 2580636 - RNA, 17 nt, Coxiella burnetii RSA 493
ccauacgggcuacuucc

SEQ ID NO: 2580637 - RNA, 22 nt, Coxiella burnetii RSA 493
ccauacgggcuacuuccuucuu

SEQ ID NO: 2580638 - RNA, 18 nt, Coxiella burnetii RSA 493
ccauauaaucgcaaaauu

SEQ ID NO: 2580639 - RNA, 15 nt, Coxiella burnetii RSA 493
ccauaucguuuucac

SEQ ID NO: 2580640 - RNA, 21 nt, Coxiella burnetii RSA 493
ccauauuugcugaauuuuauu

SEQ ID NO: 2580641 - RNA, 12 nt, Coxiella burnetii RSA 493
ccauccaauaac

SEQ ID NO: 2580642 - RNA, 21 nt, Coxiella burnetii RSA 493
ccauccggaugucauaaucac

SEQ ID NO: 2580643 - RNA, 19 nt, Coxiella burnetii RSA 493
ccaucgccacucauuauuc

SEQ ID NO: 2580644 - RNA, 12 nt, Coxiella burnetii RSA 493
ccaugacgauuu

SEQ ID NO: 2580645 - RNA, 21 nt, Coxiella burnetii RSA 493
ccaugucguuauugcucaucu

SEQ ID NO: 2580646 - RNA, 21 nt, Coxiella burnetii RSA 493
ccauguuggauuucaucuugc

SEQ ID NO: 2580647 - RNA, 14 nt, Coxiella burnetii RSA 493
ccauuaaaaacaau

SEQ ID NO: 2580648 - RNA, 20 nt, Coxiella burnetii RSA 493
ccauuaaaagcgaggaccgu

SEQ ID NO: 2580649 - RNA, 13 nt, Coxiella burnetii RSA 493
ccauuaauaaagu

SEQ ID NO: 2580650 - RNA, 20 nt, Coxiella burnetii RSA 493
ccauuacgcaugucaauaac

SEQ ID NO: 2580651 - RNA, 14 nt, Coxiella burnetii RSA 493
ccauuauauuugua

SEQ ID NO: 2580652 - RNA, 13 nt, Coxiella burnetii RSA 493
ccauucaaugcua

SEQ ID NO: 2580653 - RNA, 14 nt, Coxiella burnetii RSA 493
ccauucaaugcuaa

SEQ ID NO: 2580654 - RNA, 17 nt, Coxiella burnetii RSA 493
ccauucgcguuuuuaaa

SEQ ID NO: 2580655 - RNA, 19 nt, Coxiella burnetii RSA 493
ccauucgcuaauuguuuug

SEQ ID NO: 2580656 - RNA, 14 nt, Coxiella burnetii RSA 493
ccauugcuuauuaa

SEQ ID NO: 2580657 - RNA, 15 nt, Coxiella burnetii RSA 493
ccauugcuuauuaau

SEQ ID NO: 2580658 - RNA, 22 nt, Coxiella burnetii RSA 493
ccauugguuuaaaaaguucacc

SEQ ID NO: 2580659 - RNA, 19 nt, Coxiella burnetii RSA 493
ccauuugcggaaaaggaga

SEQ ID NO: 2580660 - RNA, 22 nt, Coxiella burnetii RSA 493
cccaaaggugucaaaauuauuc

SEQ ID NO: 2580661 - RNA, 19 nt, Coxiella burnetii RSA 493
cccaaaucauggcggugau

SEQ ID NO: 2580662 - RNA, 13 nt, Coxiella burnetii RSA 493
cccaacaauaaaa

SEQ ID NO: 2580663 - RNA, 22 nt, Coxiella burnetii RSA 493
cccaacgagcucaaaaguugau

SEQ ID NO: 2580664 - RNA, 15 nt, Coxiella burnetii RSA 493
cccaacuguuuuagu

SEQ ID NO: 2580665 - RNA, 21 nt, Coxiella burnetii RSA 493
cccacaauuauccuggccuga

SEQ ID NO: 2580666 - RNA, 16 nt, Coxiella burnetii RSA 493
cccacccuuguuguca

SEQ ID NO: 2580667 - RNA, 19 nt, Coxiella burnetii RSA 493
cccacggcgccaucaacca

SEQ ID NO: 2580668 - RNA, 16 nt, Coxiella burnetii RSA 493
cccacguugcaauaac

SEQ ID NO: 2580669 - RNA, 15 nt, Coxiella burnetii RSA 493
cccacguuguuugau

SEQ ID NO: 2580670 - RNA, 21 nt, Coxiella burnetii RSA 493
cccagcguuuccaauuguuug

SEQ ID NO: 2580671 - RNA, 19 nt, Coxiella burnetii RSA 493
cccaugcgcaucgcgccau

SEQ ID NO: 2580672 - RNA, 21 nt, Coxiella burnetii RSA 493
cccauugauaauaauugcugu

SEQ ID NO: 2580673 - RNA, 21 nt, Coxiella burnetii RSA 493
cccauuugccgccaggcuuca

SEQ ID NO: 2580674 - RNA, 11 nt, Coxiella burnetii RSA 493
cccauuuuuua

SEQ ID NO: 2580675 - RNA, 11 nt, Coxiella burnetii RSA 493
cccauuuuuuu

SEQ ID NO: 2580676 - RNA, 22 nt, Coxiella burnetii RSA 493
ccccaaaguuccgcuggggccg

SEQ ID NO: 2580677 - RNA, 15 nt, Coxiella burnetii RSA 493
ccccaaaguuucacg

SEQ ID NO: 2580678 - RNA, 21 nt, Coxiella burnetii RSA 493
ccccaagagaacguaaaaugc

SEQ ID NO: 2580679 - RNA, 14 nt, Coxiella burnetii RSA 493
ccccaauuuauuca

SEQ ID NO: 2580680 - RNA, 16 nt, Coxiella burnetii RSA 493
ccccaauuuuuggcuu

SEQ ID NO: 2580681 - RNA, 13 nt, Coxiella burnetii RSA 493
ccccaucuacuuc

SEQ ID NO: 2580682 - RNA, 17 nt, Coxiella burnetii RSA 493
ccccauugauaauaauu

SEQ ID NO: 2580683 - RNA, 13 nt, Coxiella burnetii RSA 493
ccccauuucaaca

SEQ ID NO: 2580684 - RNA, 13 nt, Coxiella burnetii RSA 493
ccccauuuuuuau

SEQ ID NO: 2580685 - RNA, 16 nt, Coxiella burnetii RSA 493
ccccauuuuuuaucca

SEQ ID NO: 2580686 - RNA, 12 nt, Coxiella burnetii RSA 493
ccccuccucuaa

SEQ ID NO: 2580687 - RNA, 22 nt, Coxiella burnetii RSA 493
ccccuuugcggcuaaugcuuuu

SEQ ID NO: 2580688 - RNA, 14 nt, Coxiella burnetii RSA 493
cccgaaacaggcgg

SEQ ID NO: 2580689 - RNA, 14 nt, Coxiella burnetii RSA 493
cccgagccccaaaa

SEQ ID NO: 2580690 - RNA, 14 nt, Coxiella burnetii RSA 493
cccgauggccggca

SEQ ID NO: 2580691 - RNA, 21 nt, Coxiella burnetii RSA 493
cccgccgagcuuuucacccaa

SEQ ID NO: 2580692 - RNA, 16 nt, Coxiella burnetii RSA 493
cccgccugcgcgggaa

SEQ ID NO: 2580693 - RNA, 23 nt, Coxiella burnetii RSA 493
cccgcuaauuguucagcguugau

SEQ ID NO: 2580694 - RNA, 20 nt, Coxiella burnetii RSA 493
cccguaucaccaaaauacag

SEQ ID NO: 2580695 - RNA, 20 nt, Coxiella burnetii RSA 493
cccguauuccgcuuugcucc

SEQ ID NO: 2580696 - RNA, 18 nt, Coxiella burnetii RSA 493
cccguauuucgcuucgcu

SEQ ID NO: 2580697 - RNA, 19 nt, Coxiella burnetii RSA 493
cccguauuucgcuucgcua

SEQ ID NO: 2580698 - RNA, 23 nt, Coxiella burnetii RSA 493
cccguauuucgcuucgcuacaua

SEQ ID NO: 2580699 - RNA, 20 nt, Coxiella burnetii RSA 493
cccguauuucgcuucgcuca

SEQ ID NO: 2580700 - RNA, 22 nt, Coxiella burnetii RSA 493
cccguauuucgcuucgcucaga

SEQ ID NO: 2580701 - RNA, 21 nt, Coxiella burnetii RSA 493
cccguauuucgcuucgcucau

SEQ ID NO: 2580702 - RNA, 22 nt, Coxiella burnetii RSA 493
cccguauuucgcuucgcucaua

SEQ ID NO: 2580703 - RNA, 20 nt, Coxiella burnetii RSA 493
cccguauuucgcuucgcucc

SEQ ID NO: 2580704 - RNA, 22 nt, Coxiella burnetii RSA 493
cccguauuucgcuucgcuccau

SEQ ID NO: 2580705 - RNA, 23 nt, Coxiella burnetii RSA 493
cccguauuucgcuucgcuccaua

SEQ ID NO: 2580706 - RNA, 23 nt, Coxiella burnetii RSA 493
cccguauuucgcuucgcugcaua

SEQ ID NO: 2580707 - RNA, 21 nt, Coxiella burnetii RSA 493
cccguugcaagcguuuuucau

SEQ ID NO: 2580708 - RNA, 20 nt, Coxiella burnetii RSA 493
cccguuucgguuuucgcugc

SEQ ID NO: 2580709 - RNA, 20 nt, Coxiella burnetii RSA 493
cccuaauaaaacaagauacc

SEQ ID NO: 2580710 - RNA, 22 nt, Coxiella burnetii RSA 493
cccucgaucuuucgcccauagc

SEQ ID NO: 2580711 - RNA, 22 nt, Coxiella burnetii RSA 493
cccucucgucggguauuuucau

SEQ ID NO: 2580712 - RNA, 19 nt, Coxiella burnetii RSA 493
cccucugaaaaauauucua

SEQ ID NO: 2580713 - RNA, 20 nt, Coxiella burnetii RSA 493
cccucuuuaccccgcucccu

SEQ ID NO: 2580714 - RNA, 14 nt, Coxiella burnetii RSA 493
cccucuuuaccucc

SEQ ID NO: 2580715 - RNA, 18 nt, Coxiella burnetii RSA 493
cccucuuuaccuccuccc

SEQ ID NO: 2580716 - RNA, 16 nt, Coxiella burnetii RSA 493
cccuuaacuucucuuc

SEQ ID NO: 2580717 - RNA, 18 nt, Coxiella burnetii RSA 493
cccuuauagcgugagagg

SEQ ID NO: 2580718 - RNA, 20 nt, Coxiella burnetii RSA 493
cccuuauagcgugagaggac

SEQ ID NO: 2580719 - RNA, 22 nt, Coxiella burnetii RSA 493
cccuucaauugcuuucccuuuu

SEQ ID NO: 2580720 - RNA, 11 nt, Coxiella burnetii RSA 493
cccuuuaaccg

SEQ ID NO: 2580721 - RNA, 15 nt, Coxiella burnetii RSA 493
cccuuuaaugcauuu

SEQ ID NO: 2580722 - RNA, 17 nt, Coxiella burnetii RSA 493
cccuuugcggcuaaugc

SEQ ID NO: 2580723 - RNA, 22 nt, Coxiella burnetii RSA 493
cccuuugcggcuaaugcuuuuu

SEQ ID NO: 2580724 - RNA, 13 nt, Coxiella burnetii RSA 493
cccuuuuuuucca

SEQ ID NO: 2580725 - RNA, 21 nt, Coxiella burnetii RSA 493
ccgaagcgcggccauaaccau

SEQ ID NO: 2580726 - RNA, 15 nt, Coxiella burnetii RSA 493
ccgacaaagaaggcg

SEQ ID NO: 2580727 - RNA, 18 nt, Coxiella burnetii RSA 493
ccgaccaaggguauuuuu

SEQ ID NO: 2580728 - RNA, 13 nt, Coxiella burnetii RSA 493
ccgagcaaagcau

SEQ ID NO: 2580729 - RNA, 19 nt, Coxiella burnetii RSA 493
ccgaggaugaugaaaagcc

SEQ ID NO: 2580730 - RNA, 17 nt, Coxiella burnetii RSA 493
ccgagucaaaaauaaaa

SEQ ID NO: 2580731 - RNA, 18 nt, Coxiella burnetii RSA 493
ccgauaauggggccgccc

SEQ ID NO: 2580732 - RNA, 13 nt, Coxiella burnetii RSA 493
ccgauauucuuuu

SEQ ID NO: 2580733 - RNA, 17 nt, Coxiella burnetii RSA 493
ccgauauucuuuuucuu

SEQ ID NO: 2580734 - RNA, 15 nt, Coxiella burnetii RSA 493
ccgauuaauucuuua

SEQ ID NO: 2580735 - RNA, 20 nt, Coxiella burnetii RSA 493
ccgauuguuguggauaaagg

SEQ ID NO: 2580736 - RNA, 21 nt, Coxiella burnetii RSA 493
ccgcaaaccaggcuuaaaccc

SEQ ID NO: 2580737 - RNA, 13 nt, Coxiella burnetii RSA 493
ccgcaaaguaaaa

SEQ ID NO: 2580738 - RNA, 14 nt, Coxiella burnetii RSA 493
ccgcaaaguaaaaa

SEQ ID NO: 2580739 - RNA, 22 nt, Coxiella burnetii RSA 493
ccgcaauccucgcguuuuauca

SEQ ID NO: 2580740 - RNA, 22 nt, Coxiella burnetii RSA 493
ccgcacaaacgcgcccgcccca

SEQ ID NO: 2580741 - RNA, 22 nt, Coxiella burnetii RSA 493
ccgccgaaauuuaacacuuuaa

SEQ ID NO: 2580742 - RNA, 20 nt, Coxiella burnetii RSA 493
ccgccgagcuuuucacccaa

SEQ ID NO: 2580743 - RNA, 14 nt, Coxiella burnetii RSA 493
ccgccuacccuuuu

SEQ ID NO: 2580744 - RNA, 14 nt, Coxiella burnetii RSA 493
ccgccugcgcggga

SEQ ID NO: 2580745 - RNA, 23 nt, Coxiella burnetii RSA 493
ccgccuuaaaacauaaaggccaa

SEQ ID NO: 2580746 - RNA, 15 nt, Coxiella burnetii RSA 493
ccgcgcaggcgggga

SEQ ID NO: 2580747 - RNA, 12 nt, Coxiella burnetii RSA 493
ccgcgcauuagu

SEQ ID NO: 2580748 - RNA, 16 nt, Coxiella burnetii RSA 493
ccgcgcugaaguccuu

SEQ ID NO: 2580749 - RNA, 15 nt, Coxiella burnetii RSA 493
ccgcuaaaauuuuuu

SEQ ID NO: 2580750 - RNA, 13 nt, Coxiella burnetii RSA 493
ccgcuaauuguuc

SEQ ID NO: 2580751 - RNA, 23 nt, Coxiella burnetii RSA 493
ccgcugacgucagaaaacagccu

SEQ ID NO: 2580752 - RNA, 12 nt, Coxiella burnetii RSA 493
ccgcuguuuaua

SEQ ID NO: 2580753 - RNA, 17 nt, Coxiella burnetii RSA 493
ccgcuuagcgccgacuc

SEQ ID NO: 2580754 - RNA, 14 nt, Coxiella burnetii RSA 493
ccgcuucaaacaau

SEQ ID NO: 2580755 - RNA, 23 nt, Coxiella burnetii RSA 493
ccgcuuccagcaaacccauuuca

SEQ ID NO: 2580756 - RNA, 14 nt, Coxiella burnetii RSA 493
ccgcuugcacggga

SEQ ID NO: 2580757 - RNA, 17 nt, Coxiella burnetii RSA 493
ccggaagagcagucauu

SEQ ID NO: 2580758 - RNA, 15 nt, Coxiella burnetii RSA 493
ccggacgccaccaaa

SEQ ID NO: 2580759 - RNA, 16 nt, Coxiella burnetii RSA 493
ccggagucacuaugau

SEQ ID NO: 2580760 - RNA, 19 nt, Coxiella burnetii RSA 493
ccggaguccccaaaguuuc

SEQ ID NO: 2580761 - RNA, 14 nt, Coxiella burnetii RSA 493
ccggcaaacccauc

SEQ ID NO: 2580762 - RNA, 15 nt, Coxiella burnetii RSA 493
ccggcaaugcaccau

SEQ ID NO: 2580763 - RNA, 16 nt, Coxiella burnetii RSA 493
ccggcgucgucccaaa

SEQ ID NO: 2580764 - RNA, 15 nt, Coxiella burnetii RSA 493
ccggcuaauaauccg

SEQ ID NO: 2580765 - RNA, 17 nt, Coxiella burnetii RSA 493
ccggcucgaugcaauua

SEQ ID NO: 2580766 - RNA, 18 nt, Coxiella burnetii RSA 493
ccggcuuuuuaggucguu

SEQ ID NO: 2580767 - RNA, 17 nt, Coxiella burnetii RSA 493
ccgguauuuugcaaaug

SEQ ID NO: 2580768 - RNA, 14 nt, Coxiella burnetii RSA 493
ccgguccgccgcuu

SEQ ID NO: 2580769 - RNA, 11 nt, Coxiella burnetii RSA 493
ccgguucuuuu

SEQ ID NO: 2580770 - RNA, 18 nt, Coxiella burnetii RSA 493
ccgguuucgguuucguuc

SEQ ID NO: 2580771 - RNA, 19 nt, Coxiella burnetii RSA 493
ccgguuuugauuuuugcuc

SEQ ID NO: 2580772 - RNA, 15 nt, Coxiella burnetii RSA 493
ccguaagccgcccgg

SEQ ID NO: 2580773 - RNA, 20 nt, Coxiella burnetii RSA 493
ccguaugcagcgaagcggaa

SEQ ID NO: 2580774 - RNA, 21 nt, Coxiella burnetii RSA 493
ccguauggggcguuagcggaa

SEQ ID NO: 2580775 - RNA, 17 nt, Coxiella burnetii RSA 493
ccguauuucgcuucgcu

SEQ ID NO: 2580776 - RNA, 20 nt, Coxiella burnetii RSA 493
ccguauuucgcuucgcuaca

SEQ ID NO: 2580777 - RNA, 21 nt, Coxiella burnetii RSA 493
ccguauuucgcuucgcuacau

SEQ ID NO: 2580778 - RNA, 22 nt, Coxiella burnetii RSA 493
ccguauuucgcuucgcuacaua

SEQ ID NO: 2580779 - RNA, 19 nt, Coxiella burnetii RSA 493
ccguauuucgcuucgcuca

SEQ ID NO: 2580780 - RNA, 20 nt, Coxiella burnetii RSA 493
ccguauuucgcuucgcucau

SEQ ID NO: 2580781 - RNA, 20 nt, Coxiella burnetii RSA 493
ccguauuucgcuucgcucca

SEQ ID NO: 2580782 - RNA, 22 nt, Coxiella burnetii RSA 493
ccguauuucgcuucgcuccaua

SEQ ID NO: 2580783 - RNA, 21 nt, Coxiella burnetii RSA 493
ccguauuucgcuucgcugcau

SEQ ID NO: 2580784 - RNA, 22 nt, Coxiella burnetii RSA 493
ccguauuucgcuucgcugcaua

SEQ ID NO: 2580785 - RNA, 22 nt, Coxiella burnetii RSA 493
ccgucgcuuugcggccucgccu

SEQ ID NO: 2580786 - RNA, 21 nt, Coxiella burnetii RSA 493
ccgucuuuaauacaaggaaaa

SEQ ID NO: 2580787 - RNA, 21 nt, Coxiella burnetii RSA 493
ccgugcagggcacccaggcgg

SEQ ID NO: 2580788 - RNA, 14 nt, Coxiella burnetii RSA 493
ccguggcaguuaaa

SEQ ID NO: 2580789 - RNA, 16 nt, Coxiella burnetii RSA 493
ccguugagcaagcaga

SEQ ID NO: 2580790 - RNA, 20 nt, Coxiella burnetii RSA 493
ccguugcaagcguuuuucau

SEQ ID NO: 2580791 - RNA, 19 nt, Coxiella burnetii RSA 493
ccguuggcaaacagcgaaa

SEQ ID NO: 2580792 - RNA, 13 nt, Coxiella burnetii RSA 493
ccguuuaauuucu

SEQ ID NO: 2580793 - RNA, 15 nt, Coxiella burnetii RSA 493
ccuaaagaaagaaga

SEQ ID NO: 2580794 - RNA, 12 nt, Coxiella burnetii RSA 493
ccuaaaucaauu

SEQ ID NO: 2580795 - RNA, 18 nt, Coxiella burnetii RSA 493
ccuaagccaguucucuau

SEQ ID NO: 2580796 - RNA, 21 nt, Coxiella burnetii RSA 493
ccuaaggauaggaucuuaaga

SEQ ID NO: 2580797 - RNA, 14 nt, Coxiella burnetii RSA 493
ccuaauaaaaauau

SEQ ID NO: 2580798 - RNA, 20 nt, Coxiella burnetii RSA 493
ccuaauacaugacuuuaucu

SEQ ID NO: 2580799 - RNA, 13 nt, Coxiella burnetii RSA 493
ccuaaucggccua

SEQ ID NO: 2580800 - RNA, 21 nt, Coxiella burnetii RSA 493
ccuaauuuaaugccgauaacu

SEQ ID NO: 2580801 - RNA, 20 nt, Coxiella burnetii RSA 493
ccuacacuauugaagucugg

SEQ ID NO: 2580802 - RNA, 14 nt, Coxiella burnetii RSA 493
ccuacacuuucaau

SEQ ID NO: 2580803 - RNA, 20 nt, Coxiella burnetii RSA 493
ccuacgucggguuaucccga

SEQ ID NO: 2580804 - RNA, 12 nt, Coxiella burnetii RSA 493
ccuacuuuucua

SEQ ID NO: 2580805 - RNA, 14 nt, Coxiella burnetii RSA 493
ccuacuuuuguuuu

SEQ ID NO: 2580806 - RNA, 10 nt, Coxiella burnetii RSA 493
cgaauaacaa

SEQ ID NO: 2580807 - RNA, 12 nt, Coxiella burnetii RSA 493
cgaauagccaau

SEQ ID NO: 2580808 - RNA, 20 nt, Coxiella burnetii RSA 493
cgaaucaccugcuccuuuuc

SEQ ID NO: 2580809 - RNA, 21 nt, Coxiella burnetii RSA 493
cgaaucacuuguccuucuucu

SEQ ID NO: 2580810 - RNA, 15 nt, Coxiella burnetii RSA 493
cgaaucaucuuuuuu

SEQ ID NO: 2580811 - RNA, 22 nt, Coxiella burnetii RSA 493
cgaauggccuuacuuaccguuu

SEQ ID NO: 2580812 - RNA, 19 nt, Coxiella burnetii RSA 493
cgaaugguugaaagaaaaa

SEQ ID NO: 2580813 - RNA, 14 nt, Coxiella burnetii RSA 493
cgaauguuaauucg

SEQ ID NO: 2580814 - RNA, 16 nt, Coxiella burnetii RSA 493
cgaauguuuaaauuaa

SEQ ID NO: 2580815 - RNA, 15 nt, Coxiella burnetii RSA 493
cgaauuguaaaaaga

SEQ ID NO: 2580816 - RNA, 13 nt, Coxiella burnetii RSA 493
cgaauuuguucuu

SEQ ID NO: 2580817 - RNA, 20 nt, Coxiella burnetii RSA 493
cgaauuuuugccaauauaaa

SEQ ID NO: 2580818 - RNA, 12 nt, Coxiella burnetii RSA 493
cgacaauaaaag

SEQ ID NO: 2580819 - RNA, 17 nt, Coxiella burnetii RSA 493
cgacaauaaaagcgccu

SEQ ID NO: 2580820 - RNA, 20 nt, Coxiella burnetii RSA 493
cgacaauucccccaaaaacu

SEQ ID NO: 2580821 - RNA, 18 nt, Coxiella burnetii RSA 493
cgacaggacaaaccuggc

SEQ ID NO: 2580822 - RNA, 14 nt, Coxiella burnetii RSA 493
cgacaguauuucua

SEQ ID NO: 2580823 - RNA, 19 nt, Coxiella burnetii RSA 493
cgacauaggagauuuuuau

SEQ ID NO: 2580824 - RNA, 13 nt, Coxiella burnetii RSA 493
cgaccuucuuuuu

SEQ ID NO: 2580825 - RNA, 16 nt, Coxiella burnetii RSA 493
cgaccuucuuuuuuau

SEQ ID NO: 2580826 - RNA, 16 nt, Coxiella burnetii RSA 493
cgacgacauuaaaaau

SEQ ID NO: 2580827 - RNA, 17 nt, Coxiella burnetii RSA 493
cgacgcucgguuccaaa

SEQ ID NO: 2580828 - RNA, 18 nt, Coxiella burnetii RSA 493
cgacggacauuuuuucaa

SEQ ID NO: 2580829 - RNA, 15 nt, Coxiella burnetii RSA 493
cgacggcucucucua

SEQ ID NO: 2580830 - RNA, 13 nt, Coxiella burnetii RSA 493
cgacgggaaaaau

SEQ ID NO: 2580831 - RNA, 14 nt, Coxiella burnetii RSA 493
cgacggguuuuaag

SEQ ID NO: 2580832 - RNA, 14 nt, Coxiella burnetii RSA 493
cgacuaaaccaacg

SEQ ID NO: 2580833 - RNA, 12 nt, Coxiella burnetii RSA 493
cgacuucauuuc

SEQ ID NO: 2580834 - RNA, 13 nt, Coxiella burnetii RSA 493
cgacuucucuuuc

SEQ ID NO: 2580835 - RNA, 22 nt, Coxiella burnetii RSA 493
cgagaaaaccgcagcucaaaca

SEQ ID NO: 2580836 - RNA, 13 nt, Coxiella burnetii RSA 493
cgagaaggccaca

SEQ ID NO: 2580837 - RNA, 15 nt, Coxiella burnetii RSA 493
cgagagaauuaaaaa

SEQ ID NO: 2580838 - RNA, 12 nt, Coxiella burnetii RSA 493
cgagcaaagcau

SEQ ID NO: 2580839 - RNA, 14 nt, Coxiella burnetii RSA 493
cgagcaaucaaaac

SEQ ID NO: 2580840 - RNA, 14 nt, Coxiella burnetii RSA 493
cgagcaucuuuuug

SEQ ID NO: 2580841 - RNA, 18 nt, Coxiella burnetii RSA 493
cgagccccaaaacgcuga

SEQ ID NO: 2580842 - RNA, 16 nt, Coxiella burnetii RSA 493
cgagcgcccauuuuuu

SEQ ID NO: 2580843 - RNA, 22 nt, Coxiella burnetii RSA 493
cgagcgcgcgagaagauuuuuu

SEQ ID NO: 2580844 - RNA, 11 nt, Coxiella burnetii RSA 493
cgagcuucaug

SEQ ID NO: 2580845 - RNA, 18 nt, Coxiella burnetii RSA 493
cgaggaggguaagaauaa

SEQ ID NO: 2580846 - RNA, 14 nt, Coxiella burnetii RSA 493
cgaggcaaaauaaa

SEQ ID NO: 2580847 - RNA, 13 nt, Coxiella burnetii RSA 493
cgagggcugcaac

SEQ ID NO: 2580848 - RNA, 16 nt, Coxiella burnetii RSA 493
cgagucaaaaauaaaa

SEQ ID NO: 2580849 - RNA, 21 nt, Coxiella burnetii RSA 493
cgauaaaaacaaagugaaaua

SEQ ID NO: 2580850 - RNA, 13 nt, Coxiella burnetii RSA 493
cgauaaaaauaau

SEQ ID NO: 2580851 - RNA, 15 nt, Coxiella burnetii RSA 493
cgauaaaaauaauga

SEQ ID NO: 2580852 - RNA, 14 nt, Coxiella burnetii RSA 493
cgauaacucagcgg

SEQ ID NO: 2580853 - RNA, 21 nt, Coxiella burnetii RSA 493
cgauaagcguuugguugguuu

SEQ ID NO: 2580854 - RNA, 15 nt, Coxiella burnetii RSA 493
cgauaaucauuaacg

SEQ ID NO: 2580855 - RNA, 14 nt, Coxiella burnetii RSA 493
cgauaaugcacauc

SEQ ID NO: 2580856 - RNA, 19 nt, Coxiella burnetii RSA 493
cgauacagccuucaugaau

SEQ ID NO: 2580857 - RNA, 16 nt, Coxiella burnetii RSA 493
cgauacuuguugacau

SEQ ID NO: 2580858 - RNA, 19 nt, Coxiella burnetii RSA 493
cgauacuuuguuuuuuuuc

SEQ ID NO: 2580859 - RNA, 19 nt, Coxiella burnetii RSA 493
cgauaucgugcucuuuuuu

SEQ ID NO: 2580860 - RNA, 19 nt, Coxiella burnetii RSA 493
cgauauguuguuugcuuga

SEQ ID NO: 2580861 - RNA, 19 nt, Coxiella burnetii RSA 493
cgauauucuaucucaaagg

SEQ ID NO: 2580862 - RNA, 23 nt, Coxiella burnetii RSA 493
cgauauugauuuaaauuuaaagu

SEQ ID NO: 2580863 - RNA, 13 nt, Coxiella burnetii RSA 493
cgaucaacaaaau

SEQ ID NO: 2580864 - RNA, 21 nt, Coxiella burnetii RSA 493
cgaucaagacucaaagaaaua

SEQ ID NO: 2580865 - RNA, 13 nt, Coxiella burnetii RSA 493
cgaucagcggaau

SEQ ID NO: 2580866 - RNA, 20 nt, Coxiella burnetii RSA 493
cgaucgcugugaaaauguca

SEQ ID NO: 2580867 - RNA, 16 nt, Coxiella burnetii RSA 493
cgaucuuucgcccaua

SEQ ID NO: 2580868 - RNA, 19 nt, Coxiella burnetii RSA 493
cgaucuuucgcccauagcu

SEQ ID NO: 2580869 - RNA, 15 nt, Coxiella burnetii RSA 493
cgaugacaaauaaac

SEQ ID NO: 2580870 - RNA, 11 nt, Coxiella burnetii RSA 493
cgaugauaaag

SEQ ID NO: 2580871 - RNA, 22 nt, Coxiella burnetii RSA 493
cgaugauuaaaucaacacccca

SEQ ID NO: 2580872 - RNA, 13 nt, Coxiella burnetii RSA 493
cgauggcauucuu

SEQ ID NO: 2580873 - RNA, 19 nt, Coxiella burnetii RSA 493
cgauggccggcagcguaau

SEQ ID NO: 2580874 - RNA, 15 nt, Coxiella burnetii RSA 493
cgauggggauacauc

SEQ ID NO: 2580875 - RNA, 23 nt, Coxiella burnetii RSA 493
cgauguaguuuuguccauuuguu

SEQ ID NO: 2580876 - RNA, 18 nt, Coxiella burnetii RSA 493
cgaugugaaacaugcugc

SEQ ID NO: 2580877 - RNA, 19 nt, Coxiella burnetii RSA 493
cgauguucggcgaaugcgc

SEQ ID NO: 2580878 - RNA, 16 nt, Coxiella burnetii RSA 493
cgauucauaaaaaaug

SEQ ID NO: 2580879 - RNA, 12 nt, Coxiella burnetii RSA 493
cgauuccaauga

SEQ ID NO: 2580880 - RNA, 13 nt, Coxiella burnetii RSA 493
cgauucuuugucu

SEQ ID NO: 2580881 - RNA, 11 nt, Coxiella burnetii RSA 493
cgauucuuuuu

SEQ ID NO: 2580882 - RNA, 11 nt, Coxiella burnetii RSA 493
cgauugcuaaa

SEQ ID NO: 2580883 - RNA, 17 nt, Coxiella burnetii RSA 493
cgauuguaauugcuugg

SEQ ID NO: 2580884 - RNA, 18 nt, Coxiella burnetii RSA 493
cgauuuuaauuuuuucuc

SEQ ID NO: 2580885 - RNA, 20 nt, Coxiella burnetii RSA 493
cgauuuucgucguagacaau

SEQ ID NO: 2580886 - RNA, 16 nt, Coxiella burnetii RSA 493
cgauuuucucuucaac

SEQ ID NO: 2580887 - RNA, 17 nt, Coxiella burnetii RSA 493
cgauuuugaauuuugcc

SEQ ID NO: 2580888 - RNA, 15 nt, Coxiella burnetii RSA 493
cgcaaaaauuucauu

SEQ ID NO: 2580889 - RNA, 12 nt, Coxiella burnetii RSA 493
cgcaaacgcugc

SEQ ID NO: 2580890 - RNA, 20 nt, Coxiella burnetii RSA 493
cgcaaaguaaaaaugaaauc

SEQ ID NO: 2580891 - RNA, 23 nt, Coxiella burnetii RSA 493
cgcaaaguaaaaaugaaaucccg

SEQ ID NO: 2580892 - RNA, 18 nt, Coxiella burnetii RSA 493
cgcaaaucggaaaagcca

SEQ ID NO: 2580893 - RNA, 13 nt, Coxiella burnetii RSA 493
cgcaacuuuuuuc

SEQ ID NO: 2580894 - RNA, 14 nt, Coxiella burnetii RSA 493
cgcaagcacugcac

SEQ ID NO: 2580895 - RNA, 16 nt, Coxiella burnetii RSA 493
cgcaagcguggagcaa

SEQ ID NO: 2580896 - RNA, 15 nt, Coxiella burnetii RSA 493
cgcaagucaucggga

SEQ ID NO: 2580897 - RNA, 22 nt, Coxiella burnetii RSA 493
cgcaagugaccgagauuuuucc

SEQ ID NO: 2580898 - RNA, 19 nt, Coxiella burnetii RSA 493
cgcacgccgaauccgccgg

SEQ ID NO: 2580899 - RNA, 15 nt, Coxiella burnetii RSA 493
cgcagaauagcggau

SEQ ID NO: 2580900 - RNA, 14 nt, Coxiella burnetii RSA 493
cgcaggcggggacc

SEQ ID NO: 2580901 - RNA, 15 nt, Coxiella burnetii RSA 493
cgcauacagcggaac

SEQ ID NO: 2580902 - RNA, 17 nt, Coxiella burnetii RSA 493
cgcauagccaaccgcca

SEQ ID NO: 2580903 - RNA, 17 nt, Coxiella burnetii RSA 493
cgcauauucgccuucuu

SEQ ID NO: 2580904 - RNA, 17 nt, Coxiella burnetii RSA 493
cgcaucgcgccaugcau

SEQ ID NO: 2580905 - RNA, 18 nt, Coxiella burnetii RSA 493
cgcaucggccuuuuucau

SEQ ID NO: 2580906 - RNA, 21 nt, Coxiella burnetii RSA 493
cgcaucggccuuuuucauuuc

SEQ ID NO: 2580907 - RNA, 14 nt, Coxiella burnetii RSA 493
cgcaugaauuaaau

SEQ ID NO: 2580908 - RNA, 16 nt, Coxiella burnetii RSA 493
cgcauggauuaaaccc

SEQ ID NO: 2580909 - RNA, 14 nt, Coxiella burnetii RSA 493
cgcaugguccaaaa

SEQ ID NO: 2580910 - RNA, 16 nt, Coxiella burnetii RSA 493
cgcauuagcuucguua

SEQ ID NO: 2580911 - RNA, 12 nt, Coxiella burnetii RSA 493
cgcauucuuuua

SEQ ID NO: 2580912 - RNA, 13 nt, Coxiella burnetii RSA 493
cgcauugcauuuc

SEQ ID NO: 2580913 - RNA, 22 nt, Coxiella burnetii RSA 493
cggggcauucuuacggcucacg

SEQ ID NO: 2580914 - RNA, 18 nt, Coxiella burnetii RSA 493
cgggguguagcucagccu

SEQ ID NO: 2580915 - RNA, 20 nt, Coxiella burnetii RSA 493
cgggguuaaggaaaagcacg

SEQ ID NO: 2580916 - RNA, 12 nt, Coxiella burnetii RSA 493
cgggguucugua

SEQ ID NO: 2580917 - RNA, 18 nt, Coxiella burnetii RSA 493
cggguggcggacuuuucg

SEQ ID NO: 2580918 - RNA, 17 nt, Coxiella burnetii RSA 493
cggguuuacauaagaaa

SEQ ID NO: 2580919 - RNA, 23 nt, Coxiella burnetii RSA 493
cggguuuugaagaagagcggcuu

SEQ ID NO: 2580920 - RNA, 18 nt, Coxiella burnetii RSA 493
cgguaacagcaagaggag

SEQ ID NO: 2580921 - RNA, 13 nt, Coxiella burnetii RSA 493
cgguaaggaacag

SEQ ID NO: 2580922 - RNA, 15 nt, Coxiella burnetii RSA 493
cgguaaggaacaggg

SEQ ID NO: 2580923 - RNA, 19 nt, Coxiella burnetii RSA 493
cgguaauaauauaauugag

SEQ ID NO: 2580924 - RNA, 16 nt, Coxiella burnetii RSA 493
cgguacuuaagaaagu

SEQ ID NO: 2580925 - RNA, 22 nt, Coxiella burnetii RSA 493
cgguauggauaguuucaaauuu

SEQ ID NO: 2580926 - RNA, 23 nt, Coxiella burnetii RSA 493
cgguauuuugcaaaugaauaaca

SEQ ID NO: 2580927 - RNA, 19 nt, Coxiella burnetii RSA 493
cggugaaccgauucauaaa

SEQ ID NO: 2580928 - RNA, 14 nt, Coxiella burnetii RSA 493
cggugaucuaaccu

SEQ ID NO: 2580929 - RNA, 19 nt, Coxiella burnetii RSA 493
cgguggcguacaagugcuu

SEQ ID NO: 2580930 - RNA, 22 nt, Coxiella burnetii RSA 493
cgguuagaguuaauuucauaaa

SEQ ID NO: 2580931 - RNA, 15 nt, Coxiella burnetii RSA 493
cgguuagugggaagc

SEQ ID NO: 2580932 - RNA, 19 nt, Coxiella burnetii RSA 493
cgguucccgcuuccagcaa

SEQ ID NO: 2580933 - RNA, 15 nt, Coxiella burnetii RSA 493
cgguugggucguuug

SEQ ID NO: 2580934 - RNA, 14 nt, Coxiella burnetii RSA 493
cgguuguaauaaug

SEQ ID NO: 2580935 - RNA, 14 nt, Coxiella burnetii RSA 493
cgguuuuuuuaaaa

SEQ ID NO: 2580936 - RNA, 22 nt, Coxiella burnetii RSA 493
cgguuuuuuuaaaaaagaaaau

SEQ ID NO: 2580937 - RNA, 16 nt, Coxiella burnetii RSA 493
cgguuuuuuucuuuuu

SEQ ID NO: 2580938 - RNA, 12 nt, Coxiella burnetii RSA 493
cguaaaacgaua

SEQ ID NO: 2580939 - RNA, 20 nt, Coxiella burnetii RSA 493
cguaaauuucguugauuaau

SEQ ID NO: 2580940 - RNA, 11 nt, Coxiella burnetii RSA 493
cguaacaaaag

SEQ ID NO: 2580941 - RNA, 18 nt, Coxiella burnetii RSA 493
cguaacgucacaaauaaa

SEQ ID NO: 2580942 - RNA, 13 nt, Coxiella burnetii RSA 493
cguaacugcuaag

SEQ ID NO: 2580943 - RNA, 14 nt, Coxiella burnetii RSA 493
cguaagccgcccgg

SEQ ID NO: 2580944 - RNA, 14 nt, Coxiella burnetii RSA 493
cguaauaauaagcg

SEQ ID NO: 2580945 - RNA, 19 nt, Coxiella burnetii RSA 493
cguaauggaucgcgcgcca

SEQ ID NO: 2580946 - RNA, 18 nt, Coxiella burnetii RSA 493
cguaauuaccugaaugcu

SEQ ID NO: 2580947 - RNA, 14 nt, Coxiella burnetii RSA 493
cguacaaagagaag

SEQ ID NO: 2580948 - RNA, 23 nt, Coxiella burnetii RSA 493
cguagagauucccgcugccuuua

SEQ ID NO: 2580949 - RNA, 21 nt, Coxiella burnetii RSA 493
cguaugaagugggggaacaga

SEQ ID NO: 2580950 - RNA, 18 nt, Coxiella burnetii RSA 493
cguaugaaucagcuuaau

SEQ ID NO: 2580951 - RNA, 19 nt, Coxiella burnetii RSA 493
cguaugagcgaagcgaaau

SEQ ID NO: 2580952 - RNA, 20 nt, Coxiella burnetii RSA 493
cguaugagcgaagcgaaaua

SEQ ID NO: 2580953 - RNA, 19 nt, Coxiella burnetii RSA 493
cguaugagcgaagcgaagu

SEQ ID NO: 2580954 - RNA, 20 nt, Coxiella burnetii RSA 493
cguaugagcgaagcgaagua

SEQ ID NO: 2580955 - RNA, 20 nt, Coxiella burnetii RSA 493
cguaugcagcgaagcgaaau

SEQ ID NO: 2580956 - RNA, 21 nt, Coxiella burnetii RSA 493
cguauggggcguuagcggaau

SEQ ID NO: 2580957 - RNA, 12 nt, Coxiella burnetii RSA 493
cguauuccaaau

SEQ ID NO: 2580958 - RNA, 21 nt, Coxiella burnetii RSA 493
cguauuccgcuucgcugcaua

SEQ ID NO: 2580959 - RNA, 21 nt, Coxiella burnetii RSA 493
cguauuccgcuuugcuccaua

SEQ ID NO: 2580960 - RNA, 19 nt, Coxiella burnetii RSA 493
cguauuccuuuuucuuuua

SEQ ID NO: 2580961 - RNA, 15 nt, Coxiella burnetii RSA 493
cguauugggcggaau

SEQ ID NO: 2580962 - RNA, 20 nt, Coxiella burnetii RSA 493
cguauuucgcuucgcuacau

SEQ ID NO: 2580963 - RNA, 20 nt, Coxiella burnetii RSA 493
cguauuucgcuucgcugcau

SEQ ID NO: 2580964 - RNA, 11 nt, Coxiella burnetii RSA 493
cgucaauuuuu

SEQ ID NO: 2580965 - RNA, 19 nt, Coxiella burnetii RSA 493
cgucacaaauaaagcagca

SEQ ID NO: 2580966 - RNA, 21 nt, Coxiella burnetii RSA 493
cgucaccgguuaggaugcgaa

SEQ ID NO: 2580967 - RNA, 18 nt, Coxiella burnetii RSA 493
cgucacuucuucuccauu

SEQ ID NO: 2580968 - RNA, 16 nt, Coxiella burnetii RSA 493
cgucaugaaaagcgga

SEQ ID NO: 2580969 - RNA, 18 nt, Coxiella burnetii RSA 493
cgucauugaaaucuguaa

SEQ ID NO: 2580970 - RNA, 22 nt, Coxiella burnetii RSA 493
cgucccaaaaaacuuagccaau

SEQ ID NO: 2580971 - RNA, 17 nt, Coxiella burnetii RSA 493
cgucgaagcauuuuuuu

SEQ ID NO: 2580972 - RNA, 12 nt, Coxiella burnetii RSA 493
cgucgcaaauaa

SEQ ID NO: 2580973 - RNA, 10 nt, Coxiella burnetii RSA 493
cgucugaaug

SEQ ID NO: 2580974 - RNA, 14 nt, Coxiella burnetii RSA 493
cgucuuuaauacaa

SEQ ID NO: 2580975 - RNA, 22 nt, Coxiella burnetii RSA 493
cgucuuuucuaagacuaagaau

SEQ ID NO: 2580976 - RNA, 17 nt, Coxiella burnetii RSA 493
cgugaaauaccucuucu

SEQ ID NO: 2580977 - RNA, 23 nt, Coxiella burnetii RSA 493
cgugaaggaaauuugcauuaauc

SEQ ID NO: 2580978 - RNA, 18 nt, Coxiella burnetii RSA 493
cgugagguuuuaccuuga

SEQ ID NO: 2580979 - RNA, 17 nt, Coxiella burnetii RSA 493
cgugaugggauaaaaaa

SEQ ID NO: 2580980 - RNA, 22 nt, Coxiella burnetii RSA 493
cgugcagcugauuucugguuga

SEQ ID NO: 2580981 - RNA, 16 nt, Coxiella burnetii RSA 493
cgugcauagcauccuu

SEQ ID NO: 2580982 - RNA, 21 nt, Coxiella burnetii RSA 493
cgugccgccgaaauuuaacac

SEQ ID NO: 2580983 - RNA, 21 nt, Coxiella burnetii RSA 493
cgugcggauauucaagcccgc

SEQ ID NO: 2580984 - RNA, 20 nt, Coxiella burnetii RSA 493
cguggccggcaaugcaccau

SEQ ID NO: 2580985 - RNA, 18 nt, Coxiella burnetii RSA 493
cguggcuucgagaggaau

SEQ ID NO: 2580986 - RNA, 20 nt, Coxiella burnetii RSA 493
cguggcuuuaucaggcgcuc

SEQ ID NO: 2580987 - RNA, 15 nt, Coxiella burnetii RSA 493
cgugucaucgcauac

SEQ ID NO: 2580988 - RNA, 14 nt, Coxiella burnetii RSA 493
cguuaaaaaauucg

SEQ ID NO: 2580989 - RNA, 21 nt, Coxiella burnetii RSA 493
cguuaaaaccuuuuuuuucaa

SEQ ID NO: 2580990 - RNA, 15 nt, Coxiella burnetii RSA 493
cguuaaauagccaac

SEQ ID NO: 2580991 - RNA, 11 nt, Coxiella burnetii RSA 493
cguuaccacuu

SEQ ID NO: 2580992 - RNA, 14 nt, Coxiella burnetii RSA 493
cguuaccuucugua

SEQ ID NO: 2580993 - RNA, 18 nt, Coxiella burnetii RSA 493
cguuagcggaauacggga

SEQ ID NO: 2580994 - RNA, 15 nt, Coxiella burnetii RSA 493
cguuaguuucuuuua

SEQ ID NO: 2580995 - RNA, 16 nt, Coxiella burnetii RSA 493
cguuauagaguaaaua

SEQ ID NO: 2580996 - RNA, 19 nt, Coxiella burnetii RSA 493
cguuauagaguaaauacuc

SEQ ID NO: 2580997 - RNA, 15 nt, Coxiella burnetii RSA 493
cguuauccaugagca

SEQ ID NO: 2580998 - RNA, 11 nt, Coxiella burnetii RSA 493
cguuaugaaaa

SEQ ID NO: 2580999 - RNA, 22 nt, Coxiella burnetii RSA 493
cguuauucuaacguuaguuucu

SEQ ID NO: 2581000 - RNA, 18 nt, Coxiella burnetii RSA 493
cguuauugggauuuaccu

SEQ ID NO: 2581001 - RNA, 21 nt, Coxiella burnetii RSA 493
cguuauuguuaacaccuuuuu

SEQ ID NO: 2581002 - RNA, 16 nt, Coxiella burnetii RSA 493
cguucaccccauuuca

SEQ ID NO: 2581003 - RNA, 15 nt, Coxiella burnetii RSA 493
cguucagcuagccau

SEQ ID NO: 2581004 - RNA, 12 nt, Coxiella burnetii RSA 493
cguuccagcggg

SEQ ID NO: 2581005 - RNA, 14 nt, Coxiella burnetii RSA 493
cguuccagcgggga

SEQ ID NO: 2581006 - RNA, 14 nt, Coxiella burnetii RSA 493
cguuccaugacaug

SEQ ID NO: 2581007 - RNA, 23 nt, Coxiella burnetii RSA 493
cguucuugacaccacgcuaaaug

SEQ ID NO: 2581008 - RNA, 18 nt, Coxiella burnetii RSA 493
cguucuugggcaauuugu

SEQ ID NO: 2581009 - RNA, 15 nt, Coxiella burnetii RSA 493
cguugaugucuucuu

SEQ ID NO: 2581010 - RNA, 15 nt, Coxiella burnetii RSA 493
cguugauuaauaaug

SEQ ID NO: 2581011 - RNA, 16 nt, Coxiella burnetii RSA 493
cguugccaguguuaau

SEQ ID NO: 2581012 - RNA, 23 nt, Coxiella burnetii RSA 493
cguugcugugcgguauuuuuccu

SEQ ID NO: 2581013 - RNA, 19 nt, Coxiella burnetii RSA 493
cguuggcaaacagcgaaaa

SEQ ID NO: 2581014 - RNA, 23 nt, Coxiella burnetii RSA 493
cguuggcaaacagcgaaaacaaa

SEQ ID NO: 2581015 - RNA, 13 nt, Coxiella burnetii RSA 493
cguuuacuuguug

SEQ ID NO: 2581016 - RNA, 13 nt, Coxiella burnetii RSA 493
cguuuccaauugu

SEQ ID NO: 2581017 - RNA, 17 nt, Coxiella burnetii RSA 493
cguuuccgccucaauuu

SEQ ID NO: 2581018 - RNA, 18 nt, Coxiella burnetii RSA 493
cuaucgugccaguauuuu

SEQ ID NO: 2581019 - RNA, 17 nt, Coxiella burnetii RSA 493
cuaugaucaugccuuuu

SEQ ID NO: 2581020 - RNA, 13 nt, Coxiella burnetii RSA 493
cuauuagcuggca

SEQ ID NO: 2581021 - RNA, 20 nt, Coxiella burnetii RSA 493
cuauuagucuuaauuuuaaa

SEQ ID NO: 2581022 - RNA, 22 nt, Coxiella burnetii RSA 493
cuauuagucuuaauuuuaaaaa

SEQ ID NO: 2581023 - RNA, 14 nt, Coxiella burnetii RSA 493
cuauugaaaaaaac

SEQ ID NO: 2581024 - RNA, 16 nt, Coxiella burnetii RSA 493
cuauuggauuuacuuc

SEQ ID NO: 2581025 - RNA, 17 nt, Coxiella burnetii RSA 493
cuauuucgagauuauua

SEQ ID NO: 2581026 - RNA, 19 nt, Coxiella burnetii RSA 493
cuauuugcccaucugaugg

SEQ ID NO: 2581027 - RNA, 21 nt, Coxiella burnetii RSA 493
cuauuugguuguggcugaaaa

SEQ ID NO: 2581028 - RNA, 11 nt, Coxiella burnetii RSA 493
cuauuuuuccc

SEQ ID NO: 2581029 - RNA, 13 nt, Coxiella burnetii RSA 493
cucaaacaaauca

SEQ ID NO: 2581030 - RNA, 22 nt, Coxiella burnetii RSA 493
cucaaagaaacgauuaaaaauu

SEQ ID NO: 2581031 - RNA, 22 nt, Coxiella burnetii RSA 493
cucaaauuuucccaggaaagaa

SEQ ID NO: 2581032 - RNA, 23 nt, Coxiella burnetii RSA 493
cucaaccgguuuuucuucauuug

SEQ ID NO: 2581033 - RNA, 16 nt, Coxiella burnetii RSA 493
cucaaguggcuccgau

SEQ ID NO: 2581034 - RNA, 17 nt, Coxiella burnetii RSA 493
cucaauagaaaaaagaa

SEQ ID NO: 2581035 - RNA, 21 nt, Coxiella burnetii RSA 493
cucaauagucuuuuuauauuc

SEQ ID NO: 2581036 - RNA, 21 nt, Coxiella burnetii RSA 493
cucaauuucaauuagaaugcc

SEQ ID NO: 2581037 - RNA, 13 nt, Coxiella burnetii RSA 493
cucacaaagauuu

SEQ ID NO: 2581038 - RNA, 14 nt, Coxiella burnetii RSA 493
cucagcaucagccu

SEQ ID NO: 2581039 - RNA, 17 nt, Coxiella burnetii RSA 493
cucagcaucagccugau

SEQ ID NO: 2581040 - RNA, 15 nt, Coxiella burnetii RSA 493
cucagcgucuuuuuu

SEQ ID NO: 2581041 - RNA, 22 nt, Coxiella burnetii RSA 493
cucaguaauuucucgaaugaca

SEQ ID NO: 2581042 - RNA, 15 nt, Coxiella burnetii RSA 493
cucagucugucguuu

SEQ ID NO: 2581043 - RNA, 15 nt, Coxiella burnetii RSA 493
cucaguuaaaauaau

SEQ ID NO: 2581044 - RNA, 16 nt, Coxiella burnetii RSA 493
cucaguugucauguaa

SEQ ID NO: 2581045 - RNA, 17 nt, Coxiella burnetii RSA 493
cucaguuguuagcuuuu

SEQ ID NO: 2581046 - RNA, 20 nt, Coxiella burnetii RSA 493
cucaguuguuagcuuuucuu

SEQ ID NO: 2581047 - RNA, 22 nt, Coxiella burnetii RSA 493
cucauacgggcuacuuuacuug

SEQ ID NO: 2581048 - RNA, 23 nt, Coxiella burnetii RSA 493
cucaucuccuuuugcuaacucca

SEQ ID NO: 2581049 - RNA, 14 nt, Coxiella burnetii RSA 493
cucaugaaaagcag

SEQ ID NO: 2581050 - RNA, 19 nt, Coxiella burnetii RSA 493
cucauuaggcuuuagaaga

SEQ ID NO: 2581051 - RNA, 17 nt, Coxiella burnetii RSA 493
cucauugccaaagaaau

SEQ ID NO: 2581052 - RNA, 18 nt, Coxiella burnetii RSA 493
cucauuggcgguuaaggu

SEQ ID NO: 2581053 - RNA, 20 nt, Coxiella burnetii RSA 493
cucauuguggauuaugugga

SEQ ID NO: 2581054 - RNA, 20 nt, Coxiella burnetii RSA 493
cuccaaaacccauccauccc

SEQ ID NO: 2581055 - RNA, 18 nt, Coxiella burnetii RSA 493
cuccaaagggaccuuuuu

SEQ ID NO: 2581056 - RNA, 21 nt, Coxiella burnetii RSA 493
cuccaaauugggugcauugcu

SEQ ID NO: 2581057 - RNA, 14 nt, Coxiella burnetii RSA 493
cuccaauaauaaaa

SEQ ID NO: 2581058 - RNA, 21 nt, Coxiella burnetii RSA 493
cuccacgguuaccuugucaca

SEQ ID NO: 2581059 - RNA, 16 nt, Coxiella burnetii RSA 493
cuccagggcuuguuca

SEQ ID NO: 2581060 - RNA, 14 nt, Coxiella burnetii RSA 493
cuccaguauuucau

SEQ ID NO: 2581061 - RNA, 15 nt, Coxiella burnetii RSA 493
cuccaguauuucauc

SEQ ID NO: 2581062 - RNA, 17 nt, Coxiella burnetii RSA 493
cuccauaacaauggaca

SEQ ID NO: 2581063 - RNA, 22 nt, Coxiella burnetii RSA 493
cuccauuacauaauuuaaacuc

SEQ ID NO: 2581064 - RNA, 21 nt, Coxiella burnetii RSA 493
cuccauugaguggugguagaa

SEQ ID NO: 2581065 - RNA, 22 nt, Coxiella burnetii RSA 493
cucccagcguuuccaauuguuu

SEQ ID NO: 2581066 - RNA, 18 nt, Coxiella burnetii RSA 493
cuccccacucucuuuauu

SEQ ID NO: 2581067 - RNA, 15 nt, Coxiella burnetii RSA 493
cuccccccaaaaaaa

SEQ ID NO: 2581068 - RNA, 13 nt, Coxiella burnetii RSA 493
cuccccgcuccaa

SEQ ID NO: 2581069 - RNA, 23 nt, Coxiella burnetii RSA 493
cucccggauaaaguguugucggc

SEQ ID NO: 2581070 - RNA, 19 nt, Coxiella burnetii RSA 493
cuccgccgcgacgggaggu

SEQ ID NO: 2581071 - RNA, 21 nt, Coxiella burnetii RSA 493
cuccgugcgagcaauaauuuc

SEQ ID NO: 2581072 - RNA, 16 nt, Coxiella burnetii RSA 493
cuccuaaauuuucuug

SEQ ID NO: 2581073 - RNA, 22 nt, Coxiella burnetii RSA 493
cuccucuauauaagcuuucaau

SEQ ID NO: 2581074 - RNA, 12 nt, Coxiella burnetii RSA 493
cuccuucgcuuu

SEQ ID NO: 2581075 - RNA, 20 nt, Coxiella burnetii RSA 493
cuccuugaggaauuuuucaa

SEQ ID NO: 2581076 - RNA, 17 nt, Coxiella burnetii RSA 493
cuccuugcaagcugcug

SEQ ID NO: 2581077 - RNA, 16 nt, Coxiella burnetii RSA 493
cuccuuguuuuaaccu

SEQ ID NO: 2581078 - RNA, 13 nt, Coxiella burnetii RSA 493
cuccuuuuaaagg

SEQ ID NO: 2581079 - RNA, 12 nt, Coxiella burnetii RSA 493
cuccuuuugcua

SEQ ID NO: 2581080 - RNA, 21 nt, Coxiella burnetii RSA 493
cuccuuuuguuaauucuuuuu

SEQ ID NO: 2581081 - RNA, 13 nt, Coxiella burnetii RSA 493
cucgaaugacaac

SEQ ID NO: 2581082 - RNA, 17 nt, Coxiella burnetii RSA 493
cucgcaagaaucuccac

SEQ ID NO: 2581083 - RNA, 17 nt, Coxiella burnetii RSA 493
cucgcgaaauuguauug

SEQ ID NO: 2581084 - RNA, 23 nt, Coxiella burnetii RSA 493
cucgcgaaauuuaauaaaauuaa

SEQ ID NO: 2581085 - RNA, 14 nt, Coxiella burnetii RSA 493
cucggauagcgaca

SEQ ID NO: 2581086 - RNA, 20 nt, Coxiella burnetii RSA 493
cucggccauuuggucaaggc

SEQ ID NO: 2581087 - RNA, 21 nt, Coxiella burnetii RSA 493
cucggccgcaagugaccgaga

SEQ ID NO: 2581088 - RNA, 14 nt, Coxiella burnetii RSA 493
cucgguuccaaaaa

SEQ ID NO: 2581089 - RNA, 14 nt, Coxiella burnetii RSA 493
cucguaacaaaaga

SEQ ID NO: 2581090 - RNA, 16 nt, Coxiella burnetii RSA 493
cucguaauugagaggg

SEQ ID NO: 2581091 - RNA, 20 nt, Coxiella burnetii RSA 493
cucguauuccgcuucgcugc

SEQ ID NO: 2581092 - RNA, 19 nt, Coxiella burnetii RSA 493
cucgucuggggauacaccc

SEQ ID NO: 2581093 - RNA, 16 nt, Coxiella burnetii RSA 493
cucguugagguucgca

SEQ ID NO: 2581094 - RNA, 20 nt, Coxiella burnetii RSA 493
cucguugauaaagauucugu

SEQ ID NO: 2581095 - RNA, 15 nt, Coxiella burnetii RSA 493
cucguuuuggcugca

SEQ ID NO: 2581096 - RNA, 13 nt, Coxiella burnetii RSA 493
cucuaauucugau

SEQ ID NO: 2581097 - RNA, 20 nt, Coxiella burnetii RSA 493
cucuauaucuuuuaaauuaa

SEQ ID NO: 2581098 - RNA, 12 nt, Coxiella burnetii RSA 493
cucucaaagaaa

SEQ ID NO: 2581099 - RNA, 13 nt, Coxiella burnetii RSA 493
cucucaaagaaac

SEQ ID NO: 2581100 - RNA, 21 nt, Coxiella burnetii RSA 493
cucucauaaucgauaaucaac

SEQ ID NO: 2581101 - RNA, 20 nt, Coxiella burnetii RSA 493
cucucccuuaacuucucuuc

SEQ ID NO: 2581102 - RNA, 16 nt, Coxiella burnetii RSA 493
cucuccuaccaaauaa

SEQ ID NO: 2581103 - RNA, 19 nt, Coxiella burnetii RSA 493
cucucuagcuguuuuuucu

SEQ ID NO: 2581104 - RNA, 21 nt, Coxiella burnetii RSA 493
cucucucauaaucgauaauca

SEQ ID NO: 2581105 - RNA, 17 nt, Coxiella burnetii RSA 493
cucugccacauaaggga

SEQ ID NO: 2581106 - RNA, 18 nt, Coxiella burnetii RSA 493
cucugcgaggaccucucc

SEQ ID NO: 2581107 - RNA, 13 nt, Coxiella burnetii RSA 493
cucuggugacauc

SEQ ID NO: 2581108 - RNA, 22 nt, Coxiella burnetii RSA 493
cucuguaaugggcguacaaaga

SEQ ID NO: 2581109 - RNA, 10 nt, Coxiella burnetii RSA 493
cucuucuuuu

SEQ ID NO: 2581110 - RNA, 15 nt, Coxiella burnetii RSA 493
cucuugcccccauug

SEQ ID NO: 2581111 - RNA, 20 nt, Coxiella burnetii RSA 493
cucuugcccccauugauaau

SEQ ID NO: 2581112 - RNA, 21 nt, Coxiella burnetii RSA 493
cucuuguuucuggcguaagcg

SEQ ID NO: 2581113 - RNA, 15 nt, Coxiella burnetii RSA 493
cucuuuaccuccucc

SEQ ID NO: 2581114 - RNA, 14 nt, Coxiella burnetii RSA 493
cucuuuaucagaaa

SEQ ID NO: 2581115 - RNA, 16 nt, Coxiella burnetii RSA 493
cucuuuauuuuuucuu

SEQ ID NO: 2581116 - RNA, 18 nt, Coxiella burnetii RSA 493
cucuuuauuuuuucuuug

SEQ ID NO: 2581117 - RNA, 12 nt, Coxiella burnetii RSA 493
cugaaaaauaau

SEQ ID NO: 2581118 - RNA, 17 nt, Coxiella burnetii RSA 493
cugaacaggcagaugau

SEQ ID NO: 2581119 - RNA, 14 nt, Coxiella burnetii RSA 493
cugaaccuaaauua

SEQ ID NO: 2581120 - RNA, 20 nt, Coxiella burnetii RSA 493
cugaaccuaaauuauaaaug

SEQ ID NO: 2581121 - RNA, 21 nt, Coxiella burnetii RSA 493
cugaagaggcugaauaagcug

SEQ ID NO: 2581122 - RNA, 14 nt, Coxiella burnetii RSA 493
cugaagaguaaaaa

SEQ ID NO: 2581123 - RNA, 13 nt, Coxiella burnetii RSA 493
cuuaguaggccua

SEQ ID NO: 2581124 - RNA, 21 nt, Coxiella burnetii RSA 493
cuuauagcuuguuccuuuuua

SEQ ID NO: 2581125 - RNA, 15 nt, Coxiella burnetii RSA 493
cuuauauaaagggcc

SEQ ID NO: 2581126 - RNA, 22 nt, Coxiella burnetii RSA 493
cuuaucacuagcuauucuuuug

SEQ ID NO: 2581127 - RNA, 15 nt, Coxiella burnetii RSA 493
cuuauccuuacaaaa

SEQ ID NO: 2581128 - RNA, 16 nt, Coxiella burnetii RSA 493
cuuauccuuacaaaaa

SEQ ID NO: 2581129 - RNA, 16 nt, Coxiella burnetii RSA 493
cuuaucuuaaaccuca

SEQ ID NO: 2581130 - RNA, 17 nt, Coxiella burnetii RSA 493
cuuauuaccgguugaaa

SEQ ID NO: 2581131 - RNA, 16 nt, Coxiella burnetii RSA 493
cuuauuauucauaucu

SEQ ID NO: 2581132 - RNA, 21 nt, Coxiella burnetii RSA 493
cuuauuauucauaucuuuuuc

SEQ ID NO: 2581133 - RNA, 23 nt, Coxiella burnetii RSA 493
cuuauucauuaaauauuucuucc

SEQ ID NO: 2581134 - RNA, 22 nt, Coxiella burnetii RSA 493
cuuauuuuauaguccgcuacau

SEQ ID NO: 2581135 - RNA, 14 nt, Coxiella burnetii RSA 493
cuucaaggauugaa

SEQ ID NO: 2581136 - RNA, 15 nt, Coxiella burnetii RSA 493
cuucaauaaaaaagc

SEQ ID NO: 2581137 - RNA, 17 nt, Coxiella burnetii RSA 493
cuucacgaaguugacga

SEQ ID NO: 2581138 - RNA, 23 nt, Coxiella burnetii RSA 493
cuucacgcauuucccaaucauca

SEQ ID NO: 2581139 - RNA, 13 nt, Coxiella burnetii RSA 493
cuucacuuuucug

SEQ ID NO: 2581140 - RNA, 15 nt, Coxiella burnetii RSA 493
cuucacuuuucuggc

SEQ ID NO: 2581141 - RNA, 20 nt, Coxiella burnetii RSA 493
cuucagucgccguugcuuuu

SEQ ID NO: 2581142 - RNA, 13 nt, Coxiella burnetii RSA 493
cuucaguuggcuc

SEQ ID NO: 2581143 - RNA, 16 nt, Coxiella burnetii RSA 493
cuucauacuaacugca

SEQ ID NO: 2581144 - RNA, 15 nt, Coxiella burnetii RSA 493
cuucauccaaaauuu

SEQ ID NO: 2581145 - RNA, 17 nt, Coxiella burnetii RSA 493
cuucaucgauugcuaaa

SEQ ID NO: 2581146 - RNA, 21 nt, Coxiella burnetii RSA 493
cuucaucuuuagcaauauaac

SEQ ID NO: 2581147 - RNA, 17 nt, Coxiella burnetii RSA 493
cuucaugaauauuuuuc

SEQ ID NO: 2581148 - RNA, 14 nt, Coxiella burnetii RSA 493
cuucaugcaaaaau

SEQ ID NO: 2581149 - RNA, 22 nt, Coxiella burnetii RSA 493
cuucauugagcgggauauuuuu

SEQ ID NO: 2581150 - RNA, 22 nt, Coxiella burnetii RSA 493
cuuccaacacguauuuucauuc

SEQ ID NO: 2581151 - RNA, 13 nt, Coxiella burnetii RSA 493
cuuccaauaacau

SEQ ID NO: 2581152 - RNA, 12 nt, Coxiella burnetii RSA 493
cuuccauuaauu

SEQ ID NO: 2581153 - RNA, 19 nt, Coxiella burnetii RSA 493
cuuccauuaauuucuuuuu

SEQ ID NO: 2581154 - RNA, 21 nt, Coxiella burnetii RSA 493
cuucccauucuauaaucauuu

SEQ ID NO: 2581155 - RNA, 22 nt, Coxiella burnetii RSA 493
cuuccguugucuuggaaaaaaa

SEQ ID NO: 2581156 - RNA, 14 nt, Coxiella burnetii RSA 493
cuuccuuaaagcaa

SEQ ID NO: 2581157 - RNA, 12 nt, Coxiella burnetii RSA 493
cuucgcaaagcu

SEQ ID NO: 2581158 - RNA, 21 nt, Coxiella burnetii RSA 493
cuucgcaaagcucagcccaac

SEQ ID NO: 2581159 - RNA, 23 nt, Coxiella burnetii RSA 493
cuucgcuccauacgggcuacuuc

SEQ ID NO: 2581160 - RNA, 13 nt, Coxiella burnetii RSA 493
cuucgcuuuuucc

SEQ ID NO: 2581161 - RNA, 22 nt, Coxiella burnetii RSA 493
cuucgguaucgguaauuuguuu

SEQ ID NO: 2581162 - RNA, 17 nt, Coxiella burnetii RSA 493
cuucguaggccgcuuuu

SEQ ID NO: 2581163 - RNA, 15 nt, Coxiella burnetii RSA 493
cuucgucauuuccgu

SEQ ID NO: 2581164 - RNA, 19 nt, Coxiella burnetii RSA 493
cuucuaaagaauuuuucau

SEQ ID NO: 2581165 - RNA, 21 nt, Coxiella burnetii RSA 493
cuucuaagagcugucgccagc

SEQ ID NO: 2581166 - RNA, 17 nt, Coxiella burnetii RSA 493
cuucuaaguaaacagca

SEQ ID NO: 2581167 - RNA, 15 nt, Coxiella burnetii RSA 493
cuucuagaaaaccca

SEQ ID NO: 2581168 - RNA, 12 nt, Coxiella burnetii RSA 493
cuucuauucccu

SEQ ID NO: 2581169 - RNA, 16 nt, Coxiella burnetii RSA 493
cuucucaguuaaaaua

SEQ ID NO: 2581170 - RNA, 21 nt, Coxiella burnetii RSA 493
cuucucuugaauaagccgcgc

SEQ ID NO: 2581171 - RNA, 12 nt, Coxiella burnetii RSA 493
cuucucuuucug

SEQ ID NO: 2581172 - RNA, 22 nt, Coxiella burnetii RSA 493
cuucucuuucugagcuuguuuu

SEQ ID NO: 2581173 - RNA, 14 nt, Coxiella burnetii RSA 493
cuucuggcaaagcc

SEQ ID NO: 2581174 - RNA, 22 nt, Coxiella burnetii RSA 493
cuucuggcaaagccgcuauuuc

SEQ ID NO: 2581175 - RNA, 20 nt, Coxiella burnetii RSA 493
cuucuuauaaucuuaucaau

SEQ ID NO: 2581176 - RNA, 14 nt, Coxiella burnetii RSA 493
cuucuucaacuccu

SEQ ID NO: 2581177 - RNA, 12 nt, Coxiella burnetii RSA 493
cuucuucauuua

SEQ ID NO: 2581178 - RNA, 13 nt, Coxiella burnetii RSA 493
cuucuucauuuau

SEQ ID NO: 2581179 - RNA, 23 nt, Coxiella burnetii RSA 493
cuucuucuuuuaaguggauuuca

SEQ ID NO: 2581180 - RNA, 23 nt, Coxiella burnetii RSA 493
cuucuugucauucccuuuuucgu

SEQ ID NO: 2581181 - RNA, 16 nt, Coxiella burnetii RSA 493
cuucuuuaauaucaaa

SEQ ID NO: 2581182 - RNA, 19 nt, Coxiella burnetii RSA 493
cuucuuuaauaucaaaaaa

SEQ ID NO: 2581183 - RNA, 17 nt, Coxiella burnetii RSA 493
cuucuuuuaaguggauu

SEQ ID NO: 2581184 - RNA, 13 nt, Coxiella burnetii RSA 493
cuucuuuuuuaug

SEQ ID NO: 2581185 - RNA, 14 nt, Coxiella burnetii RSA 493
cuugaaaaaauuga

SEQ ID NO: 2581186 - RNA, 21 nt, Coxiella burnetii RSA 493
cuugaacaggagcgauaaaau

SEQ ID NO: 2581187 - RNA, 23 nt, Coxiella burnetii RSA 493
cuugaacaggagcgauaaaauaa

SEQ ID NO: 2581188 - RNA, 22 nt, Coxiella burnetii RSA 493
cuugagaguaaauguuucuuuu

SEQ ID NO: 2581189 - RNA, 17 nt, Coxiella burnetii RSA 493
cuugagcgcaaacuuca

SEQ ID NO: 2581190 - RNA, 19 nt, Coxiella burnetii RSA 493
cuugaguaaccucuccauc

SEQ ID NO: 2581191 - RNA, 21 nt, Coxiella burnetii RSA 493
cuugcaaacaaacgauaaucu

SEQ ID NO: 2581192 - RNA, 13 nt, Coxiella burnetii RSA 493
cuugcauuucaau

SEQ ID NO: 2581193 - RNA, 20 nt, Coxiella burnetii RSA 493
cuugccaccggacucuugcc

SEQ ID NO: 2581194 - RNA, 21 nt, Coxiella burnetii RSA 493
cuugcccccauugauaauaau

SEQ ID NO: 2581195 - RNA, 19 nt, Coxiella burnetii RSA 493
cuugccgaggcaaaauaaa

SEQ ID NO: 2581196 - RNA, 22 nt, Coxiella burnetii RSA 493
cuugccgauuuguuuaggcgaa

SEQ ID NO: 2581197 - RNA, 21 nt, Coxiella burnetii RSA 493
cuugccgcugcgguauuguuc

SEQ ID NO: 2581198 - RNA, 16 nt, Coxiella burnetii RSA 493
cuugcgguacaagcgc

SEQ ID NO: 2581199 - RNA, 22 nt, Coxiella burnetii RSA 493
cuugcgguucaugaaaaagaua

SEQ ID NO: 2581200 - RNA, 15 nt, Coxiella burnetii RSA 493
cuugcucaaguccuu

SEQ ID NO: 2581201 - RNA, 16 nt, Coxiella burnetii RSA 493
cuugcucaaguccuug

SEQ ID NO: 2581202 - RNA, 21 nt, Coxiella burnetii RSA 493
cuugcucaaguccuugcugaa

SEQ ID NO: 2581203 - RNA, 14 nt, Coxiella burnetii RSA 493
cuugcugcaagccc

SEQ ID NO: 2581204 - RNA, 12 nt, Coxiella burnetii RSA 493
cuuggauuuuaa

SEQ ID NO: 2581205 - RNA, 15 nt, Coxiella burnetii RSA 493
cuugggcaaaaaaag

SEQ ID NO: 2581206 - RNA, 18 nt, Coxiella burnetii RSA 493
cuugggcaaaaaaagaaa

SEQ ID NO: 2581207 - RNA, 20 nt, Coxiella burnetii RSA 493
cuugggcaaaaaaagaaaau

SEQ ID NO: 2581208 - RNA, 14 nt, Coxiella burnetii RSA 493
cuuguaaggauucu

SEQ ID NO: 2581209 - RNA, 20 nt, Coxiella burnetii RSA 493
cuuguaauucaaauuuuaaa

SEQ ID NO: 2581210 - RNA, 15 nt, Coxiella burnetii RSA 493
cuuguaccugccauu

SEQ ID NO: 2581211 - RNA, 18 nt, Coxiella burnetii RSA 493
cuugucacaaguguggau

SEQ ID NO: 2581212 - RNA, 16 nt, Coxiella burnetii RSA 493
cuugucauucccuuuu

SEQ ID NO: 2581213 - RNA, 19 nt, Coxiella burnetii RSA 493
cuuguuccgccauuuccca

SEQ ID NO: 2581214 - RNA, 12 nt, Coxiella burnetii RSA 493
cuuguuccuuuu

SEQ ID NO: 2581215 - RNA, 17 nt, Coxiella burnetii RSA 493
cuuguuccuuuuuauaa

SEQ ID NO: 2581216 - RNA, 18 nt, Coxiella burnetii RSA 493
cuuguugaauuccuugcu

SEQ ID NO: 2581217 - RNA, 11 nt, Coxiella burnetii RSA 493
cuuguuuuaag

SEQ ID NO: 2581218 - RNA, 22 nt, Coxiella burnetii RSA 493
cuuguuuuucgguuucuucaac

SEQ ID NO: 2581219 - RNA, 23 nt, Coxiella burnetii RSA 493
cuuuaaaauaaguauccauccca

SEQ ID NO: 2581220 - RNA, 17 nt, Coxiella burnetii RSA 493
cuuuaagaucgcuguau

SEQ ID NO: 2581221 - RNA, 18 nt, Coxiella burnetii RSA 493
cuuuaagauuucuucacg

SEQ ID NO: 2581222 - RNA, 17 nt, Coxiella burnetii RSA 493
cuuuaagcacuucuuuu

SEQ ID NO: 2581223 - RNA, 16 nt, Coxiella burnetii RSA 493
cuuuaauaucgcuaua

SEQ ID NO: 2581224 - RNA, 13 nt, Coxiella burnetii RSA 493
cuuuaaugcauuu

SEQ ID NO: 2581225 - RNA, 15 nt, Coxiella burnetii RSA 493
cuuuaaugcauuuga

SEQ ID NO: 2581226 - RNA, 16 nt, Coxiella burnetii RSA 493
cuuuacagguucacuc

SEQ ID NO: 2581227 - RNA, 13 nt, Coxiella burnetii RSA 493
cuuuaccuaucac

SEQ ID NO: 2581228 - RNA, 17 nt, Coxiella burnetii RSA 493
gaaacgacgaucaccca

SEQ ID NO: 2581229 - RNA, 16 nt, Coxiella burnetii RSA 493
gaaacgauuaaaaauu

SEQ ID NO: 2581230 - RNA, 17 nt, Coxiella burnetii RSA 493
gaaacgcgccaaacaac

SEQ ID NO: 2581231 - RNA, 19 nt, Coxiella burnetii RSA 493
gaaacgcuuauaggaaucu

SEQ ID NO: 2581232 - RNA, 15 nt, Coxiella burnetii RSA 493
gaaacggcuuguuua

SEQ ID NO: 2581233 - RNA, 22 nt, Coxiella burnetii RSA 493
gaaacuaagcauuaaaaaauaa

SEQ ID NO: 2581234 - RNA, 15 nt, Coxiella burnetii RSA 493
gaaagaaaaaaaacc

SEQ ID NO: 2581235 - RNA, 17 nt, Coxiella burnetii RSA 493
gaaagaaaaugaguugu

SEQ ID NO: 2581236 - RNA, 17 nt, Coxiella burnetii RSA 493
gaaagaagaaggucguu

SEQ ID NO: 2581237 - RNA, 16 nt, Coxiella burnetii RSA 493
gaaagacaacuuuaua

SEQ ID NO: 2581238 - RNA, 15 nt, Coxiella burnetii RSA 493
gaaagaguauuuuuu

SEQ ID NO: 2581239 - RNA, 22 nt, Coxiella burnetii RSA 493
gaaagauauucuucuagaaaac

SEQ ID NO: 2581240 - RNA, 22 nt, Coxiella burnetii RSA 493
gaaagccaaguuuuaagaaaaa

SEQ ID NO: 2581241 - RNA, 15 nt, Coxiella burnetii RSA 493
gaaagcuaaaaaaga

SEQ ID NO: 2581242 - RNA, 19 nt, Coxiella burnetii RSA 493
gaaagcuaaaaaagaaaua

SEQ ID NO: 2581243 - RNA, 14 nt, Coxiella burnetii RSA 493
gaaaguagaaaacu

SEQ ID NO: 2581244 - RNA, 22 nt, Coxiella burnetii RSA 493
gaaagugagccgcuaauaacau

SEQ ID NO: 2581245 - RNA, 23 nt, Coxiella burnetii RSA 493
gaaagugagccgcuaauaacauu

SEQ ID NO: 2581246 - RNA, 19 nt, Coxiella burnetii RSA 493
gaaaguguagguuuucaac

SEQ ID NO: 2581247 - RNA, 13 nt, Coxiella burnetii RSA 493
gaaaguuucauaa

SEQ ID NO: 2581248 - RNA, 20 nt, Coxiella burnetii RSA 493
gaaaguuucccacaaaauac

SEQ ID NO: 2581249 - RNA, 22 nt, Coxiella burnetii RSA 493
gaaaguuucccacaaaauaccc

SEQ ID NO: 2581250 - RNA, 20 nt, Coxiella burnetii RSA 493
gaaauaacguugucuuauuu

SEQ ID NO: 2581251 - RNA, 13 nt, Coxiella burnetii RSA 493
gaaauaaugacaa

SEQ ID NO: 2581252 - RNA, 19 nt, Coxiella burnetii RSA 493
gaaauaaugacaauucccg

SEQ ID NO: 2581253 - RNA, 13 nt, Coxiella burnetii RSA 493
gaaauaaugugac

SEQ ID NO: 2581254 - RNA, 13 nt, Coxiella burnetii RSA 493
gaaauaauucgca

SEQ ID NO: 2581255 - RNA, 20 nt, Coxiella burnetii RSA 493
gaaauacgggaaaacaauga

SEQ ID NO: 2581256 - RNA, 22 nt, Coxiella burnetii RSA 493
gaaauacggggacaauagauga

SEQ ID NO: 2581257 - RNA, 18 nt, Coxiella burnetii RSA 493
gaaauacggggacgauug

SEQ ID NO: 2581258 - RNA, 14 nt, Coxiella burnetii RSA 493
gaaauauuagaaau

SEQ ID NO: 2581259 - RNA, 18 nt, Coxiella burnetii RSA 493
gaaauauuagaaauaaua

SEQ ID NO: 2581260 - RNA, 19 nt, Coxiella burnetii RSA 493
gaaauauuuuuauucuucu

SEQ ID NO: 2581261 - RNA, 18 nt, Coxiella burnetii RSA 493
gaaaucuaccguauuuaa

SEQ ID NO: 2581262 - RNA, 19 nt, Coxiella burnetii RSA 493
gaaauguuuagucggaaau

SEQ ID NO: 2581263 - RNA, 23 nt, Coxiella burnetii RSA 493
gaaauuucacacguaucugcuaa

SEQ ID NO: 2581264 - RNA, 14 nt, Coxiella burnetii RSA 493
gaaauuuuuugcug

SEQ ID NO: 2581265 - RNA, 19 nt, Coxiella burnetii RSA 493
gaacaacacgaucaacaaa

SEQ ID NO: 2581266 - RNA, 20 nt, Coxiella burnetii RSA 493
gaacaauauuagccacauuu

SEQ ID NO: 2581267 - RNA, 17 nt, Coxiella burnetii RSA 493
gaacaauuaacuuugca

SEQ ID NO: 2581268 - RNA, 21 nt, Coxiella burnetii RSA 493
gaacagccgaugacaaauaaa

SEQ ID NO: 2581269 - RNA, 22 nt, Coxiella burnetii RSA 493
gaacauuaagaaagcgagcaau

SEQ ID NO: 2581270 - RNA, 22 nt, Coxiella burnetii RSA 493
gaaccauucaauuggagguucu

SEQ ID NO: 2581271 - RNA, 14 nt, Coxiella burnetii RSA 493
gaacccguuuuaau

SEQ ID NO: 2581272 - RNA, 18 nt, Coxiella burnetii RSA 493
gaaccgauucauaaaaaa

SEQ ID NO: 2581273 - RNA, 23 nt, Coxiella burnetii RSA 493
gaacgacuuuuuuuaccauuuca

SEQ ID NO: 2581274 - RNA, 18 nt, Coxiella burnetii RSA 493
gaacgugcacgaaauaau

SEQ ID NO: 2581275 - RNA, 15 nt, Coxiella burnetii RSA 493
gaacguuucccaagg

SEQ ID NO: 2581276 - RNA, 15 nt, Coxiella burnetii RSA 493
gaacugaugaauaac

SEQ ID NO: 2581277 - RNA, 13 nt, Coxiella burnetii RSA 493
gaacuuauccaug

SEQ ID NO: 2581278 - RNA, 15 nt, Coxiella burnetii RSA 493
gaagaaaaagaaauu

SEQ ID NO: 2581279 - RNA, 15 nt, Coxiella burnetii RSA 493
gaagaauugauuagu

SEQ ID NO: 2581280 - RNA, 18 nt, Coxiella burnetii RSA 493
gaagaauuuguuuugauc

SEQ ID NO: 2581281 - RNA, 22 nt, Coxiella burnetii RSA 493
gaagagacaaaguuucuucaua

SEQ ID NO: 2581282 - RNA, 16 nt, Coxiella burnetii RSA 493
gaagaguaaaaaacca

SEQ ID NO: 2581283 - RNA, 23 nt, Coxiella burnetii RSA 493
gaagcaucgcgcguuuuuuuauc

SEQ ID NO: 2581284 - RNA, 17 nt, Coxiella burnetii RSA 493
gaagcaugcugauuuuc

SEQ ID NO: 2581285 - RNA, 14 nt, Coxiella burnetii RSA 493
gaagcgaaauacgg

SEQ ID NO: 2581286 - RNA, 15 nt, Coxiella burnetii RSA 493
gaagcgaaauacggg

SEQ ID NO: 2581287 - RNA, 16 nt, Coxiella burnetii RSA 493
gaagcgaaauacggga

SEQ ID NO: 2581288 - RNA, 16 nt, Coxiella burnetii RSA 493
gaagcgaaauacgggg

SEQ ID NO: 2581289 - RNA, 19 nt, Coxiella burnetii RSA 493
gaagcgaaauacggggaaa

SEQ ID NO: 2581290 - RNA, 21 nt, Coxiella burnetii RSA 493
gaagcgaaauacggggaaaua

SEQ ID NO: 2581291 - RNA, 19 nt, Coxiella burnetii RSA 493
gaagcgaaauacggggaca

SEQ ID NO: 2581292 - RNA, 16 nt, Coxiella burnetii RSA 493
gaagcgauugacuucu

SEQ ID NO: 2581293 - RNA, 21 nt, Coxiella burnetii RSA 493
gaagcuauccaaauaaucggg

SEQ ID NO: 2581294 - RNA, 13 nt, Coxiella burnetii RSA 493
gaaggcagaggac

SEQ ID NO: 2581295 - RNA, 15 nt, Coxiella burnetii RSA 493
gaaggcugcuugaag

SEQ ID NO: 2581296 - RNA, 22 nt, Coxiella burnetii RSA 493
gaaggugauucucucaaagaaa

SEQ ID NO: 2581297 - RNA, 21 nt, Coxiella burnetii RSA 493
gaaguaaaaagagucauugua

SEQ ID NO: 2581298 - RNA, 20 nt, Coxiella burnetii RSA 493
gaagucugguuaaacccauu

SEQ ID NO: 2581299 - RNA, 19 nt, Coxiella burnetii RSA 493
gaagugggggaacagagga

SEQ ID NO: 2581300 - RNA, 20 nt, Coxiella burnetii RSA 493
gaagugggggaacagaggac

SEQ ID NO: 2581301 - RNA, 16 nt, Coxiella burnetii RSA 493
gaauaaaaccuucaaa

SEQ ID NO: 2581302 - RNA, 18 nt, Coxiella burnetii RSA 493
gaauaaaacggcuugauu

SEQ ID NO: 2581303 - RNA, 19 nt, Coxiella burnetii RSA 493
gaauaacuucuucuuuuaa

SEQ ID NO: 2581304 - RNA, 13 nt, Coxiella burnetii RSA 493
gaauaagccgcgc

SEQ ID NO: 2581305 - RNA, 19 nt, Coxiella burnetii RSA 493
gaauacggagaaaaugauu

SEQ ID NO: 2581306 - RNA, 12 nt, Coxiella burnetii RSA 493
gaauagaaaaac

SEQ ID NO: 2581307 - RNA, 20 nt, Coxiella burnetii RSA 493
gaauauaaugggaguaauga

SEQ ID NO: 2581308 - RNA, 20 nt, Coxiella burnetii RSA 493
gaauauagacaaugcuuucu

SEQ ID NO: 2581309 - RNA, 21 nt, Coxiella burnetii RSA 493
gaauauuaguggaauuaaaua

SEQ ID NO: 2581310 - RNA, 12 nt, Coxiella burnetii RSA 493
gaauauuuucgg

SEQ ID NO: 2581311 - RNA, 13 nt, Coxiella burnetii RSA 493
gaauauuuuucuc

SEQ ID NO: 2581312 - RNA, 22 nt, Coxiella burnetii RSA 493
gaaucacuucuuccaugguuuc

SEQ ID NO: 2581313 - RNA, 12 nt, Coxiella burnetii RSA 493
gaaucagcuuaa

SEQ ID NO: 2581314 - RNA, 19 nt, Coxiella burnetii RSA 493
gaaucagcuuaaucaaccu

SEQ ID NO: 2581315 - RNA, 22 nt, Coxiella burnetii RSA 493
gaaucagcuuaaucaaccucag

SEQ ID NO: 2581316 - RNA, 19 nt, Coxiella burnetii RSA 493
gaaucauacgguacaggua

SEQ ID NO: 2581317 - RNA, 14 nt, Coxiella burnetii RSA 493
gaaucgacuuucuc

SEQ ID NO: 2581318 - RNA, 17 nt, Coxiella burnetii RSA 493
gaaucgcggacaauaag

SEQ ID NO: 2581319 - RNA, 22 nt, Coxiella burnetii RSA 493
gaaucgggccgccuuaauaacc

SEQ ID NO: 2581320 - RNA, 22 nt, Coxiella burnetii RSA 493
gaaucugaauuuaugaaugcug

SEQ ID NO: 2581321 - RNA, 15 nt, Coxiella burnetii RSA 493
gaaugaauagaaaaa

SEQ ID NO: 2581322 - RNA, 16 nt, Coxiella burnetii RSA 493
gaaugacgauuaaaaa

SEQ ID NO: 2581323 - RNA, 23 nt, Coxiella burnetii RSA 493
gaaugagcauaacgaaucguuug

SEQ ID NO: 2581324 - RNA, 13 nt, Coxiella burnetii RSA 493
gaaugauaccauc

SEQ ID NO: 2581325 - RNA, 18 nt, Coxiella burnetii RSA 493
gaaugcagcucuuucaau

SEQ ID NO: 2581326 - RNA, 17 nt, Coxiella burnetii RSA 493
gaauggcccaauaaaga

SEQ ID NO: 2581327 - RNA, 11 nt, Coxiella burnetii RSA 493
gaaugggaaga

SEQ ID NO: 2581328 - RNA, 19 nt, Coxiella burnetii RSA 493
gaaugggaagauuuauaac

SEQ ID NO: 2581329 - RNA, 14 nt, Coxiella burnetii RSA 493
gaaugggauugaac

SEQ ID NO: 2581330 - RNA, 21 nt, Coxiella burnetii RSA 493
gaauguuaauucgagcaucuu

SEQ ID NO: 2581331 - RNA, 21 nt, Coxiella burnetii RSA 493
gaauguuauccgguuuugguu

SEQ ID NO: 2581332 - RNA, 23 nt, Coxiella burnetii RSA 493
gaauuaaccaaucaauaaaaaua

SEQ ID NO: 2581333 - RNA, 19 nt, Coxiella burnetii RSA 493
gaggaggguaagaauaaac

SEQ ID NO: 2581334 - RNA, 15 nt, Coxiella burnetii RSA 493
gagggagcagcagcc

SEQ ID NO: 2581335 - RNA, 14 nt, Coxiella burnetii RSA 493
gagggauuuugcag

SEQ ID NO: 2581336 - RNA, 21 nt, Coxiella burnetii RSA 493
gagggauuuugcaggggauaa

SEQ ID NO: 2581337 - RNA, 14 nt, Coxiella burnetii RSA 493
gaggguaagaauaa

SEQ ID NO: 2581338 - RNA, 17 nt, Coxiella burnetii RSA 493
gagguagacuuuugcgc

SEQ ID NO: 2581339 - RNA, 19 nt, Coxiella burnetii RSA 493
gaggucguuaaaaaauucg

SEQ ID NO: 2581340 - RNA, 22 nt, Coxiella burnetii RSA 493
gagguucaucgccuugcaaaca

SEQ ID NO: 2581341 - RNA, 23 nt, Coxiella burnetii RSA 493
gagguucucuuuaucagaaaaag

SEQ ID NO: 2581342 - RNA, 16 nt, Coxiella burnetii RSA 493
gagguuucuuuccagc

SEQ ID NO: 2581343 - RNA, 15 nt, Coxiella burnetii RSA 493
gaguaaaaaaccaau

SEQ ID NO: 2581344 - RNA, 13 nt, Coxiella burnetii RSA 493
gaguaacgccagc

SEQ ID NO: 2581345 - RNA, 15 nt, Coxiella burnetii RSA 493
gaguaaugacagaaa

SEQ ID NO: 2581346 - RNA, 21 nt, Coxiella burnetii RSA 493
gaguaaugguuuugaucacac

SEQ ID NO: 2581347 - RNA, 15 nt, Coxiella burnetii RSA 493
gaguaaugucacguu

SEQ ID NO: 2581348 - RNA, 18 nt, Coxiella burnetii RSA 493
gaguauuuuuuuuaaaau

SEQ ID NO: 2581349 - RNA, 20 nt, Coxiella burnetii RSA 493
gagucaaaaauaaaaauuuc

SEQ ID NO: 2581350 - RNA, 21 nt, Coxiella burnetii RSA 493
gagucggugacgaggaaagau

SEQ ID NO: 2581351 - RNA, 23 nt, Coxiella burnetii RSA 493
gagucguauuccuuuuucuuuua

SEQ ID NO: 2581352 - RNA, 22 nt, Coxiella burnetii RSA 493
gagugagaaggguuuugugcau

SEQ ID NO: 2581353 - RNA, 14 nt, Coxiella burnetii RSA 493
gaguggcugcuucu

SEQ ID NO: 2581354 - RNA, 15 nt, Coxiella burnetii RSA 493
gaguggcugcuucuu

SEQ ID NO: 2581355 - RNA, 15 nt, Coxiella burnetii RSA 493
gagugguaaugacga

SEQ ID NO: 2581356 - RNA, 23 nt, Coxiella burnetii RSA 493
gaguggugguagaauucucccau

SEQ ID NO: 2581357 - RNA, 20 nt, Coxiella burnetii RSA 493
gaguuaauuucauaaaucaa

SEQ ID NO: 2581358 - RNA, 20 nt, Coxiella burnetii RSA 493
gaguucugucacuaauaauc

SEQ ID NO: 2581359 - RNA, 14 nt, Coxiella burnetii RSA 493
gaguuguauaaagg

SEQ ID NO: 2581360 - RNA, 16 nt, Coxiella burnetii RSA 493
gaguuuuugacaagcu

SEQ ID NO: 2581361 - RNA, 12 nt, Coxiella burnetii RSA 493
gauaaaaaaccc

SEQ ID NO: 2581362 - RNA, 13 nt, Coxiella burnetii RSA 493
gauaaaaauaaug

SEQ ID NO: 2581363 - RNA, 23 nt, Coxiella burnetii RSA 493
gauaaagagccgucauccaaacg

SEQ ID NO: 2581364 - RNA, 16 nt, Coxiella burnetii RSA 493
gauaaagugguuucga

SEQ ID NO: 2581365 - RNA, 23 nt, Coxiella burnetii RSA 493
gauaaaguguugucggcgauacg

SEQ ID NO: 2581366 - RNA, 17 nt, Coxiella burnetii RSA 493
gauaaaucgggaaacuu

SEQ ID NO: 2581367 - RNA, 16 nt, Coxiella burnetii RSA 493
gauaaauuuugaaucc

SEQ ID NO: 2581368 - RNA, 16 nt, Coxiella burnetii RSA 493
gauaacgcuucuuuua

SEQ ID NO: 2581369 - RNA, 15 nt, Coxiella burnetii RSA 493
gauaacuauuauuaa

SEQ ID NO: 2581370 - RNA, 17 nt, Coxiella burnetii RSA 493
gauaacuauuauuaaaa

SEQ ID NO: 2581371 - RNA, 23 nt, Coxiella burnetii RSA 493
gauaagcauaauucaucaaggua

SEQ ID NO: 2581372 - RNA, 19 nt, Coxiella burnetii RSA 493
gauaagccauuaaaagcag

SEQ ID NO: 2581373 - RNA, 16 nt, Coxiella burnetii RSA 493
gauaagcuguuucuuu

SEQ ID NO: 2581374 - RNA, 18 nt, Coxiella burnetii RSA 493
gauaagcuguuucuuuua

SEQ ID NO: 2581375 - RNA, 14 nt, Coxiella burnetii RSA 493
gauaagguguuuua

SEQ ID NO: 2581376 - RNA, 10 nt, Coxiella burnetii RSA 493
gauaauaauu

SEQ ID NO: 2581377 - RNA, 15 nt, Coxiella burnetii RSA 493
gauaauaauugcugu

SEQ ID NO: 2581378 - RNA, 15 nt, Coxiella burnetii RSA 493
gauaaucccaauaaa

SEQ ID NO: 2581379 - RNA, 14 nt, Coxiella burnetii RSA 493
gauaaucucaucau

SEQ ID NO: 2581380 - RNA, 16 nt, Coxiella burnetii RSA 493
gauaaucucaucaucu

SEQ ID NO: 2581381 - RNA, 18 nt, Coxiella burnetii RSA 493
gauaaugcuugcucuucu

SEQ ID NO: 2581382 - RNA, 20 nt, Coxiella burnetii RSA 493
gauaaugcuugcucuucuuc

SEQ ID NO: 2581383 - RNA, 18 nt, Coxiella burnetii RSA 493
gauaaugggguaaagcuu

SEQ ID NO: 2581384 - RNA, 15 nt, Coxiella burnetii RSA 493
gauaauuacaaucca

SEQ ID NO: 2581385 - RNA, 17 nt, Coxiella burnetii RSA 493
gauaauuacaauccaau

SEQ ID NO: 2581386 - RNA, 18 nt, Coxiella burnetii RSA 493
gauaauucauaaauaguu

SEQ ID NO: 2581387 - RNA, 17 nt, Coxiella burnetii RSA 493
gauaauugauaguucau

SEQ ID NO: 2581388 - RNA, 15 nt, Coxiella burnetii RSA 493
gauacaaauuuuuaa

SEQ ID NO: 2581389 - RNA, 12 nt, Coxiella burnetii RSA 493
gauacagccuuc

SEQ ID NO: 2581390 - RNA, 17 nt, Coxiella burnetii RSA 493
gauacagccuucaugaa

SEQ ID NO: 2581391 - RNA, 18 nt, Coxiella burnetii RSA 493
gauacagccuucaugaau

SEQ ID NO: 2581392 - RNA, 17 nt, Coxiella burnetii RSA 493
gauacaggagauauacc

SEQ ID NO: 2581393 - RNA, 23 nt, Coxiella burnetii RSA 493
gauacgcuucucguaacaaaaga

SEQ ID NO: 2581394 - RNA, 13 nt, Coxiella burnetii RSA 493
gauacuucuucau

SEQ ID NO: 2581395 - RNA, 13 nt, Coxiella burnetii RSA 493
gauacuuuguuuu

SEQ ID NO: 2581396 - RNA, 14 nt, Coxiella burnetii RSA 493
gauagacaauuuuu

SEQ ID NO: 2581397 - RNA, 16 nt, Coxiella burnetii RSA 493
gauagaccaucguuuu

SEQ ID NO: 2581398 - RNA, 21 nt, Coxiella burnetii RSA 493
gauagcgacaauuucgcuaug

SEQ ID NO: 2581399 - RNA, 18 nt, Coxiella burnetii RSA 493
gauagggaaagagcggau

SEQ ID NO: 2581400 - RNA, 15 nt, Coxiella burnetii RSA 493
gauaggugcugcaac

SEQ ID NO: 2581401 - RNA, 16 nt, Coxiella burnetii RSA 493
gauaggugcugcaacg

SEQ ID NO: 2581402 - RNA, 20 nt, Coxiella burnetii RSA 493
gauaggugcugcaacggcag

SEQ ID NO: 2581403 - RNA, 21 nt, Coxiella burnetii RSA 493
gauagucucuauaucuuuuaa

SEQ ID NO: 2581404 - RNA, 22 nt, Coxiella burnetii RSA 493
gauagucucuauaucuuuuaaa

SEQ ID NO: 2581405 - RNA, 20 nt, Coxiella burnetii RSA 493
gauagucuuugguuuuccau

SEQ ID NO: 2581406 - RNA, 15 nt, Coxiella burnetii RSA 493
gauagugcuuuuaaa

SEQ ID NO: 2581407 - RNA, 22 nt, Coxiella burnetii RSA 493
gauauaaaagcaucaauaaugc

SEQ ID NO: 2581408 - RNA, 12 nt, Coxiella burnetii RSA 493
gauauaacaccc

SEQ ID NO: 2581409 - RNA, 16 nt, Coxiella burnetii RSA 493
gauauccuucuuuuaa

SEQ ID NO: 2581410 - RNA, 18 nt, Coxiella burnetii RSA 493
gauaucgacacaaacgau

SEQ ID NO: 2581411 - RNA, 18 nt, Coxiella burnetii RSA 493
gauaucuccauuuucaag

SEQ ID NO: 2581412 - RNA, 19 nt, Coxiella burnetii RSA 493
gauaucuccauuuucaagu

SEQ ID NO: 2581413 - RNA, 18 nt, Coxiella burnetii RSA 493
gauaugaaugagcugcuu

SEQ ID NO: 2581414 - RNA, 22 nt, Coxiella burnetii RSA 493
gauauguuucaauaacagagau

SEQ ID NO: 2581415 - RNA, 24 nt, Coxiella burnetii RSA 493
gauauuaucaaaacguagaaguuu

SEQ ID NO: 2581416 - RNA, 17 nt, Coxiella burnetii RSA 493
gauauucuaucucaagu

SEQ ID NO: 2581417 - RNA, 13 nt, Coxiella burnetii RSA 493
gauauugaacagg

SEQ ID NO: 2581418 - RNA, 17 nt, Coxiella burnetii RSA 493
gauauugauuuaaauuu

SEQ ID NO: 2581419 - RNA, 18 nt, Coxiella burnetii RSA 493
gauauugcauuguuuucu

SEQ ID NO: 2581420 - RNA, 14 nt, Coxiella burnetii RSA 493
gauauuuuaaggau

SEQ ID NO: 2581421 - RNA, 12 nt, Coxiella burnetii RSA 493
gaucaaagcgcc

SEQ ID NO: 2581422 - RNA, 14 nt, Coxiella burnetii RSA 493
gaucaagaaagaca

SEQ ID NO: 2581423 - RNA, 18 nt, Coxiella burnetii RSA 493
gaucaagacucaaagaaa

SEQ ID NO: 2581424 - RNA, 16 nt, Coxiella burnetii RSA 493
gaucaaugaaacaaac

SEQ ID NO: 2581425 - RNA, 19 nt, Coxiella burnetii RSA 493
gaucaaugaaacaaacaaa

SEQ ID NO: 2581426 - RNA, 16 nt, Coxiella burnetii RSA 493
gaucaguuuguccuug

SEQ ID NO: 2581427 - RNA, 17 nt, Coxiella burnetii RSA 493
gaucaucaucaaaauua

SEQ ID NO: 2581428 - RNA, 16 nt, Coxiella burnetii RSA 493
gaucaucgcacuugcu

SEQ ID NO: 2581429 - RNA, 16 nt, Coxiella burnetii RSA 493
gaucaugccuuuuuug

SEQ ID NO: 2581430 - RNA, 19 nt, Coxiella burnetii RSA 493
gaucaugccuuuuuugcgc

SEQ ID NO: 2581431 - RNA, 22 nt, Coxiella burnetii RSA 493
gaucauuaucucuuaaaauucc

SEQ ID NO: 2581432 - RNA, 23 nt, Coxiella burnetii RSA 493
gaucauuaucucuuaaaauuccg

SEQ ID NO: 2581433 - RNA, 17 nt, Coxiella burnetii RSA 493
gaucauuuccuagauuu

SEQ ID NO: 2581434 - RNA, 21 nt, Coxiella burnetii RSA 493
gaucccucggccaaagaaaau

SEQ ID NO: 2581435 - RNA, 21 nt, Coxiella burnetii RSA 493
gauccgucgcuuugcggccuc

SEQ ID NO: 2581436 - RNA, 21 nt, Coxiella burnetii RSA 493
gauccuugcaauaagcuauca

SEQ ID NO: 2581437 - RNA, 14 nt, Coxiella burnetii RSA 493
gaucgcauugaagu

SEQ ID NO: 2581438 - RNA, 15 nt, Coxiella burnetii RSA 493
gcaaagaucuccccu

SEQ ID NO: 2581439 - RNA, 20 nt, Coxiella burnetii RSA 493
gcaaagccgcuauuucuagc

SEQ ID NO: 2581440 - RNA, 18 nt, Coxiella burnetii RSA 493
gcaaagcucagcccaacc

SEQ ID NO: 2581441 - RNA, 18 nt, Coxiella burnetii RSA 493
gcaaaugaguaaaaaaga

SEQ ID NO: 2581442 - RNA, 21 nt, Coxiella burnetii RSA 493
gcaaauguugauaauaaaugg

SEQ ID NO: 2581443 - RNA, 14 nt, Coxiella burnetii RSA 493
gcaacaagaaaaau

SEQ ID NO: 2581444 - RNA, 21 nt, Coxiella burnetii RSA 493
gcaacgaaaauaccuuugcaa

SEQ ID NO: 2581445 - RNA, 15 nt, Coxiella burnetii RSA 493
gcaacguuugauuuu

SEQ ID NO: 2581446 - RNA, 19 nt, Coxiella burnetii RSA 493
gcaacguuugauuuucaag

SEQ ID NO: 2581447 - RNA, 18 nt, Coxiella burnetii RSA 493
gcaacuuuaacauuauca

SEQ ID NO: 2581448 - RNA, 19 nt, Coxiella burnetii RSA 493
gcaagaacauccggcucga

SEQ ID NO: 2581449 - RNA, 23 nt, Coxiella burnetii RSA 493
gcaagacaauguuaaaacacaua

SEQ ID NO: 2581450 - RNA, 17 nt, Coxiella burnetii RSA 493
gcaagaggaguucuaaa

SEQ ID NO: 2581451 - RNA, 19 nt, Coxiella burnetii RSA 493
gcaagcacugcaccauaac

SEQ ID NO: 2581452 - RNA, 16 nt, Coxiella burnetii RSA 493
gcaagcgucccaggaa

SEQ ID NO: 2581453 - RNA, 15 nt, Coxiella burnetii RSA 493
gcaagcguucuuaaa

SEQ ID NO: 2581454 - RNA, 13 nt, Coxiella burnetii RSA 493
gcaaggaauugag

SEQ ID NO: 2581455 - RNA, 15 nt, Coxiella burnetii RSA 493
gcaaggaucucaccu

SEQ ID NO: 2581456 - RNA, 19 nt, Coxiella burnetii RSA 493
gcaagucaucgggagcgau

SEQ ID NO: 2581457 - RNA, 15 nt, Coxiella burnetii RSA 493
gcaaguuuucuauau

SEQ ID NO: 2581458 - RNA, 15 nt, Coxiella burnetii RSA 493
gcaauaacaaauaaa

SEQ ID NO: 2581459 - RNA, 15 nt, Coxiella burnetii RSA 493
gcaauaagcuaucag

SEQ ID NO: 2581460 - RNA, 21 nt, Coxiella burnetii RSA 493
gcaauacaucuugauccuuuu

SEQ ID NO: 2581461 - RNA, 21 nt, Coxiella burnetii RSA 493
gcaauauuuagagaagguuac

SEQ ID NO: 2581462 - RNA, 15 nt, Coxiella burnetii RSA 493
gcaauccucucucuc

SEQ ID NO: 2581463 - RNA, 22 nt, Coxiella burnetii RSA 493
gcaaucggauuaacgugcucgu

SEQ ID NO: 2581464 - RNA, 24 nt, Coxiella burnetii RSA 493
gcaaucggauuaacgugcucguaa

SEQ ID NO: 2581465 - RNA, 17 nt, Coxiella burnetii RSA 493
gcaaugaaauauauaaa

SEQ ID NO: 2581466 - RNA, 16 nt, Coxiella burnetii RSA 493
gcaaugaauucaaacc

SEQ ID NO: 2581467 - RNA, 15 nt, Coxiella burnetii RSA 493
gcaaugccaccuuuu

SEQ ID NO: 2581468 - RNA, 12 nt, Coxiella burnetii RSA 493
gcaauguucuuc

SEQ ID NO: 2581469 - RNA, 20 nt, Coxiella burnetii RSA 493
gcaauuaauacauucuucag

SEQ ID NO: 2581470 - RNA, 19 nt, Coxiella burnetii RSA 493
gcaauucgcggguaaauuu

SEQ ID NO: 2581471 - RNA, 21 nt, Coxiella burnetii RSA 493
gcaauucgcggguaaauuuau

SEQ ID NO: 2581472 - RNA, 15 nt, Coxiella burnetii RSA 493
gcacaaccuugccaa

SEQ ID NO: 2581473 - RNA, 16 nt, Coxiella burnetii RSA 493
gcacaaugcuuuucuc

SEQ ID NO: 2581474 - RNA, 17 nt, Coxiella burnetii RSA 493
gcacaaugcuuuucuca

SEQ ID NO: 2581475 - RNA, 18 nt, Coxiella burnetii RSA 493
gcacaaugcuuuucucaa

SEQ ID NO: 2581476 - RNA, 15 nt, Coxiella burnetii RSA 493
gcacacuuugaugag

SEQ ID NO: 2581477 - RNA, 16 nt, Coxiella burnetii RSA 493
gcacacuuugaugagu

SEQ ID NO: 2581478 - RNA, 24 nt, Coxiella burnetii RSA 493
gcacagucacguacccaggcguag

SEQ ID NO: 2581479 - RNA, 18 nt, Coxiella burnetii RSA 493
gcacauaagcgaauaaua

SEQ ID NO: 2581480 - RNA, 14 nt, Coxiella burnetii RSA 493
gcacaucuucacgc

SEQ ID NO: 2581481 - RNA, 12 nt, Coxiella burnetii RSA 493
gcaccagggguu

SEQ ID NO: 2581482 - RNA, 21 nt, Coxiella burnetii RSA 493
gcaccguaaaacgaaucuuua

SEQ ID NO: 2581483 - RNA, 20 nt, Coxiella burnetii RSA 493
gcacgaaauaauuacaacua

SEQ ID NO: 2581484 - RNA, 16 nt, Coxiella burnetii RSA 493
gcacgggcguucaauu

SEQ ID NO: 2581485 - RNA, 14 nt, Coxiella burnetii RSA 493
gcacgguaauaaua

SEQ ID NO: 2581486 - RNA, 16 nt, Coxiella burnetii RSA 493
gcacucagaaagcaaa

SEQ ID NO: 2581487 - RNA, 17 nt, Coxiella burnetii RSA 493
gcacucuuuaauuugca

SEQ ID NO: 2581488 - RNA, 23 nt, Coxiella burnetii RSA 493
gcacugccuucgggaggcagggg

SEQ ID NO: 2581489 - RNA, 20 nt, Coxiella burnetii RSA 493
gcacuuuaaugaccaccacc

SEQ ID NO: 2581490 - RNA, 21 nt, Coxiella burnetii RSA 493
gcacuuuaaugaccaccaccc

SEQ ID NO: 2581491 - RNA, 17 nt, Coxiella burnetii RSA 493
gcagaaaagaugguugg

SEQ ID NO: 2581492 - RNA, 20 nt, Coxiella burnetii RSA 493
gcagaaacaauacucuuauu

SEQ ID NO: 2581493 - RNA, 23 nt, Coxiella burnetii RSA 493
gcagaaggcccgcuaauuguuca

SEQ ID NO: 2581494 - RNA, 20 nt, Coxiella burnetii RSA 493
gcagaauagcggauuagcau

SEQ ID NO: 2581495 - RNA, 22 nt, Coxiella burnetii RSA 493
gcagacaucuguaauuuuucuu

SEQ ID NO: 2581496 - RNA, 23 nt, Coxiella burnetii RSA 493
gcagacccauuuuuuugauucua

SEQ ID NO: 2581497 - RNA, 20 nt, Coxiella burnetii RSA 493
gcagacccgcauucuuuuau

SEQ ID NO: 2581498 - RNA, 15 nt, Coxiella burnetii RSA 493
gcagaggacagagga

SEQ ID NO: 2581499 - RNA, 18 nt, Coxiella burnetii RSA 493
gcagauaaauguuuuuua

SEQ ID NO: 2581500 - RNA, 12 nt, Coxiella burnetii RSA 493
gcagauuguaaa

SEQ ID NO: 2581501 - RNA, 20 nt, Coxiella burnetii RSA 493
gcagcaucccccaagagaac

SEQ ID NO: 2581502 - RNA, 14 nt, Coxiella burnetii RSA 493
gcagccaagucgag

SEQ ID NO: 2581503 - RNA, 14 nt, Coxiella burnetii RSA 493
gcagcgaagcgaaa

SEQ ID NO: 2581504 - RNA, 19 nt, Coxiella burnetii RSA 493
gcagcgaagcgaaauacgg

SEQ ID NO: 2581505 - RNA, 14 nt, Coxiella burnetii RSA 493
gcagcucaaacaaa

SEQ ID NO: 2581506 - RNA, 17 nt, Coxiella burnetii RSA 493
gcagcugauuucugguu

SEQ ID NO: 2581507 - RNA, 21 nt, Coxiella burnetii RSA 493
gcaggaaccaggaaaguuccc

SEQ ID NO: 2581508 - RNA, 13 nt, Coxiella burnetii RSA 493
gcaggacauacgg

SEQ ID NO: 2581509 - RNA, 22 nt, Coxiella burnetii RSA 493
gcaggauaauguuugauaucaa

SEQ ID NO: 2581510 - RNA, 20 nt, Coxiella burnetii RSA 493
gcaggcggggacgagggguu

SEQ ID NO: 2581511 - RNA, 15 nt, Coxiella burnetii RSA 493
gcaguaaauagaagc

SEQ ID NO: 2581512 - RNA, 15 nt, Coxiella burnetii RSA 493
gcaguuaaauuuuua

SEQ ID NO: 2581513 - RNA, 21 nt, Coxiella burnetii RSA 493
gcaguuaaauuuuuaauggaa

SEQ ID NO: 2581514 - RNA, 20 nt, Coxiella burnetii RSA 493
gcaguuguuagauuggugaa

SEQ ID NO: 2581515 - RNA, 14 nt, Coxiella burnetii RSA 493
gcaguuuucuucaa

SEQ ID NO: 2581516 - RNA, 19 nt, Coxiella burnetii RSA 493
gcauaaaaccgauacuuug

SEQ ID NO: 2581517 - RNA, 11 nt, Coxiella burnetii RSA 493
gcauaauaauc

SEQ ID NO: 2581518 - RNA, 14 nt, Coxiella burnetii RSA 493
gcauaauauuuucu

SEQ ID NO: 2581519 - RNA, 19 nt, Coxiella burnetii RSA 493
gcauacagcggaacaccau

SEQ ID NO: 2581520 - RNA, 17 nt, Coxiella burnetii RSA 493
gcauacgauauaaaagc

SEQ ID NO: 2581521 - RNA, 19 nt, Coxiella burnetii RSA 493
gcauacgauauaaaagcau

SEQ ID NO: 2581522 - RNA, 17 nt, Coxiella burnetii RSA 493
gcauagcauccuuaaug

SEQ ID NO: 2581523 - RNA, 18 nt, Coxiella burnetii RSA 493
gcauauaacugcaaauaa

SEQ ID NO: 2581524 - RNA, 20 nt, Coxiella burnetii RSA 493
gcauauucgaacuuuccaaa

SEQ ID NO: 2581525 - RNA, 14 nt, Coxiella burnetii RSA 493
gcauauugcaauaa

SEQ ID NO: 2581526 - RNA, 15 nt, Coxiella burnetii RSA 493
gcaucacgcucgagg

SEQ ID NO: 2581527 - RNA, 18 nt, Coxiella burnetii RSA 493
gcaucaggcuaucgccau

SEQ ID NO: 2581528 - RNA, 17 nt, Coxiella burnetii RSA 493
gcaucccccaagagaac

SEQ ID NO: 2581529 - RNA, 12 nt, Coxiella burnetii RSA 493
gcauccuuaaug

SEQ ID NO: 2581530 - RNA, 18 nt, Coxiella burnetii RSA 493
gcaucgagaagucgcucc

SEQ ID NO: 2581531 - RNA, 23 nt, Coxiella burnetii RSA 493
gcaucguuaaacucggcuuuaua

SEQ ID NO: 2581532 - RNA, 20 nt, Coxiella burnetii RSA 493
gcaucuuuucugaaacauca

SEQ ID NO: 2581533 - RNA, 14 nt, Coxiella burnetii RSA 493
gcaucuuuuucucc

SEQ ID NO: 2581534 - RNA, 13 nt, Coxiella burnetii RSA 493
gcaucuuuuugca

SEQ ID NO: 2581535 - RNA, 14 nt, Coxiella burnetii RSA 493
gcaugaaauuuuug

SEQ ID NO: 2581536 - RNA, 18 nt, Coxiella burnetii RSA 493
gcaugauacaaauuuuua

SEQ ID NO: 2581537 - RNA, 13 nt, Coxiella burnetii RSA 493
gcaugccaaauuc

SEQ ID NO: 2581538 - RNA, 20 nt, Coxiella burnetii RSA 493
gcaugcccauaaauaacuuc

SEQ ID NO: 2581539 - RNA, 17 nt, Coxiella burnetii RSA 493
gcauuaaaaaauaagaa

SEQ ID NO: 2581540 - RNA, 15 nt, Coxiella burnetii RSA 493
gcauucauucuuuuu

SEQ ID NO: 2581541 - RNA, 14 nt, Coxiella burnetii RSA 493
gcauucuauuagcu

SEQ ID NO: 2581542 - RNA, 18 nt, Coxiella burnetii RSA 493
gcauuguuggaaauaaug

SEQ ID NO: 2581543 - RNA, 19 nt, Coxiella burnetii RSA 493
gcgaucaagacucaaagaa

SEQ ID NO: 2581544 - RNA, 18 nt, Coxiella burnetii RSA 493
gcgauuaaaaguguagua

SEQ ID NO: 2581545 - RNA, 11 nt, Coxiella burnetii RSA 493
gcgauucauuc

SEQ ID NO: 2581546 - RNA, 18 nt, Coxiella burnetii RSA 493
gcgauuggcgcaucaaaa

SEQ ID NO: 2581547 - RNA, 17 nt, Coxiella burnetii RSA 493
gcgauuuauuucuucua

SEQ ID NO: 2581548 - RNA, 16 nt, Coxiella burnetii RSA 493
gcgcaagacaauguua

SEQ ID NO: 2581549 - RNA, 20 nt, Coxiella burnetii RSA 493
gcgcaauacuuucugaagaa

SEQ ID NO: 2581550 - RNA, 19 nt, Coxiella burnetii RSA 493
gcgcaccagggguuauaaa

SEQ ID NO: 2581551 - RNA, 14 nt, Coxiella burnetii RSA 493
gcgcacucaaccag

SEQ ID NO: 2581552 - RNA, 20 nt, Coxiella burnetii RSA 493
gcgcacucaaccagaaauau

SEQ ID NO: 2581553 - RNA, 15 nt, Coxiella burnetii RSA 493
gcgcauaaacuuuaa

SEQ ID NO: 2581554 - RNA, 18 nt, Coxiella burnetii RSA 493
gcgccagagauuuuuuuc

SEQ ID NO: 2581555 - RNA, 14 nt, Coxiella burnetii RSA 493
gcgccaucaaccaa

SEQ ID NO: 2581556 - RNA, 16 nt, Coxiella burnetii RSA 493
gcgcccaaaugaucgg

SEQ ID NO: 2581557 - RNA, 17 nt, Coxiella burnetii RSA 493
gcgccccucaagcaaag

SEQ ID NO: 2581558 - RNA, 18 nt, Coxiella burnetii RSA 493
gcgccgacucuaauugag

SEQ ID NO: 2581559 - RNA, 24 nt, Coxiella burnetii RSA 493
gcgcgaugggggguucuaacgcaa

SEQ ID NO: 2581560 - RNA, 20 nt, Coxiella burnetii RSA 493
gcgcgauguagccuaaccaa

SEQ ID NO: 2581561 - RNA, 17 nt, Coxiella burnetii RSA 493
gcgcgcuaaagcgcgcu

SEQ ID NO: 2581562 - RNA, 17 nt, Coxiella burnetii RSA 493
gcgcguaaaauuccacc

SEQ ID NO: 2581563 - RNA, 21 nt, Coxiella burnetii RSA 493
gcgcguuuuuuuaucuggcca

SEQ ID NO: 2581564 - RNA, 21 nt, Coxiella burnetii RSA 493
gcgcuaaugagaaacgugaga

SEQ ID NO: 2581565 - RNA, 16 nt, Coxiella burnetii RSA 493
gcgcucauuuucacua

SEQ ID NO: 2581566 - RNA, 20 nt, Coxiella burnetii RSA 493
gcgcuccauugagugguggu

SEQ ID NO: 2581567 - RNA, 20 nt, Coxiella burnetii RSA 493
gcgcuuucguguagcccuug

SEQ ID NO: 2581568 - RNA, 21 nt, Coxiella burnetii RSA 493
gcgcuuuuggcuacuuucuca

SEQ ID NO: 2581569 - RNA, 22 nt, Coxiella burnetii RSA 493
gcgcuuuuggcuacuuucucaa

SEQ ID NO: 2581570 - RNA, 15 nt, Coxiella burnetii RSA 493
gcggaaaaggagaaa

SEQ ID NO: 2581571 - RNA, 21 nt, Coxiella burnetii RSA 493
gcggaaaauuuaaaccacuau

SEQ ID NO: 2581572 - RNA, 15 nt, Coxiella burnetii RSA 493
gcggaagggggucuu

SEQ ID NO: 2581573 - RNA, 18 nt, Coxiella burnetii RSA 493
gcggacaauaagagcucc

SEQ ID NO: 2581574 - RNA, 21 nt, Coxiella burnetii RSA 493
gcggauaagccauuaaaagca

SEQ ID NO: 2581575 - RNA, 14 nt, Coxiella burnetii RSA 493
gcggauuaaaaaac

SEQ ID NO: 2581576 - RNA, 16 nt, Coxiella burnetii RSA 493
gcggcugaauucaaac

SEQ ID NO: 2581577 - RNA, 18 nt, Coxiella burnetii RSA 493
gcggcuuuuucaaugguu

SEQ ID NO: 2581578 - RNA, 14 nt, Coxiella burnetii RSA 493
gcgggaagggcgag

SEQ ID NO: 2581579 - RNA, 18 nt, Coxiella burnetii RSA 493
gcgggauuaauuuuccac

SEQ ID NO: 2581580 - RNA, 13 nt, Coxiella burnetii RSA 493
gcggguuauguga

SEQ ID NO: 2581581 - RNA, 15 nt, Coxiella burnetii RSA 493
gcgguacuuaagaaa

SEQ ID NO: 2581582 - RNA, 19 nt, Coxiella burnetii RSA 493
gcgguuguaauaaugucug

SEQ ID NO: 2581583 - RNA, 17 nt, Coxiella burnetii RSA 493
gcguaaucaauaaaacu

SEQ ID NO: 2581584 - RNA, 21 nt, Coxiella burnetii RSA 493
gcgucaacuuaagagagcgag

SEQ ID NO: 2581585 - RNA, 23 nt, Coxiella burnetii RSA 493
gcgucgucccaaaaaacuuagcc

SEQ ID NO: 2581586 - RNA, 12 nt, Coxiella burnetii RSA 493
gcgugcuguccg

SEQ ID NO: 2581587 - RNA, 18 nt, Coxiella burnetii RSA 493
gcguuaauugaagaauug

SEQ ID NO: 2581588 - RNA, 12 nt, Coxiella burnetii RSA 493
gcguucaauuau

SEQ ID NO: 2581589 - RNA, 21 nt, Coxiella burnetii RSA 493
gcguugaaaacgcgaguguuu

SEQ ID NO: 2581590 - RNA, 17 nt, Coxiella burnetii RSA 493
gcguuguggacuuguuc

SEQ ID NO: 2581591 - RNA, 16 nt, Coxiella burnetii RSA 493
gcguuuaagaggaccu

SEQ ID NO: 2581592 - RNA, 17 nt, Coxiella burnetii RSA 493
gcguuuccuccguaauu

SEQ ID NO: 2581593 - RNA, 12 nt, Coxiella burnetii RSA 493
gcguuuuuaaau

SEQ ID NO: 2581594 - RNA, 21 nt, Coxiella burnetii RSA 493
gcguuuuuuuauuaucaucgc

SEQ ID NO: 2581595 - RNA, 23 nt, Coxiella burnetii RSA 493
gcuaaacgugcgacuucuaguuu

SEQ ID NO: 2581596 - RNA, 20 nt, Coxiella burnetii RSA 493
gcuaaagcaaaaguaauauu

SEQ ID NO: 2581597 - RNA, 12 nt, Coxiella burnetii RSA 493
gcuaaagguuuc

SEQ ID NO: 2581598 - RNA, 15 nt, Coxiella burnetii RSA 493
gcuaaaucucucggu

SEQ ID NO: 2581599 - RNA, 16 nt, Coxiella burnetii RSA 493
gcuaauaggaaaaaug

SEQ ID NO: 2581600 - RNA, 21 nt, Coxiella burnetii RSA 493
gcuaaugcuuuuuuuacuuuu

SEQ ID NO: 2581601 - RNA, 20 nt, Coxiella burnetii RSA 493
gcuaauuuuccuuuucuauu

SEQ ID NO: 2581602 - RNA, 12 nt, Coxiella burnetii RSA 493
gcuacaucuaag

SEQ ID NO: 2581603 - RNA, 15 nt, Coxiella burnetii RSA 493
gcuacgaucagccac

SEQ ID NO: 2581604 - RNA, 15 nt, Coxiella burnetii RSA 493
gcuacguuguccuga

SEQ ID NO: 2581605 - RNA, 13 nt, Coxiella burnetii RSA 493
gcuacguuuuuug

SEQ ID NO: 2581606 - RNA, 16 nt, Coxiella burnetii RSA 493
gcuacguuuuuugcau

SEQ ID NO: 2581607 - RNA, 15 nt, Coxiella burnetii RSA 493
gcuacucuuuuucuu

SEQ ID NO: 2581608 - RNA, 14 nt, Coxiella burnetii RSA 493
gcuacuuccuucuu

SEQ ID NO: 2581609 - RNA, 19 nt, Coxiella burnetii RSA 493
gcuacuuggcgacagcgcu

SEQ ID NO: 2581610 - RNA, 12 nt, Coxiella burnetii RSA 493
gcuaguaaauaa

SEQ ID NO: 2581611 - RNA, 14 nt, Coxiella burnetii RSA 493
gcuaguaaauaaaa

SEQ ID NO: 2581612 - RNA, 13 nt, Coxiella burnetii RSA 493
gcuaguccuugac

SEQ ID NO: 2581613 - RNA, 13 nt, Coxiella burnetii RSA 493
gcuaucaaggccc

SEQ ID NO: 2581614 - RNA, 14 nt, Coxiella burnetii RSA 493
gcuauuuuccuaau

SEQ ID NO: 2581615 - RNA, 23 nt, Coxiella burnetii RSA 493
gcucaacgucuuuguacuucagu

SEQ ID NO: 2581616 - RNA, 12 nt, Coxiella burnetii RSA 493
gcucaagcgaac

SEQ ID NO: 2581617 - RNA, 19 nt, Coxiella burnetii RSA 493
gcucaagcgaacgcggccu

SEQ ID NO: 2581618 - RNA, 17 nt, Coxiella burnetii RSA 493
gcucaauuguuucauga

SEQ ID NO: 2581619 - RNA, 12 nt, Coxiella burnetii RSA 493
gcucauacgggc

SEQ ID NO: 2581620 - RNA, 14 nt, Coxiella burnetii RSA 493
gcucaugaaaagca

SEQ ID NO: 2581621 - RNA, 16 nt, Coxiella burnetii RSA 493
gcucauugaaaucaau

SEQ ID NO: 2581622 - RNA, 21 nt, Coxiella burnetii RSA 493
gcuccagauuucuuauuuuua

SEQ ID NO: 2581623 - RNA, 21 nt, Coxiella burnetii RSA 493
gcuccauuguuucgaaauaua

SEQ ID NO: 2581624 - RNA, 13 nt, Coxiella burnetii RSA 493
gcuccgauaagug

SEQ ID NO: 2581625 - RNA, 18 nt, Coxiella burnetii RSA 493
gcuccuaaauuuucuugu

SEQ ID NO: 2581626 - RNA, 15 nt, Coxiella burnetii RSA 493
gcuccuuuucuucga

SEQ ID NO: 2581627 - RNA, 14 nt, Coxiella burnetii RSA 493
gcucgacuuauuug

SEQ ID NO: 2581628 - RNA, 19 nt, Coxiella burnetii RSA 493
gcucgauaucuguuuuauc

SEQ ID NO: 2581629 - RNA, 16 nt, Coxiella burnetii RSA 493
gcucgauucuuugucu

SEQ ID NO: 2581630 - RNA, 12 nt, Coxiella burnetii RSA 493
gcucuaauucug

SEQ ID NO: 2581631 - RNA, 21 nt, Coxiella burnetii RSA 493
gcucuguuuacuauaaucucg

SEQ ID NO: 2581632 - RNA, 11 nt, Coxiella burnetii RSA 493
gcucuuccaac

SEQ ID NO: 2581633 - RNA, 13 nt, Coxiella burnetii RSA 493
gcucuuuguuuau

SEQ ID NO: 2581634 - RNA, 17 nt, Coxiella burnetii RSA 493
gcucuuuuucauuucuu

SEQ ID NO: 2581635 - RNA, 20 nt, Coxiella burnetii RSA 493
gcucuuuuucauuucuucga

SEQ ID NO: 2581636 - RNA, 19 nt, Coxiella burnetii RSA 493
gcugaagcaguagcugaag

SEQ ID NO: 2581637 - RNA, 21 nt, Coxiella burnetii RSA 493
gcugaagcgccugucuaaucu

SEQ ID NO: 2581638 - RNA, 15 nt, Coxiella burnetii RSA 493
gcugaaguccuuguu

SEQ ID NO: 2581639 - RNA, 23 nt, Coxiella burnetii RSA 493
gcugaauuuuauugucauguuca

SEQ ID NO: 2581640 - RNA, 18 nt, Coxiella burnetii RSA 493
gcugacaccuagccaaau

SEQ ID NO: 2581641 - RNA, 15 nt, Coxiella burnetii RSA 493
gcugacaucuuaucu

SEQ ID NO: 2581642 - RNA, 23 nt, Coxiella burnetii RSA 493
gcugagcucauugccaaagaaau

SEQ ID NO: 2581643 - RNA, 16 nt, Coxiella burnetii RSA 493
gcugauacuucuucau

SEQ ID NO: 2581644 - RNA, 23 nt, Coxiella burnetii RSA 493
gcugaugguccggcgaacagccg

SEQ ID NO: 2581645 - RNA, 22 nt, Coxiella burnetii RSA 493
gcugauuaagguggauuuucaa

SEQ ID NO: 2581646 - RNA, 21 nt, Coxiella burnetii RSA 493
gcugauuccgaucuugguccg

SEQ ID NO: 2581647 - RNA, 16 nt, Coxiella burnetii RSA 493
gcugauuucucuuuua

SEQ ID NO: 2581648 - RNA, 14 nt, Coxiella burnetii RSA 493
gcugcaagcccuuu

SEQ ID NO: 2581649 - RNA, 12 nt, Coxiella burnetii RSA 493
ucaccuuuuccc

SEQ ID NO: 2581650 - RNA, 13 nt, Coxiella burnetii RSA 493
ucaccuuuucccu

SEQ ID NO: 2581651 - RNA, 13 nt, Coxiella burnetii RSA 493
ucacgaacgcuuu

SEQ ID NO: 2581652 - RNA, 15 nt, Coxiella burnetii RSA 493
ucacgaauuaaaaaa

SEQ ID NO: 2581653 - RNA, 20 nt, Coxiella burnetii RSA 493
ucacgaauuaaaaaauucaa

SEQ ID NO: 2581654 - RNA, 23 nt, Coxiella burnetii RSA 493
ucacgaugauucccaccaaaauu

SEQ ID NO: 2581655 - RNA, 15 nt, Coxiella burnetii RSA 493
ucacgauuuuucuca

SEQ ID NO: 2581656 - RNA, 16 nt, Coxiella burnetii RSA 493
ucacgauuuuucucau

SEQ ID NO: 2581657 - RNA, 18 nt, Coxiella burnetii RSA 493
ucacgauuuuucucauca

SEQ ID NO: 2581658 - RNA, 18 nt, Coxiella burnetii RSA 493
ucacgcgcauaaaaccga

SEQ ID NO: 2581659 - RNA, 18 nt, Coxiella burnetii RSA 493
ucacgcucgagggaaacc

SEQ ID NO: 2581660 - RNA, 16 nt, Coxiella burnetii RSA 493
ucacggccccacggaa

SEQ ID NO: 2581661 - RNA, 22 nt, Coxiella burnetii RSA 493
ucacggccccacggaaugggag

SEQ ID NO: 2581662 - RNA, 17 nt, Coxiella burnetii RSA 493
ucacgguaauccaaacc

SEQ ID NO: 2581663 - RNA, 17 nt, Coxiella burnetii RSA 493
ucacguuaucauucuua

SEQ ID NO: 2581664 - RNA, 22 nt, Coxiella burnetii RSA 493
ucacguuaucauucuuauccuu

SEQ ID NO: 2581665 - RNA, 19 nt, Coxiella burnetii RSA 493
ucacuacaaauucucccuu

SEQ ID NO: 2581666 - RNA, 15 nt, Coxiella burnetii RSA 493
ucacuagcuauucuu

SEQ ID NO: 2581667 - RNA, 16 nt, Coxiella burnetii RSA 493
ucacucgcaaaaauuu

SEQ ID NO: 2581668 - RNA, 15 nt, Coxiella burnetii RSA 493
ucacuguugagcaaa

SEQ ID NO: 2581669 - RNA, 13 nt, Coxiella burnetii RSA 493
ucacuucugcgcu

SEQ ID NO: 2581670 - RNA, 17 nt, Coxiella burnetii RSA 493
ucacuuguccuucuucu

SEQ ID NO: 2581671 - RNA, 13 nt, Coxiella burnetii RSA 493
ucacuuuauuuuc

SEQ ID NO: 2581672 - RNA, 13 nt, Coxiella burnetii RSA 493
ucacuuuuuucag

SEQ ID NO: 2581673 - RNA, 22 nt, Coxiella burnetii RSA 493
ucagaauggggcgaaggcaauu

SEQ ID NO: 2581674 - RNA, 13 nt, Coxiella burnetii RSA 493
ucagacuugcuuu

SEQ ID NO: 2581675 - RNA, 23 nt, Coxiella burnetii RSA 493
ucagcaaguugcagaguuauuau

SEQ ID NO: 2581676 - RNA, 20 nt, Coxiella burnetii RSA 493
ucagcagaaaagaugguugg

SEQ ID NO: 2581677 - RNA, 13 nt, Coxiella burnetii RSA 493
ucagcccaacuac

SEQ ID NO: 2581678 - RNA, 15 nt, Coxiella burnetii RSA 493
ucagcccaacuacgg

SEQ ID NO: 2581679 - RNA, 17 nt, Coxiella burnetii RSA 493
ucagcggggagauuaaa

SEQ ID NO: 2581680 - RNA, 20 nt, Coxiella burnetii RSA 493
ucagcggggagauuaaaaau

SEQ ID NO: 2581681 - RNA, 15 nt, Coxiella burnetii RSA 493
ucagcguuucuaugc

SEQ ID NO: 2581682 - RNA, 19 nt, Coxiella burnetii RSA 493
ucaggacacauuuuuucaa

SEQ ID NO: 2581683 - RNA, 16 nt, Coxiella burnetii RSA 493
ucaggacugaaauaau

SEQ ID NO: 2581684 - RNA, 12 nt, Coxiella burnetii RSA 493
ucaggagcaggg

SEQ ID NO: 2581685 - RNA, 15 nt, Coxiella burnetii RSA 493
ucaggcaauuuugau

SEQ ID NO: 2581686 - RNA, 20 nt, Coxiella burnetii RSA 493
ucaguaaaaacauccuccau

SEQ ID NO: 2581687 - RNA, 15 nt, Coxiella burnetii RSA 493
ucaguaauuucucga

SEQ ID NO: 2581688 - RNA, 22 nt, Coxiella burnetii RSA 493
ucaguaccaaaagcaugcccau

SEQ ID NO: 2581689 - RNA, 13 nt, Coxiella burnetii RSA 493
ucagucaccauug

SEQ ID NO: 2581690 - RNA, 18 nt, Coxiella burnetii RSA 493
ucaguguaacacggccuu

SEQ ID NO: 2581691 - RNA, 12 nt, Coxiella burnetii RSA 493
ucaguuaaaaua

SEQ ID NO: 2581692 - RNA, 14 nt, Coxiella burnetii RSA 493
ucaguuaaaauaau

SEQ ID NO: 2581693 - RNA, 20 nt, Coxiella burnetii RSA 493
ucaguuggcucauuguuaau

SEQ ID NO: 2581694 - RNA, 12 nt, Coxiella burnetii RSA 493
ucaguuggcugu

SEQ ID NO: 2581695 - RNA, 18 nt, Coxiella burnetii RSA 493
ucaguugucauguaauca

SEQ ID NO: 2581696 - RNA, 12 nt, Coxiella burnetii RSA 493
ucauaaauaaaa

SEQ ID NO: 2581697 - RNA, 19 nt, Coxiella burnetii RSA 493
ucauaaucaaaaucagaaa

SEQ ID NO: 2581698 - RNA, 16 nt, Coxiella burnetii RSA 493
ucauaaucgauaauca

SEQ ID NO: 2581699 - RNA, 16 nt, Coxiella burnetii RSA 493
ucauaauuuuauaaag

SEQ ID NO: 2581700 - RNA, 18 nt, Coxiella burnetii RSA 493
ucauacauaugaauauua

SEQ ID NO: 2581701 - RNA, 16 nt, Coxiella burnetii RSA 493
ucauacgcuuuuaccc

SEQ ID NO: 2581702 - RNA, 17 nt, Coxiella burnetii RSA 493
ucauacuuaauuucgcu

SEQ ID NO: 2581703 - RNA, 20 nt, Coxiella burnetii RSA 493
ucauagguuuuuuuaaacgu

SEQ ID NO: 2581704 - RNA, 22 nt, Coxiella burnetii RSA 493
ucauauccuuucuaacgucgca

SEQ ID NO: 2581705 - RNA, 18 nt, Coxiella burnetii RSA 493
ucauaucuuuuucaauua

SEQ ID NO: 2581706 - RNA, 17 nt, Coxiella burnetii RSA 493
ucaucaaaauuaaaauc

SEQ ID NO: 2581707 - RNA, 19 nt, Coxiella burnetii RSA 493
ucaucaaaauuaaaaucuu

SEQ ID NO: 2581708 - RNA, 23 nt, Coxiella burnetii RSA 493
ucaucaaaauucuccuuaauaaa

SEQ ID NO: 2581709 - RNA, 18 nt, Coxiella burnetii RSA 493
ucaucaauauauucgcua

SEQ ID NO: 2581710 - RNA, 22 nt, Coxiella burnetii RSA 493
ucaucaauccggugaauagcca

SEQ ID NO: 2581711 - RNA, 18 nt, Coxiella burnetii RSA 493
ucaucagcccucauuguu

SEQ ID NO: 2581712 - RNA, 19 nt, Coxiella burnetii RSA 493
ucaucauccuuaagccguc

SEQ ID NO: 2581713 - RNA, 18 nt, Coxiella burnetii RSA 493
ucaucaucuucaaaaccu

SEQ ID NO: 2581714 - RNA, 16 nt, Coxiella burnetii RSA 493
ucaucauuuuccaaaa

SEQ ID NO: 2581715 - RNA, 19 nt, Coxiella burnetii RSA 493
ucauccaaaauaugauaag

SEQ ID NO: 2581716 - RNA, 17 nt, Coxiella burnetii RSA 493
ucauccauucuuucauu

SEQ ID NO: 2581717 - RNA, 19 nt, Coxiella burnetii RSA 493
ucauccauucuuucauuau

SEQ ID NO: 2581718 - RNA, 19 nt, Coxiella burnetii RSA 493
ucauccuccgauuuauuau

SEQ ID NO: 2581719 - RNA, 23 nt, Coxiella burnetii RSA 493
ucauccucguauuccgcuucgcu

SEQ ID NO: 2581720 - RNA, 16 nt, Coxiella burnetii RSA 493
ucaucgaccucuguaa

SEQ ID NO: 2581721 - RNA, 12 nt, Coxiella burnetii RSA 493
ucaucgccaaaa

SEQ ID NO: 2581722 - RNA, 17 nt, Coxiella burnetii RSA 493
ucaucguuugauucauu

SEQ ID NO: 2581723 - RNA, 15 nt, Coxiella burnetii RSA 493
ucaucuccuuuugcu

SEQ ID NO: 2581724 - RNA, 11 nt, Coxiella burnetii RSA 493
ucaugaaaaag

SEQ ID NO: 2581725 - RNA, 13 nt, Coxiella burnetii RSA 493
ucaugaaaagcgg

SEQ ID NO: 2581726 - RNA, 15 nt, Coxiella burnetii RSA 493
ucaugagaggaugca

SEQ ID NO: 2581727 - RNA, 23 nt, Coxiella burnetii RSA 493
ucaugcaaaaaccgacgccauuu

SEQ ID NO: 2581728 - RNA, 14 nt, Coxiella burnetii RSA 493
ucaugcauuugauu

SEQ ID NO: 2581729 - RNA, 19 nt, Coxiella burnetii RSA 493
ucaugcauuugauuuucug

SEQ ID NO: 2581730 - RNA, 15 nt, Coxiella burnetii RSA 493
ucaugccuuuuuugc

SEQ ID NO: 2581731 - RNA, 17 nt, Coxiella burnetii RSA 493
ucaugccuuuuuugcgc

SEQ ID NO: 2581732 - RNA, 11 nt, Coxiella burnetii RSA 493
ucaugggaugu

SEQ ID NO: 2581733 - RNA, 17 nt, Coxiella burnetii RSA 493
ucaugggguaaaauauc

SEQ ID NO: 2581734 - RNA, 23 nt, Coxiella burnetii RSA 493
ucauguaauuuaucccacguugu

SEQ ID NO: 2581735 - RNA, 23 nt, Coxiella burnetii RSA 493
ucauguggucucuuuuuuugcgc

SEQ ID NO: 2581736 - RNA, 18 nt, Coxiella burnetii RSA 493
ucauuaaauauuucuucc

SEQ ID NO: 2581737 - RNA, 14 nt, Coxiella burnetii RSA 493
ucauuaaauuuaau

SEQ ID NO: 2581738 - RNA, 17 nt, Coxiella burnetii RSA 493
ucauuaacgaaucgucu

SEQ ID NO: 2581739 - RNA, 13 nt, Coxiella burnetii RSA 493
ucauuaagcaauu

SEQ ID NO: 2581740 - RNA, 21 nt, Coxiella burnetii RSA 493
ucauuaauccaguuuuuuaac

SEQ ID NO: 2581741 - RNA, 20 nt, Coxiella burnetii RSA 493
ucauuaaugcgucgaagcau

SEQ ID NO: 2581742 - RNA, 21 nt, Coxiella burnetii RSA 493
ucauuauugaguaaugguuuu

SEQ ID NO: 2581743 - RNA, 23 nt, Coxiella burnetii RSA 493
ucauucacuaaucgucgacaaaa

SEQ ID NO: 2581744 - RNA, 19 nt, Coxiella burnetii RSA 493
ucauucauuucaauauuuc

SEQ ID NO: 2581745 - RNA, 17 nt, Coxiella burnetii RSA 493
ucauucgaacgacuuuu

SEQ ID NO: 2581746 - RNA, 17 nt, Coxiella burnetii RSA 493
ucauucgcuuuuuugcu

SEQ ID NO: 2581747 - RNA, 18 nt, Coxiella burnetii RSA 493
ucauucgggcauacgaua

SEQ ID NO: 2581748 - RNA, 23 nt, Coxiella burnetii RSA 493
ucauucuuauccuuacaaaaaua

SEQ ID NO: 2581749 - RNA, 12 nt, Coxiella burnetii RSA 493
ucauugaaauca

SEQ ID NO: 2581750 - RNA, 15 nt, Coxiella burnetii RSA 493
ucauugaaaucaauu

SEQ ID NO: 2581751 - RNA, 13 nt, Coxiella burnetii RSA 493
ucauugaaaucug

SEQ ID NO: 2581752 - RNA, 18 nt, Coxiella burnetii RSA 493
ucauugaagaauuuguuu

SEQ ID NO: 2581753 - RNA, 16 nt, Coxiella burnetii RSA 493
ucauugacagccagca

SEQ ID NO: 2581754 - RNA, 19 nt, Coxiella burnetii RSA 493
ucauugagcgggauauuuu

SEQ ID NO: 2581755 - RNA, 13 nt, Coxiella burnetii RSA 493
ucauugccaaaga

SEQ ID NO: 2581756 - RNA, 15 nt, Coxiella burnetii RSA 493
ucauugccaaagaaa

SEQ ID NO: 2581757 - RNA, 21 nt, Coxiella burnetii RSA 493
ucauugggccauuuaacaaaa

SEQ ID NO: 2581758 - RNA, 16 nt, Coxiella burnetii RSA 493
ucauugguuuuugauu

SEQ ID NO: 2581759 - RNA, 15 nt, Coxiella burnetii RSA 493
ucauuguuaauccac

SEQ ID NO: 2581760 - RNA, 16 nt, Coxiella burnetii RSA 493
ucauuuaauuuuaaau

SEQ ID NO: 2581761 - RNA, 17 nt, Coxiella burnetii RSA 493
ucauuuccuagauuuug

SEQ ID NO: 2581762 - RNA, 19 nt, Coxiella burnetii RSA 493
ucauuugggucuccguaau

SEQ ID NO: 2581763 - RNA, 15 nt, Coxiella burnetii RSA 493
ucauuuguucuauca

SEQ ID NO: 2581764 - RNA, 15 nt, Coxiella burnetii RSA 493
ucauuuucacuauuu

SEQ ID NO: 2581765 - RNA, 16 nt, Coxiella burnetii RSA 493
ucauuuuccaaaaaau

SEQ ID NO: 2581766 - RNA, 23 nt, Coxiella burnetii RSA 493
ucauuuucucuaaugauaaucca

SEQ ID NO: 2581767 - RNA, 21 nt, Coxiella burnetii RSA 493
ucauuuugauacgcuaaccac

SEQ ID NO: 2581768 - RNA, 13 nt, Coxiella burnetii RSA 493
ucauuuugauucu

SEQ ID NO: 2581769 - RNA, 20 nt, Coxiella burnetii RSA 493
ucauuuugauucucuauuuc

SEQ ID NO: 2581770 - RNA, 14 nt, Coxiella burnetii RSA 493
ucauuuugauuuuu

SEQ ID NO: 2581771 - RNA, 21 nt, Coxiella burnetii RSA 493
ucauuuuuuauaaaauuuaau

SEQ ID NO: 2581772 - RNA, 19 nt, Coxiella burnetii RSA 493
uccaaaaacagauuuaaau

SEQ ID NO: 2581773 - RNA, 17 nt, Coxiella burnetii RSA 493
uccaaaaagauaauccc

SEQ ID NO: 2581774 - RNA, 20 nt, Coxiella burnetii RSA 493
uccaaaaagauaaucccaau

SEQ ID NO: 2581775 - RNA, 20 nt, Coxiella burnetii RSA 493
uccaaaaauuucauuuaaua

SEQ ID NO: 2581776 - RNA, 19 nt, Coxiella burnetii RSA 493
uccaaaauuugagguugaa

SEQ ID NO: 2581777 - RNA, 17 nt, Coxiella burnetii RSA 493
uccaaagcagauaaaug

SEQ ID NO: 2581778 - RNA, 14 nt, Coxiella burnetii RSA 493
uccaaauagauggu

SEQ ID NO: 2581779 - RNA, 20 nt, Coxiella burnetii RSA 493
uccaaauauuuaaauugaau

SEQ ID NO: 2581780 - RNA, 17 nt, Coxiella burnetii RSA 493
uccaaaucggcaaauac

SEQ ID NO: 2581781 - RNA, 15 nt, Coxiella burnetii RSA 493
uccaacacguauuuu

SEQ ID NO: 2581782 - RNA, 16 nt, Coxiella burnetii RSA 493
uccaacacguauuuuc

SEQ ID NO: 2581783 - RNA, 16 nt, Coxiella burnetii RSA 493
uccaacuuccuaucaa

SEQ ID NO: 2581784 - RNA, 12 nt, Coxiella burnetii RSA 493
uccaagauuuuu

SEQ ID NO: 2581785 - RNA, 14 nt, Coxiella burnetii RSA 493
uccaagauuuuuuu

SEQ ID NO: 2581786 - RNA, 18 nt, Coxiella burnetii RSA 493
uccaagauuuuuuuaagu

SEQ ID NO: 2581787 - RNA, 16 nt, Coxiella burnetii RSA 493
uccaauuauaacuauu

SEQ ID NO: 2581788 - RNA, 17 nt, Coxiella burnetii RSA 493
uccaauuauaacuauuu

SEQ ID NO: 2581789 - RNA, 22 nt, Coxiella burnetii RSA 493
uccaauuauaacuauuuuaaau

SEQ ID NO: 2581790 - RNA, 23 nt, Coxiella burnetii RSA 493
uccaauucuuuaaguguuauuuc

SEQ ID NO: 2581791 - RNA, 13 nt, Coxiella burnetii RSA 493
uccaauuguucgg

SEQ ID NO: 2581792 - RNA, 18 nt, Coxiella burnetii RSA 493
uccacaaugcauuugcgc

SEQ ID NO: 2581793 - RNA, 19 nt, Coxiella burnetii RSA 493
uccacaaugcauuugcgcu

SEQ ID NO: 2581794 - RNA, 21 nt, Coxiella burnetii RSA 493
uccaccgauguggcaaaucuc

SEQ ID NO: 2581795 - RNA, 16 nt, Coxiella burnetii RSA 493
uccacuaaugguugga

SEQ ID NO: 2581796 - RNA, 22 nt, Coxiella burnetii RSA 493
uccacucgucuggggauacacc

SEQ ID NO: 2581797 - RNA, 16 nt, Coxiella burnetii RSA 493
uccacuuguuuuucgg

SEQ ID NO: 2581798 - RNA, 18 nt, Coxiella burnetii RSA 493
uccagaccuguuaaaaac

SEQ ID NO: 2581799 - RNA, 17 nt, Coxiella burnetii RSA 493
uccagcaaacccauuuc

SEQ ID NO: 2581800 - RNA, 18 nt, Coxiella burnetii RSA 493
uccagcaguuuuuuacuu

SEQ ID NO: 2581801 - RNA, 17 nt, Coxiella burnetii RSA 493
uccagccuuuaguuuua

SEQ ID NO: 2581802 - RNA, 20 nt, Coxiella burnetii RSA 493
uccagccuuuaguuuuauuu

SEQ ID NO: 2581803 - RNA, 15 nt, Coxiella burnetii RSA 493
uccagcucguaagcg

SEQ ID NO: 2581804 - RNA, 13 nt, Coxiella burnetii RSA 493
uccaggaauugca

SEQ ID NO: 2581805 - RNA, 18 nt, Coxiella burnetii RSA 493
uccagguaguuuguuuuu

SEQ ID NO: 2581806 - RNA, 20 nt, Coxiella burnetii RSA 493
uccagguaguuuguuuuuua

SEQ ID NO: 2581807 - RNA, 14 nt, Coxiella burnetii RSA 493
uccaguauuucauc

SEQ ID NO: 2581808 - RNA, 17 nt, Coxiella burnetii RSA 493
uccagucguuuuuuaau

SEQ ID NO: 2581809 - RNA, 21 nt, Coxiella burnetii RSA 493
uccagucguuuuuuaauauuu

SEQ ID NO: 2581810 - RNA, 16 nt, Coxiella burnetii RSA 493
uccauaucguuuucac

SEQ ID NO: 2581811 - RNA, 15 nt, Coxiella burnetii RSA 493
uccaucccuccuuuu

SEQ ID NO: 2581812 - RNA, 19 nt, Coxiella burnetii RSA 493
uccauccggaugucauaau

SEQ ID NO: 2581813 - RNA, 13 nt, Coxiella burnetii RSA 493
uccaucuccuuuu

SEQ ID NO: 2581814 - RNA, 16 nt, Coxiella burnetii RSA 493
uccaucuccuuuucgu

SEQ ID NO: 2581815 - RNA, 18 nt, Coxiella burnetii RSA 493
uccaugaggccaaaaauu

SEQ ID NO: 2581816 - RNA, 16 nt, Coxiella burnetii RSA 493
uccauguuuacauuaa

SEQ ID NO: 2581817 - RNA, 15 nt, Coxiella burnetii RSA 493
uccauuaaaaacaau

SEQ ID NO: 2581818 - RNA, 15 nt, Coxiella burnetii RSA 493
uccauuacauaauuu

SEQ ID NO: 2581819 - RNA, 21 nt, Coxiella burnetii RSA 493
uccauuccaaaaacagauuua

SEQ ID NO: 2581820 - RNA, 20 nt, Coxiella burnetii RSA 493
uccauugaguggugguagaa

SEQ ID NO: 2581821 - RNA, 12 nt, Coxiella burnetii RSA 493
uccauuguuucg

SEQ ID NO: 2581822 - RNA, 14 nt, Coxiella burnetii RSA 493
uccauuuagaaaaa

SEQ ID NO: 2581823 - RNA, 13 nt, Coxiella burnetii RSA 493
uccauuuucaagu

SEQ ID NO: 2581824 - RNA, 20 nt, Coxiella burnetii RSA 493
uccauuuuuuacagugugca

SEQ ID NO: 2581825 - RNA, 20 nt, Coxiella burnetii RSA 493
ucccaaaaaacuuagccaau

SEQ ID NO: 2581826 - RNA, 15 nt, Coxiella burnetii RSA 493
ucccaaacaaucauc

SEQ ID NO: 2581827 - RNA, 17 nt, Coxiella burnetii RSA 493
ucccaagcuuuugccuu

SEQ ID NO: 2581828 - RNA, 22 nt, Coxiella burnetii RSA 493
ucccaauguuuccaaauaauga

SEQ ID NO: 2581829 - RNA, 13 nt, Coxiella burnetii RSA 493
ucccaauuucuuu

SEQ ID NO: 2581830 - RNA, 19 nt, Coxiella burnetii RSA 493
ucccaauuucuuuucuaaa

SEQ ID NO: 2581831 - RNA, 13 nt, Coxiella burnetii RSA 493
ucccaccaaaauu

SEQ ID NO: 2581832 - RNA, 15 nt, Coxiella burnetii RSA 493
ucccacguuguuuga

SEQ ID NO: 2581833 - RNA, 23 nt, Coxiella burnetii RSA 493
ucccagcguuuccaauuguuuga

SEQ ID NO: 2581834 - RNA, 16 nt, Coxiella burnetii RSA 493
ucccaggaaagaaaau

SEQ ID NO: 2581835 - RNA, 20 nt, Coxiella burnetii RSA 493
ucccaggaaagaaaaugagu

SEQ ID NO: 2581836 - RNA, 13 nt, Coxiella burnetii RSA 493
ucccauaacaagg

SEQ ID NO: 2581837 - RNA, 18 nt, Coxiella burnetii RSA 493
ucccauguccauccgcua

SEQ ID NO: 2581838 - RNA, 18 nt, Coxiella burnetii RSA 493
uccccaaaggugucaaaa

SEQ ID NO: 2581839 - RNA, 15 nt, Coxiella burnetii RSA 493
uccccaaaguuucac

SEQ ID NO: 2581840 - RNA, 18 nt, Coxiella burnetii RSA 493
uccccgaaggcgccuaau

SEQ ID NO: 2581841 - RNA, 19 nt, Coxiella burnetii RSA 493
uccccguauuucgcuucgc

SEQ ID NO: 2581842 - RNA, 20 nt, Coxiella burnetii RSA 493
uccccguauuucgcuucgcu

SEQ ID NO: 2581843 - RNA, 20 nt, Coxiella burnetii RSA 493
ucccgccugcgcgaaacgac

SEQ ID NO: 2581844 - RNA, 18 nt, Coxiella burnetii RSA 493
ucccggauaaaguguugu

SEQ ID NO: 2581845 - RNA, 17 nt, Coxiella burnetii RSA 493
ucccggcugugaauuag

SEQ ID NO: 2581846 - RNA, 15 nt, Coxiella burnetii RSA 493
ucccguauuucgcuu

SEQ ID NO: 2581847 - RNA, 19 nt, Coxiella burnetii RSA 493
ucccguauuucgcuucgcu

SEQ ID NO: 2581848 - RNA, 19 nt, Coxiella burnetii RSA 493
ucccuccuuuugaggucua

SEQ ID NO: 2581849 - RNA, 19 nt, Coxiella burnetii RSA 493
ucccucuuuaccuccuccc

SEQ ID NO: 2581850 - RNA, 13 nt, Coxiella burnetii RSA 493
ucccuucugcuga

SEQ ID NO: 2581851 - RNA, 21 nt, Coxiella burnetii RSA 493
ucccuucugcugaagcaguag

SEQ ID NO: 2581852 - RNA, 12 nt, Coxiella burnetii RSA 493
ucccuuuaaccg

SEQ ID NO: 2581853 - RNA, 21 nt, Coxiella burnetii RSA 493
uccgaauaguagguuagagag

SEQ ID NO: 2581854 - RNA, 13 nt, Coxiella burnetii RSA 493
uccgacauucuuc

SEQ ID NO: 2581855 - RNA, 21 nt, Coxiella burnetii RSA 493
uccgagcccaauaacaagcuc

SEQ ID NO: 2581856 - RNA, 18 nt, Coxiella burnetii RSA 493
uccgaucauuaccccauc

SEQ ID NO: 2581857 - RNA, 21 nt, Coxiella burnetii RSA 493
uccgcauagguauuuccuugc

SEQ ID NO: 2581858 - RNA, 17 nt, Coxiella burnetii RSA 493
uccgcauugcauuucuu

SEQ ID NO: 2581859 - RNA, 20 nt, Coxiella burnetii RSA 493
uccgccgcuugaagcuaaga

SEQ ID NO: 2581860 - RNA, 18 nt, Coxiella burnetii RSA 493
uccgccuuuauuagaaaa

SEQ ID NO: 2581861 - RNA, 19 nt, Coxiella burnetii RSA 493
uccgccuuuauuagaaaag

SEQ ID NO: 2581862 - RNA, 17 nt, Coxiella burnetii RSA 493
uccgcuuuauuuuucgc

SEQ ID NO: 2581863 - RNA, 20 nt, Coxiella burnetii RSA 493
uccgcuuugcuccauacggg

SEQ ID NO: 2581864 - RNA, 16 nt, Coxiella burnetii RSA 493
uccggaugucauaauc

SEQ ID NO: 2581865 - RNA, 20 nt, Coxiella burnetii RSA 493
uccggcguugauuuuuuaaa

SEQ ID NO: 2581866 - RNA, 13 nt, Coxiella burnetii RSA 493
uccgggaauagga

SEQ ID NO: 2581867 - RNA, 18 nt, Coxiella burnetii RSA 493
uccggguuauauuuaauu

SEQ ID NO: 2581868 - RNA, 15 nt, Coxiella burnetii RSA 493
uccguaauuuuaacg

SEQ ID NO: 2581869 - RNA, 14 nt, Coxiella burnetii RSA 493
uccguauccaucac

SEQ ID NO: 2581870 - RNA, 16 nt, Coxiella burnetii RSA 493
uccgucaauuuuucag

SEQ ID NO: 2581871 - RNA, 23 nt, Coxiella burnetii RSA 493
uccguuacaucgguuuuuccguu

SEQ ID NO: 2581872 - RNA, 23 nt, Coxiella burnetii RSA 493
uccuaaaauacuuaaaauuucuu

SEQ ID NO: 2581873 - RNA, 11 nt, Coxiella burnetii RSA 493
uccuaaaauga

SEQ ID NO: 2581874 - RNA, 16 nt, Coxiella burnetii RSA 493
uccuaagcuuucuccc

SEQ ID NO: 2581875 - RNA, 14 nt, Coxiella burnetii RSA 493
uccuaauaaaaaua

SEQ ID NO: 2581876 - RNA, 17 nt, Coxiella burnetii RSA 493
uccuaauaaaaauauua

SEQ ID NO: 2581877 - RNA, 15 nt, Coxiella burnetii RSA 493
uccuaccgcccgcca

SEQ ID NO: 2581878 - RNA, 23 nt, Coxiella burnetii RSA 493
uccucacgauagccagcaauauc

SEQ ID NO: 2581879 - RNA, 19 nt, Coxiella burnetii RSA 493
uccucacggcaauucucau

SEQ ID NO: 2581880 - RNA, 15 nt, Coxiella burnetii RSA 493
uccucagaaguuuua

SEQ ID NO: 2581881 - RNA, 17 nt, Coxiella burnetii RSA 493
uccuccccacucucuuu

SEQ ID NO: 2581882 - RNA, 21 nt, Coxiella burnetii RSA 493
uccuccccaucaguuggcugu

SEQ ID NO: 2581883 - RNA, 20 nt, Coxiella burnetii RSA 493
uccucguauuccgcuucgcu

SEQ ID NO: 2581884 - RNA, 16 nt, Coxiella burnetii RSA 493
uccucguuuuggcugc

SEQ ID NO: 2581885 - RNA, 21 nt, Coxiella burnetii RSA 493
uccucuauauaagcuuucaau

SEQ ID NO: 2581886 - RNA, 15 nt, Coxiella burnetii RSA 493
uccuguucuuuuucc

SEQ ID NO: 2581887 - RNA, 17 nt, Coxiella burnetii RSA 493
uccuguucuuuuuccau

SEQ ID NO: 2581888 - RNA, 18 nt, Coxiella burnetii RSA 493
uccuguucuuuuuccaug

SEQ ID NO: 2581889 - RNA, 23 nt, Coxiella burnetii RSA 493
uccuguucuuuuuccauguuuac

SEQ ID NO: 2581890 - RNA, 23 nt, Coxiella burnetii RSA 493
uccuuauacuaaauuguccuuuu

SEQ ID NO: 2581891 - RNA, 23 nt, Coxiella burnetii RSA 493
uccuucaaucacaaguucuucua

SEQ ID NO: 2581892 - RNA, 22 nt, Coxiella burnetii RSA 493
uccuugaggaauugcuaccugc

SEQ ID NO: 2581893 - RNA, 22 nt, Coxiella burnetii RSA 493
uccuugcaagcugcugacauug

SEQ ID NO: 2581894 - RNA, 23 nt, Coxiella burnetii RSA 493
uccuugcucaaguccuugcugaa

SEQ ID NO: 2581895 - RNA, 20 nt, Coxiella burnetii RSA 493
uccuuggaacaaaccauuca

SEQ ID NO: 2581896 - RNA, 19 nt, Coxiella burnetii RSA 493
uccuuguaauucaaauuuu

SEQ ID NO: 2581897 - RNA, 20 nt, Coxiella burnetii RSA 493
uccuuguugaauuccuuguu

SEQ ID NO: 2581898 - RNA, 18 nt, Coxiella burnetii RSA 493
uccuuguugcaauccuuu

SEQ ID NO: 2581899 - RNA, 22 nt, Coxiella burnetii RSA 493
uccuuuaucguugcugagcaaa

SEQ ID NO: 2581900 - RNA, 22 nt, Coxiella burnetii RSA 493
uccuuucugacgcuuuuucccu

SEQ ID NO: 2581901 - RNA, 12 nt, Coxiella burnetii RSA 493
uccuuuucauuu

SEQ ID NO: 2581902 - RNA, 18 nt, Coxiella burnetii RSA 493
uccuuuuuauaaaugauu

SEQ ID NO: 2581903 - RNA, 15 nt, Coxiella burnetii RSA 493
ucgaagcacaguuac

SEQ ID NO: 2581904 - RNA, 17 nt, Coxiella burnetii RSA 493
ucgaagcauuuuuuugu

SEQ ID NO: 2581905 - RNA, 17 nt, Coxiella burnetii RSA 493
ucgaagugugauucauu

SEQ ID NO: 2581906 - RNA, 19 nt, Coxiella burnetii RSA 493
ucgaagugugauucauuau

SEQ ID NO: 2581907 - RNA, 22 nt, Coxiella burnetii RSA 493
ucgaagugugauucauuaucau

SEQ ID NO: 2581908 - RNA, 23 nt, Coxiella burnetii RSA 493
ucgaagugugauucauuaucaug

SEQ ID NO: 2581909 - RNA, 16 nt, Coxiella burnetii RSA 493
ucgaauggccuuacuu

SEQ ID NO: 2581910 - RNA, 12 nt, Coxiella burnetii RSA 493
ucgaauuuguuc

SEQ ID NO: 2581911 - RNA, 22 nt, Coxiella burnetii RSA 493
ucgaauuuguucuuuaacaaga

SEQ ID NO: 2581912 - RNA, 21 nt, Coxiella burnetii RSA 493
ucgaauuuuugccaauauaaa

SEQ ID NO: 2581913 - RNA, 17 nt, Coxiella burnetii RSA 493
ucgacauaaggcugcga

SEQ ID NO: 2581914 - RNA, 23 nt, Coxiella burnetii RSA 493
ucgagcgcgauuuucucuucaac

SEQ ID NO: 2581915 - RNA, 21 nt, Coxiella burnetii RSA 493
ucgagucguucuugacaccac

SEQ ID NO: 2581916 - RNA, 15 nt, Coxiella burnetii RSA 493
ucgauaaauuuugaa

SEQ ID NO: 2581917 - RNA, 16 nt, Coxiella burnetii RSA 493
ucgauagaccaaaucc

SEQ ID NO: 2581918 - RNA, 17 nt, Coxiella burnetii RSA 493
ucgauauguuucaauaa

SEQ ID NO: 2581919 - RNA, 15 nt, Coxiella burnetii RSA 493
ucgaucccucggcca

SEQ ID NO: 2581920 - RNA, 20 nt, Coxiella burnetii RSA 493
ucgauccgagcccaauaaca

SEQ ID NO: 2581921 - RNA, 14 nt, Coxiella burnetii RSA 493
ucgauccuuuuaau

SEQ ID NO: 2581922 - RNA, 15 nt, Coxiella burnetii RSA 493
ucgauccuuuuaaua

SEQ ID NO: 2581923 - RNA, 11 nt, Coxiella burnetii RSA 493
ucgaucggcaa

SEQ ID NO: 2581924 - RNA, 20 nt, Coxiella burnetii RSA 493
ucgaugaagcugacgcuucu

SEQ ID NO: 2581925 - RNA, 11 nt, Coxiella burnetii RSA 493
ucgauuucuuu

SEQ ID NO: 2581926 - RNA, 19 nt, Coxiella burnetii RSA 493
ucgauuuuacaauaaucca

SEQ ID NO: 2581927 - RNA, 22 nt, Coxiella burnetii RSA 493
ucgauuuuuuugccggacuuuu

SEQ ID NO: 2581928 - RNA, 16 nt, Coxiella burnetii RSA 493
ucgcaacuuuuuuccu

SEQ ID NO: 2581929 - RNA, 13 nt, Coxiella burnetii RSA 493
ucgcaauccucuc

SEQ ID NO: 2581930 - RNA, 18 nt, Coxiella burnetii RSA 493
ucgcaaugcuucuucaau

SEQ ID NO: 2581931 - RNA, 20 nt, Coxiella burnetii RSA 493
ucuacagaacuuuuuuuaau

SEQ ID NO: 2581932 - RNA, 15 nt, Coxiella burnetii RSA 493
ucuaccguauuuaau

SEQ ID NO: 2581933 - RNA, 20 nt, Coxiella burnetii RSA 493
ucuacgaagcggcucuugcu

SEQ ID NO: 2581934 - RNA, 17 nt, Coxiella burnetii RSA 493
ucuacucuacucccuaa

SEQ ID NO: 2581935 - RNA, 21 nt, Coxiella burnetii RSA 493
ucuagaaaacccacucgguaa

SEQ ID NO: 2581936 - RNA, 16 nt, Coxiella burnetii RSA 493
ucuagauuuuccugcu

SEQ ID NO: 2581937 - RNA, 20 nt, Coxiella burnetii RSA 493
ucuagcauaaucuuuuuaga

SEQ ID NO: 2581938 - RNA, 17 nt, Coxiella burnetii RSA 493
ucuaggaccaaaugcga

SEQ ID NO: 2581939 - RNA, 12 nt, Coxiella burnetii RSA 493
ucuaguagaacg

SEQ ID NO: 2581940 - RNA, 17 nt, Coxiella burnetii RSA 493
ucuagugugauaaucau

SEQ ID NO: 2581941 - RNA, 15 nt, Coxiella burnetii RSA 493
ucuaguuauuuuuca

SEQ ID NO: 2581942 - RNA, 13 nt, Coxiella burnetii RSA 493
ucuauaaauaaca

SEQ ID NO: 2581943 - RNA, 15 nt, Coxiella burnetii RSA 493
ucuauaaucauuuuu

SEQ ID NO: 2581944 - RNA, 22 nt, Coxiella burnetii RSA 493
ucuauaccauacagaauuucuu

SEQ ID NO: 2581945 - RNA, 20 nt, Coxiella burnetii RSA 493
ucuauauaagcuuucaauaa

SEQ ID NO: 2581946 - RNA, 18 nt, Coxiella burnetii RSA 493
ucuauaucuuuuaaauua

SEQ ID NO: 2581947 - RNA, 19 nt, Coxiella burnetii RSA 493
ucuauaucuuuuaaauuaa

SEQ ID NO: 2581948 - RNA, 21 nt, Coxiella burnetii RSA 493
ucuauaucuuuuaaauuaaca

SEQ ID NO: 2581949 - RNA, 14 nt, Coxiella burnetii RSA 493
ucuauccaauaaac

SEQ ID NO: 2581950 - RNA, 14 nt, Coxiella burnetii RSA 493
ucuaucgaugaagc

SEQ ID NO: 2581951 - RNA, 19 nt, Coxiella burnetii RSA 493
ucuaucgccguuucugcuu

SEQ ID NO: 2581952 - RNA, 19 nt, Coxiella burnetii RSA 493
ucuaucguccccguauuuc

SEQ ID NO: 2581953 - RNA, 16 nt, Coxiella burnetii RSA 493
ucuauuagcugccauu

SEQ ID NO: 2581954 - RNA, 16 nt, Coxiella burnetii RSA 493
ucuauucccccgcaac

SEQ ID NO: 2581955 - RNA, 21 nt, Coxiella burnetii RSA 493
ucucaaagaaacgauuaaaaa

SEQ ID NO: 2581956 - RNA, 23 nt, Coxiella burnetii RSA 493
ucucaauuucaacgccucucuca

SEQ ID NO: 2581957 - RNA, 19 nt, Coxiella burnetii RSA 493
ucucacaacauuccuuucg

SEQ ID NO: 2581958 - RNA, 13 nt, Coxiella burnetii RSA 493
ucucagaaucugu

SEQ ID NO: 2581959 - RNA, 18 nt, Coxiella burnetii RSA 493
ucucaguuaaaauaauga

SEQ ID NO: 2581960 - RNA, 23 nt, Coxiella burnetii RSA 493
ucucaucugucaucaucgucaaa

SEQ ID NO: 2581961 - RNA, 16 nt, Coxiella burnetii RSA 493
ucuccaaauugggugc

SEQ ID NO: 2581962 - RNA, 14 nt, Coxiella burnetii RSA 493
ucuccaccacuuug

SEQ ID NO: 2581963 - RNA, 13 nt, Coxiella burnetii RSA 493
ucuccauuuagaa

SEQ ID NO: 2581964 - RNA, 13 nt, Coxiella burnetii RSA 493
ucuccauuuucaa

SEQ ID NO: 2581965 - RNA, 23 nt, Coxiella burnetii RSA 493
ucucccaacgagcucaaaaguug

SEQ ID NO: 2581966 - RNA, 22 nt, Coxiella burnetii RSA 493
ucucccuuaacuucucuucaaa

SEQ ID NO: 2581967 - RNA, 20 nt, Coxiella burnetii RSA 493
ucucccuuuuccugaacagg

SEQ ID NO: 2581968 - RNA, 22 nt, Coxiella burnetii RSA 493
ucuccuaccaaauaagccaaua

SEQ ID NO: 2581969 - RNA, 19 nt, Coxiella burnetii RSA 493
ucuccuuuuguuaauucuu

SEQ ID NO: 2581970 - RNA, 16 nt, Coxiella burnetii RSA 493
ucucgaaauuauuuga

SEQ ID NO: 2581971 - RNA, 13 nt, Coxiella burnetii RSA 493
ucucguucuuuua

SEQ ID NO: 2581972 - RNA, 15 nt, Coxiella burnetii RSA 493
ucucguugauaaaga

SEQ ID NO: 2581973 - RNA, 14 nt, Coxiella burnetii RSA 493
ucucuaaugauaau

SEQ ID NO: 2581974 - RNA, 18 nt, Coxiella burnetii RSA 493
ucucuauaucuuuuaaau

SEQ ID NO: 2581975 - RNA, 20 nt, Coxiella burnetii RSA 493
ucucucauaaucgauaauca

SEQ ID NO: 2581976 - RNA, 20 nt, Coxiella burnetii RSA 493
ucucucuaagauaucuguuu

SEQ ID NO: 2581977 - RNA, 14 nt, Coxiella burnetii RSA 493
ucucugcuucauug

SEQ ID NO: 2581978 - RNA, 22 nt, Coxiella burnetii RSA 493
ucucuuauugcccucguuuuau

SEQ ID NO: 2581979 - RNA, 13 nt, Coxiella burnetii RSA 493
ucucuucuuuuuu

SEQ ID NO: 2581980 - RNA, 21 nt, Coxiella burnetii RSA 493
ucucuuucauaauuuuauaaa

SEQ ID NO: 2581981 - RNA, 13 nt, Coxiella burnetii RSA 493
ucucuuuuuucca

SEQ ID NO: 2581982 - RNA, 13 nt, Coxiella burnetii RSA 493
ucucuuuuuuugc

SEQ ID NO: 2581983 - RNA, 20 nt, Coxiella burnetii RSA 493
ucugaaaauaauugaggaaa

SEQ ID NO: 2581984 - RNA, 16 nt, Coxiella burnetii RSA 493
ucugaauuaauuccca

SEQ ID NO: 2581985 - RNA, 15 nt, Coxiella burnetii RSA 493
ucugacaguuggcua

SEQ ID NO: 2581986 - RNA, 16 nt, Coxiella burnetii RSA 493
ucugacguuaucacuu

SEQ ID NO: 2581987 - RNA, 18 nt, Coxiella burnetii RSA 493
ucugauaggaauucuuuu

SEQ ID NO: 2581988 - RNA, 18 nt, Coxiella burnetii RSA 493
ucugaucgauaaaaauaa

SEQ ID NO: 2581989 - RNA, 19 nt, Coxiella burnetii RSA 493
ucugauggaugaaagauuu

SEQ ID NO: 2581990 - RNA, 22 nt, Coxiella burnetii RSA 493
ucugauuuuacgcuauuuuuua

SEQ ID NO: 2581991 - RNA, 19 nt, Coxiella burnetii RSA 493
ucugcacguaucugacagu

SEQ ID NO: 2581992 - RNA, 19 nt, Coxiella burnetii RSA 493
ucugccgcugauauuccca

SEQ ID NO: 2581993 - RNA, 14 nt, Coxiella burnetii RSA 493
ucugccuuuuuuua

SEQ ID NO: 2581994 - RNA, 23 nt, Coxiella burnetii RSA 493
ucugcgauuguuuucuuacuguu

SEQ ID NO: 2581995 - RNA, 13 nt, Coxiella burnetii RSA 493
ucugcugaagcag

SEQ ID NO: 2581996 - RNA, 14 nt, Coxiella burnetii RSA 493
ucugcuuccucuuc

SEQ ID NO: 2581997 - RNA, 15 nt, Coxiella burnetii RSA 493
ucugcuugcacaucu

SEQ ID NO: 2581998 - RNA, 20 nt, Coxiella burnetii RSA 493
ucuggcucagugauuaaauu

SEQ ID NO: 2581999 - RNA, 14 nt, Coxiella burnetii RSA 493
ucuggcuuucccuu

SEQ ID NO: 2582000 - RNA, 17 nt, Coxiella burnetii RSA 493
ucugggugauaaggauu

SEQ ID NO: 2582001 - RNA, 22 nt, Coxiella burnetii RSA 493
ucugucaucaucgucaaaugga

SEQ ID NO: 2582002 - RNA, 20 nt, Coxiella burnetii RSA 493
ucugucguuucugauuuuug

SEQ ID NO: 2582003 - RNA, 19 nt, Coxiella burnetii RSA 493
ucugugguuaauucuucuu

SEQ ID NO: 2582004 - RNA, 20 nt, Coxiella burnetii RSA 493
ucuguuagauauugaacagg

SEQ ID NO: 2582005 - RNA, 15 nt, Coxiella burnetii RSA 493
ucuguuauacuguuc

SEQ ID NO: 2582006 - RNA, 17 nt, Coxiella burnetii RSA 493
ucuguuauacuguucuu

SEQ ID NO: 2582007 - RNA, 20 nt, Coxiella burnetii RSA 493
ucuguuuucguaaucuuuaa

SEQ ID NO: 2582008 - RNA, 15 nt, Coxiella burnetii RSA 493
ucuuaaaagacguac

SEQ ID NO: 2582009 - RNA, 17 nt, Coxiella burnetii RSA 493
ucuuaaagucuucaaaa

SEQ ID NO: 2582010 - RNA, 18 nt, Coxiella burnetii RSA 493
ucuuaauacccguuucuu

SEQ ID NO: 2582011 - RNA, 17 nt, Coxiella burnetii RSA 493
ucuuaaugaaauuucuc

SEQ ID NO: 2582012 - RNA, 18 nt, Coxiella burnetii RSA 493
ucuuaauuucuaaaaauc

SEQ ID NO: 2582013 - RNA, 14 nt, Coxiella burnetii RSA 493
ucuuaauuuuuccu

SEQ ID NO: 2582014 - RNA, 21 nt, Coxiella burnetii RSA 493
ucuuaccaugguuccagaaac

SEQ ID NO: 2582015 - RNA, 21 nt, Coxiella burnetii RSA 493
ucuuauaaucuuaucaauggg

SEQ ID NO: 2582016 - RNA, 20 nt, Coxiella burnetii RSA 493
ucuuauuuugugaugcacgg

SEQ ID NO: 2582017 - RNA, 14 nt, Coxiella burnetii RSA 493
ucuucaaaaccuaa

SEQ ID NO: 2582018 - RNA, 20 nt, Coxiella burnetii RSA 493
ucuucaaaagugauuuuucu

SEQ ID NO: 2582019 - RNA, 21 nt, Coxiella burnetii RSA 493
ucuucaaaagugauuuuucuu

SEQ ID NO: 2582020 - RNA, 20 nt, Coxiella burnetii RSA 493
ucuucaacuccugaaaaaua

SEQ ID NO: 2582021 - RNA, 23 nt, Coxiella burnetii RSA 493
ucuucaacuccugaaaaauaauu

SEQ ID NO: 2582022 - RNA, 12 nt, Coxiella burnetii RSA 493
ucuucaauggca

SEQ ID NO: 2582023 - RNA, 17 nt, Coxiella burnetii RSA 493
ucuucacgcauuuccca

SEQ ID NO: 2582024 - RNA, 16 nt, Coxiella burnetii RSA 493
ucuucacggauaauau

SEQ ID NO: 2582025 - RNA, 13 nt, Coxiella burnetii RSA 493
ucuucacuuuccu

SEQ ID NO: 2582026 - RNA, 13 nt, Coxiella burnetii RSA 493
ucuucauauucuu

SEQ ID NO: 2582027 - RNA, 11 nt, Coxiella burnetii RSA 493
ucuucaucuuu

SEQ ID NO: 2582028 - RNA, 16 nt, Coxiella burnetii RSA 493
ucuucauuuauuucug

SEQ ID NO: 2582029 - RNA, 22 nt, Coxiella burnetii RSA 493
ucuuccaacacguauuuucauu

SEQ ID NO: 2582030 - RNA, 20 nt, Coxiella burnetii RSA 493
ucuuccacggaguuuucauu

SEQ ID NO: 2582031 - RNA, 18 nt, Coxiella burnetii RSA 493
ucuuccauuaauuucuuu

SEQ ID NO: 2582032 - RNA, 21 nt, Coxiella burnetii RSA 493
ucuucccauguccauccgcua

SEQ ID NO: 2582033 - RNA, 20 nt, Coxiella burnetii RSA 493
ucuuccgaaacuaaaagagg

SEQ ID NO: 2582034 - RNA, 21 nt, Coxiella burnetii RSA 493
ucuucgaagugugauucauua

SEQ ID NO: 2582035 - RNA, 19 nt, Coxiella burnetii RSA 493
ucuucgaguuucguggcuu

SEQ ID NO: 2582036 - RNA, 18 nt, Coxiella burnetii RSA 493
ucuucgcuggauuuuuua

SEQ ID NO: 2582037 - RNA, 23 nt, Coxiella burnetii RSA 493
ucuucguuauugggauuuaccuu

SEQ ID NO: 2582038 - RNA, 19 nt, Coxiella burnetii RSA 493
ucuucuaaagaauuuuuca

SEQ ID NO: 2582039 - RNA, 20 nt, Coxiella burnetii RSA 493
ucuucuuauaaucuuaucaa

SEQ ID NO: 2582040 - RNA, 16 nt, Coxiella burnetii RSA 493
ucuucuucauuuauuu

SEQ ID NO: 2582041 - RNA, 21 nt, Coxiella burnetii RSA 493
ucuucuugcaucugacauucu

SEQ ID NO: 2582042 - RNA, 12 nt, Coxiella burnetii RSA 493
ucuucuuuggcc

SEQ ID NO: 2582043 - RNA, 16 nt, Coxiella burnetii RSA 493
ucuucuuuuaagugga

SEQ ID NO: 2582044 - RNA, 22 nt, Coxiella burnetii RSA 493
ucuucuuuucuauuugguugug

SEQ ID NO: 2582045 - RNA, 15 nt, Coxiella burnetii RSA 493
ucuucuuuuuuguaa

SEQ ID NO: 2582046 - RNA, 17 nt, Coxiella burnetii RSA 493
ucuucuuuuuuguaaau

SEQ ID NO: 2582047 - RNA, 22 nt, Coxiella burnetii RSA 493
ucuugaaaaacuuccgccacua

SEQ ID NO: 2582048 - RNA, 15 nt, Coxiella burnetii RSA 493
ucuugcacauugcac

SEQ ID NO: 2582049 - RNA, 23 nt, Coxiella burnetii RSA 493
ucuugcccccauugauaauaauu

SEQ ID NO: 2582050 - RNA, 21 nt, Coxiella burnetii RSA 493
ucuugcugcaaaaacgugccg

SEQ ID NO: 2582051 - RNA, 17 nt, Coxiella burnetii RSA 493
ucuugcugcuuuugaau

SEQ ID NO: 2582052 - RNA, 18 nt, Coxiella burnetii RSA 493
ucuuggagauuuagccaa

SEQ ID NO: 2582053 - RNA, 19 nt, Coxiella burnetii RSA 493
ucuuggagauuuagccaaa

SEQ ID NO: 2582054 - RNA, 21 nt, Coxiella burnetii RSA 493
ucuuggagauuuagccaaaau

SEQ ID NO: 2582055 - RNA, 16 nt, Coxiella burnetii RSA 493
ucuuggauuuuuucgg

SEQ ID NO: 2582056 - RNA, 18 nt, Coxiella burnetii RSA 493
ucuugggcaaaaaaagaa

SEQ ID NO: 2582057 - RNA, 19 nt, Coxiella burnetii RSA 493
ucuuguaaucgcugauacu

SEQ ID NO: 2582058 - RNA, 16 nt, Coxiella burnetii RSA 493
ucuugucauucccuuu

SEQ ID NO: 2582059 - RNA, 14 nt, Coxiella burnetii RSA 493
ucuuguuccauguc

SEQ ID NO: 2582060 - RNA, 20 nt, Coxiella burnetii RSA 493
ucuuguuucuggcguaagcg

SEQ ID NO: 2582061 - RNA, 20 nt, Coxiella burnetii RSA 493
ucuuuaauacaaggaaaauc

SEQ ID NO: 2582062 - RNA, 15 nt, Coxiella burnetii RSA 493
ucuuuaauaucaaaa

SEQ ID NO: 2582063 - RNA, 18 nt, Coxiella burnetii RSA 493
ucuuuauuauaaaaaaaa

SEQ ID NO: 2582064 - RNA, 12 nt, Coxiella burnetii RSA 493
ucuuuauuuuuu

SEQ ID NO: 2582065 - RNA, 15 nt, Coxiella burnetii RSA 493
ucuuuauuuuuucuu

SEQ ID NO: 2582066 - RNA, 19 nt, Coxiella burnetii RSA 493
ucuuuauuuuuucuuugcu

SEQ ID NO: 2582067 - RNA, 15 nt, Coxiella burnetii RSA 493
ucuuucaauaucuuc

SEQ ID NO: 2582068 - RNA, 12 nt, Coxiella burnetii RSA 493
ucuuucacuaaa

SEQ ID NO: 2582069 - RNA, 21 nt, Coxiella burnetii RSA 493
ucuuucauguaauuuauccca

SEQ ID NO: 2582070 - RNA, 19 nt, Coxiella burnetii RSA 493
ucuuuccagcuucccgaua

SEQ ID NO: 2582071 - RNA, 19 nt, Coxiella burnetii RSA 493
ucuuuccaucaccuucaac

SEQ ID NO: 2582072 - RNA, 17 nt, Coxiella burnetii RSA 493
ucuuucccgacuguuca

SEQ ID NO: 2582073 - RNA, 20 nt, Coxiella burnetii RSA 493
ucuuucugaaaauucugaau

SEQ ID NO: 2582074 - RNA, 15 nt, Coxiella burnetii RSA 493
ucuuugaugugaaaa

SEQ ID NO: 2582075 - RNA, 17 nt, Coxiella burnetii RSA 493
ucuuuggguauaaauaa

SEQ ID NO: 2582076 - RNA, 16 nt, Coxiella burnetii RSA 493
ucuuuguagauucuuu

SEQ ID NO: 2582077 - RNA, 16 nt, Coxiella burnetii RSA 493
ucuuuuaauucauaaa

SEQ ID NO: 2582078 - RNA, 11 nt, Coxiella burnetii RSA 493
ucuuuuaauug

SEQ ID NO: 2582079 - RNA, 14 nt, Coxiella burnetii RSA 493
ucuuuuaauugauc

SEQ ID NO: 2582080 - RNA, 14 nt, Coxiella burnetii RSA 493
ucuuuucaacucau

SEQ ID NO: 2582081 - RNA, 21 nt, Coxiella burnetii RSA 493
ucuuuucugaaacaucaauac

SEQ ID NO: 2582082 - RNA, 12 nt, Coxiella burnetii RSA 493
ucuuuucuguuu

SEQ ID NO: 2582083 - RNA, 14 nt, Coxiella burnetii RSA 493
ucuuuuucaaucgc

SEQ ID NO: 2582084 - RNA, 15 nt, Coxiella burnetii RSA 493
ucuuuuucuccuuuu

SEQ ID NO: 2582085 - RNA, 15 nt, Coxiella burnetii RSA 493
ucuuuuugcaaauaa

SEQ ID NO: 2582086 - RNA, 21 nt, Coxiella burnetii RSA 493
ucuuuuuguaaauuuucccau

SEQ ID NO: 2582087 - RNA, 19 nt, Coxiella burnetii RSA 493
ugaaaaaacggcguauuuu

SEQ ID NO: 2582088 - RNA, 17 nt, Coxiella burnetii RSA 493
ugaaaaaauuaaauauu

SEQ ID NO: 2582089 - RNA, 21 nt, Coxiella burnetii RSA 493
ugaaaaacuuccgccacuaag

SEQ ID NO: 2582090 - RNA, 17 nt, Coxiella burnetii RSA 493
ugaaaaccuacacuuuu

SEQ ID NO: 2582091 - RNA, 22 nt, Coxiella burnetii RSA 493
ugaaaaccuacacuuuuaauca

SEQ ID NO: 2582092 - RNA, 15 nt, Coxiella burnetii RSA 493
ugaaaacguuauugu

SEQ ID NO: 2582093 - RNA, 12 nt, Coxiella burnetii RSA 493
ugaaaaguaaau

SEQ ID NO: 2582094 - RNA, 17 nt, Coxiella burnetii RSA 493
ugaaaaguaaauuuaua

SEQ ID NO: 2582095 - RNA, 22 nt, Coxiella burnetii RSA 493
ugaaaauaauugaggaaaauaa

SEQ ID NO: 2582096 - RNA, 18 nt, Coxiella burnetii RSA 493
ugaaaaucaaauuuuccg

SEQ ID NO: 2582097 - RNA, 19 nt, Coxiella burnetii RSA 493
ugaaaaugucauucaagag

SEQ ID NO: 2582098 - RNA, 23 nt, Coxiella burnetii RSA 493
ugaaacaaacaaaaaauagcgag

SEQ ID NO: 2582099 - RNA, 20 nt, Coxiella burnetii RSA 493
ugaaacggcuuguuuaagug

SEQ ID NO: 2582100 - RNA, 22 nt, Coxiella burnetii RSA 493
ugaaagaauuucucgauaaaaa

SEQ ID NO: 2582101 - RNA, 13 nt, Coxiella burnetii RSA 493
ugaaaguagaaaa

SEQ ID NO: 2582102 - RNA, 16 nt, Coxiella burnetii RSA 493
ugaaaguaguuuggug

SEQ ID NO: 2582103 - RNA, 18 nt, Coxiella burnetii RSA 493
ugaaaguuucauaagucc

SEQ ID NO: 2582104 - RNA, 15 nt, Coxiella burnetii RSA 493
ugaaauaaacagagu

SEQ ID NO: 2582105 - RNA, 20 nt, Coxiella burnetii RSA 493
ugaaauaggcuuucuuuuuc

SEQ ID NO: 2582106 - RNA, 16 nt, Coxiella burnetii RSA 493
ugaaaucaauuuucuu

SEQ ID NO: 2582107 - RNA, 21 nt, Coxiella burnetii RSA 493
ugaaaucccgagccccaaaac

SEQ ID NO: 2582108 - RNA, 19 nt, Coxiella burnetii RSA 493
ugaaaucguuuuguuuuaa

SEQ ID NO: 2582109 - RNA, 19 nt, Coxiella burnetii RSA 493
ugaaauggcgcuuucguua

SEQ ID NO: 2582110 - RNA, 20 nt, Coxiella burnetii RSA 493
ugaaauucuuguccuuuaua

SEQ ID NO: 2582111 - RNA, 18 nt, Coxiella burnetii RSA 493
ugaaauuucucauauauu

SEQ ID NO: 2582112 - RNA, 12 nt, Coxiella burnetii RSA 493
ugaaauuuuaua

SEQ ID NO: 2582113 - RNA, 18 nt, Coxiella burnetii RSA 493
ugaaauuuuuuuucuucu

SEQ ID NO: 2582114 - RNA, 23 nt, Coxiella burnetii RSA 493
ugaaauuuuuuuucuucuugcau

SEQ ID NO: 2582115 - RNA, 19 nt, Coxiella burnetii RSA 493
ugaacaggagcgauaaaau

SEQ ID NO: 2582116 - RNA, 21 nt, Coxiella burnetii RSA 493
ugaacaggagcgauaaaauaa

SEQ ID NO: 2582117 - RNA, 17 nt, Coxiella burnetii RSA 493
ugaacaggauuuucauu

SEQ ID NO: 2582118 - RNA, 21 nt, Coxiella burnetii RSA 493
ugaaccuaaauuauaaaugga

SEQ ID NO: 2582119 - RNA, 16 nt, Coxiella burnetii RSA 493
ugaacgcucuuccaac

SEQ ID NO: 2582120 - RNA, 12 nt, Coxiella burnetii RSA 493
ugaagaaauacg

SEQ ID NO: 2582121 - RNA, 15 nt, Coxiella burnetii RSA 493
ugaagaguaaaaaac

SEQ ID NO: 2582122 - RNA, 11 nt, Coxiella burnetii RSA 493
ugaagcgauug

SEQ ID NO: 2582123 - RNA, 19 nt, Coxiella burnetii RSA 493
ugaagcgcggcgaaauaca

SEQ ID NO: 2582124 - RNA, 20 nt, Coxiella burnetii RSA 493
ugaagcgcggcgaaauacag

SEQ ID NO: 2582125 - RNA, 17 nt, Coxiella burnetii RSA 493
ugaagcuauccaaauaa

SEQ ID NO: 2582126 - RNA, 23 nt, Coxiella burnetii RSA 493
ugaagcuauccaaauaaucggga

SEQ ID NO: 2582127 - RNA, 20 nt, Coxiella burnetii RSA 493
ugaaggaaauuugcauuaau

SEQ ID NO: 2582128 - RNA, 21 nt, Coxiella burnetii RSA 493
ugaaguaugugggcucacuug

SEQ ID NO: 2582129 - RNA, 15 nt, Coxiella burnetii RSA 493
ugaaguccuuaucac

SEQ ID NO: 2582130 - RNA, 13 nt, Coxiella burnetii RSA 493
ugaauaagcugau

SEQ ID NO: 2582131 - RNA, 16 nt, Coxiella burnetii RSA 493
ugaauaagcugauuaa

SEQ ID NO: 2582132 - RNA, 16 nt, Coxiella burnetii RSA 493
ugaauaauauuguaaa

SEQ ID NO: 2582133 - RNA, 17 nt, Coxiella burnetii RSA 493
ugaauaauuuuuuuaau

SEQ ID NO: 2582134 - RNA, 22 nt, Coxiella burnetii RSA 493
ugaauaccaugacggccauggc

SEQ ID NO: 2582135 - RNA, 14 nt, Coxiella burnetii RSA 493
ugaauagaaaaacu

SEQ ID NO: 2582136 - RNA, 14 nt, Coxiella burnetii RSA 493
ugaauagccagcgc

SEQ ID NO: 2582137 - RNA, 16 nt, Coxiella burnetii RSA 493
ugaaucacuucuucca

SEQ ID NO: 2582138 - RNA, 16 nt, Coxiella burnetii RSA 493
ugaauccucaguaaaa

SEQ ID NO: 2582139 - RNA, 18 nt, Coxiella burnetii RSA 493
ugaaucgaccacuguccc

SEQ ID NO: 2582140 - RNA, 15 nt, Coxiella burnetii RSA 493
ugaaugcguucuuua

SEQ ID NO: 2582141 - RNA, 19 nt, Coxiella burnetii RSA 493
ugaaugggcgcguauuuaa

SEQ ID NO: 2582142 - RNA, 14 nt, Coxiella burnetii RSA 493
ugaauuaaauauaa

SEQ ID NO: 2582143 - RNA, 19 nt, Coxiella burnetii RSA 493
ugaauuaaccaaucaauaa

SEQ ID NO: 2582144 - RNA, 20 nt, Coxiella burnetii RSA 493
ugaauuccuuguugaauucc

SEQ ID NO: 2582145 - RNA, 20 nt, Coxiella burnetii RSA 493
ugaauugaaguccuuaucac

SEQ ID NO: 2582146 - RNA, 15 nt, Coxiella burnetii RSA 493
ugaauuuuuugaaaa

SEQ ID NO: 2582147 - RNA, 14 nt, Coxiella burnetii RSA 493
ugacaaauaaagaa

SEQ ID NO: 2582148 - RNA, 18 nt, Coxiella burnetii RSA 493
ugacacccugaacauuaa

SEQ ID NO: 2582149 - RNA, 14 nt, Coxiella burnetii RSA 493
ugacauaucauucc

SEQ ID NO: 2582150 - RNA, 16 nt, Coxiella burnetii RSA 493
ugacaucuuaucuaaa

SEQ ID NO: 2582151 - RNA, 13 nt, Coxiella burnetii RSA 493
ugacauuuaaaaa

SEQ ID NO: 2582152 - RNA, 16 nt, Coxiella burnetii RSA 493
ugaccaaauaauugau

SEQ ID NO: 2582153 - RNA, 17 nt, Coxiella burnetii RSA 493
ugaccaauauccuugua

SEQ ID NO: 2582154 - RNA, 21 nt, Coxiella burnetii RSA 493
ugaccaucaaucaaaugaacu

SEQ ID NO: 2582155 - RNA, 16 nt, Coxiella burnetii RSA 493
ugaccaugguuucuuu

SEQ ID NO: 2582156 - RNA, 17 nt, Coxiella burnetii RSA 493
ugaccaugguuucuuua

SEQ ID NO: 2582157 - RNA, 21 nt, Coxiella burnetii RSA 493
ugaccggguuuacauaagaaa

SEQ ID NO: 2582158 - RNA, 14 nt, Coxiella burnetii RSA 493
ugaccuugccaucc

SEQ ID NO: 2582159 - RNA, 19 nt, Coxiella burnetii RSA 493
ugacgaaagcuaaaaaaga

SEQ ID NO: 2582160 - RNA, 23 nt, Coxiella burnetii RSA 493
ugacgauauugauuuaaauuuaa

SEQ ID NO: 2582161 - RNA, 21 nt, Coxiella burnetii RSA 493
ugacgauuguggagacugcuu

SEQ ID NO: 2582162 - RNA, 14 nt, Coxiella burnetii RSA 493
ugacgauuuuaauu

SEQ ID NO: 2582163 - RNA, 15 nt, Coxiella burnetii RSA 493
ugacgugucaucgca

SEQ ID NO: 2582164 - RNA, 15 nt, Coxiella burnetii RSA 493
ugacuaagucaaaaa

SEQ ID NO: 2582165 - RNA, 18 nt, Coxiella burnetii RSA 493
ugacuaugguaauaauaa

SEQ ID NO: 2582166 - RNA, 20 nt, Coxiella burnetii RSA 493
ugacucaggccuuuagcagg

SEQ ID NO: 2582167 - RNA, 14 nt, Coxiella burnetii RSA 493
ugacucgcgaaauu

SEQ ID NO: 2582168 - RNA, 15 nt, Coxiella burnetii RSA 493
ugacuuauuuuuauu

SEQ ID NO: 2582169 - RNA, 18 nt, Coxiella burnetii RSA 493
ugacuuauuuuuauucuu

SEQ ID NO: 2582170 - RNA, 12 nt, Coxiella burnetii RSA 493
ugacuuccagau

SEQ ID NO: 2582171 - RNA, 14 nt, Coxiella burnetii RSA 493
ugacuugucaauuu

SEQ ID NO: 2582172 - RNA, 21 nt, Coxiella burnetii RSA 493
ugacuugucaauuuaccucca

SEQ ID NO: 2582173 - RNA, 13 nt, Coxiella burnetii RSA 493
ugacuuuaacucg

SEQ ID NO: 2582174 - RNA, 18 nt, Coxiella burnetii RSA 493
ugagaaaacuuuucaucc

SEQ ID NO: 2582175 - RNA, 17 nt, Coxiella burnetii RSA 493
ugagaaacgugagagag

SEQ ID NO: 2582176 - RNA, 15 nt, Coxiella burnetii RSA 493
ugagaagaauaagug

SEQ ID NO: 2582177 - RNA, 23 nt, Coxiella burnetii RSA 493
ugagaaucucuuguauggcuggu

SEQ ID NO: 2582178 - RNA, 22 nt, Coxiella burnetii RSA 493
ugagaauggcggucacucgguu

SEQ ID NO: 2582179 - RNA, 18 nt, Coxiella burnetii RSA 493
ugagacucaguggcagcu

SEQ ID NO: 2582180 - RNA, 22 nt, Coxiella burnetii RSA 493
ugagacucaguggcagcuucuu

SEQ ID NO: 2582181 - RNA, 20 nt, Coxiella burnetii RSA 493
ugagaguagauaacgacaac

SEQ ID NO: 2582182 - RNA, 18 nt, Coxiella burnetii RSA 493
ugagagucaggaaauuga

SEQ ID NO: 2582183 - RNA, 23 nt, Coxiella burnetii RSA 493
ugagaguccuaaaauacuuaaaa

SEQ ID NO: 2582184 - RNA, 19 nt, Coxiella burnetii RSA 493
ugagauaucaauagcgcaa

SEQ ID NO: 2582185 - RNA, 18 nt, Coxiella burnetii RSA 493
ugagcaaagcguuuaugc

SEQ ID NO: 2582186 - RNA, 11 nt, Coxiella burnetii RSA 493
ugagcaagcaa

SEQ ID NO: 2582187 - RNA, 13 nt, Coxiella burnetii RSA 493
ugagcaagcagaa

SEQ ID NO: 2582188 - RNA, 13 nt, Coxiella burnetii RSA 493
ugagcaguugaac

SEQ ID NO: 2582189 - RNA, 18 nt, Coxiella burnetii RSA 493
ugagcgaacgaauacggg

SEQ ID NO: 2582190 - RNA, 20 nt, Coxiella burnetii RSA 493
ugagcgaagaaaaagaaauu

SEQ ID NO: 2582191 - RNA, 18 nt, Coxiella burnetii RSA 493
ugagcgaagcgaaauacg

SEQ ID NO: 2582192 - RNA, 19 nt, Coxiella burnetii RSA 493
ugagcgaagcgaaauacgg

SEQ ID NO: 2582193 - RNA, 21 nt, Coxiella burnetii RSA 493
ugagcgaagcgaaauacggga

SEQ ID NO: 2582194 - RNA, 22 nt, Coxiella burnetii RSA 493
ugagcgaagcgaaauacgggga

SEQ ID NO: 2582195 - RNA, 20 nt, Coxiella burnetii RSA 493
ugagcucauugccaaagaaa

SEQ ID NO: 2582196 - RNA, 22 nt, Coxiella burnetii RSA 493
ugagcucauugccaaagaaaug

SEQ ID NO: 2582197 - RNA, 13 nt, Coxiella burnetii RSA 493
ugaggaaaauaag

SEQ ID NO: 2582198 - RNA, 12 nt, Coxiella burnetii RSA 493
ugaggaagcgca

SEQ ID NO: 2582199 - RNA, 15 nt, Coxiella burnetii RSA 493
ugaggaauuuuucaa

SEQ ID NO: 2582200 - RNA, 14 nt, Coxiella burnetii RSA 493
ugagggauuuugca

SEQ ID NO: 2582201 - RNA, 19 nt, Coxiella burnetii RSA 493
ugaggucgagcguaaaaca

SEQ ID NO: 2582202 - RNA, 20 nt, Coxiella burnetii RSA 493
ugaggucgagcguaaaacac

SEQ ID NO: 2582203 - RNA, 23 nt, Coxiella burnetii RSA 493
ugaggugccgcuaaaauuuuuug

SEQ ID NO: 2582204 - RNA, 18 nt, Coxiella burnetii RSA 493
ugagguuaauaaaaaggu

SEQ ID NO: 2582205 - RNA, 21 nt, Coxiella burnetii RSA 493
ugagguuacauuaaauccaga

SEQ ID NO: 2582206 - RNA, 16 nt, Coxiella burnetii RSA 493
ugaguaaucagcaucg

SEQ ID NO: 2582207 - RNA, 21 nt, Coxiella burnetii RSA 493
ugaguagggugcgauugaaag

SEQ ID NO: 2582208 - RNA, 19 nt, Coxiella burnetii RSA 493
ugaguauggcuauuauuaa

SEQ ID NO: 2582209 - RNA, 14 nt, Coxiella burnetii RSA 493
ugaguauucaucaa

SEQ ID NO: 2582210 - RNA, 22 nt, Coxiella burnetii RSA 493
ugaguauuuggcagaauuugua

SEQ ID NO: 2582211 - RNA, 16 nt, Coxiella burnetii RSA 493
ugagucccauuuacga

SEQ ID NO: 2582212 - RNA, 20 nt, Coxiella burnetii RSA 493
ugagucggaaguucuauuuc

SEQ ID NO: 2582213 - RNA, 22 nt, Coxiella burnetii RSA 493
ugagugccacaaagucagacuu

SEQ ID NO: 2582214 - RNA, 16 nt, Coxiella burnetii RSA 493
ugaguggaaaaccacc

SEQ ID NO: 2582215 - RNA, 16 nt, Coxiella burnetii RSA 493
ugaguucgcuaaaagu

SEQ ID NO: 2582216 - RNA, 17 nt, Coxiella burnetii RSA 493
ugaguucugucacuaau

SEQ ID NO: 2582217 - RNA, 16 nt, Coxiella burnetii RSA 493
ugaguuggauuuguuu

SEQ ID NO: 2582218 - RNA, 22 nt, Coxiella burnetii RSA 493
ugaguugucauauuaauauuaa

SEQ ID NO: 2582219 - RNA, 13 nt, Coxiella burnetii RSA 493
ugauaaaauaaca

SEQ ID NO: 2582220 - RNA, 16 nt, Coxiella burnetii RSA 493
ugauaagcauaauuca

SEQ ID NO: 2582221 - RNA, 19 nt, Coxiella burnetii RSA 493
ugauaauccacaauuucaa

SEQ ID NO: 2582222 - RNA, 15 nt, Coxiella burnetii RSA 493
ugauacuucuucauu

SEQ ID NO: 2582223 - RNA, 19 nt, Coxiella burnetii RSA 493
ugauauccagguguuuuuc

SEQ ID NO: 2582224 - RNA, 15 nt, Coxiella burnetii RSA 493
ugauauccuucuuuu

SEQ ID NO: 2582225 - RNA, 16 nt, Coxiella burnetii RSA 493
ugauauccuucuuuua

SEQ ID NO: 2582226 - RNA, 14 nt, Coxiella burnetii RSA 493
ugauaugagaguag

SEQ ID NO: 2582227 - RNA, 11 nt, Coxiella burnetii RSA 493
ugauauuccca

SEQ ID NO: 2582228 - RNA, 18 nt, Coxiella burnetii RSA 493
ugauauucccaugcgcau

SEQ ID NO: 2582229 - RNA, 14 nt, Coxiella burnetii RSA 493
ugaucaaguuucuc

SEQ ID NO: 2582230 - RNA, 16 nt, Coxiella burnetii RSA 493
ugaucaaguuucuccc

SEQ ID NO: 2582231 - RNA, 23 nt, Coxiella burnetii RSA 493
ugaucaaugaaacaaacaaaaaa

SEQ ID NO: 2582232 - RNA, 20 nt, Coxiella burnetii RSA 493
ugaucaucaucaaaauuaaa

SEQ ID NO: 2582233 - RNA, 21 nt, Coxiella burnetii RSA 493
ugauccgccuuuauuagaaaa

SEQ ID NO: 2582234 - RNA, 17 nt, Coxiella burnetii RSA 493
ugauccuugcaauaagc

SEQ ID NO: 2582235 - RNA, 21 nt, Coxiella burnetii RSA 493
ugaucggaggaaauauuuaau

SEQ ID NO: 2582236 - RNA, 19 nt, Coxiella burnetii RSA 493
ugaucggcgcauuuuuauu

SEQ ID NO: 2582237 - RNA, 15 nt, Coxiella burnetii RSA 493
ugaucuaacguuuug

SEQ ID NO: 2582238 - RNA, 17 nt, Coxiella burnetii RSA 493
ugaucucuugcccccau

SEQ ID NO: 2582239 - RNA, 17 nt, Coxiella burnetii RSA 493
ugaucugcucuuuugua

SEQ ID NO: 2582240 - RNA, 20 nt, Coxiella burnetii RSA 493
ugaucuugggcaaaaaaaga

SEQ ID NO: 2582241 - RNA, 17 nt, Coxiella burnetii RSA 493
ugaugaaaucguuuugu

SEQ ID NO: 2582242 - RNA, 15 nt, Coxiella burnetii RSA 493
ugaugaauaacaaug

SEQ ID NO: 2582243 - RNA, 13 nt, Coxiella burnetii RSA 493
ugaugauguuuau

SEQ ID NO: 2582244 - RNA, 17 nt, Coxiella burnetii RSA 493
ugaugcguuuuuuuauu

SEQ ID NO: 2582245 - RNA, 19 nt, Coxiella burnetii RSA 493
ugaugcguuuuuuuauuau

SEQ ID NO: 2582246 - RNA, 20 nt, Coxiella burnetii RSA 493
ugauguaaggcaucuuuuuc

SEQ ID NO: 2582247 - RNA, 22 nt, Coxiella burnetii RSA 493
ugauguauccuaauaaaaauau

SEQ ID NO: 2582248 - RNA, 12 nt, Coxiella burnetii RSA 493
ugaugugaaaaa

SEQ ID NO: 2582249 - RNA, 16 nt, Coxiella burnetii RSA 493
ugaugugaaaaauucu

SEQ ID NO: 2582250 - RNA, 18 nt, Coxiella burnetii RSA 493
ugaugugaaaaauucuaa

SEQ ID NO: 2582251 - RNA, 14 nt, Coxiella burnetii RSA 493
ugauuaaaucaaca

SEQ ID NO: 2582252 - RNA, 14 nt, Coxiella burnetii RSA 493
ugauuaauuaaugc

SEQ ID NO: 2582253 - RNA, 11 nt, Coxiella burnetii RSA 493
ugauuauagaa

SEQ ID NO: 2582254 - RNA, 14 nt, Coxiella burnetii RSA 493
ugauucauuaucau

SEQ ID NO: 2582255 - RNA, 18 nt, Coxiella burnetii RSA 493
ugauuccggagucacuau

SEQ ID NO: 2582256 - RNA, 20 nt, Coxiella burnetii RSA 493
ugauuccuucaaucacaagu

SEQ ID NO: 2582257 - RNA, 19 nt, Coxiella burnetii RSA 493
ugauucuauacuucaucuc

SEQ ID NO: 2582258 - RNA, 17 nt, Coxiella burnetii RSA 493
ugauucucucaaagaaa

SEQ ID NO: 2582259 - RNA, 22 nt, Coxiella burnetii RSA 493
ugauugaaaaucccuuuuaauu

SEQ ID NO: 2582260 - RNA, 13 nt, Coxiella burnetii RSA 493
ugauugauuuugu

SEQ ID NO: 2582261 - RNA, 13 nt, Coxiella burnetii RSA 493
ugauuucauccuc

SEQ ID NO: 2582262 - RNA, 16 nt, Coxiella burnetii RSA 493
ugauuucguaaaacga

SEQ ID NO: 2582263 - RNA, 15 nt, Coxiella burnetii RSA 493
ugauuucucuuuuaa

SEQ ID NO: 2582264 - RNA, 14 nt, Coxiella burnetii RSA 493
ugauuuuaaaaaua

SEQ ID NO: 2582265 - RNA, 19 nt, Coxiella burnetii RSA 493
ugauuuuaaaaauaaauua

SEQ ID NO: 2582266 - RNA, 20 nt, Coxiella burnetii RSA 493
ugauuuuacgcuauuuuuua

SEQ ID NO: 2582267 - RNA, 12 nt, Coxiella burnetii RSA 493
ugauuuuuccca

SEQ ID NO: 2582268 - RNA, 13 nt, Coxiella burnetii RSA 493
ugauuuuucccaa

SEQ ID NO: 2582269 - RNA, 12 nt, Coxiella burnetii RSA 493
ugauuuuuuaaa

SEQ ID NO: 2582270 - RNA, 23 nt, Coxiella burnetii RSA 493
ugauuuuuuaaaucuuccaauuu

SEQ ID NO: 2582271 - RNA, 23 nt, Coxiella burnetii RSA 493
ugauuuuuuaaugaaaaauaggg

SEQ ID NO: 2582272 - RNA, 13 nt, Coxiella burnetii RSA 493
ugcaaaacggcau

SEQ ID NO: 2582273 - RNA, 19 nt, Coxiella burnetii RSA 493
ugcaaacaugcgaaagcaa

SEQ ID NO: 2582274 - RNA, 20 nt, Coxiella burnetii RSA 493
ugcaaacccacggcaaauaa

SEQ ID NO: 2582275 - RNA, 16 nt, Coxiella burnetii RSA 493
ugcaaaugaguaaaaa

SEQ ID NO: 2582276 - RNA, 18 nt, Coxiella burnetii RSA 493
ugcaacggcagaaacgag

SEQ ID NO: 2582277 - RNA, 18 nt, Coxiella burnetii RSA 493
ugcaacggucauuuguuc

SEQ ID NO: 2582278 - RNA, 13 nt, Coxiella burnetii RSA 493
ugcaacguccuga

SEQ ID NO: 2582279 - RNA, 22 nt, Coxiella burnetii RSA 493
ugcaagcaccgcuggcuuugau

SEQ ID NO: 2582280 - RNA, 14 nt, Coxiella burnetii RSA 493
ugcaagcguucuua

SEQ ID NO: 2582281 - RNA, 19 nt, Coxiella burnetii RSA 493
ugcaagcguuuuucaucca

SEQ ID NO: 2582282 - RNA, 23 nt, Coxiella burnetii RSA 493
ugcaagcugcgcauaaacuuuaa

SEQ ID NO: 2582283 - RNA, 15 nt, Coxiella burnetii RSA 493
ugcaauaacaaauaa

SEQ ID NO: 2582284 - RNA, 17 nt, Coxiella burnetii RSA 493
ugcaauaacaaauaaac

SEQ ID NO: 2582285 - RNA, 20 nt, Coxiella burnetii RSA 493
ugcaauaagcuaucagcaga

SEQ ID NO: 2582286 - RNA, 16 nt, Coxiella burnetii RSA 493
ugcaauaccauuuuua

SEQ ID NO: 2582287 - RNA, 21 nt, Coxiella burnetii RSA 493
ugcaauaccauuuuuaaauua

SEQ ID NO: 2582288 - RNA, 19 nt, Coxiella burnetii RSA 493
ugcaaugaauucaaaccaa

SEQ ID NO: 2582289 - RNA, 16 nt, Coxiella burnetii RSA 493
ugcaaugccagugcau

SEQ ID NO: 2582290 - RNA, 20 nt, Coxiella burnetii RSA 493
ugcaauuccauuaaaaacaa

SEQ ID NO: 2582291 - RNA, 16 nt, Coxiella burnetii RSA 493
ugcacauaagcgaaua

SEQ ID NO: 2582292 - RNA, 17 nt, Coxiella burnetii RSA 493
ugcacauaagcgaauaa

SEQ ID NO: 2582293 - RNA, 21 nt, Coxiella burnetii RSA 493
ugcaccauaacuaaaucgcgu

SEQ ID NO: 2582294 - RNA, 14 nt, Coxiella burnetii RSA 493
ugcaccauuuuccu

SEQ ID NO: 2582295 - RNA, 13 nt, Coxiella burnetii RSA 493
ugcacgaaauaau

SEQ ID NO: 2582296 - RNA, 16 nt, Coxiella burnetii RSA 493
ugcacgaugucuuuaa

SEQ ID NO: 2582297 - RNA, 22 nt, Coxiella burnetii RSA 493
ugcacgccuccagggcuuguuc

SEQ ID NO: 2582298 - RNA, 19 nt, Coxiella burnetii RSA 493
ugcacgggcaccauuuuuc

SEQ ID NO: 2582299 - RNA, 21 nt, Coxiella burnetii RSA 493
ugcacucuuuaauuugcacaa

SEQ ID NO: 2582300 - RNA, 12 nt, Coxiella burnetii RSA 493
ugcagaaacaau

SEQ ID NO: 2582301 - RNA, 13 nt, Coxiella burnetii RSA 493
ugcagaaacaaua

SEQ ID NO: 2582302 - RNA, 13 nt, Coxiella burnetii RSA 493
ugcagaguuauua

SEQ ID NO: 2582303 - RNA, 14 nt, Coxiella burnetii RSA 493
ugcagcgaagcgaa

SEQ ID NO: 2582304 - RNA, 19 nt, Coxiella burnetii RSA 493
ugcagcgaagcgaaauacg

SEQ ID NO: 2582305 - RNA, 20 nt, Coxiella burnetii RSA 493
ugcagcgaagcgaaauacgg

SEQ ID NO: 2582306 - RNA, 21 nt, Coxiella burnetii RSA 493
ugcagcgaagcgaaauacggg

SEQ ID NO: 2582307 - RNA, 18 nt, Coxiella burnetii RSA 493
ugcagcuucgugcaauuu

SEQ ID NO: 2582308 - RNA, 22 nt, Coxiella burnetii RSA 493
ugcagcuucgugcaauuucugg

SEQ ID NO: 2582309 - RNA, 19 nt, Coxiella burnetii RSA 493
ugcaggcgcguuuuauaaa

SEQ ID NO: 2582310 - RNA, 15 nt, Coxiella burnetii RSA 493
ugcagugaaauaacc

SEQ ID NO: 2582311 - RNA, 18 nt, Coxiella burnetii RSA 493
ugcauaaauuauuuuaau

SEQ ID NO: 2582312 - RNA, 21 nt, Coxiella burnetii RSA 493
ugcauaaauuauuuuaauaug

SEQ ID NO: 2582313 - RNA, 21 nt, Coxiella burnetii RSA 493
ugcauaacgggaauguuuuuu

SEQ ID NO: 2582314 - RNA, 15 nt, Coxiella burnetii RSA 493
ugcauaauauuuucu

SEQ ID NO: 2582315 - RNA, 18 nt, Coxiella burnetii RSA 493
ugcauauauuccacaauu

SEQ ID NO: 2582316 - RNA, 22 nt, Coxiella burnetii RSA 493
ugcauauauuccacaauuuucc

SEQ ID NO: 2582317 - RNA, 14 nt, Coxiella burnetii RSA 493
ugcaucgaacaacc

SEQ ID NO: 2582318 - RNA, 19 nt, Coxiella burnetii RSA 493
ugcaugaggagucaucgcc

SEQ ID NO: 2582319 - RNA, 13 nt, Coxiella burnetii RSA 493
ugcauuaaucuuc

SEQ ID NO: 2582320 - RNA, 20 nt, Coxiella burnetii RSA 493
ugcauucaauacagauuuua

SEQ ID NO: 2582321 - RNA, 16 nt, Coxiella burnetii RSA 493
ugcauucauucuuuuu

SEQ ID NO: 2582322 - RNA, 17 nt, Coxiella burnetii RSA 493
ugcauucauucuuuuuu

SEQ ID NO: 2582323 - RNA, 18 nt, Coxiella burnetii RSA 493
ugcauugcucaauauuga

SEQ ID NO: 2582324 - RNA, 14 nt, Coxiella burnetii RSA 493
ugcauuguuuucuu

SEQ ID NO: 2582325 - RNA, 18 nt, Coxiella burnetii RSA 493
ugcauuucaauggauucu

SEQ ID NO: 2582326 - RNA, 21 nt, Coxiella burnetii RSA 493
ugcauuucaauggauucuucu

SEQ ID NO: 2582327 - RNA, 14 nt, Coxiella burnetii RSA 493
ugcauuuuuaaaag

SEQ ID NO: 2582328 - RNA, 22 nt, Coxiella burnetii RSA 493
ugccaacccaaggaaccaccaa

SEQ ID NO: 2582329 - RNA, 17 nt, Coxiella burnetii RSA 493
ugccacaaagucagacu

SEQ ID NO: 2582330 - RNA, 20 nt, Coxiella burnetii RSA 493
ugccacucuuuauuauaaaa

SEQ ID NO: 2582331 - RNA, 23 nt, Coxiella burnetii RSA 493
ugccagcaauggugauuucuucc

SEQ ID NO: 2582332 - RNA, 15 nt, Coxiella burnetii RSA 493
ugccaguauuuuucu

SEQ ID NO: 2582333 - RNA, 18 nt, Coxiella burnetii RSA 493
ugccaguauuuuucuuug

SEQ ID NO: 2582334 - RNA, 22 nt, Coxiella burnetii RSA 493
ugccaguguuaauggauuccca

SEQ ID NO: 2582335 - RNA, 15 nt, Coxiella burnetii RSA 493
ugccauuugcggaaa

SEQ ID NO: 2582336 - RNA, 19 nt, Coxiella burnetii RSA 493
ugccauuugcggaaaagga

SEQ ID NO: 2582337 - RNA, 11 nt, Coxiella burnetii RSA 493
ugcccaagaac

SEQ ID NO: 2582338 - RNA, 13 nt, Coxiella burnetii RSA 493
ugcccauaaauaa

SEQ ID NO: 2582339 - RNA, 12 nt, Coxiella burnetii RSA 493
ugccccuccucu

SEQ ID NO: 2582340 - RNA, 22 nt, Coxiella burnetii RSA 493
ugcccgggugguuaacuucauu

SEQ ID NO: 2582341 - RNA, 21 nt, Coxiella burnetii RSA 493
ugcccuagugaggcuucuucc

SEQ ID NO: 2582342 - RNA, 16 nt, Coxiella burnetii RSA 493
ugcccucaaaguuuuu

SEQ ID NO: 2582343 - RNA, 16 nt, Coxiella burnetii RSA 493
ugcccucaguugucau

SEQ ID NO: 2582344 - RNA, 20 nt, Coxiella burnetii RSA 493
ugcccucaguugucauguaa

SEQ ID NO: 2582345 - RNA, 16 nt, Coxiella burnetii RSA 493
ugccgauauucuuuuu

SEQ ID NO: 2582346 - RNA, 19 nt, Coxiella burnetii RSA 493
ugccgccaggcuucauaca

SEQ ID NO: 2582347 - RNA, 20 nt, Coxiella burnetii RSA 493
ugccgccaggcuucauacag

SEQ ID NO: 2582348 - RNA, 13 nt, Coxiella burnetii RSA 493
ugccgccgaaauu

SEQ ID NO: 2582349 - RNA, 16 nt, Coxiella burnetii RSA 493
ugccgccgaaauuuaa

SEQ ID NO: 2582350 - RNA, 21 nt, Coxiella burnetii RSA 493
ugccucuuuuuguaaauuuuc

SEQ ID NO: 2582351 - RNA, 21 nt, Coxiella burnetii RSA 493
ugccugcuaggauuuccuuuu

SEQ ID NO: 2582352 - RNA, 21 nt, Coxiella burnetii RSA 493
ugcgaaauagaauuuuugacu

SEQ ID NO: 2582353 - RNA, 15 nt, Coxiella burnetii RSA 493
ugcgaaauauuuccg

SEQ ID NO: 2582354 - RNA, 12 nt, Coxiella burnetii RSA 493
ugcgagcaauaa

SEQ ID NO: 2582355 - RNA, 16 nt, Coxiella burnetii RSA 493
ugcgaggaccucucca

SEQ ID NO: 2582356 - RNA, 22 nt, Coxiella burnetii RSA 493
ugcgauaguuuuauuuaaaaaa

SEQ ID NO: 2582357 - RNA, 20 nt, Coxiella burnetii RSA 493
ugcgaugaauggaauguuaa

SEQ ID NO: 2582358 - RNA, 12 nt, Coxiella burnetii RSA 493
ugcgauuaaaag

SEQ ID NO: 2582359 - RNA, 13 nt, Coxiella burnetii RSA 493
ugcgauucuuuuu

SEQ ID NO: 2582360 - RNA, 16 nt, Coxiella burnetii RSA 493
ugcgauucuuuuucgu

SEQ ID NO: 2582361 - RNA, 18 nt, Coxiella burnetii RSA 493
ugcgcauccgccccgaaa

SEQ ID NO: 2582362 - RNA, 14 nt, Coxiella burnetii RSA 493
ugcgccagaagcgu

SEQ ID NO: 2582363 - RNA, 21 nt, Coxiella burnetii RSA 493
ugcgccgguacacaaaauuuc

SEQ ID NO: 2582364 - RNA, 14 nt, Coxiella burnetii RSA 493
ugcgccgguuuaaa

SEQ ID NO: 2582365 - RNA, 19 nt, Coxiella burnetii RSA 493
ugcgcgauguguaucccaa

SEQ ID NO: 2582366 - RNA, 20 nt, Coxiella burnetii RSA 493
ugcgcgcuaaagcgcgcugg

SEQ ID NO: 2582367 - RNA, 15 nt, Coxiella burnetii RSA 493
ugcgcuccucuauau

SEQ ID NO: 2582368 - RNA, 14 nt, Coxiella burnetii RSA 493
ugcgguauuuuucc

SEQ ID NO: 2582369 - RNA, 14 nt, Coxiella burnetii RSA 493
ugcguaaauggucg

SEQ ID NO: 2582370 - RNA, 21 nt, Coxiella burnetii RSA 493
ugcguuuccgccucaauuuca

SEQ ID NO: 2582371 - RNA, 12 nt, Coxiella burnetii RSA 493
ugcguuuuaaau

SEQ ID NO: 2582372 - RNA, 19 nt, Coxiella burnetii RSA 493
ugcuaaaaucgaugauaag

SEQ ID NO: 2582373 - RNA, 12 nt, Coxiella burnetii RSA 493
ugcuaaaccacg

SEQ ID NO: 2582374 - RNA, 18 nt, Coxiella burnetii RSA 493
ugcuagaaguauuuccau

SEQ ID NO: 2582375 - RNA, 14 nt, Coxiella burnetii RSA 493
ugcucaaaggcaua

SEQ ID NO: 2582376 - RNA, 23 nt, Coxiella burnetii RSA 493
ugcucauguagcccaacaaaaug

SEQ ID NO: 2582377 - RNA, 15 nt, Coxiella burnetii RSA 493
ugcuccaaaauaaga

SEQ ID NO: 2582378 - RNA, 13 nt, Coxiella burnetii RSA 493
ugcucgcgaaauu

SEQ ID NO: 2582379 - RNA, 21 nt, Coxiella burnetii RSA 493
ugcucguaagucguuuuaaug

SEQ ID NO: 2582380 - RNA, 14 nt, Coxiella burnetii RSA 493
ugcucuaaauuaaa

SEQ ID NO: 2582381 - RNA, 18 nt, Coxiella burnetii RSA 493
ugcucuaaauuaaaugcu

SEQ ID NO: 2582382 - RNA, 22 nt, Coxiella burnetii RSA 493
ugcucucccuuaacuucucuuc

SEQ ID NO: 2582383 - RNA, 23 nt, Coxiella burnetii RSA 493
ugcucuucuucaucuaaauuaaa

SEQ ID NO: 2582384 - RNA, 15 nt, Coxiella burnetii RSA 493
ugcucuuuauagagu

SEQ ID NO: 2582385 - RNA, 16 nt, Coxiella burnetii RSA 493
ugcucuuuuucauuuc

SEQ ID NO: 2582386 - RNA, 19 nt, Coxiella burnetii RSA 493
ugcucuuuuucauuucuuc

SEQ ID NO: 2582387 - RNA, 14 nt, Coxiella burnetii RSA 493
ugcugaacaaaagc

SEQ ID NO: 2582388 - RNA, 13 nt, Coxiella burnetii RSA 493
ugcugauccucau

SEQ ID NO: 2582389 - RNA, 21 nt, Coxiella burnetii RSA 493
ugcugcgaccuucuuuuuuau

SEQ ID NO: 2582390 - RNA, 21 nt, Coxiella burnetii RSA 493
ugcugguagugguugguuaug

SEQ ID NO: 2582391 - RNA, 17 nt, Coxiella burnetii RSA 493
ugcuuaccgaggucuuu

SEQ ID NO: 2582392 - RNA, 21 nt, Coxiella burnetii RSA 493
ugcuuaucgcagaaaauagag

SEQ ID NO: 2582393 - RNA, 12 nt, Coxiella burnetii RSA 493
ugcuuaucgggc

SEQ ID NO: 2582394 - RNA, 15 nt, Coxiella burnetii RSA 493
ugcuucaauaaaaaa

SEQ ID NO: 2582395 - RNA, 12 nt, Coxiella burnetii RSA 493
ugcuucauaccu

SEQ ID NO: 2582396 - RNA, 19 nt, Coxiella burnetii RSA 493
ugcuuccaaguaagccaua

SEQ ID NO: 2582397 - RNA, 13 nt, Coxiella burnetii RSA 493
ugcuuccaauaag

SEQ ID NO: 2582398 - RNA, 18 nt, Coxiella burnetii RSA 493
ugcuuccuuaaagcaacg

SEQ ID NO: 2582399 - RNA, 17 nt, Coxiella burnetii RSA 493
ugcuucuuccaauaaca

SEQ ID NO: 2582400 - RNA, 23 nt, Coxiella burnetii RSA 493
ugcuugacgucguuuguauucau

SEQ ID NO: 2582401 - RNA, 18 nt, Coxiella burnetii RSA 493
ugcuugcgcauccgcccc

SEQ ID NO: 2582402 - RNA, 15 nt, Coxiella burnetii RSA 493
ugcuugcucuucuuc

SEQ ID NO: 2582403 - RNA, 16 nt, Coxiella burnetii RSA 493
ugcuugcucuucuuca

SEQ ID NO: 2582404 - RNA, 22 nt, Coxiella burnetii RSA 493
ugcuugguugauucaauaaucu

SEQ ID NO: 2582405 - RNA, 15 nt, Coxiella burnetii RSA 493
ugcuuucuuuuaauu

SEQ ID NO: 2582406 - RNA, 16 nt, Coxiella burnetii RSA 493
ugcuuuuauuuaagug

SEQ ID NO: 2582407 - RNA, 16 nt, Coxiella burnetii RSA 493
ugcuuuucuuucauua

SEQ ID NO: 2582408 - RNA, 13 nt, Coxiella burnetii RSA 493
ugcuuuuuaaaac

SEQ ID NO: 2582409 - RNA, 20 nt, Coxiella burnetii RSA 493
ugcuuuuuuauaaggucuua

SEQ ID NO: 2582410 - RNA, 19 nt, Coxiella burnetii RSA 493
uggaaaaaggugcccaaga

SEQ ID NO: 2582411 - RNA, 15 nt, Coxiella burnetii RSA 493
uggaaaaucgaugga

SEQ ID NO: 2582412 - RNA, 20 nt, Coxiella burnetii RSA 493
uggaaaaucgauggaagaac

SEQ ID NO: 2582413 - RNA, 20 nt, Coxiella burnetii RSA 493
uggaaauaaugugacucauu

SEQ ID NO: 2582414 - RNA, 17 nt, Coxiella burnetii RSA 493
uggaacccguuuuaaug

SEQ ID NO: 2582415 - RNA, 20 nt, Coxiella burnetii RSA 493
uggaaucaaguagccaaaau

SEQ ID NO: 2582416 - RNA, 17 nt, Coxiella burnetii RSA 493
uggaauggauauuuuaa

SEQ ID NO: 2582417 - RNA, 15 nt, Coxiella burnetii RSA 493
uggaauuaaauaucc

SEQ ID NO: 2582418 - RNA, 20 nt, Coxiella burnetii RSA 493
uggaauuauugaauuauacu

SEQ ID NO: 2582419 - RNA, 13 nt, Coxiella burnetii RSA 493
uggaauucauaau

SEQ ID NO: 2582420 - RNA, 21 nt, Coxiella burnetii RSA 493
uggaauuuuaacaagcuggca

SEQ ID NO: 2582421 - RNA, 17 nt, Coxiella burnetii RSA 493
uggaccaccacguguau

SEQ ID NO: 2582422 - RNA, 21 nt, Coxiella burnetii RSA 493
uggacuacacgguuaguggga

SEQ ID NO: 2582423 - RNA, 22 nt, Coxiella burnetii RSA 493
uggacucgaugggaauuuuuga

SEQ ID NO: 2582424 - RNA, 18 nt, Coxiella burnetii RSA 493
uggaggacugcucuuaau

SEQ ID NO: 2582425 - RNA, 20 nt, Coxiella burnetii RSA 493
uggaguucuugcucccaagc

SEQ ID NO: 2582426 - RNA, 14 nt, Coxiella burnetii RSA 493
uggauaguuucaaa

SEQ ID NO: 2582427 - RNA, 15 nt, Coxiella burnetii RSA 493
uggauaguuucaaau

SEQ ID NO: 2582428 - RNA, 19 nt, Coxiella burnetii RSA 493
uggauaguuucaaauuucu

SEQ ID NO: 2582429 - RNA, 19 nt, Coxiella burnetii RSA 493
uggaugaaagauuuuuuua

SEQ ID NO: 2582430 - RNA, 16 nt, Coxiella burnetii RSA 493
uggauuucaucuugcu

SEQ ID NO: 2582431 - RNA, 18 nt, Coxiella burnetii RSA 493
uggauuuuaagauaaguu

SEQ ID NO: 2582432 - RNA, 15 nt, Coxiella burnetii RSA 493
uggcaauuaugaaaa

SEQ ID NO: 2582433 - RNA, 14 nt, Coxiella burnetii RSA 493
uggcaguaucuauu

SEQ ID NO: 2582434 - RNA, 14 nt, Coxiella burnetii RSA 493
uggcauagggauca

SEQ ID NO: 2582435 - RNA, 16 nt, Coxiella burnetii RSA 493
uggcauagggaucauu

SEQ ID NO: 2582436 - RNA, 19 nt, Coxiella burnetii RSA 493
uggcaucgagaagucgcuc

SEQ ID NO: 2582437 - RNA, 16 nt, Coxiella burnetii RSA 493
uggccgacaaagaagg

SEQ ID NO: 2582438 - RNA, 20 nt, Coxiella burnetii RSA 493
uggccguagaaccaaaagca

SEQ ID NO: 2582439 - RNA, 20 nt, Coxiella burnetii RSA 493
uggccuuugcgguuaaaaaa

SEQ ID NO: 2582440 - RNA, 20 nt, Coxiella burnetii RSA 493
uggcgaagccacacaaccac

SEQ ID NO: 2582441 - RNA, 13 nt, Coxiella burnetii RSA 493
uggcgccugacaa

SEQ ID NO: 2582442 - RNA, 15 nt, Coxiella burnetii RSA 493
uggcgccugacaaag

SEQ ID NO: 2582443 - RNA, 17 nt, Coxiella burnetii RSA 493
uggcgguuguaauaaug

SEQ ID NO: 2582444 - RNA, 16 nt, Coxiella burnetii RSA 493
uggcguaugaauaauu

SEQ ID NO: 2582445 - RNA, 13 nt, Coxiella burnetii RSA 493
uggcuaacucacu

SEQ ID NO: 2582446 - RNA, 20 nt, Coxiella burnetii RSA 493
uggcuccagccgaagcgcgg

SEQ ID NO: 2582447 - RNA, 21 nt, Coxiella burnetii RSA 493
uggcucccagcguuuccaauu

SEQ ID NO: 2582448 - RNA, 19 nt, Coxiella burnetii RSA 493
uggcugagcuugcgaagcc

SEQ ID NO: 2582449 - RNA, 12 nt, Coxiella burnetii RSA 493
uggcugcacagg

SEQ ID NO: 2582450 - RNA, 17 nt, Coxiella burnetii RSA 493
uggcuguacuuucacua

SEQ ID NO: 2582451 - RNA, 18 nt, Coxiella burnetii RSA 493
uggcuuggacaaaucauc

SEQ ID NO: 2582452 - RNA, 18 nt, Coxiella burnetii RSA 493
uggcuuuaucaggcgcuc

SEQ ID NO: 2582453 - RNA, 20 nt, Coxiella burnetii RSA 493
uggcuuucauuacuuggccg

SEQ ID NO: 2582454 - RNA, 18 nt, Coxiella burnetii RSA 493
ugggaacaacgaaaucua

SEQ ID NO: 2582455 - RNA, 21 nt, Coxiella burnetii RSA 493
ugggaaccgucacuucuucuc

SEQ ID NO: 2582456 - RNA, 18 nt, Coxiella burnetii RSA 493
ugggaacgcuaucaaggc

SEQ ID NO: 2582457 - RNA, 22 nt, Coxiella burnetii RSA 493
ugggaaguuuuauaacaagguu

SEQ ID NO: 2582458 - RNA, 21 nt, Coxiella burnetii RSA 493
ugggaauuuuugaauaccagc

SEQ ID NO: 2582459 - RNA, 15 nt, Coxiella burnetii RSA 493
ugggagauuuauucc

SEQ ID NO: 2582460 - RNA, 17 nt, Coxiella burnetii RSA 493
ugggagugguuauaauu

SEQ ID NO: 2582461 - RNA, 17 nt, Coxiella burnetii RSA 493
ugggaucguuaugggaa

SEQ ID NO: 2582462 - RNA, 14 nt, Coxiella burnetii RSA 493
ugggcaaaaaaaga

SEQ ID NO: 2582463 - RNA, 16 nt, Coxiella burnetii RSA 493
ugggccuacuuuauuu

SEQ ID NO: 2582464 - RNA, 17 nt, Coxiella burnetii RSA 493
ugggcgcguauuuaagg

SEQ ID NO: 2582465 - RNA, 15 nt, Coxiella burnetii RSA 493
ugggcggaauuucgg

SEQ ID NO: 2582466 - RNA, 19 nt, Coxiella burnetii RSA 493
ugggcucaugaaaaugaau

SEQ ID NO: 2582467 - RNA, 19 nt, Coxiella burnetii RSA 493
ugggcugagcuugcgaagc

SEQ ID NO: 2582468 - RNA, 22 nt, Coxiella burnetii RSA 493
ugggcugucuucucuugcgccu

SEQ ID NO: 2582469 - RNA, 15 nt, Coxiella burnetii RSA 493
ugggggaacagagga

SEQ ID NO: 2582470 - RNA, 19 nt, Coxiella burnetii RSA 493
uggguaggcugaaauaacg

SEQ ID NO: 2582471 - RNA, 19 nt, Coxiella burnetii RSA 493
ugggugggauuguuuucga

SEQ ID NO: 2582472 - RNA, 16 nt, Coxiella burnetii RSA 493
ugguaacaaacuggga

SEQ ID NO: 2582473 - RNA, 15 nt, Coxiella burnetii RSA 493
ugguacacgcaaaaa

SEQ ID NO: 2582474 - RNA, 16 nt, Coxiella burnetii RSA 493
ugguacacgcaaaaau

SEQ ID NO: 2582475 - RNA, 19 nt, Coxiella burnetii RSA 493
ugguauccucagaaguuuu

SEQ ID NO: 2582476 - RNA, 18 nt, Coxiella burnetii RSA 493
uggucacaugauuuuucu

SEQ ID NO: 2582477 - RNA, 18 nt, Coxiella burnetii RSA 493
ugguccguggcaguuaaa

SEQ ID NO: 2582478 - RNA, 23 nt, Coxiella burnetii RSA 493
uggucggccaaauggauuuccac

SEQ ID NO: 2582479 - RNA, 15 nt, Coxiella burnetii RSA 493
uggucucuuuuuuug

SEQ ID NO: 2582480 - RNA, 19 nt, Coxiella burnetii RSA 493
ugguggcuuucauuacuug

SEQ ID NO: 2582481 - RNA, 15 nt, Coxiella burnetii RSA 493
ugguuaauucuucuu

SEQ ID NO: 2582482 - RNA, 18 nt, Coxiella burnetii RSA 493
ugguuaauucuucuucau

SEQ ID NO: 2582483 - RNA, 18 nt, Coxiella burnetii RSA 493
ugguuccacccgcaaacu

SEQ ID NO: 2582484 - RNA, 20 nt, Coxiella burnetii RSA 493
ugguucguguuuauuuucau

SEQ ID NO: 2582485 - RNA, 14 nt, Coxiella burnetii RSA 493
ugguucuuuugaau

SEQ ID NO: 2582486 - RNA, 13 nt, Coxiella burnetii RSA 493
ugguugaaaacga

SEQ ID NO: 2582487 - RNA, 18 nt, Coxiella burnetii RSA 493
ugguugauucaauaaucu

SEQ ID NO: 2582488 - RNA, 17 nt, Coxiella burnetii RSA 493
ugguugauuuuuuaauu

SEQ ID NO: 2582489 - RNA, 15 nt, Coxiella burnetii RSA 493
ugguugguuugcaaa

SEQ ID NO: 2582490 - RNA, 14 nt, Coxiella burnetii RSA 493
ugguuuaaaaaguu

SEQ ID NO: 2582491 - RNA, 13 nt, Coxiella burnetii RSA 493
ugguuuauagcac

SEQ ID NO: 2582492 - RNA, 19 nt, Coxiella burnetii RSA 493
uguaaaauacuggcaauaa

SEQ ID NO: 2582493 - RNA, 20 nt, Coxiella burnetii RSA 493
uguaaacagguccuaaaaaa

SEQ ID NO: 2582494 - RNA, 16 nt, Coxiella burnetii RSA 493
uguaaaccaaacguaa

SEQ ID NO: 2582495 - RNA, 14 nt, Coxiella burnetii RSA 493
uguaaaucauuggu

SEQ ID NO: 2582496 - RNA, 20 nt, Coxiella burnetii RSA 493
uguaacacggccuucauuau

SEQ ID NO: 2582497 - RNA, 14 nt, Coxiella burnetii RSA 493
uguaagaauucucc

SEQ ID NO: 2582498 - RNA, 20 nt, Coxiella burnetii RSA 493
uguaaguugggguuuaauug

SEQ ID NO: 2582499 - RNA, 14 nt, Coxiella burnetii RSA 493
uguaaucaauugcu

SEQ ID NO: 2582500 - RNA, 21 nt, Coxiella burnetii RSA 493
uguaauucacgauuuucguug

SEQ ID NO: 2582501 - RNA, 14 nt, Coxiella burnetii RSA 493
uguaauuuauccca

SEQ ID NO: 2582502 - RNA, 17 nt, Coxiella burnetii RSA 493
uguaauuuccguguaau

SEQ ID NO: 2582503 - RNA, 13 nt, Coxiella burnetii RSA 493
uguacauuuuuca

SEQ ID NO: 2582504 - RNA, 14 nt, Coxiella burnetii RSA 493
uguacauuuuucaa

SEQ ID NO: 2582505 - RNA, 18 nt, Coxiella burnetii RSA 493
uguacccgaagucuaggc

SEQ ID NO: 2582506 - RNA, 15 nt, Coxiella burnetii RSA 493
uguacguuaaagccg

SEQ ID NO: 2582507 - RNA, 18 nt, Coxiella burnetii RSA 493
uguacugaaaaguaaaag

SEQ ID NO: 2582508 - RNA, 17 nt, Coxiella burnetii RSA 493
uguacugcuguauaaac

SEQ ID NO: 2582509 - RNA, 16 nt, Coxiella burnetii RSA 493
uguagauucuuucuga

SEQ ID NO: 2582510 - RNA, 14 nt, Coxiella burnetii RSA 493
uguauaaagguuuu

SEQ ID NO: 2582511 - RNA, 21 nt, Coxiella burnetii RSA 493
uguauccagucguuuuuuaau

SEQ ID NO: 2582512 - RNA, 16 nt, Coxiella burnetii RSA 493
uguauccgcuuuaaua

SEQ ID NO: 2582513 - RNA, 20 nt, Coxiella burnetii RSA 493
uguauccuaauaaaaauauu

SEQ ID NO: 2582514 - RNA, 21 nt, Coxiella burnetii RSA 493
uguaugaagcgcggcgaaaua

SEQ ID NO: 2582515 - RNA, 14 nt, Coxiella burnetii RSA 493
uguauuaacauuug

SEQ ID NO: 2582516 - RNA, 22 nt, Coxiella burnetii RSA 493
uguauuauuauccgguuuugau

SEQ ID NO: 2582517 - RNA, 22 nt, Coxiella burnetii RSA 493
uguauucauuacgauuaaucau

SEQ ID NO: 2582518 - RNA, 20 nt, Coxiella burnetii RSA 493
uguauuccgccuuaaaacau

SEQ ID NO: 2582519 - RNA, 17 nt, Coxiella burnetii RSA 493
uguauucuucaauacua

SEQ ID NO: 2582520 - RNA, 21 nt, Coxiella burnetii RSA 493
uguauugaggucguuaaaaaa

SEQ ID NO: 2582521 - RNA, 21 nt, Coxiella burnetii RSA 493
uguauugauccggcuuuugau

SEQ ID NO: 2582522 - RNA, 15 nt, Coxiella burnetii RSA 493
uguauuuaucauccu

SEQ ID NO: 2582523 - RNA, 19 nt, Coxiella burnetii RSA 493
ugucaauuuaccuccaaaa

SEQ ID NO: 2582524 - RNA, 21 nt, Coxiella burnetii RSA 493
ugucacguuaucauucuuauc

SEQ ID NO: 2582525 - RNA, 18 nt, Coxiella burnetii RSA 493
ugucauauuaauauuaaa

SEQ ID NO: 2582526 - RNA, 14 nt, Coxiella burnetii RSA 493
ugucaucaauacca

SEQ ID NO: 2582527 - RNA, 13 nt, Coxiella burnetii RSA 493
uguccgcacaaac

SEQ ID NO: 2582528 - RNA, 23 nt, Coxiella burnetii RSA 493
uguccgccguguuguaagaauuc

SEQ ID NO: 2582529 - RNA, 17 nt, Coxiella burnetii RSA 493
uguccgugauuacuucu

SEQ ID NO: 2582530 - RNA, 15 nt, Coxiella burnetii RSA 493
uguccuaaaaugaua

SEQ ID NO: 2582531 - RNA, 21 nt, Coxiella burnetii RSA 493
uguccugauuuacaauaacaa

SEQ ID NO: 2582532 - RNA, 14 nt, Coxiella burnetii RSA 493
uguccuguucuuuu

SEQ ID NO: 2582533 - RNA, 16 nt, Coxiella burnetii RSA 493
uguccuguucuuuuuc

SEQ ID NO: 2582534 - RNA, 17 nt, Coxiella burnetii RSA 493
uguccuguucuuuuucc

SEQ ID NO: 2582535 - RNA, 14 nt, Coxiella burnetii RSA 493
uguccuucuucuaa

SEQ ID NO: 2582536 - RNA, 17 nt, Coxiella burnetii RSA 493
uguccuuggaacaaacc

SEQ ID NO: 2582537 - RNA, 14 nt, Coxiella burnetii RSA 493
uguccuuuucuauu

SEQ ID NO: 2582538 - RNA, 18 nt, Coxiella burnetii RSA 493
ugucgaauuuuugccaau

SEQ ID NO: 2582539 - RNA, 20 nt, Coxiella burnetii RSA 493
ugucgcguagcgacacaacc

SEQ ID NO: 2582540 - RNA, 20 nt, Coxiella burnetii RSA 493
ugucgcuacgcgacaacuaa

SEQ ID NO: 2582541 - RNA, 15 nt, Coxiella burnetii RSA 493
ugucggcgauacggu

SEQ ID NO: 2582542 - RNA, 14 nt, Coxiella burnetii RSA 493
ugucgugcauaucg

SEQ ID NO: 2582543 - RNA, 22 nt, Coxiella burnetii RSA 493
ugucuaacauuuggccaaacua

SEQ ID NO: 2582544 - RNA, 20 nt, Coxiella burnetii RSA 493
ugucucacaacauuccuuuc

SEQ ID NO: 2582545 - RNA, 20 nt, Coxiella burnetii RSA 493
ugucuccuuuuguuaauucu

SEQ ID NO: 2582546 - RNA, 21 nt, Coxiella burnetii RSA 493
ugucucuauaccauacagaau

SEQ ID NO: 2582547 - RNA, 16 nt, Coxiella burnetii RSA 493
ugucugcauuuuuaau

SEQ ID NO: 2582548 - RNA, 16 nt, Coxiella burnetii RSA 493
ugucuuuucgcauaau

SEQ ID NO: 2582549 - RNA, 19 nt, Coxiella burnetii RSA 493
ugucuuuucgcauaauaau

SEQ ID NO: 2582550 - RNA, 17 nt, Coxiella burnetii RSA 493
ugugaaauaaacagagu

SEQ ID NO: 2582551 - RNA, 16 nt, Coxiella burnetii RSA 493
ugugagucgccaauaa

SEQ ID NO: 2582552 - RNA, 16 nt, Coxiella burnetii RSA 493
ugugauuuuaaaaaua

SEQ ID NO: 2582553 - RNA, 19 nt, Coxiella burnetii RSA 493
ugugcaauuccauuaaaaa

SEQ ID NO: 2582554 - RNA, 22 nt, Coxiella burnetii RSA 493
ugugcaauuccauuaaaaacaa

SEQ ID NO: 2582555 - RNA, 12 nt, Coxiella burnetii RSA 493
ugugccugccau

SEQ ID NO: 2582556 - RNA, 18 nt, Coxiella burnetii RSA 493
ugugcucaucuucuauuc

SEQ ID NO: 2582557 - RNA, 14 nt, Coxiella burnetii RSA 493
ugugguacacgcaa

SEQ ID NO: 2582558 - RNA, 16 nt, Coxiella burnetii RSA 493
ugugguuaauucuucu

SEQ ID NO: 2582559 - RNA, 15 nt, Coxiella burnetii RSA 493
uguguaacaaaaacg

SEQ ID NO: 2582560 - RNA, 21 nt, Coxiella burnetii RSA 493
ugugucgcuacgcgacaacua

SEQ ID NO: 2582561 - RNA, 14 nt, Coxiella burnetii RSA 493
ugugucucuauacc

SEQ ID NO: 2582562 - RNA, 22 nt, Coxiella burnetii RSA 493
uguuaaaagcgcccaaaugauc

SEQ ID NO: 2582563 - RNA, 20 nt, Coxiella burnetii RSA 493
uguuaaaauccgcuuuauuu

SEQ ID NO: 2582564 - RNA, 17 nt, Coxiella burnetii RSA 493
uguuaauccacuuaaaa

SEQ ID NO: 2582565 - RNA, 21 nt, Coxiella burnetii RSA 493
uguuaauucgagcaucuuuuu

SEQ ID NO: 2582566 - RNA, 18 nt, Coxiella burnetii RSA 493
uguuaauucuuuuuuuua

SEQ ID NO: 2582567 - RNA, 14 nt, Coxiella burnetii RSA 493
uguuagcuuuucuu

SEQ ID NO: 2582568 - RNA, 15 nt, Coxiella burnetii RSA 493
uguuauaaaacuucc

SEQ ID NO: 2582569 - RNA, 23 nt, Coxiella burnetii RSA 493
uguucacaagucucagaaucugu

SEQ ID NO: 2582570 - RNA, 18 nt, Coxiella burnetii RSA 493
uguucccccacuucauac

SEQ ID NO: 2582571 - RNA, 16 nt, Coxiella burnetii RSA 493
uguuccgccauuuccc

SEQ ID NO: 2582572 - RNA, 17 nt, Coxiella burnetii RSA 493
uguuccuuacucccgaa

SEQ ID NO: 2582573 - RNA, 22 nt, Coxiella burnetii RSA 493
uguucggcugcgcauucguaua

SEQ ID NO: 2582574 - RNA, 14 nt, Coxiella burnetii RSA 493
uguucuaaaucggu

SEQ ID NO: 2582575 - RNA, 20 nt, Coxiella burnetii RSA 493
uguugaacagagugaugaca

SEQ ID NO: 2582576 - RNA, 16 nt, Coxiella burnetii RSA 493
uguugagcuucgcgaa

SEQ ID NO: 2582577 - RNA, 17 nt, Coxiella burnetii RSA 493
uguugauaauaaauggc

SEQ ID NO: 2582578 - RNA, 15 nt, Coxiella burnetii RSA 493
uguugauuuaacuuc

SEQ ID NO: 2582579 - RNA, 14 nt, Coxiella burnetii RSA 493
uguuggauuucauc

SEQ ID NO: 2582580 - RNA, 15 nt, Coxiella burnetii RSA 493
uguuguaagaauucu

SEQ ID NO: 2582581 - RNA, 22 nt, Coxiella burnetii RSA 493
uguuuaaagcugcuuuuuaaaa

SEQ ID NO: 2582582 - RNA, 16 nt, Coxiella burnetii RSA 493
uguuuaaauuaauauu

SEQ ID NO: 2582583 - RNA, 22 nt, Coxiella burnetii RSA 493
uguuuaaucgcuccuaaauuuu

SEQ ID NO: 2582584 - RNA, 15 nt, Coxiella burnetii RSA 493
uguuuacauuaaggc

SEQ ID NO: 2582585 - RNA, 18 nt, Coxiella burnetii RSA 493
uguuuacauuaaggccaa

SEQ ID NO: 2582586 - RNA, 14 nt, Coxiella burnetii RSA 493
uguuuauuuucaug

SEQ ID NO: 2582587 - RNA, 21 nt, Coxiella burnetii RSA 493
uguuucaauuagcauuuucuc

SEQ ID NO: 2582588 - RNA, 21 nt, Coxiella burnetii RSA 493
uguuucgcaacuuuuuuccuu

SEQ ID NO: 2582589 - RNA, 13 nt, Coxiella burnetii RSA 493
uguuucuaauaug

SEQ ID NO: 2582590 - RNA, 18 nt, Coxiella burnetii RSA 493
uguuucuaauauguuuuu

SEQ ID NO: 2582591 - RNA, 16 nt, Coxiella burnetii RSA 493
uguuugaaaaaauacc

SEQ ID NO: 2582592 - RNA, 22 nt, Coxiella burnetii RSA 493
uguuugauaucaaucgaaaaaa

SEQ ID NO: 2582593 - RNA, 16 nt, Coxiella burnetii RSA 493
uguuugauuuguucua

SEQ ID NO: 2582594 - RNA, 19 nt, Coxiella burnetii RSA 493
uguuugauuuguucuaaau

SEQ ID NO: 2582595 - RNA, 17 nt, Coxiella burnetii RSA 493
uguuuggccggugguuu

SEQ ID NO: 2582596 - RNA, 12 nt, Coxiella burnetii RSA 493
uguuuuaauucc

SEQ ID NO: 2582597 - RNA, 13 nt, Coxiella burnetii RSA 493
uguuuucagauuu

SEQ ID NO: 2582598 - RNA, 15 nt, Coxiella burnetii RSA 493
uguuuucagauuuuu

SEQ ID NO: 2582599 - RNA, 18 nt, Coxiella burnetii RSA 493
uguuuucccguauuucgc

SEQ ID NO: 2582600 - RNA, 15 nt, Coxiella burnetii RSA 493
uguuuugaucagaga

SEQ ID NO: 2582601 - RNA, 22 nt, Coxiella burnetii RSA 493
uguuuuguauaguucuaauaau

SEQ ID NO: 2582602 - RNA, 18 nt, Coxiella burnetii RSA 493
uguuuuucgguuucuuca

SEQ ID NO: 2582603 - RNA, 22 nt, Coxiella burnetii RSA 493
uguuuuuggcauaccuuuugcu

SEQ ID NO: 2582604 - RNA, 12 nt, Coxiella burnetii RSA 493
uguuuuuuaaua

SEQ ID NO: 2582605 - RNA, 12 nt, Coxiella burnetii RSA 493
uguuuuuuaauc

SEQ ID NO: 2582606 - RNA, 13 nt, Coxiella burnetii RSA 493
uuaaaaaaaauac

SEQ ID NO: 2582607 - RNA, 19 nt, Coxiella burnetii RSA 493
uuaaaaaaccgacuuuuua

SEQ ID NO: 2582608 - RNA, 13 nt, Coxiella burnetii RSA 493
uuaaaaaagaaaa

SEQ ID NO: 2582609 - RNA, 14 nt, Coxiella burnetii RSA 493
uuaaaaaagaaaau

SEQ ID NO: 2582610 - RNA, 12 nt, Coxiella burnetii RSA 493
uuaaaaacaauu

SEQ ID NO: 2582611 - RNA, 21 nt, Coxiella burnetii RSA 493
uuaaaaacgccugaaauauuu

SEQ ID NO: 2582612 - RNA, 21 nt, Coxiella burnetii RSA 493
uuaaaaauaaauuaauuaucc

SEQ ID NO: 2582613 - RNA, 12 nt, Coxiella burnetii RSA 493
uuaaaaauauuu

SEQ ID NO: 2582614 - RNA, 20 nt, Coxiella burnetii RSA 493
uuaaaaccuuuuuuuucaaa

SEQ ID NO: 2582615 - RNA, 19 nt, Coxiella burnetii RSA 493
uuaaaagacguaccauuaa

SEQ ID NO: 2582616 - RNA, 21 nt, Coxiella burnetii RSA 493
uuaaaagacguaccauuaaaa

SEQ ID NO: 2582617 - RNA, 20 nt, Coxiella burnetii RSA 493
uuaaaagagcgaauaaaaaa

SEQ ID NO: 2582618 - RNA, 21 nt, Coxiella burnetii RSA 493
uuaaaauuagcgaugucagcc

SEQ ID NO: 2582619 - RNA, 17 nt, Coxiella burnetii RSA 493
uuaaaauuucuuuccag

SEQ ID NO: 2582620 - RNA, 18 nt, Coxiella burnetii RSA 493
uuaaaauuucuuuccagc

SEQ ID NO: 2582621 - RNA, 13 nt, Coxiella burnetii RSA 493
uuaaacagucuuc

SEQ ID NO: 2582622 - RNA, 20 nt, Coxiella burnetii RSA 493
uuaaacccagaaaaguaaaa

SEQ ID NO: 2582623 - RNA, 24 nt, Coxiella burnetii RSA 493
uuaaaccgacgcgcucaaugaauu

SEQ ID NO: 2582624 - RNA, 17 nt, Coxiella burnetii RSA 493
uuaaacgcgauaucucc

SEQ ID NO: 2582625 - RNA, 17 nt, Coxiella burnetii RSA 493
uuaaacgcuucaaagug

SEQ ID NO: 2582626 - RNA, 19 nt, Coxiella burnetii RSA 493
uuaaacguauuccaaauaa

SEQ ID NO: 2582627 - RNA, 19 nt, Coxiella burnetii RSA 493
uuaaagcugcuuuuuaaaa

SEQ ID NO: 2582628 - RNA, 15 nt, Coxiella burnetii RSA 493
uuaaagucuucaaaa

SEQ ID NO: 2582629 - RNA, 19 nt, Coxiella burnetii RSA 493
uuaaagugaugauuaaacg

SEQ ID NO: 2582630 - RNA, 18 nt, Coxiella burnetii RSA 493
uuaaauaacuuuacuaaa

SEQ ID NO: 2582631 - RNA, 14 nt, Coxiella burnetii RSA 493
uuaaauagcuccuu

SEQ ID NO: 2582632 - RNA, 18 nt, Coxiella burnetii RSA 493
uuaaauccgagugggagc

SEQ ID NO: 2582633 - RNA, 13 nt, Coxiella burnetii RSA 493
uuaaaucuuccaa

SEQ ID NO: 2582634 - RNA, 20 nt, Coxiella burnetii RSA 493
uuaaaucuuuggguauaaau

SEQ ID NO: 2582635 - RNA, 22 nt, Coxiella burnetii RSA 493
uuaaaucuuuggguauaaauaa

SEQ ID NO: 2582636 - RNA, 16 nt, Coxiella burnetii RSA 493
uuaaaugaauuacuuu

SEQ ID NO: 2582637 - RNA, 20 nt, Coxiella burnetii RSA 493
uuaaaugcgguacuuaagaa

SEQ ID NO: 2582638 - RNA, 21 nt, Coxiella burnetii RSA 493
uuaaaugcgguacuuaagaaa

SEQ ID NO: 2582639 - RNA, 15 nt, Coxiella burnetii RSA 493
uuaaaugcuuuuuaa

SEQ ID NO: 2582640 - RNA, 23 nt, Coxiella burnetii RSA 493
uuaaaugggugcaguuugggggc

SEQ ID NO: 2582641 - RNA, 23 nt, Coxiella burnetii RSA 493
uuaaauucucgccuacuuuuguu

SEQ ID NO: 2582642 - RNA, 13 nt, Coxiella burnetii RSA 493
uuaaauuuaaucu

SEQ ID NO: 2582643 - RNA, 14 nt, Coxiella burnetii RSA 493
uuaaauuuuuaaau

SEQ ID NO: 2582644 - RNA, 12 nt, Coxiella burnetii RSA 493
uuaaauuuuuca

SEQ ID NO: 2582645 - RNA, 17 nt, Coxiella burnetii RSA 493
uuaacaacgaaaccuug

SEQ ID NO: 2582646 - RNA, 16 nt, Coxiella burnetii RSA 493
uuaacacuuuaauauc

SEQ ID NO: 2582647 - RNA, 16 nt, Coxiella burnetii RSA 493
uuaacauauuuacuug

SEQ ID NO: 2582648 - RNA, 12 nt, Coxiella burnetii RSA 493
uuaaccacagac

SEQ ID NO: 2582649 - RNA, 22 nt, Coxiella burnetii RSA 493
uuaacggaaaugcuuucacuuc

SEQ ID NO: 2582650 - RNA, 16 nt, Coxiella burnetii RSA 493
uuaacuccuucgcuuu

SEQ ID NO: 2582651 - RNA, 12 nt, Coxiella burnetii RSA 493
uuaacuuugcaa

SEQ ID NO: 2582652 - RNA, 13 nt, Coxiella burnetii RSA 493
uuaacuuugcaaa

SEQ ID NO: 2582653 - RNA, 15 nt, Coxiella burnetii RSA 493
uuaagacgugaaaug

SEQ ID NO: 2582654 - RNA, 23 nt, Coxiella burnetii RSA 493
uuaagacuaggaaaaaauaauua

SEQ ID NO: 2582655 - RNA, 20 nt, Coxiella burnetii RSA 493
uuaagagauaagcuguuucu

SEQ ID NO: 2582656 - RNA, 13 nt, Coxiella burnetii RSA 493
uuaagcguaaauu

SEQ ID NO: 2582657 - RNA, 21 nt, Coxiella burnetii RSA 493
uuaagcguuccuuucaucaaa

SEQ ID NO: 2582658 - RNA, 22 nt, Coxiella burnetii RSA 493
uuaagcucgagaagaugucccg

SEQ ID NO: 2582659 - RNA, 15 nt, Coxiella burnetii RSA 493
uuaagcugauacacc

SEQ ID NO: 2582660 - RNA, 15 nt, Coxiella burnetii RSA 493
uuaagcuugaaaaaa

SEQ ID NO: 2582661 - RNA, 13 nt, Coxiella burnetii RSA 493
uuaaggaaaagca

SEQ ID NO: 2582662 - RNA, 19 nt, Coxiella burnetii RSA 493
uuaaguuaagauaauaauu

SEQ ID NO: 2582663 - RNA, 20 nt, Coxiella burnetii RSA 493
uuaaguuaagauaauaauua

SEQ ID NO: 2582664 - RNA, 13 nt, Coxiella burnetii RSA 493
uuaaguuuuucac

SEQ ID NO: 2582665 - RNA, 16 nt, Coxiella burnetii RSA 493
uuaaguuuuuugcucu

SEQ ID NO: 2582666 - RNA, 20 nt, Coxiella burnetii RSA 493
uuaauaaaucaauuaaauuu

SEQ ID NO: 2582667 - RNA, 16 nt, Coxiella burnetii RSA 493
uuaauacaggaaaaag

SEQ ID NO: 2582668 - RNA, 19 nt, Coxiella burnetii RSA 493
uuaauacaggaaaaagaua

SEQ ID NO: 2582669 - RNA, 15 nt, Coxiella burnetii RSA 493
uuaauacauucuuca

SEQ ID NO: 2582670 - RNA, 19 nt, Coxiella burnetii RSA 493
uuaauacauucuucaguaa

SEQ ID NO: 2582671 - RNA, 15 nt, Coxiella burnetii RSA 493
uuaauaugauaaaag

SEQ ID NO: 2582672 - RNA, 16 nt, Coxiella burnetii RSA 493
uuaauaugcaagcugc

SEQ ID NO: 2582673 - RNA, 15 nt, Coxiella burnetii RSA 493
uuaauauuaaaacaa

SEQ ID NO: 2582674 - RNA, 23 nt, Coxiella burnetii RSA 493
uuaaucaaccucagguuuuaccu

SEQ ID NO: 2582675 - RNA, 15 nt, Coxiella burnetii RSA 493
uuaaucacaucccuu

SEQ ID NO: 2582676 - RNA, 13 nt, Coxiella burnetii RSA 493
uuaaucauauaau

SEQ ID NO: 2582677 - RNA, 23 nt, Coxiella burnetii RSA 493
uuaaucaucugcgggauuaauuu

SEQ ID NO: 2582678 - RNA, 21 nt, Coxiella burnetii RSA 493
uuaauccguuuugaaaaauaa

SEQ ID NO: 2582679 - RNA, 23 nt, Coxiella burnetii RSA 493
uuaauccguuuugaaaaauaaaa

SEQ ID NO: 2582680 - RNA, 15 nt, Coxiella burnetii RSA 493
uuaaucgcuccuaaa

SEQ ID NO: 2582681 - RNA, 16 nt, Coxiella burnetii RSA 493
uuaaucuuccauuaau

SEQ ID NO: 2582682 - RNA, 18 nt, Coxiella burnetii RSA 493
uuaaucuuccauuaauuu

SEQ ID NO: 2582683 - RNA, 13 nt, Coxiella burnetii RSA 493
uuaaugaaaaaua

SEQ ID NO: 2582684 - RNA, 14 nt, Coxiella burnetii RSA 493
uuaaugaaaaauag

SEQ ID NO: 2582685 - RNA, 17 nt, Coxiella burnetii RSA 493
uuaaugaguucauuaau

SEQ ID NO: 2582686 - RNA, 19 nt, Coxiella burnetii RSA 493
uuaaugucuuuuauuuuca

SEQ ID NO: 2582687 - RNA, 20 nt, Coxiella burnetii RSA 493
uuaauguuauuuauuuuucu

SEQ ID NO: 2582688 - RNA, 14 nt, Coxiella burnetii RSA 493
uuaauuaaugcagc

SEQ ID NO: 2582689 - RNA, 15 nt, Coxiella burnetii RSA 493
uuaauuaaugcagca

SEQ ID NO: 2582690 - RNA, 16 nt, Coxiella burnetii RSA 493
uuaauucauaaauaau

SEQ ID NO: 2582691 - RNA, 21 nt, Coxiella burnetii RSA 493
uuaauuccccguauuucgcuu

SEQ ID NO: 2582692 - RNA, 19 nt, Coxiella burnetii RSA 493
uuaauugauagcgauuucc

SEQ ID NO: 2582693 - RNA, 13 nt, Coxiella burnetii RSA 493
uuaauuucauaaa

SEQ ID NO: 2582694 - RNA, 14 nt, Coxiella burnetii RSA 493
uuaauuucuaaaaa

SEQ ID NO: 2582695 - RNA, 17 nt, Coxiella burnetii RSA 493
uuaauuucuaaaaauca

SEQ ID NO: 2582696 - RNA, 18 nt, Coxiella burnetii RSA 493
uuaauuugaucauuuccu

SEQ ID NO: 2582697 - RNA, 20 nt, Coxiella burnetii RSA 493
uuaauuugccggcauauuca

SEQ ID NO: 2582698 - RNA, 13 nt, Coxiella burnetii RSA 493
uuaauuuuaaaaa

SEQ ID NO: 2582699 - RNA, 14 nt, Coxiella burnetii RSA 493
uuaauuuuaaaaaa

SEQ ID NO: 2582700 - RNA, 15 nt, Coxiella burnetii RSA 493
uuaauuuuaaaaaac

SEQ ID NO: 2582701 - RNA, 21 nt, Coxiella burnetii RSA 493
uuaauuuuggguuuuggcgua

SEQ ID NO: 2582702 - RNA, 12 nt, Coxiella burnetii RSA 493
uuaauuuuuccu

SEQ ID NO: 2582703 - RNA, 14 nt, Coxiella burnetii RSA 493
uuaauuuuuucucu

SEQ ID NO: 2582704 - RNA, 14 nt, Coxiella burnetii RSA 493
uuacaaaaauacuu

SEQ ID NO: 2582705 - RNA, 16 nt, Coxiella burnetii RSA 493
uuacaauaauccacau

SEQ ID NO: 2582706 - RNA, 20 nt, Coxiella burnetii RSA 493
uuacaauaauccacauauuu

SEQ ID NO: 2582707 - RNA, 17 nt, Coxiella burnetii RSA 493
uuacaauccaauacuag

SEQ ID NO: 2582708 - RNA, 12 nt, Coxiella burnetii RSA 493
uuacaauucgcu

SEQ ID NO: 2582709 - RNA, 23 nt, Coxiella burnetii RSA 493
uuacaauucgcuaaguugggcca

SEQ ID NO: 2582710 - RNA, 18 nt, Coxiella burnetii RSA 493
uuacauaauuuaaacuca

SEQ ID NO: 2582711 - RNA, 13 nt, Coxiella burnetii RSA 493
uuacauauuucuu

SEQ ID NO: 2582712 - RNA, 21 nt, Coxiella burnetii RSA 493
uuacauauuucuuuucuguuu

SEQ ID NO: 2582713 - RNA, 16 nt, Coxiella burnetii RSA 493
uuacaucgguuuuucc

SEQ ID NO: 2582714 - RNA, 15 nt, Coxiella burnetii RSA 493
uuacccguuuaaauu

SEQ ID NO: 2582715 - RNA, 22 nt, Coxiella burnetii RSA 493
uuaccugaaugcuuuuaaagug

SEQ ID NO: 2582716 - RNA, 14 nt, Coxiella burnetii RSA 493
uuaccuucuguaau

SEQ ID NO: 2582717 - RNA, 20 nt, Coxiella burnetii RSA 493
uuacgcuauuggauuuacuu

SEQ ID NO: 2582718 - RNA, 13 nt, Coxiella burnetii RSA 493
uuacuucuauaca

SEQ ID NO: 2582719 - RNA, 12 nt, Coxiella burnetii RSA 493
uuacuugcuuca

SEQ ID NO: 2582720 - RNA, 17 nt, Coxiella burnetii RSA 493
uuacuuguugaaaaccu

SEQ ID NO: 2582721 - RNA, 16 nt, Coxiella burnetii RSA 493
uuacuuuauuacccuc

SEQ ID NO: 2582722 - RNA, 19 nt, Coxiella burnetii RSA 493
uuagaaaagcgcuuuaauc

SEQ ID NO: 2582723 - RNA, 18 nt, Coxiella burnetii RSA 493
uuagaaaaucaaaugcua

SEQ ID NO: 2582724 - RNA, 13 nt, Coxiella burnetii RSA 493
uuagacauuuuuc

SEQ ID NO: 2582725 - RNA, 13 nt, Coxiella burnetii RSA 493
uuagagugaacca

SEQ ID NO: 2582726 - RNA, 19 nt, Coxiella burnetii RSA 493
uuagcaaugggaacuuuua

SEQ ID NO: 2582727 - RNA, 22 nt, Coxiella burnetii RSA 493
uuagcaaugggaacuuuuaacu

SEQ ID NO: 2582728 - RNA, 15 nt, Coxiella burnetii RSA 493
uuagcaggauuuuca

SEQ ID NO: 2582729 - RNA, 17 nt, Coxiella burnetii RSA 493
uuagcaucuugaaucau

SEQ ID NO: 2582730 - RNA, 19 nt, Coxiella burnetii RSA 493
uuagcaucuugaaucauug

SEQ ID NO: 2582731 - RNA, 17 nt, Coxiella burnetii RSA 493
uuagcgccgugcaaaac

SEQ ID NO: 2582732 - RNA, 13 nt, Coxiella burnetii RSA 493
uuagcggaauacg

SEQ ID NO: 2582733 - RNA, 18 nt, Coxiella burnetii RSA 493
uuagcguaaucaucaauc

SEQ ID NO: 2582734 - RNA, 16 nt, Coxiella burnetii RSA 493
uuagcucauugaaauc

SEQ ID NO: 2582735 - RNA, 15 nt, Coxiella burnetii RSA 493
uuagcugacaucuua

SEQ ID NO: 2582736 - RNA, 16 nt, Coxiella burnetii RSA 493
uuagcugauuucucuu

SEQ ID NO: 2582737 - RNA, 23 nt, Coxiella burnetii RSA 493
uuagcugauuucucuuuuaacuu

SEQ ID NO: 2582738 - RNA, 11 nt, Coxiella burnetii RSA 493
uuagcuuccau

SEQ ID NO: 2582739 - RNA, 14 nt, Coxiella burnetii RSA 493
uuagcuuccauugc

SEQ ID NO: 2582740 - RNA, 23 nt, Coxiella burnetii RSA 493
uuagcuucggccgugaaaacgcu

SEQ ID NO: 2582741 - RNA, 13 nt, Coxiella burnetii RSA 493
uuagcuuuucuuu

SEQ ID NO: 2582742 - RNA, 19 nt, Coxiella burnetii RSA 493
uuaggaaggacaaaaauau

SEQ ID NO: 2582743 - RNA, 20 nt, Coxiella burnetii RSA 493
uuaggaaggacaaaaauauc

SEQ ID NO: 2582744 - RNA, 19 nt, Coxiella burnetii RSA 493
uuaggaugcgaauguaaug

SEQ ID NO: 2582745 - RNA, 20 nt, Coxiella burnetii RSA 493
uuaggcagccuaauuuaaug

SEQ ID NO: 2582746 - RNA, 23 nt, Coxiella burnetii RSA 493
uuaguaacccuuucauuuaauuu

SEQ ID NO: 2582747 - RNA, 13 nt, Coxiella burnetii RSA 493
uuaguaauauuuu

SEQ ID NO: 2582748 - RNA, 12 nt, Coxiella burnetii RSA 493
uuagugcaaaaa

SEQ ID NO: 2582749 - RNA, 15 nt, Coxiella burnetii RSA 493
uuaguugcuaaugaa

SEQ ID NO: 2582750 - RNA, 14 nt, Coxiella burnetii RSA 493
uuaguuuuucccuc

SEQ ID NO: 2582751 - RNA, 22 nt, Coxiella burnetii RSA 493
uuauaaaauuuaauaagucuuu

SEQ ID NO: 2582752 - RNA, 15 nt, Coxiella burnetii RSA 493
uuauaacaagguuuu

SEQ ID NO: 2582753 - RNA, 20 nt, Coxiella burnetii RSA 493
uuauaacccgcguauaaaug

SEQ ID NO: 2582754 - RNA, 16 nt, Coxiella burnetii RSA 493
uuauaacuauuuuaaa

SEQ ID NO: 2582755 - RNA, 22 nt, Coxiella burnetii RSA 493
uuauaagacgcuuucaacauau

SEQ ID NO: 2582756 - RNA, 13 nt, Coxiella burnetii RSA 493
uuauaauuaucca

SEQ ID NO: 2582757 - RNA, 23 nt, Coxiella burnetii RSA 493
uuauacacaucuuuuaaaacgcc

SEQ ID NO: 2582758 - RNA, 16 nt, Coxiella burnetii RSA 493
uuauaucauggucagc

SEQ ID NO: 2582759 - RNA, 19 nt, Coxiella burnetii RSA 493
uuauauugcugauaguuaa

SEQ ID NO: 2582760 - RNA, 13 nt, Coxiella burnetii RSA 493
uuauauuuaauuu

SEQ ID NO: 2582761 - RNA, 19 nt, Coxiella burnetii RSA 493
uuauauuuacugagaaaac

SEQ ID NO: 2582762 - RNA, 21 nt, Coxiella burnetii RSA 493
uuaucaaucguguagaaagaa

SEQ ID NO: 2582763 - RNA, 15 nt, Coxiella burnetii RSA 493
uuaucacuagcuauu

SEQ ID NO: 2582764 - RNA, 13 nt, Coxiella burnetii RSA 493
uuaucacuccaau

SEQ ID NO: 2582765 - RNA, 15 nt, Coxiella burnetii RSA 493
uuaucacuccaauaa

SEQ ID NO: 2582766 - RNA, 16 nt, Coxiella burnetii RSA 493
uuaucaugcauuugau

SEQ ID NO: 2582767 - RNA, 17 nt, Coxiella burnetii RSA 493
uuaucauguucauccaa

SEQ ID NO: 2582768 - RNA, 21 nt, Coxiella burnetii RSA 493
uuaucauuugggucuccguaa

SEQ ID NO: 2582769 - RNA, 14 nt, Coxiella burnetii RSA 493
uuauccaaaaucca

SEQ ID NO: 2582770 - RNA, 21 nt, Coxiella burnetii RSA 493
uuauccggcaucguuaaacuc

SEQ ID NO: 2582771 - RNA, 20 nt, Coxiella burnetii RSA 493
uuaucuagauuuuccugcug

SEQ ID NO: 2582772 - RNA, 21 nt, Coxiella burnetii RSA 493
uuaucucgugaagauugccac

SEQ ID NO: 2582773 - RNA, 15 nt, Coxiella burnetii RSA 493
uuaucuggccagcga

SEQ ID NO: 2582774 - RNA, 18 nt, Coxiella burnetii RSA 493
uuaucuuaaugaaauuuc

SEQ ID NO: 2582775 - RNA, 18 nt, Coxiella burnetii RSA 493
uuaugaaagaguauuuuu

SEQ ID NO: 2582776 - RNA, 15 nt, Coxiella burnetii RSA 493
uuaugacgguuaugu

SEQ ID NO: 2582777 - RNA, 14 nt, Coxiella burnetii RSA 493
uuaugauguuuuaa

SEQ ID NO: 2582778 - RNA, 14 nt, Coxiella burnetii RSA 493
uuaugcuugaacuu

SEQ ID NO: 2582779 - RNA, 23 nt, Coxiella burnetii RSA 493
uuaugggggacagccaauuuauu

SEQ ID NO: 2582780 - RNA, 19 nt, Coxiella burnetii RSA 493
uuauuaagcguuccuuuca

SEQ ID NO: 2582781 - RNA, 23 nt, Coxiella burnetii RSA 493
uuauuaauacaggaaaaagauaa

SEQ ID NO: 2582782 - RNA, 16 nt, Coxiella burnetii RSA 493
uuauuauaaaaaaaag

SEQ ID NO: 2582783 - RNA, 22 nt, Coxiella burnetii RSA 493
uuauuaugggggacagccaauu

SEQ ID NO: 2582784 - RNA, 22 nt, Coxiella burnetii RSA 493
uuauucaacaaccguuaucccc

SEQ ID NO: 2582785 - RNA, 21 nt, Coxiella burnetii RSA 493
uuauugagaaucucuuguaug

SEQ ID NO: 2582786 - RNA, 17 nt, Coxiella burnetii RSA 493
uuauuggagucgcuuuc

SEQ ID NO: 2582787 - RNA, 17 nt, Coxiella burnetii RSA 493
uuauugggauuuaccuu

SEQ ID NO: 2582788 - RNA, 17 nt, Coxiella burnetii RSA 493
uuauuguguuguagaau

SEQ ID NO: 2582789 - RNA, 17 nt, Coxiella burnetii RSA 493
uuauuguuagauaagcc

SEQ ID NO: 2582790 - RNA, 22 nt, Coxiella burnetii RSA 493
uuauuuaacgccucuugcaacg

SEQ ID NO: 2582791 - RNA, 22 nt, Coxiella burnetii RSA 493
uuauuuccugucguuaauacga

SEQ ID NO: 2582792 - RNA, 19 nt, Coxiella burnetii RSA 493
uuauuugaaaguagaaaac

SEQ ID NO: 2582793 - RNA, 12 nt, Coxiella burnetii RSA 493
uuauuuguugaa

SEQ ID NO: 2582794 - RNA, 14 nt, Coxiella burnetii RSA 493
uuauuuucaaauga

SEQ ID NO: 2582795 - RNA, 19 nt, Coxiella burnetii RSA 493
uuauuuucaaaugaauaag

SEQ ID NO: 2582796 - RNA, 12 nt, Coxiella burnetii RSA 493
uuauuuuggaua

SEQ ID NO: 2582797 - RNA, 20 nt, Coxiella burnetii RSA 493
uuauuuuucaucuuguaauc

SEQ ID NO: 2582798 - RNA, 18 nt, Coxiella burnetii RSA 493
uuauuuuuucuuugcuuu

SEQ ID NO: 2582799 - RNA, 18 nt, Coxiella burnetii RSA 493
uucaaaagugauuuuucu

SEQ ID NO: 2582800 - RNA, 13 nt, Coxiella burnetii RSA 493
uucaaauugcuga

SEQ ID NO: 2582801 - RNA, 20 nt, Coxiella burnetii RSA 493
uucaacuacuugauauuccc

SEQ ID NO: 2582802 - RNA, 17 nt, Coxiella burnetii RSA 493
uucaacuccugaaaaau

SEQ ID NO: 2582803 - RNA, 20 nt, Coxiella burnetii RSA 493
uucaacuccugaaaaauaau

SEQ ID NO: 2582804 - RNA, 17 nt, Coxiella burnetii RSA 493
uucaagaacgauuuccc

SEQ ID NO: 2582805 - RNA, 13 nt, Coxiella burnetii RSA 493
uucaagaugccca

SEQ ID NO: 2582806 - RNA, 14 nt, Coxiella burnetii RSA 493
uucaagcacuaguu

SEQ ID NO: 2582807 - RNA, 19 nt, Coxiella burnetii RSA 493
uucaagcacuaguuuuacu

SEQ ID NO: 2582808 - RNA, 15 nt, Coxiella burnetii RSA 493
uucaagugacguguc

SEQ ID NO: 2582809 - RNA, 12 nt, Coxiella burnetii RSA 493
uucaauaaaaaa

SEQ ID NO: 2582810 - RNA, 19 nt, Coxiella burnetii RSA 493
uucaauauuucuugaaaaa

SEQ ID NO: 2582811 - RNA, 10 nt, Coxiella burnetii RSA 493
uucaauggca

SEQ ID NO: 2582812 - RNA, 17 nt, Coxiella burnetii RSA 493
uucaauggcauuacaaa

SEQ ID NO: 2582813 - RNA, 16 nt, Coxiella burnetii RSA 493
uucaauuacuuuuaua

SEQ ID NO: 2582814 - RNA, 18 nt, Coxiella burnetii RSA 493
uucaauuacuuuuauaau

SEQ ID NO: 2582815 - RNA, 21 nt, Coxiella burnetii RSA 493
uucaauuagcauuuucuccaa

SEQ ID NO: 2582816 - RNA, 12 nt, Coxiella burnetii RSA 493
uucaauugcuuu

SEQ ID NO: 2582817 - RNA, 14 nt, Coxiella burnetii RSA 493
uucacagagccacc

SEQ ID NO: 2582818 - RNA, 13 nt, Coxiella burnetii RSA 493
uucaccuuuuccc

SEQ ID NO: 2582819 - RNA, 19 nt, Coxiella burnetii RSA 493
uucaccuuuucccuaggaa

SEQ ID NO: 2582820 - RNA, 15 nt, Coxiella burnetii RSA 493
uucacggauacgcuu

SEQ ID NO: 2582821 - RNA, 23 nt, Coxiella burnetii RSA 493
uucacuaaucgucgacaaaaaga

SEQ ID NO: 2582822 - RNA, 18 nt, Coxiella burnetii RSA 493
uucagcauaacuaauugc

SEQ ID NO: 2582823 - RNA, 24 nt, Coxiella burnetii RSA 493
uucagcauucccauagaagaacaa

SEQ ID NO: 2582824 - RNA, 20 nt, Coxiella burnetii RSA 493
uucagccgauucuucauacu

SEQ ID NO: 2582825 - RNA, 14 nt, Coxiella burnetii RSA 493
uucagcggggagga

SEQ ID NO: 2582826 - RNA, 14 nt, Coxiella burnetii RSA 493
uucaggacacauuu

SEQ ID NO: 2582827 - RNA, 23 nt, Coxiella burnetii RSA 493
uucaggacacauuuuuucaaauu

SEQ ID NO: 2582828 - RNA, 16 nt, Coxiella burnetii RSA 493
uucaggacugaaauaa

SEQ ID NO: 2582829 - RNA, 15 nt, Coxiella burnetii RSA 493
uucaguaauuuuuaa

SEQ ID NO: 2582830 - RNA, 16 nt, Coxiella burnetii RSA 493
uucaguucgcuaaaua

SEQ ID NO: 2582831 - RNA, 17 nt, Coxiella burnetii RSA 493
uucaguucgcuaaauaa

SEQ ID NO: 2582832 - RNA, 22 nt, Coxiella burnetii RSA 493
uucauaaggccaauuucuaauc

SEQ ID NO: 2582833 - RNA, 16 nt, Coxiella burnetii RSA 493
uucauaauuuuauaaa

SEQ ID NO: 2582834 - RNA, 18 nt, Coxiella burnetii RSA 493
uucauaauuuuauaaagc

SEQ ID NO: 2582835 - RNA, 19 nt, Coxiella burnetii RSA 493
uucauauucuucauaggau

SEQ ID NO: 2582836 - RNA, 18 nt, Coxiella burnetii RSA 493
uucauccaaaauaugaua

SEQ ID NO: 2582837 - RNA, 13 nt, Coxiella burnetii RSA 493
uucauccaaaauu

SEQ ID NO: 2582838 - RNA, 16 nt, Coxiella burnetii RSA 493
uucaucggauaucuga

SEQ ID NO: 2582839 - RNA, 16 nt, Coxiella burnetii RSA 493
uucaugaaaaagauaa

SEQ ID NO: 2582840 - RNA, 13 nt, Coxiella burnetii RSA 493
uucaugagaggau

SEQ ID NO: 2582841 - RNA, 23 nt, Coxiella burnetii RSA 493
uucaugcgcgcgauagccuccuc

SEQ ID NO: 2582842 - RNA, 17 nt, Coxiella burnetii RSA 493
uucauuaaauauuucuu

SEQ ID NO: 2582843 - RNA, 22 nt, Coxiella burnetii RSA 493
uucauuaacauuauuacauauu

SEQ ID NO: 2582844 - RNA, 14 nt, Coxiella burnetii RSA 493
uucauuaguucuau

SEQ ID NO: 2582845 - RNA, 14 nt, Coxiella burnetii RSA 493
uucauuaucuagau

SEQ ID NO: 2582846 - RNA, 20 nt, Coxiella burnetii RSA 493
uucauugagcgggauauuuu

SEQ ID NO: 2582847 - RNA, 15 nt, Coxiella burnetii RSA 493
uucauuuaaggguac

SEQ ID NO: 2582848 - RNA, 21 nt, Coxiella burnetii RSA 493
uucauuuuuuccucuuaagga

SEQ ID NO: 2582849 - RNA, 11 nt, Coxiella burnetii RSA 493
uucauuuuuuu

SEQ ID NO: 2582850 - RNA, 20 nt, Coxiella burnetii RSA 493
uuccaaaaacagauuuaaau

SEQ ID NO: 2582851 - RNA, 11 nt, Coxiella burnetii RSA 493
uuccaaaaauu

SEQ ID NO: 2582852 - RNA, 12 nt, Coxiella burnetii RSA 493
uuccaaaaauuu

SEQ ID NO: 2582853 - RNA, 23 nt, Coxiella burnetii RSA 493
uuccaaaaauuucauuuaauaaa

SEQ ID NO: 2582854 - RNA, 23 nt, Coxiella burnetii RSA 493
uuccaaagcagauaaauguuuuu

SEQ ID NO: 2582855 - RNA, 22 nt, Coxiella burnetii RSA 493
uuccaacgcuuguuuuauaccu

SEQ ID NO: 2582856 - RNA, 11 nt, Coxiella burnetii RSA 493
uuccaauaaca

SEQ ID NO: 2582857 - RNA, 19 nt, Coxiella burnetii RSA 493
uuccaucgaaaaugcucgc

SEQ ID NO: 2582858 - RNA, 19 nt, Coxiella burnetii RSA 493
uuccauuaauuucuuuuuu

SEQ ID NO: 2582859 - RNA, 17 nt, Coxiella burnetii RSA 493
uucccaaucaucaauuc

SEQ ID NO: 2582860 - RNA, 19 nt, Coxiella burnetii RSA 493
uucccaauuacgcccuuuc

SEQ ID NO: 2582861 - RNA, 15 nt, Coxiella burnetii RSA 493
uucccacaaaauacc

SEQ ID NO: 2582862 - RNA, 14 nt, Coxiella burnetii RSA 493
uucccaggaaagaa

SEQ ID NO: 2582863 - RNA, 17 nt, Coxiella burnetii RSA 493
uucccauucuauaauca

SEQ ID NO: 2582864 - RNA, 19 nt, Coxiella burnetii RSA 493
uuccccaccacucacagcc

SEQ ID NO: 2582865 - RNA, 18 nt, Coxiella burnetii RSA 493
uucccccacuucauacgg

SEQ ID NO: 2582866 - RNA, 20 nt, Coxiella burnetii RSA 493
uucccguauuccgcuuugcu

SEQ ID NO: 2582867 - RNA, 18 nt, Coxiella burnetii RSA 493
uucccguauuucgcuucg

SEQ ID NO: 2582868 - RNA, 22 nt, Coxiella burnetii RSA 493
uuccgaaacuaaaagaggccac

SEQ ID NO: 2582869 - RNA, 14 nt, Coxiella burnetii RSA 493
uuccgauaagcguu

SEQ ID NO: 2582870 - RNA, 23 nt, Coxiella burnetii RSA 493
uuccgcaaaucggaaaagccaau

SEQ ID NO: 2582871 - RNA, 19 nt, Coxiella burnetii RSA 493
uuccgcuuugcuccauacg

SEQ ID NO: 2582872 - RNA, 20 nt, Coxiella burnetii RSA 493
uuccgcuuugcuccauacgg

SEQ ID NO: 2582873 - RNA, 15 nt, Coxiella burnetii RSA 493
uuccgugguuuaacg

SEQ ID NO: 2582874 - RNA, 18 nt, Coxiella burnetii RSA 493
uuccuaucaauauuucgu

SEQ ID NO: 2582875 - RNA, 20 nt, Coxiella burnetii RSA 493
uuccuguccgauauaacacc

SEQ ID NO: 2582876 - RNA, 19 nt, Coxiella burnetii RSA 493
uuccuguggaagguugaga

SEQ ID NO: 2582877 - RNA, 15 nt, Coxiella burnetii RSA 493
uuccuucaaacagug

SEQ ID NO: 2582878 - RNA, 16 nt, Coxiella burnetii RSA 493
uuccuuguugaauucc

SEQ ID NO: 2582879 - RNA, 22 nt, Coxiella burnetii RSA 493
uuccuuguugaauuccuugcuc

SEQ ID NO: 2582880 - RNA, 16 nt, Coxiella burnetii RSA 493
uuccuuucuuucuuca

SEQ ID NO: 2582881 - RNA, 14 nt, Coxiella burnetii RSA 493
uuccuuuucuauuu

SEQ ID NO: 2582882 - RNA, 13 nt, Coxiella burnetii RSA 493
uuccuuuuuuuaa

SEQ ID NO: 2582883 - RNA, 19 nt, Coxiella burnetii RSA 493
uucgaaagaaauaacugug

SEQ ID NO: 2582884 - RNA, 17 nt, Coxiella burnetii RSA 493
uucgaggaagaccgcua

SEQ ID NO: 2582885 - RNA, 18 nt, Coxiella burnetii RSA 493
uucgauacagccuucaug

SEQ ID NO: 2582886 - RNA, 21 nt, Coxiella burnetii RSA 493
uucgauacagccuucaugaau

SEQ ID NO: 2582887 - RNA, 19 nt, Coxiella burnetii RSA 493
uucgauuuuacaauaaucc

SEQ ID NO: 2582888 - RNA, 20 nt, Coxiella burnetii RSA 493
uucgauuuuacaauaaucca

SEQ ID NO: 2582889 - RNA, 17 nt, Coxiella burnetii RSA 493
uucgcaauccucucucu

SEQ ID NO: 2582890 - RNA, 16 nt, Coxiella burnetii RSA 493
uucgcacaaugcuuuu

SEQ ID NO: 2582891 - RNA, 21 nt, Coxiella burnetii RSA 493
uucgcacaaugcuuuucucaa

SEQ ID NO: 2582892 - RNA, 16 nt, Coxiella burnetii RSA 493
uucgccagaaacaacu

SEQ ID NO: 2582893 - RNA, 15 nt, Coxiella burnetii RSA 493
uucgcuaacgccaca

SEQ ID NO: 2582894 - RNA, 14 nt, Coxiella burnetii RSA 493
uucgcuccauacgg

SEQ ID NO: 2582895 - RNA, 16 nt, Coxiella burnetii RSA 493
uucgcuggauuuuuua

SEQ ID NO: 2582896 - RNA, 20 nt, Coxiella burnetii RSA 493
uucgcuucgcuacauacggg

SEQ ID NO: 2582897 - RNA, 19 nt, Coxiella burnetii RSA 493
uucgcuucgcuccauacgg

SEQ ID NO: 2582898 - RNA, 20 nt, Coxiella burnetii RSA 493
uucgcuucgcuccauacggg

SEQ ID NO: 2582899 - RNA, 16 nt, Coxiella burnetii RSA 493
uucgcuugacgggcau

SEQ ID NO: 2582900 - RNA, 15 nt, Coxiella burnetii RSA 493
uucgcuuuuuugcuu

SEQ ID NO: 2582901 - RNA, 16 nt, Coxiella burnetii RSA 493
uucggauuuugaacag

SEQ ID NO: 2582902 - RNA, 16 nt, Coxiella burnetii RSA 493
uucggcgccagcauug

SEQ ID NO: 2582903 - RNA, 18 nt, Coxiella burnetii RSA 493
uucggcguuaacgguguc

SEQ ID NO: 2582904 - RNA, 15 nt, Coxiella burnetii RSA 493
uucgguaagcgcuuu

SEQ ID NO: 2582905 - RNA, 21 nt, Coxiella burnetii RSA 493
uucgguuuuuuuaaaaaagaa

SEQ ID NO: 2582906 - RNA, 13 nt, Coxiella burnetii RSA 493
uucguaagauucu

SEQ ID NO: 2582907 - RNA, 13 nt, Coxiella burnetii RSA 493
uucguauaauuca

SEQ ID NO: 2582908 - RNA, 16 nt, Coxiella burnetii RSA 493
uucgucauuuccgugc

SEQ ID NO: 2582909 - RNA, 14 nt, Coxiella burnetii RSA 493
uucguucugaaauu

SEQ ID NO: 2582910 - RNA, 16 nt, Coxiella burnetii RSA 493
uucguuucgaaaaauu

SEQ ID NO: 2582911 - RNA, 21 nt, Coxiella burnetii RSA 493
uucguuucgaaaaauuauuaa

SEQ ID NO: 2582912 - RNA, 20 nt, Coxiella burnetii RSA 493
uucuaaccacccugucauau

SEQ ID NO: 2582913 - RNA, 17 nt, Coxiella burnetii RSA 493
uucuaagagcugucgcc

SEQ ID NO: 2582914 - RNA, 16 nt, Coxiella burnetii RSA 493
uucuaaguaaacagca

SEQ ID NO: 2582915 - RNA, 17 nt, Coxiella burnetii RSA 493
uucuaaguaaacagcau

SEQ ID NO: 2582916 - RNA, 12 nt, Coxiella burnetii RSA 493
uucuaauaaaau

SEQ ID NO: 2582917 - RNA, 19 nt, Coxiella burnetii RSA 493
uucuaauaaucgauaauua

SEQ ID NO: 2582918 - RNA, 15 nt, Coxiella burnetii RSA 493
uucuaauuugaaaaa

SEQ ID NO: 2582919 - RNA, 17 nt, Coxiella burnetii RSA 493
uucuaauuugaaaaacc

SEQ ID NO: 2582920 - RNA, 16 nt, Coxiella burnetii RSA 493
uucuacggccaucgcc

SEQ ID NO: 2582921 - RNA, 17 nt, Coxiella burnetii RSA 493
uucuagagcaacgauuu

SEQ ID NO: 2582922 - RNA, 17 nt, Coxiella burnetii RSA 493
uucuagugugauaauca

SEQ ID NO: 2582923 - RNA, 14 nt, Coxiella burnetii RSA 493
uucuauacuucauc

SEQ ID NO: 2582924 - RNA, 18 nt, Coxiella burnetii RSA 493
uucuaucgaugaagcuga

SEQ ID NO: 2582925 - RNA, 11 nt, Coxiella burnetii RSA 493
uucuauuuccg

SEQ ID NO: 2582926 - RNA, 20 nt, Coxiella burnetii RSA 493
uucuauuuuggcccaacuua

SEQ ID NO: 2582927 - RNA, 15 nt, Coxiella burnetii RSA 493
uucuauuuuuuugcc

SEQ ID NO: 2582928 - RNA, 20 nt, Coxiella burnetii RSA 493
uucucaaauugcuccaaaca

SEQ ID NO: 2582929 - RNA, 15 nt, Coxiella burnetii RSA 493
uucucaaauuuuccc

SEQ ID NO: 2582930 - RNA, 21 nt, Coxiella burnetii RSA 493
uucucaaauuuucccaggaaa

SEQ ID NO: 2582931 - RNA, 15 nt, Coxiella burnetii RSA 493
uucucaguuaaaaua

SEQ ID NO: 2582932 - RNA, 16 nt, Coxiella burnetii RSA 493
uucucaguuaaaauaa

SEQ ID NO: 2582933 - RNA, 19 nt, Coxiella burnetii RSA 493
uucucaguuaaaauaauga

SEQ ID NO: 2582934 - RNA, 20 nt, Coxiella burnetii RSA 493
uucuccuuaauaaaguuuua

SEQ ID NO: 2582935 - RNA, 14 nt, Coxiella burnetii RSA 493
uucuccuuuuaaag

SEQ ID NO: 2582936 - RNA, 21 nt, Coxiella burnetii RSA 493
uucucgacauaggagauuuuu

SEQ ID NO: 2582937 - RNA, 22 nt, Coxiella burnetii RSA 493
uucucgauauucuaucucaaag

SEQ ID NO: 2582938 - RNA, 14 nt, Coxiella burnetii RSA 493
uucucguaacaaaa

SEQ ID NO: 2582939 - RNA, 23 nt, Coxiella burnetii RSA 493
uucucguccgaucauuaccccau

SEQ ID NO: 2582940 - RNA, 17 nt, Coxiella burnetii RSA 493
uucucuauuucgagauu

SEQ ID NO: 2582941 - RNA, 21 nt, Coxiella burnetii RSA 493
uucucuucaacgccagcuucc

SEQ ID NO: 2582942 - RNA, 22 nt, Coxiella burnetii RSA 493
uucucuugcgccuuaauaugca

SEQ ID NO: 2582943 - RNA, 18 nt, Coxiella burnetii RSA 493
uucucuuuaucagaaaaa

SEQ ID NO: 2582944 - RNA, 14 nt, Coxiella burnetii RSA 493
uucucuuucauaau

SEQ ID NO: 2582945 - RNA, 21 nt, Coxiella burnetii RSA 493
uucugagcuuguuuuuggcau

SEQ ID NO: 2582946 - RNA, 22 nt, Coxiella burnetii RSA 493
uucugaucgauaaaaauaauga

SEQ ID NO: 2582947 - RNA, 18 nt, Coxiella burnetii RSA 493
uucugauuuuugaagcua

SEQ ID NO: 2582948 - RNA, 16 nt, Coxiella burnetii RSA 493
uucugcagauuguaaa

SEQ ID NO: 2582949 - RNA, 22 nt, Coxiella burnetii RSA 493
uucuggaagagaguaagucucu

SEQ ID NO: 2582950 - RNA, 23 nt, Coxiella burnetii RSA 493
uucuggauaagcauauugcaaua

SEQ ID NO: 2582951 - RNA, 20 nt, Coxiella burnetii RSA 493
uucuggcggugcgaauaaca

SEQ ID NO: 2582952 - RNA, 16 nt, Coxiella burnetii RSA 493
uucuggcuugcuauga

SEQ ID NO: 2582953 - RNA, 17 nt, Coxiella burnetii RSA 493
uucuggcuugcuaugau

SEQ ID NO: 2582954 - RNA, 11 nt, Coxiella burnetii RSA 493
uucuguaaguu

SEQ ID NO: 2582955 - RNA, 15 nt, Coxiella burnetii RSA 493
uucugugaaauaaac

SEQ ID NO: 2582956 - RNA, 16 nt, Coxiella burnetii RSA 493
uucugugaaauaaaca

SEQ ID NO: 2582957 - RNA, 17 nt, Coxiella burnetii RSA 493
uucuuaacgaagguuuc

SEQ ID NO: 2582958 - RNA, 20 nt, Coxiella burnetii RSA 493
uucuuaauuuuuccuuucuu

SEQ ID NO: 2582959 - RNA, 17 nt, Coxiella burnetii RSA 493
uucuuagcgcuaaugag

SEQ ID NO: 2582960 - RNA, 15 nt, Coxiella burnetii RSA 493
uucuucacuuuccuu

SEQ ID NO: 2582961 - RNA, 15 nt, Coxiella burnetii RSA 493
uucuucaucuaaauu

SEQ ID NO: 2582962 - RNA, 12 nt, Coxiella burnetii RSA 493
uucuucucccaa

SEQ ID NO: 2582963 - RNA, 14 nt, Coxiella burnetii RSA 493
uucuucuuuggauu

SEQ ID NO: 2582964 - RNA, 13 nt, Coxiella burnetii RSA 493
uucuucuuuggcc

SEQ ID NO: 2582965 - RNA, 14 nt, Coxiella burnetii RSA 493
uucuugaaaaacuu

SEQ ID NO: 2582966 - RNA, 23 nt, Coxiella burnetii RSA 493
uucuugacaccacgcuaaauggu

SEQ ID NO: 2582967 - RNA, 12 nt, Coxiella burnetii RSA 493
uucuugcuccca

SEQ ID NO: 2582968 - RNA, 18 nt, Coxiella burnetii RSA 493
uucuugggcaauuuguga

SEQ ID NO: 2582969 - RNA, 11 nt, Coxiella burnetii RSA 493
uucuuuaacuu

SEQ ID NO: 2582970 - RNA, 23 nt, Coxiella burnetii RSA 493
uucuuuaacuuuagcuaauucuu

SEQ ID NO: 2582971 - RNA, 13 nt, Coxiella burnetii RSA 493
uucuuuaauauca

SEQ ID NO: 2582972 - RNA, 15 nt, Coxiella burnetii RSA 493
uucuuuaauaucaaa

SEQ ID NO: 2582973 - RNA, 15 nt, Coxiella burnetii RSA 493
uucuuucaauaaacc

SEQ ID NO: 2582974 - RNA, 13 nt, Coxiella burnetii RSA 493
uucuuucauuauu

SEQ ID NO: 2582975 - RNA, 20 nt, Coxiella burnetii RSA 493
uucuuucugaaaauucugaa

SEQ ID NO: 2582976 - RNA, 22 nt, Coxiella burnetii RSA 493
uucuuucugauuuuacgcuauu

SEQ ID NO: 2582977 - RNA, 15 nt, Coxiella burnetii RSA 493
uucuuucuucacuuu

SEQ ID NO: 2582978 - RNA, 16 nt, Coxiella burnetii RSA 493
uucuuuuagaaaauca

SEQ ID NO: 2582979 - RNA, 18 nt, Coxiella burnetii RSA 493
uucuuuuagaaaaucaaa

SEQ ID NO: 2582980 - RNA, 18 nt, Coxiella burnetii RSA 493
uucuuuuggcauuguucu

SEQ ID NO: 2582981 - RNA, 17 nt, Coxiella burnetii RSA 493
uugaaaaaauugauaau

SEQ ID NO: 2582982 - RNA, 14 nt, Coxiella burnetii RSA 493
uugaaaaauaaaag

SEQ ID NO: 2582983 - RNA, 18 nt, Coxiella burnetii RSA 493
uugaaaaauaaaaggaga

SEQ ID NO: 2582984 - RNA, 22 nt, Coxiella burnetii RSA 493
uugaaaaccuacacguuaaaua

SEQ ID NO: 2582985 - RNA, 15 nt, Coxiella burnetii RSA 493
uugaaaaucccuuuu

SEQ ID NO: 2582986 - RNA, 18 nt, Coxiella burnetii RSA 493
uugaaaaucccuuuuaau

SEQ ID NO: 2582987 - RNA, 15 nt, Coxiella burnetii RSA 493
uugaaagaaaaaaaa

SEQ ID NO: 2582988 - RNA, 17 nt, Coxiella burnetii RSA 493
uugaaagaaaaaaaacc

SEQ ID NO: 2582989 - RNA, 23 nt, Coxiella burnetii RSA 493
uugaaagaaaaaaaaccaaugaa

SEQ ID NO: 2582990 - RNA, 16 nt, Coxiella burnetii RSA 493
uugaaagaauuucucg

SEQ ID NO: 2582991 - RNA, 20 nt, Coxiella burnetii RSA 493
uugaaauaaacuggaaaaag

SEQ ID NO: 2582992 - RNA, 22 nt, Coxiella burnetii RSA 493
uugaacaggagcgauaaaauaa

SEQ ID NO: 2582993 - RNA, 13 nt, Coxiella burnetii RSA 493
uugaacuucaaau

SEQ ID NO: 2582994 - RNA, 15 nt, Coxiella burnetii RSA 493
uugaacuucaaaucg

SEQ ID NO: 2582995 - RNA, 13 nt, Coxiella burnetii RSA 493
uugaagaaauacg

SEQ ID NO: 2582996 - RNA, 14 nt, Coxiella burnetii RSA 493
uugaagaaauacga

SEQ ID NO: 2582997 - RNA, 22 nt, Coxiella burnetii RSA 493
uugaaggaauaaaaccuucaaa

SEQ ID NO: 2582998 - RNA, 20 nt, Coxiella burnetii RSA 493
uugaauaauucguuuacuug

SEQ ID NO: 2582999 - RNA, 23 nt, Coxiella burnetii RSA 493
uugaaucaaauuaaaauaaucca

SEQ ID NO: 2583000 - RNA, 20 nt, Coxiella burnetii RSA 493
uugaauuccuugcucaaguc

SEQ ID NO: 2583001 - RNA, 16 nt, Coxiella burnetii RSA 493
uugaauuucuguuuua

SEQ ID NO: 2583002 - RNA, 21 nt, Coxiella burnetii RSA 493
uugaauuugagaacguuuccc

SEQ ID NO: 2583003 - RNA, 13 nt, Coxiella burnetii RSA 493
uugaauuugcuug

SEQ ID NO: 2583004 - RNA, 16 nt, Coxiella burnetii RSA 493
uugaauuuuuugaaaa

SEQ ID NO: 2583005 - RNA, 9 nt, Coxiella burnetii RSA 493
uugacaaau

SEQ ID NO: 2583006 - RNA, 13 nt, Coxiella burnetii RSA 493
uugacaaauaaag

SEQ ID NO: 2583007 - RNA, 22 nt, Coxiella burnetii RSA 493
uugacaccacgcuaaauggucu

SEQ ID NO: 2583008 - RNA, 15 nt, Coxiella burnetii RSA 493
uugacauugggguaa

SEQ ID NO: 2583009 - RNA, 14 nt, Coxiella burnetii RSA 493
uugacgccuauugc

SEQ ID NO: 2583010 - RNA, 20 nt, Coxiella burnetii RSA 493
uugagaacguuucccaagga

SEQ ID NO: 2583011 - RNA, 22 nt, Coxiella burnetii RSA 493
uugagaauagcauuagacauuu

SEQ ID NO: 2583012 - RNA, 12 nt, Coxiella burnetii RSA 493
uugagcgaaagc

SEQ ID NO: 2583013 - RNA, 17 nt, Coxiella burnetii RSA 493
uugagcggcuuuuucaa

SEQ ID NO: 2583014 - RNA, 20 nt, Coxiella burnetii RSA 493
uugaggaaaauaagaugacg

SEQ ID NO: 2583015 - RNA, 23 nt, Coxiella burnetii RSA 493
uugaggaaaauaagaugacgcag

SEQ ID NO: 2583016 - RNA, 18 nt, Coxiella burnetii RSA 493
uugaggugccgcuaaaau

SEQ ID NO: 2583017 - RNA, 17 nt, Coxiella burnetii RSA 493
uugaguaagaaaugccg

SEQ ID NO: 2583018 - RNA, 15 nt, Coxiella burnetii RSA 493
uugauaaaagacuuu

SEQ ID NO: 2583019 - RNA, 14 nt, Coxiella burnetii RSA 493
uugauaaagauucu

SEQ ID NO: 2583020 - RNA, 17 nt, Coxiella burnetii RSA 493
uugauaagcauaauuca

SEQ ID NO: 2583021 - RNA, 19 nt, Coxiella burnetii RSA 493
uugauacugcguuuuucag

SEQ ID NO: 2583022 - RNA, 11 nt, Coxiella burnetii RSA 493
uugauagcgau

SEQ ID NO: 2583023 - RNA, 13 nt, Coxiella burnetii RSA 493
uugauaguucaua

SEQ ID NO: 2583024 - RNA, 17 nt, Coxiella burnetii RSA 493
uugauaucaaucgaaaa

SEQ ID NO: 2583025 - RNA, 20 nt, Coxiella burnetii RSA 493
uugauaucaaucgaaaaaaa

SEQ ID NO: 2583026 - RNA, 22 nt, Coxiella burnetii RSA 493
uugauaucaaucgaaaaaaauc

SEQ ID NO: 2583027 - RNA, 13 nt, Coxiella burnetii RSA 493
uugauauucccuc

SEQ ID NO: 2583028 - RNA, 15 nt, Coxiella burnetii RSA 493
uugaucauuuccuag

SEQ ID NO: 2583029 - RNA, 19 nt, Coxiella burnetii RSA 493
uugauccggcuuuugauua

SEQ ID NO: 2583030 - RNA, 11 nt, Coxiella burnetii RSA 493
uugauccuuuu

SEQ ID NO: 2583031 - RNA, 19 nt, Coxiella burnetii RSA 493
uugaucuugggcaaaaaaa

SEQ ID NO: 2583032 - RNA, 22 nt, Coxiella burnetii RSA 493
uugaucuugggcaaaaaaagaa

SEQ ID NO: 2583033 - RNA, 21 nt, Coxiella burnetii RSA 493
uugaugaaaagaaagcgguug

SEQ ID NO: 2583034 - RNA, 14 nt, Coxiella burnetii RSA 493
uugaugccauaauu

SEQ ID NO: 2583035 - RNA, 19 nt, Coxiella burnetii RSA 493
uugaugcguuuuuuuauua

SEQ ID NO: 2583036 - RNA, 16 nt, Coxiella burnetii RSA 493
uugauuaacuuucguu

SEQ ID NO: 2583037 - RNA, 15 nt, Coxiella burnetii RSA 493
uugauuaauaauguu

SEQ ID NO: 2583038 - RNA, 20 nt, Coxiella burnetii RSA 493
uugauuacuugauauucccu

SEQ ID NO: 2583039 - RNA, 17 nt, Coxiella burnetii RSA 493
uugauuccuucaaucac

SEQ ID NO: 2583040 - RNA, 14 nt, Coxiella burnetii RSA 493
uugcaaaacagccc

SEQ ID NO: 2583041 - RNA, 23 nt, Coxiella burnetii RSA 493
uugcaaaccgcgcugaaguccuu

SEQ ID NO: 2583042 - RNA, 15 nt, Coxiella burnetii RSA 493
uugcaaaugaauaac

SEQ ID NO: 2583043 - RNA, 12 nt, Coxiella burnetii RSA 493
uugcaauccuuu

SEQ ID NO: 2583044 - RNA, 19 nt, Coxiella burnetii RSA 493
uugcaauccuuuuuguaau

SEQ ID NO: 2583045 - RNA, 15 nt, Coxiella burnetii RSA 493
uugcacauggaaaaa

SEQ ID NO: 2583046 - RNA, 15 nt, Coxiella burnetii RSA 493
uugcagcauccccca

SEQ ID NO: 2583047 - RNA, 18 nt, Coxiella burnetii RSA 493
uugcagccgccaauuuug

SEQ ID NO: 2583048 - RNA, 13 nt, Coxiella burnetii RSA 493
uugcaguugguuu

SEQ ID NO: 2583049 - RNA, 16 nt, Coxiella burnetii RSA 493
uugcauccgaacuaau

SEQ ID NO: 2583050 - RNA, 21 nt, Coxiella burnetii RSA 493
uugcaugaggagucaucgcca

SEQ ID NO: 2583051 - RNA, 16 nt, Coxiella burnetii RSA 493
uugcauuuuuaaaagu

SEQ ID NO: 2583052 - RNA, 21 nt, Coxiella burnetii RSA 493
uugccaauauaaauaaucuuc

SEQ ID NO: 2583053 - RNA, 21 nt, Coxiella burnetii RSA 493
uugccacucuuuauuauaaaa

SEQ ID NO: 2583054 - RNA, 15 nt, Coxiella burnetii RSA 493
uugccagaaauagcu

SEQ ID NO: 2583055 - RNA, 21 nt, Coxiella burnetii RSA 493
uugccaggacuuuaagauuuc

SEQ ID NO: 2583056 - RNA, 16 nt, Coxiella burnetii RSA 493
uugccauccaaaugag

SEQ ID NO: 2583057 - RNA, 21 nt, Coxiella burnetii RSA 493
uugcccccauugauaauaauu

SEQ ID NO: 2583058 - RNA, 17 nt, Coxiella burnetii RSA 493
uugccgcccuugcugca

SEQ ID NO: 2583059 - RNA, 15 nt, Coxiella burnetii RSA 493
uugccggacuuuuuc

SEQ ID NO: 2583060 - RNA, 22 nt, Coxiella burnetii RSA 493
uugccggauugauaaaguuuau

SEQ ID NO: 2583061 - RNA, 21 nt, Coxiella burnetii RSA 493
uugccgguauuuugcaaauga

SEQ ID NO: 2583062 - RNA, 16 nt, Coxiella burnetii RSA 493
uugcgcguaaaauucc

SEQ ID NO: 2583063 - RNA, 14 nt, Coxiella burnetii RSA 493
uugcgcguucaaua

SEQ ID NO: 2583064 - RNA, 16 nt, Coxiella burnetii RSA 493
uugcgcguucaauaug

SEQ ID NO: 2583065 - RNA, 19 nt, Coxiella burnetii RSA 493
uugcuaaugacgauugugg

SEQ ID NO: 2583066 - RNA, 13 nt, Coxiella burnetii RSA 493
uugcuauuuuccu

SEQ ID NO: 2583067 - RNA, 16 nt, Coxiella burnetii RSA 493
uugcugaccuuuuccu

SEQ ID NO: 2583068 - RNA, 18 nt, Coxiella burnetii RSA 493
uugcugcauauauuccac

SEQ ID NO: 2583069 - RNA, 22 nt, Coxiella burnetii RSA 493
uugcuuaauacgagugcgcccg

SEQ ID NO: 2583070 - RNA, 23 nt, Coxiella burnetii RSA 493
uugcuuaccgaggucuuuuauuu

SEQ ID NO: 2583071 - RNA, 16 nt, Coxiella burnetii RSA 493
uugcuuuguucaucca

SEQ ID NO: 2583072 - RNA, 23 nt, Coxiella burnetii RSA 493
uuggaaaaucgauggaagaacau

SEQ ID NO: 2583073 - RNA, 18 nt, Coxiella burnetii RSA 493
uuggaacaaaccauucaa

SEQ ID NO: 2583074 - RNA, 18 nt, Coxiella burnetii RSA 493
uuggaaucgcggacaaua

SEQ ID NO: 2583075 - RNA, 14 nt, Coxiella burnetii RSA 493
uuggauaagauucg

SEQ ID NO: 2583076 - RNA, 15 nt, Coxiella burnetii RSA 493
uuggcagaauuugua

SEQ ID NO: 2583077 - RNA, 20 nt, Coxiella burnetii RSA 493
uuggcuaaauccagcgauug

SEQ ID NO: 2583078 - RNA, 18 nt, Coxiella burnetii RSA 493
uuggcuacuuucucaauu

SEQ ID NO: 2583079 - RNA, 13 nt, Coxiella burnetii RSA 493
uuggcucccagcg

SEQ ID NO: 2583080 - RNA, 22 nt, Coxiella burnetii RSA 493
uuggcucccagcguuuccaauu

SEQ ID NO: 2583081 - RNA, 17 nt, Coxiella burnetii RSA 493
uuggcuugcuccaaaau

SEQ ID NO: 2583082 - RNA, 18 nt, Coxiella burnetii RSA 493
uugggauucgaauuuguu

SEQ ID NO: 2583083 - RNA, 15 nt, Coxiella burnetii RSA 493
uugggcaaaaaaaga

SEQ ID NO: 2583084 - RNA, 16 nt, Coxiella burnetii RSA 493
uugggcucgaaaaacu

SEQ ID NO: 2583085 - RNA, 20 nt, Coxiella burnetii RSA 493
uugggcucgaaaaacuuuuu

SEQ ID NO: 2583086 - RNA, 17 nt, Coxiella burnetii RSA 493
uugggggucuuuuuuuc

SEQ ID NO: 2583087 - RNA, 18 nt, Coxiella burnetii RSA 493
uugggucuaccggcacaa

SEQ ID NO: 2583088 - RNA, 18 nt, Coxiella burnetii RSA 493
uugguaaugcuucuaauu

SEQ ID NO: 2583089 - RNA, 22 nt, Coxiella burnetii RSA 493
uugguagcccgaaaaaguagcg

SEQ ID NO: 2583090 - RNA, 21 nt, Coxiella burnetii RSA 493
uugguauaaaugaucccaugc

SEQ ID NO: 2583091 - RNA, 16 nt, Coxiella burnetii RSA 493
uuggucaggaacaacg

SEQ ID NO: 2583092 - RNA, 13 nt, Coxiella burnetii RSA 493
uugguuugcaaaa

SEQ ID NO: 2583093 - RNA, 14 nt, Coxiella burnetii RSA 493
uugguuuuccauga

SEQ ID NO: 2583094 - RNA, 20 nt, Coxiella burnetii RSA 493
uugguuuuccaugaggccaa

SEQ ID NO: 2583095 - RNA, 15 nt, Coxiella burnetii RSA 493
uuguaagaauucucc

SEQ ID NO: 2583096 - RNA, 21 nt, Coxiella burnetii RSA 493
uuguaagcguacaacaacaaa

SEQ ID NO: 2583097 - RNA, 13 nt, Coxiella burnetii RSA 493
uuguaauucaaau

SEQ ID NO: 2583098 - RNA, 13 nt, Coxiella burnetii RSA 493
uuguaauugcuug

SEQ ID NO: 2583099 - RNA, 12 nt, Coxiella burnetii RSA 493
uuguaauuuggg

SEQ ID NO: 2583100 - RNA, 13 nt, Coxiella burnetii RSA 493
uuguaccugccau

SEQ ID NO: 2583101 - RNA, 21 nt, Coxiella burnetii RSA 493
uuguagacaguuuagaaucuc

SEQ ID NO: 2583102 - RNA, 16 nt, Coxiella burnetii RSA 493
uuguagauuagaaaaa

SEQ ID NO: 2583103 - RNA, 17 nt, Coxiella burnetii RSA 493
uuguagauuagaaaaag

SEQ ID NO: 2583104 - RNA, 22 nt, Coxiella burnetii RSA 493
uuguagauuagaaaaagcgauu

SEQ ID NO: 2583105 - RNA, 19 nt, Coxiella burnetii RSA 493
uuguauaguucuaauaauu

SEQ ID NO: 2583106 - RNA, 14 nt, Coxiella burnetii RSA 493
uugucaauuuaccu

SEQ ID NO: 2583107 - RNA, 21 nt, Coxiella burnetii RSA 493
uuguccggcguugauuuuuua

SEQ ID NO: 2583108 - RNA, 20 nt, Coxiella burnetii RSA 493
uuguccgugauuacuucuuu

SEQ ID NO: 2583109 - RNA, 20 nt, Coxiella burnetii RSA 493
uuguccuguucuuuuuccau

SEQ ID NO: 2583110 - RNA, 14 nt, Coxiella burnetii RSA 493
uugucgccacuggg

SEQ ID NO: 2583111 - RNA, 15 nt, Coxiella burnetii RSA 493
uugucgccacugggu

SEQ ID NO: 2583112 - RNA, 19 nt, Coxiella burnetii RSA 493
uugucggccggauuuuaau

SEQ ID NO: 2583113 - RNA, 23 nt, Coxiella burnetii RSA 493
uugucggcgauacggugcagaag

SEQ ID NO: 2583114 - RNA, 21 nt, Coxiella burnetii RSA 493
uugugagucgccaauaauagu

SEQ ID NO: 2583115 - RNA, 23 nt, Coxiella burnetii RSA 493
uugugagucgccaauaauaguuu

SEQ ID NO: 2583116 - RNA, 19 nt, Coxiella burnetii RSA 493
uuguggagacugcuuuaga

SEQ ID NO: 2583117 - RNA, 19 nt, Coxiella burnetii RSA 493
uuguuaacaccuuuuucaa

SEQ ID NO: 2583118 - RNA, 22 nt, Coxiella burnetii RSA 493
uuguucauccagccaaaucgca

SEQ ID NO: 2583119 - RNA, 17 nt, Coxiella burnetii RSA 493
uuguuccaugucuugaa

SEQ ID NO: 2583120 - RNA, 12 nt, Coxiella burnetii RSA 493
uuguucuaaauc

SEQ ID NO: 2583121 - RNA, 21 nt, Coxiella burnetii RSA 493
uuguugaaaaccuacacuuuu

SEQ ID NO: 2583122 - RNA, 22 nt, Coxiella burnetii RSA 493
uuguugcggauuggcuuugccu

SEQ ID NO: 2583123 - RNA, 16 nt, Coxiella burnetii RSA 493
uuguugggcuucgcaa

SEQ ID NO: 2583124 - RNA, 21 nt, Coxiella burnetii RSA 493
uuguuucgcaacuuuuuuccu

SEQ ID NO: 2583125 - RNA, 22 nt, Coxiella burnetii RSA 493
uuguuucgcaacuuuuuuccuu

SEQ ID NO: 2583126 - RNA, 18 nt, Coxiella burnetii RSA 493
uuguuuuauaccuuuuuc

SEQ ID NO: 2583127 - RNA, 20 nt, Coxiella burnetii RSA 493
uuguuuuauaccuuuuuccc

SEQ ID NO: 2583128 - RNA, 17 nt, Coxiella burnetii RSA 493
uuguuuucuuacuguuu

SEQ ID NO: 2583129 - RNA, 19 nt, Coxiella burnetii RSA 493
uuguuuuuaagauuuuuau

SEQ ID NO: 2583130 - RNA, 19 nt, Coxiella burnetii RSA 493
uuguuuuuggcauaccuuu

SEQ ID NO: 2583131 - RNA, 12 nt, Coxiella burnetii RSA 493
uuuaaaaaacua

SEQ ID NO: 2583132 - RNA, 13 nt, Coxiella burnetii RSA 493
uuuaaaaaacuag

SEQ ID NO: 2583133 - RNA, 19 nt, Coxiella burnetii RSA 493
uuuaaaauaaguauccauc

SEQ ID NO: 2583134 - RNA, 11 nt, Coxiella burnetii RSA 493
uuuaaaccacu

SEQ ID NO: 2583135 - RNA, 17 nt, Coxiella burnetii RSA 493
uuuaaacucaauucgcu

SEQ ID NO: 2583136 - RNA, 13 nt, Coxiella burnetii RSA 493
uuuaaauaacaaa

SEQ ID NO: 2583137 - RNA, 20 nt, Coxiella burnetii RSA 493
uuuaaaucugacguuaucac

SEQ ID NO: 2583138 - RNA, 22 nt, Coxiella burnetii RSA 493
uuuaaaugcgguacuuaagaaa

SEQ ID NO: 2583139 - RNA, 13 nt, Coxiella burnetii RSA 493
uuuaaauuuuuca

SEQ ID NO: 2583140 - RNA, 18 nt, Coxiella burnetii RSA 493
uuuaacgauuuuaaguaa

SEQ ID NO: 2583141 - RNA, 18 nt, Coxiella burnetii RSA 493
uuuaacucgaaucacuug

SEQ ID NO: 2583142 - RNA, 15 nt, Coxiella burnetii RSA 493
uuuaacuuauaaauu

SEQ ID NO: 2583143 - RNA, 20 nt, Coxiella burnetii RSA 493
uuuaacuuauaaauuaaauu

SEQ ID NO: 2583144 - RNA, 19 nt, Coxiella burnetii RSA 493
uuuaacuucucuugaauaa

SEQ ID NO: 2583145 - RNA, 12 nt, Coxiella burnetii RSA 493
uuuaagauuuuu

SEQ ID NO: 2583146 - RNA, 17 nt, Coxiella burnetii RSA 493
uuuaagauuuuuauaau

SEQ ID NO: 2583147 - RNA, 19 nt, Coxiella burnetii RSA 493
uuuaaggcagggaaaguau

SEQ ID NO: 2583148 - RNA, 19 nt, Coxiella burnetii RSA 493
uuuaagucccaauuucuuu

SEQ ID NO: 2583149 - RNA, 13 nt, Coxiella burnetii RSA 493
uuuaaguuuuuca

SEQ ID NO: 2583150 - RNA, 11 nt, Coxiella burnetii RSA 493
uuuaauaauca

SEQ ID NO: 2583151 - RNA, 21 nt, Coxiella burnetii RSA 493
uuuaauaauucggguaacaaa

SEQ ID NO: 2583152 - RNA, 14 nt, Coxiella burnetii RSA 493
uuuaauacauaaaa

SEQ ID NO: 2583153 - RNA, 13 nt, Coxiella burnetii RSA 493
uuuaauaucaaaa

SEQ ID NO: 2583154 - RNA, 22 nt, Coxiella burnetii RSA 493
uuuaaucgcuccuaaauuuucu

SEQ ID NO: 2583155 - RNA, 22 nt, Coxiella burnetii RSA 493
uuuaaugagguuaauaaaaagg

SEQ ID NO: 2583156 - RNA, 17 nt, Coxiella burnetii RSA 493
uuuaaugucuuuuauuu

SEQ ID NO: 2583157 - RNA, 15 nt, Coxiella burnetii RSA 493
uuuaauuaagcuuga

SEQ ID NO: 2583158 - RNA, 13 nt, Coxiella burnetii RSA 493
uuuaauucauaaa

SEQ ID NO: 2583159 - RNA, 11 nt, Coxiella burnetii RSA 493
uuuacaauacg

SEQ ID NO: 2583160 - RNA, 20 nt, Coxiella burnetii RSA 493
uuuacaauacggugaaccga

SEQ ID NO: 2583161 - RNA, 14 nt, Coxiella burnetii RSA 493
uuuacaauucuauu

SEQ ID NO: 2583162 - RNA, 21 nt, Coxiella burnetii RSA 493
uuuacauagccucuauaaaua

SEQ ID NO: 2583163 - RNA, 22 nt, Coxiella burnetii RSA 493
uuuacauagccucuauaaauaa

SEQ ID NO: 2583164 - RNA, 16 nt, Coxiella burnetii RSA 493
uuuacgcuauuuuuua

SEQ ID NO: 2583165 - RNA, 20 nt, Coxiella burnetii RSA 493
uuuacgcuauuuuuuaaauc

SEQ ID NO: 2583166 - RNA, 22 nt, Coxiella burnetii RSA 493
uuuacguuuaaauaacaaaugc

SEQ ID NO: 2583167 - RNA, 16 nt, Coxiella burnetii RSA 493
uuuacuaaaaaacgau

SEQ ID NO: 2583168 - RNA, 15 nt, Coxiella burnetii RSA 493
uuuacugagaaaacu

SEQ ID NO: 2583169 - RNA, 12 nt, Coxiella burnetii RSA 493
uuuacuuuuuca

SEQ ID NO: 2583170 - RNA, 14 nt, Coxiella burnetii RSA 493
uuuagaaaaaugcu

SEQ ID NO: 2583171 - RNA, 23 nt, Coxiella burnetii RSA 493
uuuagaaagcggaauaagaaauc

SEQ ID NO: 2583172 - RNA, 13 nt, Coxiella burnetii RSA 493
uuuagccuuuacc

SEQ ID NO: 2583173 - RNA, 11 nt, Coxiella burnetii RSA 493
uuuagcgauuu

SEQ ID NO: 2583174 - RNA, 13 nt, Coxiella burnetii RSA 493
uuuaggcgccaca

SEQ ID NO: 2583175 - RNA, 14 nt, Coxiella burnetii RSA 493
uuuagguguaaguc

SEQ ID NO: 2583176 - RNA, 23 nt, Coxiella burnetii RSA 493
uuuagguguaaguccuccuucaa

SEQ ID NO: 2583177 - RNA, 13 nt, Coxiella burnetii RSA 493
uuuagucggaaau

SEQ ID NO: 2583178 - RNA, 15 nt, Coxiella burnetii RSA 493
uuuagugaaaguuuc

SEQ ID NO: 2583179 - RNA, 14 nt, Coxiella burnetii RSA 493
uuuaguuuuucccu

SEQ ID NO: 2583180 - RNA, 21 nt, Coxiella burnetii RSA 493
uuuauaaaauuuaauaagucu

SEQ ID NO: 2583181 - RNA, 18 nt, Coxiella burnetii RSA 493
uuuauaaaugauuuccaa

SEQ ID NO: 2583182 - RNA, 16 nt, Coxiella burnetii RSA 493
uuuauacacaucuuuu

SEQ ID NO: 2583183 - RNA, 20 nt, Coxiella burnetii RSA 493
uuuauacacaucuuuuaaaa

SEQ ID NO: 2583184 - RNA, 17 nt, Coxiella burnetii RSA 493
uuuauacccaaaaaccc

SEQ ID NO: 2583185 - RNA, 13 nt, Coxiella burnetii RSA 493
uuuauagcuugcu

SEQ ID NO: 2583186 - RNA, 18 nt, Coxiella burnetii RSA 493
uuuauauguguaacaaaa

SEQ ID NO: 2583187 - RNA, 20 nt, Coxiella burnetii RSA 493
uuuauauguguaacaaaaac

SEQ ID NO: 2583188 - RNA, 18 nt, Coxiella burnetii RSA 493
uuuauauuccugaaguaa

SEQ ID NO: 2583189 - RNA, 18 nt, Coxiella burnetii RSA 493
uuuauauuuacugagaaa

SEQ ID NO: 2583190 - RNA, 21 nt, Coxiella burnetii RSA 493
uuuaucacuccaauaauaaaa

SEQ ID NO: 2583191 - RNA, 22 nt, Coxiella burnetii RSA 493
uuuaucauacuuaauuucgcuc

SEQ ID NO: 2583192 - RNA, 18 nt, Coxiella burnetii RSA 493
uuuaugcuucaauaaaaa

SEQ ID NO: 2583193 - RNA, 21 nt, Coxiella burnetii RSA 493
uuuauggaauggauauuuuaa

SEQ ID NO: 2583194 - RNA, 14 nt, Coxiella burnetii RSA 493
uuuauuauaaaaaa

SEQ ID NO: 2583195 - RNA, 20 nt, Coxiella burnetii RSA 493
uuuauucucccaaacaauca

SEQ ID NO: 2583196 - RNA, 17 nt, Coxiella burnetii RSA 493
uuuauuuucaaaugaau

SEQ ID NO: 2583197 - RNA, 21 nt, Coxiella burnetii RSA 493
uuucaaacacuuguuugccca

SEQ ID NO: 2583198 - RNA, 21 nt, Coxiella burnetii RSA 493
uuucaaagauaucguccagcu

SEQ ID NO: 2583199 - RNA, 18 nt, Coxiella burnetii RSA 493
uuucaaaugaccaaauaa

SEQ ID NO: 2583200 - RNA, 20 nt, Coxiella burnetii RSA 493
uuucaaaugaccaaauaauu

SEQ ID NO: 2583201 - RNA, 12 nt, Coxiella burnetii RSA 493
uuucaaauuucu

SEQ ID NO: 2583202 - RNA, 17 nt, Coxiella burnetii RSA 493
uuucaacuacuugauau

SEQ ID NO: 2583203 - RNA, 19 nt, Coxiella burnetii RSA 493
uuucaaggccgugaauucg

SEQ ID NO: 2583204 - RNA, 16 nt, Coxiella burnetii RSA 493
uuucaauaaacccguu

SEQ ID NO: 2583205 - RNA, 14 nt, Coxiella burnetii RSA 493
uuucaauaaauaaa

SEQ ID NO: 2583206 - RNA, 13 nt, Coxiella burnetii RSA 493
uuucaaugccauu

SEQ ID NO: 2583207 - RNA, 17 nt, Coxiella burnetii RSA 493
uuucaauuagcauuuuc

SEQ ID NO: 2583208 - RNA, 15 nt, Coxiella burnetii RSA 493
uuucaauuauacuga

SEQ ID NO: 2583209 - RNA, 17 nt, Coxiella burnetii RSA 493
uuucacgaauuaaaaaa

SEQ ID NO: 2583210 - RNA, 15 nt, Coxiella burnetii RSA 493
uuucacgauuuuucu

SEQ ID NO: 2583211 - RNA, 13 nt, Coxiella burnetii RSA 493
uuucacuaaaaga

SEQ ID NO: 2583212 - RNA, 19 nt, Coxiella burnetii RSA 493
uuucacuguugagcaaagc

SEQ ID NO: 2583213 - RNA, 20 nt, Coxiella burnetii RSA 493
uuucacuuuauuuucauacg

SEQ ID NO: 2583214 - RNA, 23 nt, Coxiella burnetii RSA 493
uuucauaaggccaauuucuaauc

SEQ ID NO: 2583215 - RNA, 22 nt, Coxiella burnetii RSA 493
uuucauaaguccgcuuuucccu

SEQ ID NO: 2583216 - RNA, 13 nt, Coxiella burnetii RSA 493
uuucauagguuuu

SEQ ID NO: 2583217 - RNA, 23 nt, Coxiella burnetii RSA 493
uuucauagguuuuuuuaaacguu

SEQ ID NO: 2583218 - RNA, 20 nt, Coxiella burnetii RSA 493
uuucauccagugaaaacccg

SEQ ID NO: 2583219 - RNA, 17 nt, Coxiella burnetii RSA 493
uuucaugaaguuccauu

SEQ ID NO: 2583220 - RNA, 19 nt, Coxiella burnetii RSA 493
uuucauuaagcaauuuuuu

SEQ ID NO: 2583221 - RNA, 17 nt, Coxiella burnetii RSA 493
uuucauuacuuggccga

SEQ ID NO: 2583222 - RNA, 17 nt, Coxiella burnetii RSA 493
uuucauucauucgcuuu

SEQ ID NO: 2583223 - RNA, 19 nt, Coxiella burnetii RSA 493
uuucauuuugauucucuau

SEQ ID NO: 2583224 - RNA, 23 nt, Coxiella burnetii RSA 493
uuucauuuuuuccucuuaaggac

SEQ ID NO: 2583225 - RNA, 16 nt, Coxiella burnetii RSA 493
uuuccaacgcuuguuu

SEQ ID NO: 2583226 - RNA, 22 nt, Coxiella burnetii RSA 493
uuuccaagcgauuaaauauuua

SEQ ID NO: 2583227 - RNA, 16 nt, Coxiella burnetii RSA 493
uuuccaauuguuugaa

SEQ ID NO: 2583228 - RNA, 18 nt, Coxiella burnetii RSA 493
uuuccaauuguuugaaaa

SEQ ID NO: 2583229 - RNA, 13 nt, Coxiella burnetii RSA 493
uuuccacucgucu

SEQ ID NO: 2583230 - RNA, 20 nt, Coxiella burnetii RSA 493
uuuccagccuuuaguuuuau

SEQ ID NO: 2583231 - RNA, 15 nt, Coxiella burnetii RSA 493
uuuccaucuccuuuu

SEQ ID NO: 2583232 - RNA, 14 nt, Coxiella burnetii RSA 493
uuuccccuucuucg

SEQ ID NO: 2583233 - RNA, 13 nt, Coxiella burnetii RSA 493
uuucccucucagu

SEQ ID NO: 2583234 - RNA, 16 nt, Coxiella burnetii RSA 493
uuuccgaguauuuauu

SEQ ID NO: 2583235 - RNA, 18 nt, Coxiella burnetii RSA 493
uuuccguaaaacaaugca

SEQ ID NO: 2583236 - RNA, 18 nt, Coxiella burnetii RSA 493
uuuccguguaauaacgug

SEQ ID NO: 2583237 - RNA, 17 nt, Coxiella burnetii RSA 493
uuuccuagauuuuggcu

SEQ ID NO: 2583238 - RNA, 15 nt, Coxiella burnetii RSA 493
uuuccugucguuaau

SEQ ID NO: 2583239 - RNA, 14 nt, Coxiella burnetii RSA 493
uuuccuuucuuucu

SEQ ID NO: 2583240 - RNA, 15 nt, Coxiella burnetii RSA 493
uuuccuuuucauuuu

SEQ ID NO: 2583241 - RNA, 14 nt, Coxiella burnetii RSA 493
uuucgauaaauuuu

SEQ ID NO: 2583242 - RNA, 21 nt, Coxiella burnetii RSA 493
uuucgcaggauaauguuugau

SEQ ID NO: 2583243 - RNA, 18 nt, Coxiella burnetii RSA 493
uuucgcuucaauucuuuu

SEQ ID NO: 2583244 - RNA, 19 nt, Coxiella burnetii RSA 493
uuucgcuucgcucagacgg

SEQ ID NO: 2583245 - RNA, 20 nt, Coxiella burnetii RSA 493
uuucgcuucgcucagacggg

SEQ ID NO: 2583246 - RNA, 18 nt, Coxiella burnetii RSA 493
uuucgcuucgcucauacg

SEQ ID NO: 2583247 - RNA, 19 nt, Coxiella burnetii RSA 493
uuucgcuucgcucauacgg

SEQ ID NO: 2583248 - RNA, 20 nt, Coxiella burnetii RSA 493
uuucgcuucgcuccauacgg

SEQ ID NO: 2583249 - RNA, 18 nt, Coxiella burnetii RSA 493
uuucggauuuugaacagu

SEQ ID NO: 2583250 - RNA, 15 nt, Coxiella burnetii RSA 493
uuucgguuuucgcug

SEQ ID NO: 2583251 - RNA, 21 nt, Coxiella burnetii RSA 493
uuucguaugccgcuugaaaaa

SEQ ID NO: 2583252 - RNA, 22 nt, Coxiella burnetii RSA 493
uuucuaaauaaugaauauucug

SEQ ID NO: 2583253 - RNA, 19 nt, Coxiella burnetii RSA 493
uuucuaacgucgcaaauaa

SEQ ID NO: 2583254 - RNA, 21 nt, Coxiella burnetii RSA 493
uuucuagagcaacgauuuucc

SEQ ID NO: 2583255 - RNA, 19 nt, Coxiella burnetii RSA 493
uuucuagggagaaaaauuu

SEQ ID NO: 2583256 - RNA, 20 nt, Coxiella burnetii RSA 493
uuucuauccagaaaccaaaa

SEQ ID NO: 2583257 - RNA, 17 nt, Coxiella burnetii RSA 493
uuucucaauagaaaaaa

SEQ ID NO: 2583258 - RNA, 19 nt, Coxiella burnetii RSA 493
uuucucgaaugacaacccc

SEQ ID NO: 2583259 - RNA, 16 nt, Coxiella burnetii RSA 493
uuucucgauauucuau

SEQ ID NO: 2583260 - RNA, 22 nt, Coxiella burnetii RSA 493
uuucucucucauaaucgauaau

SEQ ID NO: 2583261 - RNA, 15 nt, Coxiella burnetii RSA 493
uuucucuucaacgcc

SEQ ID NO: 2583262 - RNA, 16 nt, Coxiella burnetii RSA 493
uuucucuuuuuuccaa

SEQ ID NO: 2583263 - RNA, 15 nt, Coxiella burnetii RSA 493
uuucugaaaauucug

SEQ ID NO: 2583264 - RNA, 14 nt, Coxiella burnetii RSA 493
uuucugauuuuuga

SEQ ID NO: 2583265 - RNA, 16 nt, Coxiella burnetii RSA 493
uuucugccgcugauau

SEQ ID NO: 2583266 - RNA, 19 nt, Coxiella burnetii RSA 493
uuucugccgcugauauucc

SEQ ID NO: 2583267 - RNA, 19 nt, Coxiella burnetii RSA 493
uuucugggagauuuauucc

SEQ ID NO: 2583268 - RNA, 20 nt, Coxiella burnetii RSA 493
uuucugggccaaauaaaaaa

SEQ ID NO: 2583269 - RNA, 15 nt, Coxiella burnetii RSA 493
uuucugguuuccuuu

SEQ ID NO: 2583270 - RNA, 17 nt, Coxiella burnetii RSA 493
uuucugguuuccuuucu

SEQ ID NO: 2583271 - RNA, 19 nt, Coxiella burnetii RSA 493
uuucuguuuuacugccuac

SEQ ID NO: 2583272 - RNA, 12 nt, Coxiella burnetii RSA 493
uuucuuagagag

SEQ ID NO: 2583273 - RNA, 18 nt, Coxiella burnetii RSA 493
uuucuucacuuuccuuau

SEQ ID NO: 2583274 - RNA, 11 nt, Coxiella burnetii RSA 493
uuucuucauau

SEQ ID NO: 2583275 - RNA, 12 nt, Coxiella burnetii RSA 493
uuucuucauauu

SEQ ID NO: 2583276 - RNA, 17 nt, Coxiella burnetii RSA 493
uuucuucauauucuuca

SEQ ID NO: 2583277 - RNA, 12 nt, Coxiella burnetii RSA 493
uuucuucauuug

SEQ ID NO: 2583278 - RNA, 15 nt, Coxiella burnetii RSA 493
uuucuuccucaacgg

SEQ ID NO: 2583279 - RNA, 16 nt, Coxiella burnetii RSA 493
uuucuucuuuucuauu

SEQ ID NO: 2583280 - RNA, 16 nt, Coxiella burnetii RSA 493
uuucuugaaaaacuuc

SEQ ID NO: 2583281 - RNA, 20 nt, Coxiella burnetii RSA 493
uuucuugucgaaaacuaguu

SEQ ID NO: 2583282 - RNA, 14 nt, Coxiella burnetii RSA 493
uuucuuuccaucac

SEQ ID NO: 2583283 - RNA, 13 nt, Coxiella burnetii RSA 493
uuucuuucuucac

SEQ ID NO: 2583284 - RNA, 16 nt, Coxiella burnetii RSA 493
uuucuuucuucuaaug

SEQ ID NO: 2583285 - RNA, 14 nt, Coxiella burnetii RSA 493
uuucuuucuuuucu

SEQ ID NO: 2583286 - RNA, 23 nt, Coxiella burnetii RSA 493
uuucuuuggguuggcuuuugaca

SEQ ID NO: 2583287 - RNA, 14 nt, Coxiella burnetii RSA 493
uuucuuuuauaaaa

SEQ ID NO: 2583288 - RNA, 14 nt, Coxiella burnetii RSA 493
uuucuuuucuaaau

SEQ ID NO: 2583289 - RNA, 22 nt, Coxiella burnetii RSA 493
uuugaaaaauaaaaggagaaau

SEQ ID NO: 2583290 - RNA, 20 nt, Coxiella burnetii RSA 493
uuugaacaguuccugaaacg

SEQ ID NO: 2583291 - RNA, 13 nt, Coxiella burnetii RSA 493
uuugaagcgauug

SEQ ID NO: 2583292 - RNA, 20 nt, Coxiella burnetii RSA 493
uuugaaggaauaaaaccuuc

SEQ ID NO: 2583293 - RNA, 15 nt, Coxiella burnetii RSA 493
uuugaauuuuuugaa

SEQ ID NO: 2583294 - RNA, 15 nt, Coxiella burnetii RSA 493
uuugacaaacaguua

SEQ ID NO: 2583295 - RNA, 12 nt, Coxiella burnetii RSA 493
uuugacccgaaa

SEQ ID NO: 2583296 - RNA, 22 nt, Coxiella burnetii RSA 493
uuugacuaagucaaaaacuuca

SEQ ID NO: 2583297 - RNA, 21 nt, Coxiella burnetii RSA 493
uuugagugguugaaaacgaua

SEQ ID NO: 2583298 - RNA, 19 nt, Coxiella burnetii RSA 493
uuugauaaaacuugauuau

SEQ ID NO: 2583299 - RNA, 17 nt, Coxiella burnetii RSA 493
uuugauaaauuaaaaaa

SEQ ID NO: 2583300 - RNA, 19 nt, Coxiella burnetii RSA 493
uuugauccuugcaauaagc

SEQ ID NO: 2583301 - RNA, 23 nt, Coxiella burnetii RSA 493
uuugaugaucggaggaaauauuu

SEQ ID NO: 2583302 - RNA, 18 nt, Coxiella burnetii RSA 493
uuugauuagagcgauuau

SEQ ID NO: 2583303 - RNA, 15 nt, Coxiella burnetii RSA 493
uuugauuuugcugaa

SEQ ID NO: 2583304 - RNA, 13 nt, Coxiella burnetii RSA 493
uuugcaaaacuaa

SEQ ID NO: 2583305 - RNA, 15 nt, Coxiella burnetii RSA 493
uuugcaaaugaauaa

SEQ ID NO: 2583306 - RNA, 10 nt, Coxiella burnetii RSA 493
uuugcacaua

SEQ ID NO: 2583307 - RNA, 16 nt, Coxiella burnetii RSA 493
uuugcagaugcuccau

SEQ ID NO: 2583308 - RNA, 15 nt, Coxiella burnetii RSA 493
uuugcauuaaucuuc

SEQ ID NO: 2583309 - RNA, 19 nt, Coxiella burnetii RSA 493
uuugcauuaaucuuccauu

SEQ ID NO: 2583310 - RNA, 22 nt, Coxiella burnetii RSA 493
uuugcauuaaucuuccauuaau

SEQ ID NO: 2583311 - RNA, 21 nt, Coxiella burnetii RSA 493
uuugccaauauaaauaaucuu

SEQ ID NO: 2583312 - RNA, 23 nt, Coxiella burnetii RSA 493
uuugccaauauaaauaaucuucc

SEQ ID NO: 2583313 - RNA, 22 nt, Coxiella burnetii RSA 493
uuugccacuauauacuccccua

SEQ ID NO: 2583314 - RNA, 17 nt, Coxiella burnetii RSA 493
uuugcgcaaaauuagga

SEQ ID NO: 2583315 - RNA, 19 nt, Coxiella burnetii RSA 493
uuugcgcuugcguaaaguu

SEQ ID NO: 2583316 - RNA, 19 nt, Coxiella burnetii RSA 493
uuugcuaagauaauuacaa

SEQ ID NO: 2583317 - RNA, 15 nt, Coxiella burnetii RSA 493
uuugcuccauacggg

SEQ ID NO: 2583318 - RNA, 21 nt, Coxiella burnetii RSA 493
uuugcugaagacguauuugga

SEQ ID NO: 2583319 - RNA, 19 nt, Coxiella burnetii RSA 493
uuugcuggagaucacugga

SEQ ID NO: 2583320 - RNA, 18 nt, Coxiella burnetii RSA 493
uuugcuugaguaaccucu

SEQ ID NO: 2583321 - RNA, 19 nt, Coxiella burnetii RSA 493
uuuggauugccaauugucu

SEQ ID NO: 2583322 - RNA, 19 nt, Coxiella burnetii RSA 493
uuugguggaugaucaucgg

SEQ ID NO: 2583323 - RNA, 16 nt, Coxiella burnetii RSA 493
uuuguagauuagaaaa

SEQ ID NO: 2583324 - RNA, 23 nt, Coxiella burnetii RSA 493
uuuguagauuagaaaaagcgauu

SEQ ID NO: 2583325 - RNA, 12 nt, Coxiella burnetii RSA 493
uuugucaauggg

SEQ ID NO: 2583326 - RNA, 22 nt, Coxiella burnetii RSA 493
uuugucuccuacgucggguuau

SEQ ID NO: 2583327 - RNA, 20 nt, Coxiella burnetii RSA 493
uuugugagucgccaauaaua

SEQ ID NO: 2583328 - RNA, 13 nt, Coxiella burnetii RSA 493
uuugugauuuuaa

SEQ ID NO: 2583329 - RNA, 21 nt, Coxiella burnetii RSA 493
uuugugcauaaauuauuuuaa

SEQ ID NO: 2583330 - RNA, 13 nt, Coxiella burnetii RSA 493
uuuguuaauucuu

SEQ ID NO: 2583331 - RNA, 18 nt, Coxiella burnetii RSA 493
uuuguuccuugagaguaa

SEQ ID NO: 2583332 - RNA, 22 nt, Coxiella burnetii RSA 493
uuuguucgagaaggccacauuu

SEQ ID NO: 2583333 - RNA, 19 nt, Coxiella burnetii RSA 493
uuuguuuugaucagagaaa

SEQ ID NO: 2583334 - RNA, 16 nt, Coxiella burnetii RSA 493
uuuuaaaaaaaucgcu

SEQ ID NO: 2583335 - RNA, 13 nt, Coxiella burnetii RSA 493
uuuuaaaaaagaa

SEQ ID NO: 2583336 - RNA, 14 nt, Coxiella burnetii RSA 493
uuuuaaaaaagaaa

SEQ ID NO: 2583337 - RNA, 22 nt, Coxiella burnetii RSA 493
uuuuaaauaagggauaaaacac

SEQ ID NO: 2583338 - RNA, 12 nt, Coxiella burnetii RSA 493
uuuuaaaucuuc

SEQ ID NO: 2583339 - RNA, 20 nt, Coxiella burnetii RSA 493
uuuuaaaucuuccaauuuuu

SEQ ID NO: 2583340 - RNA, 23 nt, Coxiella burnetii RSA 493
uuuuaaaugcgguacuuaagaaa

SEQ ID NO: 2583341 - RNA, 13 nt, Coxiella burnetii RSA 493
uuuuaaauuaucu

SEQ ID NO: 2583342 - RNA, 19 nt, Coxiella burnetii RSA 493
uuuuaacuucucuugaaua

SEQ ID NO: 2583343 - RNA, 19 nt, Coxiella burnetii RSA 493
uuuuaagaugccagugcuc

SEQ ID NO: 2583344 - RNA, 12 nt, Coxiella burnetii RSA 493
uuuuaauauuug

SEQ ID NO: 2583345 - RNA, 14 nt, Coxiella burnetii RSA 493
uuuuaauauuuuuu

SEQ ID NO: 2583346 - RNA, 19 nt, Coxiella burnetii RSA 493
uuuuaauuaagcuugaaaa

SEQ ID NO: 2583347 - RNA, 20 nt, Coxiella burnetii RSA 493
uuuuaauuaagcuugaaaaa

SEQ ID NO: 2583348 - RNA, 14 nt, Coxiella burnetii RSA 493
uuuuaauugaauuu

SEQ ID NO: 2583349 - RNA, 13 nt, Coxiella burnetii RSA 493
uuuuaauuuuuuc

SEQ ID NO: 2583350 - RNA, 17 nt, Coxiella burnetii RSA 493
uuuuacccguuuaaauu

SEQ ID NO: 2583351 - RNA, 16 nt, Coxiella burnetii RSA 493
uuuuacgcuauuuuuu

SEQ ID NO: 2583352 - RNA, 20 nt, Coxiella burnetii RSA 493
uuuuacgcuauuuuuuaaau

SEQ ID NO: 2583353 - RNA, 13 nt, Coxiella burnetii RSA 493
uuuuacuuuuuca

SEQ ID NO: 2583354 - RNA, 21 nt, Coxiella burnetii RSA 493
uuuuagcacagcgaaauacga

SEQ ID NO: 2583355 - RNA, 18 nt, Coxiella burnetii RSA 493
uuuuagugaaaguuucau

SEQ ID NO: 2583356 - RNA, 14 nt, Coxiella burnetii RSA 493
uuuuaguuaaagaa

SEQ ID NO: 2583357 - RNA, 15 nt, Coxiella burnetii RSA 493
uuuuauaaaauuuaa

SEQ ID NO: 2583358 - RNA, 16 nt, Coxiella burnetii RSA 493
uuuuauagcuugcuua

SEQ ID NO: 2583359 - RNA, 15 nt, Coxiella burnetii RSA 493
uuuuauccaaacuuu

SEQ ID NO: 2583360 - RNA, 22 nt, Coxiella burnetii RSA 493
uuuuaucguucgcaauugaaaa

SEQ ID NO: 2583361 - RNA, 19 nt, Coxiella burnetii RSA 493
uuuuaucuuauuauucaua

SEQ ID NO: 2583362 - RNA, 23 nt, Coxiella burnetii RSA 493
uuuuaugcgcuuuccauuuuuua

SEQ ID NO: 2583363 - RNA, 21 nt, Coxiella burnetii RSA 493
uuuuaugcuucaauaaaaaag

SEQ ID NO: 2583364 - RNA, 17 nt, Coxiella burnetii RSA 493
uuuuaugucguucaauu

SEQ ID NO: 2583365 - RNA, 13 nt, Coxiella burnetii RSA 493
uuuuauuaucauc

SEQ ID NO: 2583366 - RNA, 16 nt, Coxiella burnetii RSA 493
uuuuauuaucaucgca

SEQ ID NO: 2583367 - RNA, 17 nt, Coxiella burnetii RSA 493
uuuuauugucauguuca

SEQ ID NO: 2583368 - RNA, 18 nt, Coxiella burnetii RSA 493
uuuuauuuaaaaaacuag

SEQ ID NO: 2583369 - RNA, 13 nt, Coxiella burnetii RSA 493
uuuuauuugaaau

SEQ ID NO: 2583370 - RNA, 14 nt, Coxiella burnetii RSA 493
uuuuauuugaaaua

SEQ ID NO: 2583371 - RNA, 20 nt, Coxiella burnetii RSA 493
uuuucaaaacaaucaaugca

SEQ ID NO: 2583372 - RNA, 13 nt, Coxiella burnetii RSA 493
uuuucaaaauuua

SEQ ID NO: 2583373 - RNA, 18 nt, Coxiella burnetii RSA 493
uuuucaaagauaucgucc

SEQ ID NO: 2583374 - RNA, 22 nt, Coxiella burnetii RSA 493
uuuucaaggccgugaauucgga

SEQ ID NO: 2583375 - RNA, 14 nt, Coxiella burnetii RSA 493
uuuucaaugccauu

SEQ ID NO: 2583376 - RNA, 15 nt, Coxiella burnetii RSA 493
uuuucaccuuuuccc

SEQ ID NO: 2583377 - RNA, 15 nt, Coxiella burnetii RSA 493
uuuucagucaccauu

SEQ ID NO: 2583378 - RNA, 18 nt, Coxiella burnetii RSA 493
uuuucauccagugaaaac

SEQ ID NO: 2583379 - RNA, 15 nt, Coxiella burnetii RSA 493
uuuucaugcaaaaac

SEQ ID NO: 2583380 - RNA, 13 nt, Coxiella burnetii RSA 493
uuuucauucucaa

SEQ ID NO: 2583381 - RNA, 19 nt, Coxiella burnetii RSA 493
uuuucccuaggaaacgaag

SEQ ID NO: 2583382 - RNA, 15 nt, Coxiella burnetii RSA 493
uuuucccucuacaaa

SEQ ID NO: 2583383 - RNA, 18 nt, Coxiella burnetii RSA 493
uuuuccgugcagaaacaa

SEQ ID NO: 2583384 - RNA, 22 nt, Coxiella burnetii RSA 493
uuuuccugacuuccagauuuag

SEQ ID NO: 2583385 - RNA, 20 nt, Coxiella burnetii RSA 493
uuuuccugcugauugagaau

SEQ ID NO: 2583386 - RNA, 22 nt, Coxiella burnetii RSA 493
uuuucgcggagaggucaucauu

SEQ ID NO: 2583387 - RNA, 18 nt, Coxiella burnetii RSA 493
uuuucgcuucaauucuuu

SEQ ID NO: 2583388 - RNA, 18 nt, Coxiella burnetii RSA 493
uuuucguuuaacaaugaa

SEQ ID NO: 2583389 - RNA, 20 nt, Coxiella burnetii RSA 493
uuuucuauaaguccaagacu

SEQ ID NO: 2583390 - RNA, 17 nt, Coxiella burnetii RSA 493
uuuucuauccagaaacc

SEQ ID NO: 2583391 - RNA, 13 nt, Coxiella burnetii RSA 493
uuuucuauuuuuu

SEQ ID NO: 2583392 - RNA, 23 nt, Coxiella burnetii RSA 493
uuuucugaaacaucaauaccgau

SEQ ID NO: 2583393 - RNA, 23 nt, Coxiella burnetii RSA 493
uuuucugccgcugauauucccau

SEQ ID NO: 2583394 - RNA, 15 nt, Coxiella burnetii RSA 493
uuuucuucaauggca

SEQ ID NO: 2583395 - RNA, 23 nt, Coxiella burnetii RSA 493
uuuucuucgcuggauuuuuuaau

SEQ ID NO: 2583396 - RNA, 15 nt, Coxiella burnetii RSA 493
uuuucuucugaauua

SEQ ID NO: 2583397 - RNA, 21 nt, Coxiella burnetii RSA 493
uuuucuucuugcaucugacau

SEQ ID NO: 2583398 - RNA, 14 nt, Coxiella burnetii RSA 493
uuuucuucuuuucu

SEQ ID NO: 2583399 - RNA, 15 nt, Coxiella burnetii RSA 493
uuuucuuuccaucac

SEQ ID NO: 2583400 - RNA, 12 nt, Coxiella burnetii RSA 493
uuuucuuuuaau

SEQ ID NO: 2583401 - RNA, 13 nt, Coxiella burnetii RSA 493
uuuugaaaaauaa

SEQ ID NO: 2583402 - RNA, 19 nt, Coxiella burnetii RSA 493
uuuugaaaaauaaaaggag

SEQ ID NO: 2583403 - RNA, 23 nt, Coxiella burnetii RSA 493
uuuugaauacaacgcuguuaaaa

SEQ ID NO: 2583404 - RNA, 15 nt, Coxiella burnetii RSA 493
uuuugaauaucaugg

SEQ ID NO: 2583405 - RNA, 23 nt, Coxiella burnetii RSA 493
uuuugauaggauuauuaucaaag

SEQ ID NO: 2583406 - RNA, 22 nt, Coxiella burnetii RSA 493
uuuugauaggguucgcaccuaa

SEQ ID NO: 2583407 - RNA, 16 nt, Coxiella burnetii RSA 493
uuuugauuaaccacuc

SEQ ID NO: 2583408 - RNA, 19 nt, Coxiella burnetii RSA 493
uuuugcaaugccagugcau

SEQ ID NO: 2583409 - RNA, 16 nt, Coxiella burnetii RSA 493
uuuugccggaguuaac

SEQ ID NO: 2583410 - RNA, 21 nt, Coxiella burnetii RSA 493
uuuugcgcuuauagcuuguuc

SEQ ID NO: 2583411 - RNA, 24 nt, Coxiella burnetii RSA 493
uuuugcugaauugaugauguuuau

SEQ ID NO: 2583412 - RNA, 13 nt, Coxiella burnetii RSA 493
uuuuguaaauuuu

SEQ ID NO: 2583413 - RNA, 11 nt, Coxiella burnetii RSA 493
uuuuguacugc

SEQ ID NO: 2583414 - RNA, 16 nt, Coxiella burnetii RSA 493
uuuugugcauaaauua

SEQ ID NO: 2583415 - RNA, 20 nt, Coxiella burnetii RSA 493
uuuugugcauaaauuauuuu

SEQ ID NO: 2583416 - RNA, 16 nt, Coxiella burnetii RSA 493
uuuuguuugauuuguu

SEQ ID NO: 2583417 - RNA, 22 nt, Coxiella burnetii RSA 493
uuuuguuugauuuguucuaaau

SEQ ID NO: 2583418 - RNA, 11 nt, Coxiella burnetii RSA 493
uuuuguuuuaa

SEQ ID NO: 2583419 - RNA, 11 nt, Coxiella burnetii RSA 493
uuuuuaaaaaa

SEQ ID NO: 2583420 - RNA, 11 nt, Coxiella burnetii RSA 493
uuuuuaaaagu

SEQ ID NO: 2583421 - RNA, 13 nt, Coxiella burnetii RSA 493
uuuuuaaacguuu

SEQ ID NO: 2583422 - RNA, 18 nt, Coxiella burnetii RSA 493
uuuuuaaagccauagaau

SEQ ID NO: 2583423 - RNA, 18 nt, Coxiella burnetii RSA 493
uuuuuaaaugaauuacuu

SEQ ID NO: 2583424 - RNA, 15 nt, Coxiella burnetii RSA 493
uuuuuaaauuucuca

SEQ ID NO: 2583425 - RNA, 15 nt, Coxiella burnetii RSA 493
uuuuuaagucccaau

SEQ ID NO: 2583426 - RNA, 23 nt, Coxiella burnetii RSA 493
uuuuuaaugcgauucuuuuucgu

SEQ ID NO: 2583427 - RNA, 23 nt, Coxiella burnetii RSA 493
uuuuuacccguuuaaauuugccu

SEQ ID NO: 2583428 - RNA, 22 nt, Coxiella burnetii RSA 493
uuuuuacgacccccaauuuaau

SEQ ID NO: 2583429 - RNA, 15 nt, Coxiella burnetii RSA 493
uuuuuauauuccuga

SEQ ID NO: 2583430 - RNA, 12 nt, Coxiella burnetii RSA 493
uuuuuaugaaaa

SEQ ID NO: 2583431 - RNA, 15 nt, Coxiella burnetii RSA 493
uuuuuaugcuucaau

SEQ ID NO: 2583432 - RNA, 17 nt, Coxiella burnetii RSA 493
uuuuuauuaucaucgca

SEQ ID NO: 2583433 - RNA, 14 nt, Coxiella burnetii RSA 493
uuuuuauuugaaau

SEQ ID NO: 2583434 - RNA, 16 nt, Coxiella burnetii RSA 493
uuuuuauuuugacuua

SEQ ID NO: 2583435 - RNA, 21 nt, Coxiella burnetii RSA 493
uuuuucaaaacaaucaaugca

SEQ ID NO: 2583436 - RNA, 22 nt, Coxiella burnetii RSA 493
uuuuucaacuacuugauauucc

SEQ ID NO: 2583437 - RNA, 14 nt, Coxiella burnetii RSA 493
uuuuucauccagug

SEQ ID NO: 2583438 - RNA, 24 nt, Coxiella burnetii RSA 493
uuuuucggggcggcuuuuuucgcu

SEQ ID NO: 2583439 - RNA, 18 nt, Coxiella burnetii RSA 493
uuuuucguuuaacaauga

SEQ ID NO: 2583440 - RNA, 10 nt, Coxiella burnetii RSA 493
uuuuucucuu

SEQ ID NO: 2583441 - RNA, 12 nt, Coxiella burnetii RSA 493
uuuuucucuucu

SEQ ID NO: 2583442 - RNA, 12 nt, Coxiella burnetii RSA 493
uuuuucuucuga

SEQ ID NO: 2583443 - RNA, 17 nt, Coxiella burnetii RSA 493
uuuuugaagcauauaac

SEQ ID NO: 2583444 - RNA, 18 nt, Coxiella burnetii RSA 493
uuuuugaagcuauccaaa

SEQ ID NO: 2583445 - RNA, 13 nt, Coxiella burnetii RSA 493
uuuuugcaaauaa

SEQ ID NO: 2583446 - RNA, 16 nt, Coxiella burnetii RSA 493
uuuuugccagacuucu

SEQ ID NO: 2583447 - RNA, 22 nt, Coxiella burnetii RSA 493
uuuuuggaaugagcauaacgaa

SEQ ID NO: 2583448 - RNA, 22 nt, Coxiella burnetii RSA 493
uuuuuggcauaaauagcauuaa

SEQ ID NO: 2583449 - RNA, 22 nt, Coxiella burnetii RSA 493
uuuuuggcaugauguucucucc

SEQ ID NO: 2583450 - RNA, 12 nt, Coxiella burnetii RSA 493
uuuuuguuugau

SEQ ID NO: 2583451 - RNA, 12 nt, Coxiella burnetii RSA 493
uuuuuucuucug

SEQ ID NO: 2583452 - RNA, 23 nt, Coxiella burnetii RSA 493
uuuuuucuucugaauuaauuccc

SEQ ID NO: 2583453 - RNA, 12 nt, Coxiella burnetii RSA 493
uuuuuugaaauu

SEQ ID NO: 2583454 - RNA, 10 nt, Coxiella burnetii RSA 493
uuuuuugcgc

SEQ ID NO: 2583455 - RNA, 11 nt, Coxiella burnetii RSA 493
uuuuuuuguug

SEQ ID NO: 2583456 - RNA, 12 nt, Coxiella burnetii RSA 493
uuuuuuuuaaaa

SEQ ID NO: 2583457 - RNA, 11 nt, Coxiella burnetii RSA 493
uuuuuuuucuu

SEQ ID NO: 2583458 - RNA, 17 nt, Coxiella burnetii RSA 493
agguuaccggcaaaccc

SEQ ID NO: 2583459 - RNA, 19 nt, Coxiella burnetii RSA 493
agguuauuaagcguuccuu

SEQ ID NO: 2583460 - RNA, 20 nt, Coxiella burnetii RSA 493
agguuauuaagcguuccuuu

SEQ ID NO: 2583461 - RNA, 15 nt, Coxiella burnetii RSA 493
agguuauuuuuuccu

SEQ ID NO: 2583462 - RNA, 17 nt, Coxiella burnetii RSA 493
agguuauuuuuugcucu

SEQ ID NO: 2583463 - RNA, 22 nt, Coxiella burnetii RSA 493
agguucagauucaggaaacguu

SEQ ID NO: 2583464 - RNA, 17 nt, Coxiella burnetii RSA 493
agguucuggcuuucccu

SEQ ID NO: 2583465 - RNA, 15 nt, Coxiella burnetii RSA 493
agguugaccacagcg

SEQ ID NO: 2583466 - RNA, 22 nt, Coxiella burnetii RSA 493
agguugucaacaaaauuuuuca

SEQ ID NO: 2583467 - RNA, 18 nt, Coxiella burnetii RSA 493
agguuuucaacaaguaaa

SEQ ID NO: 2583468 - RNA, 13 nt, Coxiella burnetii RSA 493
aguaaaaaaccaa

SEQ ID NO: 2583469 - RNA, 21 nt, Coxiella burnetii RSA 493
aguaaaaacauccuccauuac

SEQ ID NO: 2583470 - RNA, 20 nt, Coxiella burnetii RSA 493
aguaaaacaacguaacugau

SEQ ID NO: 2583471 - RNA, 18 nt, Coxiella burnetii RSA 493
aguaaaccgcuuucuaga

SEQ ID NO: 2583472 - RNA, 15 nt, Coxiella burnetii RSA 493
aguaaauguuucuuu

SEQ ID NO: 2583473 - RNA, 20 nt, Coxiella burnetii RSA 493
aguaacccuuucauuuaauu

SEQ ID NO: 2583474 - RNA, 16 nt, Coxiella burnetii RSA 493
aguaacgauuucucuu

SEQ ID NO: 2583475 - RNA, 20 nt, Coxiella burnetii RSA 493
aguaacucuaauuuuccuga

SEQ ID NO: 2583476 - RNA, 19 nt, Coxiella burnetii RSA 493
aguaagcggcagaaugcuu

SEQ ID NO: 2583477 - RNA, 19 nt, Coxiella burnetii RSA 493
aguaaguagcucuuaaaag

SEQ ID NO: 2583478 - RNA, 15 nt, Coxiella burnetii RSA 493
aguaagucucugcuu

SEQ ID NO: 2583479 - RNA, 15 nt, Coxiella burnetii RSA 493
aguaaugguuuugau

SEQ ID NO: 2583480 - RNA, 17 nt, Coxiella burnetii RSA 493
aguaaugguuuugauca

SEQ ID NO: 2583481 - RNA, 13 nt, Coxiella burnetii RSA 493
aguaauuuuaaaa

SEQ ID NO: 2583482 - RNA, 14 nt, Coxiella burnetii RSA 493
aguaauuuuucgau

SEQ ID NO: 2583483 - RNA, 17 nt, Coxiella burnetii RSA 493
aguacuguauugagcag

SEQ ID NO: 2583484 - RNA, 16 nt, Coxiella burnetii RSA 493
aguagccaaaauaaua

SEQ ID NO: 2583485 - RNA, 17 nt, Coxiella burnetii RSA 493
aguagcgauaaauuuuu

SEQ ID NO: 2583486 - RNA, 15 nt, Coxiella burnetii RSA 493
aguagcuaaaaaauu

SEQ ID NO: 2583487 - RNA, 17 nt, Coxiella burnetii RSA 493
aguagcucuuaaaagac

SEQ ID NO: 2583488 - RNA, 18 nt, Coxiella burnetii RSA 493
aguauauuugcaguuugc

SEQ ID NO: 2583489 - RNA, 20 nt, Coxiella burnetii RSA 493
aguauggagaaggucaucca

SEQ ID NO: 2583490 - RNA, 19 nt, Coxiella burnetii RSA 493
aguaugugggcucacuugc

SEQ ID NO: 2583491 - RNA, 16 nt, Coxiella burnetii RSA 493
aguauuaacgcaggau

SEQ ID NO: 2583492 - RNA, 15 nt, Coxiella burnetii RSA 493
aguauuuauuaaaaa

SEQ ID NO: 2583493 - RNA, 14 nt, Coxiella burnetii RSA 493
aguauuuuucuuug

SEQ ID NO: 2583494 - RNA, 15 nt, Coxiella burnetii RSA 493
aguauuuuucuuugg

SEQ ID NO: 2583495 - RNA, 15 nt, Coxiella burnetii RSA 493
aguauuuuuuuuaaa

SEQ ID NO: 2583496 - RNA, 16 nt, Coxiella burnetii RSA 493
agucaacaaacgaaug

SEQ ID NO: 2583497 - RNA, 17 nt, Coxiella burnetii RSA 493
agucagacuugcuuuuu

SEQ ID NO: 2583498 - RNA, 13 nt, Coxiella burnetii RSA 493
agucauagcuaag

SEQ ID NO: 2583499 - RNA, 21 nt, Coxiella burnetii RSA 493
agucauucauuucaauauuuc

SEQ ID NO: 2583500 - RNA, 23 nt, Coxiella burnetii RSA 493
agucccucugaaaaauauucuaa

SEQ ID NO: 2583501 - RNA, 21 nt, Coxiella burnetii RSA 493
aguccgcccccguaucaccaa

SEQ ID NO: 2583502 - RNA, 14 nt, Coxiella burnetii RSA 493
aguccgcuuuuccc

SEQ ID NO: 2583503 - RNA, 18 nt, Coxiella burnetii RSA 493
aguccggccggauuuuuu

SEQ ID NO: 2583504 - RNA, 22 nt, Coxiella burnetii RSA 493
aguccggccggauuuuuucuuc

SEQ ID NO: 2583505 - RNA, 22 nt, Coxiella burnetii RSA 493
aguccuaaaauacuuaaaauuu

SEQ ID NO: 2583506 - RNA, 15 nt, Coxiella burnetii RSA 493
aguccuguucuuuuc

SEQ ID NO: 2583507 - RNA, 19 nt, Coxiella burnetii RSA 493
agucgcaauuugaugccau

SEQ ID NO: 2583508 - RNA, 22 nt, Coxiella burnetii RSA 493
agucgcguagagauucccgcug

SEQ ID NO: 2583509 - RNA, 14 nt, Coxiella burnetii RSA 493
agucgcuuucaauu

SEQ ID NO: 2583510 - RNA, 17 nt, Coxiella burnetii RSA 493
agucggaaguucuauuu

SEQ ID NO: 2583511 - RNA, 15 nt, Coxiella burnetii RSA 493
agucgggaaauaaaa

SEQ ID NO: 2583512 - RNA, 20 nt, Coxiella burnetii RSA 493
agucggggccgguucuuuuc

SEQ ID NO: 2583513 - RNA, 22 nt, Coxiella burnetii RSA 493
agucguguuuuuauuuugacuu

SEQ ID NO: 2583514 - RNA, 17 nt, Coxiella burnetii RSA 493
agucguuuuuuaauauu

SEQ ID NO: 2583515 - RNA, 16 nt, Coxiella burnetii RSA 493
agucuauugaaaaaaa

SEQ ID NO: 2583516 - RNA, 19 nt, Coxiella burnetii RSA 493
agucucagacucucuuauu

SEQ ID NO: 2583517 - RNA, 22 nt, Coxiella burnetii RSA 493
agucuggccugccacaaucacu

SEQ ID NO: 2583518 - RNA, 18 nt, Coxiella burnetii RSA 493
agucugguuaaacccauu

SEQ ID NO: 2583519 - RNA, 21 nt, Coxiella burnetii RSA 493
agucugucguuucugauuuuu

SEQ ID NO: 2583520 - RNA, 18 nt, Coxiella burnetii RSA 493
agucuuaauuuuaaaaaa

SEQ ID NO: 2583521 - RNA, 20 nt, Coxiella burnetii RSA 493
agucuucaaaagugauuuuu

SEQ ID NO: 2583522 - RNA, 18 nt, Coxiella burnetii RSA 493
agucuuugacauaucauu

SEQ ID NO: 2583523 - RNA, 16 nt, Coxiella burnetii RSA 493
agucuuugguuuucca

SEQ ID NO: 2583524 - RNA, 19 nt, Coxiella burnetii RSA 493
agugaaaacccgagcggau

SEQ ID NO: 2583525 - RNA, 13 nt, Coxiella burnetii RSA 493
agugaaaguuuca

SEQ ID NO: 2583526 - RNA, 18 nt, Coxiella burnetii RSA 493
agugaaaguuucauaagu

SEQ ID NO: 2583527 - RNA, 20 nt, Coxiella burnetii RSA 493
agugaaccaaucuauuagcu

SEQ ID NO: 2583528 - RNA, 16 nt, Coxiella burnetii RSA 493
agugacucaucuccuu

SEQ ID NO: 2583529 - RNA, 22 nt, Coxiella burnetii RSA 493
agugacucaucuccuuuugcua

SEQ ID NO: 2583530 - RNA, 19 nt, Coxiella burnetii RSA 493
agugagccgcuaauaacau

SEQ ID NO: 2583531 - RNA, 21 nt, Coxiella burnetii RSA 493
agugaugacauuuaaaaaaac

SEQ ID NO: 2583532 - RNA, 15 nt, Coxiella burnetii RSA 493
agugauuaaauugcu

SEQ ID NO: 2583533 - RNA, 22 nt, Coxiella burnetii RSA 493
agugauuuuuuuagcacagcga

SEQ ID NO: 2583534 - RNA, 23 nt, Coxiella burnetii RSA 493
agugccccuacacuauugaaguc

SEQ ID NO: 2583535 - RNA, 13 nt, Coxiella burnetii RSA 493
agugccgcgaaua

SEQ ID NO: 2583536 - RNA, 22 nt, Coxiella burnetii RSA 493
agugcuauucccgccaucacca

SEQ ID NO: 2583537 - RNA, 19 nt, Coxiella burnetii RSA 493
agugcuuuuaaccacagac

SEQ ID NO: 2583538 - RNA, 21 nt, Coxiella burnetii RSA 493
aguggcagcuucuuuaaaaua

SEQ ID NO: 2583539 - RNA, 16 nt, Coxiella burnetii RSA 493
aguggggauaauugaa

SEQ ID NO: 2583540 - RNA, 13 nt, Coxiella burnetii RSA 493
agugggggaacag

SEQ ID NO: 2583541 - RNA, 21 nt, Coxiella burnetii RSA 493
agugggggaacagaggacaga

SEQ ID NO: 2583542 - RNA, 22 nt, Coxiella burnetii RSA 493
aguguauuuucaccuuuucccu

SEQ ID NO: 2583543 - RNA, 14 nt, Coxiella burnetii RSA 493
agugugauucauua

SEQ ID NO: 2583544 - RNA, 13 nt, Coxiella burnetii RSA 493
aguguggucugaa

SEQ ID NO: 2583545 - RNA, 22 nt, Coxiella burnetii RSA 493
aguguuuuggcaucgagaaguc

SEQ ID NO: 2583546 - RNA, 12 nt, Coxiella burnetii RSA 493
aguuaaaauaau

SEQ ID NO: 2583547 - RNA, 13 nt, Coxiella burnetii RSA 493
aguuaaaauaaug

SEQ ID NO: 2583548 - RNA, 20 nt, Coxiella burnetii RSA 493
aguuaaaggcguaagcacaa

SEQ ID NO: 2583549 - RNA, 13 nt, Coxiella burnetii RSA 493
aguuaaauuuuua

SEQ ID NO: 2583550 - RNA, 18 nt, Coxiella burnetii RSA 493
aguuacgagcuguuugcc

SEQ ID NO: 2583551 - RNA, 16 nt, Coxiella burnetii RSA 493
aguuacguaauuauua

SEQ ID NO: 2583552 - RNA, 14 nt, Coxiella burnetii RSA 493
aguuauuucuuuug

SEQ ID NO: 2583553 - RNA, 16 nt, Coxiella burnetii RSA 493
aguuauuuuucaucuu

SEQ ID NO: 2583554 - RNA, 18 nt, Coxiella burnetii RSA 493
aguuauuuuucaucuugu

SEQ ID NO: 2583555 - RNA, 19 nt, Coxiella burnetii RSA 493
aguucagacgcuaauugau

SEQ ID NO: 2583556 - RNA, 22 nt, Coxiella burnetii RSA 493
aguucagacgcuaauugauuaa

SEQ ID NO: 2583557 - RNA, 23 nt, Coxiella burnetii RSA 493
aguucagacgcuaauugauuaau

SEQ ID NO: 2583558 - RNA, 19 nt, Coxiella burnetii RSA 493
aguuccauuccaaaaacag

SEQ ID NO: 2583559 - RNA, 17 nt, Coxiella burnetii RSA 493
aguucgggccuucacuu

SEQ ID NO: 2583560 - RNA, 21 nt, Coxiella burnetii RSA 493
aguucuaagcuaucagcaauc

SEQ ID NO: 2583561 - RNA, 19 nt, Coxiella burnetii RSA 493
aguucuauccaauaaacgg

SEQ ID NO: 2583562 - RNA, 21 nt, Coxiella burnetii RSA 493
aguucuauuuccgcuacaucu

SEQ ID NO: 2583563 - RNA, 21 nt, Coxiella burnetii RSA 493
ucgcaauuugaugccauaauu

SEQ ID NO: 2583564 - RNA, 16 nt, Coxiella burnetii RSA 493
ucgcacaaugcuuuuc

SEQ ID NO: 2583565 - RNA, 22 nt, Coxiella burnetii RSA 493
ucgcacaaugcuuuucucaacg

SEQ ID NO: 2583566 - RNA, 16 nt, Coxiella burnetii RSA 493
ucgcacaucauugaaa

SEQ ID NO: 2583567 - RNA, 15 nt, Coxiella burnetii RSA 493
ucgcaucauucgggc

SEQ ID NO: 2583568 - RNA, 13 nt, Coxiella burnetii RSA 493
ucgccagaaacaa

SEQ ID NO: 2583569 - RNA, 21 nt, Coxiella burnetii RSA 493
ucgccaucgcuuucggcgcca

SEQ ID NO: 2583570 - RNA, 20 nt, Coxiella burnetii RSA 493
ucgccuccggcgcgcgcuug

SEQ ID NO: 2583571 - RNA, 20 nt, Coxiella burnetii RSA 493
ucgccuucuugccgcccuug

SEQ ID NO: 2583572 - RNA, 22 nt, Coxiella burnetii RSA 493
ucgccuucuugccgcccuugcu

SEQ ID NO: 2583573 - RNA, 17 nt, Coxiella burnetii RSA 493
ucgcggaaaauuuaaac

SEQ ID NO: 2583574 - RNA, 16 nt, Coxiella burnetii RSA 493
ucgcguagcgacacaa

SEQ ID NO: 2583575 - RNA, 20 nt, Coxiella burnetii RSA 493
ucgcguagcgacacaaccac

SEQ ID NO: 2583576 - RNA, 19 nt, Coxiella burnetii RSA 493
ucgcguauaaaugaauaau

SEQ ID NO: 2583577 - RNA, 22 nt, Coxiella burnetii RSA 493
ucgcguauaaaugaauaauauu

SEQ ID NO: 2583578 - RNA, 23 nt, Coxiella burnetii RSA 493
ucgcguauaaaugaauaauauug

SEQ ID NO: 2583579 - RNA, 16 nt, Coxiella burnetii RSA 493
ucgcguuguauaagug

SEQ ID NO: 2583580 - RNA, 13 nt, Coxiella burnetii RSA 493
ucgcuaaauaaca

SEQ ID NO: 2583581 - RNA, 15 nt, Coxiella burnetii RSA 493
ucgcuaaauaacaua

SEQ ID NO: 2583582 - RNA, 17 nt, Coxiella burnetii RSA 493
ucgcucaauuguuucau

SEQ ID NO: 2583583 - RNA, 22 nt, Coxiella burnetii RSA 493
ucgcuccuaaauuuucuuguuc

SEQ ID NO: 2583584 - RNA, 22 nt, Coxiella burnetii RSA 493
ucgcucgcaagaaucuccacca

SEQ ID NO: 2583585 - RNA, 14 nt, Coxiella burnetii RSA 493
ucgcucuuguuucu

SEQ ID NO: 2583586 - RNA, 17 nt, Coxiella burnetii RSA 493
ucgcuggauuuuuuaau

SEQ ID NO: 2583587 - RNA, 15 nt, Coxiella burnetii RSA 493
ucgcuuaaauuuuga

SEQ ID NO: 2583588 - RNA, 21 nt, Coxiella burnetii RSA 493
ucgcuucaauucuuuuuaaga

SEQ ID NO: 2583589 - RNA, 20 nt, Coxiella burnetii RSA 493
ucgcuucgcuacauacgggc

SEQ ID NO: 2583590 - RNA, 20 nt, Coxiella burnetii RSA 493
ucgcuucgcuccauacgggc

SEQ ID NO: 2583591 - RNA, 20 nt, Coxiella burnetii RSA 493
ucgcuucgcugcauacggac

SEQ ID NO: 2583592 - RNA, 14 nt, Coxiella burnetii RSA 493
ucgcuuuauucauu

SEQ ID NO: 2583593 - RNA, 21 nt, Coxiella burnetii RSA 493
ucgcuuucaauuacuuuuaua

SEQ ID NO: 2583594 - RNA, 15 nt, Coxiella burnetii RSA 493
ucgcuuugcggccuc

SEQ ID NO: 2583595 - RNA, 19 nt, Coxiella burnetii RSA 493
ucgcuuuuauuuccugucg

SEQ ID NO: 2583596 - RNA, 20 nt, Coxiella burnetii RSA 493
ucggaaauuucucucucaua

SEQ ID NO: 2583597 - RNA, 23 nt, Coxiella burnetii RSA 493
ucggaauugcuaaauguuuagcu

SEQ ID NO: 2583598 - RNA, 13 nt, Coxiella burnetii RSA 493
ucggaucaauuuu

SEQ ID NO: 2583599 - RNA, 16 nt, Coxiella burnetii RSA 493
ucggaucaauuuuggu

SEQ ID NO: 2583600 - RNA, 16 nt, Coxiella burnetii RSA 493
ucggauguuuuuucac

SEQ ID NO: 2583601 - RNA, 14 nt, Coxiella burnetii RSA 493
ucggcaccaaaauc

SEQ ID NO: 2583602 - RNA, 22 nt, Coxiella burnetii RSA 493
ucggccaaauggauuuccacuu

SEQ ID NO: 2583603 - RNA, 14 nt, Coxiella burnetii RSA 493
ucggccuuuuucau

SEQ ID NO: 2583604 - RNA, 17 nt, Coxiella burnetii RSA 493
ucggccuuuuucauuuc

SEQ ID NO: 2583605 - RNA, 14 nt, Coxiella burnetii RSA 493
ucggcuaaaucuug

SEQ ID NO: 2583606 - RNA, 22 nt, Coxiella burnetii RSA 493
ucggcucgccggauugaaaccg

SEQ ID NO: 2583607 - RNA, 18 nt, Coxiella burnetii RSA 493
ucggcuuuauauguguaa

SEQ ID NO: 2583608 - RNA, 15 nt, Coxiella burnetii RSA 493
ucgggaaauaaaauu

SEQ ID NO: 2583609 - RNA, 18 nt, Coxiella burnetii RSA 493
ucgggaaauaaaauuaau

SEQ ID NO: 2583610 - RNA, 16 nt, Coxiella burnetii RSA 493
ucgggaauaaaauaau

SEQ ID NO: 2583611 - RNA, 21 nt, Coxiella burnetii RSA 493
ucgggcgugaaggaaauuugc

SEQ ID NO: 2583612 - RNA, 17 nt, Coxiella burnetii RSA 493
ucgggcuaucggcuuca

SEQ ID NO: 2583613 - RNA, 15 nt, Coxiella burnetii RSA 493
ucggguauuuucaug

SEQ ID NO: 2583614 - RNA, 15 nt, Coxiella burnetii RSA 493
ucgggugauugaaaa

SEQ ID NO: 2583615 - RNA, 18 nt, Coxiella burnetii RSA 493
ucggguucuacaauaauu

SEQ ID NO: 2583616 - RNA, 19 nt, Coxiella burnetii RSA 493
ucgguagaaugauaccauc

SEQ ID NO: 2583617 - RNA, 23 nt, Coxiella burnetii RSA 493
ucgguagagcaggugacuguuaa

SEQ ID NO: 2583618 - RNA, 20 nt, Coxiella burnetii RSA 493
ucggugacgaggaaagauaa

SEQ ID NO: 2583619 - RNA, 22 nt, Coxiella burnetii RSA 493
ucgguuggucggaauugcuaaa

SEQ ID NO: 2583620 - RNA, 17 nt, Coxiella burnetii RSA 493
ucgguuucuucaacgaa

SEQ ID NO: 2583621 - RNA, 17 nt, Coxiella burnetii RSA 493
ucgguuuuuuuaaaaaa

SEQ ID NO: 2583622 - RNA, 20 nt, Coxiella burnetii RSA 493
ucgguuuuuuuaaaaaagaa

SEQ ID NO: 2583623 - RNA, 17 nt, Coxiella burnetii RSA 493
ucgguuuuuuucuuuuu

SEQ ID NO: 2583624 - RNA, 21 nt, Coxiella burnetii RSA 493
ucguaaaacgauauuaucaaa

SEQ ID NO: 2583625 - RNA, 13 nt, Coxiella burnetii RSA 493
ucguaaauauuuu

SEQ ID NO: 2583626 - RNA, 17 nt, Coxiella burnetii RSA 493
ucguaacaaaagauauu

SEQ ID NO: 2583627 - RNA, 17 nt, Coxiella burnetii RSA 493
ucguaggccgcuuuuug

SEQ ID NO: 2583628 - RNA, 16 nt, Coxiella burnetii RSA 493
ucguauccaaauauuu

SEQ ID NO: 2583629 - RNA, 19 nt, Coxiella burnetii RSA 493
ucguauccaaauauuuaaa

SEQ ID NO: 2583630 - RNA, 20 nt, Coxiella burnetii RSA 493
ucguauccaaauauuuaaau

SEQ ID NO: 2583631 - RNA, 18 nt, Coxiella burnetii RSA 493
ucguaucgauuucuuuuu

SEQ ID NO: 2583632 - RNA, 21 nt, Coxiella burnetii RSA 493
ucguaugccgcuugaaaaauu

SEQ ID NO: 2583633 - RNA, 16 nt, Coxiella burnetii RSA 493
ucgucacccaaaucau

SEQ ID NO: 2583634 - RNA, 18 nt, Coxiella burnetii RSA 493
ucguccaauucuuuaagu

SEQ ID NO: 2583635 - RNA, 12 nt, Coxiella burnetii RSA 493
ucgucccaaaaa

SEQ ID NO: 2583636 - RNA, 14 nt, Coxiella burnetii RSA 493
ucgucccaaaaaac

SEQ ID NO: 2583637 - RNA, 19 nt, Coxiella burnetii RSA 493
ucguccccguauuucgcuu

SEQ ID NO: 2583638 - RNA, 20 nt, Coxiella burnetii RSA 493
ucguccccguauuucgcuuc

SEQ ID NO: 2583639 - RNA, 19 nt, Coxiella burnetii RSA 493
ucgucgaugauuuuuucga

SEQ ID NO: 2583640 - RNA, 20 nt, Coxiella burnetii RSA 493
ucgucggguauuuucaugca

SEQ ID NO: 2583641 - RNA, 21 nt, Coxiella burnetii RSA 493
ucgugaaauaccucuucuaaa

SEQ ID NO: 2583642 - RNA, 19 nt, Coxiella burnetii RSA 493
ucgugccaguauuuuucuu

SEQ ID NO: 2583643 - RNA, 22 nt, Coxiella burnetii RSA 493
ucgugcucuuuuuucaaaacuc

SEQ ID NO: 2583644 - RNA, 17 nt, Coxiella burnetii RSA 493
ucguuaugggaauuaaa

SEQ ID NO: 2583645 - RNA, 21 nt, Coxiella burnetii RSA 493
ucguuauugcucaucucuaac

SEQ ID NO: 2583646 - RNA, 22 nt, Coxiella burnetii RSA 493
ucguuccguauccaucacgggg

SEQ ID NO: 2583647 - RNA, 18 nt, Coxiella burnetii RSA 493
ucguucgaagguauuuug

SEQ ID NO: 2583648 - RNA, 16 nt, Coxiella burnetii RSA 493
ucguugauuaauaaug

SEQ ID NO: 2583649 - RNA, 21 nt, Coxiella burnetii RSA 493
ucguugcugagcaaacagcua

SEQ ID NO: 2583650 - RNA, 21 nt, Coxiella burnetii RSA 493
ucguuucgaaaaauuauuaau

SEQ ID NO: 2583651 - RNA, 21 nt, Coxiella burnetii RSA 493
ucguuucugguuuccuuucug

SEQ ID NO: 2583652 - RNA, 12 nt, Coxiella burnetii RSA 493
ucguuuguaaua

SEQ ID NO: 2583653 - RNA, 13 nt, Coxiella burnetii RSA 493
ucguuuuggcugc

SEQ ID NO: 2583654 - RNA, 15 nt, Coxiella burnetii RSA 493
ucguuuuuuaauauu

SEQ ID NO: 2583655 - RNA, 22 nt, Coxiella burnetii RSA 493
ucuaaaguacuagcaucaauaa

SEQ ID NO: 2583656 - RNA, 20 nt, Coxiella burnetii RSA 493
ucuaacauuuggccaaacua

SEQ ID NO: 2583657 - RNA, 23 nt, Coxiella burnetii RSA 493
ucuaaccauaacaaugaauuguc

SEQ ID NO: 2583658 - RNA, 19 nt, Coxiella burnetii RSA 493
ucuaaccuauugcggaauu

SEQ ID NO: 2583659 - RNA, 17 nt, Coxiella burnetii RSA 493
ucuaacgucgcaaauaa

SEQ ID NO: 2583660 - RNA, 23 nt, Coxiella burnetii RSA 493
ucuaacguuaguuucuuuuauga

SEQ ID NO: 2583661 - RNA, 18 nt, Coxiella burnetii RSA 493
ucuaacuuugauaagcau

SEQ ID NO: 2583662 - RNA, 17 nt, Coxiella burnetii RSA 493
ucuaagacuaagaauaa

SEQ ID NO: 2583663 - RNA, 12 nt, Coxiella burnetii RSA 493
ucuaauaaaaua

SEQ ID NO: 2583664 - RNA, 19 nt, Coxiella burnetii RSA 493
ucuaauuugaaaaacccau

SEQ ID NO: 2583665 - RNA, 12 nt, Coxiella burnetii RSA 493
ucuaauuuuccu

SEQ ID NO: 2583666 - RNA, 16 nt, Coxiella burnetii RSA 493
ucuaauuuucuuucca

SEQ ID NO: 2583667 - RNA, 16 nt, Coxiella burnetii RSA 493
ucuacaauaaacacau

SEQ ID NO: 2583668 - RNA, 15 nt, Coxiella burnetii RSA 493
ucuacagaacuuuuu

SEQ ID NO: 2583669 - RNA, 24 nt, Coxiella burnetii RSA 493
aaaaaggacaccguugagcaagca

SEQ ID NO: 2583670 - RNA, 15 nt, Coxiella burnetii RSA 493
aaaaaguucaccgca

SEQ ID NO: 2583671 - RNA, 17 nt, Coxiella burnetii RSA 493
aaaaaguuggucuuuuu

SEQ ID NO: 2583672 - RNA, 11 nt, Coxiella burnetii RSA 493
aaaaauaaaaa

SEQ ID NO: 2583673 - RNA, 11 nt, Coxiella burnetii RSA 493
aaaaauaaaag

SEQ ID NO: 2583674 - RNA, 18 nt, Coxiella burnetii RSA 493
aaaaauaguuucaauuuc

SEQ ID NO: 2583675 - RNA, 14 nt, Coxiella burnetii RSA 493
aaaaauaucccuuu

SEQ ID NO: 2583676 - RNA, 23 nt, Coxiella burnetii RSA 493
aaaaauauccuuacuauucgaau

SEQ ID NO: 2583677 - RNA, 24 nt, Coxiella burnetii RSA 493
aaaaauggguuuugucaaugggca

SEQ ID NO: 2583678 - RNA, 14 nt, Coxiella burnetii RSA 493
aaaaauuaagagaa

SEQ ID NO: 2583679 - RNA, 18 nt, Coxiella burnetii RSA 493
aaaaauuauuaaucauau

SEQ ID NO: 2583680 - RNA, 17 nt, Coxiella burnetii RSA 493
aaaaauuccaaaaacau

SEQ ID NO: 2583681 - RNA, 18 nt, Coxiella burnetii RSA 493
aaaaauuccaaaaacauu

SEQ ID NO: 2583682 - RNA, 20 nt, Coxiella burnetii RSA 493
aaaaauuuauucuaacuuug

SEQ ID NO: 2583683 - RNA, 19 nt, Coxiella burnetii RSA 493
aaaaauuucauccguggaa

SEQ ID NO: 2583684 - RNA, 13 nt, Coxiella burnetii RSA 493
aaaaauuucauuu

SEQ ID NO: 2583685 - RNA, 17 nt, Coxiella burnetii RSA 493
aaaaauuucauuuaaua

SEQ ID NO: 2583686 - RNA, 20 nt, Coxiella burnetii RSA 493
aaaaauuucauuuaauaaau

SEQ ID NO: 2583687 - RNA, 12 nt, Coxiella burnetii RSA 493
aaaaauuuuaaa

SEQ ID NO: 2583688 - RNA, 17 nt, Coxiella burnetii RSA 493
aaaaauuuuaaaaaaau

SEQ ID NO: 2583689 - RNA, 17 nt, Coxiella burnetii RSA 493
aaaacaagacaacaaaa

SEQ ID NO: 2583690 - RNA, 22 nt, Coxiella burnetii RSA 493
aaaacaaugaugucaucuaucg

SEQ ID NO: 2583691 - RNA, 14 nt, Coxiella burnetii RSA 493
aaaacagauuuaaa

SEQ ID NO: 2583692 - RNA, 12 nt, Coxiella burnetii RSA 493
aaaacagcccca

SEQ ID NO: 2583693 - RNA, 17 nt, Coxiella burnetii RSA 493
aaaacauucgauauguu

SEQ ID NO: 2583694 - RNA, 17 nt, Coxiella burnetii RSA 493
aaaaccauucaaugcua

SEQ ID NO: 2583695 - RNA, 22 nt, Coxiella burnetii RSA 493
aaaacccauuugccgccaggcu

SEQ ID NO: 2583696 - RNA, 23 nt, Coxiella burnetii RSA 493
aaaaccgacgccauuuuuuagca

SEQ ID NO: 2583697 - RNA, 21 nt, Coxiella burnetii RSA 493
aaaaccgcagcucaaacaaau

SEQ ID NO: 2583698 - RNA, 21 nt, Coxiella burnetii RSA 493
aaaaccuacacuuuuaaucac

SEQ ID NO: 2583699 - RNA, 15 nt, Coxiella burnetii RSA 493
aaaaccuacuuuucu

SEQ ID NO: 2583700 - RNA, 21 nt, Coxiella burnetii RSA 493
aaaaccugcuauuugcccauc

SEQ ID NO: 2583701 - RNA, 16 nt, Coxiella burnetii RSA 493
aaaacggcgaaaggga

SEQ ID NO: 2583702 - RNA, 17 nt, Coxiella burnetii RSA 493
aaaacguagaaguuuaa

SEQ ID NO: 2583703 - RNA, 22 nt, Coxiella burnetii RSA 493
aaaacguagaaguuuaaaguua

SEQ ID NO: 2583704 - RNA, 17 nt, Coxiella burnetii RSA 493
aaaacgucgccugcuaa

SEQ ID NO: 2583705 - RNA, 23 nt, Coxiella burnetii RSA 493
aaaacgugccgccgaaauuuaac

SEQ ID NO: 2583706 - RNA, 21 nt, Coxiella burnetii RSA 493
aaaacguuucaucaaaauucu

SEQ ID NO: 2583707 - RNA, 20 nt, Coxiella burnetii RSA 493
aaaacuagaaauauuagaaa

SEQ ID NO: 2583708 - RNA, 17 nt, Coxiella burnetii RSA 493
aaaacuaguuauuuuua

SEQ ID NO: 2583709 - RNA, 18 nt, Coxiella burnetii RSA 493
aaaacuaguuauuuuuaa

SEQ ID NO: 2583710 - RNA, 19 nt, Coxiella burnetii RSA 493
aaaacuaguuauuuuuaaa

SEQ ID NO: 2583711 - RNA, 15 nt, Coxiella burnetii RSA 493
aaaacucccaucaaa

SEQ ID NO: 2583712 - RNA, 22 nt, Coxiella burnetii RSA 493
aaaacuggcuuggacaaaucau

SEQ ID NO: 2583713 - RNA, 17 nt, Coxiella burnetii RSA 493
aaaacuuccgccacuaa

SEQ ID NO: 2583714 - RNA, 11 nt, Coxiella burnetii RSA 493
aaaagaaaaua

SEQ ID NO: 2583715 - RNA, 20 nt, Coxiella burnetii RSA 493
aaaagacgcuaguuuuuaag

SEQ ID NO: 2583716 - RNA, 16 nt, Coxiella burnetii RSA 493
aaaagacuuuguuuua

SEQ ID NO: 2583717 - RNA, 19 nt, Coxiella burnetii RSA 493
aaaagagcgaauaaaaaau

SEQ ID NO: 2583718 - RNA, 19 nt, Coxiella burnetii RSA 493
aaaagauaaucccaauaaa

SEQ ID NO: 2583719 - RNA, 16 nt, Coxiella burnetii RSA 493
aaaagcaccccgugaa

SEQ ID NO: 2583720 - RNA, 22 nt, Coxiella burnetii RSA 493
aaaagcauuuuucgcagcaaaa

SEQ ID NO: 2583721 - RNA, 23 nt, Coxiella burnetii RSA 493
aaaagccaaagaccaaucguaaa

SEQ ID NO: 2583722 - RNA, 13 nt, Coxiella burnetii RSA 493
aaaagccaauuua

SEQ ID NO: 2583723 - RNA, 14 nt, Coxiella burnetii RSA 493
aaaagcgccaaaac

SEQ ID NO: 2583724 - RNA, 18 nt, Coxiella burnetii RSA 493
aaaagcguuuaaauaacu

SEQ ID NO: 2583725 - RNA, 15 nt, Coxiella burnetii RSA 493
aaaagcuagcgaaau

SEQ ID NO: 2583726 - RNA, 13 nt, Coxiella burnetii RSA 493
aaaaggagaaauu

SEQ ID NO: 2583727 - RNA, 23 nt, Coxiella burnetii RSA 493
aaaagugauuuuucuuuguuccu

SEQ ID NO: 2583728 - RNA, 18 nt, Coxiella burnetii RSA 493
aaaaguggggauaauuga

SEQ ID NO: 2583729 - RNA, 18 nt, Coxiella burnetii RSA 493
aaaauaaaaccuuguuau

SEQ ID NO: 2583730 - RNA, 22 nt, Coxiella burnetii RSA 493
aaaauaaaaccuuguuauaaaa

SEQ ID NO: 2583731 - RNA, 18 nt, Coxiella burnetii RSA 493
aaaauaaaaggagaaauu

SEQ ID NO: 2583732 - RNA, 19 nt, Coxiella burnetii RSA 493
aaaauaagguuaaaucccu

SEQ ID NO: 2583733 - RNA, 14 nt, Coxiella burnetii RSA 493
aaaauaaguaucca

SEQ ID NO: 2583734 - RNA, 20 nt, Coxiella burnetii RSA 493
aaaauaauacggcuuuauuu

SEQ ID NO: 2583735 - RNA, 13 nt, Coxiella burnetii RSA 493
aaaauaauuuuag

SEQ ID NO: 2583736 - RNA, 16 nt, Coxiella burnetii RSA 493
aaaauacuuaaaauuu

SEQ ID NO: 2583737 - RNA, 16 nt, Coxiella burnetii RSA 493
aaaauagaauuguaaa

SEQ ID NO: 2583738 - RNA, 12 nt, Coxiella burnetii RSA 493
aaaauagcacua

SEQ ID NO: 2583739 - RNA, 13 nt, Coxiella burnetii RSA 493
aaaauagcgugua

SEQ ID NO: 2583740 - RNA, 24 nt, Coxiella burnetii RSA 493
aaaauagcguguaauugaugccga

SEQ ID NO: 2583741 - RNA, 22 nt, Coxiella burnetii RSA 493
aaaauagggcuaguaugcuaua

SEQ ID NO: 2583742 - RNA, 15 nt, Coxiella burnetii RSA 493
aaaauaguuugaugu

SEQ ID NO: 2583743 - RNA, 18 nt, Coxiella burnetii RSA 493
aaaauaugauaaggaggc

SEQ ID NO: 2583744 - RNA, 21 nt, Coxiella burnetii RSA 493
aaaauauuaucccgaaaaccc

SEQ ID NO: 2583745 - RNA, 17 nt, Coxiella burnetii RSA 493
aaaaucccuuuuaauuu

SEQ ID NO: 2583746 - RNA, 21 nt, Coxiella burnetii RSA 493
aaaaucgauggaagaacauuu

SEQ ID NO: 2583747 - RNA, 22 nt, Coxiella burnetii RSA 493
aaaaucuucugaucgauaaaaa

SEQ ID NO: 2583748 - RNA, 20 nt, Coxiella burnetii RSA 493
aaaaugagggggagccugua

SEQ ID NO: 2583749 - RNA, 16 nt, Coxiella burnetii RSA 493
aaaaugcucgcgaaau

SEQ ID NO: 2583750 - RNA, 18 nt, Coxiella burnetii RSA 493
aaaauggaaacgacgauc

SEQ ID NO: 2583751 - RNA, 23 nt, Coxiella burnetii RSA 493
aaaauggugaaaagccaaagacc

SEQ ID NO: 2583752 - RNA, 15 nt, Coxiella burnetii RSA 493
aaaauguuaggaagg

SEQ ID NO: 2583753 - RNA, 12 nt, Coxiella burnetii RSA 493
aaaauuaaaauc

SEQ ID NO: 2583754 - RNA, 13 nt, Coxiella burnetii RSA 493
aaaauuacugaaa

SEQ ID NO: 2583755 - RNA, 17 nt, Coxiella burnetii RSA 493
aaaauuacuuuauuacc

SEQ ID NO: 2583756 - RNA, 15 nt, Coxiella burnetii RSA 493
aaaauuccaaaaaca

SEQ ID NO: 2583757 - RNA, 18 nt, Coxiella burnetii RSA 493
aaaauuccuucuccuuuu

SEQ ID NO: 2583758 - RNA, 21 nt, Coxiella burnetii RSA 493
aaaauucgcuccucaauuucc

SEQ ID NO: 2583759 - RNA, 22 nt, Coxiella burnetii RSA 493
aaaauugauuagcaucuugaau

SEQ ID NO: 2583760 - RNA, 12 nt, Coxiella burnetii RSA 493
aaaauuguuuau

SEQ ID NO: 2583761 - RNA, 11 nt, Coxiella burnetii RSA 493
aaaauuuaaac

SEQ ID NO: 2583762 - RNA, 18 nt, Coxiella burnetii RSA 493
aaaauuuauucuaacuuu

SEQ ID NO: 2583763 - RNA, 13 nt, Coxiella burnetii RSA 493
aaaauuucaagua

SEQ ID NO: 2583764 - RNA, 17 nt, Coxiella burnetii RSA 493
aaaauuucauuuaauaa

SEQ ID NO: 2583765 - RNA, 20 nt, Coxiella burnetii RSA 493
aaaauuucuuuccagccuuu

SEQ ID NO: 2583766 - RNA, 18 nt, Coxiella burnetii RSA 493
aaaauuugagguugaaua

SEQ ID NO: 2583767 - RNA, 13 nt, Coxiella burnetii RSA 493
aaaauuugauuaa

SEQ ID NO: 2583768 - RNA, 15 nt, Coxiella burnetii RSA 493
aaaauuuuaaaaaaa

SEQ ID NO: 2583769 - RNA, 12 nt, Coxiella burnetii RSA 493
aaacaaaauaau

SEQ ID NO: 2583770 - RNA, 15 nt, Coxiella burnetii RSA 493
aaacaaacaaaaaau

SEQ ID NO: 2583771 - RNA, 14 nt, Coxiella burnetii RSA 493
aaacaaagugaaau

SEQ ID NO: 2583772 - RNA, 22 nt, Coxiella burnetii RSA 493
aaacaacuaccugauaaaauaa

SEQ ID NO: 2583773 - RNA, 18 nt, Coxiella burnetii RSA 493
aaacaagacaacaaaaug

SEQ ID NO: 2583774 - RNA, 22 nt, Coxiella burnetii RSA 493
aaaggcaaauguugauaauaaa

SEQ ID NO: 2583775 - RNA, 20 nt, Coxiella burnetii RSA 493
aaaggcuaauaggaaaaaug

SEQ ID NO: 2583776 - RNA, 13 nt, Coxiella burnetii RSA 493
aaagguaaaaaga

SEQ ID NO: 2583777 - RNA, 22 nt, Coxiella burnetii RSA 493
aaagguguucgagauuauucaa

SEQ ID NO: 2583778 - RNA, 19 nt, Coxiella burnetii RSA 493
aaagguuuucuuccgaaac

SEQ ID NO: 2583779 - RNA, 19 nt, Coxiella burnetii RSA 493
aaagguuuuuccuuuuauu

SEQ ID NO: 2583780 - RNA, 13 nt, Coxiella burnetii RSA 493
aaaguaaaaauga

SEQ ID NO: 2583781 - RNA, 16 nt, Coxiella burnetii RSA 493
aaaguaaaaaugaaau

SEQ ID NO: 2583782 - RNA, 15 nt, Coxiella burnetii RSA 493
aaaguaaauuuauau

SEQ ID NO: 2583783 - RNA, 13 nt, Coxiella burnetii RSA 493
aaaguaauauuuc

SEQ ID NO: 2583784 - RNA, 13 nt, Coxiella burnetii RSA 493
aaaguaauuuuaa

SEQ ID NO: 2583785 - RNA, 15 nt, Coxiella burnetii RSA 493
aaaguaauuuuaaaa

SEQ ID NO: 2583786 - RNA, 20 nt, Coxiella burnetii RSA 493
aaaguaauuuuaaaaaaaau

SEQ ID NO: 2583787 - RNA, 19 nt, Coxiella burnetii RSA 493
aaaguacuagcaucaauaa

SEQ ID NO: 2583788 - RNA, 21 nt, Coxiella burnetii RSA 493
aaagucagcuuuggaaaaaca

SEQ ID NO: 2583789 - RNA, 22 nt, Coxiella burnetii RSA 493
aaagucagcuuuggaaaaacau

SEQ ID NO: 2583790 - RNA, 15 nt, Coxiella burnetii RSA 493
aaaguccuguucuuu

SEQ ID NO: 2583791 - RNA, 18 nt, Coxiella burnetii RSA 493
aaagugaugauuaaacgu

SEQ ID NO: 2583792 - RNA, 20 nt, Coxiella burnetii RSA 493
aaaguguagguuuucaacaa

SEQ ID NO: 2583793 - RNA, 24 nt, Coxiella burnetii RSA 493
aaaguguagguuuucaacaaguaa

SEQ ID NO: 2583794 - RNA, 19 nt, Coxiella burnetii RSA 493
aaaguuauuucuuuugauu

SEQ ID NO: 2583795 - RNA, 22 nt, Coxiella burnetii RSA 493
aaaguucauuaaguauauuugc

SEQ ID NO: 2583796 - RNA, 16 nt, Coxiella burnetii RSA 493
aaaguucuaagcuauc

SEQ ID NO: 2583797 - RNA, 16 nt, Coxiella burnetii RSA 493
aaaguuuagaaaaaug

SEQ ID NO: 2583798 - RNA, 23 nt, Coxiella burnetii RSA 493
aaaguuuaucccuguuacgggau

SEQ ID NO: 2583799 - RNA, 13 nt, Coxiella burnetii RSA 493
aaaguuucacgaa

SEQ ID NO: 2583800 - RNA, 21 nt, Coxiella burnetii RSA 493
aaaguuucccacaaaauaccc

SEQ ID NO: 2583801 - RNA, 15 nt, Coxiella burnetii RSA 493
aaaguuuucccaaug

SEQ ID NO: 2583802 - RNA, 18 nt, Coxiella burnetii RSA 493
aaaguuuuuggcauaaau

SEQ ID NO: 2583803 - RNA, 23 nt, Coxiella burnetii RSA 493
aaauaaaaggagaaauugacaaa

SEQ ID NO: 2583804 - RNA, 21 nt, Coxiella burnetii RSA 493
aaauaaaccuauccaaaaaga

SEQ ID NO: 2583805 - RNA, 18 nt, Coxiella burnetii RSA 493
aaauaaacuggaaaaagg

SEQ ID NO: 2583806 - RNA, 18 nt, Coxiella burnetii RSA 493
aaauaaauccauccggau

SEQ ID NO: 2583807 - RNA, 13 nt, Coxiella burnetii RSA 493
aaauaaauuaauu

SEQ ID NO: 2583808 - RNA, 15 nt, Coxiella burnetii RSA 493
aaauaaauuaauuau

SEQ ID NO: 2583809 - RNA, 18 nt, Coxiella burnetii RSA 493
aaauaacaguugguuagc

SEQ ID NO: 2583810 - RNA, 16 nt, Coxiella burnetii RSA 493
aaauaaccugagggaa

SEQ ID NO: 2583811 - RNA, 22 nt, Coxiella burnetii RSA 493
aaauaaccuuucgcuuguuuau

SEQ ID NO: 2583812 - RNA, 13 nt, Coxiella burnetii RSA 493
aaauaacucaucg

SEQ ID NO: 2583813 - RNA, 15 nt, Coxiella burnetii RSA 493
aaauaagaaacuuug

SEQ ID NO: 2583814 - RNA, 18 nt, Coxiella burnetii RSA 493
aaauaagguuaaaucccu

SEQ ID NO: 2583815 - RNA, 11 nt, Coxiella burnetii RSA 493
aaauaauaaug

SEQ ID NO: 2583816 - RNA, 16 nt, Coxiella burnetii RSA 493
aaauaauaaugaaacu

SEQ ID NO: 2583817 - RNA, 13 nt, Coxiella burnetii RSA 493
aaauaauaugaau

SEQ ID NO: 2583818 - RNA, 15 nt, Coxiella burnetii RSA 493
aaauaaucauuuuua

SEQ ID NO: 2583819 - RNA, 17 nt, Coxiella burnetii RSA 493
aaauaaucguaucgauu

SEQ ID NO: 2583820 - RNA, 21 nt, Coxiella burnetii RSA 493
aaauaaugugacucauuacua

SEQ ID NO: 2583821 - RNA, 16 nt, Coxiella burnetii RSA 493
aaauaauucgcacaau

SEQ ID NO: 2583822 - RNA, 20 nt, Coxiella burnetii RSA 493
aaauaauugauuguucggcu

SEQ ID NO: 2583823 - RNA, 18 nt, Coxiella burnetii RSA 493
aaauacaguaaauaauca

SEQ ID NO: 2583824 - RNA, 21 nt, Coxiella burnetii RSA 493
aaauaccucuucuaaaguacu

SEQ ID NO: 2583825 - RNA, 17 nt, Coxiella burnetii RSA 493
aaauacgggaaaacaau

SEQ ID NO: 2583826 - RNA, 22 nt, Coxiella burnetii RSA 493
aaauacgggaaaacaaugaugu

SEQ ID NO: 2583827 - RNA, 18 nt, Coxiella burnetii RSA 493
aaauacggggaaauaaug

SEQ ID NO: 2583828 - RNA, 19 nt, Coxiella burnetii RSA 493
aaauagaauuuuugacuaa

SEQ ID NO: 2583829 - RNA, 17 nt, Coxiella burnetii RSA 493
aaauagacuucgcuaaa

SEQ ID NO: 2583830 - RNA, 22 nt, Coxiella burnetii RSA 493
aaauagagucgggaaauaaaau

SEQ ID NO: 2583831 - RNA, 19 nt, Coxiella burnetii RSA 493
aaauagcacuaucucuuaa

SEQ ID NO: 2583832 - RNA, 16 nt, Coxiella burnetii RSA 493
aaauagccauuaauaa

SEQ ID NO: 2583833 - RNA, 13 nt, Coxiella burnetii RSA 493
aaauagcuccuuu

SEQ ID NO: 2583834 - RNA, 21 nt, Coxiella burnetii RSA 493
aaauagcuugacgauauugau

SEQ ID NO: 2583835 - RNA, 17 nt, Coxiella burnetii RSA 493
aaauaguuucaauuucg

SEQ ID NO: 2583836 - RNA, 20 nt, Coxiella burnetii RSA 493
aaauaguuugaugucccccg

SEQ ID NO: 2583837 - RNA, 19 nt, Coxiella burnetii RSA 493
aaauaucaucaacagaaca

SEQ ID NO: 2583838 - RNA, 20 nt, Coxiella burnetii RSA 493
aaauauuagaaauaauacuc

SEQ ID NO: 2583839 - RNA, 12 nt, Coxiella burnetii RSA 493
aaauauuuaaau

SEQ ID NO: 2583840 - RNA, 21 nt, Coxiella burnetii RSA 493
aaauauuucuuuuuuagcuuu

SEQ ID NO: 2583841 - RNA, 18 nt, Coxiella burnetii RSA 493
aaauauuugaaccgauaa

SEQ ID NO: 2583842 - RNA, 12 nt, Coxiella burnetii RSA 493
aaauauuuuuau

SEQ ID NO: 2583843 - RNA, 14 nt, Coxiella burnetii RSA 493
aaauauuuuuauuu

SEQ ID NO: 2583844 - RNA, 15 nt, Coxiella burnetii RSA 493
aaauauuuuuauuuc

SEQ ID NO: 2583845 - RNA, 19 nt, Coxiella burnetii RSA 493
aaauauuuuuauuuccagc

SEQ ID NO: 2583846 - RNA, 21 nt, Coxiella burnetii RSA 493
aaaucaacaccccaauuuuug

SEQ ID NO: 2583847 - RNA, 12 nt, Coxiella burnetii RSA 493
aaaucaaucccc

SEQ ID NO: 2583848 - RNA, 16 nt, Coxiella burnetii RSA 493
aaaucaccagaaaacg

SEQ ID NO: 2583849 - RNA, 22 nt, Coxiella burnetii RSA 493
aaaucacuacgaauagccaaug

SEQ ID NO: 2583850 - RNA, 20 nt, Coxiella burnetii RSA 493
aaaucauccaccacuuccau

SEQ ID NO: 2583851 - RNA, 20 nt, Coxiella burnetii RSA 493
aaaucauugguuuuugauug

SEQ ID NO: 2583852 - RNA, 13 nt, Coxiella burnetii RSA 493
aaauccagaccug

SEQ ID NO: 2583853 - RNA, 20 nt, Coxiella burnetii RSA 493
aaauccagaccuguuaaaaa

SEQ ID NO: 2583854 - RNA, 22 nt, Coxiella burnetii RSA 493
aaauccauccggaugucauaau

SEQ ID NO: 2583855 - RNA, 16 nt, Coxiella burnetii RSA 493
aaauccuuaauuaacu

SEQ ID NO: 2583856 - RNA, 23 nt, Coxiella burnetii RSA 493
aaaucgaaucgggccgccuuaau

SEQ ID NO: 2583857 - RNA, 18 nt, Coxiella burnetii RSA 493
aaaucgauggaagaacau

SEQ ID NO: 2583858 - RNA, 19 nt, Coxiella burnetii RSA 493
aaaucgauggaagaacauu

SEQ ID NO: 2583859 - RNA, 17 nt, Coxiella burnetii RSA 493
aaaucgcugagcucauu

SEQ ID NO: 2583860 - RNA, 16 nt, Coxiella burnetii RSA 493
aaaucggaaaagccaa

SEQ ID NO: 2583861 - RNA, 17 nt, Coxiella burnetii RSA 493
aaaucgguuuuuuucuu

SEQ ID NO: 2583862 - RNA, 14 nt, Coxiella burnetii RSA 493
aaaucguuuugaaa

SEQ ID NO: 2583863 - RNA, 17 nt, Coxiella burnetii RSA 493
aaaucuguaacgccaug

SEQ ID NO: 2583864 - RNA, 17 nt, Coxiella burnetii RSA 493
aaaucuuccaauuuuuu

SEQ ID NO: 2583865 - RNA, 17 nt, Coxiella burnetii RSA 493
aaaucuucugaucgaua

SEQ ID NO: 2583866 - RNA, 23 nt, Coxiella burnetii RSA 493
aaaucuucugaucgauaaaaaua

SEQ ID NO: 2583867 - RNA, 20 nt, Coxiella burnetii RSA 493
aaaucuugcggcgauaauca

SEQ ID NO: 2583868 - RNA, 22 nt, Coxiella burnetii RSA 493
aaaucuuuuuuuugaaauucuu

SEQ ID NO: 2583869 - RNA, 21 nt, Coxiella burnetii RSA 493
aaaugaaaucccgagccccaa

SEQ ID NO: 2583870 - RNA, 13 nt, Coxiella burnetii RSA 493
aaaugaauaagca

SEQ ID NO: 2583871 - RNA, 17 nt, Coxiella burnetii RSA 493
aaaugaauaauauugua

SEQ ID NO: 2583872 - RNA, 19 nt, Coxiella burnetii RSA 493
aaaugaccaugguuucuuu

SEQ ID NO: 2583873 - RNA, 20 nt, Coxiella burnetii RSA 493
aaaugagcguaaucaauaaa

SEQ ID NO: 2583874 - RNA, 15 nt, Coxiella burnetii RSA 493
aaaugaguaaaaaag

SEQ ID NO: 2583875 - RNA, 21 nt, Coxiella burnetii RSA 493
aaaugaugcuucuuugauaaa

SEQ ID NO: 2583876 - RNA, 21 nt, Coxiella burnetii RSA 493
aaaugauugggcucaaaaaga

SEQ ID NO: 2583877 - RNA, 21 nt, Coxiella burnetii RSA 493
aaaugcaacgaugcgccggcg

SEQ ID NO: 2583878 - RNA, 16 nt, Coxiella burnetii RSA 493
aaaugccaaauucgag

SEQ ID NO: 2583879 - RNA, 18 nt, Coxiella burnetii RSA 493
aacauccuccauuacaua

SEQ ID NO: 2583880 - RNA, 18 nt, Coxiella burnetii RSA 493
aacauggccaguuagugc

SEQ ID NO: 2583881 - RNA, 12 nt, Coxiella burnetii RSA 493
aacauuauuaca

SEQ ID NO: 2583882 - RNA, 12 nt, Coxiella burnetii RSA 493
aacauucaaaga

SEQ ID NO: 2583883 - RNA, 12 nt, Coxiella burnetii RSA 493
aacauuccuuuc

SEQ ID NO: 2583884 - RNA, 12 nt, Coxiella burnetii RSA 493
aacauucuuuga

SEQ ID NO: 2583885 - RNA, 20 nt, Coxiella burnetii RSA 493
aacauuuguuuaaagcugcu

SEQ ID NO: 2583886 - RNA, 13 nt, Coxiella burnetii RSA 493
aaccaaaaggaau

SEQ ID NO: 2583887 - RNA, 13 nt, Coxiella burnetii RSA 493
aaccaauaccaau

SEQ ID NO: 2583888 - RNA, 20 nt, Coxiella burnetii RSA 493
aaccaauagcuccccgcucc

SEQ ID NO: 2583889 - RNA, 13 nt, Coxiella burnetii RSA 493
aaccaaucuauua

SEQ ID NO: 2583890 - RNA, 16 nt, Coxiella burnetii RSA 493
aaccaaugaaacgcgc

SEQ ID NO: 2583891 - RNA, 17 nt, Coxiella burnetii RSA 493
aaccaauugauuaauua

SEQ ID NO: 2583892 - RNA, 14 nt, Coxiella burnetii RSA 493
aaccaccaaaucac

SEQ ID NO: 2583893 - RNA, 19 nt, Coxiella burnetii RSA 493
aaccacgcuauaauuuucc

SEQ ID NO: 2583894 - RNA, 22 nt, Coxiella burnetii RSA 493
aaccacuauuugcuuucuuuga

SEQ ID NO: 2583895 - RNA, 15 nt, Coxiella burnetii RSA 493
aaccauaagcaagcu

SEQ ID NO: 2583896 - RNA, 20 nt, Coxiella burnetii RSA 493
aaccauuaguguaaggcuga

SEQ ID NO: 2583897 - RNA, 18 nt, Coxiella burnetii RSA 493
aaccauucaaugcuaaau

SEQ ID NO: 2583898 - RNA, 15 nt, Coxiella burnetii RSA 493
aacccacaacuuucu

SEQ ID NO: 2583899 - RNA, 17 nt, Coxiella burnetii RSA 493
aacccagaaaaguaaaa

SEQ ID NO: 2583900 - RNA, 15 nt, Coxiella burnetii RSA 493
aaccccggaaaaucu

SEQ ID NO: 2583901 - RNA, 13 nt, Coxiella burnetii RSA 493
aacccuuucauuu

SEQ ID NO: 2583902 - RNA, 23 nt, Coxiella burnetii RSA 493
aaccgauagucuguaugaagcgc

SEQ ID NO: 2583903 - RNA, 16 nt, Coxiella burnetii RSA 493
aaccgccggguuuuuu

SEQ ID NO: 2583904 - RNA, 18 nt, Coxiella burnetii RSA 493
aaccgcugacgucagaaa

SEQ ID NO: 2583905 - RNA, 20 nt, Coxiella burnetii RSA 493
aaccggcuucuaaguaaaca

SEQ ID NO: 2583906 - RNA, 12 nt, Coxiella burnetii RSA 493
aaccgguuuuuc

SEQ ID NO: 2583907 - RNA, 13 nt, Coxiella burnetii RSA 493
aaccuacuuuucu

SEQ ID NO: 2583908 - RNA, 15 nt, Coxiella burnetii RSA 493
aaccucaacaguagu

SEQ ID NO: 2583909 - RNA, 15 nt, Coxiella burnetii RSA 493
aaccuucaaaaauaa

SEQ ID NO: 2583910 - RNA, 12 nt, Coxiella burnetii RSA 493
aaccuucccgga

SEQ ID NO: 2583911 - RNA, 22 nt, Coxiella burnetii RSA 493
aaccuuguuauaaaacuuccca

SEQ ID NO: 2583912 - RNA, 18 nt, Coxiella burnetii RSA 493
aacgaaaccuuguuauaa

SEQ ID NO: 2583913 - RNA, 13 nt, Coxiella burnetii RSA 493
aacgaacgccaag

SEQ ID NO: 2583914 - RNA, 18 nt, Coxiella burnetii RSA 493
aacgaagguuucauaagg

SEQ ID NO: 2583915 - RNA, 23 nt, Coxiella burnetii RSA 493
aacgaaguucucaaauuuuccca

SEQ ID NO: 2583916 - RNA, 19 nt, Coxiella burnetii RSA 493
aacgaauggcccaauaaag

SEQ ID NO: 2583917 - RNA, 15 nt, Coxiella burnetii RSA 493
aacgacgaucaccca

SEQ ID NO: 2583918 - RNA, 18 nt, Coxiella burnetii RSA 493
aacgacuucucuuucuga

SEQ ID NO: 2583919 - RNA, 16 nt, Coxiella burnetii RSA 493
aacgaggcacugcagc

SEQ ID NO: 2583920 - RNA, 17 nt, Coxiella burnetii RSA 493
aacgaggugcaaaccgu

SEQ ID NO: 2583921 - RNA, 18 nt, Coxiella burnetii RSA 493
aacgauaaaauuacuauu

SEQ ID NO: 2583922 - RNA, 14 nt, Coxiella burnetii RSA 493
aacgauaaaucaaa

SEQ ID NO: 2583923 - RNA, 16 nt, Coxiella burnetii RSA 493
aacgauaaugcacauc

SEQ ID NO: 2583924 - RNA, 15 nt, Coxiella burnetii RSA 493
aacgaugcgccggcg

SEQ ID NO: 2583925 - RNA, 17 nt, Coxiella burnetii RSA 493
aacgauggucaaaccaa

SEQ ID NO: 2583926 - RNA, 19 nt, Coxiella burnetii RSA 493
aacgauggucaaaccaauc

SEQ ID NO: 2583927 - RNA, 22 nt, Coxiella burnetii RSA 493
aacgauuucucuuaccaugguu

SEQ ID NO: 2583928 - RNA, 15 nt, Coxiella burnetii RSA 493
aacgcaggaucaacg

SEQ ID NO: 2583929 - RNA, 23 nt, Coxiella burnetii RSA 493
aacgcaucggccuuuuucauuuc

SEQ ID NO: 2583930 - RNA, 13 nt, Coxiella burnetii RSA 493
aacgccaaaaccg

SEQ ID NO: 2583931 - RNA, 16 nt, Coxiella burnetii RSA 493
aacgccagucauuuuc

SEQ ID NO: 2583932 - RNA, 17 nt, Coxiella burnetii RSA 493
aacgccaucgauuuugu

SEQ ID NO: 2583933 - RNA, 17 nt, Coxiella burnetii RSA 493
aacgccucucucauaau

SEQ ID NO: 2583934 - RNA, 20 nt, Coxiella burnetii RSA 493
aacgccucuugcaacguuug

SEQ ID NO: 2583935 - RNA, 18 nt, Coxiella burnetii RSA 493
aacgccugaaauauuuuc

SEQ ID NO: 2583936 - RNA, 16 nt, Coxiella burnetii RSA 493
aacgcgacaagaauuu

SEQ ID NO: 2583937 - RNA, 24 nt, Coxiella burnetii RSA 493
aacgcgagagucgcaacaagcaac

SEQ ID NO: 2583938 - RNA, 15 nt, Coxiella burnetii RSA 493
aacgcgccaaacaac

SEQ ID NO: 2583939 - RNA, 14 nt, Coxiella burnetii RSA 493
aacgcguuuccucc

SEQ ID NO: 2583940 - RNA, 17 nt, Coxiella burnetii RSA 493
aacgcucgauucuuugu

SEQ ID NO: 2583941 - RNA, 17 nt, Coxiella burnetii RSA 493
aacgcuuaacaguaacu

SEQ ID NO: 2583942 - RNA, 14 nt, Coxiella burnetii RSA 493
aacgcuuguuuuau

SEQ ID NO: 2583943 - RNA, 12 nt, Coxiella burnetii RSA 493
aacggagaaaau

SEQ ID NO: 2583944 - RNA, 14 nt, Coxiella burnetii RSA 493
aacggagaaaaucg

SEQ ID NO: 2583945 - RNA, 20 nt, Coxiella burnetii RSA 493
aacggcaucaacggaaaaac

SEQ ID NO: 2583946 - RNA, 23 nt, Coxiella burnetii RSA 493
aacggcaucaacggaaaaacaaa

SEQ ID NO: 2583947 - RNA, 19 nt, Coxiella burnetii RSA 493
aacgguaacagcaagagga

SEQ ID NO: 2583948 - RNA, 16 nt, Coxiella burnetii RSA 493
aacgguauaaaauuuu

SEQ ID NO: 2583949 - RNA, 17 nt, Coxiella burnetii RSA 493
aacggugcgauuuuccg

SEQ ID NO: 2583950 - RNA, 21 nt, Coxiella burnetii RSA 493
aacgguuauaaacauaaaauu

SEQ ID NO: 2583951 - RNA, 12 nt, Coxiella burnetii RSA 493
aacguaaaaugc

SEQ ID NO: 2583952 - RNA, 18 nt, Coxiella burnetii RSA 493
aacgucgccugcuaaaau

SEQ ID NO: 2583953 - RNA, 17 nt, Coxiella burnetii RSA 493
aacgugcuugccgggcg

SEQ ID NO: 2583954 - RNA, 12 nt, Coxiella burnetii RSA 493
aacguuugauuu

SEQ ID NO: 2583955 - RNA, 18 nt, Coxiella burnetii RSA 493
aacguuugauuuucaagu

SEQ ID NO: 2583956 - RNA, 20 nt, Coxiella burnetii RSA 493
aacguuugauuuucaaguuu

SEQ ID NO: 2583957 - RNA, 19 nt, Coxiella burnetii RSA 493
aacguuuugucguuuucau

SEQ ID NO: 2583958 - RNA, 18 nt, Coxiella burnetii RSA 493
aacuaaagggggaacgaa

SEQ ID NO: 2583959 - RNA, 19 nt, Coxiella burnetii RSA 493
aacuaaauuuuauaaauua

SEQ ID NO: 2583960 - RNA, 19 nt, Coxiella burnetii RSA 493
aacuaagcauuaaaaaaua

SEQ ID NO: 2583961 - RNA, 15 nt, Coxiella burnetii RSA 493
aacuaauugccaaua

SEQ ID NO: 2583962 - RNA, 17 nt, Coxiella burnetii RSA 493
aacuaccugauaaaaua

SEQ ID NO: 2583963 - RNA, 19 nt, Coxiella burnetii RSA 493
aacuaccugauaaaauaac

SEQ ID NO: 2583964 - RNA, 20 nt, Coxiella burnetii RSA 493
aacuaccugauaaaauaaca

SEQ ID NO: 2583965 - RNA, 18 nt, Coxiella burnetii RSA 493
aacuagaaauauuagaaa

SEQ ID NO: 2583966 - RNA, 15 nt, Coxiella burnetii RSA 493
aacuaguuauuuuua

SEQ ID NO: 2583967 - RNA, 17 nt, Coxiella burnetii RSA 493
aacuauccccaucguuu

SEQ ID NO: 2583968 - RNA, 21 nt, Coxiella burnetii RSA 493
aacuaucguugccuuuuugaa

SEQ ID NO: 2583969 - RNA, 22 nt, Coxiella burnetii RSA 493
aacuaucguugccuuuuugaau

SEQ ID NO: 2583970 - RNA, 18 nt, Coxiella burnetii RSA 493
aacuauuauuaaaagagc

SEQ ID NO: 2583971 - RNA, 19 nt, Coxiella burnetii RSA 493
aacucaauucgcuuaaauu

SEQ ID NO: 2583972 - RNA, 21 nt, Coxiella burnetii RSA 493
aacucaauucgcuuaaauuuu

SEQ ID NO: 2583973 - RNA, 23 nt, Coxiella burnetii RSA 493
aacucaauucgcuuaaauuuuga

SEQ ID NO: 2583974 - RNA, 16 nt, Coxiella burnetii RSA 493
aacucagcccaacaua

SEQ ID NO: 2583975 - RNA, 22 nt, Coxiella burnetii RSA 493
aacucccaucaaaguagcugca

SEQ ID NO: 2583976 - RNA, 17 nt, Coxiella burnetii RSA 493
aacuccugaaaaauaau

SEQ ID NO: 2583977 - RNA, 22 nt, Coxiella burnetii RSA 493
aacuccugaaaaauaauuuuag

SEQ ID NO: 2583978 - RNA, 19 nt, Coxiella burnetii RSA 493
aacuccuucgcuuuuucca

SEQ ID NO: 2583979 - RNA, 18 nt, Coxiella burnetii RSA 493
aacuccuuguuuuaaccu

SEQ ID NO: 2583980 - RNA, 18 nt, Coxiella burnetii RSA 493
aacucgcccauggaaauc

SEQ ID NO: 2583981 - RNA, 14 nt, Coxiella burnetii RSA 493
aacucggaacugau

SEQ ID NO: 2583982 - RNA, 15 nt, Coxiella burnetii RSA 493
aacucuaauuuuccu

SEQ ID NO: 2583983 - RNA, 23 nt, Coxiella burnetii RSA 493
aacucuguuagauauugaacagg

SEQ ID NO: 2583984 - RNA, 20 nt, Coxiella burnetii RSA 493
aacucuuuggcgccgcugga

SEQ ID NO: 2583985 - RNA, 11 nt, Coxiella burnetii RSA 493
aagcugauucc

SEQ ID NO: 2583986 - RNA, 14 nt, Coxiella burnetii RSA 493
aagcugccaccuuu

SEQ ID NO: 2583987 - RNA, 19 nt, Coxiella burnetii RSA 493
aagcugcgcauaaacuuua

SEQ ID NO: 2583988 - RNA, 21 nt, Coxiella burnetii RSA 493
aagcuucucggauagcgacaa

SEQ ID NO: 2583989 - RNA, 17 nt, Coxiella burnetii RSA 493
aagcuuucaauaaauaa

SEQ ID NO: 2583990 - RNA, 12 nt, Coxiella burnetii RSA 493
aaggaaaagcac

SEQ ID NO: 2583991 - RNA, 15 nt, Coxiella burnetii RSA 493
aaggaaaauccggau

SEQ ID NO: 2583992 - RNA, 18 nt, Coxiella burnetii RSA 493
aaggaaaggucaggcaau

SEQ ID NO: 2583993 - RNA, 17 nt, Coxiella burnetii RSA 493
aaggaaccaccaaauca

SEQ ID NO: 2583994 - RNA, 21 nt, Coxiella burnetii RSA 493
aaggaauaaaaccuucaaaaa

SEQ ID NO: 2583995 - RNA, 17 nt, Coxiella burnetii RSA 493
aaggaauagccuucuca

SEQ ID NO: 2583996 - RNA, 18 nt, Coxiella burnetii RSA 493
aaggaauccuuuuucuag

SEQ ID NO: 2583997 - RNA, 21 nt, Coxiella burnetii RSA 493
aaggacaguuggcuuguaaag

SEQ ID NO: 2583998 - RNA, 14 nt, Coxiella burnetii RSA 493
aaggcaacucuuug

SEQ ID NO: 2583999 - RNA, 14 nt, Coxiella burnetii RSA 493
aaggcaauuuuuga

SEQ ID NO: 2584000 - RNA, 14 nt, Coxiella burnetii RSA 493
aaggcagaggacag

SEQ ID NO: 2584001 - RNA, 18 nt, Coxiella burnetii RSA 493
aaggcagaggacagagga

SEQ ID NO: 2584002 - RNA, 22 nt, Coxiella burnetii RSA 493
aaggcagcuuccagaaauucau

SEQ ID NO: 2584003 - RNA, 15 nt, Coxiella burnetii RSA 493
aaggcaugaaauuuu

SEQ ID NO: 2584004 - RNA, 17 nt, Coxiella burnetii RSA 493
aaggcaugaaauuuuug

SEQ ID NO: 2584005 - RNA, 20 nt, Coxiella burnetii RSA 493
aaggcccgcuaauuguucag

SEQ ID NO: 2584006 - RNA, 22 nt, Coxiella burnetii RSA 493
aaggccucuuuagaaaauugau

SEQ ID NO: 2584007 - RNA, 19 nt, Coxiella burnetii RSA 493
aaggcgagcccauugagaa

SEQ ID NO: 2584008 - RNA, 15 nt, Coxiella burnetii RSA 493
aaggcuaauuuuccu

SEQ ID NO: 2584009 - RNA, 16 nt, Coxiella burnetii RSA 493
aaggcuaauuuuccuu

SEQ ID NO: 2584010 - RNA, 15 nt, Coxiella burnetii RSA 493
aaggcucacaauuaa

SEQ ID NO: 2584011 - RNA, 22 nt, Coxiella burnetii RSA 493
aaggcuuuauuuacggaaauca

SEQ ID NO: 2584012 - RNA, 18 nt, Coxiella burnetii RSA 493
aagggaccuuuuuugcaa

SEQ ID NO: 2584013 - RNA, 18 nt, Coxiella burnetii RSA 493
aagggaucauaaucgguu

SEQ ID NO: 2584014 - RNA, 20 nt, Coxiella burnetii RSA 493
aagggcucgcuaaucgcaau

SEQ ID NO: 2584015 - RNA, 14 nt, Coxiella burnetii RSA 493
aagggugagguaac

SEQ ID NO: 2584016 - RNA, 19 nt, Coxiella burnetii RSA 493
aaggucauccauucuuuca

SEQ ID NO: 2584017 - RNA, 23 nt, Coxiella burnetii RSA 493
aaggugcgucccgcuuaaaccca

SEQ ID NO: 2584018 - RNA, 15 nt, Coxiella burnetii RSA 493
aagguggaacaauau

SEQ ID NO: 2584019 - RNA, 17 nt, Coxiella burnetii RSA 493
aagguggagagaauuuu

SEQ ID NO: 2584020 - RNA, 15 nt, Coxiella burnetii RSA 493
aagguguucaaccgc

SEQ ID NO: 2584021 - RNA, 15 nt, Coxiella burnetii RSA 493
aagguugagaaguaa

SEQ ID NO: 2584022 - RNA, 13 nt, Coxiella burnetii RSA 493
aagguuuuuccuu

SEQ ID NO: 2584023 - RNA, 20 nt, Coxiella burnetii RSA 493
aaguaagccauaucaggagc

SEQ ID NO: 2584024 - RNA, 21 nt, Coxiella burnetii RSA 493
aaguaaguagcucuuaaaaga

SEQ ID NO: 2584025 - RNA, 15 nt, Coxiella burnetii RSA 493
aaguaauucagcauu

SEQ ID NO: 2584026 - RNA, 18 nt, Coxiella burnetii RSA 493
aaguacccaacaauaaaa

SEQ ID NO: 2584027 - RNA, 22 nt, Coxiella burnetii RSA 493
aaguacccaacaauaaaaccga

SEQ ID NO: 2584028 - RNA, 17 nt, Coxiella burnetii RSA 493
aaguacuagcaucaaua

SEQ ID NO: 2584029 - RNA, 18 nt, Coxiella burnetii RSA 493
aaguacugaugcaaauca

SEQ ID NO: 2584030 - RNA, 14 nt, Coxiella burnetii RSA 493
aaguagccaaaaua

SEQ ID NO: 2584031 - RNA, 16 nt, Coxiella burnetii RSA 493
aaguagccaaaauaau

SEQ ID NO: 2584032 - RNA, 12 nt, Coxiella burnetii RSA 493
aaguauccaucc

SEQ ID NO: 2584033 - RNA, 14 nt, Coxiella burnetii RSA 493
aaguaugauguuuc

SEQ ID NO: 2584034 - RNA, 20 nt, Coxiella burnetii RSA 493
aaguaugauguuuccguuug

SEQ ID NO: 2584035 - RNA, 19 nt, Coxiella burnetii RSA 493
aaguaugugggcucacuug

SEQ ID NO: 2584036 - RNA, 14 nt, Coxiella burnetii RSA 493
aagucagacuugcu

SEQ ID NO: 2584037 - RNA, 19 nt, Coxiella burnetii RSA 493
aaguccaauuauaacuauu

SEQ ID NO: 2584038 - RNA, 14 nt, Coxiella burnetii RSA 493
aaguccuuguugca

SEQ ID NO: 2584039 - RNA, 20 nt, Coxiella burnetii RSA 493
aagucugaacaggcagauga

SEQ ID NO: 2584040 - RNA, 15 nt, Coxiella burnetii RSA 493
aagucuuugcuaaga

SEQ ID NO: 2584041 - RNA, 23 nt, Coxiella burnetii RSA 493
aagugauuuuuuuagcacagcga

SEQ ID NO: 2584042 - RNA, 18 nt, Coxiella burnetii RSA 493
aagugggggaacagagga

SEQ ID NO: 2584043 - RNA, 15 nt, Coxiella burnetii RSA 493
aagugugggaaaaau

SEQ ID NO: 2584044 - RNA, 17 nt, Coxiella burnetii RSA 493
aagugugggaaaaauag

SEQ ID NO: 2584045 - RNA, 15 nt, Coxiella burnetii RSA 493
aaguuauuucuuuug

SEQ ID NO: 2584046 - RNA, 22 nt, Coxiella burnetii RSA 493
aaguucccccuggugcugguag

SEQ ID NO: 2584047 - RNA, 15 nt, Coxiella burnetii RSA 493
aaguucucaaauuuu

SEQ ID NO: 2584048 - RNA, 16 nt, Coxiella burnetii RSA 493
aaguucucaaauuuuc

SEQ ID NO: 2584049 - RNA, 22 nt, Coxiella burnetii RSA 493
aaguucuucuaaagaauuuuuc

SEQ ID NO: 2584050 - RNA, 13 nt, Coxiella burnetii RSA 493
aaguugacgccua

SEQ ID NO: 2584051 - RNA, 23 nt, Coxiella burnetii RSA 493
aaguugcgcccugaguucgcuaa

SEQ ID NO: 2584052 - RNA, 18 nt, Coxiella burnetii RSA 493
aaguuucacgaauuaaaa

SEQ ID NO: 2584053 - RNA, 19 nt, Coxiella burnetii RSA 493
aaguuucacgaauuaaaaa

SEQ ID NO: 2584054 - RNA, 19 nt, Coxiella burnetii RSA 493
aaguuucucccgauaaguu

SEQ ID NO: 2584055 - RNA, 11 nt, Coxiella burnetii RSA 493
aaguuugaccc

SEQ ID NO: 2584056 - RNA, 14 nt, Coxiella burnetii RSA 493
aaguuuuaagaaaa

SEQ ID NO: 2584057 - RNA, 15 nt, Coxiella burnetii RSA 493
aaguuuuaagaaaaa

SEQ ID NO: 2584058 - RNA, 19 nt, Coxiella burnetii RSA 493
aaguuuucuauauuuucuu

SEQ ID NO: 2584059 - RNA, 14 nt, Coxiella burnetii RSA 493
aauaaaaggagaaa

SEQ ID NO: 2584060 - RNA, 22 nt, Coxiella burnetii RSA 493
aauaaaaggagaaauugacaaa

SEQ ID NO: 2584061 - RNA, 20 nt, Coxiella burnetii RSA 493
aauaaaaguccuguucuuuu

SEQ ID NO: 2584062 - RNA, 12 nt, Coxiella burnetii RSA 493
aauaaaauuaaa

SEQ ID NO: 2584063 - RNA, 14 nt, Coxiella burnetii RSA 493
aauaaaauuaaaua

SEQ ID NO: 2584064 - RNA, 13 nt, Coxiella burnetii RSA 493
aauaaaauuaauu

SEQ ID NO: 2584065 - RNA, 15 nt, Coxiella burnetii RSA 493
aauaaaguaauuuua

SEQ ID NO: 2584066 - RNA, 17 nt, Coxiella burnetii RSA 493
aauaaaguaauuuuaaa

SEQ ID NO: 2584067 - RNA, 15 nt, Coxiella burnetii RSA 493
aauaaaucaauuaaa

SEQ ID NO: 2584068 - RNA, 17 nt, Coxiella burnetii RSA 493
aauaaaucaauuaaauu

SEQ ID NO: 2584069 - RNA, 15 nt, Coxiella burnetii RSA 493
aauaaauccuuggga

SEQ ID NO: 2584070 - RNA, 18 nt, Coxiella burnetii RSA 493
aauaaauuaauuauccaa

SEQ ID NO: 2584071 - RNA, 13 nt, Coxiella burnetii RSA 493
aauaacaaaguaa

SEQ ID NO: 2584072 - RNA, 13 nt, Coxiella burnetii RSA 493
aauaacaaauaaa

SEQ ID NO: 2584073 - RNA, 12 nt, Coxiella burnetii RSA 493
aauaacagagau

SEQ ID NO: 2584074 - RNA, 17 nt, Coxiella burnetii RSA 493
aauaacccacagccgcu

SEQ ID NO: 2584075 - RNA, 22 nt, Coxiella burnetii RSA 493
aauaacuuuacuaaaaaacgau

SEQ ID NO: 2584076 - RNA, 18 nt, Coxiella burnetii RSA 493
aauaacuuuaguuuuucc

SEQ ID NO: 2584077 - RNA, 16 nt, Coxiella burnetii RSA 493
aauaagccaauacgaa

SEQ ID NO: 2584078 - RNA, 18 nt, Coxiella burnetii RSA 493
aauaagccuaaacgcuua

SEQ ID NO: 2584079 - RNA, 14 nt, Coxiella burnetii RSA 493
aauaagcugauuaa

SEQ ID NO: 2584080 - RNA, 14 nt, Coxiella burnetii RSA 493
aauaagucuuugcu

SEQ ID NO: 2584081 - RNA, 13 nt, Coxiella burnetii RSA 493
aauaauaaaaccc

SEQ ID NO: 2584082 - RNA, 13 nt, Coxiella burnetii RSA 493
aauaauaugaaua

SEQ ID NO: 2584083 - RNA, 22 nt, Coxiella burnetii RSA 493
aauaauccaagggaucauaauc

SEQ ID NO: 2584084 - RNA, 18 nt, Coxiella burnetii RSA 493
aauaaugaguggcugcuu

SEQ ID NO: 2584085 - RNA, 20 nt, Coxiella burnetii RSA 493
aauaaugucugcauuuuuaa

SEQ ID NO: 2584086 - RNA, 16 nt, Coxiella burnetii RSA 493
aauaaugugacucauu

SEQ ID NO: 2584087 - RNA, 21 nt, Coxiella burnetii RSA 493
aauaauucguuuacuuguugc

SEQ ID NO: 2584088 - RNA, 19 nt, Coxiella burnetii RSA 493
aauaauugcugaacaaaag

SEQ ID NO: 2584089 - RNA, 18 nt, Coxiella burnetii RSA 493
aauaauuuuagccacuug

SEQ ID NO: 2584090 - RNA, 14 nt, Coxiella burnetii RSA 493
aauaauuuuccguc

SEQ ID NO: 2584091 - RNA, 19 nt, Coxiella burnetii RSA 493
aaucgguuuuuuucuuuuu

SEQ ID NO: 2584092 - RNA, 18 nt, Coxiella burnetii RSA 493
aaucguguagaaagaaag

SEQ ID NO: 2584093 - RNA, 17 nt, Coxiella burnetii RSA 493
aaucguugcauaauauu

SEQ ID NO: 2584094 - RNA, 19 nt, Coxiella burnetii RSA 493
aaucguugcauaauauuuu

SEQ ID NO: 2584095 - RNA, 17 nt, Coxiella burnetii RSA 493
aaucguuuguaauaauu

SEQ ID NO: 2584096 - RNA, 19 nt, Coxiella burnetii RSA 493
aaucguuuguaauaauuca

SEQ ID NO: 2584097 - RNA, 16 nt, Coxiella burnetii RSA 493
aaucucacuuggauuu

SEQ ID NO: 2584098 - RNA, 13 nt, Coxiella burnetii RSA 493
aaucucaucaucu

SEQ ID NO: 2584099 - RNA, 17 nt, Coxiella burnetii RSA 493
aaucugacguuaucacu

SEQ ID NO: 2584100 - RNA, 22 nt, Coxiella burnetii RSA 493
aaucuguaacgccaugaagcaa

SEQ ID NO: 2584101 - RNA, 21 nt, Coxiella burnetii RSA 493
aaucugugccacuuucgauaa

SEQ ID NO: 2584102 - RNA, 15 nt, Coxiella burnetii RSA 493
aaucuuccaauuuuu

SEQ ID NO: 2584103 - RNA, 19 nt, Coxiella burnetii RSA 493
aaucuugcugcaaaaacgu

SEQ ID NO: 2584104 - RNA, 12 nt, Coxiella burnetii RSA 493
aaugaaaaauag

SEQ ID NO: 2584105 - RNA, 13 nt, Coxiella burnetii RSA 493
aaugaaaaauagg

SEQ ID NO: 2584106 - RNA, 15 nt, Coxiella burnetii RSA 493
aaugaaaaauagggc

SEQ ID NO: 2584107 - RNA, 15 nt, Coxiella burnetii RSA 493
aaugaaacgcagcga

SEQ ID NO: 2584108 - RNA, 20 nt, Coxiella burnetii RSA 493
aaugaaacgcgccaaacaac

SEQ ID NO: 2584109 - RNA, 15 nt, Coxiella burnetii RSA 493
aaugaaauauauaaa

SEQ ID NO: 2584110 - RNA, 18 nt, Coxiella burnetii RSA 493
aaugaagguguuugagga

SEQ ID NO: 2584111 - RNA, 14 nt, Coxiella burnetii RSA 493
aaugaauagaaaaa

SEQ ID NO: 2584112 - RNA, 16 nt, Coxiella burnetii RSA 493
aaugaauucaaaccaa

SEQ ID NO: 2584113 - RNA, 14 nt, Coxiella burnetii RSA 493
aaugagaaacguga

SEQ ID NO: 2584114 - RNA, 18 nt, Coxiella burnetii RSA 493
aaugagaaacgugagaga

SEQ ID NO: 2584115 - RNA, 14 nt, Coxiella burnetii RSA 493
aaugagauaacucu

SEQ ID NO: 2584116 - RNA, 14 nt, Coxiella burnetii RSA 493
aaugagaucaaagc

SEQ ID NO: 2584117 - RNA, 13 nt, Coxiella burnetii RSA 493
aaugagaugauca

SEQ ID NO: 2584118 - RNA, 21 nt, Coxiella burnetii RSA 493
aaugagaugaucaucaucaaa

SEQ ID NO: 2584119 - RNA, 23 nt, Coxiella burnetii RSA 493
aaugagcguaaucaauaaaacuc

SEQ ID NO: 2584120 - RNA, 23 nt, Coxiella burnetii RSA 493
aaugaggaucaucgcacuugcuu

SEQ ID NO: 2584121 - RNA, 12 nt, Coxiella burnetii RSA 493
aaugagugcuuu

SEQ ID NO: 2584122 - RNA, 14 nt, Coxiella burnetii RSA 493
aaugagugcuuuua

SEQ ID NO: 2584123 - RNA, 14 nt, Coxiella burnetii RSA 493
aaugaguucauuaa

SEQ ID NO: 2584124 - RNA, 18 nt, Coxiella burnetii RSA 493
aaugaucaaugaaacaaa

SEQ ID NO: 2584125 - RNA, 23 nt, Coxiella burnetii RSA 493
aaugaucggcgcauuuuuauucg

SEQ ID NO: 2584126 - RNA, 14 nt, Coxiella burnetii RSA 493
aaugaucugcucuu

SEQ ID NO: 2584127 - RNA, 16 nt, Coxiella burnetii RSA 493
aaugaucugcucuuuu

SEQ ID NO: 2584128 - RNA, 19 nt, Coxiella burnetii RSA 493
aaugaugcuucuuugauaa

SEQ ID NO: 2584129 - RNA, 14 nt, Coxiella burnetii RSA 493
aaugauuucauccu

SEQ ID NO: 2584130 - RNA, 13 nt, Coxiella burnetii RSA 493
aaugcaaaaccaa

SEQ ID NO: 2584131 - RNA, 21 nt, Coxiella burnetii RSA 493
aaugcgccauccgacauucuu

SEQ ID NO: 2584132 - RNA, 17 nt, Coxiella burnetii RSA 493
aaugcgccuacaaauac

SEQ ID NO: 2584133 - RNA, 20 nt, Coxiella burnetii RSA 493
aaugcgccuacaaauaccaa

SEQ ID NO: 2584134 - RNA, 21 nt, Coxiella burnetii RSA 493
aaugcgcgauguguaucccaa

SEQ ID NO: 2584135 - RNA, 15 nt, Coxiella burnetii RSA 493
aaugcgcucugccac

SEQ ID NO: 2584136 - RNA, 23 nt, Coxiella burnetii RSA 493
aaugcgcuuuuaaacgcuucaaa

SEQ ID NO: 2584137 - RNA, 17 nt, Coxiella burnetii RSA 493
aaugcggcauucaaugg

SEQ ID NO: 2584138 - RNA, 15 nt, Coxiella burnetii RSA 493
aaugcguuuuaaaug

SEQ ID NO: 2584139 - RNA, 16 nt, Coxiella burnetii RSA 493
aaugcuaauuccuuug

SEQ ID NO: 2584140 - RNA, 16 nt, Coxiella burnetii RSA 493
aaugcugauaauugaa

SEQ ID NO: 2584141 - RNA, 18 nt, Coxiella burnetii RSA 493
aaugcugaugaaauugca

SEQ ID NO: 2584142 - RNA, 21 nt, Coxiella burnetii RSA 493
aaugcugcgaccuucuuuuuu

SEQ ID NO: 2584143 - RNA, 14 nt, Coxiella burnetii RSA 493
aaugcuuucuuuua

SEQ ID NO: 2584144 - RNA, 14 nt, Coxiella burnetii RSA 493
aaugcuuuucucaa

SEQ ID NO: 2584145 - RNA, 14 nt, Coxiella burnetii RSA 493
aaugcuuuuuuaua

SEQ ID NO: 2584146 - RNA, 13 nt, Coxiella burnetii RSA 493
aauggaaauccag

SEQ ID NO: 2584147 - RNA, 14 nt, Coxiella burnetii RSA 493
aauggauucccaua

SEQ ID NO: 2584148 - RNA, 13 nt, Coxiella burnetii RSA 493
aauggauucuucu

SEQ ID NO: 2584149 - RNA, 14 nt, Coxiella burnetii RSA 493
aauggauucuucuu

SEQ ID NO: 2584150 - RNA, 16 nt, Coxiella burnetii RSA 493
aauggauucuucuuuu

SEQ ID NO: 2584151 - RNA, 14 nt, Coxiella burnetii RSA 493
aauggauugcacuu

SEQ ID NO: 2584152 - RNA, 18 nt, Coxiella burnetii RSA 493
aauggcuaacucacuuuu

SEQ ID NO: 2584153 - RNA, 18 nt, Coxiella burnetii RSA 493
aaugggaaguuuuauaac

SEQ ID NO: 2584154 - RNA, 22 nt, Coxiella burnetii RSA 493
aaugguggucggcaccaaaauc

SEQ ID NO: 2584155 - RNA, 15 nt, Coxiella burnetii RSA 493
aaugguugaaagaaa

SEQ ID NO: 2584156 - RNA, 22 nt, Coxiella burnetii RSA 493
aaugguugauuuuuuaauuaag

SEQ ID NO: 2584157 - RNA, 15 nt, Coxiella burnetii RSA 493
aauguauccgggcca

SEQ ID NO: 2584158 - RNA, 23 nt, Coxiella burnetii RSA 493
aaugucacguuaucauucuuauc

SEQ ID NO: 2584159 - RNA, 18 nt, Coxiella burnetii RSA 493
aaugucagguucggauuu

SEQ ID NO: 2584160 - RNA, 23 nt, Coxiella burnetii RSA 493
aaugucagguucggauuucacuu

SEQ ID NO: 2584161 - RNA, 17 nt, Coxiella burnetii RSA 493
aaugucuccaaccgaua

SEQ ID NO: 2584162 - RNA, 13 nt, Coxiella burnetii RSA 493
aauguuaaaacac

SEQ ID NO: 2584163 - RNA, 12 nt, Coxiella burnetii RSA 493
aauguuaauucg

SEQ ID NO: 2584164 - RNA, 21 nt, Coxiella burnetii RSA 493
aauguuaggaaggacaaaaau

SEQ ID NO: 2584165 - RNA, 16 nt, Coxiella burnetii RSA 493
aauguugauaauaaau

SEQ ID NO: 2584166 - RNA, 18 nt, Coxiella burnetii RSA 493
aauguugauaauaaaugg

SEQ ID NO: 2584167 - RNA, 14 nt, Coxiella burnetii RSA 493
aauguuuaaucgcu

SEQ ID NO: 2584168 - RNA, 20 nt, Coxiella burnetii RSA 493
aauguuuccaaauaaugagu

SEQ ID NO: 2584169 - RNA, 16 nt, Coxiella burnetii RSA 493
aauguuugaauauuuu

SEQ ID NO: 2584170 - RNA, 22 nt, Coxiella burnetii RSA 493
aauguuugauccuugcaauaag

SEQ ID NO: 2584171 - RNA, 16 nt, Coxiella burnetii RSA 493
aauguuuuuuaauaaa

SEQ ID NO: 2584172 - RNA, 15 nt, Coxiella burnetii RSA 493
aauuaaaaaauucaa

SEQ ID NO: 2584173 - RNA, 16 nt, Coxiella burnetii RSA 493
aauuaaaaaucgguuu

SEQ ID NO: 2584174 - RNA, 23 nt, Coxiella burnetii RSA 493
aauuaaaaaucgguuuuuuucuu

SEQ ID NO: 2584175 - RNA, 15 nt, Coxiella burnetii RSA 493
aauuaaaaucuucug

SEQ ID NO: 2584176 - RNA, 10 nt, Coxiella burnetii RSA 493
aauuaaauau

SEQ ID NO: 2584177 - RNA, 13 nt, Coxiella burnetii RSA 493
aauuaaaugcuuu

SEQ ID NO: 2584178 - RNA, 23 nt, Coxiella burnetii RSA 493
aauuaaaugcuuuuuaaauaacu

SEQ ID NO: 2584179 - RNA, 17 nt, Coxiella burnetii RSA 493
aauuaaccaaucaauaa

SEQ ID NO: 2584180 - RNA, 17 nt, Coxiella burnetii RSA 493
aauuaacguauaaauaa

SEQ ID NO: 2584181 - RNA, 20 nt, Coxiella burnetii RSA 493
aauuaacguauaaauaacau

SEQ ID NO: 2584182 - RNA, 16 nt, Coxiella burnetii RSA 493
aauuaacuuugcaaag

SEQ ID NO: 2584183 - RNA, 17 nt, Coxiella burnetii RSA 493
aauuaacuuugcaaagc

SEQ ID NO: 2584184 - RNA, 21 nt, Coxiella burnetii RSA 493
aauuaagacuaggaaaaaaua

SEQ ID NO: 2584185 - RNA, 18 nt, Coxiella burnetii RSA 493
aauuaagcuugaaaaaau

SEQ ID NO: 2584186 - RNA, 19 nt, Coxiella burnetii RSA 493
aauuaagcuugaaaaaauu

SEQ ID NO: 2584187 - RNA, 23 nt, Coxiella burnetii RSA 493
aauuaagcuugaaaaaauugaua

SEQ ID NO: 2584188 - RNA, 23 nt, Coxiella burnetii RSA 493
aauuaaugaucaaugaaacaaac

SEQ ID NO: 2584189 - RNA, 20 nt, Coxiella burnetii RSA 493
aauuaaugauuuaccgccgu

SEQ ID NO: 2584190 - RNA, 19 nt, Coxiella burnetii RSA 493
aauuaaugcgccuacaaau

SEQ ID NO: 2584191 - RNA, 20 nt, Coxiella burnetii RSA 493
aauuaaugcgccuacaaaua

SEQ ID NO: 2584192 - RNA, 13 nt, Coxiella burnetii RSA 493
aauuaauuguggc

SEQ ID NO: 2584193 - RNA, 17 nt, Coxiella burnetii RSA 493
aauuacaauccaauacu

SEQ ID NO: 2584194 - RNA, 21 nt, Coxiella burnetii RSA 493
aauuacuacacgcuugaaaua

SEQ ID NO: 2584195 - RNA, 13 nt, Coxiella burnetii RSA 493
aauuacuuuuaua

SEQ ID NO: 2584196 - RNA, 21 nt, Coxiella burnetii RSA 493
aauuagaauuccuuuuaugaa

SEQ ID NO: 2584197 - RNA, 20 nt, Coxiella burnetii RSA 493
aauuuuuuuauaauuaucca

SEQ ID NO: 2584198 - RNA, 15 nt, Coxiella burnetii RSA 493
aauuuuuuuucuucu

SEQ ID NO: 2584199 - RNA, 21 nt, Coxiella burnetii RSA 493
acaaaaauaucccuuuggaua

SEQ ID NO: 2584200 - RNA, 18 nt, Coxiella burnetii RSA 493
acaaaacgggcauuggaa

SEQ ID NO: 2584201 - RNA, 13 nt, Coxiella burnetii RSA 493
acaaaagccaugc

SEQ ID NO: 2584202 - RNA, 17 nt, Coxiella burnetii RSA 493
acaaaagguaaaaaacu

SEQ ID NO: 2584203 - RNA, 21 nt, Coxiella burnetii RSA 493
acaaaaguggggauaauugaa

SEQ ID NO: 2584204 - RNA, 15 nt, Coxiella burnetii RSA 493
acaaaaucaccagaa

SEQ ID NO: 2584205 - RNA, 13 nt, Coxiella burnetii RSA 493
acaaaauuuuuca

SEQ ID NO: 2584206 - RNA, 13 nt, Coxiella burnetii RSA 493
acaaacaaaaaau

SEQ ID NO: 2584207 - RNA, 14 nt, Coxiella burnetii RSA 493
acaaacugcuggaa

SEQ ID NO: 2584208 - RNA, 12 nt, Coxiella burnetii RSA 493
acaaagaggcaa

SEQ ID NO: 2584209 - RNA, 23 nt, Coxiella burnetii RSA 493
acaaaggauuauuugaaccauga

SEQ ID NO: 2584210 - RNA, 16 nt, Coxiella burnetii RSA 493
acaaaggcacaaagau

SEQ ID NO: 2584211 - RNA, 20 nt, Coxiella burnetii RSA 493
acaaagugaaauaugucacu

SEQ ID NO: 2584212 - RNA, 18 nt, Coxiella burnetii RSA 493
acaaaguuucuucauauu

SEQ ID NO: 2584213 - RNA, 21 nt, Coxiella burnetii RSA 493
acaaauaaagaauuugacaag

SEQ ID NO: 2584214 - RNA, 17 nt, Coxiella burnetii RSA 493
acaaaugaugaauuuau

SEQ ID NO: 2584215 - RNA, 15 nt, Coxiella burnetii RSA 493
acaaaugccaaauuc

SEQ ID NO: 2584216 - RNA, 16 nt, Coxiella burnetii RSA 493
acaaauucucccuuuu

SEQ ID NO: 2584217 - RNA, 13 nt, Coxiella burnetii RSA 493
acaaauuuuuaag

SEQ ID NO: 2584218 - RNA, 22 nt, Coxiella burnetii RSA 493
acaacgaaaccuuguuauaaau

SEQ ID NO: 2584219 - RNA, 15 nt, Coxiella burnetii RSA 493
acaacgcuguuaaaa

SEQ ID NO: 2584220 - RNA, 15 nt, Coxiella burnetii RSA 493
acaacggcaucaacg

SEQ ID NO: 2584221 - RNA, 13 nt, Coxiella burnetii RSA 493
acaacguaacuga

SEQ ID NO: 2584222 - RNA, 19 nt, Coxiella burnetii RSA 493
acaacuaccugauaaaaua

SEQ ID NO: 2584223 - RNA, 15 nt, Coxiella burnetii RSA 493
acaagacaacaaaau

SEQ ID NO: 2584224 - RNA, 18 nt, Coxiella burnetii RSA 493
acaagguuuuauuuuuaa

SEQ ID NO: 2584225 - RNA, 14 nt, Coxiella burnetii RSA 493
acaaguauaacaaa

SEQ ID NO: 2584226 - RNA, 19 nt, Coxiella burnetii RSA 493
acaaguauaacaaaauuaa

SEQ ID NO: 2584227 - RNA, 13 nt, Coxiella burnetii RSA 493
acaauaaaagcgc

SEQ ID NO: 2584228 - RNA, 12 nt, Coxiella burnetii RSA 493
acaauaaacaca

SEQ ID NO: 2584229 - RNA, 22 nt, Coxiella burnetii RSA 493
acaauagggcggcaaucagaau

SEQ ID NO: 2584230 - RNA, 13 nt, Coxiella burnetii RSA 493
acaauauacgcaa

SEQ ID NO: 2584231 - RNA, 13 nt, Coxiella burnetii RSA 493
acaaugaugucau

SEQ ID NO: 2584232 - RNA, 17 nt, Coxiella burnetii RSA 493
acaaugaugucaucuau

SEQ ID NO: 2584233 - RNA, 19 nt, Coxiella burnetii RSA 493
acaaugcccgaaaaggaaa

SEQ ID NO: 2584234 - RNA, 20 nt, Coxiella burnetii RSA 493
acaaugcccgaaaaggaaau

SEQ ID NO: 2584235 - RNA, 15 nt, Coxiella burnetii RSA 493
acaaugcguuuuaaa

SEQ ID NO: 2584236 - RNA, 22 nt, Coxiella burnetii RSA 493
acaaugcuuucuuuuaauucau

SEQ ID NO: 2584237 - RNA, 14 nt, Coxiella burnetii RSA 493
acaauguuaaaaca

SEQ ID NO: 2584238 - RNA, 16 nt, Coxiella burnetii RSA 493
acaauguuaaaacaca

SEQ ID NO: 2584239 - RNA, 17 nt, Coxiella burnetii RSA 493
acaauguuaaaacacau

SEQ ID NO: 2584240 - RNA, 16 nt, Coxiella burnetii RSA 493
acaauuaacuuugcaa

SEQ ID NO: 2584241 - RNA, 19 nt, Coxiella burnetii RSA 493
acaauuaaugcgccuacaa

SEQ ID NO: 2584242 - RNA, 17 nt, Coxiella burnetii RSA 493
acaauuacuuaaauuau

SEQ ID NO: 2584243 - RNA, 16 nt, Coxiella burnetii RSA 493
acaauucccguauuuc

SEQ ID NO: 2584244 - RNA, 22 nt, Coxiella burnetii RSA 493
acaauugagcggcuuuuucaau

SEQ ID NO: 2584245 - RNA, 14 nt, Coxiella burnetii RSA 493
acaauuuuaaaaca

SEQ ID NO: 2584246 - RNA, 15 nt, Coxiella burnetii RSA 493
acaauuuuaaaacau

SEQ ID NO: 2584247 - RNA, 13 nt, Coxiella burnetii RSA 493
acacaaccacugu

SEQ ID NO: 2584248 - RNA, 14 nt, Coxiella burnetii RSA 493
acacauaaugaucg

SEQ ID NO: 2584249 - RNA, 19 nt, Coxiella burnetii RSA 493
acacauaaugaucgacaag

SEQ ID NO: 2584250 - RNA, 20 nt, Coxiella burnetii RSA 493
acacauuuuuucaaauugcu

SEQ ID NO: 2584251 - RNA, 17 nt, Coxiella burnetii RSA 493
acaccacgcuaaauggu

SEQ ID NO: 2584252 - RNA, 17 nt, Coxiella burnetii RSA 493
acaccggagacaccaau

SEQ ID NO: 2584253 - RNA, 19 nt, Coxiella burnetii RSA 493
acaccguuggaaaaggaca

SEQ ID NO: 2584254 - RNA, 17 nt, Coxiella burnetii RSA 493
acaccuuuggcaauaau

SEQ ID NO: 2584255 - RNA, 14 nt, Coxiella burnetii RSA 493
acacgaucaacaaa

SEQ ID NO: 2584256 - RNA, 23 nt, Coxiella burnetii RSA 493
acacgguuagugggaagcgggua

SEQ ID NO: 2584257 - RNA, 17 nt, Coxiella burnetii RSA 493
acacuaaagguaaaaag

SEQ ID NO: 2584258 - RNA, 20 nt, Coxiella burnetii RSA 493
acacuuugaugagucccauu

SEQ ID NO: 2584259 - RNA, 21 nt, Coxiella burnetii RSA 493
acacuuuuaaucacaucccuu

SEQ ID NO: 2584260 - RNA, 17 nt, Coxiella burnetii RSA 493
acagacagacgcuggaa

SEQ ID NO: 2584261 - RNA, 18 nt, Coxiella burnetii RSA 493
acagacccccauuuuuua

SEQ ID NO: 2584262 - RNA, 16 nt, Coxiella burnetii RSA 493
acagaggacagaaggc

SEQ ID NO: 2584263 - RNA, 13 nt, Coxiella burnetii RSA 493
acagaucauuccu

SEQ ID NO: 2584264 - RNA, 18 nt, Coxiella burnetii RSA 493
acagcccccgaauugggg

SEQ ID NO: 2584265 - RNA, 15 nt, Coxiella burnetii RSA 493
acagccgaugacaaa

SEQ ID NO: 2584266 - RNA, 15 nt, Coxiella burnetii RSA 493
acagccuucaugaau

SEQ ID NO: 2584267 - RNA, 20 nt, Coxiella burnetii RSA 493
acagcgaaaacaaaggcaca

SEQ ID NO: 2584268 - RNA, 21 nt, Coxiella burnetii RSA 493
acagcgagagaauuaaaaaua

SEQ ID NO: 2584269 - RNA, 21 nt, Coxiella burnetii RSA 493
acagcucugaaagcaauaggg

SEQ ID NO: 2584270 - RNA, 12 nt, Coxiella burnetii RSA 493
acaggaaaaaga

SEQ ID NO: 2584271 - RNA, 16 nt, Coxiella burnetii RSA 493
acaggacaaaccuggc

SEQ ID NO: 2584272 - RNA, 14 nt, Coxiella burnetii RSA 493
acaggagcgauaaa

SEQ ID NO: 2584273 - RNA, 14 nt, Coxiella burnetii RSA 493
acaggauuauauua

SEQ ID NO: 2584274 - RNA, 23 nt, Coxiella burnetii RSA 493
acaggcagaugauuaaaagcaac

SEQ ID NO: 2584275 - RNA, 16 nt, Coxiella burnetii RSA 493
acaggcuaggcggcuu

SEQ ID NO: 2584276 - RNA, 23 nt, Coxiella burnetii RSA 493
acagguucacucgcaaaaauuuc

SEQ ID NO: 2584277 - RNA, 20 nt, Coxiella burnetii RSA 493
acaguaccgucauaaggaau

SEQ ID NO: 2584278 - RNA, 15 nt, Coxiella burnetii RSA 493
acaguauaaaauuuu

SEQ ID NO: 2584279 - RNA, 23 nt, Coxiella burnetii RSA 493
acagucuucacgaaguugacgaa

SEQ ID NO: 2584280 - RNA, 19 nt, Coxiella burnetii RSA 493
acagugccccuccucuaau

SEQ ID NO: 2584281 - RNA, 23 nt, Coxiella burnetii RSA 493
acagugguuguguggcuucgcca

SEQ ID NO: 2584282 - RNA, 19 nt, Coxiella burnetii RSA 493
acauaaaauuagguaauuu

SEQ ID NO: 2584283 - RNA, 17 nt, Coxiella burnetii RSA 493
acauaaagcuuauauaa

SEQ ID NO: 2584284 - RNA, 12 nt, Coxiella burnetii RSA 493
acauaaaggcca

SEQ ID NO: 2584285 - RNA, 12 nt, Coxiella burnetii RSA 493
acauaaggcugc

SEQ ID NO: 2584286 - RNA, 14 nt, Coxiella burnetii RSA 493
acauaauuuaaacu

SEQ ID NO: 2584287 - RNA, 17 nt, Coxiella burnetii RSA 493
acauaggagauuuuuau

SEQ ID NO: 2584288 - RNA, 22 nt, Coxiella burnetii RSA 493
acauaggagauuuuuaugaaaa

SEQ ID NO: 2584289 - RNA, 19 nt, Coxiella burnetii RSA 493
acauaucgcuccccuugcc

SEQ ID NO: 2584290 - RNA, 14 nt, Coxiella burnetii RSA 493
acauauuucuuuuc

SEQ ID NO: 2584291 - RNA, 14 nt, Coxiella burnetii RSA 493
acauauuuuuuggc

SEQ ID NO: 2584292 - RNA, 17 nt, Coxiella burnetii RSA 493
acaucaaauagaugacu

SEQ ID NO: 2584293 - RNA, 23 nt, Coxiella burnetii RSA 493
acaucagcggggagauuaaaaau

SEQ ID NO: 2584294 - RNA, 21 nt, Coxiella burnetii RSA 493
acaucauugaaaaccuacuuu

SEQ ID NO: 2584295 - RNA, 14 nt, Coxiella burnetii RSA 493
acaucauuguuuuc

SEQ ID NO: 2584296 - RNA, 18 nt, Coxiella burnetii RSA 493
acauccaauuacuccaau

SEQ ID NO: 2584297 - RNA, 21 nt, Coxiella burnetii RSA 493
acaucccuuuucauuaagcaa

SEQ ID NO: 2584298 - RNA, 15 nt, Coxiella burnetii RSA 493
acaucgcaauuaaua

SEQ ID NO: 2584299 - RNA, 18 nt, Coxiella burnetii RSA 493
acaucguuucaaacacuu

SEQ ID NO: 2584300 - RNA, 16 nt, Coxiella burnetii RSA 493
acaucucucguucuuu

SEQ ID NO: 2584301 - RNA, 18 nt, Coxiella burnetii RSA 493
acaucucucguucuuuua

SEQ ID NO: 2584302 - RNA, 14 nt, Coxiella burnetii RSA 493
acaucuucauuuuc

SEQ ID NO: 2584303 - RNA, 20 nt, Coxiella burnetii RSA 493
acgaaccgccggguuuuuug

SEQ ID NO: 2584304 - RNA, 13 nt, Coxiella burnetii RSA 493
acgaagcugccac

SEQ ID NO: 2584305 - RNA, 21 nt, Coxiella burnetii RSA 493
acgaauacagggaaguuguuc

SEQ ID NO: 2584306 - RNA, 18 nt, Coxiella burnetii RSA 493
acgaauaccccuuuuguu

SEQ ID NO: 2584307 - RNA, 18 nt, Coxiella burnetii RSA 493
acgaauggcccaauaaag

SEQ ID NO: 2584308 - RNA, 19 nt, Coxiella burnetii RSA 493
acgaauggcccaauaaaga

SEQ ID NO: 2584309 - RNA, 12 nt, Coxiella burnetii RSA 493
acgaauuaaaaa

SEQ ID NO: 2584310 - RNA, 20 nt, Coxiella burnetii RSA 493
acgaauuaaaaaauucaaua

SEQ ID NO: 2584311 - RNA, 18 nt, Coxiella burnetii RSA 493
acgacauuaaaaaugaua

SEQ ID NO: 2584312 - RNA, 16 nt, Coxiella burnetii RSA 493
acgaccgcggcagcag

SEQ ID NO: 2584313 - RNA, 18 nt, Coxiella burnetii RSA 493
acgacgaaagaguaggga

SEQ ID NO: 2584314 - RNA, 21 nt, Coxiella burnetii RSA 493
acgacgaucacccacguugca

SEQ ID NO: 2584315 - RNA, 14 nt, Coxiella burnetii RSA 493
acgacgaugccaaa

SEQ ID NO: 2584316 - RNA, 14 nt, Coxiella burnetii RSA 493
acgacgcuuugguu

SEQ ID NO: 2584317 - RNA, 22 nt, Coxiella burnetii RSA 493
acgacggguuuuaaguuuuuag

SEQ ID NO: 2584318 - RNA, 20 nt, Coxiella burnetii RSA 493
acgacuaauagcucauauuc

SEQ ID NO: 2584319 - RNA, 18 nt, Coxiella burnetii RSA 493
acgacuucauuucuacca

SEQ ID NO: 2584320 - RNA, 14 nt, Coxiella burnetii RSA 493
acgagcggccucaa

SEQ ID NO: 2584321 - RNA, 15 nt, Coxiella burnetii RSA 493
acgagcggccucaac

SEQ ID NO: 2584322 - RNA, 16 nt, Coxiella burnetii RSA 493
acgagcucaaaaguug

SEQ ID NO: 2584323 - RNA, 22 nt, Coxiella burnetii RSA 493
acgaguuucgcuucaccguuuu

SEQ ID NO: 2584324 - RNA, 22 nt, Coxiella burnetii RSA 493
acgauaauccgccuaaauuaau

SEQ ID NO: 2584325 - RNA, 23 nt, Coxiella burnetii RSA 493
acgauaauccgccuaaauuaaug

SEQ ID NO: 2584326 - RNA, 22 nt, Coxiella burnetii RSA 493
acgauagaugacaucauuguuu

SEQ ID NO: 2584327 - RNA, 17 nt, Coxiella burnetii RSA 493
acgauagucucuauauc

SEQ ID NO: 2584328 - RNA, 20 nt, Coxiella burnetii RSA 493
acgauagucucuauaucuuu

SEQ ID NO: 2584329 - RNA, 22 nt, Coxiella burnetii RSA 493
acgauauaaaagcaucaauaau

SEQ ID NO: 2584330 - RNA, 12 nt, Coxiella burnetii RSA 493
acgaucuauauu

SEQ ID NO: 2584331 - RNA, 17 nt, Coxiella burnetii RSA 493
acgauggucaaaccaau

SEQ ID NO: 2584332 - RNA, 16 nt, Coxiella burnetii RSA 493
acgauguaguuuuguc

SEQ ID NO: 2584333 - RNA, 22 nt, Coxiella burnetii RSA 493
acgauuaaaaauuuuaaaaaaa

SEQ ID NO: 2584334 - RNA, 15 nt, Coxiella burnetii RSA 493
acgauuaacaacaaa

SEQ ID NO: 2584335 - RNA, 17 nt, Coxiella burnetii RSA 493
acgauugcuaaaccacg

SEQ ID NO: 2584336 - RNA, 12 nt, Coxiella burnetii RSA 493
acgauuucucuu

SEQ ID NO: 2584337 - RNA, 12 nt, Coxiella burnetii RSA 493
acgcaacaaaag

SEQ ID NO: 2584338 - RNA, 22 nt, Coxiella burnetii RSA 493
acgcaauucgcggguaaauuua

SEQ ID NO: 2584339 - RNA, 19 nt, Coxiella burnetii RSA 493
acgcaauugaguuagcaua

SEQ ID NO: 2584340 - RNA, 20 nt, Coxiella burnetii RSA 493
acgcacgggcguucaauuau

SEQ ID NO: 2584341 - RNA, 18 nt, Coxiella burnetii RSA 493
acgcauuucccaaucauc

SEQ ID NO: 2584342 - RNA, 17 nt, Coxiella burnetii RSA 493
acgccaaaaccgccggc

SEQ ID NO: 2584343 - RNA, 16 nt, Coxiella burnetii RSA 493
acgccaugaagcaauu

SEQ ID NO: 2584344 - RNA, 19 nt, Coxiella burnetii RSA 493
acgccguaaccaaaacuau

SEQ ID NO: 2584345 - RNA, 14 nt, Coxiella burnetii RSA 493
acgccugaaauauu

SEQ ID NO: 2584346 - RNA, 20 nt, Coxiella burnetii RSA 493
acgccuugccccaugaguuc

SEQ ID NO: 2584347 - RNA, 21 nt, Coxiella burnetii RSA 493
acgcgaaaagauuccaauauu

SEQ ID NO: 2584348 - RNA, 15 nt, Coxiella burnetii RSA 493
acgcgauaagagcau

SEQ ID NO: 2584349 - RNA, 21 nt, Coxiella burnetii RSA 493
acgcguggcuuuaucaggcgc

SEQ ID NO: 2584350 - RNA, 23 nt, Coxiella burnetii RSA 493
acgcguucuugcugcuuuugaau

SEQ ID NO: 2584351 - RNA, 15 nt, Coxiella burnetii RSA 493
acgcuaugaaaacca

SEQ ID NO: 2584352 - RNA, 10 nt, Coxiella burnetii RSA 493
acgcuauuuu

SEQ ID NO: 2584353 - RNA, 21 nt, Coxiella burnetii RSA 493
acgcucgauggaacugauaua

SEQ ID NO: 2584354 - RNA, 21 nt, Coxiella burnetii RSA 493
acgcugaguggaaaaccaccg

SEQ ID NO: 2584355 - RNA, 17 nt, Coxiella burnetii RSA 493
acgcuggaaaaauaaau

SEQ ID NO: 2584356 - RNA, 17 nt, Coxiella burnetii RSA 493
acgcuucagaaucugcu

SEQ ID NO: 2584357 - RNA, 15 nt, Coxiella burnetii RSA 493
acggaaaaacaaaac

SEQ ID NO: 2584358 - RNA, 17 nt, Coxiella burnetii RSA 493
acggaauuugaaauaaa

SEQ ID NO: 2584359 - RNA, 20 nt, Coxiella burnetii RSA 493
acggaauuugugauuuuaaa

SEQ ID NO: 2584360 - RNA, 12 nt, Coxiella burnetii RSA 493
acggagaaaauc

SEQ ID NO: 2584361 - RNA, 22 nt, Coxiella burnetii RSA 493
acggauaauaucuagauuuaaa

SEQ ID NO: 2584362 - RNA, 21 nt, Coxiella burnetii RSA 493
acggcaagucccucugaaaaa

SEQ ID NO: 2584363 - RNA, 18 nt, Coxiella burnetii RSA 493
acggcaccguaaaacgaa

SEQ ID NO: 2584364 - RNA, 18 nt, Coxiella burnetii RSA 493
acggcgcgcguguuuuua

SEQ ID NO: 2584365 - RNA, 15 nt, Coxiella burnetii RSA 493
acggcggauuaaaaa

SEQ ID NO: 2584366 - RNA, 14 nt, Coxiella burnetii RSA 493
acggcucucucuaa

SEQ ID NO: 2584367 - RNA, 13 nt, Coxiella burnetii RSA 493
acgggaaaacaau

SEQ ID NO: 2584368 - RNA, 13 nt, Coxiella burnetii RSA 493
acgggaaugacga

SEQ ID NO: 2584369 - RNA, 14 nt, Coxiella burnetii RSA 493
acgggaaugacgaa

SEQ ID NO: 2584370 - RNA, 22 nt, Coxiella burnetii RSA 493
acgggaauguuuuuuaauaaau

SEQ ID NO: 2584371 - RNA, 19 nt, Coxiella burnetii RSA 493
acgggcuacuugaaaaccu

SEQ ID NO: 2584372 - RNA, 18 nt, Coxiella burnetii RSA 493
acggggaaauaaugacaa

SEQ ID NO: 2584373 - RNA, 19 nt, Coxiella burnetii RSA 493
acggggaaauaaugacaau

SEQ ID NO: 2584374 - RNA, 14 nt, Coxiella burnetii RSA 493
acgggggauuggga

SEQ ID NO: 2584375 - RNA, 15 nt, Coxiella burnetii RSA 493
acggugcagaaggcc

SEQ ID NO: 2584376 - RNA, 12 nt, Coxiella burnetii RSA 493
acguaauuauua

SEQ ID NO: 2584377 - RNA, 15 nt, Coxiella burnetii RSA 493
acguaccauuaaaag

SEQ ID NO: 2584378 - RNA, 13 nt, Coxiella burnetii RSA 493
acguacuauuuca

SEQ ID NO: 2584379 - RNA, 20 nt, Coxiella burnetii RSA 493
acguagaaguuuaaaguuau

SEQ ID NO: 2584380 - RNA, 15 nt, Coxiella burnetii RSA 493
acguaucugacaguu

SEQ ID NO: 2584381 - RNA, 19 nt, Coxiella burnetii RSA 493
acguaucugcuaaaaagcu

SEQ ID NO: 2584382 - RNA, 15 nt, Coxiella burnetii RSA 493
acguauugaguuuuu

SEQ ID NO: 2584383 - RNA, 16 nt, Coxiella burnetii RSA 493
acguauugccaaaauu

SEQ ID NO: 2584384 - RNA, 15 nt, Coxiella burnetii RSA 493
acgucuuuucuguga

SEQ ID NO: 2584385 - RNA, 21 nt, Coxiella burnetii RSA 493
acgucuuuucugugaaauaaa

SEQ ID NO: 2584386 - RNA, 16 nt, Coxiella burnetii RSA 493
acgugcacgaaauaau

SEQ ID NO: 2584387 - RNA, 18 nt, Coxiella burnetii RSA 493
acgugcacgaaauaauua

SEQ ID NO: 2584388 - RNA, 16 nt, Coxiella burnetii RSA 493
acgugcuugccgggcg

SEQ ID NO: 2584389 - RNA, 10 nt, Coxiella burnetii RSA 493
acguggcugc

SEQ ID NO: 2584390 - RNA, 12 nt, Coxiella burnetii RSA 493
acguuaaagccg

SEQ ID NO: 2584391 - RNA, 20 nt, Coxiella burnetii RSA 493
acguuaaagccguugauguc

SEQ ID NO: 2584392 - RNA, 15 nt, Coxiella burnetii RSA 493
acguuaaauagccaa

SEQ ID NO: 2584393 - RNA, 21 nt, Coxiella burnetii RSA 493
acguucaucgucaaacuguuu

SEQ ID NO: 2584394 - RNA, 15 nt, Coxiella burnetii RSA 493
acguugcaauaacaa

SEQ ID NO: 2584395 - RNA, 16 nt, Coxiella burnetii RSA 493
acguuuaaauaacaaa

SEQ ID NO: 2584396 - RNA, 13 nt, Coxiella burnetii RSA 493
acguuucaucaaa

SEQ ID NO: 2584397 - RNA, 21 nt, Coxiella burnetii RSA 493
acguuugauuuucaaguuuau

SEQ ID NO: 2584398 - RNA, 23 nt, Coxiella burnetii RSA 493
acguuuuuugcauuuuuaaaagu

SEQ ID NO: 2584399 - RNA, 16 nt, Coxiella burnetii RSA 493
acuaaacaaaauaaua

SEQ ID NO: 2584400 - RNA, 14 nt, Coxiella burnetii RSA 493
acuaaagguaaaaa

SEQ ID NO: 2584401 - RNA, 15 nt, Coxiella burnetii RSA 493
acuaaaucaauugcc

SEQ ID NO: 2584402 - RNA, 12 nt, Coxiella burnetii RSA 493
acuaaauugucc

SEQ ID NO: 2584403 - RNA, 12 nt, Coxiella burnetii RSA 493
acuaaauuucca

SEQ ID NO: 2584404 - RNA, 14 nt, Coxiella burnetii RSA 493
acuaagucgccauu

SEQ ID NO: 2584405 - RNA, 20 nt, Coxiella burnetii RSA 493
acuaagucgccauuggcucu

SEQ ID NO: 2584406 - RNA, 20 nt, Coxiella burnetii RSA 493
acuaaucccgccccauuuuu

SEQ ID NO: 2584407 - RNA, 22 nt, Coxiella burnetii RSA 493
acuaaucccgccccauuuuugu

SEQ ID NO: 2584408 - RNA, 18 nt, Coxiella burnetii RSA 493
acuaaucgcuguuaauaa

SEQ ID NO: 2584409 - RNA, 23 nt, Coxiella burnetii RSA 493
agaaaacguuucaucaaaauucu

SEQ ID NO: 2584410 - RNA, 22 nt, Coxiella burnetii RSA 493
agaaaacuuuucaucccccgcu

SEQ ID NO: 2584411 - RNA, 18 nt, Coxiella burnetii RSA 493
agaaaaguaaaaaauaau

SEQ ID NO: 2584412 - RNA, 12 nt, Coxiella burnetii RSA 493
agaaaauaaccu

SEQ ID NO: 2584413 - RNA, 13 nt, Coxiella burnetii RSA 493
agaaaauaaccua

SEQ ID NO: 2584414 - RNA, 15 nt, Coxiella burnetii RSA 493
agaaaauaaccuaaa

SEQ ID NO: 2584415 - RNA, 17 nt, Coxiella burnetii RSA 493
agaaaauaaccuaaaau

SEQ ID NO: 2584416 - RNA, 18 nt, Coxiella burnetii RSA 493
agaaaaugauuucauccu

SEQ ID NO: 2584417 - RNA, 13 nt, Coxiella burnetii RSA 493
agaaaauuucacc

SEQ ID NO: 2584418 - RNA, 23 nt, Coxiella burnetii RSA 493
agaaacaacuaccugauaaaaua

SEQ ID NO: 2584419 - RNA, 15 nt, Coxiella burnetii RSA 493
agaaaccguuucuac

SEQ ID NO: 2584420 - RNA, 15 nt, Coxiella burnetii RSA 493
agaaacgauuaaaaa

SEQ ID NO: 2584421 - RNA, 16 nt, Coxiella burnetii RSA 493
agaaacgauuaaaaau

SEQ ID NO: 2584422 - RNA, 23 nt, Coxiella burnetii RSA 493
agaaacguauugccaaaauuugg

SEQ ID NO: 2584423 - RNA, 16 nt, Coxiella burnetii RSA 493
agaaacuuugcagggc

SEQ ID NO: 2584424 - RNA, 12 nt, Coxiella burnetii RSA 493
agaaagaagaag

SEQ ID NO: 2584425 - RNA, 23 nt, Coxiella burnetii RSA 493
agaaagacauuguucauaaaaua

SEQ ID NO: 2584426 - RNA, 20 nt, Coxiella burnetii RSA 493
agaaagccuaaguuuaacag

SEQ ID NO: 2584427 - RNA, 18 nt, Coxiella burnetii RSA 493
agaaagcgagcaaucaaa

SEQ ID NO: 2584428 - RNA, 22 nt, Coxiella burnetii RSA 493
agaaagggugagguaacugucu

SEQ ID NO: 2584429 - RNA, 15 nt, Coxiella burnetii RSA 493
agaaaguuucccaca

SEQ ID NO: 2584430 - RNA, 21 nt, Coxiella burnetii RSA 493
agaaauauuagaaauaauacu

SEQ ID NO: 2584431 - RNA, 22 nt, Coxiella burnetii RSA 493
agaaauauuuucucaauagaaa

SEQ ID NO: 2584432 - RNA, 23 nt, Coxiella burnetii RSA 493
agaaauauuuucucaauagaaaa

SEQ ID NO: 2584433 - RNA, 18 nt, Coxiella burnetii RSA 493
agaaauuaaauuuuuaaa

SEQ ID NO: 2584434 - RNA, 22 nt, Coxiella burnetii RSA 493
agaaauugcgcguaaaauucca

SEQ ID NO: 2584435 - RNA, 21 nt, Coxiella burnetii RSA 493
agaaauugcggaaauuucaca

SEQ ID NO: 2584436 - RNA, 23 nt, Coxiella burnetii RSA 493
agaacccaccgcuggugagacuc

SEQ ID NO: 2584437 - RNA, 20 nt, Coxiella burnetii RSA 493
agaaccgcgacuaaaccaac

SEQ ID NO: 2584438 - RNA, 22 nt, Coxiella burnetii RSA 493
agaagaagucguguuuuuauuu

SEQ ID NO: 2584439 - RNA, 17 nt, Coxiella burnetii RSA 493
agaagauuuuuuuucuu

SEQ ID NO: 2584440 - RNA, 13 nt, Coxiella burnetii RSA 493
agaagcaucagau

SEQ ID NO: 2584441 - RNA, 14 nt, Coxiella burnetii RSA 493
agaaggcagaggac

SEQ ID NO: 2584442 - RNA, 23 nt, Coxiella burnetii RSA 493
agaaggguuuugugcauaaauua

SEQ ID NO: 2584443 - RNA, 19 nt, Coxiella burnetii RSA 493
agaaguuuaaaguuauuuc

SEQ ID NO: 2584444 - RNA, 12 nt, Coxiella burnetii RSA 493
agaauaaaacgg

SEQ ID NO: 2584445 - RNA, 23 nt, Coxiella burnetii RSA 493
agaauaaaacggcuugauuucag

SEQ ID NO: 2584446 - RNA, 16 nt, Coxiella burnetii RSA 493
agaauaagaauaagga

SEQ ID NO: 2584447 - RNA, 19 nt, Coxiella burnetii RSA 493
agaauaccccgcuguuuuc

SEQ ID NO: 2584448 - RNA, 21 nt, Coxiella burnetii RSA 493
agaaucgucgucguauccaaa

SEQ ID NO: 2584449 - RNA, 21 nt, Coxiella burnetii RSA 493
agaaucuccaccacuuugcca

SEQ ID NO: 2584450 - RNA, 15 nt, Coxiella burnetii RSA 493
agaauggauugcacu

SEQ ID NO: 2584451 - RNA, 18 nt, Coxiella burnetii RSA 493
agaauggcgggaaaaaau

SEQ ID NO: 2584452 - RNA, 12 nt, Coxiella burnetii RSA 493
agaaugggaaga

SEQ ID NO: 2584453 - RNA, 15 nt, Coxiella burnetii RSA 493
agaauuaaaaauauu

SEQ ID NO: 2584454 - RNA, 18 nt, Coxiella burnetii RSA 493
agaauuaauguuauuuau

SEQ ID NO: 2584455 - RNA, 20 nt, Coxiella burnetii RSA 493
agaauuaauguuauuuauuu

SEQ ID NO: 2584456 - RNA, 20 nt, Coxiella burnetii RSA 493
agaauuacuguaaacuaggg

SEQ ID NO: 2584457 - RNA, 14 nt, Coxiella burnetii RSA 493
agaauucucccaug

SEQ ID NO: 2584458 - RNA, 19 nt, Coxiella burnetii RSA 493
agaauuuguacaaaagcgc

SEQ ID NO: 2584459 - RNA, 17 nt, Coxiella burnetii RSA 493
agaauuuguuuugauca

SEQ ID NO: 2584460 - RNA, 22 nt, Coxiella burnetii RSA 493
agaauuuuugacuaagucaaaa

SEQ ID NO: 2584461 - RNA, 23 nt, Coxiella burnetii RSA 493
agacaaugcuuucuuuuaauuca

SEQ ID NO: 2584462 - RNA, 13 nt, Coxiella burnetii RSA 493
agacaauguuaaa

SEQ ID NO: 2584463 - RNA, 16 nt, Coxiella burnetii RSA 493
agacaauguuaaaaca

SEQ ID NO: 2584464 - RNA, 11 nt, Coxiella burnetii RSA 493
agacaauuuuu

SEQ ID NO: 2584465 - RNA, 19 nt, Coxiella burnetii RSA 493
agacacaugggacaaggcu

SEQ ID NO: 2584466 - RNA, 15 nt, Coxiella burnetii RSA 493
agacacgaccccaau

SEQ ID NO: 2584467 - RNA, 20 nt, Coxiella burnetii RSA 493
agacagacgcuggaaaaaua

SEQ ID NO: 2584468 - RNA, 21 nt, Coxiella burnetii RSA 493
agacagacgcuggaaaaauaa

SEQ ID NO: 2584469 - RNA, 23 nt, Coxiella burnetii RSA 493
agacagacgcuggaaaaauaaau

SEQ ID NO: 2584470 - RNA, 15 nt, Coxiella burnetii RSA 493
agacaguuuagaauc

SEQ ID NO: 2584471 - RNA, 16 nt, Coxiella burnetii RSA 493
agacauuguucauaaa

SEQ ID NO: 2584472 - RNA, 17 nt, Coxiella burnetii RSA 493
agacauuguucauaaaa

SEQ ID NO: 2584473 - RNA, 23 nt, Coxiella burnetii RSA 493
agacccccauuuuuuauccaaau

SEQ ID NO: 2584474 - RNA, 22 nt, Coxiella burnetii RSA 493
agacgcuggaaaaauaaaucca

SEQ ID NO: 2584475 - RNA, 17 nt, Coxiella burnetii RSA 493
agacuaggaaaaaauaa

SEQ ID NO: 2584476 - RNA, 19 nt, Coxiella burnetii RSA 493
agacucaaagaaauaauca

SEQ ID NO: 2584477 - RNA, 15 nt, Coxiella burnetii RSA 493
agacuuuugcagcua

SEQ ID NO: 2584478 - RNA, 12 nt, Coxiella burnetii RSA 493
agagaaaaaacc

SEQ ID NO: 2584479 - RNA, 16 nt, Coxiella burnetii RSA 493
agagacaauagaauaa

SEQ ID NO: 2584480 - RNA, 22 nt, Coxiella burnetii RSA 493
agagagcuugccuguaaaauaa

SEQ ID NO: 2584481 - RNA, 19 nt, Coxiella burnetii RSA 493
agagauaagcuguuucuuu

SEQ ID NO: 2584482 - RNA, 17 nt, Coxiella burnetii RSA 493
agagauagugcuauuuu

SEQ ID NO: 2584483 - RNA, 21 nt, Coxiella burnetii RSA 493
agagauucccgcugccuuuac

SEQ ID NO: 2584484 - RNA, 15 nt, Coxiella burnetii RSA 493
agagccgaucgcugu

SEQ ID NO: 2584485 - RNA, 20 nt, Coxiella burnetii RSA 493
agagcuugccuguaaaauaa

SEQ ID NO: 2584486 - RNA, 16 nt, Coxiella burnetii RSA 493
agaggaguucuaaaaa

SEQ ID NO: 2584487 - RNA, 13 nt, Coxiella burnetii RSA 493
agagguauugcuu

SEQ ID NO: 2584488 - RNA, 23 nt, Coxiella burnetii RSA 493
agaggugaaccaaaaggaaugaa

SEQ ID NO: 2584489 - RNA, 15 nt, Coxiella burnetii RSA 493
agaguaaaaaaccaa

SEQ ID NO: 2584490 - RNA, 15 nt, Coxiella burnetii RSA 493
agaguaaauacucua

SEQ ID NO: 2584491 - RNA, 22 nt, Coxiella burnetii RSA 493
agaguaaauguuucuuuuauaa

SEQ ID NO: 2584492 - RNA, 14 nt, Coxiella burnetii RSA 493
agaguaacgauuuc

SEQ ID NO: 2584493 - RNA, 17 nt, Coxiella burnetii RSA 493
agaguaacgauuucucu

SEQ ID NO: 2584494 - RNA, 22 nt, Coxiella burnetii RSA 493
agaguaagucucugcuucauug

SEQ ID NO: 2584495 - RNA, 22 nt, Coxiella burnetii RSA 493
agaguacgccaaccauaauccu

SEQ ID NO: 2584496 - RNA, 16 nt, Coxiella burnetii RSA 493
agaguccuaaaauacu

SEQ ID NO: 2584497 - RNA, 20 nt, Coxiella burnetii RSA 493
agaguccuaaaauacuuaaa

SEQ ID NO: 2584498 - RNA, 19 nt, Coxiella burnetii RSA 493
agagucucagcaucagccu

SEQ ID NO: 2584499 - RNA, 23 nt, Coxiella burnetii RSA 493
agagugaugacauuuaaaaaaac

SEQ ID NO: 2584500 - RNA, 23 nt, Coxiella burnetii RSA 493
agagugcguuaaggccucuuuag

SEQ ID NO: 2584501 - RNA, 16 nt, Coxiella burnetii RSA 493
agauaauuacaaucca

SEQ ID NO: 2584502 - RNA, 13 nt, Coxiella burnetii RSA 493
agauacacauaau

SEQ ID NO: 2584503 - RNA, 18 nt, Coxiella burnetii RSA 493
agauacucgagguagacu

SEQ ID NO: 2584504 - RNA, 18 nt, Coxiella burnetii RSA 493
agauauaccaaaaaguug

SEQ ID NO: 2584505 - RNA, 20 nt, Coxiella burnetii RSA 493
agaucaucaucgccggauaa

SEQ ID NO: 2584506 - RNA, 22 nt, Coxiella burnetii RSA 493
agaucguuuuuugauaaaacuu

SEQ ID NO: 2584507 - RNA, 23 nt, Coxiella burnetii RSA 493
agaucguuuuuugauaaaacuug

SEQ ID NO: 2584508 - RNA, 19 nt, Coxiella burnetii RSA 493
agaugacaucauuguuuuc

SEQ ID NO: 2584509 - RNA, 17 nt, Coxiella burnetii RSA 493
agaugcuccaucaugau

SEQ ID NO: 2584510 - RNA, 18 nt, Coxiella burnetii RSA 493
agaugguaauaauuuucc

SEQ ID NO: 2584511 - RNA, 14 nt, Coxiella burnetii RSA 493
agauuaaaaauuug

SEQ ID NO: 2584512 - RNA, 14 nt, Coxiella burnetii RSA 493
agauuagaaaaagc

SEQ ID NO: 2584513 - RNA, 13 nt, Coxiella burnetii RSA 493
agcguaaaacacg

SEQ ID NO: 2584514 - RNA, 13 nt, Coxiella burnetii RSA 493
agcguaauaauag

SEQ ID NO: 2584515 - RNA, 13 nt, Coxiella burnetii RSA 493
agcguaaucauca

SEQ ID NO: 2584516 - RNA, 13 nt, Coxiella burnetii RSA 493
agcguacaacaac

SEQ ID NO: 2584517 - RNA, 15 nt, Coxiella burnetii RSA 493
agcguacacuagggu

SEQ ID NO: 2584518 - RNA, 20 nt, Coxiella burnetii RSA 493
agcgucuuuuuuaguuaaag

SEQ ID NO: 2584519 - RNA, 18 nt, Coxiella burnetii RSA 493
agcgugacuaaaauaaag

SEQ ID NO: 2584520 - RNA, 16 nt, Coxiella burnetii RSA 493
agcguuaauugaagaa

SEQ ID NO: 2584521 - RNA, 15 nt, Coxiella burnetii RSA 493
agcuaaaaaagaaau

SEQ ID NO: 2584522 - RNA, 13 nt, Coxiella burnetii RSA 493
agcuaacugauua

SEQ ID NO: 2584523 - RNA, 14 nt, Coxiella burnetii RSA 493
agcuaagauaggga

SEQ ID NO: 2584524 - RNA, 14 nt, Coxiella burnetii RSA 493
agcuaauucuuuuu

SEQ ID NO: 2584525 - RNA, 16 nt, Coxiella burnetii RSA 493
agcuagccauuguuuu

SEQ ID NO: 2584526 - RNA, 22 nt, Coxiella burnetii RSA 493
agcuagcccccgaaacaggcgg

SEQ ID NO: 2584527 - RNA, 16 nt, Coxiella burnetii RSA 493
agcuagcgaaauuugu

SEQ ID NO: 2584528 - RNA, 18 nt, Coxiella burnetii RSA 493
agcuagcgaaauuuguua

SEQ ID NO: 2584529 - RNA, 13 nt, Coxiella burnetii RSA 493
agcuauaagcaau

SEQ ID NO: 2584530 - RNA, 22 nt, Coxiella burnetii RSA 493
agcuauggaguucuugcuccca

SEQ ID NO: 2584531 - RNA, 14 nt, Coxiella burnetii RSA 493
agcucaaacaaauc

SEQ ID NO: 2584532 - RNA, 13 nt, Coxiella burnetii RSA 493
agcucagcccaac

SEQ ID NO: 2584533 - RNA, 14 nt, Coxiella burnetii RSA 493
agcucauugaaauc

SEQ ID NO: 2584534 - RNA, 17 nt, Coxiella burnetii RSA 493
agcucauugaaaucaau

SEQ ID NO: 2584535 - RNA, 17 nt, Coxiella burnetii RSA 493
agcucauugccaaagaa

SEQ ID NO: 2584536 - RNA, 22 nt, Coxiella burnetii RSA 493
agcuccaaacgguccgccuaaa

SEQ ID NO: 2584537 - RNA, 20 nt, Coxiella burnetii RSA 493
agcuccccgcuccaauuguu

SEQ ID NO: 2584538 - RNA, 15 nt, Coxiella burnetii RSA 493
agcucgauaucuguu

SEQ ID NO: 2584539 - RNA, 20 nt, Coxiella burnetii RSA 493
agcucguaagcgugcaacaa

SEQ ID NO: 2584540 - RNA, 13 nt, Coxiella burnetii RSA 493
agcugaaauugaa

SEQ ID NO: 2584541 - RNA, 15 nt, Coxiella burnetii RSA 493
agcugacaauagggc

SEQ ID NO: 2584542 - RNA, 20 nt, Coxiella burnetii RSA 493
agcugauuucucuuuuaacu

SEQ ID NO: 2584543 - RNA, 14 nt, Coxiella burnetii RSA 493
agcugauuucuggu

SEQ ID NO: 2584544 - RNA, 14 nt, Coxiella burnetii RSA 493
agcuggcagauaac

SEQ ID NO: 2584545 - RNA, 19 nt, Coxiella burnetii RSA 493
agcuguucgggcacaaaaa

SEQ ID NO: 2584546 - RNA, 21 nt, Coxiella burnetii RSA 493
agcuguucgggcacaaaaaaa

SEQ ID NO: 2584547 - RNA, 20 nt, Coxiella burnetii RSA 493
agcuuaaucaaccucagguu

SEQ ID NO: 2584548 - RNA, 19 nt, Coxiella burnetii RSA 493
agcuuaguacgugcuuugg

SEQ ID NO: 2584549 - RNA, 22 nt, Coxiella burnetii RSA 493
agcuucggccgugaaaacgcuc

SEQ ID NO: 2584550 - RNA, 23 nt, Coxiella burnetii RSA 493
agcuucuaaagccagugcuauuc

SEQ ID NO: 2584551 - RNA, 20 nt, Coxiella burnetii RSA 493
agcuugcauuaucggaugau

SEQ ID NO: 2584552 - RNA, 14 nt, Coxiella burnetii RSA 493
agcuugugcaauuc

SEQ ID NO: 2584553 - RNA, 16 nt, Coxiella burnetii RSA 493
agcuugugcaauucca

SEQ ID NO: 2584554 - RNA, 21 nt, Coxiella burnetii RSA 493
agcuuucaauaaauaaaucaa

SEQ ID NO: 2584555 - RNA, 17 nt, Coxiella burnetii RSA 493
agcuuuccccccaacua

SEQ ID NO: 2584556 - RNA, 13 nt, Coxiella burnetii RSA 493
agcuuuucuuuaa

SEQ ID NO: 2584557 - RNA, 14 nt, Coxiella burnetii RSA 493
aggaaagaaaauga

SEQ ID NO: 2584558 - RNA, 15 nt, Coxiella burnetii RSA 493
aggaaauauuuaauu

SEQ ID NO: 2584559 - RNA, 17 nt, Coxiella burnetii RSA 493
aggaacauucuaauaaa

SEQ ID NO: 2584560 - RNA, 22 nt, Coxiella burnetii RSA 493
aggaacauucuaauaaaauagc

SEQ ID NO: 2584561 - RNA, 18 nt, Coxiella burnetii RSA 493
aggaaccaccaaaucacg

SEQ ID NO: 2584562 - RNA, 16 nt, Coxiella burnetii RSA 493
aggaaggacaaaaaua

SEQ ID NO: 2584563 - RNA, 20 nt, Coxiella burnetii RSA 493
aggaauaguggcauuaaaag

SEQ ID NO: 2584564 - RNA, 18 nt, Coxiella burnetii RSA 493
aggaauugcaguugguuu

SEQ ID NO: 2584565 - RNA, 12 nt, Coxiella burnetii RSA 493
aggacagaaggc

SEQ ID NO: 2584566 - RNA, 15 nt, Coxiella burnetii RSA 493
aggacagaaggcaga

SEQ ID NO: 2584567 - RNA, 14 nt, Coxiella burnetii RSA 493
aggacagaggacag

SEQ ID NO: 2584568 - RNA, 18 nt, Coxiella burnetii RSA 493
aggacagugguugugucg

SEQ ID NO: 2584569 - RNA, 15 nt, Coxiella burnetii RSA 493
aggacguuauagagu

SEQ ID NO: 2584570 - RNA, 18 nt, Coxiella burnetii RSA 493
aggacguuauagaguaaa

SEQ ID NO: 2584571 - RNA, 20 nt, Coxiella burnetii RSA 493
aggacguuauagaguaaaua

SEQ ID NO: 2584572 - RNA, 13 nt, Coxiella burnetii RSA 493
aggacugcucuua

SEQ ID NO: 2584573 - RNA, 21 nt, Coxiella burnetii RSA 493
aggacuuaagcccuuuagcca

SEQ ID NO: 2584574 - RNA, 12 nt, Coxiella burnetii RSA 493
aggacuuuucuc

SEQ ID NO: 2584575 - RNA, 11 nt, Coxiella burnetii RSA 493
aggagaaagug

SEQ ID NO: 2584576 - RNA, 18 nt, Coxiella burnetii RSA 493
aggaggguaagaauaaac

SEQ ID NO: 2584577 - RNA, 15 nt, Coxiella burnetii RSA 493
aggaguucuaaaaaa

SEQ ID NO: 2584578 - RNA, 23 nt, Coxiella burnetii RSA 493
aggauaauguuugauaucaaucg

SEQ ID NO: 2584579 - RNA, 19 nt, Coxiella burnetii RSA 493
aggaugaacuaucguugcc

SEQ ID NO: 2584580 - RNA, 16 nt, Coxiella burnetii RSA 493
aggaugcgaauguaau

SEQ ID NO: 2584581 - RNA, 15 nt, Coxiella burnetii RSA 493
aggauuauauuaguu

SEQ ID NO: 2584582 - RNA, 11 nt, Coxiella burnetii RSA 493
aggcaaaauaa

SEQ ID NO: 2584583 - RNA, 12 nt, Coxiella burnetii RSA 493
aggcaaaauaaa

SEQ ID NO: 2584584 - RNA, 13 nt, Coxiella burnetii RSA 493
aggcaaaauaaac

SEQ ID NO: 2584585 - RNA, 22 nt, Coxiella burnetii RSA 493
aggcaaauguugauaauaaaug

SEQ ID NO: 2584586 - RNA, 15 nt, Coxiella burnetii RSA 493
aggcaaugauaauuu

SEQ ID NO: 2584587 - RNA, 12 nt, Coxiella burnetii RSA 493
aggcacaaagau

SEQ ID NO: 2584588 - RNA, 15 nt, Coxiella burnetii RSA 493
aggcacgaugcacag

SEQ ID NO: 2584589 - RNA, 23 nt, Coxiella burnetii RSA 493
aggcagaugauuaaaagcaacgg

SEQ ID NO: 2584590 - RNA, 14 nt, Coxiella burnetii RSA 493
aggcauucugggca

SEQ ID NO: 2584591 - RNA, 17 nt, Coxiella burnetii RSA 493
aggccaacauucuuuga

SEQ ID NO: 2584592 - RNA, 17 nt, Coxiella burnetii RSA 493
aggccaauuucuaaucu

SEQ ID NO: 2584593 - RNA, 19 nt, Coxiella burnetii RSA 493
aggccgccucgugggccca

SEQ ID NO: 2584594 - RNA, 15 nt, Coxiella burnetii RSA 493
aggccuuaauguuuu

SEQ ID NO: 2584595 - RNA, 21 nt, Coxiella burnetii RSA 493
aggccuuuagcaggauuuuca

SEQ ID NO: 2584596 - RNA, 15 nt, Coxiella burnetii RSA 493
aggcgaaucaucuuu

SEQ ID NO: 2584597 - RNA, 17 nt, Coxiella burnetii RSA 493
aggcgagcccauugaga

SEQ ID NO: 2584598 - RNA, 15 nt, Coxiella burnetii RSA 493
aggcgccugcaaaau

SEQ ID NO: 2584599 - RNA, 20 nt, Coxiella burnetii RSA 493
aggcgggaauccagcgcgcu

SEQ ID NO: 2584600 - RNA, 14 nt, Coxiella burnetii RSA 493
aggcggggacccag

SEQ ID NO: 2584601 - RNA, 19 nt, Coxiella burnetii RSA 493
aggcggggacccagcgcac

SEQ ID NO: 2584602 - RNA, 19 nt, Coxiella burnetii RSA 493
aggcuaauuuuccuuuucu

SEQ ID NO: 2584603 - RNA, 22 nt, Coxiella burnetii RSA 493
aggcuaauuuuccuuuucuauu

SEQ ID NO: 2584604 - RNA, 14 nt, Coxiella burnetii RSA 493
aggcuaugauuauc

SEQ ID NO: 2584605 - RNA, 15 nt, Coxiella burnetii RSA 493
aggcuauuccccuuc

SEQ ID NO: 2584606 - RNA, 15 nt, Coxiella burnetii RSA 493
aggcucguugcuuua

SEQ ID NO: 2584607 - RNA, 13 nt, Coxiella burnetii RSA 493
aggcucuucauau

SEQ ID NO: 2584608 - RNA, 20 nt, Coxiella burnetii RSA 493
aggcugcuagaaguauuucc

SEQ ID NO: 2584609 - RNA, 23 nt, Coxiella burnetii RSA 493
aggcugcuagaaguauuuccauu

SEQ ID NO: 2584610 - RNA, 14 nt, Coxiella burnetii RSA 493
aggcuguaaaccaa

SEQ ID NO: 2584611 - RNA, 20 nt, Coxiella burnetii RSA 493
aggcuguucgccagaaacaa

SEQ ID NO: 2584612 - RNA, 21 nt, Coxiella burnetii RSA 493
aggcuguucgccagaaacaac

SEQ ID NO: 2584613 - RNA, 12 nt, Coxiella burnetii RSA 493
aggcuucuucca

SEQ ID NO: 2584614 - RNA, 16 nt, Coxiella burnetii RSA 493
aggcuucuuccagcag

SEQ ID NO: 2584615 - RNA, 20 nt, Coxiella burnetii RSA 493
aggcuucuuccagcaguuuu

SEQ ID NO: 2584616 - RNA, 15 nt, Coxiella burnetii RSA 493
aggcuuucuuuuucu

SEQ ID NO: 2584617 - RNA, 21 nt, Coxiella burnetii RSA 493
agggacuuuaagcacuucuuu

SEQ ID NO: 2584618 - RNA, 17 nt, Coxiella burnetii RSA 493
agggauuuugcagggga

SEQ ID NO: 2584619 - RNA, 17 nt, Coxiella burnetii RSA 493
agugacucaucuccuuu

SEQ ID NO: 2584620 - RNA, 16 nt, Coxiella burnetii RSA 493
agugaucauaguggau

SEQ ID NO: 2584621 - RNA, 18 nt, Coxiella burnetii RSA 493
agugauugauuuuuuaau

SEQ ID NO: 2584622 - RNA, 14 nt, Coxiella burnetii RSA 493
agugauuuuucuuu

SEQ ID NO: 2584623 - RNA, 16 nt, Coxiella burnetii RSA 493
agugauuuuucuuugu

SEQ ID NO: 2584624 - RNA, 20 nt, Coxiella burnetii RSA 493
agugccacaaagucagacuu

SEQ ID NO: 2584625 - RNA, 14 nt, Coxiella burnetii RSA 493
agugcuauuuuucc

SEQ ID NO: 2584626 - RNA, 18 nt, Coxiella burnetii RSA 493
agugcuuuuaaacagucu

SEQ ID NO: 2584627 - RNA, 14 nt, Coxiella burnetii RSA 493
aguggaauuuuaac

SEQ ID NO: 2584628 - RNA, 14 nt, Coxiella burnetii RSA 493
aguggauuucagau

SEQ ID NO: 2584629 - RNA, 22 nt, Coxiella burnetii RSA 493
aguggcggcuagguaacuuaaa

SEQ ID NO: 2584630 - RNA, 21 nt, Coxiella burnetii RSA 493
aguggcuccgauaagugaauc

SEQ ID NO: 2584631 - RNA, 15 nt, Coxiella burnetii RSA 493
agugggaagcgggua

SEQ ID NO: 2584632 - RNA, 18 nt, Coxiella burnetii RSA 493
agugggggaacagaggac

SEQ ID NO: 2584633 - RNA, 20 nt, Coxiella burnetii RSA 493
agugggggaacagaggacag

SEQ ID NO: 2584634 - RNA, 19 nt, Coxiella burnetii RSA 493
agugguaagcuugcuugcu

SEQ ID NO: 2584635 - RNA, 14 nt, Coxiella burnetii RSA 493
aguguaaggcugaa

SEQ ID NO: 2584636 - RNA, 15 nt, Coxiella burnetii RSA 493
aguguagguuuucaa

SEQ ID NO: 2584637 - RNA, 14 nt, Coxiella burnetii RSA 493
agugucaaaggccg

SEQ ID NO: 2584638 - RNA, 15 nt, Coxiella burnetii RSA 493
agugugauucauuau

SEQ ID NO: 2584639 - RNA, 18 nt, Coxiella burnetii RSA 493
agugugauucauuaucau

SEQ ID NO: 2584640 - RNA, 17 nt, Coxiella burnetii RSA 493
agugugcacgauuuuau

SEQ ID NO: 2584641 - RNA, 22 nt, Coxiella burnetii RSA 493
agugugcccccccaauuccucg

SEQ ID NO: 2584642 - RNA, 14 nt, Coxiella burnetii RSA 493
agugugggaaaaau

SEQ ID NO: 2584643 - RNA, 16 nt, Coxiella burnetii RSA 493
aguguuuuuuugaagc

SEQ ID NO: 2584644 - RNA, 15 nt, Coxiella burnetii RSA 493
aguuaaauuuuuaau

SEQ ID NO: 2584645 - RNA, 20 nt, Coxiella burnetii RSA 493
aguuaacaaaaucaccagaa

SEQ ID NO: 2584646 - RNA, 21 nt, Coxiella burnetii RSA 493
aguuaacaaaaucaccagaaa

SEQ ID NO: 2584647 - RNA, 16 nt, Coxiella burnetii RSA 493
aguuaaccaauugauu

SEQ ID NO: 2584648 - RNA, 21 nt, Coxiella burnetii RSA 493
aguuaggccuauccuauucuu

SEQ ID NO: 2584649 - RNA, 14 nt, Coxiella burnetii RSA 493
aguuauuaucccuu

SEQ ID NO: 2584650 - RNA, 12 nt, Coxiella burnetii RSA 493
aguuauuuuuca

SEQ ID NO: 2584651 - RNA, 13 nt, Coxiella burnetii RSA 493
aguucauuaaauu

SEQ ID NO: 2584652 - RNA, 18 nt, Coxiella burnetii RSA 493
aguuccauuccaaaaaca

SEQ ID NO: 2584653 - RNA, 19 nt, Coxiella burnetii RSA 493
aguuccguucggaaacaaa

SEQ ID NO: 2584654 - RNA, 21 nt, Coxiella burnetii RSA 493
aguuccguucggaaacaaagg

SEQ ID NO: 2584655 - RNA, 17 nt, Coxiella burnetii RSA 493
aguucgcuaaaaguaac

SEQ ID NO: 2584656 - RNA, 12 nt, Coxiella burnetii RSA 493
aguucuaaaaaa

SEQ ID NO: 2584657 - RNA, 23 nt, Coxiella burnetii RSA 493
aguucuaagcuaucagcaaucaa

SEQ ID NO: 2584658 - RNA, 13 nt, Coxiella burnetii RSA 493
aguucuauuuccg

SEQ ID NO: 2584659 - RNA, 20 nt, Coxiella burnetii RSA 493
aguucuauuuccgcuacauc

SEQ ID NO: 2584660 - RNA, 23 nt, Coxiella burnetii RSA 493
aguugagcgaagaaaaagaaauu

SEQ ID NO: 2584661 - RNA, 15 nt, Coxiella burnetii RSA 493
aguuguauaaagguu

SEQ ID NO: 2584662 - RNA, 22 nt, Coxiella burnetii RSA 493
aguuguauaaagguuuuuccuu

SEQ ID NO: 2584663 - RNA, 14 nt, Coxiella burnetii RSA 493
aguugucgauaaau

SEQ ID NO: 2584664 - RNA, 22 nt, Coxiella burnetii RSA 493
aguuguucggaauauaauucuc

SEQ ID NO: 2584665 - RNA, 14 nt, Coxiella burnetii RSA 493
aguuguuuuaaauc

SEQ ID NO: 2584666 - RNA, 22 nt, Coxiella burnetii RSA 493
aguuuaaaguuauuucuuuuga

SEQ ID NO: 2584667 - RNA, 21 nt, Coxiella burnetii RSA 493
aguuuaucccuguuacgggau

SEQ ID NO: 2584668 - RNA, 13 nt, Coxiella burnetii RSA 493
aguuucaauuucg

SEQ ID NO: 2584669 - RNA, 16 nt, Coxiella burnetii RSA 493
aguuucccacaaaaua

SEQ ID NO: 2584670 - RNA, 17 nt, Coxiella burnetii RSA 493
aguuuccccuucuucgg

SEQ ID NO: 2584671 - RNA, 21 nt, Coxiella burnetii RSA 493
aguuucccguauuucgcuucg

SEQ ID NO: 2584672 - RNA, 22 nt, Coxiella burnetii RSA 493
aguuucguggcuucgagaggaa

SEQ ID NO: 2584673 - RNA, 18 nt, Coxiella burnetii RSA 493
aguuugccauuacgcaug

SEQ ID NO: 2584674 - RNA, 13 nt, Coxiella burnetii RSA 493
aguuuuauaacaa

SEQ ID NO: 2584675 - RNA, 20 nt, Coxiella burnetii RSA 493
aguuuuauaacaagguuuua

SEQ ID NO: 2584676 - RNA, 19 nt, Coxiella burnetii RSA 493
aguuuucacuguugagcaa

SEQ ID NO: 2584677 - RNA, 12 nt, Coxiella burnetii RSA 493
aguuuucauuuu

SEQ ID NO: 2584678 - RNA, 22 nt, Coxiella burnetii RSA 493
aguuuucuauauuuucuuucuu

SEQ ID NO: 2584679 - RNA, 13 nt, Coxiella burnetii RSA 493
auaaaaaauuacu

SEQ ID NO: 2584680 - RNA, 21 nt, Coxiella burnetii RSA 493
auaaaaacaaagugaaauaug

SEQ ID NO: 2584681 - RNA, 22 nt, Coxiella burnetii RSA 493
auaaaaaggcaaauguugauaa

SEQ ID NO: 2584682 - RNA, 19 nt, Coxiella burnetii RSA 493
auaaaacuucccauucuau

SEQ ID NO: 2584683 - RNA, 20 nt, Coxiella burnetii RSA 493
auaaaagcccgcaauccucg

SEQ ID NO: 2584684 - RNA, 22 nt, Coxiella burnetii RSA 493
auaaaaggaauucuaauuaaau

SEQ ID NO: 2584685 - RNA, 12 nt, Coxiella burnetii RSA 493
auaaaaggagaa

SEQ ID NO: 2584686 - RNA, 13 nt, Coxiella burnetii RSA 493
auaaaaggagaaa

SEQ ID NO: 2584687 - RNA, 15 nt, Coxiella burnetii RSA 493
auaaaaggagaaauu

SEQ ID NO: 2584688 - RNA, 19 nt, Coxiella burnetii RSA 493
auaaaaguccuguucuuuu

SEQ ID NO: 2584689 - RNA, 23 nt, Coxiella burnetii RSA 493
auaaaaguccuguucuuuucaac

SEQ ID NO: 2584690 - RNA, 18 nt, Coxiella burnetii RSA 493
auaaaauuacuauugcgc

SEQ ID NO: 2584691 - RNA, 18 nt, Coxiella burnetii RSA 493
auaaaauuuaauaagucu

SEQ ID NO: 2584692 - RNA, 23 nt, Coxiella burnetii RSA 493
auaaaauuuaauaagucuuugcu

SEQ ID NO: 2584693 - RNA, 23 nt, Coxiella burnetii RSA 493
auaaaauuucggcccacaucugu

SEQ ID NO: 2584694 - RNA, 20 nt, Coxiella burnetii RSA 493
auaaacucgcgcggcaagga

SEQ ID NO: 2584695 - RNA, 15 nt, Coxiella burnetii RSA 493
auaaacuggaaaaag

SEQ ID NO: 2584696 - RNA, 15 nt, Coxiella burnetii RSA 493
auaaagaauuugaca

SEQ ID NO: 2584697 - RNA, 18 nt, Coxiella burnetii RSA 493
auaaagcagcaauuguuu

SEQ ID NO: 2584698 - RNA, 21 nt, Coxiella burnetii RSA 493
auaaagcgcucguaauugaga

SEQ ID NO: 2584699 - RNA, 16 nt, Coxiella burnetii RSA 493
auaaagcguuucucga

SEQ ID NO: 2584700 - RNA, 22 nt, Coxiella burnetii RSA 493
auaaaggcgagcccauugagaa

SEQ ID NO: 2584701 - RNA, 17 nt, Coxiella burnetii RSA 493
auaaaggcuaauaggaa

SEQ ID NO: 2584702 - RNA, 16 nt, Coxiella burnetii RSA 493
auaaagguuuuuccuu

SEQ ID NO: 2584703 - RNA, 17 nt, Coxiella burnetii RSA 493
auaaagguuuuuccuuu

SEQ ID NO: 2584704 - RNA, 12 nt, Coxiella burnetii RSA 493
auaaaguaauuu

SEQ ID NO: 2584705 - RNA, 20 nt, Coxiella burnetii RSA 493
auaaaguaauuuuaaaaaaa

SEQ ID NO: 2584706 - RNA, 20 nt, Coxiella burnetii RSA 493
auaaaguaguugaaaaaucu

SEQ ID NO: 2584707 - RNA, 18 nt, Coxiella burnetii RSA 493
auaaagugccgcgaauac

SEQ ID NO: 2584708 - RNA, 14 nt, Coxiella burnetii RSA 493
auaaaguguuuuuu

SEQ ID NO: 2584709 - RNA, 14 nt, Coxiella burnetii RSA 493
auaaauaaaagccc

SEQ ID NO: 2584710 - RNA, 20 nt, Coxiella burnetii RSA 493
auaaauagcauuucguauaa

SEQ ID NO: 2584711 - RNA, 22 nt, Coxiella burnetii RSA 493
auaaauaguucacgaauuugcg

SEQ ID NO: 2584712 - RNA, 9 nt, Coxiella burnetii RSA 493
auaaauccu

SEQ ID NO: 2584713 - RNA, 14 nt, Coxiella burnetii RSA 493
auaaaugaauaaua

SEQ ID NO: 2584714 - RNA, 20 nt, Coxiella burnetii RSA 493
auaaauggacccuguuuuuu

SEQ ID NO: 2584715 - RNA, 13 nt, Coxiella burnetii RSA 493
auaaauguuuuuu

SEQ ID NO: 2584716 - RNA, 14 nt, Coxiella burnetii RSA 493
auaaauuauuuuaa

SEQ ID NO: 2584717 - RNA, 15 nt, Coxiella burnetii RSA 493
auaaauuauuuuaau

SEQ ID NO: 2584718 - RNA, 13 nt, Coxiella burnetii RSA 493
auaacaaaguaag

SEQ ID NO: 2584719 - RNA, 17 nt, Coxiella burnetii RSA 493
auaacaaauaaaccuau

SEQ ID NO: 2584720 - RNA, 20 nt, Coxiella burnetii RSA 493
auaacaaauaaaccuaucca

SEQ ID NO: 2584721 - RNA, 21 nt, Coxiella burnetii RSA 493
auaacaagguuuuauuuuuaa

SEQ ID NO: 2584722 - RNA, 15 nt, Coxiella burnetii RSA 493
auaacagcgaacauc

SEQ ID NO: 2584723 - RNA, 15 nt, Coxiella burnetii RSA 493
auaacauaucuucaa

SEQ ID NO: 2584724 - RNA, 21 nt, Coxiella burnetii RSA 493
auagagucgggaaauaaaauu

SEQ ID NO: 2584725 - RNA, 23 nt, Coxiella burnetii RSA 493
auagagucgggaaauaaaauuaa

SEQ ID NO: 2584726 - RNA, 17 nt, Coxiella burnetii RSA 493
auagauaggugcugcaa

SEQ ID NO: 2584727 - RNA, 19 nt, Coxiella burnetii RSA 493
auagaucgcaaaauccugu

SEQ ID NO: 2584728 - RNA, 17 nt, Coxiella burnetii RSA 493
auagaugguaauaauuu

SEQ ID NO: 2584729 - RNA, 20 nt, Coxiella burnetii RSA 493
auagcaucaagggcaaaaac

SEQ ID NO: 2584730 - RNA, 13 nt, Coxiella burnetii RSA 493
auagcauuguugg

SEQ ID NO: 2584731 - RNA, 19 nt, Coxiella burnetii RSA 493
auagcauuguuggaaauaa

SEQ ID NO: 2584732 - RNA, 19 nt, Coxiella burnetii RSA 493
auagccaaccgccauuucg

SEQ ID NO: 2584733 - RNA, 24 nt, Coxiella burnetii RSA 493
auagccaaccgccauuucgcuuuu

SEQ ID NO: 2584734 - RNA, 15 nt, Coxiella burnetii RSA 493
auagcgcaauugguc

SEQ ID NO: 2584735 - RNA, 23 nt, Coxiella burnetii RSA 493
auagcgucuuuuuuauuugaaau

SEQ ID NO: 2584736 - RNA, 22 nt, Coxiella burnetii RSA 493
auagcuggacucgaugggaauu

SEQ ID NO: 2584737 - RNA, 21 nt, Coxiella burnetii RSA 493
auagcuuguuccuuuuuauaa

SEQ ID NO: 2584738 - RNA, 17 nt, Coxiella burnetii RSA 493
auaggaauucuuuuuca

SEQ ID NO: 2584739 - RNA, 14 nt, Coxiella burnetii RSA 493
auaggacuuuucuc

SEQ ID NO: 2584740 - RNA, 13 nt, Coxiella burnetii RSA 493
auaggcagccccg

SEQ ID NO: 2584741 - RNA, 20 nt, Coxiella burnetii RSA 493
auaggcgaaucaucuuuuuu

SEQ ID NO: 2584742 - RNA, 12 nt, Coxiella burnetii RSA 493
auaggcuuucuu

SEQ ID NO: 2584743 - RNA, 18 nt, Coxiella burnetii RSA 493
auagggcggcaaucagaa

SEQ ID NO: 2584744 - RNA, 16 nt, Coxiella burnetii RSA 493
auagggcuaguaugcu

SEQ ID NO: 2584745 - RNA, 21 nt, Coxiella burnetii RSA 493
auaguaaaacgugcuuaauaa

SEQ ID NO: 2584746 - RNA, 14 nt, Coxiella burnetii RSA 493
auagucuguaugaa

SEQ ID NO: 2584747 - RNA, 15 nt, Coxiella burnetii RSA 493
auagucuugaucuuc

SEQ ID NO: 2584748 - RNA, 19 nt, Coxiella burnetii RSA 493
auagucuuugguuuuccau

SEQ ID NO: 2584749 - RNA, 21 nt, Coxiella burnetii RSA 493
auagucuuuuuauauuccuga

SEQ ID NO: 2584750 - RNA, 16 nt, Coxiella burnetii RSA 493
auagugcuauuuuucc

SEQ ID NO: 2584751 - RNA, 19 nt, Coxiella burnetii RSA 493
auaguucauuaaauuuaau

SEQ ID NO: 2584752 - RNA, 13 nt, Coxiella burnetii RSA 493
auaguuucaaauu

SEQ ID NO: 2584753 - RNA, 16 nt, Coxiella burnetii RSA 493
auaguuuuauuuaaaa

SEQ ID NO: 2584754 - RNA, 18 nt, Coxiella burnetii RSA 493
auaguuuuauuuaaaaaa

SEQ ID NO: 2584755 - RNA, 20 nt, Coxiella burnetii RSA 493
auaguuuuggcguaugaaua

SEQ ID NO: 2584756 - RNA, 14 nt, Coxiella burnetii RSA 493
auauaaaaguuacg

SEQ ID NO: 2584757 - RNA, 17 nt, Coxiella burnetii RSA 493
auauaauuuaaugaggu

SEQ ID NO: 2584758 - RNA, 12 nt, Coxiella burnetii RSA 493
auauaauuuuug

SEQ ID NO: 2584759 - RNA, 22 nt, Coxiella burnetii RSA 493
auauacccgaggaugaugaaaa

SEQ ID NO: 2584760 - RNA, 19 nt, Coxiella burnetii RSA 493
auauaggcgaaucaucuuu

SEQ ID NO: 2584761 - RNA, 20 nt, Coxiella burnetii RSA 493
auauauugggguucauuuuu

SEQ ID NO: 2584762 - RNA, 18 nt, Coxiella burnetii RSA 493
auaucaaaaaaccauaaa

SEQ ID NO: 2584763 - RNA, 16 nt, Coxiella burnetii RSA 493
auaucaauagcgcaau

SEQ ID NO: 2584764 - RNA, 17 nt, Coxiella burnetii RSA 493
auaucaaucgaaaaaaa

SEQ ID NO: 2584765 - RNA, 18 nt, Coxiella burnetii RSA 493
auaucaccgcguuuaaga

SEQ ID NO: 2584766 - RNA, 16 nt, Coxiella burnetii RSA 493
auaucaucaacagaac

SEQ ID NO: 2584767 - RNA, 21 nt, Coxiella burnetii RSA 493
auaucauggucagcccaacua

SEQ ID NO: 2584768 - RNA, 20 nt, Coxiella burnetii RSA 493
auaucauugggccauuuaac

SEQ ID NO: 2584769 - RNA, 18 nt, Coxiella burnetii RSA 493
auauccagguguuuuuca

SEQ ID NO: 2584770 - RNA, 22 nt, Coxiella burnetii RSA 493
auauccuuguaauucaaauuuu

SEQ ID NO: 2584771 - RNA, 17 nt, Coxiella burnetii RSA 493
auaucgccauauaaagu

SEQ ID NO: 2584772 - RNA, 17 nt, Coxiella burnetii RSA 493
auaucgugcucuuuuuu

SEQ ID NO: 2584773 - RNA, 13 nt, Coxiella burnetii RSA 493
auaucuccauuuu

SEQ ID NO: 2584774 - RNA, 13 nt, Coxiella burnetii RSA 493
auaucuguuuuau

SEQ ID NO: 2584775 - RNA, 21 nt, Coxiella burnetii RSA 493
auaucuguuuucgauaaaugc

SEQ ID NO: 2584776 - RNA, 22 nt, Coxiella burnetii RSA 493
auaucuguuuucgauaaaugca

SEQ ID NO: 2584777 - RNA, 13 nt, Coxiella burnetii RSA 493
auaucuuuuaaau

SEQ ID NO: 2584778 - RNA, 19 nt, Coxiella burnetii RSA 493
auaucuuuuaaauuaacau

SEQ ID NO: 2584779 - RNA, 20 nt, Coxiella burnetii RSA 493
auaugauaaggaggcaauac

SEQ ID NO: 2584780 - RNA, 16 nt, Coxiella burnetii RSA 493
auauuaauauuaaaac

SEQ ID NO: 2584781 - RNA, 19 nt, Coxiella burnetii RSA 493
auauuaauauuaaaacaag

SEQ ID NO: 2584782 - RNA, 13 nt, Coxiella burnetii RSA 493
auauuagaaauaa

SEQ ID NO: 2584783 - RNA, 19 nt, Coxiella burnetii RSA 493
auauuaguggaauuaaaua

SEQ ID NO: 2584784 - RNA, 18 nt, Coxiella burnetii RSA 493
auauuccugaaguaauuu

SEQ ID NO: 2584785 - RNA, 22 nt, Coxiella burnetii RSA 493
auauucgguuuuuuuaaaaaag

SEQ ID NO: 2584786 - RNA, 17 nt, Coxiella burnetii RSA 493
auauucuaucucaagug

SEQ ID NO: 2584787 - RNA, 18 nt, Coxiella burnetii RSA 493
auauugauuuaaauuuaa

SEQ ID NO: 2584788 - RNA, 23 nt, Coxiella burnetii RSA 493
auauuuaauuuuauuauuuauca

SEQ ID NO: 2584789 - RNA, 18 nt, Coxiella burnetii RSA 493
auauuuaccucuaaaaau

SEQ ID NO: 2584790 - RNA, 16 nt, Coxiella burnetii RSA 493
auauuuacugagaaaa

SEQ ID NO: 2584791 - RNA, 17 nt, Coxiella burnetii RSA 493
auauuucgucagugaau

SEQ ID NO: 2584792 - RNA, 17 nt, Coxiella burnetii RSA 493
auauuuggguuuucuuu

SEQ ID NO: 2584793 - RNA, 15 nt, Coxiella burnetii RSA 493
auauuuuucucuuuc

SEQ ID NO: 2584794 - RNA, 13 nt, Coxiella burnetii RSA 493
aucaaaaaaaccu

SEQ ID NO: 2584795 - RNA, 22 nt, Coxiella burnetii RSA 493
aucaaaacgaaaagcugaaauu

SEQ ID NO: 2584796 - RNA, 16 nt, Coxiella burnetii RSA 493
aucaaaauuaaaaucu

SEQ ID NO: 2584797 - RNA, 20 nt, Coxiella burnetii RSA 493
aucaaaauucuccuuaauaa

SEQ ID NO: 2584798 - RNA, 22 nt, Coxiella burnetii RSA 493
aucaaacguuuacgucuuuucu

SEQ ID NO: 2584799 - RNA, 15 nt, Coxiella burnetii RSA 493
aucaaagacaucgga

SEQ ID NO: 2584800 - RNA, 13 nt, Coxiella burnetii RSA 493
aucaaauuaaaau

SEQ ID NO: 2584801 - RNA, 19 nt, Coxiella burnetii RSA 493
aucaaauuaaaauaaucca

SEQ ID NO: 2584802 - RNA, 15 nt, Coxiella burnetii RSA 493
aucaacaaaauauac

SEQ ID NO: 2584803 - RNA, 22 nt, Coxiella burnetii RSA 493
aucaacaaaauauacucaccca

SEQ ID NO: 2584804 - RNA, 23 nt, Coxiella burnetii RSA 493
aucaacaaaauauacucacccac

SEQ ID NO: 2584805 - RNA, 16 nt, Coxiella burnetii RSA 493
aucaaccaauccuacu

SEQ ID NO: 2584806 - RNA, 21 nt, Coxiella burnetii RSA 493
aucaaccccagccgccacacc

SEQ ID NO: 2584807 - RNA, 14 nt, Coxiella burnetii RSA 493
aucaagaaagacau

SEQ ID NO: 2584808 - RNA, 20 nt, Coxiella burnetii RSA 493
aucaaguccaauuauaacua

SEQ ID NO: 2584809 - RNA, 22 nt, Coxiella burnetii RSA 493
aucaaguccaauuauaacuauu

SEQ ID NO: 2584810 - RNA, 21 nt, Coxiella burnetii RSA 493
aucaaguguucacaagucuca

SEQ ID NO: 2584811 - RNA, 20 nt, Coxiella burnetii RSA 493
aucaaguuuauaagauucuu

SEQ ID NO: 2584812 - RNA, 14 nt, Coxiella burnetii RSA 493
aucaaguuucuccc

SEQ ID NO: 2584813 - RNA, 19 nt, Coxiella burnetii RSA 493
aucaauaaaacucuugccg

SEQ ID NO: 2584814 - RNA, 14 nt, Coxiella burnetii RSA 493
aucaaucaaaugaa

SEQ ID NO: 2584815 - RNA, 14 nt, Coxiella burnetii RSA 493
aucaaucgaaaaaa

SEQ ID NO: 2584816 - RNA, 20 nt, Coxiella burnetii RSA 493
aucaaucguguagaaagaaa

SEQ ID NO: 2584817 - RNA, 22 nt, Coxiella burnetii RSA 493
aucaaucguguagaaagaaagu

SEQ ID NO: 2584818 - RNA, 14 nt, Coxiella burnetii RSA 493
aucaaugaaacaaa

SEQ ID NO: 2584819 - RNA, 18 nt, Coxiella burnetii RSA 493
aucaaugaaacaaacaaa

SEQ ID NO: 2584820 - RNA, 23 nt, Coxiella burnetii RSA 493
aucaaugaaacaaacaaaaaaua

SEQ ID NO: 2584821 - RNA, 17 nt, Coxiella burnetii RSA 493
aucaaugcaguuaacca

SEQ ID NO: 2584822 - RNA, 18 nt, Coxiella burnetii RSA 493
aucaaugcaguuaaccaa

SEQ ID NO: 2584823 - RNA, 22 nt, Coxiella burnetii RSA 493
aucaauguuaauagacuaccga

SEQ ID NO: 2584824 - RNA, 15 nt, Coxiella burnetii RSA 493
aucaauucgaaagaa

SEQ ID NO: 2584825 - RNA, 19 nt, Coxiella burnetii RSA 493
aucaauucgaaagaaauaa

SEQ ID NO: 2584826 - RNA, 22 nt, Coxiella burnetii RSA 493
aucaauucgaaagaaauaacug

SEQ ID NO: 2584827 - RNA, 18 nt, Coxiella burnetii RSA 493
aucacaaguucuucuaaa

SEQ ID NO: 2584828 - RNA, 19 nt, Coxiella burnetii RSA 493
aucguguagaaagaaaguu

SEQ ID NO: 2584829 - RNA, 16 nt, Coxiella burnetii RSA 493
aucguugcugagcaaa

SEQ ID NO: 2584830 - RNA, 15 nt, Coxiella burnetii RSA 493
aucguugggaugauc

SEQ ID NO: 2584831 - RNA, 20 nt, Coxiella burnetii RSA 493
aucguuucaaacacuuguuu

SEQ ID NO: 2584832 - RNA, 11 nt, Coxiella burnetii RSA 493
aucguuucugg

SEQ ID NO: 2584833 - RNA, 19 nt, Coxiella burnetii RSA 493
aucguuucugguuuccuuu

SEQ ID NO: 2584834 - RNA, 17 nt, Coxiella burnetii RSA 493
aucguuuuacccuuugu

SEQ ID NO: 2584835 - RNA, 14 nt, Coxiella burnetii RSA 493
aucguuuugaaauu

SEQ ID NO: 2584836 - RNA, 14 nt, Coxiella burnetii RSA 493
aucuaaaaacccca

SEQ ID NO: 2584837 - RNA, 14 nt, Coxiella burnetii RSA 493
aucuaaaggaauac

SEQ ID NO: 2584838 - RNA, 18 nt, Coxiella burnetii RSA 493
aucuaaaggaauacaauc

SEQ ID NO: 2584839 - RNA, 21 nt, Coxiella burnetii RSA 493
aucuaaucgucuugaccaaua

SEQ ID NO: 2584840 - RNA, 14 nt, Coxiella burnetii RSA 493
aucuagauuuuccu

SEQ ID NO: 2584841 - RNA, 13 nt, Coxiella burnetii RSA 493
aucuauugucauc

SEQ ID NO: 2584842 - RNA, 16 nt, Coxiella burnetii RSA 493
aucucacuuggauuuu

SEQ ID NO: 2584843 - RNA, 21 nt, Coxiella burnetii RSA 493
aucucacuuggauuuuauuug

SEQ ID NO: 2584844 - RNA, 18 nt, Coxiella burnetii RSA 493
aucuccccuucuuuaaua

SEQ ID NO: 2584845 - RNA, 17 nt, Coxiella burnetii RSA 493
aucucgauuuugguucu

SEQ ID NO: 2584846 - RNA, 14 nt, Coxiella burnetii RSA 493
aucucguugagguu

SEQ ID NO: 2584847 - RNA, 14 nt, Coxiella burnetii RSA 493
aucucuuaaaauuc

SEQ ID NO: 2584848 - RNA, 20 nt, Coxiella burnetii RSA 493
aucugacaguuggcuaaauc

SEQ ID NO: 2584849 - RNA, 16 nt, Coxiella burnetii RSA 493
aucugaucaaaaauaa

SEQ ID NO: 2584850 - RNA, 22 nt, Coxiella burnetii RSA 493
aucugauggaugaaagauuuuu

SEQ ID NO: 2584851 - RNA, 21 nt, Coxiella burnetii RSA 493
aucugcgggauuaauuuucca

SEQ ID NO: 2584852 - RNA, 13 nt, Coxiella burnetii RSA 493
aucugcuaaaaag

SEQ ID NO: 2584853 - RNA, 18 nt, Coxiella burnetii RSA 493
aucugcuaggauuuuuua

SEQ ID NO: 2584854 - RNA, 16 nt, Coxiella burnetii RSA 493
aucuguaauuuuucuu

SEQ ID NO: 2584855 - RNA, 20 nt, Coxiella burnetii RSA 493
aucugugggaauguucugau

SEQ ID NO: 2584856 - RNA, 14 nt, Coxiella burnetii RSA 493
aucuguuuuauccc

SEQ ID NO: 2584857 - RNA, 19 nt, Coxiella burnetii RSA 493
aucuuaaugaaauuucuca

SEQ ID NO: 2584858 - RNA, 20 nt, Coxiella burnetii RSA 493
aucuuaaugaaauuucucau

SEQ ID NO: 2584859 - RNA, 19 nt, Coxiella burnetii RSA 493
aucuuauuauucauaucuu

SEQ ID NO: 2584860 - RNA, 23 nt, Coxiella burnetii RSA 493
aucuuauuauucauaucuuuuuc

SEQ ID NO: 2584861 - RNA, 21 nt, Coxiella burnetii RSA 493
aucuucaacaucaaccccagc

SEQ ID NO: 2584862 - RNA, 21 nt, Coxiella burnetii RSA 493
aucuucacgcauuucccaauc

SEQ ID NO: 2584863 - RNA, 17 nt, Coxiella burnetii RSA 493
aucuuccauuaauuucu

SEQ ID NO: 2584864 - RNA, 21 nt, Coxiella burnetii RSA 493
aucuucuugugcuaaacgugc

SEQ ID NO: 2584865 - RNA, 22 nt, Coxiella burnetii RSA 493
aucuugcggcgauaaucauuaa

SEQ ID NO: 2584866 - RNA, 19 nt, Coxiella burnetii RSA 493
aucuugggcaaaaaaagaa

SEQ ID NO: 2584867 - RNA, 20 nt, Coxiella burnetii RSA 493
aucuugggcaaaaaaagaaa

SEQ ID NO: 2584868 - RNA, 23 nt, Coxiella burnetii RSA 493
aucuuguaaucgcugauacuucu

SEQ ID NO: 2584869 - RNA, 21 nt, Coxiella burnetii RSA 493
aucuuucauguaauuuauccc

SEQ ID NO: 2584870 - RNA, 17 nt, Coxiella burnetii RSA 493
aucuuugcucuaaauua

SEQ ID NO: 2584871 - RNA, 14 nt, Coxiella burnetii RSA 493
aucuuuuucaagau

SEQ ID NO: 2584872 - RNA, 16 nt, Coxiella burnetii RSA 493
aucuuuuucaauuaua

SEQ ID NO: 2584873 - RNA, 18 nt, Coxiella burnetii RSA 493
aucuuuuuuuugaaauuc

SEQ ID NO: 2584874 - RNA, 13 nt, Coxiella burnetii RSA 493
augaaaaagauaa

SEQ ID NO: 2584875 - RNA, 23 nt, Coxiella burnetii RSA 493
augaaaagcggagcagcuacaau

SEQ ID NO: 2584876 - RNA, 14 nt, Coxiella burnetii RSA 493
augaaaaguaaauu

SEQ ID NO: 2584877 - RNA, 14 nt, Coxiella burnetii RSA 493
augaaacaaacaaa

SEQ ID NO: 2584878 - RNA, 17 nt, Coxiella burnetii RSA 493
augaaacaaacaaaaaa

SEQ ID NO: 2584879 - RNA, 23 nt, Coxiella burnetii RSA 493
augaaacuaagcauuaaaaaaua

SEQ ID NO: 2584880 - RNA, 19 nt, Coxiella burnetii RSA 493
augaaaucccgagccccaa

SEQ ID NO: 2584881 - RNA, 20 nt, Coxiella burnetii RSA 493
augaaaucccgagccccaaa

SEQ ID NO: 2584882 - RNA, 21 nt, Coxiella burnetii RSA 493
augaaaucccgagccccaaaa

SEQ ID NO: 2584883 - RNA, 16 nt, Coxiella burnetii RSA 493
augaaaucguuuuguu

SEQ ID NO: 2584884 - RNA, 20 nt, Coxiella burnetii RSA 493
augaaaucguuuuguuuuaa

SEQ ID NO: 2584885 - RNA, 15 nt, Coxiella burnetii RSA 493
augaauaagcaaaga

SEQ ID NO: 2584886 - RNA, 16 nt, Coxiella burnetii RSA 493
augaauaagcaaagau

SEQ ID NO: 2584887 - RNA, 14 nt, Coxiella burnetii RSA 493
augaauagaaaaac

SEQ ID NO: 2584888 - RNA, 17 nt, Coxiella burnetii RSA 493
augaauauuaguggaau

SEQ ID NO: 2584889 - RNA, 22 nt, Coxiella burnetii RSA 493
augaaugcuggagugagaaauu

SEQ ID NO: 2584890 - RNA, 17 nt, Coxiella burnetii RSA 493
augaauggaauguuaaa

SEQ ID NO: 2584891 - RNA, 12 nt, Coxiella burnetii RSA 493
augaauuaaaua

SEQ ID NO: 2584892 - RNA, 13 nt, Coxiella burnetii RSA 493
augaauuaaauau

SEQ ID NO: 2584893 - RNA, 15 nt, Coxiella burnetii RSA 493
augaauucaaaccaa

SEQ ID NO: 2584894 - RNA, 12 nt, Coxiella burnetii RSA 493
augacaaauaaa

SEQ ID NO: 2584895 - RNA, 16 nt, Coxiella burnetii RSA 493
augacaaauaaacaag

SEQ ID NO: 2584896 - RNA, 21 nt, Coxiella burnetii RSA 493
augacaaccccgccuuuaccu

SEQ ID NO: 2584897 - RNA, 16 nt, Coxiella burnetii RSA 493
augacaauuuaauaau

SEQ ID NO: 2584898 - RNA, 19 nt, Coxiella burnetii RSA 493
augacagaaaaagcggaua

SEQ ID NO: 2584899 - RNA, 17 nt, Coxiella burnetii RSA 493
augacaugcgccacuaa

SEQ ID NO: 2584900 - RNA, 18 nt, Coxiella burnetii RSA 493
augacauuuaaaaaaacc

SEQ ID NO: 2584901 - RNA, 22 nt, Coxiella burnetii RSA 493
augacccucuuuuuaaaaaauu

SEQ ID NO: 2584902 - RNA, 22 nt, Coxiella burnetii RSA 493
augaccuuaaucgugaaauacc

SEQ ID NO: 2584903 - RNA, 16 nt, Coxiella burnetii RSA 493
augacgaaagcuaaaa

SEQ ID NO: 2584904 - RNA, 13 nt, Coxiella burnetii RSA 493
augacgauuaaca

SEQ ID NO: 2584905 - RNA, 23 nt, Coxiella burnetii RSA 493
augacggaauuugugauuuuaaa

SEQ ID NO: 2584906 - RNA, 13 nt, Coxiella burnetii RSA 493
augagauaacucu

SEQ ID NO: 2584907 - RNA, 22 nt, Coxiella burnetii RSA 493
augagaugaucaucaucaaaau

SEQ ID NO: 2584908 - RNA, 17 nt, Coxiella burnetii RSA 493
augagcgaacgaauacg

SEQ ID NO: 2584909 - RNA, 18 nt, Coxiella burnetii RSA 493
augagcgaacgaauacgg

SEQ ID NO: 2584910 - RNA, 19 nt, Coxiella burnetii RSA 493
augagcgaacgaauacggg

SEQ ID NO: 2584911 - RNA, 15 nt, Coxiella burnetii RSA 493
augagcgaagcgaaa

SEQ ID NO: 2584912 - RNA, 17 nt, Coxiella burnetii RSA 493
augagcgaagcgaaaua

SEQ ID NO: 2584913 - RNA, 20 nt, Coxiella burnetii RSA 493
augagcgaagcgaaauacgg

SEQ ID NO: 2584914 - RNA, 21 nt, Coxiella burnetii RSA 493
augagcgaagcgaaguacggg

SEQ ID NO: 2584915 - RNA, 14 nt, Coxiella burnetii RSA 493
augaggccaaaaau

SEQ ID NO: 2584916 - RNA, 15 nt, Coxiella burnetii RSA 493
augaggccaaaaauu

SEQ ID NO: 2584917 - RNA, 21 nt, Coxiella burnetii RSA 493
augaggccaaaaauucguuaa

SEQ ID NO: 2584918 - RNA, 14 nt, Coxiella burnetii RSA 493
augagucccauuua

SEQ ID NO: 2584919 - RNA, 22 nt, Coxiella burnetii RSA 493
augagugcauucauucuuuuuu

SEQ ID NO: 2584920 - RNA, 21 nt, Coxiella burnetii RSA 493
augauaauuuuggugcuggcg

SEQ ID NO: 2584921 - RNA, 18 nt, Coxiella burnetii RSA 493
augaucaaugaaacaaac

SEQ ID NO: 2584922 - RNA, 14 nt, Coxiella burnetii RSA 493
augaucaucaucaa

SEQ ID NO: 2584923 - RNA, 15 nt, Coxiella burnetii RSA 493
augaucauuuucuca

SEQ ID NO: 2584924 - RNA, 18 nt, Coxiella burnetii RSA 493
augaucgacaagcagggc

SEQ ID NO: 2584925 - RNA, 15 nt, Coxiella burnetii RSA 493
augaucgguuuuuug

SEQ ID NO: 2584926 - RNA, 15 nt, Coxiella burnetii RSA 493
augaucuaacguuuu

SEQ ID NO: 2584927 - RNA, 14 nt, Coxiella burnetii RSA 493
augaucugcucuuu

SEQ ID NO: 2584928 - RNA, 17 nt, Coxiella burnetii RSA 493
augaugcauuaaucauu

SEQ ID NO: 2584929 - RNA, 12 nt, Coxiella burnetii RSA 493
augaugccuuaa

SEQ ID NO: 2584930 - RNA, 17 nt, Coxiella burnetii RSA 493
augaugccuuaaauagu

SEQ ID NO: 2584931 - RNA, 14 nt, Coxiella burnetii RSA 493
augaugucaucuau

SEQ ID NO: 2584932 - RNA, 17 nt, Coxiella burnetii RSA 493
augauguucucuccauu

SEQ ID NO: 2584933 - RNA, 13 nt, Coxiella burnetii RSA 493
auuaaacguauuc

SEQ ID NO: 2584934 - RNA, 22 nt, Coxiella burnetii RSA 493
auuaaacguauuccaaauaauc

SEQ ID NO: 2584935 - RNA, 13 nt, Coxiella burnetii RSA 493
auuaaauauaauu

SEQ ID NO: 2584936 - RNA, 22 nt, Coxiella burnetii RSA 493
auuaaauauccgcaauaugcag

SEQ ID NO: 2584937 - RNA, 17 nt, Coxiella burnetii RSA 493
auuaaaugcuuuuuaaa

SEQ ID NO: 2584938 - RNA, 17 nt, Coxiella burnetii RSA 493
auuaaauuuacaauacg

SEQ ID NO: 2584939 - RNA, 12 nt, Coxiella burnetii RSA 493
auuaaauuuuua

SEQ ID NO: 2584940 - RNA, 12 nt, Coxiella burnetii RSA 493
auuaacaacaaa

SEQ ID NO: 2584941 - RNA, 21 nt, Coxiella burnetii RSA 493
auuaacauauuuacuugcuuu

SEQ ID NO: 2584942 - RNA, 21 nt, Coxiella burnetii RSA 493
auuaacauuuggauugccaau

SEQ ID NO: 2584943 - RNA, 23 nt, Coxiella burnetii RSA 493
auuaaccacucggaaagcaucaa

SEQ ID NO: 2584944 - RNA, 15 nt, Coxiella burnetii RSA 493
auuaacggacucaac

SEQ ID NO: 2584945 - RNA, 21 nt, Coxiella burnetii RSA 493
auuaacuucgccauugucuca

SEQ ID NO: 2584946 - RNA, 13 nt, Coxiella burnetii RSA 493
auuaagagaaauu

SEQ ID NO: 2584947 - RNA, 19 nt, Coxiella burnetii RSA 493
auuaagagaaauuaaauuu

SEQ ID NO: 2584948 - RNA, 15 nt, Coxiella burnetii RSA 493
auuaagcaauuuuuu

SEQ ID NO: 2584949 - RNA, 19 nt, Coxiella burnetii RSA 493
auuaagcaauuuuuuauca

SEQ ID NO: 2584950 - RNA, 14 nt, Coxiella burnetii RSA 493
auuaagcuugaaaa

SEQ ID NO: 2584951 - RNA, 22 nt, Coxiella burnetii RSA 493
auuaauacaggaaaaagauaau

SEQ ID NO: 2584952 - RNA, 16 nt, Coxiella burnetii RSA 493
auuaauacauucuuca

SEQ ID NO: 2584953 - RNA, 16 nt, Coxiella burnetii RSA 493
auuaauauuaaaacaa

SEQ ID NO: 2584954 - RNA, 18 nt, Coxiella burnetii RSA 493
auuaauauuaaaacaaga

SEQ ID NO: 2584955 - RNA, 22 nt, Coxiella burnetii RSA 493
auuaauauuaaaacaagacaac

SEQ ID NO: 2584956 - RNA, 13 nt, Coxiella burnetii RSA 493
auuaaucgauuug

SEQ ID NO: 2584957 - RNA, 12 nt, Coxiella burnetii RSA 493
auuaaucuucca

SEQ ID NO: 2584958 - RNA, 17 nt, Coxiella burnetii RSA 493
auuaaugcgccuacaaa

SEQ ID NO: 2584959 - RNA, 16 nt, Coxiella burnetii RSA 493
auuaauggacauucuc

SEQ ID NO: 2584960 - RNA, 22 nt, Coxiella burnetii RSA 493
auuaauucccaagcuuuugccu

SEQ ID NO: 2584961 - RNA, 13 nt, Coxiella burnetii RSA 493
auuaauugcugau

SEQ ID NO: 2584962 - RNA, 21 nt, Coxiella burnetii RSA 493
auuaauugcugauauuuuuua

SEQ ID NO: 2584963 - RNA, 21 nt, Coxiella burnetii RSA 493
auuaauuguggcgaagccaca

SEQ ID NO: 2584964 - RNA, 12 nt, Coxiella burnetii RSA 493
auuaauuucuuu

SEQ ID NO: 2584965 - RNA, 12 nt, Coxiella burnetii RSA 493
auuaauuuucca

SEQ ID NO: 2584966 - RNA, 16 nt, Coxiella burnetii RSA 493
auuacauauuucuuuu

SEQ ID NO: 2584967 - RNA, 22 nt, Coxiella burnetii RSA 493
auuaccugaaugcuuuuaaagu

SEQ ID NO: 2584968 - RNA, 14 nt, Coxiella burnetii RSA 493
auuacgauuaauca

SEQ ID NO: 2584969 - RNA, 23 nt, Coxiella burnetii RSA 493
auuacgcccuuucucuuuuuucc

SEQ ID NO: 2584970 - RNA, 17 nt, Coxiella burnetii RSA 493
auuacuccaauuucauu

SEQ ID NO: 2584971 - RNA, 16 nt, Coxiella burnetii RSA 493
auuacuucuuugagua

SEQ ID NO: 2584972 - RNA, 14 nt, Coxiella burnetii RSA 493
auuacuuuuauaau

SEQ ID NO: 2584973 - RNA, 13 nt, Coxiella burnetii RSA 493
auuagaaauaaua

SEQ ID NO: 2584974 - RNA, 17 nt, Coxiella burnetii RSA 493
auuagaauuacuguaaa

SEQ ID NO: 2584975 - RNA, 16 nt, Coxiella burnetii RSA 493
auuagagccuuaucuc

SEQ ID NO: 2584976 - RNA, 11 nt, Coxiella burnetii RSA 493
auuagccuuaa

SEQ ID NO: 2584977 - RNA, 14 nt, Coxiella burnetii RSA 493
auuagccuuuaugc

SEQ ID NO: 2584978 - RNA, 15 nt, Coxiella burnetii RSA 493
auuagcugccauuuu

SEQ ID NO: 2584979 - RNA, 18 nt, Coxiella burnetii RSA 493
auuagcuucguuuacuuu

SEQ ID NO: 2584980 - RNA, 19 nt, Coxiella burnetii RSA 493
auuaggaucaagcgccaac

SEQ ID NO: 2584981 - RNA, 17 nt, Coxiella burnetii RSA 493
auuaguaauauuuugca

SEQ ID NO: 2584982 - RNA, 18 nt, Coxiella burnetii RSA 493
auuagucuuaauuuuaaa

SEQ ID NO: 2584983 - RNA, 13 nt, Coxiella burnetii RSA 493
auuaguuuaaauu

SEQ ID NO: 2584984 - RNA, 18 nt, Coxiella burnetii RSA 493
auuaguuuaaauuuuuca

SEQ ID NO: 2584985 - RNA, 17 nt, Coxiella burnetii RSA 493
auuauaacuauuuuaaa

SEQ ID NO: 2584986 - RNA, 18 nt, Coxiella burnetii RSA 493
auuauaacuauuuuaaau

SEQ ID NO: 2584987 - RNA, 15 nt, Coxiella burnetii RSA 493
auuauacugcccagc

SEQ ID NO: 2584988 - RNA, 22 nt, Coxiella burnetii RSA 493
auuauagaaugggaaguuuuau

SEQ ID NO: 2584989 - RNA, 12 nt, Coxiella burnetii RSA 493
auuaucaaaacg

SEQ ID NO: 2584990 - RNA, 14 nt, Coxiella burnetii RSA 493
auuaucaaaacgua

SEQ ID NO: 2584991 - RNA, 12 nt, Coxiella burnetii RSA 493
auuaucaucgca

SEQ ID NO: 2584992 - RNA, 14 nt, Coxiella burnetii RSA 493
auuaucuagauuuu

SEQ ID NO: 2584993 - RNA, 23 nt, Coxiella burnetii RSA 493
auuaucuuaaugaaauuucucau

SEQ ID NO: 2584994 - RNA, 23 nt, Coxiella burnetii RSA 493
auuaugaaaacgacuuauuuuau

SEQ ID NO: 2584995 - RNA, 14 nt, Coxiella burnetii RSA 493
auuauuaacgccag

SEQ ID NO: 2584996 - RNA, 18 nt, Coxiella burnetii RSA 493
auuauuaagccuuaauca

SEQ ID NO: 2584997 - RNA, 23 nt, Coxiella burnetii RSA 493
auuauuaaucauauaauuuuuga

SEQ ID NO: 2584998 - RNA, 19 nt, Coxiella burnetii RSA 493
auuauugaauuauacuuuu

SEQ ID NO: 2584999 - RNA, 12 nt, Coxiella burnetii RSA 493
auuauugauguc

SEQ ID NO: 2585000 - RNA, 19 nt, Coxiella burnetii RSA 493
auuauugaugucacaauua

SEQ ID NO: 2585001 - RNA, 16 nt, Coxiella burnetii RSA 493
auucaaagaacgccag

SEQ ID NO: 2585002 - RNA, 23 nt, Coxiella burnetii RSA 493
auucaaagaacgccagucauuuu

SEQ ID NO: 2585003 - RNA, 18 nt, Coxiella burnetii RSA 493
auucaaauaauacugcaa

SEQ ID NO: 2585004 - RNA, 15 nt, Coxiella burnetii RSA 493
auucaacacaauauc

SEQ ID NO: 2585005 - RNA, 16 nt, Coxiella burnetii RSA 493
auucaauaaucucaca

SEQ ID NO: 2585006 - RNA, 22 nt, Coxiella burnetii RSA 493
auucaauagagcgggaauuuuc

SEQ ID NO: 2585007 - RNA, 16 nt, Coxiella burnetii RSA 493
auucaauuuuuuugau

SEQ ID NO: 2585008 - RNA, 17 nt, Coxiella burnetii RSA 493
auucaggggcaaucaau

SEQ ID NO: 2585009 - RNA, 16 nt, Coxiella burnetii RSA 493
auucauaaauaguuca

SEQ ID NO: 2585010 - RNA, 20 nt, Coxiella burnetii RSA 493
auucauaaggaaauugaugu

SEQ ID NO: 2585011 - RNA, 22 nt, Coxiella burnetii RSA 493
auucauaucuuuuucaauuaua

SEQ ID NO: 2585012 - RNA, 21 nt, Coxiella burnetii RSA 493
auucauauugcgcguaaauuu

SEQ ID NO: 2585013 - RNA, 19 nt, Coxiella burnetii RSA 493
auucaugaaaaguaaauuu

SEQ ID NO: 2585014 - RNA, 13 nt, Coxiella burnetii RSA 493
auucaugaaaauc

SEQ ID NO: 2585015 - RNA, 17 nt, Coxiella burnetii RSA 493
auucaugacaauuuaau

SEQ ID NO: 2585016 - RNA, 16 nt, Coxiella burnetii RSA 493
auucauuaguuugguu

SEQ ID NO: 2585017 - RNA, 20 nt, Coxiella burnetii RSA 493
auucauuaguuugguugaac

SEQ ID NO: 2585018 - RNA, 23 nt, Coxiella burnetii RSA 493
auucauuaucaugcauuugauuu

SEQ ID NO: 2585019 - RNA, 15 nt, Coxiella burnetii RSA 493
auucauugaaagcgc

SEQ ID NO: 2585020 - RNA, 12 nt, Coxiella burnetii RSA 493
auucauuuuuca

SEQ ID NO: 2585021 - RNA, 15 nt, Coxiella burnetii RSA 493
auuccaaagcagaua

SEQ ID NO: 2585022 - RNA, 18 nt, Coxiella burnetii RSA 493
auuccaauaauugcugaa

SEQ ID NO: 2585023 - RNA, 20 nt, Coxiella burnetii RSA 493
auuccacaauuuuccggcuu

SEQ ID NO: 2585024 - RNA, 24 nt, Coxiella burnetii RSA 493
auuccagcacccgccgcaacuaaa

SEQ ID NO: 2585025 - RNA, 20 nt, Coxiella burnetii RSA 493
auuccaggcaguagagacaa

SEQ ID NO: 2585026 - RNA, 15 nt, Coxiella burnetii RSA 493
auuccauuaaaaaca

SEQ ID NO: 2585027 - RNA, 22 nt, Coxiella burnetii RSA 493
auucccaugcgcaucgcgccau

SEQ ID NO: 2585028 - RNA, 20 nt, Coxiella burnetii RSA 493
auuccccguauuucgcuucg

SEQ ID NO: 2585029 - RNA, 16 nt, Coxiella burnetii RSA 493
auucccgauggggaua

SEQ ID NO: 2585030 - RNA, 19 nt, Coxiella burnetii RSA 493
auucccguauuucgcuucg

SEQ ID NO: 2585031 - RNA, 21 nt, Coxiella burnetii RSA 493
auucccugcgcuccagaugau

SEQ ID NO: 2585032 - RNA, 18 nt, Coxiella burnetii RSA 493
auucccuuuugaauucca

SEQ ID NO: 2585033 - RNA, 15 nt, Coxiella burnetii RSA 493
auuccugaaguaauu

SEQ ID NO: 2585034 - RNA, 20 nt, Coxiella burnetii RSA 493
auuccugaaguaauuuuucg

SEQ ID NO: 2585035 - RNA, 15 nt, Coxiella burnetii RSA 493
auuccuugcucaagu

SEQ ID NO: 2585036 - RNA, 16 nt, Coxiella burnetii RSA 493
auuccuugcucaaguc

SEQ ID NO: 2585037 - RNA, 18 nt, Coxiella burnetii RSA 493
auuccuuuuucuuuuaau

SEQ ID NO: 2585038 - RNA, 12 nt, Coxiella burnetii RSA 493
auuuaaugaggu

SEQ ID NO: 2585039 - RNA, 15 nt, Coxiella burnetii RSA 493
auuuaaugagguuaa

SEQ ID NO: 2585040 - RNA, 14 nt, Coxiella burnetii RSA 493
auuuaaugucuuuu

SEQ ID NO: 2585041 - RNA, 13 nt, Coxiella burnetii RSA 493
auuuaauuuuaaa

SEQ ID NO: 2585042 - RNA, 14 nt, Coxiella burnetii RSA 493
auuuaauuuuaaau

SEQ ID NO: 2585043 - RNA, 15 nt, Coxiella burnetii RSA 493
auuuacaauaacaaa

SEQ ID NO: 2585044 - RNA, 22 nt, Coxiella burnetii RSA 493
auuuacaauaacaaaugaugaa

SEQ ID NO: 2585045 - RNA, 23 nt, Coxiella burnetii RSA 493
auuuacaauaacaaaugaugaau

SEQ ID NO: 2585046 - RNA, 14 nt, Coxiella burnetii RSA 493
auuuacaauacggu

SEQ ID NO: 2585047 - RNA, 14 nt, Coxiella burnetii RSA 493
auuuacaauauccc

SEQ ID NO: 2585048 - RNA, 20 nt, Coxiella burnetii RSA 493
auuuaccaauuaaagaaucg

SEQ ID NO: 2585049 - RNA, 14 nt, Coxiella burnetii RSA 493
auuuagccaaaauu

SEQ ID NO: 2585050 - RNA, 16 nt, Coxiella burnetii RSA 493
auuuagcgauuuugac

SEQ ID NO: 2585051 - RNA, 20 nt, Coxiella burnetii RSA 493
auuuauaacaaaccaucgcc

SEQ ID NO: 2585052 - RNA, 18 nt, Coxiella burnetii RSA 493
auuuauaacaagguuuua

SEQ ID NO: 2585053 - RNA, 20 nt, Coxiella burnetii RSA 493
auuuauaacaagguuuuauu

SEQ ID NO: 2585054 - RNA, 13 nt, Coxiella burnetii RSA 493
auuuauaauuuau

SEQ ID NO: 2585055 - RNA, 19 nt, Coxiella burnetii RSA 493
auuuaucaacgauuuuaag

SEQ ID NO: 2585056 - RNA, 15 nt, Coxiella burnetii RSA 493
auuuaucauuuuucc

SEQ ID NO: 2585057 - RNA, 15 nt, Coxiella burnetii RSA 493
auuuaugaaugcugg

SEQ ID NO: 2585058 - RNA, 17 nt, Coxiella burnetii RSA 493
auuuaugaaugcuggag

SEQ ID NO: 2585059 - RNA, 15 nt, Coxiella burnetii RSA 493
auuuauuaaaaacua

SEQ ID NO: 2585060 - RNA, 19 nt, Coxiella burnetii RSA 493
auuuauucaacucuuaucu

SEQ ID NO: 2585061 - RNA, 18 nt, Coxiella burnetii RSA 493
auuuauuguguuguagaa

SEQ ID NO: 2585062 - RNA, 15 nt, Coxiella burnetii RSA 493
auuuauuuuucucuu

SEQ ID NO: 2585063 - RNA, 18 nt, Coxiella burnetii RSA 493
auuucaacgucaaaaccc

SEQ ID NO: 2585064 - RNA, 13 nt, Coxiella burnetii RSA 493
auuucaaguaauc

SEQ ID NO: 2585065 - RNA, 16 nt, Coxiella burnetii RSA 493
auuucaaguaaucuac

SEQ ID NO: 2585066 - RNA, 18 nt, Coxiella burnetii RSA 493
auuucaauauuucuugaa

SEQ ID NO: 2585067 - RNA, 18 nt, Coxiella burnetii RSA 493
auuucaauggauucuucu

SEQ ID NO: 2585068 - RNA, 14 nt, Coxiella burnetii RSA 493
auuucaauuagaau

SEQ ID NO: 2585069 - RNA, 11 nt, Coxiella burnetii RSA 493
auuucacuuua

SEQ ID NO: 2585070 - RNA, 18 nt, Coxiella burnetii RSA 493
auuucacuuuauuuucau

SEQ ID NO: 2585071 - RNA, 21 nt, Coxiella burnetii RSA 493
auuucagauaaugaccuuaau

SEQ ID NO: 2585072 - RNA, 19 nt, Coxiella burnetii RSA 493
auuucaggcgccugcaaaa

SEQ ID NO: 2585073 - RNA, 14 nt, Coxiella burnetii RSA 493
auuucauccaaaau

SEQ ID NO: 2585074 - RNA, 20 nt, Coxiella burnetii RSA 493
auuuccaacgcuuguuuuau

SEQ ID NO: 2585075 - RNA, 17 nt, Coxiella burnetii RSA 493
auuuccacuuguuuuuc

SEQ ID NO: 2585076 - RNA, 16 nt, Coxiella burnetii RSA 493
auuucccaaucaucaa

SEQ ID NO: 2585077 - RNA, 17 nt, Coxiella burnetii RSA 493
auuucccaaucaucaau

SEQ ID NO: 2585078 - RNA, 16 nt, Coxiella burnetii RSA 493
auuucccguauuucgc

SEQ ID NO: 2585079 - RNA, 20 nt, Coxiella burnetii RSA 493
auuucccguauuucgcuucg

SEQ ID NO: 2585080 - RNA, 14 nt, Coxiella burnetii RSA 493
auuuccgauuuauu

SEQ ID NO: 2585081 - RNA, 23 nt, Coxiella burnetii RSA 493
auuuccgcaaaucggaaaagcca

SEQ ID NO: 2585082 - RNA, 16 nt, Coxiella burnetii RSA 493
auuuccgucaauuuuu

SEQ ID NO: 2585083 - RNA, 14 nt, Coxiella burnetii RSA 493
auuuccgugcaggg

SEQ ID NO: 2585084 - RNA, 23 nt, Coxiella burnetii RSA 493
auuuccugaaccuaaauuauaaa

SEQ ID NO: 2585085 - RNA, 19 nt, Coxiella burnetii RSA 493
auuuccugucguuaauacg

SEQ ID NO: 2585086 - RNA, 14 nt, Coxiella burnetii RSA 493
auuuccuuuucauu

SEQ ID NO: 2585087 - RNA, 16 nt, Coxiella burnetii RSA 493
auuuccuuuucauuuu

SEQ ID NO: 2585088 - RNA, 19 nt, Coxiella burnetii RSA 493
auuucgagauuauuauacg

SEQ ID NO: 2585089 - RNA, 15 nt, Coxiella burnetii RSA 493
auuucgauuuuacaa

SEQ ID NO: 2585090 - RNA, 20 nt, Coxiella burnetii RSA 493
auuucgcuucgcuacauacg

SEQ ID NO: 2585091 - RNA, 20 nt, Coxiella burnetii RSA 493
auuucgcuucgcucauacgu

SEQ ID NO: 2585092 - RNA, 23 nt, Coxiella burnetii RSA 493
auuucgcuucgcuccauacgggc

SEQ ID NO: 2585093 - RNA, 20 nt, Coxiella burnetii RSA 493
auuucgcuucgcugcauacg

SEQ ID NO: 2585094 - RNA, 23 nt, Coxiella burnetii RSA 493
auuucgcuucgcugcauacggac

SEQ ID NO: 2585095 - RNA, 13 nt, Coxiella burnetii RSA 493
auuucggacaaca

SEQ ID NO: 2585096 - RNA, 15 nt, Coxiella burnetii RSA 493
auuucggacaacaaa

SEQ ID NO: 2585097 - RNA, 19 nt, Coxiella burnetii RSA 493
auuucggacaacaaauaaa

SEQ ID NO: 2585098 - RNA, 18 nt, Coxiella burnetii RSA 493
auuucggauguuuuuuca

SEQ ID NO: 2585099 - RNA, 21 nt, Coxiella burnetii RSA 493
auuucggauguuuuuucacuu

SEQ ID NO: 2585100 - RNA, 16 nt, Coxiella burnetii RSA 493
auuucggguucaaaaa

SEQ ID NO: 2585101 - RNA, 19 nt, Coxiella burnetii RSA 493
auuucguauaauucacgga

SEQ ID NO: 2585102 - RNA, 19 nt, Coxiella burnetii RSA 493
auuucguugauuaauaaug

SEQ ID NO: 2585103 - RNA, 14 nt, Coxiella burnetii RSA 493
auuucuaaaaauca

SEQ ID NO: 2585104 - RNA, 22 nt, Coxiella burnetii RSA 493
auuucuaucgccguuucugcuu

SEQ ID NO: 2585105 - RNA, 19 nt, Coxiella burnetii RSA 493
auuucucgaaccaccuggc

SEQ ID NO: 2585106 - RNA, 10 nt, Coxiella burnetii RSA 493
auuucugcag

SEQ ID NO: 2585107 - RNA, 14 nt, Coxiella burnetii RSA 493
auuucugguugaau

SEQ ID NO: 2585108 - RNA, 16 nt, Coxiella burnetii RSA 493
auuucuuagguuuuau

SEQ ID NO: 2585109 - RNA, 18 nt, Coxiella burnetii RSA 493
auuucuuuugccucuuuu

SEQ ID NO: 2585110 - RNA, 13 nt, Coxiella burnetii RSA 493
auuucuuuuugaa

SEQ ID NO: 2585111 - RNA, 17 nt, Coxiella burnetii RSA 493
auuugaaaaacccauuu

SEQ ID NO: 2585112 - RNA, 18 nt, Coxiella burnetii RSA 493
auuugagaacguuuccca

SEQ ID NO: 2585113 - RNA, 13 nt, Coxiella burnetii RSA 493
auuugagaauaaa

SEQ ID NO: 2585114 - RNA, 14 nt, Coxiella burnetii RSA 493
auuugaucauuucc

SEQ ID NO: 2585115 - RNA, 13 nt, Coxiella burnetii RSA 493
auuugauuaugcu

SEQ ID NO: 2585116 - RNA, 18 nt, Coxiella burnetii RSA 493
auuugauuuucugugguu

SEQ ID NO: 2585117 - RNA, 22 nt, Coxiella burnetii RSA 493
auuugcagccgccaauuuuguu

SEQ ID NO: 2585118 - RNA, 15 nt, Coxiella burnetii RSA 493
auuugcaguuugcag

SEQ ID NO: 2585119 - RNA, 16 nt, Coxiella burnetii RSA 493
auuugcggaaaaggag

SEQ ID NO: 2585120 - RNA, 21 nt, Coxiella burnetii RSA 493
auuugcggaaaaggagaaagu

SEQ ID NO: 2585121 - RNA, 16 nt, Coxiella burnetii RSA 493
auuugcugaauuuuau

SEQ ID NO: 2585122 - RNA, 19 nt, Coxiella burnetii RSA 493
auuugguuguggcugaaaa

SEQ ID NO: 2585123 - RNA, 16 nt, Coxiella burnetii RSA 493
auuuguauggcgccug

SEQ ID NO: 2585124 - RNA, 13 nt, Coxiella burnetii RSA 493
auuuguauugagg

SEQ ID NO: 2585125 - RNA, 15 nt, Coxiella burnetii RSA 493
auuugugauuuuaaa

SEQ ID NO: 2585126 - RNA, 17 nt, Coxiella burnetii RSA 493
auuugugauuuuaaaaa

SEQ ID NO: 2585127 - RNA, 18 nt, Coxiella burnetii RSA 493
auuuguuauugcuaaaau

SEQ ID NO: 2585128 - RNA, 16 nt, Coxiella burnetii RSA 493
auuuguucuaaaucgg

SEQ ID NO: 2585129 - RNA, 12 nt, Coxiella burnetii RSA 493
auuuguucuuua

SEQ ID NO: 2585130 - RNA, 18 nt, Coxiella burnetii RSA 493
auuuguucuuuaacaaga

SEQ ID NO: 2585131 - RNA, 18 nt, Coxiella burnetii RSA 493
auuuuaaaaaaaauacuc

SEQ ID NO: 2585132 - RNA, 13 nt, Coxiella burnetii RSA 493
auuuuaaaacauc

SEQ ID NO: 2585133 - RNA, 16 nt, Coxiella burnetii RSA 493
auuuuaaauaccauuu

SEQ ID NO: 2585134 - RNA, 16 nt, Coxiella burnetii RSA 493
auuuuaauaugauaaa

SEQ ID NO: 2585135 - RNA, 18 nt, Coxiella burnetii RSA 493
auuuuacaauaauccaca

SEQ ID NO: 2585136 - RNA, 21 nt, Coxiella burnetii RSA 493
auuuuacgcuauuuuuuaaau

SEQ ID NO: 2585137 - RNA, 22 nt, Coxiella burnetii RSA 493
auuuuacuaggucugauaggaa

SEQ ID NO: 2585138 - RNA, 14 nt, Coxiella burnetii RSA 493
auuuuauaaagcaa

SEQ ID NO: 2585139 - RNA, 22 nt, Coxiella burnetii RSA 493
auuuuaucgauccgagcccaau

SEQ ID NO: 2585140 - RNA, 14 nt, Coxiella burnetii RSA 493
auuuuauuauuuau

SEQ ID NO: 2585141 - RNA, 14 nt, Coxiella burnetii RSA 493
auuuucaaaugaau

SEQ ID NO: 2585142 - RNA, 15 nt, Coxiella burnetii RSA 493
auuuucaaaugaaua

SEQ ID NO: 2585143 - RNA, 20 nt, Coxiella burnetii RSA 493
auuuucaaaugaauaagcaa

SEQ ID NO: 2585144 - RNA, 15 nt, Coxiella burnetii RSA 493
caaauaauaugaaua

SEQ ID NO: 2585145 - RNA, 16 nt, Coxiella burnetii RSA 493
caaauaauaugaauau

SEQ ID NO: 2585146 - RNA, 20 nt, Coxiella burnetii RSA 493
caaauaaucgggaauaaaau

SEQ ID NO: 2585147 - RNA, 23 nt, Coxiella burnetii RSA 493
caaauaaugaguggcugcuucuu

SEQ ID NO: 2585148 - RNA, 16 nt, Coxiella burnetii RSA 493
caaauagaugacuuug

SEQ ID NO: 2585149 - RNA, 11 nt, Coxiella burnetii RSA 493
caaauagaugg

SEQ ID NO: 2585150 - RNA, 23 nt, Coxiella burnetii RSA 493
caaauaucugcuaggauuuuuua

SEQ ID NO: 2585151 - RNA, 16 nt, Coxiella burnetii RSA 493
caaaucacgcuuuuuu

SEQ ID NO: 2585152 - RNA, 18 nt, Coxiella burnetii RSA 493
caaaucgcagugcccaug

SEQ ID NO: 2585153 - RNA, 15 nt, Coxiella burnetii RSA 493
caaaucggcaaauac

SEQ ID NO: 2585154 - RNA, 16 nt, Coxiella burnetii RSA 493
caaaugaauaacauca

SEQ ID NO: 2585155 - RNA, 21 nt, Coxiella burnetii RSA 493
caaaugaauaacaucaguuuu

SEQ ID NO: 2585156 - RNA, 21 nt, Coxiella burnetii RSA 493
caaaugaucggcgcauuuuua

SEQ ID NO: 2585157 - RNA, 21 nt, Coxiella burnetii RSA 493
caaaugcuaauuccuuuggua

SEQ ID NO: 2585158 - RNA, 22 nt, Coxiella burnetii RSA 493
caaaugggcugugguuguuucg

SEQ ID NO: 2585159 - RNA, 20 nt, Coxiella burnetii RSA 493
caaaugguugcugucaaaaa

SEQ ID NO: 2585160 - RNA, 15 nt, Coxiella burnetii RSA 493
caaauguauuuauca

SEQ ID NO: 2585161 - RNA, 17 nt, Coxiella burnetii RSA 493
caaauguugauaauaaa

SEQ ID NO: 2585162 - RNA, 14 nt, Coxiella burnetii RSA 493
caaauuaaaauaau

SEQ ID NO: 2585163 - RNA, 15 nt, Coxiella burnetii RSA 493
caaauuaaaauaauc

SEQ ID NO: 2585164 - RNA, 21 nt, Coxiella burnetii RSA 493
caaauucuuggaugaccgcug

SEQ ID NO: 2585165 - RNA, 16 nt, Coxiella burnetii RSA 493
caaauugcuccaaaca

SEQ ID NO: 2585166 - RNA, 15 nt, Coxiella burnetii RSA 493
caaauugggugcauu

SEQ ID NO: 2585167 - RNA, 21 nt, Coxiella burnetii RSA 493
caacaaaauauacucacccac

SEQ ID NO: 2585168 - RNA, 13 nt, Coxiella burnetii RSA 493
caacaagaaaaau

SEQ ID NO: 2585169 - RNA, 16 nt, Coxiella burnetii RSA 493
caacaagcguuguaaa

SEQ ID NO: 2585170 - RNA, 22 nt, Coxiella burnetii RSA 493
caacaaguaaaguagcccguau

SEQ ID NO: 2585171 - RNA, 14 nt, Coxiella burnetii RSA 493
caacaaucaguuuu

SEQ ID NO: 2585172 - RNA, 16 nt, Coxiella burnetii RSA 493
caacaaucaguuuuga

SEQ ID NO: 2585173 - RNA, 15 nt, Coxiella burnetii RSA 493
caaccacugucuucu

SEQ ID NO: 2585174 - RNA, 22 nt, Coxiella burnetii RSA 493
caaccagaaauauuuucucaau

SEQ ID NO: 2585175 - RNA, 18 nt, Coxiella burnetii RSA 493
caacccaaggaaccacca

SEQ ID NO: 2585176 - RNA, 21 nt, Coxiella burnetii RSA 493
caaccgacgaauaacggaaaa

SEQ ID NO: 2585177 - RNA, 13 nt, Coxiella burnetii RSA 493
caaccgcaugaau

SEQ ID NO: 2585178 - RNA, 21 nt, Coxiella burnetii RSA 493
caaccgccauuucgcuuuuau

SEQ ID NO: 2585179 - RNA, 21 nt, Coxiella burnetii RSA 493
caaccgguuuuucuucauuug

SEQ ID NO: 2585180 - RNA, 20 nt, Coxiella burnetii RSA 493
caaccguugagcaagcagaa

SEQ ID NO: 2585181 - RNA, 17 nt, Coxiella burnetii RSA 493
caaccguuguauaaacu

SEQ ID NO: 2585182 - RNA, 19 nt, Coxiella burnetii RSA 493
caaccguuguauaaacucg

SEQ ID NO: 2585183 - RNA, 14 nt, Coxiella burnetii RSA 493
caacgauaaaauua

SEQ ID NO: 2585184 - RNA, 13 nt, Coxiella burnetii RSA 493
caacgauuuuccc

SEQ ID NO: 2585185 - RNA, 15 nt, Coxiella burnetii RSA 493
caacgcgacaagaau

SEQ ID NO: 2585186 - RNA, 16 nt, Coxiella burnetii RSA 493
caacgcuguuaaaauc

SEQ ID NO: 2585187 - RNA, 17 nt, Coxiella burnetii RSA 493
caacgcuuguuuuauac

SEQ ID NO: 2585188 - RNA, 14 nt, Coxiella burnetii RSA 493
caacgguucucaaa

SEQ ID NO: 2585189 - RNA, 14 nt, Coxiella burnetii RSA 493
caacgucaaaaccc

SEQ ID NO: 2585190 - RNA, 23 nt, Coxiella burnetii RSA 493
caacuaaaugacguaaugucuca

SEQ ID NO: 2585191 - RNA, 13 nt, Coxiella burnetii RSA 493
caacuaacggcua

SEQ ID NO: 2585192 - RNA, 18 nt, Coxiella burnetii RSA 493
caacuacuugauauuccc

SEQ ID NO: 2585193 - RNA, 20 nt, Coxiella burnetii RSA 493
caacuccugaaaaauaauuu

SEQ ID NO: 2585194 - RNA, 23 nt, Coxiella burnetii RSA 493
caacucucuagcuguuuuuucua

SEQ ID NO: 2585195 - RNA, 19 nt, Coxiella burnetii RSA 493
caacuuagcgaauuguaaa

SEQ ID NO: 2585196 - RNA, 12 nt, Coxiella burnetii RSA 493
caacuuccgcua

SEQ ID NO: 2585197 - RNA, 13 nt, Coxiella burnetii RSA 493
caacuuuaacauu

SEQ ID NO: 2585198 - RNA, 13 nt, Coxiella burnetii RSA 493
caacuuuuuuccu

SEQ ID NO: 2585199 - RNA, 12 nt, Coxiella burnetii RSA 493
caagaagcaucg

SEQ ID NO: 2585200 - RNA, 20 nt, Coxiella burnetii RSA 493
caagaauggcgggaaaaaau

SEQ ID NO: 2585201 - RNA, 18 nt, Coxiella burnetii RSA 493
caagaccccuaucaauca

SEQ ID NO: 2585202 - RNA, 12 nt, Coxiella burnetii RSA 493
caagacucaaag

SEQ ID NO: 2585203 - RNA, 16 nt, Coxiella burnetii RSA 493
caagacucaaagaaau

SEQ ID NO: 2585204 - RNA, 15 nt, Coxiella burnetii RSA 493
caagaggaguucuaa

SEQ ID NO: 2585205 - RNA, 20 nt, Coxiella burnetii RSA 493
caagaggaguucuaaaaaau

SEQ ID NO: 2585206 - RNA, 21 nt, Coxiella burnetii RSA 493
caagaggaguucuaaaaaauu

SEQ ID NO: 2585207 - RNA, 17 nt, Coxiella burnetii RSA 493
caagaguguucgcuaau

SEQ ID NO: 2585208 - RNA, 12 nt, Coxiella burnetii RSA 493
caagccccuuua

SEQ ID NO: 2585209 - RNA, 23 nt, Coxiella burnetii RSA 493
caagcccgcagcgcccacuuugc

SEQ ID NO: 2585210 - RNA, 14 nt, Coxiella burnetii RSA 493
caagccgaauaaau

SEQ ID NO: 2585211 - RNA, 15 nt, Coxiella burnetii RSA 493
caagcgauuaaauau

SEQ ID NO: 2585212 - RNA, 11 nt, Coxiella burnetii RSA 493
caagcgcggcc

SEQ ID NO: 2585213 - RNA, 22 nt, Coxiella burnetii RSA 493
caagcgggguuaaggaaaagca

SEQ ID NO: 2585214 - RNA, 14 nt, Coxiella burnetii RSA 493
caagcguucuuaaa

SEQ ID NO: 2585215 - RNA, 13 nt, Coxiella burnetii RSA 493
caagcguuguaaa

SEQ ID NO: 2585216 - RNA, 17 nt, Coxiella burnetii RSA 493
caagcucaugaaaagca

SEQ ID NO: 2585217 - RNA, 19 nt, Coxiella burnetii RSA 493
caagcuggcauugaaaauc

SEQ ID NO: 2585218 - RNA, 13 nt, Coxiella burnetii RSA 493
caagcuuuugccu

SEQ ID NO: 2585219 - RNA, 18 nt, Coxiella burnetii RSA 493
caaggcuauuccccuucu

SEQ ID NO: 2585220 - RNA, 14 nt, Coxiella burnetii RSA 493
caagggcaaaaaca

SEQ ID NO: 2585221 - RNA, 16 nt, Coxiella burnetii RSA 493
caaguaagccauauca

SEQ ID NO: 2585222 - RNA, 15 nt, Coxiella burnetii RSA 493
caaguaauucagcau

SEQ ID NO: 2585223 - RNA, 20 nt, Coxiella burnetii RSA 493
caagucaucgggagcgauaa

SEQ ID NO: 2585224 - RNA, 21 nt, Coxiella burnetii RSA 493
caaguccggacgcaauaccca

SEQ ID NO: 2585225 - RNA, 17 nt, Coxiella burnetii RSA 493
caagugaccgagauuuu

SEQ ID NO: 2585226 - RNA, 22 nt, Coxiella burnetii RSA 493
caagugcuuccaaguaagccau

SEQ ID NO: 2585227 - RNA, 16 nt, Coxiella burnetii RSA 493
caagugugggaaaaau

SEQ ID NO: 2585228 - RNA, 21 nt, Coxiella burnetii RSA 493
caaguguucacaagucucaga

SEQ ID NO: 2585229 - RNA, 17 nt, Coxiella burnetii RSA 493
caaguucuucuaaagaa

SEQ ID NO: 2585230 - RNA, 19 nt, Coxiella burnetii RSA 493
caaguucuuugccaccccc

SEQ ID NO: 2585231 - RNA, 14 nt, Coxiella burnetii RSA 493
caaguuuuaagaaa

SEQ ID NO: 2585232 - RNA, 16 nt, Coxiella burnetii RSA 493
caaguuuuaagaaaaa

SEQ ID NO: 2585233 - RNA, 17 nt, Coxiella burnetii RSA 493
caaguuuuaagaaaaac

SEQ ID NO: 2585234 - RNA, 13 nt, Coxiella burnetii RSA 493
caauaaacccguu

SEQ ID NO: 2585235 - RNA, 15 nt, Coxiella burnetii RSA 493
caauaacaaauaaac

SEQ ID NO: 2585236 - RNA, 15 nt, Coxiella burnetii RSA 493
caauaacaaaugaug

SEQ ID NO: 2585237 - RNA, 17 nt, Coxiella burnetii RSA 493
caauaacaagcucccag

SEQ ID NO: 2585238 - RNA, 21 nt, Coxiella burnetii RSA 493
caauaacaagcucccagacac

SEQ ID NO: 2585239 - RNA, 19 nt, Coxiella burnetii RSA 493
caauaacauaucuucaaca

SEQ ID NO: 2585240 - RNA, 18 nt, Coxiella burnetii RSA 493
caauaacccacagccgcu

SEQ ID NO: 2585241 - RNA, 12 nt, Coxiella burnetii RSA 493
caauaagccguu

SEQ ID NO: 2585242 - RNA, 12 nt, Coxiella burnetii RSA 493
caauaauaaaac

SEQ ID NO: 2585243 - RNA, 21 nt, Coxiella burnetii RSA 493
caauaccaagcucaugaaaag

SEQ ID NO: 2585244 - RNA, 18 nt, Coxiella burnetii RSA 493
caauaccaauucaaauaa

SEQ ID NO: 2585245 - RNA, 19 nt, Coxiella burnetii RSA 493
caauaccaauucaaauaau

SEQ ID NO: 2585246 - RNA, 18 nt, Coxiella burnetii RSA 493
caauaccauuuuuaaauu

SEQ ID NO: 2585247 - RNA, 14 nt, Coxiella burnetii RSA 493
caauagagcgggaa

SEQ ID NO: 2585248 - RNA, 15 nt, Coxiella burnetii RSA 493
caauagcgcaauugg

SEQ ID NO: 2585249 - RNA, 20 nt, Coxiella burnetii RSA 493
caauauacgcaauuguucua

SEQ ID NO: 2585250 - RNA, 21 nt, Coxiella burnetii RSA 493
cacgaaccgccggguuuuuug

SEQ ID NO: 2585251 - RNA, 20 nt, Coxiella burnetii RSA 493
cacgaacgcuuugaauggcu

SEQ ID NO: 2585252 - RNA, 15 nt, Coxiella burnetii RSA 493
cacgaccccaaugcu

SEQ ID NO: 2585253 - RNA, 14 nt, Coxiella burnetii RSA 493
cacgacuaauagcu

SEQ ID NO: 2585254 - RNA, 15 nt, Coxiella burnetii RSA 493
cacgaucaacaaaau

SEQ ID NO: 2585255 - RNA, 19 nt, Coxiella burnetii RSA 493
cacgaucaccgccgauggc

SEQ ID NO: 2585256 - RNA, 14 nt, Coxiella burnetii RSA 493
cacgaugauuaaau

SEQ ID NO: 2585257 - RNA, 11 nt, Coxiella burnetii RSA 493
cacgaugcaca

SEQ ID NO: 2585258 - RNA, 18 nt, Coxiella burnetii RSA 493
cacgauuuaaauuggcca

SEQ ID NO: 2585259 - RNA, 13 nt, Coxiella burnetii RSA 493
cacgauuuuucuc

SEQ ID NO: 2585260 - RNA, 22 nt, Coxiella burnetii RSA 493
cacgccaaggcuauuccccuuc

SEQ ID NO: 2585261 - RNA, 14 nt, Coxiella burnetii RSA 493
cacggcaaauaaag

SEQ ID NO: 2585262 - RNA, 19 nt, Coxiella burnetii RSA 493
cacggcaaauaaaggcgac

SEQ ID NO: 2585263 - RNA, 18 nt, Coxiella burnetii RSA 493
cacggcgccaucaaccaa

SEQ ID NO: 2585264 - RNA, 14 nt, Coxiella burnetii RSA 493
cacgguaauaauau

SEQ ID NO: 2585265 - RNA, 15 nt, Coxiella burnetii RSA 493
cacguacccaggcgu

SEQ ID NO: 2585266 - RNA, 16 nt, Coxiella burnetii RSA 493
cacguaucugcuaaaa

SEQ ID NO: 2585267 - RNA, 17 nt, Coxiella burnetii RSA 493
cacguaucugcuaaaaa

SEQ ID NO: 2585268 - RNA, 16 nt, Coxiella burnetii RSA 493
cacuaacguuacuccg

SEQ ID NO: 2585269 - RNA, 15 nt, Coxiella burnetii RSA 493
cacuaagucacugau

SEQ ID NO: 2585270 - RNA, 19 nt, Coxiella burnetii RSA 493
cacuaauaauccgcauugc

SEQ ID NO: 2585271 - RNA, 14 nt, Coxiella burnetii RSA 493
cacuacgugcgcug

SEQ ID NO: 2585272 - RNA, 14 nt, Coxiella burnetii RSA 493
cacuaggguacuau

SEQ ID NO: 2585273 - RNA, 14 nt, Coxiella burnetii RSA 493
cacuaguuuuacua

SEQ ID NO: 2585274 - RNA, 17 nt, Coxiella burnetii RSA 493
cacuauccacaaaggcu

SEQ ID NO: 2585275 - RNA, 20 nt, Coxiella burnetii RSA 493
cacuaugaucaugccuuuuu

SEQ ID NO: 2585276 - RNA, 16 nt, Coxiella burnetii RSA 493
cacuauugaagucugg

SEQ ID NO: 2585277 - RNA, 22 nt, Coxiella burnetii RSA 493
cacucgguuggucggaauugcu

SEQ ID NO: 2585278 - RNA, 14 nt, Coxiella burnetii RSA 493
cacuguccucuguc

SEQ ID NO: 2585279 - RNA, 16 nt, Coxiella burnetii RSA 493
cacuguccucuguccu

SEQ ID NO: 2585280 - RNA, 13 nt, Coxiella burnetii RSA 493
cacuucuuccaug

SEQ ID NO: 2585281 - RNA, 14 nt, Coxiella burnetii RSA 493
cacuugauaaucaa

SEQ ID NO: 2585282 - RNA, 19 nt, Coxiella burnetii RSA 493
cacuuguccuucuucuaag

SEQ ID NO: 2585283 - RNA, 13 nt, Coxiella burnetii RSA 493
cacuuucaaucgc

SEQ ID NO: 2585284 - RNA, 15 nt, Coxiella burnetii RSA 493
cacuuuucuggcugu

SEQ ID NO: 2585285 - RNA, 12 nt, Coxiella burnetii RSA 493
cacuuuuuucag

SEQ ID NO: 2585286 - RNA, 18 nt, Coxiella burnetii RSA 493
cacuuuuuucagcguuua

SEQ ID NO: 2585287 - RNA, 14 nt, Coxiella burnetii RSA 493
cagaaaaguaaaaa

SEQ ID NO: 2585288 - RNA, 16 nt, Coxiella burnetii RSA 493
cagaaauauuuucuca

SEQ ID NO: 2585289 - RNA, 13 nt, Coxiella burnetii RSA 493
cagaacaccguug

SEQ ID NO: 2585290 - RNA, 18 nt, Coxiella burnetii RSA 493
cagaacaccguuggaaaa

SEQ ID NO: 2585291 - RNA, 20 nt, Coxiella burnetii RSA 493
cagaaggcagaggacagagg

SEQ ID NO: 2585292 - RNA, 14 nt, Coxiella burnetii RSA 493
cagaaugcugauaa

SEQ ID NO: 2585293 - RNA, 15 nt, Coxiella burnetii RSA 493
cagaaugcugauaau

SEQ ID NO: 2585294 - RNA, 22 nt, Coxiella burnetii RSA 493
cagacagacgcuggaaaaauaa

SEQ ID NO: 2585295 - RNA, 15 nt, Coxiella burnetii RSA 493
cagacgcuggaaaaa

SEQ ID NO: 2585296 - RNA, 13 nt, Coxiella burnetii RSA 493
cagacucuuuuua

SEQ ID NO: 2585297 - RNA, 22 nt, Coxiella burnetii RSA 493
cagagaaguaugaucauuuucu

SEQ ID NO: 2585298 - RNA, 17 nt, Coxiella burnetii RSA 493
cagaggacagaggacag

SEQ ID NO: 2585299 - RNA, 19 nt, Coxiella burnetii RSA 493
cagauaaaucaaacgguua

SEQ ID NO: 2585300 - RNA, 17 nt, Coxiella burnetii RSA 493
cagauaaugaccuuaau

SEQ ID NO: 2585301 - RNA, 16 nt, Coxiella burnetii RSA 493
cagaucauacauauga

SEQ ID NO: 2585302 - RNA, 21 nt, Coxiella burnetii RSA 493
cagauuuuuuaucguugcugu

SEQ ID NO: 2585303 - RNA, 17 nt, Coxiella burnetii RSA 493
cagcaaguugcagaguu

SEQ ID NO: 2585304 - RNA, 16 nt, Coxiella burnetii RSA 493
cagcaauaucagaaac

SEQ ID NO: 2585305 - RNA, 21 nt, Coxiella burnetii RSA 493
cagcaauaucagaaaccguuu

SEQ ID NO: 2585306 - RNA, 19 nt, Coxiella burnetii RSA 493
cagcaauggugauuucuuc

SEQ ID NO: 2585307 - RNA, 21 nt, Coxiella burnetii RSA 493
cagcaauucgaccuuugaaaa

SEQ ID NO: 2585308 - RNA, 17 nt, Coxiella burnetii RSA 493
cagcauaaaggcuaaua

SEQ ID NO: 2585309 - RNA, 14 nt, Coxiella burnetii RSA 493
cagccaauuuauuu

SEQ ID NO: 2585310 - RNA, 15 nt, Coxiella burnetii RSA 493
cagccaccgcaugaa

SEQ ID NO: 2585311 - RNA, 19 nt, Coxiella burnetii RSA 493
cagcccaaccuacgggcua

SEQ ID NO: 2585312 - RNA, 17 nt, Coxiella burnetii RSA 493
cagcccuaauaaaacaa

SEQ ID NO: 2585313 - RNA, 18 nt, Coxiella burnetii RSA 493
cagccgaagugcuaaaaa

SEQ ID NO: 2585314 - RNA, 22 nt, Coxiella burnetii RSA 493
cagccgaccaaggguauuuuuu

SEQ ID NO: 2585315 - RNA, 18 nt, Coxiella burnetii RSA 493
cagccgaugacaaauaaa

SEQ ID NO: 2585316 - RNA, 18 nt, Coxiella burnetii RSA 493
cagccgauucuucauacu

SEQ ID NO: 2585317 - RNA, 21 nt, Coxiella burnetii RSA 493
cagccgccacucgaauuuguu

SEQ ID NO: 2585318 - RNA, 19 nt, Coxiella burnetii RSA 493
cagccgcuuuuuauuggaa

SEQ ID NO: 2585319 - RNA, 14 nt, Coxiella burnetii RSA 493
cagccugaucaagu

SEQ ID NO: 2585320 - RNA, 21 nt, Coxiella burnetii RSA 493
cagccugaucaaguuucuccc

SEQ ID NO: 2585321 - RNA, 22 nt, Coxiella burnetii RSA 493
cagcgaaauacgagguuuuuuu

SEQ ID NO: 2585322 - RNA, 20 nt, Coxiella burnetii RSA 493
cagcgaagcgaaauacgggg

SEQ ID NO: 2585323 - RNA, 19 nt, Coxiella burnetii RSA 493
cagcgaagcggaauacgga

SEQ ID NO: 2585324 - RNA, 19 nt, Coxiella burnetii RSA 493
cagcgaauacgaauuucaa

SEQ ID NO: 2585325 - RNA, 23 nt, Coxiella burnetii RSA 493
cagcgagagaauuaaaaauauuu

SEQ ID NO: 2585326 - RNA, 13 nt, Coxiella burnetii RSA 493
cagcgaugaaaaa

SEQ ID NO: 2585327 - RNA, 18 nt, Coxiella burnetii RSA 493
cagcgcacuacgugcgcu

SEQ ID NO: 2585328 - RNA, 21 nt, Coxiella burnetii RSA 493
cagcgggugaugaaaucguuu

SEQ ID NO: 2585329 - RNA, 21 nt, Coxiella burnetii RSA 493
cagcuaauuuagguguaaguc

SEQ ID NO: 2585330 - RNA, 23 nt, Coxiella burnetii RSA 493
cagcuauggaguucuugcuccca

SEQ ID NO: 2585331 - RNA, 13 nt, Coxiella burnetii RSA 493
cagcucuuucaau

SEQ ID NO: 2585332 - RNA, 16 nt, Coxiella burnetii RSA 493
cagcuuaaucaaccuc

SEQ ID NO: 2585333 - RNA, 21 nt, Coxiella burnetii RSA 493
cagcuuauacugcccaagaaa

SEQ ID NO: 2585334 - RNA, 16 nt, Coxiella burnetii RSA 493
cagcuucuuuaaaaua

SEQ ID NO: 2585335 - RNA, 14 nt, Coxiella burnetii RSA 493
cagcuugugcaauu

SEQ ID NO: 2585336 - RNA, 17 nt, Coxiella burnetii RSA 493
cagcuuuccguaaaaca

SEQ ID NO: 2585337 - RNA, 13 nt, Coxiella burnetii RSA 493
caggaaagaaaau

SEQ ID NO: 2585338 - RNA, 15 nt, Coxiella burnetii RSA 493
caggaaaguuccccc

SEQ ID NO: 2585339 - RNA, 11 nt, Coxiella burnetii RSA 493
caggaacaacg

SEQ ID NO: 2585340 - RNA, 11 nt, Coxiella burnetii RSA 493
caggaauugca

SEQ ID NO: 2585341 - RNA, 14 nt, Coxiella burnetii RSA 493
caggacuuaagccc

SEQ ID NO: 2585342 - RNA, 17 nt, Coxiella burnetii RSA 493
caggagcgauaaaauaa

SEQ ID NO: 2585343 - RNA, 21 nt, Coxiella burnetii RSA 493
caggagggugcgauuaaaagu

SEQ ID NO: 2585344 - RNA, 16 nt, Coxiella burnetii RSA 493
caggauaauguuugau

SEQ ID NO: 2585345 - RNA, 22 nt, Coxiella burnetii RSA 493
caggauaauguuugauaucaau

SEQ ID NO: 2585346 - RNA, 16 nt, Coxiella burnetii RSA 493
caggauuuucauuaau

SEQ ID NO: 2585347 - RNA, 11 nt, Coxiella burnetii RSA 493
caggcgccugc

SEQ ID NO: 2585348 - RNA, 16 nt, Coxiella burnetii RSA 493
caggcugcuagaagua

SEQ ID NO: 2585349 - RNA, 12 nt, Coxiella burnetii RSA 493
cagggaaguugu

SEQ ID NO: 2585350 - RNA, 17 nt, Coxiella burnetii RSA 493
cagggcaguaaauagaa

SEQ ID NO: 2585351 - RNA, 19 nt, Coxiella burnetii RSA 493
cagggcccacuuucacaau

SEQ ID NO: 2585352 - RNA, 13 nt, Coxiella burnetii RSA 493
cagggcuauuuua

SEQ ID NO: 2585353 - RNA, 16 nt, Coxiella burnetii RSA 493
cagggguuauaaaauu

SEQ ID NO: 2585354 - RNA, 18 nt, Coxiella burnetii RSA 493
cagguaguuuguuuuuua

SEQ ID NO: 2585355 - RNA, 15 nt, Coxiella burnetii RSA 493
cagguugcuuuugcu

SEQ ID NO: 2585356 - RNA, 17 nt, Coxiella burnetii RSA 493
caucuguaauuuuucuu

SEQ ID NO: 2585357 - RNA, 14 nt, Coxiella burnetii RSA 493
caucugucaucauc

SEQ ID NO: 2585358 - RNA, 14 nt, Coxiella burnetii RSA 493
caucuucauuuucu

SEQ ID NO: 2585359 - RNA, 15 nt, Coxiella burnetii RSA 493
caucuucauuuucug

SEQ ID NO: 2585360 - RNA, 14 nt, Coxiella burnetii RSA 493
caucuugcugcaua

SEQ ID NO: 2585361 - RNA, 16 nt, Coxiella burnetii RSA 493
caucuuuucugaaaca

SEQ ID NO: 2585362 - RNA, 22 nt, Coxiella burnetii RSA 493
caucuuuuucuccuuuucccag

SEQ ID NO: 2585363 - RNA, 12 nt, Coxiella burnetii RSA 493
caugaaaagcag

SEQ ID NO: 2585364 - RNA, 18 nt, Coxiella burnetii RSA 493
caugaaaggaauccuuuu

SEQ ID NO: 2585365 - RNA, 20 nt, Coxiella burnetii RSA 493
caugaaaggaauccuuuuuc

SEQ ID NO: 2585366 - RNA, 14 nt, Coxiella burnetii RSA 493
caugaaauuuuugg

SEQ ID NO: 2585367 - RNA, 17 nt, Coxiella burnetii RSA 493
caugaagcaauugucua

SEQ ID NO: 2585368 - RNA, 20 nt, Coxiella burnetii RSA 493
caugaggagucaucgccaaa

SEQ ID NO: 2585369 - RNA, 22 nt, Coxiella burnetii RSA 493
caugaggagucaucgccaaaag

SEQ ID NO: 2585370 - RNA, 10 nt, Coxiella burnetii RSA 493
caugaggcca

SEQ ID NO: 2585371 - RNA, 15 nt, Coxiella burnetii RSA 493
caugagguugcauga

SEQ ID NO: 2585372 - RNA, 16 nt, Coxiella burnetii RSA 493
caugagguugcaugag

SEQ ID NO: 2585373 - RNA, 12 nt, Coxiella burnetii RSA 493
caugaucgguuu

SEQ ID NO: 2585374 - RNA, 21 nt, Coxiella burnetii RSA 493
caugaucgguuuuuugacugc

SEQ ID NO: 2585375 - RNA, 17 nt, Coxiella burnetii RSA 493
caugcccauaaauaacu

SEQ ID NO: 2585376 - RNA, 18 nt, Coxiella burnetii RSA 493
caugcccauaaauaacuu

SEQ ID NO: 2585377 - RNA, 18 nt, Coxiella burnetii RSA 493
caugccuuuuuugcgcaa

SEQ ID NO: 2585378 - RNA, 23 nt, Coxiella burnetii RSA 493
caugcugcacgccuccagggcuu

SEQ ID NO: 2585379 - RNA, 18 nt, Coxiella burnetii RSA 493
caugcuugaccucgaagc

SEQ ID NO: 2585380 - RNA, 21 nt, Coxiella burnetii RSA 493
caugcuugaccucgaagcaca

SEQ ID NO: 2585381 - RNA, 16 nt, Coxiella burnetii RSA 493
caugguccguuaauuu

SEQ ID NO: 2585382 - RNA, 17 nt, Coxiella burnetii RSA 493
caugguccguuaauuua

SEQ ID NO: 2585383 - RNA, 16 nt, Coxiella burnetii RSA 493
cauguaaucaauugcu

SEQ ID NO: 2585384 - RNA, 18 nt, Coxiella burnetii RSA 493
cauguacguuuuuagugc

SEQ ID NO: 2585385 - RNA, 18 nt, Coxiella burnetii RSA 493
cauguagcccaacaaaau

SEQ ID NO: 2585386 - RNA, 23 nt, Coxiella burnetii RSA 493
caugucguuauugcucaucucua

SEQ ID NO: 2585387 - RNA, 14 nt, Coxiella burnetii RSA 493
cauguuuacauuaa

SEQ ID NO: 2585388 - RNA, 20 nt, Coxiella burnetii RSA 493
cauguuuacauuaaggccaa

SEQ ID NO: 2585389 - RNA, 14 nt, Coxiella burnetii RSA 493
cauuaaaaaauaag

SEQ ID NO: 2585390 - RNA, 17 nt, Coxiella burnetii RSA 493
cauuaaaaaauaagaaa

SEQ ID NO: 2585391 - RNA, 18 nt, Coxiella burnetii RSA 493
cauuaaaaaauaagaaag

SEQ ID NO: 2585392 - RNA, 13 nt, Coxiella burnetii RSA 493
cauuaaaaacaau

SEQ ID NO: 2585393 - RNA, 18 nt, Coxiella burnetii RSA 493
cauuaaauccucuuuaga

SEQ ID NO: 2585394 - RNA, 18 nt, Coxiella burnetii RSA 493
cauuaacgaaucgucuaa

SEQ ID NO: 2585395 - RNA, 18 nt, Coxiella burnetii RSA 493
cauuaauccaguuuuuua

SEQ ID NO: 2585396 - RNA, 12 nt, Coxiella burnetii RSA 493
cauuacauaauu

SEQ ID NO: 2585397 - RNA, 15 nt, Coxiella burnetii RSA 493
cauuaccauuuugac

SEQ ID NO: 2585398 - RNA, 15 nt, Coxiella burnetii RSA 493
cauuaccccaucuac

SEQ ID NO: 2585399 - RNA, 16 nt, Coxiella burnetii RSA 493
cauuagagccuuaucu

SEQ ID NO: 2585400 - RNA, 19 nt, Coxiella burnetii RSA 493
cauuagcuucguuuacuuu

SEQ ID NO: 2585401 - RNA, 17 nt, Coxiella burnetii RSA 493
cauuaucauguucaucc

SEQ ID NO: 2585402 - RNA, 19 nt, Coxiella burnetii RSA 493
cauuaucauguucauccaa

SEQ ID NO: 2585403 - RNA, 22 nt, Coxiella burnetii RSA 493
cauuaucggaugaugcauuaau

SEQ ID NO: 2585404 - RNA, 20 nt, Coxiella burnetii RSA 493
cauuaucuagauuuuccugc

SEQ ID NO: 2585405 - RNA, 14 nt, Coxiella burnetii RSA 493
cauucaagagaggu

SEQ ID NO: 2585406 - RNA, 20 nt, Coxiella burnetii RSA 493
cauucaaggaauuauuuuau

SEQ ID NO: 2585407 - RNA, 20 nt, Coxiella burnetii RSA 493
cauucaauacagauuuuagu

SEQ ID NO: 2585408 - RNA, 22 nt, Coxiella burnetii RSA 493
cauucagggacuuuaagcacuu

SEQ ID NO: 2585409 - RNA, 14 nt, Coxiella burnetii RSA 493
cauucauuaacauu

SEQ ID NO: 2585410 - RNA, 14 nt, Coxiella burnetii RSA 493
cauucauucuuuuu

SEQ ID NO: 2585411 - RNA, 21 nt, Coxiella burnetii RSA 493
cauuccaaaaacagauuuaaa

SEQ ID NO: 2585412 - RNA, 21 nt, Coxiella burnetii RSA 493
cauucccauagaagaacaauu

SEQ ID NO: 2585413 - RNA, 14 nt, Coxiella burnetii RSA 493
cauucccuuuuucg

SEQ ID NO: 2585414 - RNA, 19 nt, Coxiella burnetii RSA 493
cauucgaacgacuuuuuuu

SEQ ID NO: 2585415 - RNA, 17 nt, Coxiella burnetii RSA 493
cauucgcguuuuuaaau

SEQ ID NO: 2585416 - RNA, 21 nt, Coxiella burnetii RSA 493
cauucgcguuuuuaaaugaau

SEQ ID NO: 2585417 - RNA, 11 nt, Coxiella burnetii RSA 493
cauucgcuuuu

SEQ ID NO: 2585418 - RNA, 21 nt, Coxiella burnetii RSA 493
cauucgggcauacgauauaaa

SEQ ID NO: 2585419 - RNA, 13 nt, Coxiella burnetii RSA 493
cauucuaauaaaa

SEQ ID NO: 2585420 - RNA, 21 nt, Coxiella burnetii RSA 493
cauucuagguuauuuuuuccu

SEQ ID NO: 2585421 - RNA, 14 nt, Coxiella burnetii RSA 493
cauucuauaaucau

SEQ ID NO: 2585422 - RNA, 19 nt, Coxiella burnetii RSA 493
cauucugaacgcucuucca

SEQ ID NO: 2585423 - RNA, 18 nt, Coxiella burnetii RSA 493
cauugaaaaccuacuuuu

SEQ ID NO: 2585424 - RNA, 23 nt, Coxiella burnetii RSA 493
cauugaagaauuuguuuugauca

SEQ ID NO: 2585425 - RNA, 15 nt, Coxiella burnetii RSA 493
cauugauaaaccguu

SEQ ID NO: 2585426 - RNA, 14 nt, Coxiella burnetii RSA 493
cauugauaauaauu

SEQ ID NO: 2585427 - RNA, 17 nt, Coxiella burnetii RSA 493
cauugcuuauuaauccu

SEQ ID NO: 2585428 - RNA, 17 nt, Coxiella burnetii RSA 493
cauuggcaguguaaauu

SEQ ID NO: 2585429 - RNA, 20 nt, Coxiella burnetii RSA 493
cauugggccauuuaacaaaa

SEQ ID NO: 2585430 - RNA, 23 nt, Coxiella burnetii RSA 493
cauuggucaaugucagcuuccga

SEQ ID NO: 2585431 - RNA, 13 nt, Coxiella burnetii RSA 493
cauuguggauuau

SEQ ID NO: 2585432 - RNA, 13 nt, Coxiella burnetii RSA 493
cauuguuaaucca

SEQ ID NO: 2585433 - RNA, 16 nt, Coxiella burnetii RSA 493
cauuguucauaaaaua

SEQ ID NO: 2585434 - RNA, 19 nt, Coxiella burnetii RSA 493
cauuguuuucccguauuuc

SEQ ID NO: 2585435 - RNA, 14 nt, Coxiella burnetii RSA 493
cauuuaacaaaaau

SEQ ID NO: 2585436 - RNA, 18 nt, Coxiella burnetii RSA 493
cauuuauuucugcagauu

SEQ ID NO: 2585437 - RNA, 15 nt, Coxiella burnetii RSA 493
cauuucaauauuucu

SEQ ID NO: 2585438 - RNA, 19 nt, Coxiella burnetii RSA 493
cauuucccguauuucgcuu

SEQ ID NO: 2585439 - RNA, 17 nt, Coxiella burnetii RSA 493
cauuuccgcuucaaaca

SEQ ID NO: 2585440 - RNA, 19 nt, Coxiella burnetii RSA 493
cauuucgagcgcgauuuuc

SEQ ID NO: 2585441 - RNA, 23 nt, Coxiella burnetii RSA 493
cauuucgagcgcgauuuucucuu

SEQ ID NO: 2585442 - RNA, 16 nt, Coxiella burnetii RSA 493
cauuucggacaacaaa

SEQ ID NO: 2585443 - RNA, 12 nt, Coxiella burnetii RSA 493
cauuuggccaaa

SEQ ID NO: 2585444 - RNA, 16 nt, Coxiella burnetii RSA 493
cauuuggccaaacuaa

SEQ ID NO: 2585445 - RNA, 20 nt, Coxiella burnetii RSA 493
cauuuggccaaacuaaucug

SEQ ID NO: 2585446 - RNA, 23 nt, Coxiella burnetii RSA 493
cauuuguauggcgccugacaaag

SEQ ID NO: 2585447 - RNA, 15 nt, Coxiella burnetii RSA 493
cauuuguucuaucaa

SEQ ID NO: 2585448 - RNA, 16 nt, Coxiella burnetii RSA 493
cauuuguuuaaagcug

SEQ ID NO: 2585449 - RNA, 19 nt, Coxiella burnetii RSA 493
cauuuugauuuuuuaauuc

SEQ ID NO: 2585450 - RNA, 12 nt, Coxiella burnetii RSA 493
cauuuuguauug

SEQ ID NO: 2585451 - RNA, 16 nt, Coxiella burnetii RSA 493
cauuuuuaugcuucaa

SEQ ID NO: 2585452 - RNA, 22 nt, Coxiella burnetii RSA 493
cauuuuuaugcuucaauaaaaa

SEQ ID NO: 2585453 - RNA, 23 nt, Coxiella burnetii RSA 493
cauuuuuaugcuucaauaaaaaa

SEQ ID NO: 2585454 - RNA, 11 nt, Coxiella burnetii RSA 493
cauuuuucgca

SEQ ID NO: 2585455 - RNA, 13 nt, Coxiella burnetii RSA 493
cauuuuuguaaau

SEQ ID NO: 2585456 - RNA, 14 nt, Coxiella burnetii RSA 493
cauuuuuuauaaaa

SEQ ID NO: 2585457 - RNA, 19 nt, Coxiella burnetii RSA 493
cauuuuuuauaaaauuuaa

SEQ ID NO: 2585458 - RNA, 11 nt, Coxiella burnetii RSA 493
cauuuuuucaa

SEQ ID NO: 2585459 - RNA, 14 nt, Coxiella burnetii RSA 493
cauuuuuuccucuu

SEQ ID NO: 2585460 - RNA, 22 nt, Coxiella burnetii RSA 493
cauuuuuuugucgaauuuuugc

SEQ ID NO: 2585461 - RNA, 17 nt, Coxiella burnetii RSA 493
ccaaaaaacuuagccaa

SEQ ID NO: 2585462 - RNA, 16 nt, Coxiella burnetii RSA 493
ccaugagugccacaaa

SEQ ID NO: 2585463 - RNA, 13 nt, Coxiella burnetii RSA 493
ccaugucuugaac

SEQ ID NO: 2585464 - RNA, 20 nt, Coxiella burnetii RSA 493
ccauguuauuuuccucccau

SEQ ID NO: 2585465 - RNA, 11 nt, Coxiella burnetii RSA 493
ccauuaaaagc

SEQ ID NO: 2585466 - RNA, 18 nt, Coxiella burnetii RSA 493
ccauuaaugauaauuucu

SEQ ID NO: 2585467 - RNA, 21 nt, Coxiella burnetii RSA 493
ccauuacauaauuuaaacuca

SEQ ID NO: 2585468 - RNA, 21 nt, Coxiella burnetii RSA 493
ccauucgcguuuuuaaaugaa

SEQ ID NO: 2585469 - RNA, 15 nt, Coxiella burnetii RSA 493
ccauugauaauaauu

SEQ ID NO: 2585470 - RNA, 23 nt, Coxiella burnetii RSA 493
ccauugucucguuagaaaagcgc

SEQ ID NO: 2585471 - RNA, 15 nt, Coxiella burnetii RSA 493
ccauuguuuugcauc

SEQ ID NO: 2585472 - RNA, 21 nt, Coxiella burnetii RSA 493
ccauuguuuugcauccgaacu

SEQ ID NO: 2585473 - RNA, 14 nt, Coxiella burnetii RSA 493
ccauuuaacaaaaa

SEQ ID NO: 2585474 - RNA, 18 nt, Coxiella burnetii RSA 493
ccauuuagaaaaaauacc

SEQ ID NO: 2585475 - RNA, 18 nt, Coxiella burnetii RSA 493
ccauuugcggaaaaggag

SEQ ID NO: 2585476 - RNA, 17 nt, Coxiella burnetii RSA 493
ccauuuuaagagagucu

SEQ ID NO: 2585477 - RNA, 12 nt, Coxiella burnetii RSA 493
ccauuuuccuca

SEQ ID NO: 2585478 - RNA, 12 nt, Coxiella burnetii RSA 493
ccauuuuuucgu

SEQ ID NO: 2585479 - RNA, 22 nt, Coxiella burnetii RSA 493
cccaaaguuucacgaauuaaaa

SEQ ID NO: 2585480 - RNA, 14 nt, Coxiella burnetii RSA 493
cccaacaaaauggu

SEQ ID NO: 2585481 - RNA, 15 nt, Coxiella burnetii RSA 493
cccaaggaaucuauu

SEQ ID NO: 2585482 - RNA, 18 nt, Coxiella burnetii RSA 493
cccacgaugauuaaauca

SEQ ID NO: 2585483 - RNA, 19 nt, Coxiella burnetii RSA 493
cccacggcaaauaaaggcg

SEQ ID NO: 2585484 - RNA, 17 nt, Coxiella burnetii RSA 493
cccacuuguaaugugag

SEQ ID NO: 2585485 - RNA, 13 nt, Coxiella burnetii RSA 493
cccagcuauggag

SEQ ID NO: 2585486 - RNA, 21 nt, Coxiella burnetii RSA 493
cccagguaguaauuucuuccu

SEQ ID NO: 2585487 - RNA, 16 nt, Coxiella burnetii RSA 493
cccauaagcggguuau

SEQ ID NO: 2585488 - RNA, 18 nt, Coxiella burnetii RSA 493
cccaucucgaaauuauuu

SEQ ID NO: 2585489 - RNA, 15 nt, Coxiella burnetii RSA 493
cccaugagguugcau

SEQ ID NO: 2585490 - RNA, 23 nt, Coxiella burnetii RSA 493
cccauguccauccgcuaacgucu

SEQ ID NO: 2585491 - RNA, 18 nt, Coxiella burnetii RSA 493
cccaugucguuauugcuc

SEQ ID NO: 2585492 - RNA, 21 nt, Coxiella burnetii RSA 493
cccauucaaggaauuauuuua

SEQ ID NO: 2585493 - RNA, 23 nt, Coxiella burnetii RSA 493
cccauucuauaaucauuuuuccu

SEQ ID NO: 2585494 - RNA, 22 nt, Coxiella burnetii RSA 493
cccauuugccgccaggcuucau

SEQ ID NO: 2585495 - RNA, 23 nt, Coxiella burnetii RSA 493
ccccaaaggugucaaaauuauuc

SEQ ID NO: 2585496 - RNA, 14 nt, Coxiella burnetii RSA 493
ccccaaaguuucac

SEQ ID NO: 2585497 - RNA, 12 nt, Coxiella burnetii RSA 493
ccccaagagaac

SEQ ID NO: 2585498 - RNA, 13 nt, Coxiella burnetii RSA 493
cccccaaaaacua

SEQ ID NO: 2585499 - RNA, 21 nt, Coxiella burnetii RSA 493
cccccaauuccucgagucguu

SEQ ID NO: 2585500 - RNA, 13 nt, Coxiella burnetii RSA 493
ccccccgccgcaa

SEQ ID NO: 2585501 - RNA, 15 nt, Coxiella burnetii RSA 493
cccccgcuguuuaua

SEQ ID NO: 2585502 - RNA, 15 nt, Coxiella burnetii RSA 493
ccccguauuucgcuu

SEQ ID NO: 2585503 - RNA, 12 nt, Coxiella burnetii RSA 493
ccccguuaccaa

SEQ ID NO: 2585504 - RNA, 17 nt, Coxiella burnetii RSA 493
ccccugucgauacccaa

SEQ ID NO: 2585505 - RNA, 14 nt, Coxiella burnetii RSA 493
cccgagcaaagcau

SEQ ID NO: 2585506 - RNA, 13 nt, Coxiella burnetii RSA 493
cccgcagcgccca

SEQ ID NO: 2585507 - RNA, 15 nt, Coxiella burnetii RSA 493
cccgccaggcuauga

SEQ ID NO: 2585508 - RNA, 22 nt, Coxiella burnetii RSA 493
cccgccccauuuuuguaaauua

SEQ ID NO: 2585509 - RNA, 22 nt, Coxiella burnetii RSA 493
cccgcgacgggcuguacauuuu

SEQ ID NO: 2585510 - RNA, 13 nt, Coxiella burnetii RSA 493
cccgcuuaaaccc

SEQ ID NO: 2585511 - RNA, 12 nt, Coxiella burnetii RSA 493
cccguaacugcu

SEQ ID NO: 2585512 - RNA, 16 nt, Coxiella burnetii RSA 493
cccguaucaccaaaau

SEQ ID NO: 2585513 - RNA, 11 nt, Coxiella burnetii RSA 493
cccguaugagc

SEQ ID NO: 2585514 - RNA, 23 nt, Coxiella burnetii RSA 493
cccguaugagcgaacgaauacgg

SEQ ID NO: 2585515 - RNA, 18 nt, Coxiella burnetii RSA 493
cccguaugagcgaagcga

SEQ ID NO: 2585516 - RNA, 15 nt, Coxiella burnetii RSA 493
cccguauuucgcuuc

SEQ ID NO: 2585517 - RNA, 22 nt, Coxiella burnetii RSA 493
cccguauuucgcuucgcuacau

SEQ ID NO: 2585518 - RNA, 21 nt, Coxiella burnetii RSA 493
cccguauuucgcuucgcucag

SEQ ID NO: 2585519 - RNA, 21 nt, Coxiella burnetii RSA 493
cccguauuucgcuucgcugca

SEQ ID NO: 2585520 - RNA, 22 nt, Coxiella burnetii RSA 493
cccguauuucgcuucgcugcau

SEQ ID NO: 2585521 - RNA, 16 nt, Coxiella burnetii RSA 493
cccgucugggauggua

SEQ ID NO: 2585522 - RNA, 21 nt, Coxiella burnetii RSA 493
cccguuccaauauuuucggau

SEQ ID NO: 2585523 - RNA, 19 nt, Coxiella burnetii RSA 493
cccucaucuccgcaggcgg

SEQ ID NO: 2585524 - RNA, 19 nt, Coxiella burnetii RSA 493
cccucuacaauaaacacau

SEQ ID NO: 2585525 - RNA, 21 nt, Coxiella burnetii RSA 493
cccucuuuaccccgcucccuu

SEQ ID NO: 2585526 - RNA, 12 nt, Coxiella burnetii RSA 493
cccugcaacggu

SEQ ID NO: 2585527 - RNA, 14 nt, Coxiella burnetii RSA 493
cccuggugguuauu

SEQ ID NO: 2585528 - RNA, 19 nt, Coxiella burnetii RSA 493
cccuguaucccuuaaauca

SEQ ID NO: 2585529 - RNA, 20 nt, Coxiella burnetii RSA 493
cccuuuucauuaagcaauuu

SEQ ID NO: 2585530 - RNA, 14 nt, Coxiella burnetii RSA 493
cccuuuuuuuccau

SEQ ID NO: 2585531 - RNA, 23 nt, Coxiella burnetii RSA 493
ccgacaauucccccaaaaacuaa

SEQ ID NO: 2585532 - RNA, 22 nt, Coxiella burnetii RSA 493
ccgacauggcgguaaugagaac

SEQ ID NO: 2585533 - RNA, 17 nt, Coxiella burnetii RSA 493
ccgacgacauuaaaaau

SEQ ID NO: 2585534 - RNA, 19 nt, Coxiella burnetii RSA 493
ccgagcccaauaacaagcu

SEQ ID NO: 2585535 - RNA, 22 nt, Coxiella burnetii RSA 493
ccgaguccguaauagucuugau

SEQ ID NO: 2585536 - RNA, 16 nt, Coxiella burnetii RSA 493
ccgauaaguuuuuaac

SEQ ID NO: 2585537 - RNA, 11 nt, Coxiella burnetii RSA 493
ccgauaauaug

SEQ ID NO: 2585538 - RNA, 21 nt, Coxiella burnetii RSA 493
ccgauaauccgccgguacccc

SEQ ID NO: 2585539 - RNA, 18 nt, Coxiella burnetii RSA 493
ccgauacuuuguuuuuuu

SEQ ID NO: 2585540 - RNA, 17 nt, Coxiella burnetii RSA 493
ccgaugacaaauaaaca

SEQ ID NO: 2585541 - RNA, 18 nt, Coxiella burnetii RSA 493
ccgcacaaacgcgcccgc

SEQ ID NO: 2585542 - RNA, 22 nt, Coxiella burnetii RSA 493
ccgcagaagaaggcucuucaua

SEQ ID NO: 2585543 - RNA, 21 nt, Coxiella burnetii RSA 493
ccgcagccgaagugcuaaaaa

SEQ ID NO: 2585544 - RNA, 13 nt, Coxiella burnetii RSA 493
ccgccaaaaggga

SEQ ID NO: 2585545 - RNA, 14 nt, Coxiella burnetii RSA 493
ccgccuacgcggga

SEQ ID NO: 2585546 - RNA, 23 nt, Coxiella burnetii RSA 493
ccgcuauacugcuuguaccugcc

SEQ ID NO: 2585547 - RNA, 15 nt, Coxiella burnetii RSA 493
ccgcucgcuugaaaa

SEQ ID NO: 2585548 - RNA, 14 nt, Coxiella burnetii RSA 493
ccgcugauauuccc

SEQ ID NO: 2585549 - RNA, 13 nt, Coxiella burnetii RSA 493
ccgcugccuuuac

SEQ ID NO: 2585550 - RNA, 15 nt, Coxiella burnetii RSA 493
ccgcuggcuuugauu

SEQ ID NO: 2585551 - RNA, 20 nt, Coxiella burnetii RSA 493
ccgcuuugcuccauacgggc

SEQ ID NO: 2585552 - RNA, 16 nt, Coxiella burnetii RSA 493
ccgcuuuuuguuugau

SEQ ID NO: 2585553 - RNA, 16 nt, Coxiella burnetii RSA 493
ccggaucgcauugaag

SEQ ID NO: 2585554 - RNA, 12 nt, Coxiella burnetii RSA 493
ccggauuuuaau

SEQ ID NO: 2585555 - RNA, 20 nt, Coxiella burnetii RSA 493
ccggcuugcgguucaugaaa

SEQ ID NO: 2585556 - RNA, 20 nt, Coxiella burnetii RSA 493
ccgguuuugauuuuugcucu

SEQ ID NO: 2585557 - RNA, 16 nt, Coxiella burnetii RSA 493
ccguaaccaaaacuau

SEQ ID NO: 2585558 - RNA, 13 nt, Coxiella burnetii RSA 493
ccguaucuauuug

SEQ ID NO: 2585559 - RNA, 18 nt, Coxiella burnetii RSA 493
ccguaugagcgaagcgaa

SEQ ID NO: 2585560 - RNA, 19 nt, Coxiella burnetii RSA 493
ccguaugcagcgaagcgaa

SEQ ID NO: 2585561 - RNA, 19 nt, Coxiella burnetii RSA 493
ccguaugcagcgaagcgga

SEQ ID NO: 2585562 - RNA, 22 nt, Coxiella burnetii RSA 493
ccguauuccgcuuugcuccaua

SEQ ID NO: 2585563 - RNA, 18 nt, Coxiella burnetii RSA 493
ccguauuucgcuucgcua

SEQ ID NO: 2585564 - RNA, 20 nt, Coxiella burnetii RSA 493
ccguauuucgcuucgcucag

SEQ ID NO: 2585565 - RNA, 21 nt, Coxiella burnetii RSA 493
ccguauuucgcuucgcucaua

SEQ ID NO: 2585566 - RNA, 21 nt, Coxiella burnetii RSA 493
ccguauuucgcuucgcuccau

SEQ ID NO: 2585567 - RNA, 13 nt, Coxiella burnetii RSA 493
ccuuuuuguaauc

SEQ ID NO: 2585568 - RNA, 11 nt, Coxiella burnetii RSA 493
ccuuuuuuaaa

SEQ ID NO: 2585569 - RNA, 20 nt, Coxiella burnetii RSA 493
cgaaaacuaguuauuuuuaa

SEQ ID NO: 2585570 - RNA, 15 nt, Coxiella burnetii RSA 493
cgaaaagauuccaau

SEQ ID NO: 2585571 - RNA, 22 nt, Coxiella burnetii RSA 493
cgaaaagccccuuugcggcuaa

SEQ ID NO: 2585572 - RNA, 15 nt, Coxiella burnetii RSA 493
cgaaaagucguguua

SEQ ID NO: 2585573 - RNA, 21 nt, Coxiella burnetii RSA 493
cgaaaauaccuuugcaaacau

SEQ ID NO: 2585574 - RNA, 15 nt, Coxiella burnetii RSA 493
cgaaaaucgaauucc

SEQ ID NO: 2585575 - RNA, 15 nt, Coxiella burnetii RSA 493
cgaaaauugucgaua

SEQ ID NO: 2585576 - RNA, 17 nt, Coxiella burnetii RSA 493
cgaaagcuaaaaaagaa

SEQ ID NO: 2585577 - RNA, 12 nt, Coxiella burnetii RSA 493
cgaaauacggga

SEQ ID NO: 2585578 - RNA, 22 nt, Coxiella burnetii RSA 493
cgaaauugacccuuuucaauuu

SEQ ID NO: 2585579 - RNA, 11 nt, Coxiella burnetii RSA 493
cgaaauuuaac

SEQ ID NO: 2585580 - RNA, 22 nt, Coxiella burnetii RSA 493
cgaaauuuguuauugcuaaaau

SEQ ID NO: 2585581 - RNA, 13 nt, Coxiella burnetii RSA 493
cgaaccacuggaa

SEQ ID NO: 2585582 - RNA, 15 nt, Coxiella burnetii RSA 493
cgaacgacuuuuuuu

SEQ ID NO: 2585583 - RNA, 15 nt, Coxiella burnetii RSA 493
cgaacuuuccaaacu

SEQ ID NO: 2585584 - RNA, 12 nt, Coxiella burnetii RSA 493
cgaagcccaaca

SEQ ID NO: 2585585 - RNA, 17 nt, Coxiella burnetii RSA 493
cgaagcgaaauacggga

SEQ ID NO: 2585586 - RNA, 19 nt, Coxiella burnetii RSA 493
cgaagcgaaauacggggaa

SEQ ID NO: 2585587 - RNA, 20 nt, Coxiella burnetii RSA 493
cgaagcgaaauacggggaca

SEQ ID NO: 2585588 - RNA, 20 nt, Coxiella burnetii RSA 493
cgaagcggaauacggagaaa

SEQ ID NO: 2585589 - RNA, 22 nt, Coxiella burnetii RSA 493
cgaaggugauucucucaaagaa

SEQ ID NO: 2585590 - RNA, 13 nt, Coxiella burnetii RSA 493
cgaauaacggaaa

SEQ ID NO: 2585591 - RNA, 14 nt, Coxiella burnetii RSA 493
cgaauacgaauuuc

SEQ ID NO: 2585592 - RNA, 19 nt, Coxiella burnetii RSA 493
cgaaucaaguccaauuaua

SEQ ID NO: 2585593 - RNA, 15 nt, Coxiella burnetii RSA 493
cgaauccucucaccc

SEQ ID NO: 2585594 - RNA, 14 nt, Coxiella burnetii RSA 493
cgaaucgucuaaaa

SEQ ID NO: 2585595 - RNA, 22 nt, Coxiella burnetii RSA 493
cgaaucucguuucccgcuccag

SEQ ID NO: 2585596 - RNA, 16 nt, Coxiella burnetii RSA 493
cgaaugguugaaagaa

SEQ ID NO: 2585597 - RNA, 17 nt, Coxiella burnetii RSA 493
cgaaugguugaaagaaa

SEQ ID NO: 2585598 - RNA, 21 nt, Coxiella burnetii RSA 493
cgaaugguugaaagaaaaaaa

SEQ ID NO: 2585599 - RNA, 13 nt, Coxiella burnetii RSA 493
cgaauuaaaaaau

SEQ ID NO: 2585600 - RNA, 19 nt, Coxiella burnetii RSA 493
cgacaauaaaagcgccugc

SEQ ID NO: 2585601 - RNA, 16 nt, Coxiella burnetii RSA 493
cgacaaucauuuuugu

SEQ ID NO: 2585602 - RNA, 19 nt, Coxiella burnetii RSA 493
cgacacaaccacuguccuc

SEQ ID NO: 2585603 - RNA, 23 nt, Coxiella burnetii RSA 493
cgacauaggagauuuuuaugaaa

SEQ ID NO: 2585604 - RNA, 21 nt, Coxiella burnetii RSA 493
cgacaucggcuuuuucaagcu

SEQ ID NO: 2585605 - RNA, 14 nt, Coxiella burnetii RSA 493
cgaccuucuuuuuu

SEQ ID NO: 2585606 - RNA, 15 nt, Coxiella burnetii RSA 493
cgacgaucacccacg

SEQ ID NO: 2585607 - RNA, 16 nt, Coxiella burnetii RSA 493
cgacuaauagcucaua

SEQ ID NO: 2585608 - RNA, 17 nt, Coxiella burnetii RSA 493
cgacuucucuuucugag

SEQ ID NO: 2585609 - RNA, 16 nt, Coxiella burnetii RSA 493
cgacuuugauaaauua

SEQ ID NO: 2585610 - RNA, 13 nt, Coxiella burnetii RSA 493
cgacuuuuuucuu

SEQ ID NO: 2585611 - RNA, 17 nt, Coxiella burnetii RSA 493
cgagaauauauucauau

SEQ ID NO: 2585612 - RNA, 17 nt, Coxiella burnetii RSA 493
cgagaguaacgauuucu

SEQ ID NO: 2585613 - RNA, 21 nt, Coxiella burnetii RSA 493
cgagcccaauaacaagcuccc

SEQ ID NO: 2585614 - RNA, 12 nt, Coxiella burnetii RSA 493
cgagcgcccauu

SEQ ID NO: 2585615 - RNA, 20 nt, Coxiella burnetii RSA 493
cgagcuuuucacccaaccaa

SEQ ID NO: 2585616 - RNA, 13 nt, Coxiella burnetii RSA 493
cgaggaaagauaa

SEQ ID NO: 2585617 - RNA, 19 nt, Coxiella burnetii RSA 493
cgaggaggguaagaauaaa

SEQ ID NO: 2585618 - RNA, 22 nt, Coxiella burnetii RSA 493
cgaggaggguaagaauaaacuu

SEQ ID NO: 2585619 - RNA, 15 nt, Coxiella burnetii RSA 493
cgaggcaaaauaaac

SEQ ID NO: 2585620 - RNA, 14 nt, Coxiella burnetii RSA 493
cgagggguuuuuuu

SEQ ID NO: 2585621 - RNA, 17 nt, Coxiella burnetii RSA 493
cgaggguaauaaaguaa

SEQ ID NO: 2585622 - RNA, 15 nt, Coxiella burnetii RSA 493
cgagucaaaaauaaa

SEQ ID NO: 2585623 - RNA, 13 nt, Coxiella burnetii RSA 493
cgaguccuauuug

SEQ ID NO: 2585624 - RNA, 13 nt, Coxiella burnetii RSA 493
cgagugcgcccgu

SEQ ID NO: 2585625 - RNA, 20 nt, Coxiella burnetii RSA 493
cgauaaaaacaaagugaaau

SEQ ID NO: 2585626 - RNA, 14 nt, Coxiella burnetii RSA 493
cgauaaaaauaaug

SEQ ID NO: 2585627 - RNA, 14 nt, Coxiella burnetii RSA 493
cgauaaauuuugaa

SEQ ID NO: 2585628 - RNA, 23 nt, Coxiella burnetii RSA 493
cgauaaugcacaucagcguaaau

SEQ ID NO: 2585629 - RNA, 19 nt, Coxiella burnetii RSA 493
cgauagaccaucguuuuau

SEQ ID NO: 2585630 - RNA, 15 nt, Coxiella burnetii RSA 493
cgauagcgucuuuuu

SEQ ID NO: 2585631 - RNA, 16 nt, Coxiella burnetii RSA 493
cgauagcgucuuuuuu

SEQ ID NO: 2585632 - RNA, 18 nt, Coxiella burnetii RSA 493
cgauaucgugcucuuuuu

SEQ ID NO: 2585633 - RNA, 12 nt, Coxiella burnetii RSA 493
cgauauucuuuu

SEQ ID NO: 2585634 - RNA, 16 nt, Coxiella burnetii RSA 493
cgaucaacaaaauaua

SEQ ID NO: 2585635 - RNA, 15 nt, Coxiella burnetii RSA 493
cgaucaguuuguccu

SEQ ID NO: 2585636 - RNA, 21 nt, Coxiella burnetii RSA 493
cgauccgagcccaauaacaag

SEQ ID NO: 2585637 - RNA, 15 nt, Coxiella burnetii RSA 493
cgauccgucgcuuug

SEQ ID NO: 2585638 - RNA, 19 nt, Coxiella burnetii RSA 493
cgaucuauauuaauuugau

SEQ ID NO: 2585639 - RNA, 20 nt, Coxiella burnetii RSA 493
cgaugacccucuuuuuaaaa

SEQ ID NO: 2585640 - RNA, 23 nt, Coxiella burnetii RSA 493
cgaugacccucuuuuuaaaaaau

SEQ ID NO: 2585641 - RNA, 19 nt, Coxiella burnetii RSA 493
cgaugauucccaccaaaau

SEQ ID NO: 2585642 - RNA, 22 nt, Coxiella burnetii RSA 493
cgaugcaauuagcgacccagcc

SEQ ID NO: 2585643 - RNA, 14 nt, Coxiella burnetii RSA 493
cgaugcacucuuua

SEQ ID NO: 2585644 - RNA, 23 nt, Coxiella burnetii RSA 493
cgaugcgccggcguuugcacaua

SEQ ID NO: 2585645 - RNA, 15 nt, Coxiella burnetii RSA 493
cgauuaacaacgaaa

SEQ ID NO: 2585646 - RNA, 19 nt, Coxiella burnetii RSA 493
cgauucauaaaaaaugauu

SEQ ID NO: 2585647 - RNA, 22 nt, Coxiella burnetii RSA 493
cgauucauuccgcggcgcucaa

SEQ ID NO: 2585648 - RNA, 14 nt, Coxiella burnetii RSA 493
cgauuccaaagcag

SEQ ID NO: 2585649 - RNA, 12 nt, Coxiella burnetii RSA 493
cgauucuuuuuc

SEQ ID NO: 2585650 - RNA, 21 nt, Coxiella burnetii RSA 493
cgauuuauugcuuaucgcaga

SEQ ID NO: 2585651 - RNA, 21 nt, Coxiella burnetii RSA 493
cgauuucccggcugugaauua

SEQ ID NO: 2585652 - RNA, 19 nt, Coxiella burnetii RSA 493
cgauuucucuuaccauggu

SEQ ID NO: 2585653 - RNA, 12 nt, Coxiella burnetii RSA 493
cgauuucuuuuu

SEQ ID NO: 2585654 - RNA, 16 nt, Coxiella burnetii RSA 493
cgauuucuuuuugugu

SEQ ID NO: 2585655 - RNA, 20 nt, Coxiella burnetii RSA 493
cgauuucuuuuuguguugau

SEQ ID NO: 2585656 - RNA, 18 nt, Coxiella burnetii RSA 493
cgauuuguuucaugcuca

SEQ ID NO: 2585657 - RNA, 15 nt, Coxiella burnetii RSA 493
cgauuuuacaauaau

SEQ ID NO: 2585658 - RNA, 13 nt, Coxiella burnetii RSA 493
cgauuuuucucau

SEQ ID NO: 2585659 - RNA, 16 nt, Coxiella burnetii RSA 493
cgcaaacagugccccu

SEQ ID NO: 2585660 - RNA, 16 nt, Coxiella burnetii RSA 493
cgcaaagcucagccca

SEQ ID NO: 2585661 - RNA, 14 nt, Coxiella burnetii RSA 493
cgcaagaaucucca

SEQ ID NO: 2585662 - RNA, 20 nt, Coxiella burnetii RSA 493
cgcaagugaccgagauuuuu

SEQ ID NO: 2585663 - RNA, 20 nt, Coxiella burnetii RSA 493
cgcaauacgccgcugcucau

SEQ ID NO: 2585664 - RNA, 13 nt, Coxiella burnetii RSA 493
cgcaauaugcagc

SEQ ID NO: 2585665 - RNA, 17 nt, Coxiella burnetii RSA 493
cgcaauccucgcguuuu

SEQ ID NO: 2585666 - RNA, 12 nt, Coxiella burnetii RSA 493
cgcaauccucuc

SEQ ID NO: 2585667 - RNA, 15 nt, Coxiella burnetii RSA 493
cgcacaaacgcgccc

SEQ ID NO: 2585668 - RNA, 21 nt, Coxiella burnetii RSA 493
cgcacaaacgcgcccgcccca

SEQ ID NO: 2585669 - RNA, 15 nt, Coxiella burnetii RSA 493
cgcacgguaauaaua

SEQ ID NO: 2585670 - RNA, 13 nt, Coxiella burnetii RSA 493
cgcacuacgugcg

SEQ ID NO: 2585671 - RNA, 22 nt, Coxiella burnetii RSA 493
cgcagaagaaggcucuucauau

SEQ ID NO: 2585672 - RNA, 22 nt, Coxiella burnetii RSA 493
cgcagcaaaaugagggggagcc

SEQ ID NO: 2585673 - RNA, 12 nt, Coxiella burnetii RSA 493
cggcuuuuucaa

SEQ ID NO: 2585674 - RNA, 14 nt, Coxiella burnetii RSA 493
cgggaaauaaaauu

SEQ ID NO: 2585675 - RNA, 15 nt, Coxiella burnetii RSA 493
cgggaaauaaaauua

SEQ ID NO: 2585676 - RNA, 20 nt, Coxiella burnetii RSA 493
cgggaagggcgaggguaaua

SEQ ID NO: 2585677 - RNA, 14 nt, Coxiella burnetii RSA 493
cgggaauagcucag

SEQ ID NO: 2585678 - RNA, 15 nt, Coxiella burnetii RSA 493
cgggaauguuuuuua

SEQ ID NO: 2585679 - RNA, 15 nt, Coxiella burnetii RSA 493
cgggaugauuuuucc

SEQ ID NO: 2585680 - RNA, 19 nt, Coxiella burnetii RSA 493
cgggcggcaacucuacuuc

SEQ ID NO: 2585681 - RNA, 17 nt, Coxiella burnetii RSA 493
cgggcuacucuuuuucu

SEQ ID NO: 2585682 - RNA, 16 nt, Coxiella burnetii RSA 493
cgggguucuguaaguu

SEQ ID NO: 2585683 - RNA, 18 nt, Coxiella burnetii RSA 493
cggguuuacauaagaaac

SEQ ID NO: 2585684 - RNA, 11 nt, Coxiella burnetii RSA 493
cgguaauaaua

SEQ ID NO: 2585685 - RNA, 13 nt, Coxiella burnetii RSA 493
cgguaaugagaac

SEQ ID NO: 2585686 - RNA, 17 nt, Coxiella burnetii RSA 493
cgguaaugagaaccauu

SEQ ID NO: 2585687 - RNA, 14 nt, Coxiella burnetii RSA 493
cgguacuuaagaaa

SEQ ID NO: 2585688 - RNA, 15 nt, Coxiella burnetii RSA 493
cgguacuuaagaaag

SEQ ID NO: 2585689 - RNA, 21 nt, Coxiella burnetii RSA 493
cgguagaaugauaccaucagg

SEQ ID NO: 2585690 - RNA, 19 nt, Coxiella burnetii RSA 493
cgguauaaaauuuuauucu

SEQ ID NO: 2585691 - RNA, 20 nt, Coxiella burnetii RSA 493
cgguauuuugcaaaugaaua

SEQ ID NO: 2585692 - RNA, 20 nt, Coxiella burnetii RSA 493
cggucaccgcgucaccgguu

SEQ ID NO: 2585693 - RNA, 20 nt, Coxiella burnetii RSA 493
cggucuugggaggcauucug

SEQ ID NO: 2585694 - RNA, 15 nt, Coxiella burnetii RSA 493
cggugcgauuuuccg

SEQ ID NO: 2585695 - RNA, 18 nt, Coxiella burnetii RSA 493
cgguuaauagcaucaagg

SEQ ID NO: 2585696 - RNA, 12 nt, Coxiella burnetii RSA 493
cgguucaugaaa

SEQ ID NO: 2585697 - RNA, 14 nt, Coxiella burnetii RSA 493
cgguucaugaaaaa

SEQ ID NO: 2585698 - RNA, 14 nt, Coxiella burnetii RSA 493
cgguucccgcuucc

SEQ ID NO: 2585699 - RNA, 17 nt, Coxiella burnetii RSA 493
cgguugaagaaauacga

SEQ ID NO: 2585700 - RNA, 15 nt, Coxiella burnetii RSA 493
cgguuuuucuucauu

SEQ ID NO: 2585701 - RNA, 20 nt, Coxiella burnetii RSA 493
cgguuuuuuuaaaaaagaaa

SEQ ID NO: 2585702 - RNA, 21 nt, Coxiella burnetii RSA 493
cgguuuuuuuaaaaaagaaaa

SEQ ID NO: 2585703 - RNA, 13 nt, Coxiella burnetii RSA 493
cgguuuuuuucuu

SEQ ID NO: 2585704 - RNA, 17 nt, Coxiella burnetii RSA 493
cgguuuuuuucuuuuug

SEQ ID NO: 2585705 - RNA, 12 nt, Coxiella burnetii RSA 493
cguaaaauucca

SEQ ID NO: 2585706 - RNA, 18 nt, Coxiella burnetii RSA 493
cguaaaccuccaaaaacu

SEQ ID NO: 2585707 - RNA, 20 nt, Coxiella burnetii RSA 493
cguaacgauggucaaaccaa

SEQ ID NO: 2585708 - RNA, 19 nt, Coxiella burnetii RSA 493
cguaacugauguauccuaa

SEQ ID NO: 2585709 - RNA, 15 nt, Coxiella burnetii RSA 493
cguaagcacaaaagu

SEQ ID NO: 2585710 - RNA, 22 nt, Coxiella burnetii RSA 493
cguaagcacaaaaguggggaua

SEQ ID NO: 2585711 - RNA, 15 nt, Coxiella burnetii RSA 493
cguaagcguugaaag

SEQ ID NO: 2585712 - RNA, 14 nt, Coxiella burnetii RSA 493
cguaaucuuuaaca

SEQ ID NO: 2585713 - RNA, 22 nt, Coxiella burnetii RSA 493
cguaauuauuaagccuuaauca

SEQ ID NO: 2585714 - RNA, 20 nt, Coxiella burnetii RSA 493
cguaauucuugcagugaaau

SEQ ID NO: 2585715 - RNA, 19 nt, Coxiella burnetii RSA 493
cguaauuuuaacgaccgug

SEQ ID NO: 2585716 - RNA, 17 nt, Coxiella burnetii RSA 493
cguacaagugcuuccaa

SEQ ID NO: 2585717 - RNA, 12 nt, Coxiella burnetii RSA 493
cguaccacgcug

SEQ ID NO: 2585718 - RNA, 19 nt, Coxiella burnetii RSA 493
cguacugacguuugagagg

SEQ ID NO: 2585719 - RNA, 17 nt, Coxiella burnetii RSA 493
cguagcgacacaaccac

SEQ ID NO: 2585720 - RNA, 17 nt, Coxiella burnetii RSA 493
cguauaaaugaauaaua

SEQ ID NO: 2585721 - RNA, 17 nt, Coxiella burnetii RSA 493
cguaucgauuucuuuuu

SEQ ID NO: 2585722 - RNA, 13 nt, Coxiella burnetii RSA 493
cguaugaauaauu

SEQ ID NO: 2585723 - RNA, 14 nt, Coxiella burnetii RSA 493
cguaugaauaauuu

SEQ ID NO: 2585724 - RNA, 18 nt, Coxiella burnetii RSA 493
cguaugagcgaacgaaua

SEQ ID NO: 2585725 - RNA, 21 nt, Coxiella burnetii RSA 493
cguaugcagcgaagcgaaaua

SEQ ID NO: 2585726 - RNA, 20 nt, Coxiella burnetii RSA 493
cguaugcagcgaagcggaau

SEQ ID NO: 2585727 - RNA, 16 nt, Coxiella burnetii RSA 493
cguauuccaaauaauc

SEQ ID NO: 2585728 - RNA, 19 nt, Coxiella burnetii RSA 493
cguauuccgcuucgcugca

SEQ ID NO: 2585729 - RNA, 20 nt, Coxiella burnetii RSA 493
cguauuccgcuucgcugcau

SEQ ID NO: 2585730 - RNA, 22 nt, Coxiella burnetii RSA 493
cguauuccgcuucgcugcauac

SEQ ID NO: 2585731 - RNA, 22 nt, Coxiella burnetii RSA 493
cguauuccgcuuugcuccauac

SEQ ID NO: 2585732 - RNA, 16 nt, Coxiella burnetii RSA 493
cguauugaguuuuuga

SEQ ID NO: 2585733 - RNA, 20 nt, Coxiella burnetii RSA 493
cguauugucaaaauuagaau

SEQ ID NO: 2585734 - RNA, 21 nt, Coxiella burnetii RSA 493
cguauuucgcuucgcuacaua

SEQ ID NO: 2585735 - RNA, 22 nt, Coxiella burnetii RSA 493
cguauuucgcuucgcuacauac

SEQ ID NO: 2585736 - RNA, 20 nt, Coxiella burnetii RSA 493
cguauuucgcuucgcucaga

SEQ ID NO: 2585737 - RNA, 19 nt, Coxiella burnetii RSA 493
cguauuucgcuucgcucau

SEQ ID NO: 2585738 - RNA, 20 nt, Coxiella burnetii RSA 493
cguauuucgcuucgcucaua

SEQ ID NO: 2585739 - RNA, 20 nt, Coxiella burnetii RSA 493
cguauuucgcuucgcuccau

SEQ ID NO: 2585740 - RNA, 21 nt, Coxiella burnetii RSA 493
cguauuucgcuucgcuccaua

SEQ ID NO: 2585741 - RNA, 22 nt, Coxiella burnetii RSA 493
cguauuucgcuucgcuccauac

SEQ ID NO: 2585742 - RNA, 21 nt, Coxiella burnetii RSA 493
cguauuucgcuucgcugcaua

SEQ ID NO: 2585743 - RNA, 22 nt, Coxiella burnetii RSA 493
cguauuucgcuucgcugcauac

SEQ ID NO: 2585744 - RNA, 16 nt, Coxiella burnetii RSA 493
cguauuugcaauaguc

SEQ ID NO: 2585745 - RNA, 20 nt, Coxiella burnetii RSA 493
cguauuuguguaaaauacug

SEQ ID NO: 2585746 - RNA, 23 nt, Coxiella burnetii RSA 493
cguauuuguucguaauaauaagc

SEQ ID NO: 2585747 - RNA, 11 nt, Coxiella burnetii RSA 493
cguauuuuuuc

SEQ ID NO: 2585748 - RNA, 14 nt, Coxiella burnetii RSA 493
cgucaauuuuucuu

SEQ ID NO: 2585749 - RNA, 17 nt, Coxiella burnetii RSA 493
cgucaauuuuucuuuuu

SEQ ID NO: 2585750 - RNA, 15 nt, Coxiella burnetii RSA 493
cgucagaaaacagcc

SEQ ID NO: 2585751 - RNA, 16 nt, Coxiella burnetii RSA 493
cgucagaaaacagccu

SEQ ID NO: 2585752 - RNA, 17 nt, Coxiella burnetii RSA 493
cgucaugaaaagcggag

SEQ ID NO: 2585753 - RNA, 20 nt, Coxiella burnetii RSA 493
cguccagguaguuuguuuuu

SEQ ID NO: 2585754 - RNA, 21 nt, Coxiella burnetii RSA 493
cgucccaaaaaacuuagccaa

SEQ ID NO: 2585755 - RNA, 16 nt, Coxiella burnetii RSA 493
cgucccccaauaccag

SEQ ID NO: 2585756 - RNA, 20 nt, Coxiella burnetii RSA 493
cguccccguauuucgcuucg

SEQ ID NO: 2585757 - RNA, 14 nt, Coxiella burnetii RSA 493
cgucgcaaauaaua

SEQ ID NO: 2585758 - RNA, 14 nt, Coxiella burnetii RSA 493
cgucguuuguauuc

SEQ ID NO: 2585759 - RNA, 21 nt, Coxiella burnetii RSA 493
cgucuuccacggaguuuucau

SEQ ID NO: 2585760 - RNA, 20 nt, Coxiella burnetii RSA 493
cgucuuggagauuuagccaa

SEQ ID NO: 2585761 - RNA, 13 nt, Coxiella burnetii RSA 493
cgucuuuuuuagu

SEQ ID NO: 2585762 - RNA, 21 nt, Coxiella burnetii RSA 493
cgugaugggauaaaaaacccc

SEQ ID NO: 2585763 - RNA, 16 nt, Coxiella burnetii RSA 493
cgugcccguucucaag

SEQ ID NO: 2585764 - RNA, 22 nt, Coxiella burnetii RSA 493
cguggcguuauugaucaaacgc

SEQ ID NO: 2585765 - RNA, 14 nt, Coxiella burnetii RSA 493
cguguagaaagaaa

SEQ ID NO: 2585766 - RNA, 16 nt, Coxiella burnetii RSA 493
cgugugagucgaauua

SEQ ID NO: 2585767 - RNA, 18 nt, Coxiella burnetii RSA 493
cguguuaaaagcgcccaa

SEQ ID NO: 2585768 - RNA, 19 nt, Coxiella burnetii RSA 493
cguuaagccugaaaaucaa

SEQ ID NO: 2585769 - RNA, 23 nt, Coxiella burnetii RSA 493
cguuaauacgauagcgucuuuuu

SEQ ID NO: 2585770 - RNA, 19 nt, Coxiella burnetii RSA 493
cguuaauuuaucauuuuuc

SEQ ID NO: 2585771 - RNA, 15 nt, Coxiella burnetii RSA 493
cguuagaaaagcgcu

SEQ ID NO: 2585772 - RNA, 20 nt, Coxiella burnetii RSA 493
cguuauagccgcguucagcu

SEQ ID NO: 2585773 - RNA, 20 nt, Coxiella burnetii RSA 493
cguuaucacuugauaaucaa

SEQ ID NO: 2585774 - RNA, 18 nt, Coxiella burnetii RSA 493
cguuaugggaauuaaaca

SEQ ID NO: 2585775 - RNA, 22 nt, Coxiella burnetii RSA 493
cguuauuguuaacaccuuuuuc

SEQ ID NO: 2585776 - RNA, 18 nt, Coxiella burnetii RSA 493
cguucagcuagccauugu

SEQ ID NO: 2585777 - RNA, 15 nt, Coxiella burnetii RSA 493
cguuccguauccauc

SEQ ID NO: 2585778 - RNA, 14 nt, Coxiella burnetii RSA 493
cuagcuauucuuuu

SEQ ID NO: 2585779 - RNA, 14 nt, Coxiella burnetii RSA 493
cuagcuguuuuuuc

SEQ ID NO: 2585780 - RNA, 21 nt, Coxiella burnetii RSA 493
cuaggaaaaaauaauuauaga

SEQ ID NO: 2585781 - RNA, 21 nt, Coxiella burnetii RSA 493
cuaggaaacgaaguucucaaa

SEQ ID NO: 2585782 - RNA, 15 nt, Coxiella burnetii RSA 493
cuaggauuuccuuuu

SEQ ID NO: 2585783 - RNA, 19 nt, Coxiella burnetii RSA 493
cuaggcugagccagcuaag

SEQ ID NO: 2585784 - RNA, 22 nt, Coxiella burnetii RSA 493
cuaggucugauaggaauucuuu

SEQ ID NO: 2585785 - RNA, 20 nt, Coxiella burnetii RSA 493
cuagguuauuuuuuccuauu

SEQ ID NO: 2585786 - RNA, 18 nt, Coxiella burnetii RSA 493
cuaguagucucagacucu

SEQ ID NO: 2585787 - RNA, 20 nt, Coxiella burnetii RSA 493
cuagucgaaucaccugcucc

SEQ ID NO: 2585788 - RNA, 16 nt, Coxiella burnetii RSA 493
cuaguuauuuuuaaaa

SEQ ID NO: 2585789 - RNA, 18 nt, Coxiella burnetii RSA 493
cuaguuauuuuuaaaaga

SEQ ID NO: 2585790 - RNA, 16 nt, Coxiella burnetii RSA 493
cuaguuauuuuucauc

SEQ ID NO: 2585791 - RNA, 19 nt, Coxiella burnetii RSA 493
cuaguuauuuuucaucuug

SEQ ID NO: 2585792 - RNA, 14 nt, Coxiella burnetii RSA 493
cuaguuuuacuaca

SEQ ID NO: 2585793 - RNA, 22 nt, Coxiella burnetii RSA 493
cuauaaauaacagcgaacaucc

SEQ ID NO: 2585794 - RNA, 18 nt, Coxiella burnetii RSA 493
cuauaaguccaagacuga

SEQ ID NO: 2585795 - RNA, 15 nt, Coxiella burnetii RSA 493
cuauaaucauuuuuc

SEQ ID NO: 2585796 - RNA, 20 nt, Coxiella burnetii RSA 493
cuauauaagcuuucaauaaa

SEQ ID NO: 2585797 - RNA, 18 nt, Coxiella burnetii RSA 493
cuauauacccgaggauga

SEQ ID NO: 2585798 - RNA, 18 nt, Coxiella burnetii RSA 493
cuauaucuuuuaaauuaa

SEQ ID NO: 2585799 - RNA, 13 nt, Coxiella burnetii RSA 493
cuauauuuucuuu

SEQ ID NO: 2585800 - RNA, 16 nt, Coxiella burnetii RSA 493
cuaucaauauuucguc

SEQ ID NO: 2585801 - RNA, 11 nt, Coxiella burnetii RSA 493
cuauccaaaaa

SEQ ID NO: 2585802 - RNA, 12 nt, Coxiella burnetii RSA 493
cuauccaaaaag

SEQ ID NO: 2585803 - RNA, 14 nt, Coxiella burnetii RSA 493
cuauccaaaaagau

SEQ ID NO: 2585804 - RNA, 16 nt, Coxiella burnetii RSA 493
cuauccaaaaagauaa

SEQ ID NO: 2585805 - RNA, 22 nt, Coxiella burnetii RSA 493
cuauccaaaaagauaaucccaa

SEQ ID NO: 2585806 - RNA, 20 nt, Coxiella burnetii RSA 493
cuauccacaaaggcucgaua

SEQ ID NO: 2585807 - RNA, 17 nt, Coxiella burnetii RSA 493
cuauccagaaaccaaaa

SEQ ID NO: 2585808 - RNA, 22 nt, Coxiella burnetii RSA 493
cuaucgccguuucugcuuuuau

SEQ ID NO: 2585809 - RNA, 20 nt, Coxiella burnetii RSA 493
cuaucguccccguauuucgc

SEQ ID NO: 2585810 - RNA, 22 nt, Coxiella burnetii RSA 493
cuaucgugccaguauuuuucuu

SEQ ID NO: 2585811 - RNA, 23 nt, Coxiella burnetii RSA 493
cuaucgugccaguauuuuucuuu

SEQ ID NO: 2585812 - RNA, 12 nt, Coxiella burnetii RSA 493
cuaucuuuuuca

SEQ ID NO: 2585813 - RNA, 20 nt, Coxiella burnetii RSA 493
cuaugaucaugccuuuuuug

SEQ ID NO: 2585814 - RNA, 11 nt, Coxiella burnetii RSA 493
cuaugccaaca

SEQ ID NO: 2585815 - RNA, 14 nt, Coxiella burnetii RSA 493
cuauuagccuuaau

SEQ ID NO: 2585816 - RNA, 15 nt, Coxiella burnetii RSA 493
cuauuagcugccauu

SEQ ID NO: 2585817 - RNA, 16 nt, Coxiella burnetii RSA 493
cuauuagcugccauuu

SEQ ID NO: 2585818 - RNA, 21 nt, Coxiella burnetii RSA 493
cuauuauuaaaagagcgaaua

SEQ ID NO: 2585819 - RNA, 19 nt, Coxiella burnetii RSA 493
cuauuauuaauacaggaaa

SEQ ID NO: 2585820 - RNA, 19 nt, Coxiella burnetii RSA 493
cuauuccccuucuucaacu

SEQ ID NO: 2585821 - RNA, 18 nt, Coxiella burnetii RSA 493
cuauugaagucugguuaa

SEQ ID NO: 2585822 - RNA, 20 nt, Coxiella burnetii RSA 493
cuauugcgcaaauugcaaaa

SEQ ID NO: 2585823 - RNA, 15 nt, Coxiella burnetii RSA 493
cuauuggauuuacuu

SEQ ID NO: 2585824 - RNA, 13 nt, Coxiella burnetii RSA 493
cuauuuuaaaucu

SEQ ID NO: 2585825 - RNA, 13 nt, Coxiella burnetii RSA 493
cuauuuuuuaaau

SEQ ID NO: 2585826 - RNA, 14 nt, Coxiella burnetii RSA 493
cucaaacaaaucaa

SEQ ID NO: 2585827 - RNA, 15 nt, Coxiella burnetii RSA 493
cucaaacaaaucaau

SEQ ID NO: 2585828 - RNA, 12 nt, Coxiella burnetii RSA 493
cucaaagaaacg

SEQ ID NO: 2585829 - RNA, 19 nt, Coxiella burnetii RSA 493
cucaaagaaacgauuaaaa

SEQ ID NO: 2585830 - RNA, 22 nt, Coxiella burnetii RSA 493
cucaaaggccuuggguaaguga

SEQ ID NO: 2585831 - RNA, 23 nt, Coxiella burnetii RSA 493
cucaaaggccuuggguaagugaa

SEQ ID NO: 2585832 - RNA, 20 nt, Coxiella burnetii RSA 493
cucaaauugcuccaaacaga

SEQ ID NO: 2585833 - RNA, 13 nt, Coxiella burnetii RSA 493
cucaaauuuuccc

SEQ ID NO: 2585834 - RNA, 13 nt, Coxiella burnetii RSA 493
cucaacagccuuc

SEQ ID NO: 2585835 - RNA, 18 nt, Coxiella burnetii RSA 493
cucaacaguaguuuauca

SEQ ID NO: 2585836 - RNA, 21 nt, Coxiella burnetii RSA 493
cucaacgguaugucggauuuc

SEQ ID NO: 2585837 - RNA, 16 nt, Coxiella burnetii RSA 493
cucaaugagugcuuuu

SEQ ID NO: 2585838 - RNA, 11 nt, Coxiella burnetii RSA 493
cucaauuauua

SEQ ID NO: 2585839 - RNA, 20 nt, Coxiella burnetii RSA 493
cucaauucgcuuaaauuuug

SEQ ID NO: 2585840 - RNA, 22 nt, Coxiella burnetii RSA 493
cucaauucgcuuaaauuuugac

SEQ ID NO: 2585841 - RNA, 13 nt, Coxiella burnetii RSA 493
cucaauuguuuca

SEQ ID NO: 2585842 - RNA, 18 nt, Coxiella burnetii RSA 493
cucacaacauuccuuucg

SEQ ID NO: 2585843 - RNA, 14 nt, Coxiella burnetii RSA 493
cucacacaacucca

SEQ ID NO: 2585844 - RNA, 21 nt, Coxiella burnetii RSA 493
cucacauuggcaguguaaauu

SEQ ID NO: 2585845 - RNA, 16 nt, Coxiella burnetii RSA 493
cucaccccgauuuaau

SEQ ID NO: 2585846 - RNA, 17 nt, Coxiella burnetii RSA 493
cucacuuggauuuuauu

SEQ ID NO: 2585847 - RNA, 15 nt, Coxiella burnetii RSA 493
cucacuuuuuucagc

SEQ ID NO: 2585848 - RNA, 20 nt, Coxiella burnetii RSA 493
cucagacucucuuauugccc

SEQ ID NO: 2585849 - RNA, 20 nt, Coxiella burnetii RSA 493
cucagcccaaccuacgggcu

SEQ ID NO: 2585850 - RNA, 22 nt, Coxiella burnetii RSA 493
cucagcccaaccuacgggcuaa

SEQ ID NO: 2585851 - RNA, 16 nt, Coxiella burnetii RSA 493
cucagccguuaacucu

SEQ ID NO: 2585852 - RNA, 22 nt, Coxiella burnetii RSA 493
cucaguggcagcuucuuuaaaa

SEQ ID NO: 2585853 - RNA, 21 nt, Coxiella burnetii RSA 493
cucaguuguuagcuuuucuuu

SEQ ID NO: 2585854 - RNA, 18 nt, Coxiella burnetii RSA 493
cucauaaucgauaaucaa

SEQ ID NO: 2585855 - RNA, 12 nt, Coxiella burnetii RSA 493
cucauauauuua

SEQ ID NO: 2585856 - RNA, 20 nt, Coxiella burnetii RSA 493
cucauccuccgauuuauuau

SEQ ID NO: 2585857 - RNA, 14 nt, Coxiella burnetii RSA 493
cucauuaggcuuua

SEQ ID NO: 2585858 - RNA, 22 nt, Coxiella burnetii RSA 493
cucauuguuaauccacuuaaaa

SEQ ID NO: 2585859 - RNA, 16 nt, Coxiella burnetii RSA 493
cucauuuuguauugga

SEQ ID NO: 2585860 - RNA, 22 nt, Coxiella burnetii RSA 493
cuccaaagggaccuuuuuugca

SEQ ID NO: 2585861 - RNA, 22 nt, Coxiella burnetii RSA 493
cuccacggaauuugaaauaaac

SEQ ID NO: 2585862 - RNA, 17 nt, Coxiella burnetii RSA 493
cuccagaugauaucccc

SEQ ID NO: 2585863 - RNA, 20 nt, Coxiella burnetii RSA 493
cuccagccgaagcgcggcca

SEQ ID NO: 2585864 - RNA, 17 nt, Coxiella burnetii RSA 493
cuccaucaugauaucca

SEQ ID NO: 2585865 - RNA, 20 nt, Coxiella burnetii RSA 493
cuccauccauagcgaaaauu

SEQ ID NO: 2585866 - RNA, 19 nt, Coxiella burnetii RSA 493
cuccauuuagaaaaaauac

SEQ ID NO: 2585867 - RNA, 19 nt, Coxiella burnetii RSA 493
cucccagacacaugggaca

SEQ ID NO: 2585868 - RNA, 21 nt, Coxiella burnetii RSA 493
cuccccacucucuuuauuuuu

SEQ ID NO: 2585869 - RNA, 15 nt, Coxiella burnetii RSA 493
cucccgccuccugau

SEQ ID NO: 2585870 - RNA, 21 nt, Coxiella burnetii RSA 493
cucccuaagccaguucucuau

SEQ ID NO: 2585871 - RNA, 20 nt, Coxiella burnetii RSA 493
cucccuuaacuucucuucaa

SEQ ID NO: 2585872 - RNA, 21 nt, Coxiella burnetii RSA 493
cuccgcccccccaaacaaaag

SEQ ID NO: 2585873 - RNA, 19 nt, Coxiella burnetii RSA 493
cuccugaaaaauaauuuua

SEQ ID NO: 2585874 - RNA, 17 nt, Coxiella burnetii RSA 493
cuccuucgcuuuuucca

SEQ ID NO: 2585875 - RNA, 19 nt, Coxiella burnetii RSA 493
cuccuugaggaauuuuuca

SEQ ID NO: 2585876 - RNA, 12 nt, Coxiella burnetii RSA 493
cucgaaugacaa

SEQ ID NO: 2585877 - RNA, 19 nt, Coxiella burnetii RSA 493
cucgaaugcagcucuuuca

SEQ ID NO: 2585878 - RNA, 15 nt, Coxiella burnetii RSA 493
cucgcccauggaaau

SEQ ID NO: 2585879 - RNA, 21 nt, Coxiella burnetii RSA 493
cucgcgaaauuuaauaaaauu

SEQ ID NO: 2585880 - RNA, 20 nt, Coxiella burnetii RSA 493
cucgcgcggcaaggaauuga

SEQ ID NO: 2585881 - RNA, 23 nt, Coxiella burnetii RSA 493
cucgcuaaucgcaaugcuucuuc

SEQ ID NO: 2585882 - RNA, 16 nt, Coxiella burnetii RSA 493
cucgcucuuguuucug

SEQ ID NO: 2585883 - RNA, 23 nt, Coxiella burnetii RSA 493
cuggccagcgagaguacgccaac

SEQ ID NO: 2585884 - RNA, 14 nt, Coxiella burnetii RSA 493
cuggcuuggacaaa

SEQ ID NO: 2585885 - RNA, 16 nt, Coxiella burnetii RSA 493
cugggccaggaccaaa

SEQ ID NO: 2585886 - RNA, 16 nt, Coxiella burnetii RSA 493
cuggggauacacccau

SEQ ID NO: 2585887 - RNA, 21 nt, Coxiella burnetii RSA 493
cuggugcgauaguuuuauuua

SEQ ID NO: 2585888 - RNA, 20 nt, Coxiella burnetii RSA 493
cuguaaccgccuuuaagauc

SEQ ID NO: 2585889 - RNA, 22 nt, Coxiella burnetii RSA 493
cuguaacuuuuccaucuccuuu

SEQ ID NO: 2585890 - RNA, 22 nt, Coxiella burnetii RSA 493
cuguaaguugggguuuaauugc

SEQ ID NO: 2585891 - RNA, 13 nt, Coxiella burnetii RSA 493
cuguacauuuuuc

SEQ ID NO: 2585892 - RNA, 22 nt, Coxiella burnetii RSA 493
cuguauugaucgcccauauuca

SEQ ID NO: 2585893 - RNA, 16 nt, Coxiella burnetii RSA 493
cugucaaaaaaccuua

SEQ ID NO: 2585894 - RNA, 20 nt, Coxiella burnetii RSA 493
cugucaaacguccuucucca

SEQ ID NO: 2585895 - RNA, 15 nt, Coxiella burnetii RSA 493
cugucacuaauaauc

SEQ ID NO: 2585896 - RNA, 19 nt, Coxiella burnetii RSA 493
cugucaucaucgucaaaug

SEQ ID NO: 2585897 - RNA, 20 nt, Coxiella burnetii RSA 493
cuguccuaaggauaggaucu

SEQ ID NO: 2585898 - RNA, 15 nt, Coxiella burnetii RSA 493
cuguccucugccuuc

SEQ ID NO: 2585899 - RNA, 20 nt, Coxiella burnetii RSA 493
cuguccucuguccucugccu

SEQ ID NO: 2585900 - RNA, 15 nt, Coxiella burnetii RSA 493
cuguccucuguuccc

SEQ ID NO: 2585901 - RNA, 22 nt, Coxiella burnetii RSA 493
cugucuagucgaaucaccugcu

SEQ ID NO: 2585902 - RNA, 18 nt, Coxiella burnetii RSA 493
cugugauucacgcgcaua

SEQ ID NO: 2585903 - RNA, 13 nt, Coxiella burnetii RSA 493
cugugccugccau

SEQ ID NO: 2585904 - RNA, 14 nt, Coxiella burnetii RSA 493
cugugccugccauu

SEQ ID NO: 2585905 - RNA, 15 nt, Coxiella burnetii RSA 493
cugugccugccauuu

SEQ ID NO: 2585906 - RNA, 22 nt, Coxiella burnetii RSA 493
cugugcggauuaaauaacucau

SEQ ID NO: 2585907 - RNA, 18 nt, Coxiella burnetii RSA 493
cuguggauuaauucccaa

SEQ ID NO: 2585908 - RNA, 13 nt, Coxiella burnetii RSA 493
cugugguuaauuc

SEQ ID NO: 2585909 - RNA, 15 nt, Coxiella burnetii RSA 493
cuguuagauauugaa

SEQ ID NO: 2585910 - RNA, 13 nt, Coxiella burnetii RSA 493
cuguucgccagaa

SEQ ID NO: 2585911 - RNA, 13 nt, Coxiella burnetii RSA 493
cuguugauacuaa

SEQ ID NO: 2585912 - RNA, 16 nt, Coxiella burnetii RSA 493
cuguuucuucuuuggc

SEQ ID NO: 2585913 - RNA, 15 nt, Coxiella burnetii RSA 493
cuguuuguugcuuug

SEQ ID NO: 2585914 - RNA, 14 nt, Coxiella burnetii RSA 493
cuguuuuacugccu

SEQ ID NO: 2585915 - RNA, 19 nt, Coxiella burnetii RSA 493
cuguuuuacugccuacaaa

SEQ ID NO: 2585916 - RNA, 12 nt, Coxiella burnetii RSA 493
cuguuuuauccc

SEQ ID NO: 2585917 - RNA, 22 nt, Coxiella burnetii RSA 493
cuguuuuaucccaauaguaaaa

SEQ ID NO: 2585918 - RNA, 20 nt, Coxiella burnetii RSA 493
cuuaaaacaaaugcgccauu

SEQ ID NO: 2585919 - RNA, 15 nt, Coxiella burnetii RSA 493
cuuaaaauuucuuuc

SEQ ID NO: 2585920 - RNA, 24 nt, Coxiella burnetii RSA 493
cuuaaagcaacgacuucucuuucu

SEQ ID NO: 2585921 - RNA, 15 nt, Coxiella burnetii RSA 493
cuuaaagucuucaaa

SEQ ID NO: 2585922 - RNA, 16 nt, Coxiella burnetii RSA 493
cuuaaauuuugacauu

SEQ ID NO: 2585923 - RNA, 12 nt, Coxiella burnetii RSA 493
cuuaacaguaac

SEQ ID NO: 2585924 - RNA, 18 nt, Coxiella burnetii RSA 493
cuuaacgccuaucuuuuu

SEQ ID NO: 2585925 - RNA, 19 nt, Coxiella burnetii RSA 493
cuuaacgccuaucuuuuuc

SEQ ID NO: 2585926 - RNA, 18 nt, Coxiella burnetii RSA 493
cuuaacuccuucgcuuuu

SEQ ID NO: 2585927 - RNA, 19 nt, Coxiella burnetii RSA 493
cuuaagagauagugcuauu

SEQ ID NO: 2585928 - RNA, 22 nt, Coxiella burnetii RSA 493
cuuaaguugacgccuauugccc

SEQ ID NO: 2585929 - RNA, 18 nt, Coxiella burnetii RSA 493
cuuaaucaaccucagguu

SEQ ID NO: 2585930 - RNA, 22 nt, Coxiella burnetii RSA 493
cuuaaucaaccucagguuuuac

SEQ ID NO: 2585931 - RNA, 18 nt, Coxiella burnetii RSA 493
cuuaaugaaauuucucau

SEQ ID NO: 2585932 - RNA, 14 nt, Coxiella burnetii RSA 493
cuuaauguuuuuuc

SEQ ID NO: 2585933 - RNA, 19 nt, Coxiella burnetii RSA 493
cuuaauuuaaucuacucua

SEQ ID NO: 2585934 - RNA, 23 nt, Coxiella burnetii RSA 493
cuuaauuuuuccuuucuuucuuc

SEQ ID NO: 2585935 - RNA, 12 nt, Coxiella burnetii RSA 493
cuuacaaaaaua

SEQ ID NO: 2585936 - RNA, 21 nt, Coxiella burnetii RSA 493
cuuacagaacgcccuauuccc

SEQ ID NO: 2585937 - RNA, 14 nt, Coxiella burnetii RSA 493
cuuacgcugaagua

SEQ ID NO: 2585938 - RNA, 22 nt, Coxiella burnetii RSA 493
cuuagcaauguuucaaucuggg

SEQ ID NO: 2585939 - RNA, 16 nt, Coxiella burnetii RSA 493
cuuagcauaaaaugcg

SEQ ID NO: 2585940 - RNA, 19 nt, Coxiella burnetii RSA 493
cuuagcugauuucucuuuu

SEQ ID NO: 2585941 - RNA, 18 nt, Coxiella burnetii RSA 493
cuuauaaauuaaauugcu

SEQ ID NO: 2585942 - RNA, 21 nt, Coxiella burnetii RSA 493
cuuauacuaaauuguccuuuu

SEQ ID NO: 2585943 - RNA, 23 nt, Coxiella burnetii RSA 493
cuuauacuaaauuguccuuuucu

SEQ ID NO: 2585944 - RNA, 20 nt, Coxiella burnetii RSA 493
cuuauagcccacacuaaagg

SEQ ID NO: 2585945 - RNA, 16 nt, Coxiella burnetii RSA 493
cuuauagcuuguuccu

SEQ ID NO: 2585946 - RNA, 18 nt, Coxiella burnetii RSA 493
cuuauaggaaucugaauu

SEQ ID NO: 2585947 - RNA, 17 nt, Coxiella burnetii RSA 493
cuuaucuuaaaccucaa

SEQ ID NO: 2585948 - RNA, 20 nt, Coxiella burnetii RSA 493
cuuauuauucauaucuuuuu

SEQ ID NO: 2585949 - RNA, 17 nt, Coxiella burnetii RSA 493
cuuauugcccucguuuu

SEQ ID NO: 2585950 - RNA, 22 nt, Coxiella burnetii RSA 493
cuuauugcccucguuuuaucgu

SEQ ID NO: 2585951 - RNA, 23 nt, Coxiella burnetii RSA 493
cuuauuuucugggagauuuauuc

SEQ ID NO: 2585952 - RNA, 19 nt, Coxiella burnetii RSA 493
cuuauuuugugaugcacgg

SEQ ID NO: 2585953 - RNA, 23 nt, Coxiella burnetii RSA 493
cuuauuuuuauucuuaauuuuuc

SEQ ID NO: 2585954 - RNA, 14 nt, Coxiella burnetii RSA 493
cuucaaaaauaaaa

SEQ ID NO: 2585955 - RNA, 18 nt, Coxiella burnetii RSA 493
cuucaaaagugauuuuuc

SEQ ID NO: 2585956 - RNA, 20 nt, Coxiella burnetii RSA 493
cuucaaaagugauuuuucuu

SEQ ID NO: 2585957 - RNA, 22 nt, Coxiella burnetii RSA 493
cuucaaauucagccguuauaaa

SEQ ID NO: 2585958 - RNA, 21 nt, Coxiella burnetii RSA 493
cuucaacgaagccuaaacuua

SEQ ID NO: 2585959 - RNA, 21 nt, Coxiella burnetii RSA 493
cuucaacuccugaaaaauaau

SEQ ID NO: 2585960 - RNA, 13 nt, Coxiella burnetii RSA 493
cuucaauucuuuu

SEQ ID NO: 2585961 - RNA, 14 nt, Coxiella burnetii RSA 493
cuucaauucuuuuu

SEQ ID NO: 2585962 - RNA, 18 nt, Coxiella burnetii RSA 493
cuucacgcauuucccaau

SEQ ID NO: 2585963 - RNA, 14 nt, Coxiella burnetii RSA 493
cuucauacuaacug

SEQ ID NO: 2585964 - RNA, 16 nt, Coxiella burnetii RSA 493
cuucauauccuuucua

SEQ ID NO: 2585965 - RNA, 13 nt, Coxiella burnetii RSA 493
cuucaucuaaauu

SEQ ID NO: 2585966 - RNA, 18 nt, Coxiella burnetii RSA 493
cuucaugaauauuuuucu

SEQ ID NO: 2585967 - RNA, 14 nt, Coxiella burnetii RSA 493
cuucauuaaauccg

SEQ ID NO: 2585968 - RNA, 18 nt, Coxiella burnetii RSA 493
cuucauuaaauccucuuu

SEQ ID NO: 2585969 - RNA, 23 nt, Coxiella burnetii RSA 493
cuuccaauaacauaucuucaaca

SEQ ID NO: 2585970 - RNA, 12 nt, Coxiella burnetii RSA 493
cuuccaauaagg

SEQ ID NO: 2585971 - RNA, 16 nt, Coxiella burnetii RSA 493
cuuccaauaaggcauu

SEQ ID NO: 2585972 - RNA, 17 nt, Coxiella burnetii RSA 493
cuuccauacuaauuuca

SEQ ID NO: 2585973 - RNA, 20 nt, Coxiella burnetii RSA 493
cuuccccaauuuauucaacu

SEQ ID NO: 2585974 - RNA, 15 nt, Coxiella burnetii RSA 493
cuuccgaaacuaaaa

SEQ ID NO: 2585975 - RNA, 19 nt, Coxiella burnetii RSA 493
cuuccuaucaauauuucgu

SEQ ID NO: 2585976 - RNA, 15 nt, Coxiella burnetii RSA 493
cuuccucuucuacug

SEQ ID NO: 2585977 - RNA, 21 nt, Coxiella burnetii RSA 493
cuuccuucuugucauucccuu

SEQ ID NO: 2585978 - RNA, 12 nt, Coxiella burnetii RSA 493
cuucgagaggaa

SEQ ID NO: 2585979 - RNA, 15 nt, Coxiella burnetii RSA 493
cuucgcaaagcucag

SEQ ID NO: 2585980 - RNA, 21 nt, Coxiella burnetii RSA 493
cuucgcacaucauugaaaacc

SEQ ID NO: 2585981 - RNA, 14 nt, Coxiella burnetii RSA 493
cuucgccuggccaa

SEQ ID NO: 2585982 - RNA, 20 nt, Coxiella burnetii RSA 493
cuucgcgaacucagcccaac

SEQ ID NO: 2585983 - RNA, 22 nt, Coxiella burnetii RSA 493
cuucgcucauacgggcuacuuu

SEQ ID NO: 2585984 - RNA, 19 nt, Coxiella burnetii RSA 493
cuucggauugcccgguaac

SEQ ID NO: 2585985 - RNA, 22 nt, Coxiella burnetii RSA 493
cuucguuuauuuccgucaauuu

SEQ ID NO: 2585986 - RNA, 20 nt, Coxiella burnetii RSA 493
cuucuaauuugaaaaaccca

SEQ ID NO: 2585987 - RNA, 15 nt, Coxiella burnetii RSA 493
cuucuauucccuuuu

SEQ ID NO: 2585988 - RNA, 17 nt, Coxiella burnetii RSA 493
cuuuuauacccaaaaac

SEQ ID NO: 2585989 - RNA, 14 nt, Coxiella burnetii RSA 493
cuuuuauuccuuuu

SEQ ID NO: 2585990 - RNA, 17 nt, Coxiella burnetii RSA 493
cuuuuauuccuuuuuuu

SEQ ID NO: 2585991 - RNA, 17 nt, Coxiella burnetii RSA 493
cuuuuauuuaagugaua

SEQ ID NO: 2585992 - RNA, 21 nt, Coxiella burnetii RSA 493
cuuuuauuucuuuugccucuu

SEQ ID NO: 2585993 - RNA, 22 nt, Coxiella burnetii RSA 493
cuuuuauuugggagauaggacu

SEQ ID NO: 2585994 - RNA, 18 nt, Coxiella burnetii RSA 493
cuuuucacccaaccaaua

SEQ ID NO: 2585995 - RNA, 20 nt, Coxiella burnetii RSA 493
cuuuucauuaagcaauuuuu

SEQ ID NO: 2585996 - RNA, 17 nt, Coxiella burnetii RSA 493
cuuuuccaucuccuuuu

SEQ ID NO: 2585997 - RNA, 15 nt, Coxiella burnetii RSA 493
cuuuuccugaacagg

SEQ ID NO: 2585998 - RNA, 18 nt, Coxiella burnetii RSA 493
cuuuucggagaaaucuuu

SEQ ID NO: 2585999 - RNA, 23 nt, Coxiella burnetii RSA 493
cuuuucuaagacuaagaauaaga

SEQ ID NO: 2586000 - RNA, 14 nt, Coxiella burnetii RSA 493
cuuuucuauuuuuu

SEQ ID NO: 2586001 - RNA, 15 nt, Coxiella burnetii RSA 493
cuuuucuauuuuuuu

SEQ ID NO: 2586002 - RNA, 22 nt, Coxiella burnetii RSA 493
cuuuucuguuuucguaaucuuu

SEQ ID NO: 2586003 - RNA, 18 nt, Coxiella burnetii RSA 493
cuuuugaauuuuuugaaa

SEQ ID NO: 2586004 - RNA, 22 nt, Coxiella burnetii RSA 493
cuuuugccucuuuuuguaaauu

SEQ ID NO: 2586005 - RNA, 16 nt, Coxiella burnetii RSA 493
cuuuuggcuacuuucu

SEQ ID NO: 2586006 - RNA, 18 nt, Coxiella burnetii RSA 493
cuuuuguuaauucuuuuu

SEQ ID NO: 2586007 - RNA, 15 nt, Coxiella burnetii RSA 493
cuuuuguuuuuaaga

SEQ ID NO: 2586008 - RNA, 13 nt, Coxiella burnetii RSA 493
cuuuuuaaauaac

SEQ ID NO: 2586009 - RNA, 24 nt, Coxiella burnetii RSA 493
cuuuuuaaauaacuuuacuaaaaa

SEQ ID NO: 2586010 - RNA, 15 nt, Coxiella burnetii RSA 493
cuuuuucaaagauau

SEQ ID NO: 2586011 - RNA, 22 nt, Coxiella burnetii RSA 493
cuuuuucaaugccauuuuuaug

SEQ ID NO: 2586012 - RNA, 12 nt, Coxiella burnetii RSA 493
cuuuuucauuuc

SEQ ID NO: 2586013 - RNA, 16 nt, Coxiella burnetii RSA 493
cuuuuucauuuccgcu

SEQ ID NO: 2586014 - RNA, 17 nt, Coxiella burnetii RSA 493
cuuuuucauuuccgcuu

SEQ ID NO: 2586015 - RNA, 21 nt, Coxiella burnetii RSA 493
cuuuuucauuucuucgaguuu

SEQ ID NO: 2586016 - RNA, 19 nt, Coxiella burnetii RSA 493
cuuuuucguuuaacaauga

SEQ ID NO: 2586017 - RNA, 22 nt, Coxiella burnetii RSA 493
cuuuuucuagggagaaaaauuu

SEQ ID NO: 2586018 - RNA, 21 nt, Coxiella burnetii RSA 493
cuuuuucuuuuaauugaucac

SEQ ID NO: 2586019 - RNA, 13 nt, Coxiella burnetii RSA 493
cuuuuuguaaauu

SEQ ID NO: 2586020 - RNA, 17 nt, Coxiella burnetii RSA 493
cuuuuuguaaauuuucc

SEQ ID NO: 2586021 - RNA, 23 nt, Coxiella burnetii RSA 493
cuuuuuguuugauuuguucuaaa

SEQ ID NO: 2586022 - RNA, 19 nt, Coxiella burnetii RSA 493
cuuuuuucgcuucaauucu

SEQ ID NO: 2586023 - RNA, 11 nt, Coxiella burnetii RSA 493
cuuuuuucuua

SEQ ID NO: 2586024 - RNA, 12 nt, Coxiella burnetii RSA 493
cuuuuuuuaaug

SEQ ID NO: 2586025 - RNA, 19 nt, Coxiella burnetii RSA 493
cuuuuuuuacuuuuucaaa

SEQ ID NO: 2586026 - RNA, 12 nt, Coxiella burnetii RSA 493
cuuuuuuucuug

SEQ ID NO: 2586027 - RNA, 18 nt, Coxiella burnetii RSA 493
gaaaaaacuuuauucgcc

SEQ ID NO: 2586028 - RNA, 20 nt, Coxiella burnetii RSA 493
gaaaaaauaccggaaacaag

SEQ ID NO: 2586029 - RNA, 17 nt, Coxiella burnetii RSA 493
gaaaaaaugauuuuauc

SEQ ID NO: 2586030 - RNA, 14 nt, Coxiella burnetii RSA 493
gaaaaaauuaaaua

SEQ ID NO: 2586031 - RNA, 22 nt, Coxiella burnetii RSA 493
gaaaaaggcucgugcauagcau

SEQ ID NO: 2586032 - RNA, 17 nt, Coxiella burnetii RSA 493
gaaaaaguaucacggcc

SEQ ID NO: 2586033 - RNA, 17 nt, Coxiella burnetii RSA 493
gaaaaaguuaaguauau

SEQ ID NO: 2586034 - RNA, 20 nt, Coxiella burnetii RSA 493
gaaaaaugaacaaaguagaa

SEQ ID NO: 2586035 - RNA, 18 nt, Coxiella burnetii RSA 493
gaaaaaugauuauagaau

SEQ ID NO: 2586036 - RNA, 18 nt, Coxiella burnetii RSA 493
gaaaaauuccaaaaacau

SEQ ID NO: 2586037 - RNA, 21 nt, Coxiella burnetii RSA 493
gaaaaccacaauuuuaaaaca

SEQ ID NO: 2586038 - RNA, 22 nt, Coxiella burnetii RSA 493
gaaaaccaccgcucgcuugaaa

SEQ ID NO: 2586039 - RNA, 18 nt, Coxiella burnetii RSA 493
gaaaacccgagcggaugg

SEQ ID NO: 2586040 - RNA, 17 nt, Coxiella burnetii RSA 493
gaaaaccgcagcucaaa

SEQ ID NO: 2586041 - RNA, 17 nt, Coxiella burnetii RSA 493
gaaaaccuacacguuaa

SEQ ID NO: 2586042 - RNA, 21 nt, Coxiella burnetii RSA 493
gaaaacgcgaguguuuuguau

SEQ ID NO: 2586043 - RNA, 19 nt, Coxiella burnetii RSA 493
gaaaagauuccaauauuga

SEQ ID NO: 2586044 - RNA, 14 nt, Coxiella burnetii RSA 493
gaaaagcugaaauu

SEQ ID NO: 2586045 - RNA, 18 nt, Coxiella burnetii RSA 493
gaaaagcugaaauugaau

SEQ ID NO: 2586046 - RNA, 15 nt, Coxiella burnetii RSA 493
gaaaauaccuuugca

SEQ ID NO: 2586047 - RNA, 17 nt, Coxiella burnetii RSA 493
gaaaauaccuuugcaaa

SEQ ID NO: 2586048 - RNA, 15 nt, Coxiella burnetii RSA 493
gaaaaucgauggaag

SEQ ID NO: 2586049 - RNA, 14 nt, Coxiella burnetii RSA 493
gaaaauucaugaaa

SEQ ID NO: 2586050 - RNA, 12 nt, Coxiella burnetii RSA 493
gaaaauugauua

SEQ ID NO: 2586051 - RNA, 19 nt, Coxiella burnetii RSA 493
gaaaauugucgauaauaua

SEQ ID NO: 2586052 - RNA, 22 nt, Coxiella burnetii RSA 493
gaaaauugucgauaauauaacu

SEQ ID NO: 2586053 - RNA, 12 nt, Coxiella burnetii RSA 493
gaaacaaacaaa

SEQ ID NO: 2586054 - RNA, 20 nt, Coxiella burnetii RSA 493
gaaacaaagguuccaucgca

SEQ ID NO: 2586055 - RNA, 18 nt, Coxiella burnetii RSA 493
gaaacaauacucuuauuu

SEQ ID NO: 2586056 - RNA, 16 nt, Coxiella burnetii RSA 493
gaaaccguuucuacgu

SEQ ID NO: 2586057 - RNA, 15 nt, Coxiella burnetii RSA 493
gaaacgacgaucacc

SEQ ID NO: 2586058 - RNA, 21 nt, Coxiella burnetii RSA 493
gaaacgacgaucacccacguu

SEQ ID NO: 2586059 - RNA, 22 nt, Coxiella burnetii RSA 493
gaaacgcuuauaggaaucugaa

SEQ ID NO: 2586060 - RNA, 23 nt, Coxiella burnetii RSA 493
gaaacgcuuauaggaaucugaau

SEQ ID NO: 2586061 - RNA, 21 nt, Coxiella burnetii RSA 493
gaaacggaugagcaaugacau

SEQ ID NO: 2586062 - RNA, 14 nt, Coxiella burnetii RSA 493
gaaacgugagagag

SEQ ID NO: 2586063 - RNA, 15 nt, Coxiella burnetii RSA 493
gaaacuaagcauuaa

SEQ ID NO: 2586064 - RNA, 14 nt, Coxiella burnetii RSA 493
gaaagaaaaaaaac

SEQ ID NO: 2586065 - RNA, 15 nt, Coxiella burnetii RSA 493
gaaagacauuguuca

SEQ ID NO: 2586066 - RNA, 22 nt, Coxiella burnetii RSA 493
gaaagcaucaaccaauccuacu

SEQ ID NO: 2586067 - RNA, 23 nt, Coxiella burnetii RSA 493
gaaagccaaguuuuaagaaaaac

SEQ ID NO: 2586068 - RNA, 12 nt, Coxiella burnetii RSA 493
gaaagccuaagu

SEQ ID NO: 2586069 - RNA, 18 nt, Coxiella burnetii RSA 493
gaaagcuucguuugcaaa

SEQ ID NO: 2586070 - RNA, 20 nt, Coxiella burnetii RSA 493
gaaaggaauccuuuuucuag

SEQ ID NO: 2586071 - RNA, 23 nt, Coxiella burnetii RSA 493
gaaaggaauccuuuuucuaggga

SEQ ID NO: 2586072 - RNA, 22 nt, Coxiella burnetii RSA 493
gaaaggucaggcaauuuugaua

SEQ ID NO: 2586073 - RNA, 13 nt, Coxiella burnetii RSA 493
gaaaguagaaaac

SEQ ID NO: 2586074 - RNA, 15 nt, Coxiella burnetii RSA 493
gaaaguuuaccuuuc

SEQ ID NO: 2586075 - RNA, 14 nt, Coxiella burnetii RSA 493
gaaaguuucccaca

SEQ ID NO: 2586076 - RNA, 14 nt, Coxiella burnetii RSA 493
gaaaguuuucccaa

SEQ ID NO: 2586077 - RNA, 18 nt, Coxiella burnetii RSA 493
gaaaguuuucccaauguu

SEQ ID NO: 2586078 - RNA, 13 nt, Coxiella burnetii RSA 493
gaaauaaaauuaa

SEQ ID NO: 2586079 - RNA, 20 nt, Coxiella burnetii RSA 493
gaaauaaacuggaaaaaggu

SEQ ID NO: 2586080 - RNA, 14 nt, Coxiella burnetii RSA 493
gaaauaaugacaau

SEQ ID NO: 2586081 - RNA, 17 nt, Coxiella burnetii RSA 493
gaaauaauucgcacaau

SEQ ID NO: 2586082 - RNA, 18 nt, Coxiella burnetii RSA 493
gaaauacaggauuauauu

SEQ ID NO: 2586083 - RNA, 20 nt, Coxiella burnetii RSA 493
gaaauacggggaaauaauga

SEQ ID NO: 2586084 - RNA, 17 nt, Coxiella burnetii RSA 493
gaaauagaauuuuugac

SEQ ID NO: 2586085 - RNA, 15 nt, Coxiella burnetii RSA 493
gaaauaggcuuucuu

SEQ ID NO: 2586086 - RNA, 21 nt, Coxiella burnetii RSA 493
gaaauauaggcgaaucaucuu

SEQ ID NO: 2586087 - RNA, 23 nt, Coxiella burnetii RSA 493
gaaauauuuucucaauagaaaaa

SEQ ID NO: 2586088 - RNA, 16 nt, Coxiella burnetii RSA 493
gaaauccguaauuuua

SEQ ID NO: 2586089 - RNA, 19 nt, Coxiella burnetii RSA 493
gaaauccguaauuuuaacg

SEQ ID NO: 2586090 - RNA, 17 nt, Coxiella burnetii RSA 493
gaaaucguuuuguuuua

SEQ ID NO: 2586091 - RNA, 19 nt, Coxiella burnetii RSA 493
gaaaucuaccguauuuaau

SEQ ID NO: 2586092 - RNA, 16 nt, Coxiella burnetii RSA 493
gaaauuauuugauuuu

SEQ ID NO: 2586093 - RNA, 22 nt, Coxiella burnetii RSA 493
gaauuuuuugcggaauuugaua

SEQ ID NO: 2586094 - RNA, 13 nt, Coxiella burnetii RSA 493
gacaaagaaggcg

SEQ ID NO: 2586095 - RNA, 15 nt, Coxiella burnetii RSA 493
gacaaaguuucuuca

SEQ ID NO: 2586096 - RNA, 13 nt, Coxiella burnetii RSA 493
gacaaauaaacaa

SEQ ID NO: 2586097 - RNA, 23 nt, Coxiella burnetii RSA 493
gacaaauaaagaauuugacaagc

SEQ ID NO: 2586098 - RNA, 19 nt, Coxiella burnetii RSA 493
gacaaggcucacaauuaac

SEQ ID NO: 2586099 - RNA, 16 nt, Coxiella burnetii RSA 493
gacaauagaauaauga

SEQ ID NO: 2586100 - RNA, 19 nt, Coxiella burnetii RSA 493
gacaauagaauaaugaaca

SEQ ID NO: 2586101 - RNA, 19 nt, Coxiella burnetii RSA 493
gacaaugcccgaaaaggaa

SEQ ID NO: 2586102 - RNA, 21 nt, Coxiella burnetii RSA 493
gacaaugcccgaaaaggaaau

SEQ ID NO: 2586103 - RNA, 15 nt, Coxiella burnetii RSA 493
gacaaugcguuuuaa

SEQ ID NO: 2586104 - RNA, 15 nt, Coxiella burnetii RSA 493
gacacauuuuuucaa

SEQ ID NO: 2586105 - RNA, 20 nt, Coxiella burnetii RSA 493
gacagaaggcagaggacaga

SEQ ID NO: 2586106 - RNA, 20 nt, Coxiella burnetii RSA 493
gacagauaaaccguggugcc

SEQ ID NO: 2586107 - RNA, 13 nt, Coxiella burnetii RSA 493
gacagguauuuua

SEQ ID NO: 2586108 - RNA, 21 nt, Coxiella burnetii RSA 493
gacagguauuuuaaguaauuu

SEQ ID NO: 2586109 - RNA, 18 nt, Coxiella burnetii RSA 493
gacaguuuagaaucucac

SEQ ID NO: 2586110 - RNA, 14 nt, Coxiella burnetii RSA 493
gacauaaggcugcg

SEQ ID NO: 2586111 - RNA, 16 nt, Coxiella burnetii RSA 493
gacaucguuguuuucc

SEQ ID NO: 2586112 - RNA, 21 nt, Coxiella burnetii RSA 493
gacauggcgguaaugagaacc

SEQ ID NO: 2586113 - RNA, 13 nt, Coxiella burnetii RSA 493
gacauucuucucc

SEQ ID NO: 2586114 - RNA, 17 nt, Coxiella burnetii RSA 493
gacauuucacccagacu

SEQ ID NO: 2586115 - RNA, 13 nt, Coxiella burnetii RSA 493
gacauuuuuucaa

SEQ ID NO: 2586116 - RNA, 12 nt, Coxiella burnetii RSA 493
gaccaaaagccg

SEQ ID NO: 2586117 - RNA, 22 nt, Coxiella burnetii RSA 493
gaccaaauccgcauaaaaaccc

SEQ ID NO: 2586118 - RNA, 15 nt, Coxiella burnetii RSA 493
gacccccaauuuaau

SEQ ID NO: 2586119 - RNA, 16 nt, Coxiella burnetii RSA 493
gacccgcauucuuuua

SEQ ID NO: 2586120 - RNA, 16 nt, Coxiella burnetii RSA 493
gaccgcuaaagcaaaa

SEQ ID NO: 2586121 - RNA, 19 nt, Coxiella burnetii RSA 493
gaccgcuuagcaauguuuc

SEQ ID NO: 2586122 - RNA, 19 nt, Coxiella burnetii RSA 493
gaccugcugcccggguggu

SEQ ID NO: 2586123 - RNA, 14 nt, Coxiella burnetii RSA 493
gaccugugagggau

SEQ ID NO: 2586124 - RNA, 13 nt, Coxiella burnetii RSA 493
gaccuuuuccuua

SEQ ID NO: 2586125 - RNA, 20 nt, Coxiella burnetii RSA 493
gacgaauaacggaaaaugga

SEQ ID NO: 2586126 - RNA, 15 nt, Coxiella burnetii RSA 493
gacgauagaugacau

SEQ ID NO: 2586127 - RNA, 16 nt, Coxiella burnetii RSA 493
gacgauagaugacauc

SEQ ID NO: 2586128 - RNA, 19 nt, Coxiella burnetii RSA 493
gacgccauuuuuuagcacc

SEQ ID NO: 2586129 - RNA, 15 nt, Coxiella burnetii RSA 493
gacgcguaaaauagc

SEQ ID NO: 2586130 - RNA, 23 nt, Coxiella burnetii RSA 493
gacgcguggcuuuaucaggcgcu

SEQ ID NO: 2586131 - RNA, 18 nt, Coxiella burnetii RSA 493
gacgcucgguuccaaaaa

SEQ ID NO: 2586132 - RNA, 22 nt, Coxiella burnetii RSA 493
gacggaauuugugauuuuaaaa

SEQ ID NO: 2586133 - RNA, 22 nt, Coxiella burnetii RSA 493
gacgggcuguacauuuuucaag

SEQ ID NO: 2586134 - RNA, 20 nt, Coxiella burnetii RSA 493
gacgguuauguacucagcuu

SEQ ID NO: 2586135 - RNA, 16 nt, Coxiella burnetii RSA 493
gacguaccauuaaaag

SEQ ID NO: 2586136 - RNA, 16 nt, Coxiella burnetii RSA 493
gacguauugucaaaau

SEQ ID NO: 2586137 - RNA, 18 nt, Coxiella burnetii RSA 493
gacgucuugguuguuucu

SEQ ID NO: 2586138 - RNA, 17 nt, Coxiella burnetii RSA 493
gacguuauagaguaaau

SEQ ID NO: 2586139 - RNA, 23 nt, Coxiella burnetii RSA 493
gacguuaucacuugauaaucaau

SEQ ID NO: 2586140 - RNA, 23 nt, Coxiella burnetii RSA 493
gacguuucgucgauauccaaaac

SEQ ID NO: 2586141 - RNA, 16 nt, Coxiella burnetii RSA 493
gacuaaaaccuccugc

SEQ ID NO: 2586142 - RNA, 13 nt, Coxiella burnetii RSA 493
gacuaaaauaaag

SEQ ID NO: 2586143 - RNA, 18 nt, Coxiella burnetii RSA 493
gacuaagaauaagaauaa

SEQ ID NO: 2586144 - RNA, 17 nt, Coxiella burnetii RSA 493
gacuacaucaaauagau

SEQ ID NO: 2586145 - RNA, 21 nt, Coxiella burnetii RSA 493
gacuauaaaguaguugaaaaa

SEQ ID NO: 2586146 - RNA, 18 nt, Coxiella burnetii RSA 493
gacucaaccgguuuuucu

SEQ ID NO: 2586147 - RNA, 21 nt, Coxiella burnetii RSA 493
gacucuuuucggcguuaacgg

SEQ ID NO: 2586148 - RNA, 22 nt, Coxiella burnetii RSA 493
gacugauaacuauuauuaaaag

SEQ ID NO: 2586149 - RNA, 15 nt, Coxiella burnetii RSA 493
gacugugagcgcgaa

SEQ ID NO: 2586150 - RNA, 19 nt, Coxiella burnetii RSA 493
gacuuauuuuuauucuuaa

SEQ ID NO: 2586151 - RNA, 18 nt, Coxiella burnetii RSA 493
gacuucgcuaaauaacau

SEQ ID NO: 2586152 - RNA, 20 nt, Coxiella burnetii RSA 493
gacuucucuuucugagcuug

SEQ ID NO: 2586153 - RNA, 17 nt, Coxiella burnetii RSA 493
gacuuuaucuuuuuucu

SEQ ID NO: 2586154 - RNA, 23 nt, Coxiella burnetii RSA 493
gagaaaaccgcagcucaaacaaa

SEQ ID NO: 2586155 - RNA, 22 nt, Coxiella burnetii RSA 493
gagaaaacuuuucaucccccgc

SEQ ID NO: 2586156 - RNA, 21 nt, Coxiella burnetii RSA 493
gagaaauugacaaauaaagaa

SEQ ID NO: 2586157 - RNA, 23 nt, Coxiella burnetii RSA 493
gagaaccauuaguguaaggcuga

SEQ ID NO: 2586158 - RNA, 13 nt, Coxiella burnetii RSA 493
gagaacguaaaau

SEQ ID NO: 2586159 - RNA, 18 nt, Coxiella burnetii RSA 493
gagaagauuuuuuuucuu

SEQ ID NO: 2586160 - RNA, 19 nt, Coxiella burnetii RSA 493
gagaauagcauuagacauu

SEQ ID NO: 2586161 - RNA, 15 nt, Coxiella burnetii RSA 493
gagaauuaaaaauau

SEQ ID NO: 2586162 - RNA, 22 nt, Coxiella burnetii RSA 493
gagaggaugcagcuucgugcaa

SEQ ID NO: 2586163 - RNA, 20 nt, Coxiella burnetii RSA 493
gagaggugaaccaaaaggaa

SEQ ID NO: 2586164 - RNA, 17 nt, Coxiella burnetii RSA 493
gagauccacuuucucgc

SEQ ID NO: 2586165 - RNA, 12 nt, Coxiella burnetii RSA 493
gagauuauucaa

SEQ ID NO: 2586166 - RNA, 17 nt, Coxiella burnetii RSA 493
gagauugccagcaaugg

SEQ ID NO: 2586167 - RNA, 13 nt, Coxiella burnetii RSA 493
gagcaaacagucc

SEQ ID NO: 2586168 - RNA, 22 nt, Coxiella burnetii RSA 493
gagcaauaucugaucaaaaaua

SEQ ID NO: 2586169 - RNA, 18 nt, Coxiella burnetii RSA 493
gagcaaucaaaacagcaa

SEQ ID NO: 2586170 - RNA, 22 nt, Coxiella burnetii RSA 493
gagcaauggcgcgaggaauuga

SEQ ID NO: 2586171 - RNA, 16 nt, Coxiella burnetii RSA 493
gagcaauucaauuuuu

SEQ ID NO: 2586172 - RNA, 14 nt, Coxiella burnetii RSA 493
gagcauauaaaagu

SEQ ID NO: 2586173 - RNA, 19 nt, Coxiella burnetii RSA 493
gagcaucuuuuugcaaaua

SEQ ID NO: 2586174 - RNA, 15 nt, Coxiella burnetii RSA 493
gagccagauaaauca

SEQ ID NO: 2586175 - RNA, 15 nt, Coxiella burnetii RSA 493
gagccagcuaaguaa

SEQ ID NO: 2586176 - RNA, 21 nt, Coxiella burnetii RSA 493
gagccaucacaccaagaaauu

SEQ ID NO: 2586177 - RNA, 22 nt, Coxiella burnetii RSA 493
gagccaucacaccaagaaauug

SEQ ID NO: 2586178 - RNA, 19 nt, Coxiella burnetii RSA 493
gagccauuaagacaccauc

SEQ ID NO: 2586179 - RNA, 17 nt, Coxiella burnetii RSA 493
gagccgcuaauaacauu

SEQ ID NO: 2586180 - RNA, 14 nt, Coxiella burnetii RSA 493
gagccgucauccaa

SEQ ID NO: 2586181 - RNA, 14 nt, Coxiella burnetii RSA 493
gagcgaaagccaag

SEQ ID NO: 2586182 - RNA, 17 nt, Coxiella burnetii RSA 493
gagcgaacgaauacggg

SEQ ID NO: 2586183 - RNA, 18 nt, Coxiella burnetii RSA 493
gagcgaacgaauacgggg

SEQ ID NO: 2586184 - RNA, 19 nt, Coxiella burnetii RSA 493
gagcgaagaaaaagaaauu

SEQ ID NO: 2586185 - RNA, 20 nt, Coxiella burnetii RSA 493
gagcgaagcgaaauacggga

SEQ ID NO: 2586186 - RNA, 20 nt, Coxiella burnetii RSA 493
gagcgaagcgaaguacggga

SEQ ID NO: 2586187 - RNA, 16 nt, Coxiella burnetii RSA 493
gagcgacuucauugag

SEQ ID NO: 2586188 - RNA, 21 nt, Coxiella burnetii RSA 493
gagcgacuucauugagcggga

SEQ ID NO: 2586189 - RNA, 17 nt, Coxiella burnetii RSA 493
gagcggauauaacgcca

SEQ ID NO: 2586190 - RNA, 16 nt, Coxiella burnetii RSA 493
gagcgggauauuuuuu

SEQ ID NO: 2586191 - RNA, 15 nt, Coxiella burnetii RSA 493
gagcguaaaacacgg

SEQ ID NO: 2586192 - RNA, 17 nt, Coxiella burnetii RSA 493
gagcgugacuaaaauaa

SEQ ID NO: 2586193 - RNA, 14 nt, Coxiella burnetii RSA 493
gagcuauaauucuc

SEQ ID NO: 2586194 - RNA, 13 nt, Coxiella burnetii RSA 493
gagcuugcauuau

SEQ ID NO: 2586195 - RNA, 24 nt, Coxiella burnetii RSA 493
gagcuugccuguaaaauaagaagg

SEQ ID NO: 2586196 - RNA, 20 nt, Coxiella burnetii RSA 493
gaggaagcgcacggacguga

SEQ ID NO: 2586197 - RNA, 20 nt, Coxiella burnetii RSA 493
gaggacagaggacagugguu

SEQ ID NO: 2586198 - RNA, 15 nt, Coxiella burnetii RSA 493
gauguuuuaaaauua

SEQ ID NO: 2586199 - RNA, 13 nt, Coxiella burnetii RSA 493
gauuaaaaauuuu

SEQ ID NO: 2586200 - RNA, 14 nt, Coxiella burnetii RSA 493
gauuaaaaauuuua

SEQ ID NO: 2586201 - RNA, 18 nt, Coxiella burnetii RSA 493
gauuaaaaauuuuaaaaa

SEQ ID NO: 2586202 - RNA, 20 nt, Coxiella burnetii RSA 493
gauuaaaaauuuuaaaaaaa

SEQ ID NO: 2586203 - RNA, 11 nt, Coxiella burnetii RSA 493
gauuaaaagug

SEQ ID NO: 2586204 - RNA, 23 nt, Coxiella burnetii RSA 493
gauuaaacgcgauaucuccauuu

SEQ ID NO: 2586205 - RNA, 19 nt, Coxiella burnetii RSA 493
gauuaaauaacucaucgac

SEQ ID NO: 2586206 - RNA, 20 nt, Coxiella burnetii RSA 493
gauuaaucguuuuugcuaga

SEQ ID NO: 2586207 - RNA, 15 nt, Coxiella burnetii RSA 493
gauuaccuuugcgca

SEQ ID NO: 2586208 - RNA, 14 nt, Coxiella burnetii RSA 493
gauuacuugauauu

SEQ ID NO: 2586209 - RNA, 12 nt, Coxiella burnetii RSA 493
gauuagagcgau

SEQ ID NO: 2586210 - RNA, 18 nt, Coxiella burnetii RSA 493
gauuaucgaggaaaauug

SEQ ID NO: 2586211 - RNA, 20 nt, Coxiella burnetii RSA 493
gauuaucuuucgaccaggac

SEQ ID NO: 2586212 - RNA, 15 nt, Coxiella burnetii RSA 493
gauuauguauuuuuu

SEQ ID NO: 2586213 - RNA, 17 nt, Coxiella burnetii RSA 493
gauuauguauuuuuugg

SEQ ID NO: 2586214 - RNA, 18 nt, Coxiella burnetii RSA 493
gauucaugaaaaucuaaa

SEQ ID NO: 2586215 - RNA, 20 nt, Coxiella burnetii RSA 493
gauucaugaaaaucuaaagg

SEQ ID NO: 2586216 - RNA, 19 nt, Coxiella burnetii RSA 493
gauucauuaucaugcauuu

SEQ ID NO: 2586217 - RNA, 23 nt, Coxiella burnetii RSA 493
gauuccaaagcagauaaauguuu

SEQ ID NO: 2586218 - RNA, 14 nt, Coxiella burnetii RSA 493
gauuccaauauuga

SEQ ID NO: 2586219 - RNA, 14 nt, Coxiella burnetii RSA 493
gauucguaauauua

SEQ ID NO: 2586220 - RNA, 17 nt, Coxiella burnetii RSA 493
gauucuacagaacuuuu

SEQ ID NO: 2586221 - RNA, 12 nt, Coxiella burnetii RSA 493
gauucuauacuu

SEQ ID NO: 2586222 - RNA, 16 nt, Coxiella burnetii RSA 493
gauucucucaaagaaa

SEQ ID NO: 2586223 - RNA, 18 nt, Coxiella burnetii RSA 493
gauucuguaacuuuucca

SEQ ID NO: 2586224 - RNA, 19 nt, Coxiella burnetii RSA 493
gauucuucuuuugccauau

SEQ ID NO: 2586225 - RNA, 21 nt, Coxiella burnetii RSA 493
gauugauacugcguuuuucag

SEQ ID NO: 2586226 - RNA, 20 nt, Coxiella burnetii RSA 493
gauugauuuuguccuguucu

SEQ ID NO: 2586227 - RNA, 18 nt, Coxiella burnetii RSA 493
gauugcacuucagucgcc

SEQ ID NO: 2586228 - RNA, 16 nt, Coxiella burnetii RSA 493
gauugcguaaugcaau

SEQ ID NO: 2586229 - RNA, 18 nt, Coxiella burnetii RSA 493
gauuguuguggauaaagg

SEQ ID NO: 2586230 - RNA, 19 nt, Coxiella burnetii RSA 493
gauuuacaauaacaaauga

SEQ ID NO: 2586231 - RNA, 17 nt, Coxiella burnetii RSA 493
gauuuacaauaucccau

SEQ ID NO: 2586232 - RNA, 18 nt, Coxiella burnetii RSA 493
gauuuaccuuaagaagag

SEQ ID NO: 2586233 - RNA, 15 nt, Coxiella burnetii RSA 493
gauuucacuuuauuu

SEQ ID NO: 2586234 - RNA, 18 nt, Coxiella burnetii RSA 493
gauuucaucuugcugcau

SEQ ID NO: 2586235 - RNA, 19 nt, Coxiella burnetii RSA 493
gauuucaucuugcugcaua

SEQ ID NO: 2586236 - RNA, 21 nt, Coxiella burnetii RSA 493
gauuuccacuuguuuuucggu

SEQ ID NO: 2586237 - RNA, 20 nt, Coxiella burnetii RSA 493
gauuuccaucgaaaaugcuc

SEQ ID NO: 2586238 - RNA, 14 nt, Coxiella burnetii RSA 493
gauuugaguaagaa

SEQ ID NO: 2586239 - RNA, 17 nt, Coxiella burnetii RSA 493
gauuuuaagaaucgucg

SEQ ID NO: 2586240 - RNA, 13 nt, Coxiella burnetii RSA 493
gauuuuaauuuuu

SEQ ID NO: 2586241 - RNA, 16 nt, Coxiella burnetii RSA 493
gauuuuaauuuuuucu

SEQ ID NO: 2586242 - RNA, 22 nt, Coxiella burnetii RSA 493
gauuuuaauuuuuucucugcaa

SEQ ID NO: 2586243 - RNA, 13 nt, Coxiella burnetii RSA 493
gauuuuaucuuau

SEQ ID NO: 2586244 - RNA, 13 nt, Coxiella burnetii RSA 493
gauuuucaaaaga

SEQ ID NO: 2586245 - RNA, 22 nt, Coxiella burnetii RSA 493
gauuuuggcucccuaauacugu

SEQ ID NO: 2586246 - RNA, 21 nt, Coxiella burnetii RSA 493
gauuuuuaagggcucgcuaau

SEQ ID NO: 2586247 - RNA, 19 nt, Coxiella burnetii RSA 493
gauuuuucuuuguuccuug

SEQ ID NO: 2586248 - RNA, 14 nt, Coxiella burnetii RSA 493
gauuuuuuaaaucu

SEQ ID NO: 2586249 - RNA, 17 nt, Coxiella burnetii RSA 493
gauuuuuuaaugaaaaa

SEQ ID NO: 2586250 - RNA, 16 nt, Coxiella burnetii RSA 493
gauuuuuuaauuggua

SEQ ID NO: 2586251 - RNA, 15 nt, Coxiella burnetii RSA 493
gcaaaaaaagaaaau

SEQ ID NO: 2586252 - RNA, 18 nt, Coxiella burnetii RSA 493
gcaaaaccaauagcuccc

SEQ ID NO: 2586253 - RNA, 23 nt, Coxiella burnetii RSA 493
gcaaacagcuagcccccgaaaca

SEQ ID NO: 2586254 - RNA, 18 nt, Coxiella burnetii RSA 493
gcaaacaugcgaaagcaa

SEQ ID NO: 2586255 - RNA, 23 nt, Coxiella burnetii RSA 493
gcaaagaucuccccuucuuuaau

SEQ ID NO: 2586256 - RNA, 18 nt, Coxiella burnetii RSA 493
gcaaagccgcuauuucua

SEQ ID NO: 2586257 - RNA, 16 nt, Coxiella burnetii RSA 493
gcaaaguaaaaaugaa

SEQ ID NO: 2586258 - RNA, 23 nt, Coxiella burnetii RSA 493
gcaaauaaugaguggcugcuucu

SEQ ID NO: 2586259 - RNA, 13 nt, Coxiella burnetii RSA 493
gcaaaugaauaac

SEQ ID NO: 2586260 - RNA, 19 nt, Coxiella burnetii RSA 493
gcaaauguugauaauaaau

SEQ ID NO: 2586261 - RNA, 19 nt, Coxiella burnetii RSA 493
gcaaauucgggcaacgagg

SEQ ID NO: 2586262 - RNA, 14 nt, Coxiella burnetii RSA 493
gcaaauugcccaaa

SEQ ID NO: 2586263 - RNA, 23 nt, Coxiella burnetii RSA 493
gcaacaccacggcgaacaccuaa

SEQ ID NO: 2586264 - RNA, 17 nt, Coxiella burnetii RSA 493
gcaacgaaaauaccuuu

SEQ ID NO: 2586265 - RNA, 18 nt, Coxiella burnetii RSA 493
gcaacguuugauuuucaa

SEQ ID NO: 2586266 - RNA, 20 nt, Coxiella burnetii RSA 493
gcaacguuugauuuucaagu

SEQ ID NO: 2586267 - RNA, 23 nt, Coxiella burnetii RSA 493
gcaacuuuaacauuaucauguuc

SEQ ID NO: 2586268 - RNA, 17 nt, Coxiella burnetii RSA 493
gcaagacaauguuaaaa

SEQ ID NO: 2586269 - RNA, 21 nt, Coxiella burnetii RSA 493
gcaagaugaggaauagggaga

SEQ ID NO: 2586270 - RNA, 14 nt, Coxiella burnetii RSA 493
gcaagcagaagggc

SEQ ID NO: 2586271 - RNA, 15 nt, Coxiella burnetii RSA 493
gcaagucccucugaa

SEQ ID NO: 2586272 - RNA, 23 nt, Coxiella burnetii RSA 493
gcaauaccauuuuuaaauuaucu

SEQ ID NO: 2586273 - RNA, 19 nt, Coxiella burnetii RSA 493
gcaauacccaauucagaau

SEQ ID NO: 2586274 - RNA, 19 nt, Coxiella burnetii RSA 493
gcaauaccccaaucgauua

SEQ ID NO: 2586275 - RNA, 18 nt, Coxiella burnetii RSA 493
gcaauaggguuaguaacu

SEQ ID NO: 2586276 - RNA, 15 nt, Coxiella burnetii RSA 493
gcaauaucagaaacc

SEQ ID NO: 2586277 - RNA, 21 nt, Coxiella burnetii RSA 493
gcaauaucugaucaaaaauaa

SEQ ID NO: 2586278 - RNA, 23 nt, Coxiella burnetii RSA 493
gcaaugaaauauauaaaggaacc

SEQ ID NO: 2586279 - RNA, 20 nt, Coxiella burnetii RSA 493
gcaauuccauuaaaaacaau

SEQ ID NO: 2586280 - RNA, 19 nt, Coxiella burnetii RSA 493
gcaauucgaccuuugaaaa

SEQ ID NO: 2586281 - RNA, 23 nt, Coxiella burnetii RSA 493
gcaauucgcggguaaauuuauca

SEQ ID NO: 2586282 - RNA, 19 nt, Coxiella burnetii RSA 493
gcaauuuauucgauaugaa

SEQ ID NO: 2586283 - RNA, 13 nt, Coxiella burnetii RSA 493
gcaauuugugaaa

SEQ ID NO: 2586284 - RNA, 20 nt, Coxiella burnetii RSA 493
gcacaaaaaaauuauuuuua

SEQ ID NO: 2586285 - RNA, 14 nt, Coxiella burnetii RSA 493
gcacagcgaaauac

SEQ ID NO: 2586286 - RNA, 14 nt, Coxiella burnetii RSA 493
gcaccagggguuau

SEQ ID NO: 2586287 - RNA, 22 nt, Coxiella burnetii RSA 493
gcaccuuaacgccuaucuuuuu

SEQ ID NO: 2586288 - RNA, 18 nt, Coxiella burnetii RSA 493
gcaccuuggcguccuguu

SEQ ID NO: 2586289 - RNA, 14 nt, Coxiella burnetii RSA 493
gcacgaugcacagu

SEQ ID NO: 2586290 - RNA, 17 nt, Coxiella burnetii RSA 493
gcacgguaauaauauaa

SEQ ID NO: 2586291 - RNA, 12 nt, Coxiella burnetii RSA 493
gcacuucuuuua

SEQ ID NO: 2586292 - RNA, 15 nt, Coxiella burnetii RSA 493
gcagaauuuguacaa

SEQ ID NO: 2586293 - RNA, 20 nt, Coxiella burnetii RSA 493
gcagacaucgcaauuaauac

SEQ ID NO: 2586294 - RNA, 14 nt, Coxiella burnetii RSA 493
gcagaugauuaaaa

SEQ ID NO: 2586295 - RNA, 23 nt, Coxiella burnetii RSA 493
gcagccuaauuuaaugccgauaa

SEQ ID NO: 2586296 - RNA, 15 nt, Coxiella burnetii RSA 493
gcagcgaagcgaaau

SEQ ID NO: 2586297 - RNA, 19 nt, Coxiella burnetii RSA 493
gcagcgaagcggaauacgg

SEQ ID NO: 2586298 - RNA, 18 nt, Coxiella burnetii RSA 493
gcagcucaaacaaaucaa

SEQ ID NO: 2586299 - RNA, 20 nt, Coxiella burnetii RSA 493
gcagcugauuucugguugaa

SEQ ID NO: 2586300 - RNA, 12 nt, Coxiella burnetii RSA 493
gcaggaucuugu

SEQ ID NO: 2586301 - RNA, 15 nt, Coxiella burnetii RSA 493
gcaggcauucaacac

SEQ ID NO: 2586302 - RNA, 13 nt, Coxiella burnetii RSA 493
gcaguaucuauuc

SEQ ID NO: 2586303 - RNA, 16 nt, Coxiella burnetii RSA 493
gccggcuaauuuuuua

SEQ ID NO: 2586304 - RNA, 18 nt, Coxiella burnetii RSA 493
gccgguacacaaaauuuc

SEQ ID NO: 2586305 - RNA, 23 nt, Coxiella burnetii RSA 493
gccgguacacaaaauuucaagua

SEQ ID NO: 2586306 - RNA, 14 nt, Coxiella burnetii RSA 493
gccgguaccccaug

SEQ ID NO: 2586307 - RNA, 13 nt, Coxiella burnetii RSA 493
gccgguucuuuuc

SEQ ID NO: 2586308 - RNA, 15 nt, Coxiella burnetii RSA 493
gccgucauccaaacg

SEQ ID NO: 2586309 - RNA, 15 nt, Coxiella burnetii RSA 493
gccguucaccccauu

SEQ ID NO: 2586310 - RNA, 19 nt, Coxiella burnetii RSA 493
gccuaaguuuaacagacag

SEQ ID NO: 2586311 - RNA, 13 nt, Coxiella burnetii RSA 493
gccuacuuuuguu

SEQ ID NO: 2586312 - RNA, 13 nt, Coxiella burnetii RSA 493
gccuccagggcuu

SEQ ID NO: 2586313 - RNA, 19 nt, Coxiella burnetii RSA 493
gccuccggcgcgcgcuuga

SEQ ID NO: 2586314 - RNA, 14 nt, Coxiella burnetii RSA 493
gccucgccuucuuc

SEQ ID NO: 2586315 - RNA, 22 nt, Coxiella burnetii RSA 493
gccucuauaaauaacagcgaac

SEQ ID NO: 2586316 - RNA, 17 nt, Coxiella burnetii RSA 493
gccucuuuuuguaaauu

SEQ ID NO: 2586317 - RNA, 21 nt, Coxiella burnetii RSA 493
gccugaaaaucaaauuuuccg

SEQ ID NO: 2586318 - RNA, 14 nt, Coxiella burnetii RSA 493
gccugaaauauuuu

SEQ ID NO: 2586319 - RNA, 15 nt, Coxiella burnetii RSA 493
gccugacagcccggc

SEQ ID NO: 2586320 - RNA, 22 nt, Coxiella burnetii RSA 493
gccuguggcaauuaugaaaacg

SEQ ID NO: 2586321 - RNA, 21 nt, Coxiella burnetii RSA 493
gccuuaaaacauaaaggccaa

SEQ ID NO: 2586322 - RNA, 17 nt, Coxiella burnetii RSA 493
gccuuaauguuuuuucu

SEQ ID NO: 2586323 - RNA, 14 nt, Coxiella burnetii RSA 493
gccuucuuuuucaa

SEQ ID NO: 2586324 - RNA, 14 nt, Coxiella burnetii RSA 493
gccuugcaaacaaa

SEQ ID NO: 2586325 - RNA, 17 nt, Coxiella burnetii RSA 493
gccuuggagcucuuguc

SEQ ID NO: 2586326 - RNA, 12 nt, Coxiella burnetii RSA 493
gccuuuauuaga

SEQ ID NO: 2586327 - RNA, 16 nt, Coxiella burnetii RSA 493
gccuuuauuagaaaag

SEQ ID NO: 2586328 - RNA, 13 nt, Coxiella burnetii RSA 493
gccuuuuuuuacu

SEQ ID NO: 2586329 - RNA, 19 nt, Coxiella burnetii RSA 493
gcgaaaagauuccaauauu

SEQ ID NO: 2586330 - RNA, 20 nt, Coxiella burnetii RSA 493
gcgaaauacgggaaaacaau

SEQ ID NO: 2586331 - RNA, 21 nt, Coxiella burnetii RSA 493
gcgaaauacgggaaaacaaug

SEQ ID NO: 2586332 - RNA, 21 nt, Coxiella burnetii RSA 493
gcgaaauacggggaaauaaug

SEQ ID NO: 2586333 - RNA, 22 nt, Coxiella burnetii RSA 493
gcgaaauacggggacgauaacg

SEQ ID NO: 2586334 - RNA, 22 nt, Coxiella burnetii RSA 493
gcgaaauuuaauaaaauuaaau

SEQ ID NO: 2586335 - RNA, 14 nt, Coxiella burnetii RSA 493
gcgaacucagccca

SEQ ID NO: 2586336 - RNA, 16 nt, Coxiella burnetii RSA 493
gcgaagcgaaauacgg

SEQ ID NO: 2586337 - RNA, 20 nt, Coxiella burnetii RSA 493
gcgaagcgaaauacgggaaa

SEQ ID NO: 2586338 - RNA, 20 nt, Coxiella burnetii RSA 493
gcgaagcgaaguacgggaaa

SEQ ID NO: 2586339 - RNA, 16 nt, Coxiella burnetii RSA 493
gcgaagcggaauacgg

SEQ ID NO: 2586340 - RNA, 20 nt, Coxiella burnetii RSA 493
gcgaaguacgggaaaacaau

SEQ ID NO: 2586341 - RNA, 16 nt, Coxiella burnetii RSA 493
gcgaaugguugaaaga

SEQ ID NO: 2586342 - RNA, 17 nt, Coxiella burnetii RSA 493
gcgaaugguugaaagaa

SEQ ID NO: 2586343 - RNA, 21 nt, Coxiella burnetii RSA 493
gcgaaugguugaaagaaaaaa

SEQ ID NO: 2586344 - RNA, 19 nt, Coxiella burnetii RSA 493
gcgacaaucauuuuuguac

SEQ ID NO: 2586345 - RNA, 17 nt, Coxiella burnetii RSA 493
gcgacaguauuucuauc

SEQ ID NO: 2586346 - RNA, 18 nt, Coxiella burnetii RSA 493
gcgacaguauuucuaucg

SEQ ID NO: 2586347 - RNA, 19 nt, Coxiella burnetii RSA 493
gcgagaagauuuuuuuucu

SEQ ID NO: 2586348 - RNA, 20 nt, Coxiella burnetii RSA 493
gcgagcaauaauuuccuguc

SEQ ID NO: 2586349 - RNA, 17 nt, Coxiella burnetii RSA 493
gcgagcaaucaaaacag

SEQ ID NO: 2586350 - RNA, 15 nt, Coxiella burnetii RSA 493
gcgagguaaagaggg

SEQ ID NO: 2586351 - RNA, 14 nt, Coxiella burnetii RSA 493
gcgauaaucauuaa

SEQ ID NO: 2586352 - RNA, 21 nt, Coxiella burnetii RSA 493
gcgauaucuccauuuucaagu

SEQ ID NO: 2586353 - RNA, 18 nt, Coxiella burnetii RSA 493
gcgaucuauagcuucaag

SEQ ID NO: 2586354 - RNA, 19 nt, Coxiella burnetii RSA 493
gcgauguagccuaaccaag

SEQ ID NO: 2586355 - RNA, 14 nt, Coxiella burnetii RSA 493
gcgauuaaauauuu

SEQ ID NO: 2586356 - RNA, 16 nt, Coxiella burnetii RSA 493
gcgauuuucucuucaa

SEQ ID NO: 2586357 - RNA, 19 nt, Coxiella burnetii RSA 493
gcgcaagacaauguuaaaa

SEQ ID NO: 2586358 - RNA, 24 nt, Coxiella burnetii RSA 493
gcgcaagacaauguuaaaacacau

SEQ ID NO: 2586359 - RNA, 13 nt, Coxiella burnetii RSA 493
gcgcaaguuuuga

SEQ ID NO: 2586360 - RNA, 16 nt, Coxiella burnetii RSA 493
gcgcacucaaccagaa

SEQ ID NO: 2586361 - RNA, 16 nt, Coxiella burnetii RSA 493
gcgcaucaaaaaaacc

SEQ ID NO: 2586362 - RNA, 13 nt, Coxiella burnetii RSA 493
gcgcauucuagga

SEQ ID NO: 2586363 - RNA, 14 nt, Coxiella burnetii RSA 493
gcgcauuuuuauuc

SEQ ID NO: 2586364 - RNA, 16 nt, Coxiella burnetii RSA 493
gcgccaugcauaucgg

SEQ ID NO: 2586365 - RNA, 23 nt, Coxiella burnetii RSA 493
gcgcgaucaagacucaaagaaau

SEQ ID NO: 2586366 - RNA, 21 nt, Coxiella burnetii RSA 493
gcgcgauuuucucuucaacgc

SEQ ID NO: 2586367 - RNA, 15 nt, Coxiella burnetii RSA 493
gcgcguauuuaaggu

SEQ ID NO: 2586368 - RNA, 15 nt, Coxiella burnetii RSA 493
gcgcuaaaagcgcgc

SEQ ID NO: 2586369 - RNA, 15 nt, Coxiella burnetii RSA 493
gcgcuccucuauaua

SEQ ID NO: 2586370 - RNA, 17 nt, Coxiella burnetii RSA 493
gcgcucggguucuacaa

SEQ ID NO: 2586371 - RNA, 14 nt, Coxiella burnetii RSA 493
gcgcugaaguccuu

SEQ ID NO: 2586372 - RNA, 22 nt, Coxiella burnetii RSA 493
gcgcuuuuauuccuuuuuuuaa

SEQ ID NO: 2586373 - RNA, 12 nt, Coxiella burnetii RSA 493
gcggaaaaggag

SEQ ID NO: 2586374 - RNA, 16 nt, Coxiella burnetii RSA 493
gcggacaauaagagcu

SEQ ID NO: 2586375 - RNA, 18 nt, Coxiella burnetii RSA 493
gcggaccguaagccgccc

SEQ ID NO: 2586376 - RNA, 13 nt, Coxiella burnetii RSA 493
gcggauuguaaac

SEQ ID NO: 2586377 - RNA, 18 nt, Coxiella burnetii RSA 493
gcggcaagccagccgcca

SEQ ID NO: 2586378 - RNA, 19 nt, Coxiella burnetii RSA 493
gcggcgauaaucauuaacg

SEQ ID NO: 2586379 - RNA, 16 nt, Coxiella burnetii RSA 493
gcggcuaaugcuuuuu

SEQ ID NO: 2586380 - RNA, 18 nt, Coxiella burnetii RSA 493
gcggcuagguaacuuaaa

SEQ ID NO: 2586381 - RNA, 13 nt, Coxiella burnetii RSA 493
gcggcuuuuucaa

SEQ ID NO: 2586382 - RNA, 19 nt, Coxiella burnetii RSA 493
gcgguauggauaguuucaa

SEQ ID NO: 2586383 - RNA, 21 nt, Coxiella burnetii RSA 493
gcgguauuguucaacuugggu

SEQ ID NO: 2586384 - RNA, 20 nt, Coxiella burnetii RSA 493
gcgguguuuaggcgccacag

SEQ ID NO: 2586385 - RNA, 13 nt, Coxiella burnetii RSA 493
gcguaaaauucca

SEQ ID NO: 2586386 - RNA, 14 nt, Coxiella burnetii RSA 493
gcguaaagauaaaa

SEQ ID NO: 2586387 - RNA, 19 nt, Coxiella burnetii RSA 493
gcguaaagauaaaaugacc

SEQ ID NO: 2586388 - RNA, 16 nt, Coxiella burnetii RSA 493
gcguaaaguugccggu

SEQ ID NO: 2586389 - RNA, 18 nt, Coxiella burnetii RSA 493
gcguaacgucacaaauaa

SEQ ID NO: 2586390 - RNA, 14 nt, Coxiella burnetii RSA 493
gcguaccaaugucu

SEQ ID NO: 2586391 - RNA, 23 nt, Coxiella burnetii RSA 493
gcgucugcgacgacgcuuugguu

SEQ ID NO: 2586392 - RNA, 21 nt, Coxiella burnetii RSA 493
gcgucuuggagauuuagccaa

SEQ ID NO: 2586393 - RNA, 14 nt, Coxiella burnetii RSA 493
gcgugagaggacca

SEQ ID NO: 2586394 - RNA, 19 nt, Coxiella burnetii RSA 493
gcguuauugaucaaacgcc

SEQ ID NO: 2586395 - RNA, 16 nt, Coxiella burnetii RSA 493
gcguuccuuucaucaa

SEQ ID NO: 2586396 - RNA, 19 nt, Coxiella burnetii RSA 493
gcguucuuaaagucuucaa

SEQ ID NO: 2586397 - RNA, 20 nt, Coxiella burnetii RSA 493
gcguugauagggcuuugggu

SEQ ID NO: 2586398 - RNA, 11 nt, Coxiella burnetii RSA 493
gcguugauuuu

SEQ ID NO: 2586399 - RNA, 14 nt, Coxiella burnetii RSA 493
gcguugccgccugu

SEQ ID NO: 2586400 - RNA, 15 nt, Coxiella burnetii RSA 493
gcguuguaaauuuug

SEQ ID NO: 2586401 - RNA, 17 nt, Coxiella burnetii RSA 493
gcguuuccaauuguuug

SEQ ID NO: 2586402 - RNA, 14 nt, Coxiella burnetii RSA 493
gcuaaaaaauuacg

SEQ ID NO: 2586403 - RNA, 12 nt, Coxiella burnetii RSA 493
gcuaaaaucacg

SEQ ID NO: 2586404 - RNA, 16 nt, Coxiella burnetii RSA 493
gcuaaagcaaaaguaa

SEQ ID NO: 2586405 - RNA, 17 nt, Coxiella burnetii RSA 493
gcuaaauccagcgauug

SEQ ID NO: 2586406 - RNA, 22 nt, Coxiella burnetii RSA 493
gcuaacaauuguugauuuaacu

SEQ ID NO: 2586407 - RNA, 18 nt, Coxiella burnetii RSA 493
gcuaacuggauugauagu

SEQ ID NO: 2586408 - RNA, 19 nt, Coxiella burnetii RSA 493
gcuaagaucaagaaagaca

SEQ ID NO: 2586409 - RNA, 20 nt, Coxiella burnetii RSA 493
gcuuuucguucugaaauuuu

SEQ ID NO: 2586410 - RNA, 20 nt, Coxiella burnetii RSA 493
gcuuuugaagcgauugacuu

SEQ ID NO: 2586411 - RNA, 14 nt, Coxiella burnetii RSA 493
gcuuuugaauuuuu

SEQ ID NO: 2586412 - RNA, 11 nt, Coxiella burnetii RSA 493
gcuuuuuccac

SEQ ID NO: 2586413 - RNA, 15 nt, Coxiella burnetii RSA 493
gcuuuuuucaaaauu

SEQ ID NO: 2586414 - RNA, 12 nt, Coxiella burnetii RSA 493
gcuuuuuucgcu

SEQ ID NO: 2586415 - RNA, 11 nt, Coxiella burnetii RSA 493
gcuuuuuugcu

SEQ ID NO: 2586416 - RNA, 18 nt, Coxiella burnetii RSA 493
gcuuuuuugcuucuucca

SEQ ID NO: 2586417 - RNA, 11 nt, Coxiella burnetii RSA 493
ggaaaaggaga

SEQ ID NO: 2586418 - RNA, 16 nt, Coxiella burnetii RSA 493
ggaaaaggagaaagug

SEQ ID NO: 2586419 - RNA, 11 nt, Coxiella burnetii RSA 493
ggaaagaaaau

SEQ ID NO: 2586420 - RNA, 14 nt, Coxiella burnetii RSA 493
ggaaagaaaaugag

SEQ ID NO: 2586421 - RNA, 15 nt, Coxiella burnetii RSA 493
ggaaccuagcaauaa

SEQ ID NO: 2586422 - RNA, 22 nt, Coxiella burnetii RSA 493
ggaacgacggacauuuuuucaa

SEQ ID NO: 2586423 - RNA, 18 nt, Coxiella burnetii RSA 493
ggaacgcgaaaagauucc

SEQ ID NO: 2586424 - RNA, 17 nt, Coxiella burnetii RSA 493
ggaacugaugaauaaca

SEQ ID NO: 2586425 - RNA, 13 nt, Coxiella burnetii RSA 493
ggaacuuauccau

SEQ ID NO: 2586426 - RNA, 23 nt, Coxiella burnetii RSA 493
ggaacuuuuaacuucucuugaau

SEQ ID NO: 2586427 - RNA, 16 nt, Coxiella burnetii RSA 493
ggaaggacaaaaauau

SEQ ID NO: 2586428 - RNA, 20 nt, Coxiella burnetii RSA 493
ggaauacggagaaaaugauu

SEQ ID NO: 2586429 - RNA, 23 nt, Coxiella burnetii RSA 493
ggaauaguuuuggcguaugaaua

SEQ ID NO: 2586430 - RNA, 17 nt, Coxiella burnetii RSA 493
ggaauauuggccuuagc

SEQ ID NO: 2586431 - RNA, 19 nt, Coxiella burnetii RSA 493
ggaaugacguauugucaaa

SEQ ID NO: 2586432 - RNA, 15 nt, Coxiella burnetii RSA 493
ggaauuauugaauua

SEQ ID NO: 2586433 - RNA, 17 nt, Coxiella burnetii RSA 493
ggaauuguguuuuaauu

SEQ ID NO: 2586434 - RNA, 19 nt, Coxiella burnetii RSA 493
ggacaccguugagcaagca

SEQ ID NO: 2586435 - RNA, 20 nt, Coxiella burnetii RSA 493
ggaccgcaugguccaaaaaa

SEQ ID NO: 2586436 - RNA, 19 nt, Coxiella burnetii RSA 493
ggaccuuuuuugcaacuuc

SEQ ID NO: 2586437 - RNA, 14 nt, Coxiella burnetii RSA 493
ggacgauagauggc

SEQ ID NO: 2586438 - RNA, 19 nt, Coxiella burnetii RSA 493
ggacuacaucaaauagaug

SEQ ID NO: 2586439 - RNA, 22 nt, Coxiella burnetii RSA 493
ggacuacaucaaauagaugacu

SEQ ID NO: 2586440 - RNA, 13 nt, Coxiella burnetii RSA 493
ggacucgauggga

SEQ ID NO: 2586441 - RNA, 15 nt, Coxiella burnetii RSA 493
ggagaaauugacaaa

SEQ ID NO: 2586442 - RNA, 18 nt, Coxiella burnetii RSA 493
ggagaagaagccaguauu

SEQ ID NO: 2586443 - RNA, 14 nt, Coxiella burnetii RSA 493
ggagacaccaauaa

SEQ ID NO: 2586444 - RNA, 20 nt, Coxiella burnetii RSA 493
ggagauuaaaaauuugauua

SEQ ID NO: 2586445 - RNA, 12 nt, Coxiella burnetii RSA 493
ggagcgagcaua

SEQ ID NO: 2586446 - RNA, 12 nt, Coxiella burnetii RSA 493
ggagcgauaaug

SEQ ID NO: 2586447 - RNA, 14 nt, Coxiella burnetii RSA 493
ggagcggcugaauu

SEQ ID NO: 2586448 - RNA, 16 nt, Coxiella burnetii RSA 493
ggaggcauucugggca

SEQ ID NO: 2586449 - RNA, 18 nt, Coxiella burnetii RSA 493
ggaguuguauaaagguuu

SEQ ID NO: 2586450 - RNA, 20 nt, Coxiella burnetii RSA 493
ggauaauaucuagauuuaaa

SEQ ID NO: 2586451 - RNA, 17 nt, Coxiella burnetii RSA 493
ggauacgaccuucugaa

SEQ ID NO: 2586452 - RNA, 18 nt, Coxiella burnetii RSA 493
ggauacgaccuucugaau

SEQ ID NO: 2586453 - RNA, 12 nt, Coxiella burnetii RSA 493
ggaugaugcauu

SEQ ID NO: 2586454 - RNA, 17 nt, Coxiella burnetii RSA 493
ggaugcgacuuuuugca

SEQ ID NO: 2586455 - RNA, 15 nt, Coxiella burnetii RSA 493
ggaugucauaaucac

SEQ ID NO: 2586456 - RNA, 15 nt, Coxiella burnetii RSA 493
ggauuguaaacagac

SEQ ID NO: 2586457 - RNA, 12 nt, Coxiella burnetii RSA 493
ggcaaaaaaaga

SEQ ID NO: 2586458 - RNA, 17 nt, Coxiella burnetii RSA 493
ggcaaaaaaagaaaauc

SEQ ID NO: 2586459 - RNA, 19 nt, Coxiella burnetii RSA 493
ggcaaagccgcuauuucua

SEQ ID NO: 2586460 - RNA, 19 nt, Coxiella burnetii RSA 493
ggcaaauguugauaauaaa

SEQ ID NO: 2586461 - RNA, 22 nt, Coxiella burnetii RSA 493
ggcaaucagaaugcugauaauu

SEQ ID NO: 2586462 - RNA, 15 nt, Coxiella burnetii RSA 493
ggcaauuugugaaau

SEQ ID NO: 2586463 - RNA, 21 nt, Coxiella burnetii RSA 493
ggcacaaaaaaauuauuuuua

SEQ ID NO: 2586464 - RNA, 19 nt, Coxiella burnetii RSA 493
ggcaccaaaauccaaauuu

SEQ ID NO: 2586465 - RNA, 23 nt, Coxiella burnetii RSA 493
ggcagaggacagaggacaguggu

SEQ ID NO: 2586466 - RNA, 22 nt, Coxiella burnetii RSA 493
ggcauagggaucauuaucucuu

SEQ ID NO: 2586467 - RNA, 19 nt, Coxiella burnetii RSA 493
ggcaucaacggaaaaacaa

SEQ ID NO: 2586468 - RNA, 13 nt, Coxiella burnetii RSA 493
ggccaaagaaaau

SEQ ID NO: 2586469 - RNA, 17 nt, Coxiella burnetii RSA 493
ggccaauuucuaaucuc

SEQ ID NO: 2586470 - RNA, 11 nt, Coxiella burnetii RSA 493
ggccagcgaga

SEQ ID NO: 2586471 - RNA, 15 nt, Coxiella burnetii RSA 493
ggccccgucaucguc

SEQ ID NO: 2586472 - RNA, 22 nt, Coxiella burnetii RSA 493
ggccggauuuuuucuucugaau

SEQ ID NO: 2586473 - RNA, 17 nt, Coxiella burnetii RSA 493
ggccguaucuauuugca

SEQ ID NO: 2586474 - RNA, 14 nt, Coxiella burnetii RSA 493
ggccuuaauguuuu

SEQ ID NO: 2586475 - RNA, 21 nt, Coxiella burnetii RSA 493
ggccuucgauagcgcaguaag

SEQ ID NO: 2586476 - RNA, 23 nt, Coxiella burnetii RSA 493
ggcgaacagccgaugacaaauaa

SEQ ID NO: 2586477 - RNA, 11 nt, Coxiella burnetii RSA 493
ggcgagcgcgc

SEQ ID NO: 2586478 - RNA, 14 nt, Coxiella burnetii RSA 493
ggcgaucuauagcu

SEQ ID NO: 2586479 - RNA, 20 nt, Coxiella burnetii RSA 493
ggcgcaucuucgccuggcca

SEQ ID NO: 2586480 - RNA, 18 nt, Coxiella burnetii RSA 493
ggcguccuguugauacua

SEQ ID NO: 2586481 - RNA, 12 nt, Coxiella burnetii RSA 493
ggcuaaagguuu

SEQ ID NO: 2586482 - RNA, 18 nt, Coxiella burnetii RSA 493
ggcuaaagguuucaaauu

SEQ ID NO: 2586483 - RNA, 17 nt, Coxiella burnetii RSA 493
ggcuaaauaaggagcau

SEQ ID NO: 2586484 - RNA, 20 nt, Coxiella burnetii RSA 493
ggcuaacuggauugauagua

SEQ ID NO: 2586485 - RNA, 18 nt, Coxiella burnetii RSA 493
ggcuaauaggaaaaauga

SEQ ID NO: 2586486 - RNA, 20 nt, Coxiella burnetii RSA 493
ggcuacguuguccugauuua

SEQ ID NO: 2586487 - RNA, 16 nt, Coxiella burnetii RSA 493
ggcuacucuuuuucuu

SEQ ID NO: 2586488 - RNA, 17 nt, Coxiella burnetii RSA 493
ggcuacuugaaaaccua

SEQ ID NO: 2586489 - RNA, 20 nt, Coxiella burnetii RSA 493
ggcuacuuguugaaaaccua

SEQ ID NO: 2586490 - RNA, 12 nt, Coxiella burnetii RSA 493
ggcuaguaaaua

SEQ ID NO: 2586491 - RNA, 19 nt, Coxiella burnetii RSA 493
ggcucagugauuaaauugc

SEQ ID NO: 2586492 - RNA, 15 nt, Coxiella burnetii RSA 493
ggcucccuaauacug

SEQ ID NO: 2586493 - RNA, 15 nt, Coxiella burnetii RSA 493
ggcugaagaggcuga

SEQ ID NO: 2586494 - RNA, 20 nt, Coxiella burnetii RSA 493
ggcugaagaggcugaauaag

SEQ ID NO: 2586495 - RNA, 17 nt, Coxiella burnetii RSA 493
ggcugcuagaaguauuu

SEQ ID NO: 2586496 - RNA, 18 nt, Coxiella burnetii RSA 493
ggcuguucgccagaaaca

SEQ ID NO: 2586497 - RNA, 15 nt, Coxiella burnetii RSA 493
ggcuuaaguuuuuga

SEQ ID NO: 2586498 - RNA, 17 nt, Coxiella burnetii RSA 493
ggcuuaaguuuuugaua

SEQ ID NO: 2586499 - RNA, 21 nt, Coxiella burnetii RSA 493
ggcuuaaguuuuugauagggu

SEQ ID NO: 2586500 - RNA, 14 nt, Coxiella burnetii RSA 493
ggcuucauacagaa

SEQ ID NO: 2586501 - RNA, 18 nt, Coxiella burnetii RSA 493
ggcuucgagaggaauguu

SEQ ID NO: 2586502 - RNA, 22 nt, Coxiella burnetii RSA 493
ggcuucgcaaagcucagcccaa

SEQ ID NO: 2586503 - RNA, 17 nt, Coxiella burnetii RSA 493
ggcuucuaaguaaacag

SEQ ID NO: 2586504 - RNA, 14 nt, Coxiella burnetii RSA 493
ggcuugauuucagg

SEQ ID NO: 2586505 - RNA, 18 nt, Coxiella burnetii RSA 493
ggcuugauuucaggcgcc

SEQ ID NO: 2586506 - RNA, 13 nt, Coxiella burnetii RSA 493
ggcuugcuaugau

SEQ ID NO: 2586507 - RNA, 19 nt, Coxiella burnetii RSA 493
ggcuuuauucccgaugggg

SEQ ID NO: 2586508 - RNA, 12 nt, Coxiella burnetii RSA 493
ggcuuuuucaag

SEQ ID NO: 2586509 - RNA, 16 nt, Coxiella burnetii RSA 493
gggaaggcaaugauaa

SEQ ID NO: 2586510 - RNA, 17 nt, Coxiella burnetii RSA 493
gggaaucgacuuucuca

SEQ ID NO: 2586511 - RNA, 16 nt, Coxiella burnetii RSA 493
gggaccuuuuuugcaa

SEQ ID NO: 2586512 - RNA, 20 nt, Coxiella burnetii RSA 493
gggacuuuaagcacuucuuu

SEQ ID NO: 2586513 - RNA, 13 nt, Coxiella burnetii RSA 493
gggagauaggacu

SEQ ID NO: 2586514 - RNA, 17 nt, Coxiella burnetii RSA 493
gggagcgagcauauaaa

SEQ ID NO: 2586515 - RNA, 22 nt, Coxiella burnetii RSA 493
guaauugcuugguugauucaau

SEQ ID NO: 2586516 - RNA, 14 nt, Coxiella burnetii RSA 493
guaauuuaucccac

SEQ ID NO: 2586517 - RNA, 14 nt, Coxiella burnetii RSA 493
guaauuucuuccuc

SEQ ID NO: 2586518 - RNA, 20 nt, Coxiella burnetii RSA 493
guacaaaccacccuccagcc

SEQ ID NO: 2586519 - RNA, 19 nt, Coxiella burnetii RSA 493
guacacaaaauuucaagua

SEQ ID NO: 2586520 - RNA, 22 nt, Coxiella burnetii RSA 493
guacagcgagagaauuaaaaau

SEQ ID NO: 2586521 - RNA, 13 nt, Coxiella burnetii RSA 493
guacagcuccaua

SEQ ID NO: 2586522 - RNA, 18 nt, Coxiella burnetii RSA 493
guacagguuguuugcuua

SEQ ID NO: 2586523 - RNA, 20 nt, Coxiella burnetii RSA 493
guaccgaagaauaaugaacg

SEQ ID NO: 2586524 - RNA, 17 nt, Coxiella burnetii RSA 493
guacgccaaccauaauc

SEQ ID NO: 2586525 - RNA, 21 nt, Coxiella burnetii RSA 493
guacguuuuuagugcaaaaaa

SEQ ID NO: 2586526 - RNA, 20 nt, Coxiella burnetii RSA 493
guacuauuuccaacccagcu

SEQ ID NO: 2586527 - RNA, 22 nt, Coxiella burnetii RSA 493
guacugaaaaguaaaaguccuc

SEQ ID NO: 2586528 - RNA, 22 nt, Coxiella burnetii RSA 493
guacugugcggauuaaauaacu

SEQ ID NO: 2586529 - RNA, 12 nt, Coxiella burnetii RSA 493
guacuuucacua

SEQ ID NO: 2586530 - RNA, 10 nt, Coxiella burnetii RSA 493
guagaaugga

SEQ ID NO: 2586531 - RNA, 17 nt, Coxiella burnetii RSA 493
guagaugcuaucgauga

SEQ ID NO: 2586532 - RNA, 19 nt, Coxiella burnetii RSA 493
guagcaacgccuuucccuc

SEQ ID NO: 2586533 - RNA, 12 nt, Coxiella burnetii RSA 493
guagcccuugcg

SEQ ID NO: 2586534 - RNA, 18 nt, Coxiella burnetii RSA 493
guagcuaauacuaaacaa

SEQ ID NO: 2586535 - RNA, 21 nt, Coxiella burnetii RSA 493
guaggccuaaaguacccaaca

SEQ ID NO: 2586536 - RNA, 18 nt, Coxiella burnetii RSA 493
guagguuagagagcuugc

SEQ ID NO: 2586537 - RNA, 16 nt, Coxiella burnetii RSA 493
guaguaugagcggcaa

SEQ ID NO: 2586538 - RNA, 20 nt, Coxiella burnetii RSA 493
guauaacaaaauuaaaaaac

SEQ ID NO: 2586539 - RNA, 16 nt, Coxiella burnetii RSA 493
guauaccaaaaagcgu

SEQ ID NO: 2586540 - RNA, 22 nt, Coxiella burnetii RSA 493
guauaggaacauucuaauaaaa

SEQ ID NO: 2586541 - RNA, 14 nt, Coxiella burnetii RSA 493
guauauuugcaguu

SEQ ID NO: 2586542 - RNA, 16 nt, Coxiella burnetii RSA 493
guaucaccaaaauaca

SEQ ID NO: 2586543 - RNA, 12 nt, Coxiella burnetii RSA 493
guauccauccca

SEQ ID NO: 2586544 - RNA, 18 nt, Coxiella burnetii RSA 493
guauccaucccaauucuc

SEQ ID NO: 2586545 - RNA, 15 nt, Coxiella burnetii RSA 493
guaucuuucauguaa

SEQ ID NO: 2586546 - RNA, 19 nt, Coxiella burnetii RSA 493
guaugagcgaagcgaaaua

SEQ ID NO: 2586547 - RNA, 14 nt, Coxiella burnetii RSA 493
guaugagcggcaau

SEQ ID NO: 2586548 - RNA, 15 nt, Coxiella burnetii RSA 493
guaugagcggcaauu

SEQ ID NO: 2586549 - RNA, 18 nt, Coxiella burnetii RSA 493
guaugagcggcaauuuug

SEQ ID NO: 2586550 - RNA, 14 nt, Coxiella burnetii RSA 493
guaugaucauuuuc

SEQ ID NO: 2586551 - RNA, 19 nt, Coxiella burnetii RSA 493
guaugcagcgaagcgaaau

SEQ ID NO: 2586552 - RNA, 20 nt, Coxiella burnetii RSA 493
guaugcagcgaagcgaaaua

SEQ ID NO: 2586553 - RNA, 20 nt, Coxiella burnetii RSA 493
guaugcagcgaagcggaaua

SEQ ID NO: 2586554 - RNA, 21 nt, Coxiella burnetii RSA 493
guauggggcguuagcggaaua

SEQ ID NO: 2586555 - RNA, 19 nt, Coxiella burnetii RSA 493
guauuaacgcaggaucaac

SEQ ID NO: 2586556 - RNA, 14 nt, Coxiella burnetii RSA 493
guauuccaaauaau

SEQ ID NO: 2586557 - RNA, 20 nt, Coxiella burnetii RSA 493
guauuccgcuucgcugcaua

SEQ ID NO: 2586558 - RNA, 21 nt, Coxiella burnetii RSA 493
guauuccgcuucgcugcauac

SEQ ID NO: 2586559 - RNA, 22 nt, Coxiella burnetii RSA 493
guauuccgcuucgcugcauacg

SEQ ID NO: 2586560 - RNA, 20 nt, Coxiella burnetii RSA 493
guauuccgcuuugcuccaua

SEQ ID NO: 2586561 - RNA, 19 nt, Coxiella burnetii RSA 493
guauuccuuuuucuuuuaa

SEQ ID NO: 2586562 - RNA, 17 nt, Coxiella burnetii RSA 493
guauugaguuuuugaca

SEQ ID NO: 2586563 - RNA, 16 nt, Coxiella burnetii RSA 493
guauugaucgcccaua

SEQ ID NO: 2586564 - RNA, 17 nt, Coxiella burnetii RSA 493
guauuggaugguucuuu

SEQ ID NO: 2586565 - RNA, 15 nt, Coxiella burnetii RSA 493
guauugggcggaauu

SEQ ID NO: 2586566 - RNA, 18 nt, Coxiella burnetii RSA 493
guauuguaauuugggcug

SEQ ID NO: 2586567 - RNA, 21 nt, Coxiella burnetii RSA 493
guauuuaggggugaauuuuug

SEQ ID NO: 2586568 - RNA, 20 nt, Coxiella burnetii RSA 493
guauuucgcuucgcuacaua

SEQ ID NO: 2586569 - RNA, 22 nt, Coxiella burnetii RSA 493
guauuucgcuucgcugcauacg

SEQ ID NO: 2586570 - RNA, 18 nt, Coxiella burnetii RSA 493
guauuuugcaaaugaaua

SEQ ID NO: 2586571 - RNA, 23 nt, Coxiella burnetii RSA 493
guauuuuucuuuggguuggcuuu

SEQ ID NO: 2586572 - RNA, 15 nt, Coxiella burnetii RSA 493
gucaagucuuugaca

SEQ ID NO: 2586573 - RNA, 16 nt, Coxiella burnetii RSA 493
gucaauuucaaugacu

SEQ ID NO: 2586574 - RNA, 20 nt, Coxiella burnetii RSA 493
gucacaaauaaagcagcaau

SEQ ID NO: 2586575 - RNA, 17 nt, Coxiella burnetii RSA 493
gucacgaauuuuuucag

SEQ ID NO: 2586576 - RNA, 19 nt, Coxiella burnetii RSA 493
gucacuauuaaucauucuc

SEQ ID NO: 2586577 - RNA, 17 nt, Coxiella burnetii RSA 493
gucacuccggguuuucc

SEQ ID NO: 2586578 - RNA, 19 nt, Coxiella burnetii RSA 493
gucagacuugcuuuuuucu

SEQ ID NO: 2586579 - RNA, 14 nt, Coxiella burnetii RSA 493
gucauaaagguuuu

SEQ ID NO: 2586580 - RNA, 21 nt, Coxiella burnetii RSA 493
gucauauuaauauuaaaacaa

SEQ ID NO: 2586581 - RNA, 16 nt, Coxiella burnetii RSA 493
gucauccauucuuuca

SEQ ID NO: 2586582 - RNA, 16 nt, Coxiella burnetii RSA 493
gucaucgccaaaaggu

SEQ ID NO: 2586583 - RNA, 13 nt, Coxiella burnetii RSA 493
gucaugaaauaaa

SEQ ID NO: 2586584 - RNA, 16 nt, Coxiella burnetii RSA 493
gucauuuguucuauca

SEQ ID NO: 2586585 - RNA, 20 nt, Coxiella burnetii RSA 493
gucauuuuggauaagauucg

SEQ ID NO: 2586586 - RNA, 18 nt, Coxiella burnetii RSA 493
gucauuuuuuauaaaauu

SEQ ID NO: 2586587 - RNA, 14 nt, Coxiella burnetii RSA 493
guccaaaaaaguuu

SEQ ID NO: 2586588 - RNA, 20 nt, Coxiella burnetii RSA 493
guccaauuauaacuauuuua

SEQ ID NO: 2586589 - RNA, 20 nt, Coxiella burnetii RSA 493
gucccaaaaaacuuagccaa

SEQ ID NO: 2586590 - RNA, 15 nt, Coxiella burnetii RSA 493
guccccaaaguuuca

SEQ ID NO: 2586591 - RNA, 20 nt, Coxiella burnetii RSA 493
guccccguauuucgcuucgc

SEQ ID NO: 2586592 - RNA, 18 nt, Coxiella burnetii RSA 493
gucccgcuuaaacccaga

SEQ ID NO: 2586593 - RNA, 14 nt, Coxiella burnetii RSA 493
guccuaaaaugaua

SEQ ID NO: 2586594 - RNA, 15 nt, Coxiella burnetii RSA 493
guccuaagcuuucuc

SEQ ID NO: 2586595 - RNA, 15 nt, Coxiella burnetii RSA 493
guccugcuuuugcau

SEQ ID NO: 2586596 - RNA, 14 nt, Coxiella burnetii RSA 493
guccuguucuuuuc

SEQ ID NO: 2586597 - RNA, 17 nt, Coxiella burnetii RSA 493
guccuguucuuuuucca

SEQ ID NO: 2586598 - RNA, 18 nt, Coxiella burnetii RSA 493
guccuguucuuuuuccau

SEQ ID NO: 2586599 - RNA, 20 nt, Coxiella burnetii RSA 493
guccuguucuuuuuccaugu

SEQ ID NO: 2586600 - RNA, 19 nt, Coxiella burnetii RSA 493
guccuguugauacuaaauu

SEQ ID NO: 2586601 - RNA, 22 nt, Coxiella burnetii RSA 493
guccuuaucacuagcuauucuu

SEQ ID NO: 2586602 - RNA, 21 nt, Coxiella burnetii RSA 493
guccuucucaguuaaaauaau

SEQ ID NO: 2586603 - RNA, 16 nt, Coxiella burnetii RSA 493
guccuugcugaauucc

SEQ ID NO: 2586604 - RNA, 17 nt, Coxiella burnetii RSA 493
gucgaugauuuuuucga

SEQ ID NO: 2586605 - RNA, 23 nt, Coxiella burnetii RSA 493
gucgcauagccaaccgccauuuc

SEQ ID NO: 2586606 - RNA, 17 nt, Coxiella burnetii RSA 493
gucgcauucuauuagcu

SEQ ID NO: 2586607 - RNA, 19 nt, Coxiella burnetii RSA 493
gucgccucaguaauuucuc

SEQ ID NO: 2586608 - RNA, 14 nt, Coxiella burnetii RSA 493
gucguaauugcuug

SEQ ID NO: 2586609 - RNA, 16 nt, Coxiella burnetii RSA 493
gucguauuccuuuuuc

SEQ ID NO: 2586610 - RNA, 22 nt, Coxiella burnetii RSA 493
gucguucuuuuccuguggugcg

SEQ ID NO: 2586611 - RNA, 22 nt, Coxiella burnetii RSA 493
gucuagucgaaucaccugcucc

SEQ ID NO: 2586612 - RNA, 15 nt, Coxiella burnetii RSA 493
gucuaguuauuuuuc

SEQ ID NO: 2586613 - RNA, 16 nt, Coxiella burnetii RSA 493
gucuaguuauuuuuca

SEQ ID NO: 2586614 - RNA, 17 nt, Coxiella burnetii RSA 493
gucuaguuauuuuucau

SEQ ID NO: 2586615 - RNA, 15 nt, Coxiella burnetii RSA 493
gucucguuagaaaag

SEQ ID NO: 2586616 - RNA, 14 nt, Coxiella burnetii RSA 493
gucucugcuucauu

SEQ ID NO: 2586617 - RNA, 20 nt, Coxiella burnetii RSA 493
gucugaacaggcagaugauu

SEQ ID NO: 2586618 - RNA, 22 nt, Coxiella burnetii RSA 493
gucugauaggaauucuuuuuca

SEQ ID NO: 2586619 - RNA, 23 nt, Coxiella burnetii RSA 493
gucugauaggaauucuuuuucau

SEQ ID NO: 2586620 - RNA, 22 nt, Coxiella burnetii RSA 493
guugaaucaaauuaaaauaauc

SEQ ID NO: 2586621 - RNA, 19 nt, Coxiella burnetii RSA 493
guugaaugcguucuuuaau

SEQ ID NO: 2586622 - RNA, 14 nt, Coxiella burnetii RSA 493
guugaauuccuugc

SEQ ID NO: 2586623 - RNA, 17 nt, Coxiella burnetii RSA 493
guugagagucaggaaau

SEQ ID NO: 2586624 - RNA, 15 nt, Coxiella burnetii RSA 493
guugaucggcggaaa

SEQ ID NO: 2586625 - RNA, 14 nt, Coxiella burnetii RSA 493
guugauuuuuuaaa

SEQ ID NO: 2586626 - RNA, 19 nt, Coxiella burnetii RSA 493
guugcaauaacaaauaaac

SEQ ID NO: 2586627 - RNA, 21 nt, Coxiella burnetii RSA 493
guugcaggcgcguuuuauaaa

SEQ ID NO: 2586628 - RNA, 22 nt, Coxiella burnetii RSA 493
guugcaggcgcguuuuauaaau

SEQ ID NO: 2586629 - RNA, 18 nt, Coxiella burnetii RSA 493
guugcauaauauuuucug

SEQ ID NO: 2586630 - RNA, 24 nt, Coxiella burnetii RSA 493
guugccgauaaaaaggcaaauguu

SEQ ID NO: 2586631 - RNA, 15 nt, Coxiella burnetii RSA 493
guugcugagcaaaca

SEQ ID NO: 2586632 - RNA, 13 nt, Coxiella burnetii RSA 493
guuggauuucauc

SEQ ID NO: 2586633 - RNA, 16 nt, Coxiella burnetii RSA 493
guugguuagcaauggg

SEQ ID NO: 2586634 - RNA, 15 nt, Coxiella burnetii RSA 493
guuguaaauuuugcc

SEQ ID NO: 2586635 - RNA, 20 nt, Coxiella burnetii RSA 493
guugucaacaaaauuuuuca

SEQ ID NO: 2586636 - RNA, 20 nt, Coxiella burnetii RSA 493
guuguccuuggaacaaacca

SEQ ID NO: 2586637 - RNA, 13 nt, Coxiella burnetii RSA 493
guuuaaaaaugua

SEQ ID NO: 2586638 - RNA, 11 nt, Coxiella burnetii RSA 493
guuuaaaguua

SEQ ID NO: 2586639 - RNA, 18 nt, Coxiella burnetii RSA 493
guuuaaaguuauuucuuu

SEQ ID NO: 2586640 - RNA, 14 nt, Coxiella burnetii RSA 493
guuuaaauaacaaa

SEQ ID NO: 2586641 - RNA, 16 nt, Coxiella burnetii RSA 493
guuuaaauaacaaaug

SEQ ID NO: 2586642 - RNA, 20 nt, Coxiella burnetii RSA 493
guuuaacagacagacgcugg

SEQ ID NO: 2586643 - RNA, 14 nt, Coxiella burnetii RSA 493
guuuaagcugauac

SEQ ID NO: 2586644 - RNA, 20 nt, Coxiella burnetii RSA 493
guuuaauugcauguuugcug

SEQ ID NO: 2586645 - RNA, 14 nt, Coxiella burnetii RSA 493
guuuacguauucau

SEQ ID NO: 2586646 - RNA, 20 nt, Coxiella burnetii RSA 493
guuuauuuccgucaauuuuu

SEQ ID NO: 2586647 - RNA, 15 nt, Coxiella burnetii RSA 493
guuuauuugaucgcc

SEQ ID NO: 2586648 - RNA, 18 nt, Coxiella burnetii RSA 493
guuucaauuagcauuuuc

SEQ ID NO: 2586649 - RNA, 24 nt, Coxiella burnetii RSA 493
guuucauaaggccaauuucuaauc

SEQ ID NO: 2586650 - RNA, 14 nt, Coxiella burnetii RSA 493
guuuccaauuguuu

SEQ ID NO: 2586651 - RNA, 19 nt, Coxiella burnetii RSA 493
guuucccguauuucgcuuc

SEQ ID NO: 2586652 - RNA, 20 nt, Coxiella burnetii RSA 493
guuucccguauuucgcuucg

SEQ ID NO: 2586653 - RNA, 17 nt, Coxiella burnetii RSA 493
guuuccgccucaauuuc

SEQ ID NO: 2586654 - RNA, 21 nt, Coxiella burnetii RSA 493
guuuccuccguaauuaccuga

SEQ ID NO: 2586655 - RNA, 16 nt, Coxiella burnetii RSA 493
guuucgguuucuaucg

SEQ ID NO: 2586656 - RNA, 19 nt, Coxiella burnetii RSA 493
guuucgucgauauccaaaa

SEQ ID NO: 2586657 - RNA, 13 nt, Coxiella burnetii RSA 493
guuucguggcuuc

SEQ ID NO: 2586658 - RNA, 17 nt, Coxiella burnetii RSA 493
guuucuacguugccagu

SEQ ID NO: 2586659 - RNA, 19 nt, Coxiella burnetii RSA 493
guuucucccgauaaguugu

SEQ ID NO: 2586660 - RNA, 19 nt, Coxiella burnetii RSA 493
guuucucgauauucuaucu

SEQ ID NO: 2586661 - RNA, 16 nt, Coxiella burnetii RSA 493
guuucuuggauuuuuu

SEQ ID NO: 2586662 - RNA, 11 nt, Coxiella burnetii RSA 493
guuucuuucca

SEQ ID NO: 2586663 - RNA, 14 nt, Coxiella burnetii RSA 493
guuucuuuuauaaa

SEQ ID NO: 2586664 - RNA, 14 nt, Coxiella burnetii RSA 493
guuugaaaaaauac

SEQ ID NO: 2586665 - RNA, 21 nt, Coxiella burnetii RSA 493
guuugauaagguaucccuucg

SEQ ID NO: 2586666 - RNA, 23 nt, Coxiella burnetii RSA 493
guuugaucauuuugauuuuuuaa

SEQ ID NO: 2586667 - RNA, 19 nt, Coxiella burnetii RSA 493
guuugcacauaagcgaaua

SEQ ID NO: 2586668 - RNA, 16 nt, Coxiella burnetii RSA 493
guuugcguuuuucgca

SEQ ID NO: 2586669 - RNA, 20 nt, Coxiella burnetii RSA 493
guuuguccuugccgcugcgg

SEQ ID NO: 2586670 - RNA, 21 nt, Coxiella burnetii RSA 493
guuuuaaaauuagcgauguca

SEQ ID NO: 2586671 - RNA, 18 nt, Coxiella burnetii RSA 493
guuuuaaaugcuuuucuu

SEQ ID NO: 2586672 - RNA, 20 nt, Coxiella burnetii RSA 493
guuuuaaccugaaaaaauua

SEQ ID NO: 2586673 - RNA, 16 nt, Coxiella burnetii RSA 493
guuuuaagaaaaacca

SEQ ID NO: 2586674 - RNA, 17 nt, Coxiella burnetii RSA 493
guuuuaagcugcggaua

SEQ ID NO: 2586675 - RNA, 20 nt, Coxiella burnetii RSA 493
guuuuacguuuaaauaacaa

SEQ ID NO: 2586676 - RNA, 14 nt, Coxiella burnetii RSA 493
guuuuacugccuac

SEQ ID NO: 2586677 - RNA, 21 nt, Coxiella burnetii RSA 493
guuuuaucguucgcaauugaa

SEQ ID NO: 2586678 - RNA, 19 nt, Coxiella burnetii RSA 493
guuuucuauccagaaacca

SEQ ID NO: 2586679 - RNA, 18 nt, Coxiella burnetii RSA 493
guuuugauuugaguaaga

SEQ ID NO: 2586680 - RNA, 22 nt, Coxiella burnetii RSA 493
guuuugcauccgaacuaauggu

SEQ ID NO: 2586681 - RNA, 13 nt, Coxiella burnetii RSA 493
guuuugguucgug

SEQ ID NO: 2586682 - RNA, 15 nt, Coxiella burnetii RSA 493
guuuuuccuuuuauu

SEQ ID NO: 2586683 - RNA, 22 nt, Coxiella burnetii RSA 493
guuuuucgcaacgauaaaauua

SEQ ID NO: 2586684 - RNA, 18 nt, Coxiella burnetii RSA 493
guuuuucgguuucuucaa

SEQ ID NO: 2586685 - RNA, 18 nt, Coxiella burnetii RSA 493
guuuuugacaagcuucuc

SEQ ID NO: 2586686 - RNA, 17 nt, Coxiella burnetii RSA 493
guuuuugauugccaaag

SEQ ID NO: 2586687 - RNA, 15 nt, Coxiella burnetii RSA 493
guuuuuuaauuuuug

SEQ ID NO: 2586688 - RNA, 12 nt, Coxiella burnetii RSA 493
guuuuuucuagg

SEQ ID NO: 2586689 - RNA, 15 nt, Coxiella burnetii RSA 493
guuuuuugcauuuuu

SEQ ID NO: 2586690 - RNA, 17 nt, Coxiella burnetii RSA 493
guuuuuuuaaaaaagaa

SEQ ID NO: 2586691 - RNA, 12 nt, Coxiella burnetii RSA 493
guuuuuuuaaac

SEQ ID NO: 2586692 - RNA, 14 nt, Coxiella burnetii RSA 493
guuuuuuucuuuuu

SEQ ID NO: 2586693 - RNA, 13 nt, Coxiella burnetii RSA 493
uaaaaaagaaaau

SEQ ID NO: 2586694 - RNA, 14 nt, Coxiella burnetii RSA 493
uaaaaaauaagaaa

SEQ ID NO: 2586695 - RNA, 15 nt, Coxiella burnetii RSA 493
uaaaaaaucuuugcu

SEQ ID NO: 2586696 - RNA, 19 nt, Coxiella burnetii RSA 493
uaaaaaaucuuugcucuaa

SEQ ID NO: 2586697 - RNA, 23 nt, Coxiella burnetii RSA 493
uaaaaaaucuuugcucuaaauua

SEQ ID NO: 2586698 - RNA, 13 nt, Coxiella burnetii RSA 493
uaaaaaauucaau

SEQ ID NO: 2586699 - RNA, 12 nt, Coxiella burnetii RSA 493
uaaaaaauucau

SEQ ID NO: 2586700 - RNA, 21 nt, Coxiella burnetii RSA 493
uaaaaaauucaucguagaugu

SEQ ID NO: 2586701 - RNA, 23 nt, Coxiella burnetii RSA 493
uaaaaacaaagugaaauauguca

SEQ ID NO: 2586702 - RNA, 11 nt, Coxiella burnetii RSA 493
uaaaaacaauu

SEQ ID NO: 2586703 - RNA, 13 nt, Coxiella burnetii RSA 493
uaaaaauaaauua

SEQ ID NO: 2586704 - RNA, 17 nt, Coxiella burnetii RSA 493
uaaaaauaaauuaauua

SEQ ID NO: 2586705 - RNA, 15 nt, Coxiella burnetii RSA 493
uaaaaauaaugaucc

SEQ ID NO: 2586706 - RNA, 17 nt, Coxiella burnetii RSA 493
uaaaaauuuuaaaaaaa

SEQ ID NO: 2586707 - RNA, 19 nt, Coxiella burnetii RSA 493
uaaaacaagacaacaaaau

SEQ ID NO: 2586708 - RNA, 15 nt, Coxiella burnetii RSA 493
uaaaacccgauggca

SEQ ID NO: 2586709 - RNA, 14 nt, Coxiella burnetii RSA 493
uaaaaccuccugca

SEQ ID NO: 2586710 - RNA, 19 nt, Coxiella burnetii RSA 493
uaaaaccugcuauuugccc

SEQ ID NO: 2586711 - RNA, 18 nt, Coxiella burnetii RSA 493
uaaaaccuuguuauaaaa

SEQ ID NO: 2586712 - RNA, 21 nt, Coxiella burnetii RSA 493
uaaaaccuuguuauaaaacuu

SEQ ID NO: 2586713 - RNA, 23 nt, Coxiella burnetii RSA 493
uaaaacgacagguauuuuaagua

SEQ ID NO: 2586714 - RNA, 23 nt, Coxiella burnetii RSA 493
uaaaacgauauuaucaaaacgua

SEQ ID NO: 2586715 - RNA, 23 nt, Coxiella burnetii RSA 493
uaaaacgcaucggccuuuuucau

SEQ ID NO: 2586716 - RNA, 23 nt, Coxiella burnetii RSA 493
uaaaacgccguaaccaaaacuau

SEQ ID NO: 2586717 - RNA, 23 nt, Coxiella burnetii RSA 493
uaaaacucuugccggauugauaa

SEQ ID NO: 2586718 - RNA, 17 nt, Coxiella burnetii RSA 493
uaaaacuucccauucua

SEQ ID NO: 2586719 - RNA, 22 nt, Coxiella burnetii RSA 493
uaaaacuuuguagaccaaucga

SEQ ID NO: 2586720 - RNA, 20 nt, Coxiella burnetii RSA 493
uaaaagacguaccauuaaaa

SEQ ID NO: 2586721 - RNA, 19 nt, Coxiella burnetii RSA 493
uaaaagagcgaauaaaaaa

SEQ ID NO: 2586722 - RNA, 12 nt, Coxiella burnetii RSA 493
uaaaagcaucaa

SEQ ID NO: 2586723 - RNA, 20 nt, Coxiella burnetii RSA 493
uaaaaggaauucuaauuaaa

SEQ ID NO: 2586724 - RNA, 23 nt, Coxiella burnetii RSA 493
uaaaaggagaaauugacaaauaa

SEQ ID NO: 2586725 - RNA, 19 nt, Coxiella burnetii RSA 493
uaaccaagaguguucgcua

SEQ ID NO: 2586726 - RNA, 18 nt, Coxiella burnetii RSA 493
uaaccaauugauuaauua

SEQ ID NO: 2586727 - RNA, 17 nt, Coxiella burnetii RSA 493
uaaccacucggaaagca

SEQ ID NO: 2586728 - RNA, 23 nt, Coxiella burnetii RSA 493
uaacccacagccgcuuuuuauug

SEQ ID NO: 2586729 - RNA, 17 nt, Coxiella burnetii RSA 493
uaacccucgauuuaccg

SEQ ID NO: 2586730 - RNA, 17 nt, Coxiella burnetii RSA 493
uaaccucuccauccaua

SEQ ID NO: 2586731 - RNA, 18 nt, Coxiella burnetii RSA 493
uaaccugaaaaaauuaau

SEQ ID NO: 2586732 - RNA, 13 nt, Coxiella burnetii RSA 493
uaaccuuucgcuu

SEQ ID NO: 2586733 - RNA, 16 nt, Coxiella burnetii RSA 493
uaacgaagguuucaua

SEQ ID NO: 2586734 - RNA, 19 nt, Coxiella burnetii RSA 493
uaacgaaucgauugaacuu

SEQ ID NO: 2586735 - RNA, 15 nt, Coxiella burnetii RSA 493
uaacgacaaccauug

SEQ ID NO: 2586736 - RNA, 19 nt, Coxiella burnetii RSA 493
uaacgauggucaaaccaau

SEQ ID NO: 2586737 - RNA, 13 nt, Coxiella burnetii RSA 493
uaacgauuucucu

SEQ ID NO: 2586738 - RNA, 14 nt, Coxiella burnetii RSA 493
uaacgcaggaucaa

SEQ ID NO: 2586739 - RNA, 14 nt, Coxiella burnetii RSA 493
uaacgcauugguaa

SEQ ID NO: 2586740 - RNA, 19 nt, Coxiella burnetii RSA 493
uaacgcauugguaacgccc

SEQ ID NO: 2586741 - RNA, 22 nt, Coxiella burnetii RSA 493
uaacgccuaucuuuuucaagau

SEQ ID NO: 2586742 - RNA, 15 nt, Coxiella burnetii RSA 493
uaacgcgaaaccuac

SEQ ID NO: 2586743 - RNA, 19 nt, Coxiella burnetii RSA 493
uaacgcuccaguauuucau

SEQ ID NO: 2586744 - RNA, 14 nt, Coxiella burnetii RSA 493
uaacgcuucuuuua

SEQ ID NO: 2586745 - RNA, 15 nt, Coxiella burnetii RSA 493
uaacggacucaaccg

SEQ ID NO: 2586746 - RNA, 20 nt, Coxiella burnetii RSA 493
uaacgggaauguuuuuuaau

SEQ ID NO: 2586747 - RNA, 17 nt, Coxiella burnetii RSA 493
uaacgucgcaaauaaua

SEQ ID NO: 2586748 - RNA, 20 nt, Coxiella burnetii RSA 493
uaacguuuugucguuuucau

SEQ ID NO: 2586749 - RNA, 21 nt, Coxiella burnetii RSA 493
uaacuaccuucuaaucgguuu

SEQ ID NO: 2586750 - RNA, 14 nt, Coxiella burnetii RSA 493
uaacuauuauuaaa

SEQ ID NO: 2586751 - RNA, 16 nt, Coxiella burnetii RSA 493
uaacuauuauuaaaag

SEQ ID NO: 2586752 - RNA, 17 nt, Coxiella burnetii RSA 493
uaacuauuauuaaaaga

SEQ ID NO: 2586753 - RNA, 16 nt, Coxiella burnetii RSA 493
uaacuccguuacaucg

SEQ ID NO: 2586754 - RNA, 14 nt, Coxiella burnetii RSA 493
uaacuccuucgcuu

SEQ ID NO: 2586755 - RNA, 15 nt, Coxiella burnetii RSA 493
uaacuccuucgcuuu

SEQ ID NO: 2586756 - RNA, 16 nt, Coxiella burnetii RSA 493
uaacucuaauuuuccu

SEQ ID NO: 2586757 - RNA, 13 nt, Coxiella burnetii RSA 493
uaacuucauuaga

SEQ ID NO: 2586758 - RNA, 19 nt, Coxiella burnetii RSA 493
uaacuucgacgggaaaaau

SEQ ID NO: 2586759 - RNA, 14 nt, Coxiella burnetii RSA 493
uaacuucucuugaa

SEQ ID NO: 2586760 - RNA, 17 nt, Coxiella burnetii RSA 493
uaacuucucuugaauaa

SEQ ID NO: 2586761 - RNA, 21 nt, Coxiella burnetii RSA 493
uaacuuuuccaucuccuuuuc

SEQ ID NO: 2586762 - RNA, 20 nt, Coxiella burnetii RSA 493
uaagaagagcacgcaaugcu

SEQ ID NO: 2586763 - RNA, 19 nt, Coxiella burnetii RSA 493
uaagaaggucuacguacug

SEQ ID NO: 2586764 - RNA, 16 nt, Coxiella burnetii RSA 493
uaagaauaaacuuuau

SEQ ID NO: 2586765 - RNA, 17 nt, Coxiella burnetii RSA 493
uaagacuaggaaaaaau

SEQ ID NO: 2586766 - RNA, 12 nt, Coxiella burnetii RSA 493
uaagagaaaaaa

SEQ ID NO: 2586767 - RNA, 14 nt, Coxiella burnetii RSA 493
uaagagaaauuaaa

SEQ ID NO: 2586768 - RNA, 23 nt, Coxiella burnetii RSA 493
uaagagaaauuaaauuuuuaaau

SEQ ID NO: 2586769 - RNA, 20 nt, Coxiella burnetii RSA 493
uaagaggaccugugagggau

SEQ ID NO: 2586770 - RNA, 16 nt, Coxiella burnetii RSA 493
uaagauaauaauuaua

SEQ ID NO: 2586771 - RNA, 23 nt, Coxiella burnetii RSA 493
uaagcaauuuuuuaucauacuua

SEQ ID NO: 2586772 - RNA, 15 nt, Coxiella burnetii RSA 493
uaagcacuucuuuua

SEQ ID NO: 2586773 - RNA, 16 nt, Coxiella burnetii RSA 493
uaagcacuucuuuuau

SEQ ID NO: 2586774 - RNA, 22 nt, Coxiella burnetii RSA 493
uaagcagacccgcauucuuuua

SEQ ID NO: 2586775 - RNA, 16 nt, Coxiella burnetii RSA 493
uaagcauaauucauca

SEQ ID NO: 2586776 - RNA, 19 nt, Coxiella burnetii RSA 493
uaagcaugggccuacuuua

SEQ ID NO: 2586777 - RNA, 21 nt, Coxiella burnetii RSA 493
uaagcauuaaaaaauaagaaa

SEQ ID NO: 2586778 - RNA, 20 nt, Coxiella burnetii RSA 493
uaagccaguucucuauucuu

SEQ ID NO: 2586779 - RNA, 16 nt, Coxiella burnetii RSA 493
uaagccauaucaggag

SEQ ID NO: 2586780 - RNA, 18 nt, Coxiella burnetii RSA 493
uaagccauaucaggagca

SEQ ID NO: 2586781 - RNA, 16 nt, Coxiella burnetii RSA 493
uaagccauuaaaagca

SEQ ID NO: 2586782 - RNA, 17 nt, Coxiella burnetii RSA 493
uaagccauuaaaagcag

SEQ ID NO: 2586783 - RNA, 17 nt, Coxiella burnetii RSA 493
uaagccguccaguuggc

SEQ ID NO: 2586784 - RNA, 14 nt, Coxiella burnetii RSA 493
uaagccuaaacgcu

SEQ ID NO: 2586785 - RNA, 17 nt, Coxiella burnetii RSA 493
uaagcgccagagauuuu

SEQ ID NO: 2586786 - RNA, 18 nt, Coxiella burnetii RSA 493
uaagcguaacgucacaaa

SEQ ID NO: 2586787 - RNA, 17 nt, Coxiella burnetii RSA 493
uaagcgucaugaaaagc

SEQ ID NO: 2586788 - RNA, 21 nt, Coxiella burnetii RSA 493
uaagcgucaugaaaagcggag

SEQ ID NO: 2586789 - RNA, 21 nt, Coxiella burnetii RSA 493
uaagcucgagaagaugucccg

SEQ ID NO: 2586790 - RNA, 15 nt, Coxiella burnetii RSA 493
uaagcugauacacca

SEQ ID NO: 2586791 - RNA, 17 nt, Coxiella burnetii RSA 493
uaagcugauacaccauc

SEQ ID NO: 2586792 - RNA, 16 nt, Coxiella burnetii RSA 493
uaagcuguuucuuuua

SEQ ID NO: 2586793 - RNA, 14 nt, Coxiella burnetii RSA 493
uaagcuugaaaaaa

SEQ ID NO: 2586794 - RNA, 20 nt, Coxiella burnetii RSA 493
uaaggaggcaauacaucuug

SEQ ID NO: 2586795 - RNA, 17 nt, Coxiella burnetii RSA 493
uaaggccaauuccaaua

SEQ ID NO: 2586796 - RNA, 15 nt, Coxiella burnetii RSA 493
uaaggccucuuuaga

SEQ ID NO: 2586797 - RNA, 12 nt, Coxiella burnetii RSA 493
uaaggucucaac

SEQ ID NO: 2586798 - RNA, 13 nt, Coxiella burnetii RSA 493
uaaggucucaaca

SEQ ID NO: 2586799 - RNA, 12 nt, Coxiella burnetii RSA 493
uaaggugggggg

SEQ ID NO: 2586800 - RNA, 15 nt, Coxiella burnetii RSA 493
uaaguaaaugcaccu

SEQ ID NO: 2586801 - RNA, 20 nt, Coxiella burnetii RSA 493
uaaguacugaugcaaaucau

SEQ ID NO: 2586802 - RNA, 17 nt, Coxiella burnetii RSA 493
uaaguagcuaaaaaauu

SEQ ID NO: 2586803 - RNA, 18 nt, Coxiella burnetii RSA 493
uaaguagcucuuaaaaga

SEQ ID NO: 2586804 - RNA, 14 nt, Coxiella burnetii RSA 493
uaaguauccauccc

SEQ ID NO: 2586805 - RNA, 20 nt, Coxiella burnetii RSA 493
uaagucuauugaaaaaaacg

SEQ ID NO: 2586806 - RNA, 23 nt, Coxiella burnetii RSA 493
uaagugacagcucugaaagcaau

SEQ ID NO: 2586807 - RNA, 21 nt, Coxiella burnetii RSA 493
uaaguguggucugaaaauaau

SEQ ID NO: 2586808 - RNA, 12 nt, Coxiella burnetii RSA 493
uaaguuuuuagc

SEQ ID NO: 2586809 - RNA, 18 nt, Coxiella burnetii RSA 493
uaaguuuuuugcucuuua

SEQ ID NO: 2586810 - RNA, 12 nt, Coxiella burnetii RSA 493
uaauaaaaauau

SEQ ID NO: 2586811 - RNA, 13 nt, Coxiella burnetii RSA 493
uaauaaaaauauu

SEQ ID NO: 2586812 - RNA, 12 nt, Coxiella burnetii RSA 493
uaauaaaacaag

SEQ ID NO: 2586813 - RNA, 17 nt, Coxiella burnetii RSA 493
uaauaaaacaagauacc

SEQ ID NO: 2586814 - RNA, 20 nt, Coxiella burnetii RSA 493
uaauaaaguaauuuuaaaaa

SEQ ID NO: 2586815 - RNA, 12 nt, Coxiella burnetii RSA 493
uaauaaaucaau

SEQ ID NO: 2586816 - RNA, 19 nt, Coxiella burnetii RSA 493
uaauaaaucaauuaaauuu

SEQ ID NO: 2586817 - RNA, 17 nt, Coxiella burnetii RSA 493
uaauaacgcuaugaaaa

SEQ ID NO: 2586818 - RNA, 20 nt, Coxiella burnetii RSA 493
uaauaacgcuaugaaaacca

SEQ ID NO: 2586819 - RNA, 18 nt, Coxiella burnetii RSA 493
uaauaaggcuaauuuucc

SEQ ID NO: 2586820 - RNA, 21 nt, Coxiella burnetii RSA 493
uaauaaggcuaauuuuccuuu

SEQ ID NO: 2586821 - RNA, 16 nt, Coxiella burnetii RSA 493
uaauaaggguaauagu

SEQ ID NO: 2586822 - RNA, 19 nt, Coxiella burnetii RSA 493
uaauaauagcguauagagu

SEQ ID NO: 2586823 - RNA, 15 nt, Coxiella burnetii RSA 493
uaauacaaggaaaau

SEQ ID NO: 2586824 - RNA, 18 nt, Coxiella burnetii RSA 493
uaauacaaggaaaauccg

SEQ ID NO: 2586825 - RNA, 20 nt, Coxiella burnetii RSA 493
uaauacaaggaaaauccgga

SEQ ID NO: 2586826 - RNA, 14 nt, Coxiella burnetii RSA 493
uaauacaggaaaaa

SEQ ID NO: 2586827 - RNA, 14 nt, Coxiella burnetii RSA 493
uaauacauucuuca

SEQ ID NO: 2586828 - RNA, 18 nt, Coxiella burnetii RSA 493
uaauacauucuucaguaa

SEQ ID NO: 2586829 - RNA, 20 nt, Coxiella burnetii RSA 493
uaauacggcuuuauuuugga

SEQ ID NO: 2586830 - RNA, 21 nt, Coxiella burnetii RSA 493
uaauacggcuuuauuuuggau

SEQ ID NO: 2586831 - RNA, 17 nt, Coxiella burnetii RSA 493
uacacuuuuaaucacau

SEQ ID NO: 2586832 - RNA, 19 nt, Coxiella burnetii RSA 493
uacagaacgcccuauuccc

SEQ ID NO: 2586833 - RNA, 14 nt, Coxiella burnetii RSA 493
uacagaacuuuuuu

SEQ ID NO: 2586834 - RNA, 23 nt, Coxiella burnetii RSA 493
uacagcgagagaauuaaaaauau

SEQ ID NO: 2586835 - RNA, 18 nt, Coxiella burnetii RSA 493
uacagcggaacaccauuc

SEQ ID NO: 2586836 - RNA, 19 nt, Coxiella burnetii RSA 493
uacagcggaacaccauucg

SEQ ID NO: 2586837 - RNA, 13 nt, Coxiella burnetii RSA 493
uacagcuccauag

SEQ ID NO: 2586838 - RNA, 15 nt, Coxiella burnetii RSA 493
uacaguaaauaauca

SEQ ID NO: 2586839 - RNA, 23 nt, Coxiella burnetii RSA 493
uacauaaaauuagguaauuuaua

SEQ ID NO: 2586840 - RNA, 18 nt, Coxiella burnetii RSA 493
uacauaaagcuuauauaa

SEQ ID NO: 2586841 - RNA, 13 nt, Coxiella burnetii RSA 493
uacauaauuuaaa

SEQ ID NO: 2586842 - RNA, 20 nt, Coxiella burnetii RSA 493
uacauagccucuauaaauaa

SEQ ID NO: 2586843 - RNA, 22 nt, Coxiella burnetii RSA 493
uacauauuucuuuucuguuuuc

SEQ ID NO: 2586844 - RNA, 13 nt, Coxiella burnetii RSA 493
uacaucgucggca

SEQ ID NO: 2586845 - RNA, 17 nt, Coxiella burnetii RSA 493
uacaucguugggaugau

SEQ ID NO: 2586846 - RNA, 17 nt, Coxiella burnetii RSA 493
uacauuggucaauguca

SEQ ID NO: 2586847 - RNA, 18 nt, Coxiella burnetii RSA 493
uaccaagcucaugaaaag

SEQ ID NO: 2586848 - RNA, 15 nt, Coxiella burnetii RSA 493
uaccacuugcacacu

SEQ ID NO: 2586849 - RNA, 12 nt, Coxiella burnetii RSA 493
uaccagcaguga

SEQ ID NO: 2586850 - RNA, 18 nt, Coxiella burnetii RSA 493
uaccagcagugaaauauc

SEQ ID NO: 2586851 - RNA, 23 nt, Coxiella burnetii RSA 493
uaccagucuguuauacuguucuu

SEQ ID NO: 2586852 - RNA, 18 nt, Coxiella burnetii RSA 493
uaccauacagaauuucuu

SEQ ID NO: 2586853 - RNA, 19 nt, Coxiella burnetii RSA 493
uaccaugguuccagaaaca

SEQ ID NO: 2586854 - RNA, 15 nt, Coxiella burnetii RSA 493
uaccauuaaaagcga

SEQ ID NO: 2586855 - RNA, 13 nt, Coxiella burnetii RSA 493
uaccauuuuuaaa

SEQ ID NO: 2586856 - RNA, 14 nt, Coxiella burnetii RSA 493
uaccauuuuuaaau

SEQ ID NO: 2586857 - RNA, 23 nt, Coxiella burnetii RSA 493
uacccaaaaacccauaacgaaaa

SEQ ID NO: 2586858 - RNA, 13 nt, Coxiella burnetii RSA 493
uacccaacaauaa

SEQ ID NO: 2586859 - RNA, 21 nt, Coxiella burnetii RSA 493
uacccagguaguaauuucuuc

SEQ ID NO: 2586860 - RNA, 22 nt, Coxiella burnetii RSA 493
uacccagguaguaauuucuucc

SEQ ID NO: 2586861 - RNA, 19 nt, Coxiella burnetii RSA 493
uaccccgcuguuuucagau

SEQ ID NO: 2586862 - RNA, 19 nt, Coxiella burnetii RSA 493
uacccgaggaugaugaaaa

SEQ ID NO: 2586863 - RNA, 21 nt, Coxiella burnetii RSA 493
uacccugguggccauuauauu

SEQ ID NO: 2586864 - RNA, 18 nt, Coxiella burnetii RSA 493
uacccuucaauugcuuuc

SEQ ID NO: 2586865 - RNA, 21 nt, Coxiella burnetii RSA 493
uaccgcaaguggggacaguga

SEQ ID NO: 2586866 - RNA, 14 nt, Coxiella burnetii RSA 493
uaccguauuuaauc

SEQ ID NO: 2586867 - RNA, 20 nt, Coxiella burnetii RSA 493
uaccguuucacgauuuuucu

SEQ ID NO: 2586868 - RNA, 21 nt, Coxiella burnetii RSA 493
uaccguuucacgauuuuucuc

SEQ ID NO: 2586869 - RNA, 18 nt, Coxiella burnetii RSA 493
uaccuccgucauugaaau

SEQ ID NO: 2586870 - RNA, 13 nt, Coxiella burnetii RSA 493
uaccucuaaaaau

SEQ ID NO: 2586871 - RNA, 14 nt, Coxiella burnetii RSA 493
uaccucuaaaaauu

SEQ ID NO: 2586872 - RNA, 20 nt, Coxiella burnetii RSA 493
uaccugcuucgcuucaucca

SEQ ID NO: 2586873 - RNA, 13 nt, Coxiella burnetii RSA 493
uaccuucuaaucg

SEQ ID NO: 2586874 - RNA, 18 nt, Coxiella burnetii RSA 493
uaccuucuguaaugauuu

SEQ ID NO: 2586875 - RNA, 21 nt, Coxiella burnetii RSA 493
uaccuuuguucgguuaaagca

SEQ ID NO: 2586876 - RNA, 12 nt, Coxiella burnetii RSA 493
uaccuuuuuccc

SEQ ID NO: 2586877 - RNA, 19 nt, Coxiella burnetii RSA 493
uaccuuuuucguuuaacaa

SEQ ID NO: 2586878 - RNA, 17 nt, Coxiella burnetii RSA 493
uacgacuucauuucuac

SEQ ID NO: 2586879 - RNA, 22 nt, Coxiella burnetii RSA 493
uacgauagcgucuuuuuuauuu

SEQ ID NO: 2586880 - RNA, 17 nt, Coxiella burnetii RSA 493
uacgcaugauacaaauu

SEQ ID NO: 2586881 - RNA, 16 nt, Coxiella burnetii RSA 493
uacgccaaccauaauc

SEQ ID NO: 2586882 - RNA, 21 nt, Coxiella burnetii RSA 493
uacgcgggaaugacgauuaac

SEQ ID NO: 2586883 - RNA, 13 nt, Coxiella burnetii RSA 493
uacgcuauuuuuu

SEQ ID NO: 2586884 - RNA, 17 nt, Coxiella burnetii RSA 493
uacgcuauuuuuuaaau

SEQ ID NO: 2586885 - RNA, 13 nt, Coxiella burnetii RSA 493
uacgggaaaacaa

SEQ ID NO: 2586886 - RNA, 14 nt, Coxiella burnetii RSA 493
uacgggaaaacaau

SEQ ID NO: 2586887 - RNA, 20 nt, Coxiella burnetii RSA 493
uacgggacgcguaaaauagc

SEQ ID NO: 2586888 - RNA, 16 nt, Coxiella burnetii RSA 493
uacgucuuuucuguga

SEQ ID NO: 2586889 - RNA, 17 nt, Coxiella burnetii RSA 493
uacgugcgcugcgcgcu

SEQ ID NO: 2586890 - RNA, 15 nt, Coxiella burnetii RSA 493
uacguuaaagccguu

SEQ ID NO: 2586891 - RNA, 13 nt, Coxiella burnetii RSA 493
uacguuauaauuu

SEQ ID NO: 2586892 - RNA, 17 nt, Coxiella burnetii RSA 493
uacguuauaauuucuuu

SEQ ID NO: 2586893 - RNA, 14 nt, Coxiella burnetii RSA 493
uacguuuaaauaac

SEQ ID NO: 2586894 - RNA, 13 nt, Coxiella burnetii RSA 493
uacuaaacaaaau

SEQ ID NO: 2586895 - RNA, 15 nt, Coxiella burnetii RSA 493
uacuaaauuaguaau

SEQ ID NO: 2586896 - RNA, 20 nt, Coxiella burnetii RSA 493
uacuaaauuguccuuuucua

SEQ ID NO: 2586897 - RNA, 12 nt, Coxiella burnetii RSA 493
uacuaauuucag

SEQ ID NO: 2586898 - RNA, 18 nt, Coxiella burnetii RSA 493
uacuagcggauuguaaac

SEQ ID NO: 2586899 - RNA, 14 nt, Coxiella burnetii RSA 493
uacuauaaucucgu

SEQ ID NO: 2586900 - RNA, 20 nt, Coxiella burnetii RSA 493
uacuauuuacgaguuaacuu

SEQ ID NO: 2586901 - RNA, 19 nt, Coxiella burnetii RSA 493
uacuauuuccaacccagcu

SEQ ID NO: 2586902 - RNA, 21 nt, Coxiella burnetii RSA 493
uacucagcuuuccccccaacu

SEQ ID NO: 2586903 - RNA, 14 nt, Coxiella burnetii RSA 493
uacuccaauuucau

SEQ ID NO: 2586904 - RNA, 23 nt, Coxiella burnetii RSA 493
uacuccgcccccccaaacaaaag

SEQ ID NO: 2586905 - RNA, 16 nt, Coxiella burnetii RSA 493
uacucuuuuucuuaga

SEQ ID NO: 2586906 - RNA, 16 nt, Coxiella burnetii RSA 493
uacugacguuugagag

SEQ ID NO: 2586907 - RNA, 14 nt, Coxiella burnetii RSA 493
uacugagaaaacuu

SEQ ID NO: 2586908 - RNA, 19 nt, Coxiella burnetii RSA 493
uacugagaaaacuuuucau

SEQ ID NO: 2586909 - RNA, 16 nt, Coxiella burnetii RSA 493
uacugcccaagaaauu

SEQ ID NO: 2586910 - RNA, 14 nt, Coxiella burnetii RSA 493
uacuguuugggagc

SEQ ID NO: 2586911 - RNA, 20 nt, Coxiella burnetii RSA 493
uacuuaaaauuucuuuccag

SEQ ID NO: 2586912 - RNA, 20 nt, Coxiella burnetii RSA 493
uacuucuauacaaugcguag

SEQ ID NO: 2586913 - RNA, 23 nt, Coxiella burnetii RSA 493
uacuucuucauuaaauccucuuu

SEQ ID NO: 2586914 - RNA, 13 nt, Coxiella burnetii RSA 493
uacuucuuugagu

SEQ ID NO: 2586915 - RNA, 12 nt, Coxiella burnetii RSA 493
uacuucuuuuuc

SEQ ID NO: 2586916 - RNA, 23 nt, Coxiella burnetii RSA 493
uacuugcuucaucgauugcuaaa

SEQ ID NO: 2586917 - RNA, 16 nt, Coxiella burnetii RSA 493
uacuuguugaaaaccu

SEQ ID NO: 2586918 - RNA, 21 nt, Coxiella burnetii RSA 493
uacuuguugaaaaccuacacu

SEQ ID NO: 2586919 - RNA, 17 nt, Coxiella burnetii RSA 493
uacuuguugcggauugg

SEQ ID NO: 2586920 - RNA, 21 nt, Coxiella burnetii RSA 493
uacuuuacgcucaauuuugcg

SEQ ID NO: 2586921 - RNA, 17 nt, Coxiella burnetii RSA 493
uacuuuacuuguugaaa

SEQ ID NO: 2586922 - RNA, 19 nt, Coxiella burnetii RSA 493
uacuuucucaauuucucgu

SEQ ID NO: 2586923 - RNA, 21 nt, Coxiella burnetii RSA 493
uacuuuuagcgaccaccaugu

SEQ ID NO: 2586924 - RNA, 13 nt, Coxiella burnetii RSA 493
uagaaaaaagaaa

SEQ ID NO: 2586925 - RNA, 12 nt, Coxiella burnetii RSA 493
uagaaaaucaaa

SEQ ID NO: 2586926 - RNA, 13 nt, Coxiella burnetii RSA 493
uagaaauauuaga

SEQ ID NO: 2586927 - RNA, 17 nt, Coxiella burnetii RSA 493
uagaagcaucagauacc

SEQ ID NO: 2586928 - RNA, 13 nt, Coxiella burnetii RSA 493
uagaaggggagcg

SEQ ID NO: 2586929 - RNA, 21 nt, Coxiella burnetii RSA 493
uagaaugaauuuaaugucuuu

SEQ ID NO: 2586930 - RNA, 21 nt, Coxiella burnetii RSA 493
uagaaugccggcuaauuuuuu

SEQ ID NO: 2586931 - RNA, 17 nt, Coxiella burnetii RSA 493
uagaauuacuguaaacu

SEQ ID NO: 2586932 - RNA, 15 nt, Coxiella burnetii RSA 493
uagaauuccuuuuau

SEQ ID NO: 2586933 - RNA, 17 nt, Coxiella burnetii RSA 493
uagaauuccuuuuauga

SEQ ID NO: 2586934 - RNA, 19 nt, Coxiella burnetii RSA 493
uagaauuccuuuuaugaaa

SEQ ID NO: 2586935 - RNA, 15 nt, Coxiella burnetii RSA 493
uagacaguuuagaau

SEQ ID NO: 2586936 - RNA, 18 nt, Coxiella burnetii RSA 493
uagagcaacgauuuuccc

SEQ ID NO: 2586937 - RNA, 21 nt, Coxiella burnetii RSA 493
uauucuaacguuaguuucuuu

SEQ ID NO: 2586938 - RNA, 20 nt, Coxiella burnetii RSA 493
uauucuaacuuugauaagca

SEQ ID NO: 2586939 - RNA, 18 nt, Coxiella burnetii RSA 493
uauucuuaauuuuuccuu

SEQ ID NO: 2586940 - RNA, 21 nt, Coxiella burnetii RSA 493
uauucuucaauacuacagcac

SEQ ID NO: 2586941 - RNA, 19 nt, Coxiella burnetii RSA 493
uauucuucuagaaaaccca

SEQ ID NO: 2586942 - RNA, 20 nt, Coxiella burnetii RSA 493
uauucuuuuucuuuauuugg

SEQ ID NO: 2586943 - RNA, 14 nt, Coxiella burnetii RSA 493
uauugaaaaaaacg

SEQ ID NO: 2586944 - RNA, 18 nt, Coxiella burnetii RSA 493
uauugagaaucucuugua

SEQ ID NO: 2586945 - RNA, 20 nt, Coxiella burnetii RSA 493
uauugauccggcuuuugauu

SEQ ID NO: 2586946 - RNA, 17 nt, Coxiella burnetii RSA 493
uauugauuuaaauuuaa

SEQ ID NO: 2586947 - RNA, 14 nt, Coxiella burnetii RSA 493
uauugcaauauuua

SEQ ID NO: 2586948 - RNA, 17 nt, Coxiella burnetii RSA 493
uauugcauuguuuucuu

SEQ ID NO: 2586949 - RNA, 22 nt, Coxiella burnetii RSA 493
uauugcauuguuuucuuacuuu

SEQ ID NO: 2586950 - RNA, 14 nt, Coxiella burnetii RSA 493
uauugccaaaauuu

SEQ ID NO: 2586951 - RNA, 20 nt, Coxiella burnetii RSA 493
uauugcgcguaaauuucguu

SEQ ID NO: 2586952 - RNA, 17 nt, Coxiella burnetii RSA 493
uauugggggucuuuuuu

SEQ ID NO: 2586953 - RNA, 15 nt, Coxiella burnetii RSA 493
uauugucauguucaa

SEQ ID NO: 2586954 - RNA, 20 nt, Coxiella burnetii RSA 493
uauuuaaauugaaucacagc

SEQ ID NO: 2586955 - RNA, 17 nt, Coxiella burnetii RSA 493
uauuuaauuuuauuauu

SEQ ID NO: 2586956 - RNA, 18 nt, Coxiella burnetii RSA 493
uauuuacgaguuaacuuu

SEQ ID NO: 2586957 - RNA, 13 nt, Coxiella burnetii RSA 493
uauuuagcaacuc

SEQ ID NO: 2586958 - RNA, 19 nt, Coxiella burnetii RSA 493
uauuuaggggugaauuuuu

SEQ ID NO: 2586959 - RNA, 13 nt, Coxiella burnetii RSA 493
uauuuauuaaaaa

SEQ ID NO: 2586960 - RNA, 12 nt, Coxiella burnetii RSA 493
uauuuauuuaca

SEQ ID NO: 2586961 - RNA, 16 nt, Coxiella burnetii RSA 493
uauuuauuuauugacu

SEQ ID NO: 2586962 - RNA, 17 nt, Coxiella burnetii RSA 493
uauuucaccuucuucuu

SEQ ID NO: 2586963 - RNA, 20 nt, Coxiella burnetii RSA 493
uauuucaccuucuucuuugg

SEQ ID NO: 2586964 - RNA, 22 nt, Coxiella burnetii RSA 493
uauuuccagcaguaaugagcau

SEQ ID NO: 2586965 - RNA, 14 nt, Coxiella burnetii RSA 493
uauuucgcuucgcu

SEQ ID NO: 2586966 - RNA, 18 nt, Coxiella burnetii RSA 493
uauuucgcuucgcuacau

SEQ ID NO: 2586967 - RNA, 20 nt, Coxiella burnetii RSA 493
uauuucgcuucgcuacauac

SEQ ID NO: 2586968 - RNA, 20 nt, Coxiella burnetii RSA 493
uauuucgcuucgcuccauac

SEQ ID NO: 2586969 - RNA, 20 nt, Coxiella burnetii RSA 493
uauuucgcuucgcugcauac

SEQ ID NO: 2586970 - RNA, 15 nt, Coxiella burnetii RSA 493
uauuucgucagugaa

SEQ ID NO: 2586971 - RNA, 15 nt, Coxiella burnetii RSA 493
uauuucguuccauga

SEQ ID NO: 2586972 - RNA, 11 nt, Coxiella burnetii RSA 493
uauuucuuuuc

SEQ ID NO: 2586973 - RNA, 13 nt, Coxiella burnetii RSA 493
uauuucuuuugau

SEQ ID NO: 2586974 - RNA, 14 nt, Coxiella burnetii RSA 493
uauuucuuuugauu

SEQ ID NO: 2586975 - RNA, 14 nt, Coxiella burnetii RSA 493
uauuucuuuugccu

SEQ ID NO: 2586976 - RNA, 15 nt, Coxiella burnetii RSA 493
uauuugaaauagcca

SEQ ID NO: 2586977 - RNA, 17 nt, Coxiella burnetii RSA 493
uauuugaaauagccauu

SEQ ID NO: 2586978 - RNA, 15 nt, Coxiella burnetii RSA 493
uauuugaaccaugag

SEQ ID NO: 2586979 - RNA, 22 nt, Coxiella burnetii RSA 493
uauuugcaauagucacgagaua

SEQ ID NO: 2586980 - RNA, 18 nt, Coxiella burnetii RSA 493
uauuuggguuuucuuuug

SEQ ID NO: 2586981 - RNA, 23 nt, Coxiella burnetii RSA 493
uauuuguucguaauaauaagcgu

SEQ ID NO: 2586982 - RNA, 16 nt, Coxiella burnetii RSA 493
uauuuguugaacagag

SEQ ID NO: 2586983 - RNA, 14 nt, Coxiella burnetii RSA 493
uauuuucauucuca

SEQ ID NO: 2586984 - RNA, 21 nt, Coxiella burnetii RSA 493
uauuuucuacggccaucgccc

SEQ ID NO: 2586985 - RNA, 12 nt, Coxiella burnetii RSA 493
uauuuucucaau

SEQ ID NO: 2586986 - RNA, 16 nt, Coxiella burnetii RSA 493
uauuuuuauucuucug

SEQ ID NO: 2586987 - RNA, 12 nt, Coxiella burnetii RSA 493
uauuuuucuuug

SEQ ID NO: 2586988 - RNA, 11 nt, Coxiella burnetii RSA 493
uauuuuuuaac

SEQ ID NO: 2586989 - RNA, 23 nt, Coxiella burnetii RSA 493
uauuuuuuacccguuuaaauuug

SEQ ID NO: 2586990 - RNA, 13 nt, Coxiella burnetii RSA 493
uauuuuuucuuug

SEQ ID NO: 2586991 - RNA, 13 nt, Coxiella burnetii RSA 493
uauuuuuugcucu

SEQ ID NO: 2586992 - RNA, 21 nt, Coxiella burnetii RSA 493
ucaaaaaaccauaaauggaua

SEQ ID NO: 2586993 - RNA, 22 nt, Coxiella burnetii RSA 493
ucaaaaagggcgaugugaaaca

SEQ ID NO: 2586994 - RNA, 15 nt, Coxiella burnetii RSA 493
ucaaaaauaaaaauu

SEQ ID NO: 2586995 - RNA, 17 nt, Coxiella burnetii RSA 493
ucaaaacaaucaaugca

SEQ ID NO: 2586996 - RNA, 19 nt, Coxiella burnetii RSA 493
ucaaaacaaucaaugcagu

SEQ ID NO: 2586997 - RNA, 17 nt, Coxiella burnetii RSA 493
ucaaaagaggguauuuu

SEQ ID NO: 2586998 - RNA, 15 nt, Coxiella burnetii RSA 493
ucaaaaucagaaacg

SEQ ID NO: 2586999 - RNA, 15 nt, Coxiella burnetii RSA 493
ucaaaauuaaaaucu

SEQ ID NO: 2587000 - RNA, 21 nt, Coxiella burnetii RSA 493
ucaaaauuaaaaucuucugau

SEQ ID NO: 2587001 - RNA, 20 nt, Coxiella burnetii RSA 493
ucaaacaauugagcggcuuu

SEQ ID NO: 2587002 - RNA, 17 nt, Coxiella burnetii RSA 493
ucaaacguccuucucca

SEQ ID NO: 2587003 - RNA, 19 nt, Coxiella burnetii RSA 493
ucaaacuguuugcauuuaa

SEQ ID NO: 2587004 - RNA, 20 nt, Coxiella burnetii RSA 493
ucaaacuguuugcauuuaau

SEQ ID NO: 2587005 - RNA, 13 nt, Coxiella burnetii RSA 493
ucaaaguagcugc

SEQ ID NO: 2587006 - RNA, 22 nt, Coxiella burnetii RSA 493
ucaaagucaugaucgguuuuuu

SEQ ID NO: 2587007 - RNA, 14 nt, Coxiella burnetii RSA 493
ucaaaucaauaauc

SEQ ID NO: 2587008 - RNA, 11 nt, Coxiella burnetii RSA 493
ucaaaugaaua

SEQ ID NO: 2587009 - RNA, 17 nt, Coxiella burnetii RSA 493
ucaaaugaauaagcaaa

SEQ ID NO: 2587010 - RNA, 19 nt, Coxiella burnetii RSA 493
ucaaaugaauaagcaaaga

SEQ ID NO: 2587011 - RNA, 17 nt, Coxiella burnetii RSA 493
ucaaauuaaaauaaucc

SEQ ID NO: 2587012 - RNA, 22 nt, Coxiella burnetii RSA 493
ucaaauucagccguuauaaagu

SEQ ID NO: 2587013 - RNA, 20 nt, Coxiella burnetii RSA 493
ucaaauucuagugugauaau

SEQ ID NO: 2587014 - RNA, 20 nt, Coxiella burnetii RSA 493
ucaaauugcuccaaacagac

SEQ ID NO: 2587015 - RNA, 12 nt, Coxiella burnetii RSA 493
ucaaauuuuccc

SEQ ID NO: 2587016 - RNA, 14 nt, Coxiella burnetii RSA 493
ucaaauuuucccag

SEQ ID NO: 2587017 - RNA, 18 nt, Coxiella burnetii RSA 493
ucaacaaaauuuuucaug

SEQ ID NO: 2587018 - RNA, 15 nt, Coxiella burnetii RSA 493
ucaacauauuucuug

SEQ ID NO: 2587019 - RNA, 16 nt, Coxiella burnetii RSA 493
ucaacaucaaccccag

SEQ ID NO: 2587020 - RNA, 17 nt, Coxiella burnetii RSA 493
ucaacaucaaccccagc

SEQ ID NO: 2587021 - RNA, 19 nt, Coxiella burnetii RSA 493
ucaaccucagguuuuaccu

SEQ ID NO: 2587022 - RNA, 23 nt, Coxiella burnetii RSA 493
ucaacgauuuuaagaaucgucgu

SEQ ID NO: 2587023 - RNA, 22 nt, Coxiella burnetii RSA 493
ucaacgcuucagaaucugcuuc

SEQ ID NO: 2587024 - RNA, 20 nt, Coxiella burnetii RSA 493
ucaacggaaaaacaaaacaa

SEQ ID NO: 2587025 - RNA, 23 nt, Coxiella burnetii RSA 493
ucaacggaucguacuuggaaaau

SEQ ID NO: 2587026 - RNA, 19 nt, Coxiella burnetii RSA 493
ucaacuacuugauauuccc

SEQ ID NO: 2587027 - RNA, 22 nt, Coxiella burnetii RSA 493
ucaacucgcccauggaaaucgc

SEQ ID NO: 2587028 - RNA, 17 nt, Coxiella burnetii RSA 493
ucaagaaagacauuguu

SEQ ID NO: 2587029 - RNA, 22 nt, Coxiella burnetii RSA 493
ucaagcacuaguuuuacuacau

SEQ ID NO: 2587030 - RNA, 17 nt, Coxiella burnetii RSA 493
ucaaggccaacauucuu

SEQ ID NO: 2587031 - RNA, 19 nt, Coxiella burnetii RSA 493
ucaaggggaacugauuaaa

SEQ ID NO: 2587032 - RNA, 22 nt, Coxiella burnetii RSA 493
ucaagguuauugcuauuuuccu

SEQ ID NO: 2587033 - RNA, 16 nt, Coxiella burnetii RSA 493
ucaaguagccaaaaua

SEQ ID NO: 2587034 - RNA, 20 nt, Coxiella burnetii RSA 493
ucaaguccuugcugaauucc

SEQ ID NO: 2587035 - RNA, 22 nt, Coxiella burnetii RSA 493
ucaaguccuugcugaauucccu

SEQ ID NO: 2587036 - RNA, 23 nt, Coxiella burnetii RSA 493
ucaaguggcuccgauaagugaau

SEQ ID NO: 2587037 - RNA, 13 nt, Coxiella burnetii RSA 493
ucaaguguauuuu

SEQ ID NO: 2587038 - RNA, 15 nt, Coxiella burnetii RSA 493
ucaaguguauuuuca

SEQ ID NO: 2587039 - RNA, 15 nt, Coxiella burnetii RSA 493
ucaauaaaaauauac

SEQ ID NO: 2587040 - RNA, 16 nt, Coxiella burnetii RSA 493
ucaauaaauaaaucaa

SEQ ID NO: 2587041 - RNA, 18 nt, Coxiella burnetii RSA 493
ucaauaaauaaaucaagu

SEQ ID NO: 2587042 - RNA, 18 nt, Coxiella burnetii RSA 493
ucauccagugaaaacccg

SEQ ID NO: 2587043 - RNA, 19 nt, Coxiella burnetii RSA 493
ucaucgcauacagcggaac

SEQ ID NO: 2587044 - RNA, 19 nt, Coxiella burnetii RSA 493
ucaucgccaaaagguaugu

SEQ ID NO: 2587045 - RNA, 19 nt, Coxiella burnetii RSA 493
ucaucgggagcgauaauga

SEQ ID NO: 2587046 - RNA, 20 nt, Coxiella burnetii RSA 493
ucaucguuugauucauuagu

SEQ ID NO: 2587047 - RNA, 17 nt, Coxiella burnetii RSA 493
ucaucuaaauuaaaaau

SEQ ID NO: 2587048 - RNA, 21 nt, Coxiella burnetii RSA 493
ucaucuaaauuaaaaaucggu

SEQ ID NO: 2587049 - RNA, 12 nt, Coxiella burnetii RSA 493
ucaucuccuuuu

SEQ ID NO: 2587050 - RNA, 21 nt, Coxiella burnetii RSA 493
ucaucugcgggauuaauuuuc

SEQ ID NO: 2587051 - RNA, 14 nt, Coxiella burnetii RSA 493
ucaucuucaaaacc

SEQ ID NO: 2587052 - RNA, 22 nt, Coxiella burnetii RSA 493
ucaucuucaaaaccuaacgcaa

SEQ ID NO: 2587053 - RNA, 15 nt, Coxiella burnetii RSA 493
ucaucuuguaaucgc

SEQ ID NO: 2587054 - RNA, 13 nt, Coxiella burnetii RSA 493
ucaugaaaaagau

SEQ ID NO: 2587055 - RNA, 15 nt, Coxiella burnetii RSA 493
ucaugaaaaguaaau

SEQ ID NO: 2587056 - RNA, 20 nt, Coxiella burnetii RSA 493
ucaugaaaaguaaauuuaua

SEQ ID NO: 2587057 - RNA, 19 nt, Coxiella burnetii RSA 493
ucaugaucgguuuuuugac

SEQ ID NO: 2587058 - RNA, 22 nt, Coxiella burnetii RSA 493
ucauggcuuguuccgccauuuc

SEQ ID NO: 2587059 - RNA, 14 nt, Coxiella burnetii RSA 493
ucauguaaucaauu

SEQ ID NO: 2587060 - RNA, 18 nt, Coxiella burnetii RSA 493
ucauuaagcaauuuuuua

SEQ ID NO: 2587061 - RNA, 19 nt, Coxiella burnetii RSA 493
ucauuaagcaauuuuuuau

SEQ ID NO: 2587062 - RNA, 15 nt, Coxiella burnetii RSA 493
ucauuaucaugcauu

SEQ ID NO: 2587063 - RNA, 20 nt, Coxiella burnetii RSA 493
ucauuaucaugcauuugauu

SEQ ID NO: 2587064 - RNA, 17 nt, Coxiella burnetii RSA 493
ucauuaucuagauuuuc

SEQ ID NO: 2587065 - RNA, 21 nt, Coxiella burnetii RSA 493
ucauuaucucuuaaaauuccg

SEQ ID NO: 2587066 - RNA, 15 nt, Coxiella burnetii RSA 493
ucauucauucgcuuu

SEQ ID NO: 2587067 - RNA, 18 nt, Coxiella burnetii RSA 493
ucauucauuucaauauuu

SEQ ID NO: 2587068 - RNA, 15 nt, Coxiella burnetii RSA 493
ucauucgcuuuuuug

SEQ ID NO: 2587069 - RNA, 17 nt, Coxiella burnetii RSA 493
ucauucgggcauacgau

SEQ ID NO: 2587070 - RNA, 19 nt, Coxiella burnetii RSA 493
ucauucuuuuuucaagccc

SEQ ID NO: 2587071 - RNA, 21 nt, Coxiella burnetii RSA 493
ucauucuuuuuucaagcccuu

SEQ ID NO: 2587072 - RNA, 14 nt, Coxiella burnetii RSA 493
ucauugaaaucaau

SEQ ID NO: 2587073 - RNA, 22 nt, Coxiella burnetii RSA 493
ucauugaaaucaauuuucuucg

SEQ ID NO: 2587074 - RNA, 22 nt, Coxiella burnetii RSA 493
ucauugagcgggauauuuuuua

SEQ ID NO: 2587075 - RNA, 14 nt, Coxiella burnetii RSA 493
ucauuguuaaucca

SEQ ID NO: 2587076 - RNA, 13 nt, Coxiella burnetii RSA 493
ucauuuaauuuua

SEQ ID NO: 2587077 - RNA, 15 nt, Coxiella burnetii RSA 493
ucauuuaauuuuaaa

SEQ ID NO: 2587078 - RNA, 16 nt, Coxiella burnetii RSA 493
ucauuucccguauuuc

SEQ ID NO: 2587079 - RNA, 21 nt, Coxiella burnetii RSA 493
ucauuuccugaaccuaaauua

SEQ ID NO: 2587080 - RNA, 21 nt, Coxiella burnetii RSA 493
ucauuucgagcgcgauuuucu

SEQ ID NO: 2587081 - RNA, 16 nt, Coxiella burnetii RSA 493
ucauuuguucuaucaa

SEQ ID NO: 2587082 - RNA, 12 nt, Coxiella burnetii RSA 493
ucauuuucucua

SEQ ID NO: 2587083 - RNA, 17 nt, Coxiella burnetii RSA 493
ucauuuuuaugcuucaa

SEQ ID NO: 2587084 - RNA, 13 nt, Coxiella burnetii RSA 493
ucauuuuucaggg

SEQ ID NO: 2587085 - RNA, 17 nt, Coxiella burnetii RSA 493
ucauuuuuuauaaaauu

SEQ ID NO: 2587086 - RNA, 22 nt, Coxiella burnetii RSA 493
ucauuuuuuauaaaauuuaaua

SEQ ID NO: 2587087 - RNA, 20 nt, Coxiella burnetii RSA 493
uccaaaaacagauuuaaaua

SEQ ID NO: 2587088 - RNA, 14 nt, Coxiella burnetii RSA 493
uccaaaaagauaau

SEQ ID NO: 2587089 - RNA, 16 nt, Coxiella burnetii RSA 493
uccaaaaauuucauuu

SEQ ID NO: 2587090 - RNA, 20 nt, Coxiella burnetii RSA 493
uccaaaauuugagguugaau

SEQ ID NO: 2587091 - RNA, 20 nt, Coxiella burnetii RSA 493
uccaaacuacucucaaaauc

SEQ ID NO: 2587092 - RNA, 16 nt, Coxiella burnetii RSA 493
uccaaauauuuaaauu

SEQ ID NO: 2587093 - RNA, 19 nt, Coxiella burnetii RSA 493
uccaacacguauuuucauu

SEQ ID NO: 2587094 - RNA, 20 nt, Coxiella burnetii RSA 493
uccaacacguauuuucauuc

SEQ ID NO: 2587095 - RNA, 16 nt, Coxiella burnetii RSA 493
uccaacauauggccca

SEQ ID NO: 2587096 - RNA, 16 nt, Coxiella burnetii RSA 493
uccaacgguucucaaa

SEQ ID NO: 2587097 - RNA, 19 nt, Coxiella burnetii RSA 493
uccaagauuuuuuuaaguu

SEQ ID NO: 2587098 - RNA, 21 nt, Coxiella burnetii RSA 493
uccaaggaaaggucaggcaau

SEQ ID NO: 2587099 - RNA, 18 nt, Coxiella burnetii RSA 493
uccaauaaggcauuugca

SEQ ID NO: 2587100 - RNA, 21 nt, Coxiella burnetii RSA 493
uccaauaauugcugaacaaaa

SEQ ID NO: 2587101 - RNA, 14 nt, Coxiella burnetii RSA 493
uccaauuauaacua

SEQ ID NO: 2587102 - RNA, 21 nt, Coxiella burnetii RSA 493
uccaauuauaacuauuuuaaa

SEQ ID NO: 2587103 - RNA, 15 nt, Coxiella burnetii RSA 493
uccaauucuuuaagu

SEQ ID NO: 2587104 - RNA, 19 nt, Coxiella burnetii RSA 493
uccaauuguuugaaaaaau

SEQ ID NO: 2587105 - RNA, 22 nt, Coxiella burnetii RSA 493
uccaauuguuugaaaaaauacc

SEQ ID NO: 2587106 - RNA, 13 nt, Coxiella burnetii RSA 493
uccaauuuuuugc

SEQ ID NO: 2587107 - RNA, 15 nt, Coxiella burnetii RSA 493
uccacaauuuuccgg

SEQ ID NO: 2587108 - RNA, 13 nt, Coxiella burnetii RSA 493
uccaccacuuugc

SEQ ID NO: 2587109 - RNA, 17 nt, Coxiella burnetii RSA 493
uccacggaguuuucauu

SEQ ID NO: 2587110 - RNA, 12 nt, Coxiella burnetii RSA 493
uccacuuaaaac

SEQ ID NO: 2587111 - RNA, 14 nt, Coxiella burnetii RSA 493
uccacuuucucgcu

SEQ ID NO: 2587112 - RNA, 13 nt, Coxiella burnetii RSA 493
uccagaaauucau

SEQ ID NO: 2587113 - RNA, 16 nt, Coxiella burnetii RSA 493
uccagaccuguuaaaa

SEQ ID NO: 2587114 - RNA, 14 nt, Coxiella burnetii RSA 493
uccagcaguaauga

SEQ ID NO: 2587115 - RNA, 21 nt, Coxiella burnetii RSA 493
uccagcccccucuacaauaaa

SEQ ID NO: 2587116 - RNA, 17 nt, Coxiella burnetii RSA 493
uccagccgaagcgcggc

SEQ ID NO: 2587117 - RNA, 22 nt, Coxiella burnetii RSA 493
uccagccuuuaguuuuauuuga

SEQ ID NO: 2587118 - RNA, 16 nt, Coxiella burnetii RSA 493
uccagguguuuuucaa

SEQ ID NO: 2587119 - RNA, 12 nt, Coxiella burnetii RSA 493
uccaguuuuuua

SEQ ID NO: 2587120 - RNA, 14 nt, Coxiella burnetii RSA 493
uccaguuuuuuaac

SEQ ID NO: 2587121 - RNA, 12 nt, Coxiella burnetii RSA 493
uccauacuaauu

SEQ ID NO: 2587122 - RNA, 16 nt, Coxiella burnetii RSA 493
uccauacuaauuucag

SEQ ID NO: 2587123 - RNA, 17 nt, Coxiella burnetii RSA 493
uccauagcgaaaauuca

SEQ ID NO: 2587124 - RNA, 14 nt, Coxiella burnetii RSA 493
uccaucuccuuuuc

SEQ ID NO: 2587125 - RNA, 15 nt, Coxiella burnetii RSA 493
uccaugauaaagcgc

SEQ ID NO: 2587126 - RNA, 14 nt, Coxiella burnetii RSA 493
uccaugucuugaac

SEQ ID NO: 2587127 - RNA, 15 nt, Coxiella burnetii RSA 493
uccauuaauuucuuu

SEQ ID NO: 2587128 - RNA, 17 nt, Coxiella burnetii RSA 493
uccauuaauuucuuuuu

SEQ ID NO: 2587129 - RNA, 21 nt, Coxiella burnetii RSA 493
uccauuaauuucuuuuuuugu

SEQ ID NO: 2587130 - RNA, 22 nt, Coxiella burnetii RSA 493
uccauucgcguuuuuaaaugaa

SEQ ID NO: 2587131 - RNA, 13 nt, Coxiella burnetii RSA 493
uccauucuuucau

SEQ ID NO: 2587132 - RNA, 15 nt, Coxiella burnetii RSA 493
uccauucuuucauua

SEQ ID NO: 2587133 - RNA, 18 nt, Coxiella burnetii RSA 493
ucccaaggaaucuauugu

SEQ ID NO: 2587134 - RNA, 18 nt, Coxiella burnetii RSA 493
ucccaauguuuccaaaua

SEQ ID NO: 2587135 - RNA, 22 nt, Coxiella burnetii RSA 493
ucccaauuacgcccuuucucuu

SEQ ID NO: 2587136 - RNA, 20 nt, Coxiella burnetii RSA 493
ucccaauuucuuuucuaaau

SEQ ID NO: 2587137 - RNA, 15 nt, Coxiella burnetii RSA 493
ucccacaaaauaccc

SEQ ID NO: 2587138 - RNA, 20 nt, Coxiella burnetii RSA 493
ucccacguuguuugauuuac

SEQ ID NO: 2587139 - RNA, 20 nt, Coxiella burnetii RSA 493
ucccagcuuuccguaaaaca

SEQ ID NO: 2587140 - RNA, 20 nt, Coxiella burnetii RSA 493
ucccauaauuccgcauaaac

SEQ ID NO: 2587141 - RNA, 18 nt, Coxiella burnetii RSA 493
ucccaugacgauuuuaau

SEQ ID NO: 2587142 - RNA, 23 nt, Coxiella burnetii RSA 493
uccccaaaggugucaaaauuauu

SEQ ID NO: 2587143 - RNA, 16 nt, Coxiella burnetii RSA 493
uccccaauuuauucaa

SEQ ID NO: 2587144 - RNA, 18 nt, Coxiella burnetii RSA 493
uccccaucaguuggcugu

SEQ ID NO: 2587145 - RNA, 15 nt, Coxiella burnetii RSA 493
uccccguauuucgcu

SEQ ID NO: 2587146 - RNA, 18 nt, Coxiella burnetii RSA 493
uccccuuauagcgugaga

SEQ ID NO: 2587147 - RNA, 13 nt, Coxiella burnetii RSA 493
ucgcaaagcucag

SEQ ID NO: 2587148 - RNA, 21 nt, Coxiella burnetii RSA 493
ucgcaacaagcaacgaucaug

SEQ ID NO: 2587149 - RNA, 18 nt, Coxiella burnetii RSA 493
ucgcaauuaauacauucu

SEQ ID NO: 2587150 - RNA, 22 nt, Coxiella burnetii RSA 493
ucgcaauuaauacauucuucag

SEQ ID NO: 2587151 - RNA, 18 nt, Coxiella burnetii RSA 493
ucgcaauugaaaaaccau

SEQ ID NO: 2587152 - RNA, 21 nt, Coxiella burnetii RSA 493
ucgcaauugaaaaaccauuca

SEQ ID NO: 2587153 - RNA, 19 nt, Coxiella burnetii RSA 493
ucgcacaaugcuuuucuca

SEQ ID NO: 2587154 - RNA, 14 nt, Coxiella burnetii RSA 493
ucgcaccucgccuu

SEQ ID NO: 2587155 - RNA, 15 nt, Coxiella burnetii RSA 493
ucgcauaauaaucga

SEQ ID NO: 2587156 - RNA, 23 nt, Coxiella burnetii RSA 493
ucgcauagccaaccgccauuucg

SEQ ID NO: 2587157 - RNA, 22 nt, Coxiella burnetii RSA 493
ucgcauucuauuagcugccauu

SEQ ID NO: 2587158 - RNA, 21 nt, Coxiella burnetii RSA 493
ucgccacuggguuuuccccau

SEQ ID NO: 2587159 - RNA, 20 nt, Coxiella burnetii RSA 493
ucgccauugucucacaacau

SEQ ID NO: 2587160 - RNA, 15 nt, Coxiella burnetii RSA 493
ucgccguuucugcuu

SEQ ID NO: 2587161 - RNA, 22 nt, Coxiella burnetii RSA 493
ucgccuguggcaauuaugaaaa

SEQ ID NO: 2587162 - RNA, 23 nt, Coxiella burnetii RSA 493
ucgccuguggcaauuaugaaaac

SEQ ID NO: 2587163 - RNA, 20 nt, Coxiella burnetii RSA 493
ucgcgaaauuuaauaaaauu

SEQ ID NO: 2587164 - RNA, 23 nt, Coxiella burnetii RSA 493
ucgcgaaauuuaauaaaauuaaa

SEQ ID NO: 2587165 - RNA, 14 nt, Coxiella burnetii RSA 493
ucgcgcaaguuuug

SEQ ID NO: 2587166 - RNA, 15 nt, Coxiella burnetii RSA 493
ucgcgcguuuuuuua

SEQ ID NO: 2587167 - RNA, 23 nt, Coxiella burnetii RSA 493
ucgcgguuagcacuuaacuccuu

SEQ ID NO: 2587168 - RNA, 20 nt, Coxiella burnetii RSA 493
ucgcguauaaaugaauaaua

SEQ ID NO: 2587169 - RNA, 20 nt, Coxiella burnetii RSA 493
ucgcuaagcgaaaaaugacc

SEQ ID NO: 2587170 - RNA, 21 nt, Coxiella burnetii RSA 493
ucgcuaauccuaccgcccgcc

SEQ ID NO: 2587171 - RNA, 22 nt, Coxiella burnetii RSA 493
ucgcuccccuugccgaggcaaa

SEQ ID NO: 2587172 - RNA, 16 nt, Coxiella burnetii RSA 493
ucgcuccuaaauuuuc

SEQ ID NO: 2587173 - RNA, 17 nt, Coxiella burnetii RSA 493
ucgcugauacuucuuca

SEQ ID NO: 2587174 - RNA, 20 nt, Coxiella burnetii RSA 493
ucgcugauacuucuucauua

SEQ ID NO: 2587175 - RNA, 22 nt, Coxiella burnetii RSA 493
ucgcugauacuucuucauuaaa

SEQ ID NO: 2587176 - RNA, 21 nt, Coxiella burnetii RSA 493
ucgcuguuaauaauagcguau

SEQ ID NO: 2587177 - RNA, 13 nt, Coxiella burnetii RSA 493
ucgcuucaauucu

SEQ ID NO: 2587178 - RNA, 17 nt, Coxiella burnetii RSA 493
ucgcuucaauucuuuuu

SEQ ID NO: 2587179 - RNA, 19 nt, Coxiella burnetii RSA 493
ucgcuucaauucuuuuuaa

SEQ ID NO: 2587180 - RNA, 20 nt, Coxiella burnetii RSA 493
ucgcuucaauucuuuuuaag

SEQ ID NO: 2587181 - RNA, 19 nt, Coxiella burnetii RSA 493
ucgcuucgcucauacgggc

SEQ ID NO: 2587182 - RNA, 19 nt, Coxiella burnetii RSA 493
ucgcuuugcggccucgccu

SEQ ID NO: 2587183 - RNA, 23 nt, Coxiella burnetii RSA 493
ucgcuuuucguucugaaauuuua

SEQ ID NO: 2587184 - RNA, 18 nt, Coxiella burnetii RSA 493
ucggaaauuucucucuca

SEQ ID NO: 2587185 - RNA, 22 nt, Coxiella burnetii RSA 493
ucggaaauuucucucucauaau

SEQ ID NO: 2587186 - RNA, 20 nt, Coxiella burnetii RSA 493
ucggauacgaccuucugaau

SEQ ID NO: 2587187 - RNA, 19 nt, Coxiella burnetii RSA 493
ucggcauauucugccaucg

SEQ ID NO: 2587188 - RNA, 20 nt, Coxiella burnetii RSA 493
ucggccggauuuuaauugaa

SEQ ID NO: 2587189 - RNA, 18 nt, Coxiella burnetii RSA 493
ucggccugggcaaggcau

SEQ ID NO: 2587190 - RNA, 17 nt, Coxiella burnetii RSA 493
ucggcgcauuuuuauuc

SEQ ID NO: 2587191 - RNA, 18 nt, Coxiella burnetii RSA 493
ucggcuaaaucuugcugc

SEQ ID NO: 2587192 - RNA, 13 nt, Coxiella burnetii RSA 493
ucgggaaauaaaa

SEQ ID NO: 2587193 - RNA, 16 nt, Coxiella burnetii RSA 493
ucgggcaccauaucca

SEQ ID NO: 2587194 - RNA, 19 nt, Coxiella burnetii RSA 493
ucgggccuucacuuuucug

SEQ ID NO: 2587195 - RNA, 21 nt, Coxiella burnetii RSA 493
ucggggcggcuuuuuucgcuu

SEQ ID NO: 2587196 - RNA, 17 nt, Coxiella burnetii RSA 493
ucgguagaaugauacca

SEQ ID NO: 2587197 - RNA, 21 nt, Coxiella burnetii RSA 493
ucgguucaagcacuaguuuua

SEQ ID NO: 2587198 - RNA, 23 nt, Coxiella burnetii RSA 493
ucgguucaagcacuaguuuuacu

SEQ ID NO: 2587199 - RNA, 16 nt, Coxiella burnetii RSA 493
ucgguugaagaaauac

SEQ ID NO: 2587200 - RNA, 11 nt, Coxiella burnetii RSA 493
ucgguuuuuuu

SEQ ID NO: 2587201 - RNA, 19 nt, Coxiella burnetii RSA 493
ucgguuuuuuuaaaaaaga

SEQ ID NO: 2587202 - RNA, 18 nt, Coxiella burnetii RSA 493
ucguaaauauuuuuauuu

SEQ ID NO: 2587203 - RNA, 23 nt, Coxiella burnetii RSA 493
ucguauauccggcaucacgauuu

SEQ ID NO: 2587204 - RNA, 17 nt, Coxiella burnetii RSA 493
ucguauccaaauauuua

SEQ ID NO: 2587205 - RNA, 14 nt, Coxiella burnetii RSA 493
ucgucauuuccgug

SEQ ID NO: 2587206 - RNA, 13 nt, Coxiella burnetii RSA 493
ucguccugaaaac

SEQ ID NO: 2587207 - RNA, 22 nt, Coxiella burnetii RSA 493
ucgucgacaaaaagacauuaau

SEQ ID NO: 2587208 - RNA, 15 nt, Coxiella burnetii RSA 493
ucgucgcccucauuc

SEQ ID NO: 2587209 - RNA, 17 nt, Coxiella burnetii RSA 493
ucgugagguuuuaccuu

SEQ ID NO: 2587210 - RNA, 19 nt, Coxiella burnetii RSA 493
ucgugcucuuuuuucaaaa

SEQ ID NO: 2587211 - RNA, 17 nt, Coxiella burnetii RSA 493
ucguguuagggagugaa

SEQ ID NO: 2587212 - RNA, 22 nt, Coxiella burnetii RSA 493
ucguuaaaaccuuuuuuuucaa

SEQ ID NO: 2587213 - RNA, 24 nt, Coxiella burnetii RSA 493
ucguuaaaucgggugcauaacggg

SEQ ID NO: 2587214 - RNA, 21 nt, Coxiella burnetii RSA 493
ucguuaagccugaaaaucaaa

SEQ ID NO: 2587215 - RNA, 21 nt, Coxiella burnetii RSA 493
ucguuaccuucuguaaugauu

SEQ ID NO: 2587216 - RNA, 23 nt, Coxiella burnetii RSA 493
ucguuccaugacaugcgccacua

SEQ ID NO: 2587217 - RNA, 20 nt, Coxiella burnetii RSA 493
ucguucgaagguauuuugcg

SEQ ID NO: 2587218 - RNA, 15 nt, Coxiella burnetii RSA 493
ucguucugaaauuuu

SEQ ID NO: 2587219 - RNA, 16 nt, Coxiella burnetii RSA 493
ucguugcauaauauuu

SEQ ID NO: 2587220 - RNA, 17 nt, Coxiella burnetii RSA 493
ucguugcauaauauuuu

SEQ ID NO: 2587221 - RNA, 14 nt, Coxiella burnetii RSA 493
ucguugcauaggaa

SEQ ID NO: 2587222 - RNA, 20 nt, Coxiella burnetii RSA 493
ucguugcauucaauacagau

SEQ ID NO: 2587223 - RNA, 17 nt, Coxiella burnetii RSA 493
ucguugccuuuuugaau

SEQ ID NO: 2587224 - RNA, 18 nt, Coxiella burnetii RSA 493
ucguuuacuuguugcgga

SEQ ID NO: 2587225 - RNA, 22 nt, Coxiella burnetii RSA 493
ucguuuauuuccgucaauuuuu

SEQ ID NO: 2587226 - RNA, 15 nt, Coxiella burnetii RSA 493
ucguuuguaauaauu

SEQ ID NO: 2587227 - RNA, 20 nt, Coxiella burnetii RSA 493
ucguuuguauucauuacgau

SEQ ID NO: 2587228 - RNA, 18 nt, Coxiella burnetii RSA 493
ucguuugucuuuguagau

SEQ ID NO: 2587229 - RNA, 13 nt, Coxiella burnetii RSA 493
ucguuuuuuaaua

SEQ ID NO: 2587230 - RNA, 19 nt, Coxiella burnetii RSA 493
ucuaaaaaccccaacucuu

SEQ ID NO: 2587231 - RNA, 13 nt, Coxiella burnetii RSA 493
ucuaaaucgguug

SEQ ID NO: 2587232 - RNA, 22 nt, Coxiella burnetii RSA 493
ucuaaauuaaaugcuuuuuaaa

SEQ ID NO: 2587233 - RNA, 20 nt, Coxiella burnetii RSA 493
ucuaacuccggcggaaugcu

SEQ ID NO: 2587234 - RNA, 22 nt, Coxiella burnetii RSA 493
ucuaacuuugauaagcauaauu

SEQ ID NO: 2587235 - RNA, 20 nt, Coxiella burnetii RSA 493
ucuaagucuauugaaaaaaa

SEQ ID NO: 2587236 - RNA, 21 nt, Coxiella burnetii RSA 493
ucuaagucuauugaaaaaaac

SEQ ID NO: 2587237 - RNA, 22 nt, Coxiella burnetii RSA 493
ucuaaguuauggauaccggaaa

SEQ ID NO: 2587238 - RNA, 14 nt, Coxiella burnetii RSA 493
ucuaauaaaauagc

SEQ ID NO: 2587239 - RNA, 15 nt, Coxiella burnetii RSA 493
ucuaauaauuuuuua

SEQ ID NO: 2587240 - RNA, 20 nt, Coxiella burnetii RSA 493
ucuaaucgucuugaccaaua

SEQ ID NO: 2587241 - RNA, 21 nt, Coxiella burnetii RSA 493
ucuaauugaguauccaacucu

SEQ ID NO: 2587242 - RNA, 22 nt, Coxiella burnetii RSA 493
ucuaauuucuuagguuuuauua

SEQ ID NO: 2587243 - RNA, 12 nt, Coxiella burnetii RSA 493
ucuaccguggcc

SEQ ID NO: 2587244 - RNA, 13 nt, Coxiella burnetii RSA 493
ucuacgaaacgcu

SEQ ID NO: 2587245 - RNA, 13 nt, Coxiella burnetii RSA 493
ucuagauuuaaaa

SEQ ID NO: 2587246 - RNA, 14 nt, Coxiella burnetii RSA 493
ucuagauuuaaaac

SEQ ID NO: 2587247 - RNA, 13 nt, Coxiella burnetii RSA 493
ucuagauuuuccu

SEQ ID NO: 2587248 - RNA, 14 nt, Coxiella burnetii RSA 493
ucuagauuuuccug

SEQ ID NO: 2587249 - RNA, 24 nt, Coxiella burnetii RSA 493
ucuaguuauuuuucaucuuguaau

SEQ ID NO: 2587250 - RNA, 13 nt, Coxiella burnetii RSA 493
ucuaguuuuucaa

SEQ ID NO: 2587251 - RNA, 16 nt, Coxiella burnetii RSA 493
ucuugccgauuuguuu

SEQ ID NO: 2587252 - RNA, 16 nt, Coxiella burnetii RSA 493
ucuugcgacagucucu

SEQ ID NO: 2587253 - RNA, 19 nt, Coxiella burnetii RSA 493
ucuugcgacagucucuuag

SEQ ID NO: 2587254 - RNA, 17 nt, Coxiella burnetii RSA 493
ucuugcggcgauaauca

SEQ ID NO: 2587255 - RNA, 14 nt, Coxiella burnetii RSA 493
ucuugcugcaaaaa

SEQ ID NO: 2587256 - RNA, 22 nt, Coxiella burnetii RSA 493
ucuugcugcauauauuccacaa

SEQ ID NO: 2587257 - RNA, 21 nt, Coxiella burnetii RSA 493
ucuugggcaauuugugaaaua

SEQ ID NO: 2587258 - RNA, 22 nt, Coxiella burnetii RSA 493
ucuuguaaucgcugauacuucu

SEQ ID NO: 2587259 - RNA, 14 nt, Coxiella burnetii RSA 493
ucuugucauucccu

SEQ ID NO: 2587260 - RNA, 20 nt, Coxiella burnetii RSA 493
ucuugucggccggauuuuaa

SEQ ID NO: 2587261 - RNA, 22 nt, Coxiella burnetii RSA 493
ucuugucggccggauuuuaauu

SEQ ID NO: 2587262 - RNA, 19 nt, Coxiella burnetii RSA 493
ucuuguuccaugucuugaa

SEQ ID NO: 2587263 - RNA, 15 nt, Coxiella burnetii RSA 493
ucuuuaaacugagug

SEQ ID NO: 2587264 - RNA, 19 nt, Coxiella burnetii RSA 493
ucuuuaacaagaucaauac

SEQ ID NO: 2587265 - RNA, 21 nt, Coxiella burnetii RSA 493
ucuuuaacuuuagcuaauucu

SEQ ID NO: 2587266 - RNA, 22 nt, Coxiella burnetii RSA 493
ucuuuaauaucaaaaaaccaua

SEQ ID NO: 2587267 - RNA, 15 nt, Coxiella burnetii RSA 493
ucuuuaccuccuccc

SEQ ID NO: 2587268 - RNA, 22 nt, Coxiella burnetii RSA 493
ucuuuacgcgcuucuuuuaauu

SEQ ID NO: 2587269 - RNA, 17 nt, Coxiella burnetii RSA 493
ucuuuagauucaugaaa

SEQ ID NO: 2587270 - RNA, 19 nt, Coxiella burnetii RSA 493
ucuuuagcaauauaacgcu

SEQ ID NO: 2587271 - RNA, 20 nt, Coxiella burnetii RSA 493
ucuuuauuuggcuuuacaua

SEQ ID NO: 2587272 - RNA, 15 nt, Coxiella burnetii RSA 493
ucuuucacuaaaaga

SEQ ID NO: 2587273 - RNA, 17 nt, Coxiella burnetii RSA 493
ucuuucacuaaaagaac

SEQ ID NO: 2587274 - RNA, 16 nt, Coxiella burnetii RSA 493
ucuuucauuaucuaga

SEQ ID NO: 2587275 - RNA, 15 nt, Coxiella burnetii RSA 493
ucuuucuuuucuucu

SEQ ID NO: 2587276 - RNA, 17 nt, Coxiella burnetii RSA 493
ucuuugacauaucauuc

SEQ ID NO: 2587277 - RNA, 18 nt, Coxiella burnetii RSA 493
ucuuugacauaucauucc

SEQ ID NO: 2587278 - RNA, 14 nt, Coxiella burnetii RSA 493
ucuuugaugugaaa

SEQ ID NO: 2587279 - RNA, 16 nt, Coxiella burnetii RSA 493
ucuuugcucuaaauua

SEQ ID NO: 2587280 - RNA, 16 nt, Coxiella burnetii RSA 493
ucuuugguuuuccaug

SEQ ID NO: 2587281 - RNA, 14 nt, Coxiella burnetii RSA 493
ucuuuguagauucu

SEQ ID NO: 2587282 - RNA, 23 nt, Coxiella burnetii RSA 493
ucuuugugagucgccaauaauag

SEQ ID NO: 2587283 - RNA, 21 nt, Coxiella burnetii RSA 493
ucuuuuaaaacgccaaaaccg

SEQ ID NO: 2587284 - RNA, 19 nt, Coxiella burnetii RSA 493
ucuuuuagagccucaaagu

SEQ ID NO: 2587285 - RNA, 22 nt, Coxiella burnetii RSA 493
ucuuuuaugucguucaauucug

SEQ ID NO: 2587286 - RNA, 22 nt, Coxiella burnetii RSA 493
ucuuuuuccauguuuacauuaa

SEQ ID NO: 2587287 - RNA, 16 nt, Coxiella burnetii RSA 493
ucuuuuucgucuguuu

SEQ ID NO: 2587288 - RNA, 16 nt, Coxiella burnetii RSA 493
ucuuuuucuccuuuuc

SEQ ID NO: 2587289 - RNA, 12 nt, Coxiella burnetii RSA 493
ucuuuuuuaaua

SEQ ID NO: 2587290 - RNA, 12 nt, Coxiella burnetii RSA 493
ucuuuuuuccaa

SEQ ID NO: 2587291 - RNA, 13 nt, Coxiella burnetii RSA 493
ucuuuuuuggccc

SEQ ID NO: 2587292 - RNA, 16 nt, Coxiella burnetii RSA 493
ugaaaaaauuaaauau

SEQ ID NO: 2587293 - RNA, 18 nt, Coxiella burnetii RSA 493
ugaaaaaauugauaaucu

SEQ ID NO: 2587294 - RNA, 17 nt, Coxiella burnetii RSA 493
ugaaaaauaaaaggaga

SEQ ID NO: 2587295 - RNA, 19 nt, Coxiella burnetii RSA 493
ugaaaaccuacacuuucaa

SEQ ID NO: 2587296 - RNA, 19 nt, Coxiella burnetii RSA 493
ugaaaacgacuuauuuuau

SEQ ID NO: 2587297 - RNA, 20 nt, Coxiella burnetii RSA 493
ugaaaacgauagucucuaua

SEQ ID NO: 2587298 - RNA, 14 nt, Coxiella burnetii RSA 493
ugaaaaguaaauuu

SEQ ID NO: 2587299 - RNA, 15 nt, Coxiella burnetii RSA 493
ugaaaaguaaauuua

SEQ ID NO: 2587300 - RNA, 16 nt, Coxiella burnetii RSA 493
ugaaaaguaaauuuau

SEQ ID NO: 2587301 - RNA, 21 nt, Coxiella burnetii RSA 493
ugaaaagugguaagcuugcuu

SEQ ID NO: 2587302 - RNA, 15 nt, Coxiella burnetii RSA 493
ugaaaauaauugagg

SEQ ID NO: 2587303 - RNA, 18 nt, Coxiella burnetii RSA 493
ugaaaaucccuuuuaauu

SEQ ID NO: 2587304 - RNA, 20 nt, Coxiella burnetii RSA 493
ugaaaaucccuuuuaauuua

SEQ ID NO: 2587305 - RNA, 14 nt, Coxiella burnetii RSA 493
ugaaacaucaauac

SEQ ID NO: 2587306 - RNA, 20 nt, Coxiella burnetii RSA 493
ugaaacuaagcauuaaaaaa

SEQ ID NO: 2587307 - RNA, 15 nt, Coxiella burnetii RSA 493
ugaaagaauuucucg

SEQ ID NO: 2587308 - RNA, 16 nt, Coxiella burnetii RSA 493
ugaaaguagaaaacuu

SEQ ID NO: 2587309 - RNA, 18 nt, Coxiella burnetii RSA 493
ugaaaguuuucccaaugu

SEQ ID NO: 2587310 - RNA, 12 nt, Coxiella burnetii RSA 493
ugaaauaaacag

SEQ ID NO: 2587311 - RNA, 20 nt, Coxiella burnetii RSA 493
ugaaauaccucuucuaaagu

SEQ ID NO: 2587312 - RNA, 23 nt, Coxiella burnetii RSA 493
ugaaauagccauuaauaaagugc

SEQ ID NO: 2587313 - RNA, 19 nt, Coxiella burnetii RSA 493
ugaaauaugcacuaaaccu

SEQ ID NO: 2587314 - RNA, 13 nt, Coxiella burnetii RSA 493
ugaaauauuuucu

SEQ ID NO: 2587315 - RNA, 22 nt, Coxiella burnetii RSA 493
ugaaaucguuuuguuuuaaguu

SEQ ID NO: 2587316 - RNA, 15 nt, Coxiella burnetii RSA 493
ugaaauucuuguccu

SEQ ID NO: 2587317 - RNA, 14 nt, Coxiella burnetii RSA 493
ugaaauuuuuuuuc

SEQ ID NO: 2587318 - RNA, 19 nt, Coxiella burnetii RSA 493
ugaacaaaagccaugcguu

SEQ ID NO: 2587319 - RNA, 18 nt, Coxiella burnetii RSA 493
ugaacaggauuuucauua

SEQ ID NO: 2587320 - RNA, 19 nt, Coxiella burnetii RSA 493
ugaaccaaaaggaaugaau

SEQ ID NO: 2587321 - RNA, 21 nt, Coxiella burnetii RSA 493
ugaaccaaaaggaaugaauag

SEQ ID NO: 2587322 - RNA, 16 nt, Coxiella burnetii RSA 493
ugaaccgauucauaaa

SEQ ID NO: 2587323 - RNA, 14 nt, Coxiella burnetii RSA 493
ugaaccuaaauuau

SEQ ID NO: 2587324 - RNA, 22 nt, Coxiella burnetii RSA 493
ugaacuaagcgugcucuuuuuc

SEQ ID NO: 2587325 - RNA, 13 nt, Coxiella burnetii RSA 493
ugaagaaauacga

SEQ ID NO: 2587326 - RNA, 18 nt, Coxiella burnetii RSA 493
ugaagaauuuguuuugau

SEQ ID NO: 2587327 - RNA, 18 nt, Coxiella burnetii RSA 493
ugaagaguaaaaaaccaa

SEQ ID NO: 2587328 - RNA, 21 nt, Coxiella burnetii RSA 493
ugaagaguaaaaaaccaauac

SEQ ID NO: 2587329 - RNA, 21 nt, Coxiella burnetii RSA 493
ugaagauugccacucuuuauu

SEQ ID NO: 2587330 - RNA, 22 nt, Coxiella burnetii RSA 493
ugaagcuauccaaauaaucggg

SEQ ID NO: 2587331 - RNA, 23 nt, Coxiella burnetii RSA 493
ugaaggaaauuugcauuaaucuu

SEQ ID NO: 2587332 - RNA, 12 nt, Coxiella burnetii RSA 493
ugaaggagauca

SEQ ID NO: 2587333 - RNA, 12 nt, Coxiella burnetii RSA 493
ugaauaagcaaa

SEQ ID NO: 2587334 - RNA, 22 nt, Coxiella burnetii RSA 493
ugaauaagcugauuaaggugga

SEQ ID NO: 2587335 - RNA, 13 nt, Coxiella burnetii RSA 493
ugaauacaacgcu

SEQ ID NO: 2587336 - RNA, 13 nt, Coxiella burnetii RSA 493
ugaauagaaaaac

SEQ ID NO: 2587337 - RNA, 23 nt, Coxiella burnetii RSA 493
ugaauauuaguggaauuaaauau

SEQ ID NO: 2587338 - RNA, 18 nt, Coxiella burnetii RSA 493
ugaauauuuuucucuuuc

SEQ ID NO: 2587339 - RNA, 16 nt, Coxiella burnetii RSA 493
ugaaugcguucuuuaa

SEQ ID NO: 2587340 - RNA, 18 nt, Coxiella burnetii RSA 493
ugaaugcguucuuuaauc

SEQ ID NO: 2587341 - RNA, 19 nt, Coxiella burnetii RSA 493
ugaaugcguucuuuaaucc

SEQ ID NO: 2587342 - RNA, 17 nt, Coxiella burnetii RSA 493
ugaaugcuggagugaga

SEQ ID NO: 2587343 - RNA, 16 nt, Coxiella burnetii RSA 493
ugaauggcuuuguaau

SEQ ID NO: 2587344 - RNA, 13 nt, Coxiella burnetii RSA 493
ugaauuaaauaua

SEQ ID NO: 2587345 - RNA, 14 nt, Coxiella burnetii RSA 493
ugaauuacuuucag

SEQ ID NO: 2587346 - RNA, 20 nt, Coxiella burnetii RSA 493
ugaauucccuuuugaauucc

SEQ ID NO: 2587347 - RNA, 18 nt, Coxiella burnetii RSA 493
ugaauuccuugcucaagu

SEQ ID NO: 2587348 - RNA, 14 nt, Coxiella burnetii RSA 493
ugaauuuauuucug

SEQ ID NO: 2587349 - RNA, 23 nt, Coxiella burnetii RSA 493
ugaauuucaccguuuucuaucca

SEQ ID NO: 2587350 - RNA, 22 nt, Coxiella burnetii RSA 493
ugaauuugcuuguuaaguagau

SEQ ID NO: 2587351 - RNA, 16 nt, Coxiella burnetii RSA 493
ugaauuuuugccagga

SEQ ID NO: 2587352 - RNA, 17 nt, Coxiella burnetii RSA 493
ugaauuuuuugaaaaac

SEQ ID NO: 2587353 - RNA, 12 nt, Coxiella burnetii RSA 493
ugacaaauaaag

SEQ ID NO: 2587354 - RNA, 17 nt, Coxiella burnetii RSA 493
ugacaccuagccaaauc

SEQ ID NO: 2587355 - RNA, 18 nt, Coxiella burnetii RSA 493
ugacaccuuuggcaauaa

SEQ ID NO: 2587356 - RNA, 20 nt, Coxiella burnetii RSA 493
ugcaagcguuuuucauccag

SEQ ID NO: 2587357 - RNA, 20 nt, Coxiella burnetii RSA 493
ugcaauaacaaauaaaccua

SEQ ID NO: 2587358 - RNA, 22 nt, Coxiella burnetii RSA 493
ugcaauaauucuuucugaaaau

SEQ ID NO: 2587359 - RNA, 21 nt, Coxiella burnetii RSA 493
ugcaauacaccggaaauuuuu

SEQ ID NO: 2587360 - RNA, 19 nt, Coxiella burnetii RSA 493
ugcaauaccauuuuuaaau

SEQ ID NO: 2587361 - RNA, 12 nt, Coxiella burnetii RSA 493
ugcaauguucuu

SEQ ID NO: 2587362 - RNA, 17 nt, Coxiella burnetii RSA 493
ugcaauuccauuaaaaa

SEQ ID NO: 2587363 - RNA, 17 nt, Coxiella burnetii RSA 493
ugcaauucuaguagaac

SEQ ID NO: 2587364 - RNA, 23 nt, Coxiella burnetii RSA 493
ugcacaucuucacgcauuuccca

SEQ ID NO: 2587365 - RNA, 22 nt, Coxiella burnetii RSA 493
ugcacgaaauaauuacaacuac

SEQ ID NO: 2587366 - RNA, 17 nt, Coxiella burnetii RSA 493
ugcacgauuuuauaaac

SEQ ID NO: 2587367 - RNA, 19 nt, Coxiella burnetii RSA 493
ugcacgccuccagggcuug

SEQ ID NO: 2587368 - RNA, 14 nt, Coxiella burnetii RSA 493
ugcagaguuauuau

SEQ ID NO: 2587369 - RNA, 18 nt, Coxiella burnetii RSA 493
ugcagcgaagcgaaauac

SEQ ID NO: 2587370 - RNA, 23 nt, Coxiella burnetii RSA 493
ugcagcgaagcgaaauacgggaa

SEQ ID NO: 2587371 - RNA, 22 nt, Coxiella burnetii RSA 493
ugcagcgaagcgaaauacgggg

SEQ ID NO: 2587372 - RNA, 20 nt, Coxiella burnetii RSA 493
ugcagcgaagcggaauacgg

SEQ ID NO: 2587373 - RNA, 14 nt, Coxiella burnetii RSA 493
ugcagcucuuucaa

SEQ ID NO: 2587374 - RNA, 19 nt, Coxiella burnetii RSA 493
ugcagcucuuucaauguau

SEQ ID NO: 2587375 - RNA, 15 nt, Coxiella burnetii RSA 493
ugcagcugauuucug

SEQ ID NO: 2587376 - RNA, 17 nt, Coxiella burnetii RSA 493
ugcagcugauuucuggu

SEQ ID NO: 2587377 - RNA, 21 nt, Coxiella burnetii RSA 493
ugcagcuucgugcaauuucug

SEQ ID NO: 2587378 - RNA, 21 nt, Coxiella burnetii RSA 493
ugcaguuaaccaauugauuaa

SEQ ID NO: 2587379 - RNA, 19 nt, Coxiella burnetii RSA 493
ugcauaaauuauuuuaaua

SEQ ID NO: 2587380 - RNA, 18 nt, Coxiella burnetii RSA 493
ugcauaauauuuucugcc

SEQ ID NO: 2587381 - RNA, 16 nt, Coxiella burnetii RSA 493
ugcauagcauccuuaa

SEQ ID NO: 2587382 - RNA, 22 nt, Coxiella burnetii RSA 493
ugcauucaauacagauuuuagu

SEQ ID NO: 2587383 - RNA, 15 nt, Coxiella burnetii RSA 493
ugcauugcucaauau

SEQ ID NO: 2587384 - RNA, 16 nt, Coxiella burnetii RSA 493
ugcauugcucaauauu

SEQ ID NO: 2587385 - RNA, 16 nt, Coxiella burnetii RSA 493
ugcauuucuuucaaua

SEQ ID NO: 2587386 - RNA, 15 nt, Coxiella burnetii RSA 493
ugcauuugauuuucu

SEQ ID NO: 2587387 - RNA, 18 nt, Coxiella burnetii RSA 493
ugcauuugcgcuccucua

SEQ ID NO: 2587388 - RNA, 24 nt, Coxiella burnetii RSA 493
ugcauuugcgcuccucuauauaag

SEQ ID NO: 2587389 - RNA, 16 nt, Coxiella burnetii RSA 493
ugcauuuuuaaaagug

SEQ ID NO: 2587390 - RNA, 13 nt, Coxiella burnetii RSA 493
ugcauuuuuaaug

SEQ ID NO: 2587391 - RNA, 17 nt, Coxiella burnetii RSA 493
ugccaauauaaauaauc

SEQ ID NO: 2587392 - RNA, 20 nt, Coxiella burnetii RSA 493
ugccaauauaaauaaucuuc

SEQ ID NO: 2587393 - RNA, 20 nt, Coxiella burnetii RSA 493
ugccacaauauacgcaauug

SEQ ID NO: 2587394 - RNA, 22 nt, Coxiella burnetii RSA 493
ugccacuuucgauaaauuuuga

SEQ ID NO: 2587395 - RNA, 21 nt, Coxiella burnetii RSA 493
ugccagcaauggugauuucuu

SEQ ID NO: 2587396 - RNA, 22 nt, Coxiella burnetii RSA 493
ugccagcaauggugauuucuuc

SEQ ID NO: 2587397 - RNA, 23 nt, Coxiella burnetii RSA 493
ugccagccacaaagaauuuuucc

SEQ ID NO: 2587398 - RNA, 24 nt, Coxiella burnetii RSA 493
ugccaggacuuuaagauuucuuca

SEQ ID NO: 2587399 - RNA, 21 nt, Coxiella burnetii RSA 493
ugccauaaugccuccuugcaa

SEQ ID NO: 2587400 - RNA, 21 nt, Coxiella burnetii RSA 493
ugccaucgccaugagugcauu

SEQ ID NO: 2587401 - RNA, 20 nt, Coxiella burnetii RSA 493
ugccauuugcggaaaaggag

SEQ ID NO: 2587402 - RNA, 21 nt, Coxiella burnetii RSA 493
ugccauuugcggaaaaggaga

SEQ ID NO: 2587403 - RNA, 19 nt, Coxiella burnetii RSA 493
ugccauuuucauuuucucu

SEQ ID NO: 2587404 - RNA, 18 nt, Coxiella burnetii RSA 493
ugcccauucuuucauuaa

SEQ ID NO: 2587405 - RNA, 13 nt, Coxiella burnetii RSA 493
ugcccccccaauu

SEQ ID NO: 2587406 - RNA, 13 nt, Coxiella burnetii RSA 493
ugccccuccucua

SEQ ID NO: 2587407 - RNA, 15 nt, Coxiella burnetii RSA 493
ugcccgaaaaggaaa

SEQ ID NO: 2587408 - RNA, 23 nt, Coxiella burnetii RSA 493
ugcccgaaaaggaaauguaaaaa

SEQ ID NO: 2587409 - RNA, 23 nt, Coxiella burnetii RSA 493
ugcccuagugaggcuucuuccag

SEQ ID NO: 2587410 - RNA, 13 nt, Coxiella burnetii RSA 493
ugccgaguccuau

SEQ ID NO: 2587411 - RNA, 23 nt, Coxiella burnetii RSA 493
ugccgauauucuuuuucuuuauu

SEQ ID NO: 2587412 - RNA, 18 nt, Coxiella burnetii RSA 493
ugccgcaacaagaaaaau

SEQ ID NO: 2587413 - RNA, 20 nt, Coxiella burnetii RSA 493
ugccgcaacaagaaaaauuc

SEQ ID NO: 2587414 - RNA, 17 nt, Coxiella burnetii RSA 493
ugccgccuguaaggucu

SEQ ID NO: 2587415 - RNA, 17 nt, Coxiella burnetii RSA 493
ugccgcgguaaggaaca

SEQ ID NO: 2587416 - RNA, 18 nt, Coxiella burnetii RSA 493
ugccgcgguaaggaacag

SEQ ID NO: 2587417 - RNA, 16 nt, Coxiella burnetii RSA 493
ugccgcuaaaauuuuu

SEQ ID NO: 2587418 - RNA, 18 nt, Coxiella burnetii RSA 493
ugccgcuaaaauuuuuug

SEQ ID NO: 2587419 - RNA, 23 nt, Coxiella burnetii RSA 493
ugccggauugauaaaguuuauug

SEQ ID NO: 2587420 - RNA, 15 nt, Coxiella burnetii RSA 493
ugccuacaaauagag

SEQ ID NO: 2587421 - RNA, 12 nt, Coxiella burnetii RSA 493
ugccucuuuuug

SEQ ID NO: 2587422 - RNA, 16 nt, Coxiella burnetii RSA 493
ugccuguaaaauaaga

SEQ ID NO: 2587423 - RNA, 19 nt, Coxiella burnetii RSA 493
ugccuguaaaauaagaagg

SEQ ID NO: 2587424 - RNA, 19 nt, Coxiella burnetii RSA 493
ugccuucguaaacuuuacc

SEQ ID NO: 2587425 - RNA, 14 nt, Coxiella burnetii RSA 493
ugccuugccuuguu

SEQ ID NO: 2587426 - RNA, 18 nt, Coxiella burnetii RSA 493
ugccuugccuuguuuuaa

SEQ ID NO: 2587427 - RNA, 18 nt, Coxiella burnetii RSA 493
ugccuuggagcucuuguc

SEQ ID NO: 2587428 - RNA, 23 nt, Coxiella burnetii RSA 493
ugccuuugagguuggagguuucu

SEQ ID NO: 2587429 - RNA, 17 nt, Coxiella burnetii RSA 493
ugcgaauaacaaagacu

SEQ ID NO: 2587430 - RNA, 16 nt, Coxiella burnetii RSA 493
ugcgaauguaaugcuu

SEQ ID NO: 2587431 - RNA, 23 nt, Coxiella burnetii RSA 493
ugcgacgaauaccccuuuuguua

SEQ ID NO: 2587432 - RNA, 17 nt, Coxiella burnetii RSA 493
ugcgaggaccucuccaa

SEQ ID NO: 2587433 - RNA, 16 nt, Coxiella burnetii RSA 493
ugcgauaguuuuauuu

SEQ ID NO: 2587434 - RNA, 21 nt, Coxiella burnetii RSA 493
ugcgauaguuuuauuuaaaaa

SEQ ID NO: 2587435 - RNA, 13 nt, Coxiella burnetii RSA 493
ugcgauuaaaagu

SEQ ID NO: 2587436 - RNA, 16 nt, Coxiella burnetii RSA 493
ugcgauuguuuucuua

SEQ ID NO: 2587437 - RNA, 18 nt, Coxiella burnetii RSA 493
ugcgauuuuguuucuuug

SEQ ID NO: 2587438 - RNA, 17 nt, Coxiella burnetii RSA 493
ugcgccgcaaaguaaaa

SEQ ID NO: 2587439 - RNA, 20 nt, Coxiella burnetii RSA 493
ugcgccggcguuugcacaua

SEQ ID NO: 2587440 - RNA, 17 nt, Coxiella burnetii RSA 493
ugcgccuacaaauacca

SEQ ID NO: 2587441 - RNA, 21 nt, Coxiella burnetii RSA 493
ugcgcgggaaugacgauuaaa

SEQ ID NO: 2587442 - RNA, 23 nt, Coxiella burnetii RSA 493
ugcgcgggaaugacgauuaaaaa

SEQ ID NO: 2587443 - RNA, 13 nt, Coxiella burnetii RSA 493
ugcgcguauaauu

SEQ ID NO: 2587444 - RNA, 17 nt, Coxiella burnetii RSA 493
ugcgcuuauagcuuguu

SEQ ID NO: 2587445 - RNA, 13 nt, Coxiella burnetii RSA 493
ugcggaaaaggag

SEQ ID NO: 2587446 - RNA, 14 nt, Coxiella burnetii RSA 493
ugcggaaaaggaga

SEQ ID NO: 2587447 - RNA, 15 nt, Coxiella burnetii RSA 493
ugcggaaaaggagaa

SEQ ID NO: 2587448 - RNA, 14 nt, Coxiella burnetii RSA 493
ugcggaaauuucac

SEQ ID NO: 2587449 - RNA, 15 nt, Coxiella burnetii RSA 493
ugcggaaauuucaca

SEQ ID NO: 2587450 - RNA, 22 nt, Coxiella burnetii RSA 493
ugcggaauucaggacugaaaua

SEQ ID NO: 2587451 - RNA, 18 nt, Coxiella burnetii RSA 493
ugcguuguggacuuguuc

SEQ ID NO: 2587452 - RNA, 14 nt, Coxiella burnetii RSA 493
ugcguuuuaaaugc

SEQ ID NO: 2587453 - RNA, 16 nt, Coxiella burnetii RSA 493
ugcguuuuaaaugcuu

SEQ ID NO: 2587454 - RNA, 15 nt, Coxiella burnetii RSA 493
ugcguuuuuuuauua

SEQ ID NO: 2587455 - RNA, 20 nt, Coxiella burnetii RSA 493
ugcuaaaccacgcuauaauu

SEQ ID NO: 2587456 - RNA, 22 nt, Coxiella burnetii RSA 493
ugcuaaaugcgucaugaaauaa

SEQ ID NO: 2587457 - RNA, 15 nt, Coxiella burnetii RSA 493
ugcuaagauaauuac

SEQ ID NO: 2587458 - RNA, 17 nt, Coxiella burnetii RSA 493
ugcuagaaguauuucca

SEQ ID NO: 2587459 - RNA, 23 nt, Coxiella burnetii RSA 493
ugcuauuugcccaucugauggau

SEQ ID NO: 2587460 - RNA, 13 nt, Coxiella burnetii RSA 493
uggucucuuuuuu

SEQ ID NO: 2587461 - RNA, 15 nt, Coxiella burnetii RSA 493
uggucuguuucuucu

SEQ ID NO: 2587462 - RNA, 16 nt, Coxiella burnetii RSA 493
uggucuguuucuucuu

SEQ ID NO: 2587463 - RNA, 17 nt, Coxiella burnetii RSA 493
uggucuugauuccuuca

SEQ ID NO: 2587464 - RNA, 14 nt, Coxiella burnetii RSA 493
ugguuaaauaggcu

SEQ ID NO: 2587465 - RNA, 14 nt, Coxiella burnetii RSA 493
ugguuaaguagcua

SEQ ID NO: 2587466 - RNA, 17 nt, Coxiella burnetii RSA 493
ugguuaauucuucuuca

SEQ ID NO: 2587467 - RNA, 20 nt, Coxiella burnetii RSA 493
ugguuaauucuucuucauuu

SEQ ID NO: 2587468 - RNA, 21 nt, Coxiella burnetii RSA 493
ugguuaugauguuuuaaaauu

SEQ ID NO: 2587469 - RNA, 18 nt, Coxiella burnetii RSA 493
ugguucguguuuauuuuc

SEQ ID NO: 2587470 - RNA, 14 nt, Coxiella burnetii RSA 493
ugguugaaagaaaa

SEQ ID NO: 2587471 - RNA, 19 nt, Coxiella burnetii RSA 493
ugguugucuaugcaagcac

SEQ ID NO: 2587472 - RNA, 13 nt, Coxiella burnetii RSA 493
ugguuuaaaaagu

SEQ ID NO: 2587473 - RNA, 21 nt, Coxiella burnetii RSA 493
ugguuuaacggaaaugcuuuc

SEQ ID NO: 2587474 - RNA, 13 nt, Coxiella burnetii RSA 493
ugguuuuccauga

SEQ ID NO: 2587475 - RNA, 13 nt, Coxiella burnetii RSA 493
uguaaaauacugg

SEQ ID NO: 2587476 - RNA, 23 nt, Coxiella burnetii RSA 493
uguaaaucauugguuuuugauug

SEQ ID NO: 2587477 - RNA, 16 nt, Coxiella burnetii RSA 493
uguaacuuuuccaucu

SEQ ID NO: 2587478 - RNA, 17 nt, Coxiella burnetii RSA 493
uguaacuuuuccaucuc

SEQ ID NO: 2587479 - RNA, 19 nt, Coxiella burnetii RSA 493
uguaaggcaucuuuuucuc

SEQ ID NO: 2587480 - RNA, 15 nt, Coxiella burnetii RSA 493
uguaaggcugaagag

SEQ ID NO: 2587481 - RNA, 19 nt, Coxiella burnetii RSA 493
uguaaguugggguuuaauu

SEQ ID NO: 2587482 - RNA, 13 nt, Coxiella burnetii RSA 493
uguaauaaugucu

SEQ ID NO: 2587483 - RNA, 12 nt, Coxiella burnetii RSA 493
uguaauaauuca

SEQ ID NO: 2587484 - RNA, 13 nt, Coxiella burnetii RSA 493
uguaauccuuguu

SEQ ID NO: 2587485 - RNA, 20 nt, Coxiella burnetii RSA 493
uguaauccuuguugaauucc

SEQ ID NO: 2587486 - RNA, 22 nt, Coxiella burnetii RSA 493
uguaauccuuguugaauuccuu

SEQ ID NO: 2587487 - RNA, 17 nt, Coxiella burnetii RSA 493
uguaaucuuuuggcaua

SEQ ID NO: 2587488 - RNA, 18 nt, Coxiella burnetii RSA 493
uguaaugcuugcgcaucc

SEQ ID NO: 2587489 - RNA, 13 nt, Coxiella burnetii RSA 493
uguaauugcuucc

SEQ ID NO: 2587490 - RNA, 16 nt, Coxiella burnetii RSA 493
uguaauugcuuccaau

SEQ ID NO: 2587491 - RNA, 19 nt, Coxiella burnetii RSA 493
uguaauuuaucccacguug

SEQ ID NO: 2587492 - RNA, 13 nt, Coxiella burnetii RSA 493
uguacucagcuuu

SEQ ID NO: 2587493 - RNA, 18 nt, Coxiella burnetii RSA 493
uguacuuucacuaauuau

SEQ ID NO: 2587494 - RNA, 11 nt, Coxiella burnetii RSA 493
uguagaaugga

SEQ ID NO: 2587495 - RNA, 15 nt, Coxiella burnetii RSA 493
uguagauuagaaaaa

SEQ ID NO: 2587496 - RNA, 24 nt, Coxiella burnetii RSA 493
uguauaaguguggucugaaaauaa

SEQ ID NO: 2587497 - RNA, 18 nt, Coxiella burnetii RSA 493
uguauggcgccugacaaa

SEQ ID NO: 2587498 - RNA, 18 nt, Coxiella burnetii RSA 493
uguauuaacauuuggauu

SEQ ID NO: 2587499 - RNA, 13 nt, Coxiella burnetii RSA 493
uguauuauuaucc

SEQ ID NO: 2587500 - RNA, 23 nt, Coxiella burnetii RSA 493
uguauugagcagcauucagcuuu

SEQ ID NO: 2587501 - RNA, 11 nt, Coxiella burnetii RSA 493
uguauuuaggg

SEQ ID NO: 2587502 - RNA, 21 nt, Coxiella burnetii RSA 493
uguauuuucaccuuuucccua

SEQ ID NO: 2587503 - RNA, 13 nt, Coxiella burnetii RSA 493
ugucaaaauuauu

SEQ ID NO: 2587504 - RNA, 19 nt, Coxiella burnetii RSA 493
ugucaaacguccuucucca

SEQ ID NO: 2587505 - RNA, 16 nt, Coxiella burnetii RSA 493
ugucaacaaucaguuu

SEQ ID NO: 2587506 - RNA, 19 nt, Coxiella burnetii RSA 493
ugucaauaacccacagccg

SEQ ID NO: 2587507 - RNA, 22 nt, Coxiella burnetii RSA 493
ugucaaugggcaguuuucuuca

SEQ ID NO: 2587508 - RNA, 16 nt, Coxiella burnetii RSA 493
ugucaauuuaccucca

SEQ ID NO: 2587509 - RNA, 22 nt, Coxiella burnetii RSA 493
ugucaauuuaccuccaaaaccc

SEQ ID NO: 2587510 - RNA, 15 nt, Coxiella burnetii RSA 493
ugucacguuaucauu

SEQ ID NO: 2587511 - RNA, 17 nt, Coxiella burnetii RSA 493
ugucagccgcuuccaga

SEQ ID NO: 2587512 - RNA, 19 nt, Coxiella burnetii RSA 493
ugucagcuuccgacaauuc

SEQ ID NO: 2587513 - RNA, 22 nt, Coxiella burnetii RSA 493
ugucagguucggauuucacuuu

SEQ ID NO: 2587514 - RNA, 14 nt, Coxiella burnetii RSA 493
ugucauaaauaaaa

SEQ ID NO: 2587515 - RNA, 16 nt, Coxiella burnetii RSA 493
ugucauaaucacaaaa

SEQ ID NO: 2587516 - RNA, 14 nt, Coxiella burnetii RSA 493
ugucauauuaauau

SEQ ID NO: 2587517 - RNA, 17 nt, Coxiella burnetii RSA 493
ugucauauuaauauuaa

SEQ ID NO: 2587518 - RNA, 18 nt, Coxiella burnetii RSA 493
ugucaucuaucguccccg

SEQ ID NO: 2587519 - RNA, 20 nt, Coxiella burnetii RSA 493
ugucauguucaaucgagucc

SEQ ID NO: 2587520 - RNA, 21 nt, Coxiella burnetii RSA 493
ugucccccgagcaaagcauuu

SEQ ID NO: 2587521 - RNA, 20 nt, Coxiella burnetii RSA 493
uguccuguucuuuuuccaug

SEQ ID NO: 2587522 - RNA, 20 nt, Coxiella burnetii RSA 493
ugucgccacuggguuuuccc

SEQ ID NO: 2587523 - RNA, 14 nt, Coxiella burnetii RSA 493
ugucggauuucuuu

SEQ ID NO: 2587524 - RNA, 18 nt, Coxiella burnetii RSA 493
ugucggccggauuuuaau

SEQ ID NO: 2587525 - RNA, 16 nt, Coxiella burnetii RSA 493
ugucguuaauacgaua

SEQ ID NO: 2587526 - RNA, 23 nt, Coxiella burnetii RSA 493
ugucguuucugauuuuugaagcu

SEQ ID NO: 2587527 - RNA, 17 nt, Coxiella burnetii RSA 493
ugucucaaggcucguug

SEQ ID NO: 2587528 - RNA, 19 nt, Coxiella burnetii RSA 493
ugucugagauggccuuauc

SEQ ID NO: 2587529 - RNA, 18 nt, Coxiella burnetii RSA 493
ugucuuccguugucuugg

SEQ ID NO: 2587530 - RNA, 12 nt, Coxiella burnetii RSA 493
ugucuuuucgca

SEQ ID NO: 2587531 - RNA, 20 nt, Coxiella burnetii RSA 493
ugucuuuucgcauaauaauc

SEQ ID NO: 2587532 - RNA, 13 nt, Coxiella burnetii RSA 493
ugugauuuuaaaa

SEQ ID NO: 2587533 - RNA, 17 nt, Coxiella burnetii RSA 493
ugugauuuuaaaaauaa

SEQ ID NO: 2587534 - RNA, 16 nt, Coxiella burnetii RSA 493
ugugcaauuccauuaa

SEQ ID NO: 2587535 - RNA, 20 nt, Coxiella burnetii RSA 493
ugugcauaaauuauuuuaau

SEQ ID NO: 2587536 - RNA, 20 nt, Coxiella burnetii RSA 493
ugugccacuuucgauaaauu

SEQ ID NO: 2587537 - RNA, 13 nt, Coxiella burnetii RSA 493
ugugcggauuaaa

SEQ ID NO: 2587538 - RNA, 18 nt, Coxiella burnetii RSA 493
ugugcgguauuuuuccug

SEQ ID NO: 2587539 - RNA, 15 nt, Coxiella burnetii RSA 493
uguggaucauccgca

SEQ ID NO: 2587540 - RNA, 13 nt, Coxiella burnetii RSA 493
uguggauuaugug

SEQ ID NO: 2587541 - RNA, 21 nt, Coxiella burnetii RSA 493
uguggcgaagccacacaacca

SEQ ID NO: 2587542 - RNA, 23 nt, Coxiella burnetii RSA 493
ugugguuaauucuucuucauuua

SEQ ID NO: 2587543 - RNA, 14 nt, Coxiella burnetii RSA 493
uguguaaaauacug

SEQ ID NO: 2587544 - RNA, 15 nt, Coxiella burnetii RSA 493
uguguggcuucgcca

SEQ ID NO: 2587545 - RNA, 13 nt, Coxiella burnetii RSA 493
uguguuuuaauuc

SEQ ID NO: 2587546 - RNA, 22 nt, Coxiella burnetii RSA 493
uguuaaaaacgccugaaauauu

SEQ ID NO: 2587547 - RNA, 11 nt, Coxiella burnetii RSA 493
uguuaaaacac

SEQ ID NO: 2587548 - RNA, 23 nt, Coxiella burnetii RSA 493
uguuaacuuuucggagaaaucuu

SEQ ID NO: 2587549 - RNA, 17 nt, Coxiella burnetii RSA 493
uguuauccgguuuuggu

SEQ ID NO: 2587550 - RNA, 14 nt, Coxiella burnetii RSA 493
uguuauugcuaaaa

SEQ ID NO: 2587551 - RNA, 19 nt, Coxiella burnetii RSA 493
uguucaaccgcaugaauua

SEQ ID NO: 2587552 - RNA, 16 nt, Coxiella burnetii RSA 493
uguuccaugucuugaa

SEQ ID NO: 2587553 - RNA, 20 nt, Coxiella burnetii RSA 493
uguuccgcagccuaaaucua

SEQ ID NO: 2587554 - RNA, 14 nt, Coxiella burnetii RSA 493
uguucggaauauaa

SEQ ID NO: 2587555 - RNA, 18 nt, Coxiella burnetii RSA 493
uguucggaauauaauucu

SEQ ID NO: 2587556 - RNA, 16 nt, Coxiella burnetii RSA 493
uguucgggcacaaaaa

SEQ ID NO: 2587557 - RNA, 20 nt, Coxiella burnetii RSA 493
uguucuugaucuaaucgucu

SEQ ID NO: 2587558 - RNA, 17 nt, Coxiella burnetii RSA 493
uguucuugcgacagucu

SEQ ID NO: 2587559 - RNA, 22 nt, Coxiella burnetii RSA 493
uguucuuuuuccauguuuacau

SEQ ID NO: 2587560 - RNA, 14 nt, Coxiella burnetii RSA 493
uguugaaaaccuac

SEQ ID NO: 2587561 - RNA, 16 nt, Coxiella burnetii RSA 493
uguugaauuccuuguu

SEQ ID NO: 2587562 - RNA, 21 nt, Coxiella burnetii RSA 493
uguugaauuccuuguugaauu

SEQ ID NO: 2587563 - RNA, 13 nt, Coxiella burnetii RSA 493
uguugagcaaagc

SEQ ID NO: 2587564 - RNA, 21 nt, Coxiella burnetii RSA 493
uguugggcuucgcaaagcuca

SEQ ID NO: 2587565 - RNA, 23 nt, Coxiella burnetii RSA 493
uguugucaacaaucaguuuugau

SEQ ID NO: 2587566 - RNA, 16 nt, Coxiella burnetii RSA 493
uuaaucucgauuuugg

SEQ ID NO: 2587567 - RNA, 17 nt, Coxiella burnetii RSA 493
uuaaucucgauuuuggu

SEQ ID NO: 2587568 - RNA, 22 nt, Coxiella burnetii RSA 493
uuaaugaaaaauagggcuagua

SEQ ID NO: 2587569 - RNA, 16 nt, Coxiella burnetii RSA 493
uuaaugagguuaauaa

SEQ ID NO: 2587570 - RNA, 17 nt, Coxiella burnetii RSA 493
uuaaugauuuaccgccg

SEQ ID NO: 2587571 - RNA, 15 nt, Coxiella burnetii RSA 493
uuaaugcagcacaaa

SEQ ID NO: 2587572 - RNA, 17 nt, Coxiella burnetii RSA 493
uuaaugcauuugaagua

SEQ ID NO: 2587573 - RNA, 18 nt, Coxiella burnetii RSA 493
uuaaugcgccuacaaaua

SEQ ID NO: 2587574 - RNA, 19 nt, Coxiella burnetii RSA 493
uuaaugcugaugaaauugc

SEQ ID NO: 2587575 - RNA, 14 nt, Coxiella burnetii RSA 493
uuaauggauuccca

SEQ ID NO: 2587576 - RNA, 21 nt, Coxiella burnetii RSA 493
uuaauuauccaaaauccaggc

SEQ ID NO: 2587577 - RNA, 14 nt, Coxiella burnetii RSA 493
uuaauucauaaaua

SEQ ID NO: 2587578 - RNA, 21 nt, Coxiella burnetii RSA 493
uuaauucuucuucauuuauuu

SEQ ID NO: 2587579 - RNA, 23 nt, Coxiella burnetii RSA 493
uuaauugacuacgcauucagaaa

SEQ ID NO: 2587580 - RNA, 19 nt, Coxiella burnetii RSA 493
uuaauugcugauauuuuuu

SEQ ID NO: 2587581 - RNA, 23 nt, Coxiella burnetii RSA 493
uuaauugcugauauuuuuuauuu

SEQ ID NO: 2587582 - RNA, 21 nt, Coxiella burnetii RSA 493
uuaauugcuuccuuaaagcaa

SEQ ID NO: 2587583 - RNA, 11 nt, Coxiella burnetii RSA 493
uuaauuuaggc

SEQ ID NO: 2587584 - RNA, 22 nt, Coxiella burnetii RSA 493
uuaauuucggauguuuuuucac

SEQ ID NO: 2587585 - RNA, 16 nt, Coxiella burnetii RSA 493
uuaauuucuaaaaauc

SEQ ID NO: 2587586 - RNA, 19 nt, Coxiella burnetii RSA 493
uuaauuugaucauuuccua

SEQ ID NO: 2587587 - RNA, 12 nt, Coxiella burnetii RSA 493
uuaauuuuauua

SEQ ID NO: 2587588 - RNA, 21 nt, Coxiella burnetii RSA 493
uuaauuuuugcaucgguagaa

SEQ ID NO: 2587589 - RNA, 19 nt, Coxiella burnetii RSA 493
uuacaauacggugaaccga

SEQ ID NO: 2587590 - RNA, 13 nt, Coxiella burnetii RSA 493
uuacaauauccca

SEQ ID NO: 2587591 - RNA, 14 nt, Coxiella burnetii RSA 493
uuacaauaucccau

SEQ ID NO: 2587592 - RNA, 21 nt, Coxiella burnetii RSA 493
uuacaauccaauacuagcuuu

SEQ ID NO: 2587593 - RNA, 21 nt, Coxiella burnetii RSA 493
uuacaccuaagagaaaaaacc

SEQ ID NO: 2587594 - RNA, 15 nt, Coxiella burnetii RSA 493
uuacagguucacucg

SEQ ID NO: 2587595 - RNA, 12 nt, Coxiella burnetii RSA 493
uuacauaagaaa

SEQ ID NO: 2587596 - RNA, 14 nt, Coxiella burnetii RSA 493
uuacauauuucuuu

SEQ ID NO: 2587597 - RNA, 17 nt, Coxiella burnetii RSA 493
uuacauauuucuuuucu

SEQ ID NO: 2587598 - RNA, 16 nt, Coxiella burnetii RSA 493
uuaccaauuaaagaau

SEQ ID NO: 2587599 - RNA, 12 nt, Coxiella burnetii RSA 493
uuaccacuccug

SEQ ID NO: 2587600 - RNA, 23 nt, Coxiella burnetii RSA 493
uuaccauuuugacaaacaguuag

SEQ ID NO: 2587601 - RNA, 16 nt, Coxiella burnetii RSA 493
uuaccuaacucaaccu

SEQ ID NO: 2587602 - RNA, 17 nt, Coxiella burnetii RSA 493
uuaccuaacucaaccuc

SEQ ID NO: 2587603 - RNA, 19 nt, Coxiella burnetii RSA 493
uuacgcgcuucuuuuaauu

SEQ ID NO: 2587604 - RNA, 19 nt, Coxiella burnetii RSA 493
uuacguuuaaauaacaaau

SEQ ID NO: 2587605 - RNA, 15 nt, Coxiella burnetii RSA 493
uuacuccaauuucau

SEQ ID NO: 2587606 - RNA, 17 nt, Coxiella burnetii RSA 493
uuacuccccccaaaaaa

SEQ ID NO: 2587607 - RNA, 18 nt, Coxiella burnetii RSA 493
uuacuccccccaaaaaaa

SEQ ID NO: 2587608 - RNA, 23 nt, Coxiella burnetii RSA 493
uuacuccccccaaaaaaaaaccu

SEQ ID NO: 2587609 - RNA, 13 nt, Coxiella burnetii RSA 493
uuacuucuuuuuc

SEQ ID NO: 2587610 - RNA, 18 nt, Coxiella burnetii RSA 493
uuacuugcuucaucgauu

SEQ ID NO: 2587611 - RNA, 22 nt, Coxiella burnetii RSA 493
uuacuuguugcggauuggcuuu

SEQ ID NO: 2587612 - RNA, 19 nt, Coxiella burnetii RSA 493
uuagaaugccggcuaauuu

SEQ ID NO: 2587613 - RNA, 22 nt, Coxiella burnetii RSA 493
uuagaauuccuuuuaugaaaga

SEQ ID NO: 2587614 - RNA, 18 nt, Coxiella burnetii RSA 493
uuagagcgauuauguauu

SEQ ID NO: 2587615 - RNA, 23 nt, Coxiella burnetii RSA 493
uuagaguaacgccagcgauuuau

SEQ ID NO: 2587616 - RNA, 16 nt, Coxiella burnetii RSA 493
uuagauauugaacagg

SEQ ID NO: 2587617 - RNA, 15 nt, Coxiella burnetii RSA 493
uuagauuucuggaug

SEQ ID NO: 2587618 - RNA, 18 nt, Coxiella burnetii RSA 493
uuagcaaagccagaagua

SEQ ID NO: 2587619 - RNA, 16 nt, Coxiella burnetii RSA 493
uuagcaacuccgucug

SEQ ID NO: 2587620 - RNA, 22 nt, Coxiella burnetii RSA 493
uuagcgcuaaugagaaacguga

SEQ ID NO: 2587621 - RNA, 17 nt, Coxiella burnetii RSA 493
uuagcguaaucaucaau

SEQ ID NO: 2587622 - RNA, 15 nt, Coxiella burnetii RSA 493
uuagcugauuucucu

SEQ ID NO: 2587623 - RNA, 15 nt, Coxiella burnetii RSA 493
uuagcuuccauugcu

SEQ ID NO: 2587624 - RNA, 20 nt, Coxiella burnetii RSA 493
uuagcuuuuuucaaaauuua

SEQ ID NO: 2587625 - RNA, 22 nt, Coxiella burnetii RSA 493
uuagcuuuuuucaaaauuuacu

SEQ ID NO: 2587626 - RNA, 21 nt, Coxiella burnetii RSA 493
uuaggaaggacaaaaauaucc

SEQ ID NO: 2587627 - RNA, 13 nt, Coxiella burnetii RSA 493
uuaggcgccacag

SEQ ID NO: 2587628 - RNA, 23 nt, Coxiella burnetii RSA 493
uuagggugacggcggauuaaaaa

SEQ ID NO: 2587629 - RNA, 21 nt, Coxiella burnetii RSA 493
uuaguaacccuuucauuuaau

SEQ ID NO: 2587630 - RNA, 16 nt, Coxiella burnetii RSA 493
uuagugaaaguuucau

SEQ ID NO: 2587631 - RNA, 19 nt, Coxiella burnetii RSA 493
uuaguggaauuaaauaucc

SEQ ID NO: 2587632 - RNA, 20 nt, Coxiella burnetii RSA 493
uuaguuucccguauuucgcu

SEQ ID NO: 2587633 - RNA, 22 nt, Coxiella burnetii RSA 493
uuaguuuuauuugaaaguagaa

SEQ ID NO: 2587634 - RNA, 23 nt, Coxiella burnetii RSA 493
uuaguuuuauuugaaaguagaaa

SEQ ID NO: 2587635 - RNA, 20 nt, Coxiella burnetii RSA 493
uuauaaaacuucccauucua

SEQ ID NO: 2587636 - RNA, 24 nt, Coxiella burnetii RSA 493
uuauaaaacuucccauucuauaau

SEQ ID NO: 2587637 - RNA, 16 nt, Coxiella burnetii RSA 493
uuauaaaauuuaauaa

SEQ ID NO: 2587638 - RNA, 12 nt, Coxiella burnetii RSA 493
uuauaaaucccg

SEQ ID NO: 2587639 - RNA, 17 nt, Coxiella burnetii RSA 493
uuauaacuauuuuaaau

SEQ ID NO: 2587640 - RNA, 18 nt, Coxiella burnetii RSA 493
uuauaacuauuuuaaauc

SEQ ID NO: 2587641 - RNA, 14 nt, Coxiella burnetii RSA 493
uuauacacaucuuu

SEQ ID NO: 2587642 - RNA, 17 nt, Coxiella burnetii RSA 493
uuauacccaaaaaccca

SEQ ID NO: 2587643 - RNA, 11 nt, Coxiella burnetii RSA 493
uuauacuuuuu

SEQ ID NO: 2587644 - RNA, 17 nt, Coxiella burnetii RSA 493
uuauaugacgaauacag

SEQ ID NO: 2587645 - RNA, 21 nt, Coxiella burnetii RSA 493
uuaucacuagcuauucuuuug

SEQ ID NO: 2587646 - RNA, 17 nt, Coxiella burnetii RSA 493
uuaucacuccaauaaua

SEQ ID NO: 2587647 - RNA, 22 nt, Coxiella burnetii RSA 493
uuaucauuugggucuccguaau

SEQ ID NO: 2587648 - RNA, 23 nt, Coxiella burnetii RSA 493
uuaucauuugggucuccguaaua

SEQ ID NO: 2587649 - RNA, 13 nt, Coxiella burnetii RSA 493
uuaucauuuuucc

SEQ ID NO: 2587650 - RNA, 18 nt, Coxiella burnetii RSA 493
uuaucccuuuaaccguca

SEQ ID NO: 2587651 - RNA, 14 nt, Coxiella burnetii RSA 493
uuauccgcuuaauc

SEQ ID NO: 2587652 - RNA, 14 nt, Coxiella burnetii RSA 493
uuauccguuuuauu

SEQ ID NO: 2587653 - RNA, 13 nt, Coxiella burnetii RSA 493
uuauccucacaaa

SEQ ID NO: 2587654 - RNA, 15 nt, Coxiella burnetii RSA 493
uuaucgcagaaaaua

SEQ ID NO: 2587655 - RNA, 21 nt, Coxiella burnetii RSA 493
uuaucggaugaugcauuaauc

SEQ ID NO: 2587656 - RNA, 22 nt, Coxiella burnetii RSA 493
uuaucggaugaugcauuaauca

SEQ ID NO: 2587657 - RNA, 18 nt, Coxiella burnetii RSA 493
uuaucguaaaacuuuuuc

SEQ ID NO: 2587658 - RNA, 17 nt, Coxiella burnetii RSA 493
uuaucguaaauauuuuu

SEQ ID NO: 2587659 - RNA, 16 nt, Coxiella burnetii RSA 493
uuaucuagauuuuccu

SEQ ID NO: 2587660 - RNA, 16 nt, Coxiella burnetii RSA 493
uuaucuuauuauucau

SEQ ID NO: 2587661 - RNA, 21 nt, Coxiella burnetii RSA 493
uuaucuuuuuucuuaucccag

SEQ ID NO: 2587662 - RNA, 12 nt, Coxiella burnetii RSA 493
uuaugaaaacau

SEQ ID NO: 2587663 - RNA, 17 nt, Coxiella burnetii RSA 493
uuaugacgguuauguac

SEQ ID NO: 2587664 - RNA, 17 nt, Coxiella burnetii RSA 493
uuaugagacuuuaauaa

SEQ ID NO: 2587665 - RNA, 18 nt, Coxiella burnetii RSA 493
uuaugauguuuuaaaauu

SEQ ID NO: 2587666 - RNA, 14 nt, Coxiella burnetii RSA 493
uuaugcguuauucu

SEQ ID NO: 2587667 - RNA, 13 nt, Coxiella burnetii RSA 493
uuaugcuucaaua

SEQ ID NO: 2587668 - RNA, 23 nt, Coxiella burnetii RSA 493
uuaugggugggcgugauugaaag

SEQ ID NO: 2587669 - RNA, 19 nt, Coxiella burnetii RSA 493
uuauguauuuuuuggaaug

SEQ ID NO: 2587670 - RNA, 21 nt, Coxiella burnetii RSA 493
uuauuaauacaggaaaaagau

SEQ ID NO: 2587671 - RNA, 20 nt, Coxiella burnetii RSA 493
uucccaggaaagaaaaugag

SEQ ID NO: 2587672 - RNA, 24 nt, Coxiella burnetii RSA 493
uucccaugucguuauugcucaucu

SEQ ID NO: 2587673 - RNA, 11 nt, Coxiella burnetii RSA 493
uucccauucag

SEQ ID NO: 2587674 - RNA, 17 nt, Coxiella burnetii RSA 493
uucccccacuucauacg

SEQ ID NO: 2587675 - RNA, 20 nt, Coxiella burnetii RSA 493
uucccguauuucgcuucgcu

SEQ ID NO: 2587676 - RNA, 15 nt, Coxiella burnetii RSA 493
uucccgugcaauugu

SEQ ID NO: 2587677 - RNA, 20 nt, Coxiella burnetii RSA 493
uucccuuuuggaauuuuuga

SEQ ID NO: 2587678 - RNA, 15 nt, Coxiella burnetii RSA 493
uuccgauaagcguuu

SEQ ID NO: 2587679 - RNA, 16 nt, Coxiella burnetii RSA 493
uuccgcagccuaaauc

SEQ ID NO: 2587680 - RNA, 13 nt, Coxiella burnetii RSA 493
uuccgccauuaau

SEQ ID NO: 2587681 - RNA, 15 nt, Coxiella burnetii RSA 493
uuccgcuacguuuuu

SEQ ID NO: 2587682 - RNA, 18 nt, Coxiella burnetii RSA 493
uuccggguuauauuuaau

SEQ ID NO: 2587683 - RNA, 14 nt, Coxiella burnetii RSA 493
uuccgucaauuuuu

SEQ ID NO: 2587684 - RNA, 16 nt, Coxiella burnetii RSA 493
uuccgucaauuuuucu

SEQ ID NO: 2587685 - RNA, 15 nt, Coxiella burnetii RSA 493
uuccguugucuugga

SEQ ID NO: 2587686 - RNA, 20 nt, Coxiella burnetii RSA 493
uuccucacggcaauucucau

SEQ ID NO: 2587687 - RNA, 19 nt, Coxiella burnetii RSA 493
uuccucuucuacuguaagc

SEQ ID NO: 2587688 - RNA, 24 nt, Coxiella burnetii RSA 493
uuccugaacaggauuuucauuaau

SEQ ID NO: 2587689 - RNA, 21 nt, Coxiella burnetii RSA 493
uuccugaaccuaaauuauaaa

SEQ ID NO: 2587690 - RNA, 17 nt, Coxiella burnetii RSA 493
uuccuucaaacagugcg

SEQ ID NO: 2587691 - RNA, 14 nt, Coxiella burnetii RSA 493
uuccuuucaucaaa

SEQ ID NO: 2587692 - RNA, 22 nt, Coxiella burnetii RSA 493
uuccuuuucuauuuuuuugcca

SEQ ID NO: 2587693 - RNA, 23 nt, Coxiella burnetii RSA 493
uuccuuuuuauaaaugauuucca

SEQ ID NO: 2587694 - RNA, 17 nt, Coxiella burnetii RSA 493
uucgaacauuuguuuaa

SEQ ID NO: 2587695 - RNA, 23 nt, Coxiella burnetii RSA 493
uucgaacgacuuuuuuuaccauu

SEQ ID NO: 2587696 - RNA, 23 nt, Coxiella burnetii RSA 493
uucgacguggaaccuagcaauaa

SEQ ID NO: 2587697 - RNA, 19 nt, Coxiella burnetii RSA 493
uucgagaauauauucauau

SEQ ID NO: 2587698 - RNA, 20 nt, Coxiella burnetii RSA 493
uucgagaauauauucauauc

SEQ ID NO: 2587699 - RNA, 14 nt, Coxiella burnetii RSA 493
uucgagauuauuca

SEQ ID NO: 2587700 - RNA, 16 nt, Coxiella burnetii RSA 493
uucgauuuuacaauaa

SEQ ID NO: 2587701 - RNA, 11 nt, Coxiella burnetii RSA 493
uucgcaaagcu

SEQ ID NO: 2587702 - RNA, 14 nt, Coxiella burnetii RSA 493
uucgcaacuuuuuu

SEQ ID NO: 2587703 - RNA, 18 nt, Coxiella burnetii RSA 493
uucgcaacuuuuuuccuu

SEQ ID NO: 2587704 - RNA, 15 nt, Coxiella burnetii RSA 493
uucgcaauugaaaaa

SEQ ID NO: 2587705 - RNA, 13 nt, Coxiella burnetii RSA 493
uucgcauaauaau

SEQ ID NO: 2587706 - RNA, 22 nt, Coxiella burnetii RSA 493
uucgccagaaacaacuaccuga

SEQ ID NO: 2587707 - RNA, 15 nt, Coxiella burnetii RSA 493
uucgccuggccaaga

SEQ ID NO: 2587708 - RNA, 23 nt, Coxiella burnetii RSA 493
uucgccuucccgccuacccuuuu

SEQ ID NO: 2587709 - RNA, 19 nt, Coxiella burnetii RSA 493
uucgcuggauuuuuuaauu

SEQ ID NO: 2587710 - RNA, 16 nt, Coxiella burnetii RSA 493
uucgcuuaaauuuuga

SEQ ID NO: 2587711 - RNA, 19 nt, Coxiella burnetii RSA 493
uucgcuucgcuacauacgg

SEQ ID NO: 2587712 - RNA, 19 nt, Coxiella burnetii RSA 493
uucgcuucgcucagacggg

SEQ ID NO: 2587713 - RNA, 18 nt, Coxiella burnetii RSA 493
uucgcuucgcucauacgg

SEQ ID NO: 2587714 - RNA, 19 nt, Coxiella burnetii RSA 493
uucgcuucgcucauacggg

SEQ ID NO: 2587715 - RNA, 19 nt, Coxiella burnetii RSA 493
uucgcuucgcugcauacgg

SEQ ID NO: 2587716 - RNA, 12 nt, Coxiella burnetii RSA 493
uucggaaacaaa

SEQ ID NO: 2587717 - RNA, 17 nt, Coxiella burnetii RSA 493
uucggacaacaaauaaa

SEQ ID NO: 2587718 - RNA, 18 nt, Coxiella burnetii RSA 493
uucggacaacaaauaaau

SEQ ID NO: 2587719 - RNA, 20 nt, Coxiella burnetii RSA 493
uucggacaacaaauaaaucg

SEQ ID NO: 2587720 - RNA, 16 nt, Coxiella burnetii RSA 493
uucggauucucucgcu

SEQ ID NO: 2587721 - RNA, 17 nt, Coxiella burnetii RSA 493
uucggauuuugaacagu

SEQ ID NO: 2587722 - RNA, 22 nt, Coxiella burnetii RSA 493
uucggggcggcuuuuuucgcuu

SEQ ID NO: 2587723 - RNA, 13 nt, Coxiella burnetii RSA 493
uucgguuucuauc

SEQ ID NO: 2587724 - RNA, 17 nt, Coxiella burnetii RSA 493
uucguaaaccuuuaauu

SEQ ID NO: 2587725 - RNA, 23 nt, Coxiella burnetii RSA 493
uucguaauauuauugagaaucuc

SEQ ID NO: 2587726 - RNA, 17 nt, Coxiella burnetii RSA 493
uucgugauagugcuuuu

SEQ ID NO: 2587727 - RNA, 19 nt, Coxiella burnetii RSA 493
uucguggcuucgagaggaa

SEQ ID NO: 2587728 - RNA, 22 nt, Coxiella burnetii RSA 493
uucguuucgaaaaauuauuaau

SEQ ID NO: 2587729 - RNA, 17 nt, Coxiella burnetii RSA 493
uucuaaagaauuuuuca

SEQ ID NO: 2587730 - RNA, 20 nt, Coxiella burnetii RSA 493
uucuaaaucgguugaagaaa

SEQ ID NO: 2587731 - RNA, 14 nt, Coxiella burnetii RSA 493
uucuaauaaaauag

SEQ ID NO: 2587732 - RNA, 14 nt, Coxiella burnetii RSA 493
uucuaauuaaauua

SEQ ID NO: 2587733 - RNA, 23 nt, Coxiella burnetii RSA 493
uucuaauuaaauuacuugggggu

SEQ ID NO: 2587734 - RNA, 16 nt, Coxiella burnetii RSA 493
uucuaauuugaaaaac

SEQ ID NO: 2587735 - RNA, 22 nt, Coxiella burnetii RSA 493
uucuaauuugaaaaacccauuu

SEQ ID NO: 2587736 - RNA, 16 nt, Coxiella burnetii RSA 493
uucuacagaacuuuuu

SEQ ID NO: 2587737 - RNA, 21 nt, Coxiella burnetii RSA 493
uucuagagcaacgauuuuccc

SEQ ID NO: 2587738 - RNA, 21 nt, Coxiella burnetii RSA 493
uucuagggagaaaaauuuauu

SEQ ID NO: 2587739 - RNA, 18 nt, Coxiella burnetii RSA 493
uucuauaaguccaagacu

SEQ ID NO: 2587740 - RNA, 18 nt, Coxiella burnetii RSA 493
uucuauaaucauuuuucc

SEQ ID NO: 2587741 - RNA, 22 nt, Coxiella burnetii RSA 493
uucuauaaucauuuuuccuauu

SEQ ID NO: 2587742 - RNA, 20 nt, Coxiella burnetii RSA 493
uucuaucgccguuucugcuu

SEQ ID NO: 2587743 - RNA, 20 nt, Coxiella burnetii RSA 493
uucuaucgugccaguauuuu

SEQ ID NO: 2587744 - RNA, 23 nt, Coxiella burnetii RSA 493
uucuaucgugccaguauuuuucu

SEQ ID NO: 2587745 - RNA, 13 nt, Coxiella burnetii RSA 493
uucuauuagcugc

SEQ ID NO: 2587746 - RNA, 16 nt, Coxiella burnetii RSA 493
uucucaauagaaaaaa

SEQ ID NO: 2587747 - RNA, 17 nt, Coxiella burnetii RSA 493
uucucaguuaaaauaau

SEQ ID NO: 2587748 - RNA, 17 nt, Coxiella burnetii RSA 493
uucucauuugacuuguc

SEQ ID NO: 2587749 - RNA, 21 nt, Coxiella burnetii RSA 493
uucuccaaagggaccuuuuuu

SEQ ID NO: 2587750 - RNA, 18 nt, Coxiella burnetii RSA 493
uucuccuuaauaaaguuu

SEQ ID NO: 2587751 - RNA, 11 nt, Coxiella burnetii RSA 493
uucuccuugua

SEQ ID NO: 2587752 - RNA, 21 nt, Coxiella burnetii RSA 493
uucucgauauucuaucucaaa

SEQ ID NO: 2587753 - RNA, 20 nt, Coxiella burnetii RSA 493
uucucuauuucgagauuauu

SEQ ID NO: 2587754 - RNA, 16 nt, Coxiella burnetii RSA 493
uucucugcaaucgcau

SEQ ID NO: 2587755 - RNA, 19 nt, Coxiella burnetii RSA 493
uucucugcgaggaccucuc

SEQ ID NO: 2587756 - RNA, 20 nt, Coxiella burnetii RSA 493
uucucugcgaggaccucucc

SEQ ID NO: 2587757 - RNA, 21 nt, Coxiella burnetii RSA 493
uucucuucuuuuuuguaaaug

SEQ ID NO: 2587758 - RNA, 22 nt, Coxiella burnetii RSA 493
uucucuuucugagcuuguuuuu

SEQ ID NO: 2587759 - RNA, 14 nt, Coxiella burnetii RSA 493
uucucuuuuuucca

SEQ ID NO: 2587760 - RNA, 17 nt, Coxiella burnetii RSA 493
uucugaauuaauuccca

SEQ ID NO: 2587761 - RNA, 16 nt, Coxiella burnetii RSA 493
uucugagcuuguuuuu

SEQ ID NO: 2587762 - RNA, 21 nt, Coxiella burnetii RSA 493
uucugauuuuacgcuauuuuu

SEQ ID NO: 2587763 - RNA, 21 nt, Coxiella burnetii RSA 493
uucugcuuuuauuuaagugau

SEQ ID NO: 2587764 - RNA, 12 nt, Coxiella burnetii RSA 493
uucuggaugaaa

SEQ ID NO: 2587765 - RNA, 23 nt, Coxiella burnetii RSA 493
uucuggcaaagccgcuauuucua

SEQ ID NO: 2587766 - RNA, 12 nt, Coxiella burnetii RSA 493
uucugguugaau

SEQ ID NO: 2587767 - RNA, 14 nt, Coxiella burnetii RSA 493
uucugugaaauaaa

SEQ ID NO: 2587768 - RNA, 17 nt, Coxiella burnetii RSA 493
uucugugucauuuugga

SEQ ID NO: 2587769 - RNA, 16 nt, Coxiella burnetii RSA 493
uucuuauccuuacaaa

SEQ ID NO: 2587770 - RNA, 17 nt, Coxiella burnetii RSA 493
uucuuauccuuacaaaa

SEQ ID NO: 2587771 - RNA, 18 nt, Coxiella burnetii RSA 493
uucuuauccuuacaaaaa

SEQ ID NO: 2587772 - RNA, 16 nt, Coxiella burnetii RSA 493
uucuuauuuuuaacuc

SEQ ID NO: 2587773 - RNA, 15 nt, Coxiella burnetii RSA 493
uucuucaauacugug

SEQ ID NO: 2587774 - RNA, 20 nt, Coxiella burnetii RSA 493
uucuucacggauaauaucua

SEQ ID NO: 2587775 - RNA, 11 nt, Coxiella burnetii RSA 493
uucuucauauu

SEQ ID NO: 2587776 - RNA, 14 nt, Coxiella burnetii RSA 493
uugcugucaaaaaa

SEQ ID NO: 2587777 - RNA, 22 nt, Coxiella burnetii RSA 493
uugcuuaccgaggucuuuuauu

SEQ ID NO: 2587778 - RNA, 21 nt, Coxiella burnetii RSA 493
uugcuuccccaauuuauucaa

SEQ ID NO: 2587779 - RNA, 16 nt, Coxiella burnetii RSA 493
uugcuugguugauuca

SEQ ID NO: 2587780 - RNA, 23 nt, Coxiella burnetii RSA 493
uugcuuuaaaucccguuucgguu

SEQ ID NO: 2587781 - RNA, 12 nt, Coxiella burnetii RSA 493
uugcuuuaacuc

SEQ ID NO: 2587782 - RNA, 21 nt, Coxiella burnetii RSA 493
uuggaaaaaaaccuaaagaaa

SEQ ID NO: 2587783 - RNA, 21 nt, Coxiella burnetii RSA 493
uuggaaggcugcuugaagucg

SEQ ID NO: 2587784 - RNA, 17 nt, Coxiella burnetii RSA 493
uuggacaaaucaucaaa

SEQ ID NO: 2587785 - RNA, 18 nt, Coxiella burnetii RSA 493
uuggauaagauucguaau

SEQ ID NO: 2587786 - RNA, 13 nt, Coxiella burnetii RSA 493
uuggcauccucau

SEQ ID NO: 2587787 - RNA, 22 nt, Coxiella burnetii RSA 493
uuggccgcggugguaaacaacg

SEQ ID NO: 2587788 - RNA, 16 nt, Coxiella burnetii RSA 493
uuggcucauuguuaau

SEQ ID NO: 2587789 - RNA, 14 nt, Coxiella burnetii RSA 493
uugggcaauuugug

SEQ ID NO: 2587790 - RNA, 20 nt, Coxiella burnetii RSA 493
uugggcaauuugugaaauau

SEQ ID NO: 2587791 - RNA, 20 nt, Coxiella burnetii RSA 493
uugggcuucgcaaagcucag

SEQ ID NO: 2587792 - RNA, 17 nt, Coxiella burnetii RSA 493
uuggguauaaauaacuu

SEQ ID NO: 2587793 - RNA, 19 nt, Coxiella burnetii RSA 493
uugggucuccguaauaagg

SEQ ID NO: 2587794 - RNA, 19 nt, Coxiella burnetii RSA 493
uugggugggugagaagaau

SEQ ID NO: 2587795 - RNA, 20 nt, Coxiella burnetii RSA 493
uugguagcccgaaaaaguag

SEQ ID NO: 2587796 - RNA, 19 nt, Coxiella burnetii RSA 493
uugguaguccugagucgga

SEQ ID NO: 2587797 - RNA, 13 nt, Coxiella burnetii RSA 493
uuggucaaagaga

SEQ ID NO: 2587798 - RNA, 22 nt, Coxiella burnetii RSA 493
uuggucggaauugcuaaauguu

SEQ ID NO: 2587799 - RNA, 21 nt, Coxiella burnetii RSA 493
uugguuugcaaaacuaaauca

SEQ ID NO: 2587800 - RNA, 18 nt, Coxiella burnetii RSA 493
uugguuuuugauugccaa

SEQ ID NO: 2587801 - RNA, 20 nt, Coxiella burnetii RSA 493
uuguaauaaugucugcauuu

SEQ ID NO: 2587802 - RNA, 22 nt, Coxiella burnetii RSA 493
uuguaauucacgauuuucguug

SEQ ID NO: 2587803 - RNA, 17 nt, Coxiella burnetii RSA 493
uuguacaaaagcgccga

SEQ ID NO: 2587804 - RNA, 23 nt, Coxiella burnetii RSA 493
uuguagauuagaaaaagcgauuc

SEQ ID NO: 2587805 - RNA, 13 nt, Coxiella burnetii RSA 493
uuguauaaagguu

SEQ ID NO: 2587806 - RNA, 14 nt, Coxiella burnetii RSA 493
uuguauaaagguuu

SEQ ID NO: 2587807 - RNA, 19 nt, Coxiella burnetii RSA 493
uuguauaaagguuuuuccu

SEQ ID NO: 2587808 - RNA, 17 nt, Coxiella burnetii RSA 493
uuguauucuucaauacu

SEQ ID NO: 2587809 - RNA, 15 nt, Coxiella burnetii RSA 493
uugucaacaaucagu

SEQ ID NO: 2587810 - RNA, 19 nt, Coxiella burnetii RSA 493
uugucaaugggcaguuuuc

SEQ ID NO: 2587811 - RNA, 15 nt, Coxiella burnetii RSA 493
uugucacaagugugg

SEQ ID NO: 2587812 - RNA, 21 nt, Coxiella burnetii RSA 493
uuguccuguucuuuuuccaug

SEQ ID NO: 2587813 - RNA, 15 nt, Coxiella burnetii RSA 493
uuguccuuuucuauu

SEQ ID NO: 2587814 - RNA, 20 nt, Coxiella burnetii RSA 493
uugucgcguagcgacacaac

SEQ ID NO: 2587815 - RNA, 17 nt, Coxiella burnetii RSA 493
uugucucguuagaaaag

SEQ ID NO: 2587816 - RNA, 14 nt, Coxiella burnetii RSA 493
uugucuuuucgcau

SEQ ID NO: 2587817 - RNA, 16 nt, Coxiella burnetii RSA 493
uugugaaauaugcacu

SEQ ID NO: 2587818 - RNA, 19 nt, Coxiella burnetii RSA 493
uugugagucgccaauaaua

SEQ ID NO: 2587819 - RNA, 12 nt, Coxiella burnetii RSA 493
uuguggagaggu

SEQ ID NO: 2587820 - RNA, 18 nt, Coxiella burnetii RSA 493
uuguguggcuucgccaca

SEQ ID NO: 2587821 - RNA, 12 nt, Coxiella burnetii RSA 493
uuguguuuuaau

SEQ ID NO: 2587822 - RNA, 22 nt, Coxiella burnetii RSA 493
uuguuaaucgucauucccgccu

SEQ ID NO: 2587823 - RNA, 17 nt, Coxiella burnetii RSA 493
uuguuauaaaacuuccc

SEQ ID NO: 2587824 - RNA, 14 nt, Coxiella burnetii RSA 493
uuguucauaaaaua

SEQ ID NO: 2587825 - RNA, 24 nt, Coxiella burnetii RSA 493
uuguucauccagccaaaucgcagu

SEQ ID NO: 2587826 - RNA, 18 nt, Coxiella burnetii RSA 493
uuguuccgccauuuccca

SEQ ID NO: 2587827 - RNA, 19 nt, Coxiella burnetii RSA 493
uuguuccgccauuucccag

SEQ ID NO: 2587828 - RNA, 21 nt, Coxiella burnetii RSA 493
uuguuccuugagaguaaaugu

SEQ ID NO: 2587829 - RNA, 16 nt, Coxiella burnetii RSA 493
uuguucguaauaauaa

SEQ ID NO: 2587830 - RNA, 14 nt, Coxiella burnetii RSA 493
uuguuggaaauaau

SEQ ID NO: 2587831 - RNA, 22 nt, Coxiella burnetii RSA 493
uuguuuaagugacagcucugaa

SEQ ID NO: 2587832 - RNA, 16 nt, Coxiella burnetii RSA 493
uuguuugaaaaaauac

SEQ ID NO: 2587833 - RNA, 15 nt, Coxiella burnetii RSA 493
uuguuugcuugagua

SEQ ID NO: 2587834 - RNA, 20 nt, Coxiella burnetii RSA 493
uuguuuucccguauuucgcu

SEQ ID NO: 2587835 - RNA, 21 nt, Coxiella burnetii RSA 493
uuguuuucccguauuucgcuu

SEQ ID NO: 2587836 - RNA, 14 nt, Coxiella burnetii RSA 493
uuuaaaaaacuaga

SEQ ID NO: 2587837 - RNA, 22 nt, Coxiella burnetii RSA 493
uuuaaaaaacuagaaauauuag

SEQ ID NO: 2587838 - RNA, 13 nt, Coxiella burnetii RSA 493
uuuaaaaaagaaa

SEQ ID NO: 2587839 - RNA, 13 nt, Coxiella burnetii RSA 493
uuuaaaccacuau

SEQ ID NO: 2587840 - RNA, 17 nt, Coxiella burnetii RSA 493
uuuaaaguuauuucuuu

SEQ ID NO: 2587841 - RNA, 19 nt, Coxiella burnetii RSA 493
uuuaaauuggccaccauug

SEQ ID NO: 2587842 - RNA, 15 nt, Coxiella burnetii RSA 493
uuuaaauuucucauc

SEQ ID NO: 2587843 - RNA, 11 nt, Coxiella burnetii RSA 493
uuuaacaaaaa

SEQ ID NO: 2587844 - RNA, 17 nt, Coxiella burnetii RSA 493
uuuaacaagaucaauac

SEQ ID NO: 2587845 - RNA, 20 nt, Coxiella burnetii RSA 493
uuuaaccgcgaaugguugaa

SEQ ID NO: 2587846 - RNA, 17 nt, Coxiella burnetii RSA 493
uuuaacuucucuugaau

SEQ ID NO: 2587847 - RNA, 12 nt, Coxiella burnetii RSA 493
uuuaagaaaaac

SEQ ID NO: 2587848 - RNA, 18 nt, Coxiella burnetii RSA 493
uuuaagagagucucagca

SEQ ID NO: 2587849 - RNA, 20 nt, Coxiella burnetii RSA 493
uuuaagaugccagugcucgc

SEQ ID NO: 2587850 - RNA, 22 nt, Coxiella burnetii RSA 493
uuuaagaugccagugcucgcca

SEQ ID NO: 2587851 - RNA, 16 nt, Coxiella burnetii RSA 493
uuuaagucccaauuuc

SEQ ID NO: 2587852 - RNA, 17 nt, Coxiella burnetii RSA 493
uuuaagucccaauuucu

SEQ ID NO: 2587853 - RNA, 15 nt, Coxiella burnetii RSA 493
uuuaauacauaaaau

SEQ ID NO: 2587854 - RNA, 15 nt, Coxiella burnetii RSA 493
uuuaauaucaaaaaa

SEQ ID NO: 2587855 - RNA, 16 nt, Coxiella burnetii RSA 493
uuuaauaucaaaaaac

SEQ ID NO: 2587856 - RNA, 14 nt, Coxiella burnetii RSA 493
uuuaaugaaaaaua

SEQ ID NO: 2587857 - RNA, 19 nt, Coxiella burnetii RSA 493
uuuaauuaagcuugaaaaa

SEQ ID NO: 2587858 - RNA, 20 nt, Coxiella burnetii RSA 493
uuuaauugacuuauuuuuau

SEQ ID NO: 2587859 - RNA, 22 nt, Coxiella burnetii RSA 493
uuuaauuucggauguuuuuuca

SEQ ID NO: 2587860 - RNA, 13 nt, Coxiella burnetii RSA 493
uuuaauuuuaaau

SEQ ID NO: 2587861 - RNA, 17 nt, Coxiella burnetii RSA 493
uuuaauuuuuucauaac

SEQ ID NO: 2587862 - RNA, 15 nt, Coxiella burnetii RSA 493
uuuaauuuuuucucu

SEQ ID NO: 2587863 - RNA, 15 nt, Coxiella burnetii RSA 493
uuuacaguaauuacc

SEQ ID NO: 2587864 - RNA, 15 nt, Coxiella burnetii RSA 493
uuuacauuaaggcca

SEQ ID NO: 2587865 - RNA, 17 nt, Coxiella burnetii RSA 493
uuuaccaauuaaagaau

SEQ ID NO: 2587866 - RNA, 19 nt, Coxiella burnetii RSA 493
uuuaccgaaagcgcgggca

SEQ ID NO: 2587867 - RNA, 17 nt, Coxiella burnetii RSA 493
uuuaccuaacucaaccu

SEQ ID NO: 2587868 - RNA, 21 nt, Coxiella burnetii RSA 493
uuuacgacccccaauuuaauu

SEQ ID NO: 2587869 - RNA, 14 nt, Coxiella burnetii RSA 493
uuuacgucuuuucu

SEQ ID NO: 2587870 - RNA, 15 nt, Coxiella burnetii RSA 493
uuuacguuuaaauaa

SEQ ID NO: 2587871 - RNA, 17 nt, Coxiella burnetii RSA 493
uuuacguuuaaauaaca

SEQ ID NO: 2587872 - RNA, 21 nt, Coxiella burnetii RSA 493
uuuacuaggucugauaggaau

SEQ ID NO: 2587873 - RNA, 16 nt, Coxiella burnetii RSA 493
uuuacuugcuucaucg

SEQ ID NO: 2587874 - RNA, 21 nt, Coxiella burnetii RSA 493
uuuagaaagcggaauaagaaa

SEQ ID NO: 2587875 - RNA, 12 nt, Coxiella burnetii RSA 493
uuuagaaucuca

SEQ ID NO: 2587876 - RNA, 23 nt, Coxiella burnetii RSA 493
uuuagcgauuuugacgucuuggu

SEQ ID NO: 2587877 - RNA, 21 nt, Coxiella burnetii RSA 493
uuuaggcgaagcgacuaaauu

SEQ ID NO: 2587878 - RNA, 13 nt, Coxiella burnetii RSA 493
uuuauaaaauuua

SEQ ID NO: 2587879 - RNA, 17 nt, Coxiella burnetii RSA 493
uuuauaacaaaccaucg

SEQ ID NO: 2587880 - RNA, 17 nt, Coxiella burnetii RSA 493
uuuauaccuuuuuccca

SEQ ID NO: 2587881 - RNA, 10 nt, Coxiella burnetii RSA 493
uuucuucaua

SEQ ID NO: 2587882 - RNA, 20 nt, Coxiella burnetii RSA 493
uuucuuccaacacguauuuu

SEQ ID NO: 2587883 - RNA, 22 nt, Coxiella burnetii RSA 493
uuucuuccaacacguauuuuca

SEQ ID NO: 2587884 - RNA, 17 nt, Coxiella burnetii RSA 493
uuucuuggcguguuaaa

SEQ ID NO: 2587885 - RNA, 14 nt, Coxiella burnetii RSA 493
uuucuuucaauaaa

SEQ ID NO: 2587886 - RNA, 13 nt, Coxiella burnetii RSA 493
uuucuuuucuaaa

SEQ ID NO: 2587887 - RNA, 14 nt, Coxiella burnetii RSA 493
uuucuuuugccucu

SEQ ID NO: 2587888 - RNA, 23 nt, Coxiella burnetii RSA 493
uuucuuuuuguguugauccuuga

SEQ ID NO: 2587889 - RNA, 15 nt, Coxiella burnetii RSA 493
uuugaaaguagaaaa

SEQ ID NO: 2587890 - RNA, 13 nt, Coxiella burnetii RSA 493
uuugaaauaaacu

SEQ ID NO: 2587891 - RNA, 18 nt, Coxiella burnetii RSA 493
uuugaaauaaacuggaaa

SEQ ID NO: 2587892 - RNA, 19 nt, Coxiella burnetii RSA 493
uuugaaauaaacuggaaaa

SEQ ID NO: 2587893 - RNA, 22 nt, Coxiella burnetii RSA 493
uuugaaauaaacuggaaaaagg

SEQ ID NO: 2587894 - RNA, 15 nt, Coxiella burnetii RSA 493
uuugaaauagccauu

SEQ ID NO: 2587895 - RNA, 23 nt, Coxiella burnetii RSA 493
uuugaaccaugagugccacaaag

SEQ ID NO: 2587896 - RNA, 16 nt, Coxiella burnetii RSA 493
uuugaauaauucguuu

SEQ ID NO: 2587897 - RNA, 23 nt, Coxiella burnetii RSA 493
uuugacaacugccugcuaggauu

SEQ ID NO: 2587898 - RNA, 14 nt, Coxiella burnetii RSA 493
uuugacaagcuucu

SEQ ID NO: 2587899 - RNA, 16 nt, Coxiella burnetii RSA 493
uuugaguaagaaaugc

SEQ ID NO: 2587900 - RNA, 16 nt, Coxiella burnetii RSA 493
uuugaguaaucagcau

SEQ ID NO: 2587901 - RNA, 16 nt, Coxiella burnetii RSA 493
uuugagugguugaaaa

SEQ ID NO: 2587902 - RNA, 15 nt, Coxiella burnetii RSA 493
uuugauaaaacuuga

SEQ ID NO: 2587903 - RNA, 18 nt, Coxiella burnetii RSA 493
uuugauaagguaucccuu

SEQ ID NO: 2587904 - RNA, 21 nt, Coxiella burnetii RSA 493
uuugauaggauuauuaucaaa

SEQ ID NO: 2587905 - RNA, 19 nt, Coxiella burnetii RSA 493
uuugauaggguucgcaccu

SEQ ID NO: 2587906 - RNA, 14 nt, Coxiella burnetii RSA 493
uuugaucauuuccu

SEQ ID NO: 2587907 - RNA, 20 nt, Coxiella burnetii RSA 493
uuugaucgucccaucaucug

SEQ ID NO: 2587908 - RNA, 19 nt, Coxiella burnetii RSA 493
uuugaucucuugcccccau

SEQ ID NO: 2587909 - RNA, 19 nt, Coxiella burnetii RSA 493
uuugaugugaaaaauucua

SEQ ID NO: 2587910 - RNA, 13 nt, Coxiella burnetii RSA 493
uuugauucuauac

SEQ ID NO: 2587911 - RNA, 19 nt, Coxiella burnetii RSA 493
uuugauuuacaauauccca

SEQ ID NO: 2587912 - RNA, 17 nt, Coxiella burnetii RSA 493
uuugauuuguucuaaau

SEQ ID NO: 2587913 - RNA, 16 nt, Coxiella burnetii RSA 493
uuugcaaaugaauaac

SEQ ID NO: 2587914 - RNA, 18 nt, Coxiella burnetii RSA 493
uuugcaaaugaauaacau

SEQ ID NO: 2587915 - RNA, 15 nt, Coxiella burnetii RSA 493
uuugcaacuuccgcu

SEQ ID NO: 2587916 - RNA, 21 nt, Coxiella burnetii RSA 493
uuugcagcaucccccaagaga

SEQ ID NO: 2587917 - RNA, 22 nt, Coxiella burnetii RSA 493
uuugcagccgccaauuuuguuu

SEQ ID NO: 2587918 - RNA, 17 nt, Coxiella burnetii RSA 493
uuugcaucggucgaaau

SEQ ID NO: 2587919 - RNA, 16 nt, Coxiella burnetii RSA 493
uuugcauuaaucuucc

SEQ ID NO: 2587920 - RNA, 14 nt, Coxiella burnetii RSA 493
uuugccaggacuuu

SEQ ID NO: 2587921 - RNA, 19 nt, Coxiella burnetii RSA 493
uuugccauauaauuuaaug

SEQ ID NO: 2587922 - RNA, 18 nt, Coxiella burnetii RSA 493
uuugccggaguuaacagc

SEQ ID NO: 2587923 - RNA, 23 nt, Coxiella burnetii RSA 493
uuugcgcccgccaggcuaugauu

SEQ ID NO: 2587924 - RNA, 20 nt, Coxiella burnetii RSA 493
uuugcgcuuauagcuuguuc

SEQ ID NO: 2587925 - RNA, 14 nt, Coxiella burnetii RSA 493
uuugcggaauuuga

SEQ ID NO: 2587926 - RNA, 21 nt, Coxiella burnetii RSA 493
uuugcggccucgccuucuucg

SEQ ID NO: 2587927 - RNA, 15 nt, Coxiella burnetii RSA 493
uuugcgguuaaaaaa

SEQ ID NO: 2587928 - RNA, 21 nt, Coxiella burnetii RSA 493
uuugcuagaucguuuuuugau

SEQ ID NO: 2587929 - RNA, 18 nt, Coxiella burnetii RSA 493
uuugcucuaauucugauu

SEQ ID NO: 2587930 - RNA, 17 nt, Coxiella burnetii RSA 493
uuugcugaccuuuuccu

SEQ ID NO: 2587931 - RNA, 16 nt, Coxiella burnetii RSA 493
uuugcuuuguucaucc

SEQ ID NO: 2587932 - RNA, 14 nt, Coxiella burnetii RSA 493
uuuggauaauuuuu

SEQ ID NO: 2587933 - RNA, 16 nt, Coxiella burnetii RSA 493
uuuggcagaauuugua

SEQ ID NO: 2587934 - RNA, 19 nt, Coxiella burnetii RSA 493
uuugguaaugcuucuaauu

SEQ ID NO: 2587935 - RNA, 22 nt, Coxiella burnetii RSA 493
uuugguaaugcuucuaauuuga

SEQ ID NO: 2587936 - RNA, 17 nt, Coxiella burnetii RSA 493
uuugguucguguuuauu

SEQ ID NO: 2587937 - RNA, 15 nt, Coxiella burnetii RSA 493
uuuguauaguucuaa

SEQ ID NO: 2587938 - RNA, 16 nt, Coxiella burnetii RSA 493
uuuguauucauuacga

SEQ ID NO: 2587939 - RNA, 21 nt, Coxiella burnetii RSA 493
uuuguauucauuacgauuaau

SEQ ID NO: 2587940 - RNA, 23 nt, Coxiella burnetii RSA 493
uuuguauugaggucguuaaaaaa

SEQ ID NO: 2587941 - RNA, 15 nt, Coxiella burnetii RSA 493
uuugucuuuucgcau

SEQ ID NO: 2587942 - RNA, 17 nt, Coxiella burnetii RSA 493
uuugugauuuuaaaaau

SEQ ID NO: 2587943 - RNA, 15 nt, Coxiella burnetii RSA 493
uuuguuauugcuaaa

SEQ ID NO: 2587944 - RNA, 17 nt, Coxiella burnetii RSA 493
uuuguucgguuaaagca

SEQ ID NO: 2587945 - RNA, 13 nt, Coxiella burnetii RSA 493
uuuguugaacaga

SEQ ID NO: 2587946 - RNA, 22 nt, Coxiella burnetii RSA 493
uuuguuugaacaugucuuugag

SEQ ID NO: 2587947 - RNA, 12 nt, Coxiella burnetii RSA 493
uuuuaaaaauaa

SEQ ID NO: 2587948 - RNA, 13 nt, Coxiella burnetii RSA 493
uuuuaaaagauuu

SEQ ID NO: 2587949 - RNA, 17 nt, Coxiella burnetii RSA 493
uuuuaaauaacuuuacu

SEQ ID NO: 2587950 - RNA, 12 nt, Coxiella burnetii RSA 493
uuuuaaauuucu

SEQ ID NO: 2587951 - RNA, 14 nt, Coxiella burnetii RSA 493
uuuuaaauuucuca

SEQ ID NO: 2587952 - RNA, 13 nt, Coxiella burnetii RSA 493
uuuuaacuucucu

SEQ ID NO: 2587953 - RNA, 14 nt, Coxiella burnetii RSA 493
uuuuaagauuuuua

SEQ ID NO: 2587954 - RNA, 21 nt, Coxiella burnetii RSA 493
uuuuaagcucgauaucuguuu

SEQ ID NO: 2587955 - RNA, 11 nt, Coxiella burnetii RSA 493
uuuuaaguaac

SEQ ID NO: 2587956 - RNA, 13 nt, Coxiella burnetii RSA 493
uuuuaaguuuuca

SEQ ID NO: 2587957 - RNA, 20 nt, Coxiella burnetii RSA 493
uuuuaauaugauaaaaggca

SEQ ID NO: 2587958 - RNA, 23 nt, Coxiella burnetii RSA 493
uuuuaaucacaucccuuuucauu

SEQ ID NO: 2587959 - RNA, 15 nt, Coxiella burnetii RSA 493
uuuuaaugcgauucu

SEQ ID NO: 2587960 - RNA, 14 nt, Coxiella burnetii RSA 493
uuuuaauuuuugca

SEQ ID NO: 2587961 - RNA, 12 nt, Coxiella burnetii RSA 493
uuuuaauuuuuu

SEQ ID NO: 2587962 - RNA, 14 nt, Coxiella burnetii RSA 493
uuuuaauuuuuuca

SEQ ID NO: 2587963 - RNA, 14 nt, Coxiella burnetii RSA 493
uuuuacaauaaucc

SEQ ID NO: 2587964 - RNA, 22 nt, Coxiella burnetii RSA 493
uuuuacagugugcacgauuuua

SEQ ID NO: 2587965 - RNA, 13 nt, Coxiella burnetii RSA 493
uuuuaccauuuca

SEQ ID NO: 2587966 - RNA, 15 nt, Coxiella burnetii RSA 493
uuuuacccguuuaaa

SEQ ID NO: 2587967 - RNA, 16 nt, Coxiella burnetii RSA 493
uuuuacccguuuaaau

SEQ ID NO: 2587968 - RNA, 22 nt, Coxiella burnetii RSA 493
uuuuacgacccccaauuuaauu

SEQ ID NO: 2587969 - RNA, 13 nt, Coxiella burnetii RSA 493
uuuuacguuuaaa

SEQ ID NO: 2587970 - RNA, 16 nt, Coxiella burnetii RSA 493
uuuuacguuuaaauaa

SEQ ID NO: 2587971 - RNA, 21 nt, Coxiella burnetii RSA 493
uuuuacugccuacaaauagag

SEQ ID NO: 2587972 - RNA, 19 nt, Coxiella burnetii RSA 493
uuuuagaaaaucaaaugcu

SEQ ID NO: 2587973 - RNA, 18 nt, Coxiella burnetii RSA 493
uuuuagcucauugaaauc

SEQ ID NO: 2587974 - RNA, 23 nt, Coxiella burnetii RSA 493
uuuuagggcugaaaaaauuaaau

SEQ ID NO: 2587975 - RNA, 13 nt, Coxiella burnetii RSA 493
uuuuauaaacgcc

SEQ ID NO: 2587976 - RNA, 16 nt, Coxiella burnetii RSA 493
uuuuauaaacuuguuu

SEQ ID NO: 2587977 - RNA, 13 nt, Coxiella burnetii RSA 493
uuuuaucaggcag

SEQ ID NO: 2587978 - RNA, 21 nt, Coxiella burnetii RSA 493
uuuuaucauacuuaauuucgc

SEQ ID NO: 2587979 - RNA, 15 nt, Coxiella burnetii RSA 493
uuuuaucuuauuauu

SEQ ID NO: 2587980 - RNA, 17 nt, Coxiella burnetii RSA 493
uuuuaugaaaaaaauca

SEQ ID NO: 2587981 - RNA, 21 nt, Coxiella burnetii RSA 493
uuuuaugaaagaguauuuuuu

SEQ ID NO: 2587982 - RNA, 22 nt, Coxiella burnetii RSA 493
uuuuaugcgcuuuccauuuuuu

SEQ ID NO: 2587983 - RNA, 20 nt, Coxiella burnetii RSA 493
uuuuaugcuucaauaaaaaa

SEQ ID NO: 2587984 - RNA, 19 nt, Coxiella burnetii RSA 493
uuuuauuccuuuuuuuaau

SEQ ID NO: 2587985 - RNA, 13 nt, Coxiella burnetii RSA 493
uuuuauucuucug

SEQ ID NO: 2587986 - RNA, 11 nt, Coxiella burnetii RSA 493
uuuuauuguua

SEQ ID NO: 2587987 - RNA, 16 nt, Coxiella burnetii RSA 493
aaaaaaaccuuuuaaa

SEQ ID NO: 2587988 - RNA, 12 nt, Coxiella burnetii RSA 493
aaaaaaagaaaa

SEQ ID NO: 2587989 - RNA, 13 nt, Coxiella burnetii RSA 493
aaaaaaagaaaau

SEQ ID NO: 2587990 - RNA, 19 nt, Coxiella burnetii RSA 493
aaaaaaaguuuagaaaaau

SEQ ID NO: 2587991 - RNA, 14 nt, Coxiella burnetii RSA 493
aaaaaaaucguuuu

SEQ ID NO: 2587992 - RNA, 12 nt, Coxiella burnetii RSA 493
aaaaaaauuauu

SEQ ID NO: 2587993 - RNA, 19 nt, Coxiella burnetii RSA 493
aaaaaaccuaaagaaagaa

SEQ ID NO: 2587994 - RNA, 17 nt, Coxiella burnetii RSA 493
aaaaaacuagaaauauu

SEQ ID NO: 2587995 - RNA, 9 nt, Coxiella burnetii RSA 493
aaaaaacug

SEQ ID NO: 2587996 - RNA, 12 nt, Coxiella burnetii RSA 493
aaaaaagaaaau

SEQ ID NO: 2587997 - RNA, 13 nt, Coxiella burnetii RSA 493
aaaaaaucaaaua

SEQ ID NO: 2587998 - RNA, 12 nt, Coxiella burnetii RSA 493
aaaaaauuaaau

SEQ ID NO: 2587999 - RNA, 15 nt, Coxiella burnetii RSA 493
aaaaacaaaacaaac

SEQ ID NO: 2588000 - RNA, 22 nt, Coxiella burnetii RSA 493
aaaaacauuauugaugucacaa

SEQ ID NO: 2588001 - RNA, 17 nt, Coxiella burnetii RSA 493
aaaaacauugguauggu

SEQ ID NO: 2588002 - RNA, 16 nt, Coxiella burnetii RSA 493
aaaaacccauuaagua

SEQ ID NO: 2588003 - RNA, 18 nt, Coxiella burnetii RSA 493
aaaaaccccaacucuuca

SEQ ID NO: 2588004 - RNA, 19 nt, Coxiella burnetii RSA 493
ggacucugcgauuguuuuc

SEQ ID NO: 2588005 - RNA, 21 nt, Coxiella burnetii RSA 493
ggagaaaucuuuuuuuugaaa

SEQ ID NO: 2588006 - RNA, 20 nt, Coxiella burnetii RSA 493
ggagaaauugacaaauaaag

SEQ ID NO: 2588007 - RNA, 22 nt, Coxiella burnetii RSA 493
ggagaaauugacaaauaaagaa

SEQ ID NO: 2588008 - RNA, 16 nt, Coxiella burnetii RSA 493
ggagacaccaauaauu

SEQ ID NO: 2588009 - RNA, 12 nt, Coxiella burnetii RSA 493
ggagacugcuuu

SEQ ID NO: 2588010 - RNA, 15 nt, Coxiella burnetii RSA 493
ggagcaaguuuucua

SEQ ID NO: 2588011 - RNA, 16 nt, Coxiella burnetii RSA 493
ggagcgauaaaauaac

SEQ ID NO: 2588012 - RNA, 14 nt, Coxiella burnetii RSA 493
ggaguaaugacaga

SEQ ID NO: 2588013 - RNA, 15 nt, Coxiella burnetii RSA 493
ggaguaaugacagaa

SEQ ID NO: 2588014 - RNA, 19 nt, Coxiella burnetii RSA 493
ggaguaaugacagaaaaag

SEQ ID NO: 2588015 - RNA, 15 nt, Coxiella burnetii RSA 493
ggagugguuauaauu

SEQ ID NO: 2588016 - RNA, 19 nt, Coxiella burnetii RSA 493
ggaguucuugcucccaagc

SEQ ID NO: 2588017 - RNA, 21 nt, Coxiella burnetii RSA 493
ggauacgcuucucguaacaaa

SEQ ID NO: 2588018 - RNA, 21 nt, Coxiella burnetii RSA 493
ggaucauuaucucuuaaaauu

SEQ ID NO: 2588019 - RNA, 22 nt, Coxiella burnetii RSA 493
ggaucauuaucucuuaaaauuc

SEQ ID NO: 2588020 - RNA, 20 nt, Coxiella burnetii RSA 493
ggaugaguauucaucaauau

SEQ ID NO: 2588021 - RNA, 16 nt, Coxiella burnetii RSA 493
ggaugaucgagaggag

SEQ ID NO: 2588022 - RNA, 20 nt, Coxiella burnetii RSA 493
ggaugcgaagcaugcugauu

SEQ ID NO: 2588023 - RNA, 17 nt, Coxiella burnetii RSA 493
ggauuuccuuuucauuu

SEQ ID NO: 2588024 - RNA, 16 nt, Coxiella burnetii RSA 493
ggauuuucaaaagagg

SEQ ID NO: 2588025 - RNA, 15 nt, Coxiella burnetii RSA 493
ggauuuugaacaguu

SEQ ID NO: 2588026 - RNA, 11 nt, Coxiella burnetii RSA 493
ggcaaaaaaag

SEQ ID NO: 2588027 - RNA, 14 nt, Coxiella burnetii RSA 493
ggcaauuaugaaaa

SEQ ID NO: 2588028 - RNA, 13 nt, Coxiella burnetii RSA 493
ggcagaggacaga

SEQ ID NO: 2588029 - RNA, 14 nt, Coxiella burnetii RSA 493
ggcaguggggucuu

SEQ ID NO: 2588030 - RNA, 11 nt, Coxiella burnetii RSA 493
ggcaguuaaau

SEQ ID NO: 2588031 - RNA, 16 nt, Coxiella burnetii RSA 493
ggcaucuuuuucuccu

SEQ ID NO: 2588032 - RNA, 17 nt, Coxiella burnetii RSA 493
ggcauggccaguacagc

SEQ ID NO: 2588033 - RNA, 20 nt, Coxiella burnetii RSA 493
ggcccaguaacuaaguagcc

SEQ ID NO: 2588034 - RNA, 22 nt, Coxiella burnetii RSA 493
ggccucuuuagaaaauugauua

SEQ ID NO: 2588035 - RNA, 14 nt, Coxiella burnetii RSA 493
ggccuuuuucauuu

SEQ ID NO: 2588036 - RNA, 14 nt, Coxiella burnetii RSA 493
ggcgaaauacagga

SEQ ID NO: 2588037 - RNA, 21 nt, Coxiella burnetii RSA 493
ggcgaagucgggugauugaaa

SEQ ID NO: 2588038 - RNA, 21 nt, Coxiella burnetii RSA 493
ggcgaugugaaacaugcugcu

SEQ ID NO: 2588039 - RNA, 16 nt, Coxiella burnetii RSA 493
ggcgguaaugagaacc

SEQ ID NO: 2588040 - RNA, 16 nt, Coxiella burnetii RSA 493
ggcgguuguaauaaug

SEQ ID NO: 2588041 - RNA, 16 nt, Coxiella burnetii RSA 493
ggcuaaagguuucaaa

SEQ ID NO: 2588042 - RNA, 22 nt, Coxiella burnetii RSA 493
ggcuaaaucuugcugcaaaaac

SEQ ID NO: 2588043 - RNA, 16 nt, Coxiella burnetii RSA 493
ggcuaauaggaaaaau

SEQ ID NO: 2588044 - RNA, 13 nt, Coxiella burnetii RSA 493
ggcuaauuuuccu

SEQ ID NO: 2588045 - RNA, 14 nt, Coxiella burnetii RSA 493
ggcuacuuccuucu

SEQ ID NO: 2588046 - RNA, 14 nt, Coxiella burnetii RSA 493
ggcucagugauuaa

SEQ ID NO: 2588047 - RNA, 16 nt, Coxiella burnetii RSA 493
ggcucagugauuaaau

SEQ ID NO: 2588048 - RNA, 21 nt, Coxiella burnetii RSA 493
ggcucaugaaaaugaaugagu

SEQ ID NO: 2588049 - RNA, 11 nt, Coxiella burnetii RSA 493
ggcucuucaua

SEQ ID NO: 2588050 - RNA, 15 nt, Coxiella burnetii RSA 493
ggcugaaaaaauuaa

SEQ ID NO: 2588051 - RNA, 12 nt, Coxiella burnetii RSA 493
ggcugaauaagc

SEQ ID NO: 2588052 - RNA, 14 nt, Coxiella burnetii RSA 493
ggcugaauagagag

SEQ ID NO: 2588053 - RNA, 21 nt, Coxiella burnetii RSA 493
ggcugagcuugcgaagcccaa

SEQ ID NO: 2588054 - RNA, 19 nt, Coxiella burnetii RSA 493
ggcugcggcgauucaugag

SEQ ID NO: 2588055 - RNA, 18 nt, Coxiella burnetii RSA 493
ggcuguacauuuuucaag

SEQ ID NO: 2588056 - RNA, 22 nt, Coxiella burnetii RSA 493
ggcuguucgccagaaacaacua

SEQ ID NO: 2588057 - RNA, 19 nt, Coxiella burnetii RSA 493
ggcuuaaugcgaaaaauga

SEQ ID NO: 2588058 - RNA, 14 nt, Coxiella burnetii RSA 493
ggcuucauauaaag

SEQ ID NO: 2588059 - RNA, 21 nt, Coxiella burnetii RSA 493
ggcuucuaaguaaacagcauu

SEQ ID NO: 2588060 - RNA, 21 nt, Coxiella burnetii RSA 493
ggcuugagggcuguccucugc

SEQ ID NO: 2588061 - RNA, 21 nt, Coxiella burnetii RSA 493
ggcuuguuuaagugacagcuc

SEQ ID NO: 2588062 - RNA, 18 nt, Coxiella burnetii RSA 493
ggcuuuuucaagcuuuug

SEQ ID NO: 2588063 - RNA, 12 nt, Coxiella burnetii RSA 493
ggcuuuuucaau

SEQ ID NO: 2588064 - RNA, 18 nt, Coxiella burnetii RSA 493
gggaaccgccaaaaggga

SEQ ID NO: 2588065 - RNA, 13 nt, Coxiella burnetii RSA 493
gggacgaccgcgg

SEQ ID NO: 2588066 - RNA, 23 nt, Coxiella burnetii RSA 493
gggaggcauucugggcacccagu

SEQ ID NO: 2588067 - RNA, 18 nt, Coxiella burnetii RSA 493
gggauuaauuuuccacuc

SEQ ID NO: 2588068 - RNA, 16 nt, Coxiella burnetii RSA 493
gggcaaaaaaagaaaa

SEQ ID NO: 2588069 - RNA, 13 nt, Coxiella burnetii RSA 493
gggcaacuaaagg

SEQ ID NO: 2588070 - RNA, 15 nt, Coxiella burnetii RSA 493
gggccgguucuuuuc

SEQ ID NO: 2588071 - RNA, 13 nt, Coxiella burnetii RSA 493
gggcgcacucaac

SEQ ID NO: 2588072 - RNA, 18 nt, Coxiella burnetii RSA 493
gggcggcaacucuacuuc

SEQ ID NO: 2588073 - RNA, 20 nt, Coxiella burnetii RSA 493
gggcuacucuaauuuucuuu

SEQ ID NO: 2588074 - RNA, 15 nt, Coxiella burnetii RSA 493
gggcuacuuuacuuu

SEQ ID NO: 2588075 - RNA, 21 nt, Coxiella burnetii RSA 493
ggggaucguuucugguuuccu

SEQ ID NO: 2588076 - RNA, 17 nt, Coxiella burnetii RSA 493
ggggaugaucgagagga

SEQ ID NO: 2588077 - RNA, 23 nt, Coxiella burnetii RSA 493
gggguucauuuuuuuugccgcgg

SEQ ID NO: 2588078 - RNA, 13 nt, Coxiella burnetii RSA 493
gggucuuuuuuuc

SEQ ID NO: 2588079 - RNA, 17 nt, Coxiella burnetii RSA 493
gggugauugaaaauccc

SEQ ID NO: 2588080 - RNA, 13 nt, Coxiella burnetii RSA 493
ggguuaaggaaaa

SEQ ID NO: 2588081 - RNA, 17 nt, Coxiella burnetii RSA 493
ggguuaucccgagaucc

SEQ ID NO: 2588082 - RNA, 23 nt, Coxiella burnetii RSA 493
gguaacauacgacuucauuucua

SEQ ID NO: 2588083 - RNA, 20 nt, Coxiella burnetii RSA 493
gguaauaaaguaauuuuaaa

SEQ ID NO: 2588084 - RNA, 22 nt, Coxiella burnetii RSA 493
gguaaucucacuuggauuuuau

SEQ ID NO: 2588085 - RNA, 12 nt, Coxiella burnetii RSA 493
gguaaugcuucu

SEQ ID NO: 2588086 - RNA, 16 nt, Coxiella burnetii RSA 493
gguacaagcgcuuggu

SEQ ID NO: 2588087 - RNA, 23 nt, Coxiella burnetii RSA 493
gguacgaaccacuggaaucaauc

SEQ ID NO: 2588088 - RNA, 17 nt, Coxiella burnetii RSA 493
gguauuuugcguaaaug

SEQ ID NO: 2588089 - RNA, 23 nt, Coxiella burnetii RSA 493
gguauuuuuucccgcaacauggc

SEQ ID NO: 2588090 - RNA, 21 nt, Coxiella burnetii RSA 493
ggucaauuucaaugacuuuaa

SEQ ID NO: 2588091 - RNA, 16 nt, Coxiella burnetii RSA 493
ggucggcaccaaaauc

SEQ ID NO: 2588092 - RNA, 15 nt, Coxiella burnetii RSA 493
ggucucaacagccuu

SEQ ID NO: 2588093 - RNA, 21 nt, Coxiella burnetii RSA 493
ggugacgaggaaagauaaggu

SEQ ID NO: 2588094 - RNA, 14 nt, Coxiella burnetii RSA 493
ggugagaagaauaa

SEQ ID NO: 2588095 - RNA, 20 nt, Coxiella burnetii RSA 493
ggugauucucucaaagaaac

SEQ ID NO: 2588096 - RNA, 14 nt, Coxiella burnetii RSA 493
ggugcccuagugag

SEQ ID NO: 2588097 - RNA, 21 nt, Coxiella burnetii RSA 493
gguggccauuauauuuguauc

SEQ ID NO: 2588098 - RNA, 23 nt, Coxiella burnetii RSA 493
gguggccguaucuauuugcauag

SEQ ID NO: 2588099 - RNA, 14 nt, Coxiella burnetii RSA 493
ggugucaaaauuau

SEQ ID NO: 2588100 - RNA, 12 nt, Coxiella burnetii RSA 493
ggugucauaacc

SEQ ID NO: 2588101 - RNA, 13 nt, Coxiella burnetii RSA 493
gguguuuuucaaa

SEQ ID NO: 2588102 - RNA, 23 nt, Coxiella burnetii RSA 493
gguuaacagcggcaguuucuggc

SEQ ID NO: 2588103 - RNA, 15 nt, Coxiella burnetii RSA 493
gguuaaggaaaagca

SEQ ID NO: 2588104 - RNA, 18 nt, Coxiella burnetii RSA 493
gguuaaguagcuaaaaaa

SEQ ID NO: 2588105 - RNA, 13 nt, Coxiella burnetii RSA 493
gguuagaguuaau

SEQ ID NO: 2588106 - RNA, 22 nt, Coxiella burnetii RSA 493
gguuagcaaugggaacuuuuaa

SEQ ID NO: 2588107 - RNA, 14 nt, Coxiella burnetii RSA 493
gguucaagucccuc

SEQ ID NO: 2588108 - RNA, 18 nt, Coxiella burnetii RSA 493
gguucaugaaaaagauaa

SEQ ID NO: 2588109 - RNA, 16 nt, Coxiella burnetii RSA 493
gguugaaagaaaaaaa

SEQ ID NO: 2588110 - RNA, 12 nt, Coxiella burnetii RSA 493
guauuuugcaaa

SEQ ID NO: 2588111 - RNA, 16 nt, Coxiella burnetii RSA 493
guauuuugcaaaugaa

SEQ ID NO: 2588112 - RNA, 17 nt, Coxiella burnetii RSA 493
guauuuugcaaaugaau

SEQ ID NO: 2588113 - RNA, 13 nt, Coxiella burnetii RSA 493
guauuuuguagau

SEQ ID NO: 2588114 - RNA, 17 nt, Coxiella burnetii RSA 493
guauuuuuuuuaaaauu

SEQ ID NO: 2588115 - RNA, 15 nt, Coxiella burnetii RSA 493
gucaaaaccccccgc

SEQ ID NO: 2588116 - RNA, 14 nt, Coxiella burnetii RSA 493
gucaaaccaaucac

SEQ ID NO: 2588117 - RNA, 14 nt, Coxiella burnetii RSA 493
gucaauuuaccucc

SEQ ID NO: 2588118 - RNA, 15 nt, Coxiella burnetii RSA 493
gucaauuuaccucca

SEQ ID NO: 2588119 - RNA, 19 nt, Coxiella burnetii RSA 493
gucaauuucaaugacuuua

SEQ ID NO: 2588120 - RNA, 24 nt, Coxiella burnetii RSA 493
gucaauuucaaugacuuuaacucg

SEQ ID NO: 2588121 - RNA, 23 nt, Coxiella burnetii RSA 493
gucaauuuuucagucuggccugc

SEQ ID NO: 2588122 - RNA, 21 nt, Coxiella burnetii RSA 493
gucacaauuaucuuaaugaaa

SEQ ID NO: 2588123 - RNA, 14 nt, Coxiella burnetii RSA 493
gucacaugauuuuu

SEQ ID NO: 2588124 - RNA, 22 nt, Coxiella burnetii RSA 493
gucacccaaaucauggcgguga

SEQ ID NO: 2588125 - RNA, 13 nt, Coxiella burnetii RSA 493
gucaccgguuagg

SEQ ID NO: 2588126 - RNA, 13 nt, Coxiella burnetii RSA 493
gucagcccaacua

SEQ ID NO: 2588127 - RNA, 15 nt, Coxiella burnetii RSA 493
gucagcguuucuaug

SEQ ID NO: 2588128 - RNA, 14 nt, Coxiella burnetii RSA 493
gucaggcaauuuug

SEQ ID NO: 2588129 - RNA, 15 nt, Coxiella burnetii RSA 493
gucauaaauaaaagc

SEQ ID NO: 2588130 - RNA, 23 nt, Coxiella burnetii RSA 493
gucaucgcauacagcggaacacc

SEQ ID NO: 2588131 - RNA, 19 nt, Coxiella burnetii RSA 493
gucaucgucguuaucuauu

SEQ ID NO: 2588132 - RNA, 22 nt, Coxiella burnetii RSA 493
gucaugaucgguuuuuugacug

SEQ ID NO: 2588133 - RNA, 20 nt, Coxiella burnetii RSA 493
gucauucauuucaauauuuc

SEQ ID NO: 2588134 - RNA, 19 nt, Coxiella burnetii RSA 493
gucauuuuuuauaaaauuu

SEQ ID NO: 2588135 - RNA, 21 nt, Coxiella burnetii RSA 493
gucccaaaaaacuuagccaau

SEQ ID NO: 2588136 - RNA, 19 nt, Coxiella burnetii RSA 493
gucccaggaaagauauucu

SEQ ID NO: 2588137 - RNA, 16 nt, Coxiella burnetii RSA 493
guccccaaaguuucac

SEQ ID NO: 2588138 - RNA, 21 nt, Coxiella burnetii RSA 493
guccccguauuucgcuucgcu

SEQ ID NO: 2588139 - RNA, 13 nt, Coxiella burnetii RSA 493
guccguaauaguc

SEQ ID NO: 2588140 - RNA, 22 nt, Coxiella burnetii RSA 493
guccuaaaauacuuaaaauuuc

SEQ ID NO: 2588141 - RNA, 17 nt, Coxiella burnetii RSA 493
guccuaaggauaggauc

SEQ ID NO: 2588142 - RNA, 18 nt, Coxiella burnetii RSA 493
guccucccggcuuuaaaa

SEQ ID NO: 2588143 - RNA, 14 nt, Coxiella burnetii RSA 493
guccugcuuuugca

SEQ ID NO: 2588144 - RNA, 19 nt, Coxiella burnetii RSA 493
guccuucucaguuaaaaua

SEQ ID NO: 2588145 - RNA, 20 nt, Coxiella burnetii RSA 493
gucgaucaaagucaugaucg

SEQ ID NO: 2588146 - RNA, 14 nt, Coxiella burnetii RSA 493
gucgcaauuugaug

SEQ ID NO: 2588147 - RNA, 21 nt, Coxiella burnetii RSA 493
gucgcaauuugaugccauaau

SEQ ID NO: 2588148 - RNA, 20 nt, Coxiella burnetii RSA 493
gucgccucaguaauuucucg

SEQ ID NO: 2588149 - RNA, 16 nt, Coxiella burnetii RSA 493
gucgccugcuaaaaua

SEQ ID NO: 2588150 - RNA, 20 nt, Coxiella burnetii RSA 493
gucgcguagcgacacaacca

SEQ ID NO: 2588151 - RNA, 23 nt, Coxiella burnetii RSA 493
gucgcuacgcgacaacuaaauuu

SEQ ID NO: 2588152 - RNA, 15 nt, Coxiella burnetii RSA 493
gucggcaccaaaauc

SEQ ID NO: 2588153 - RNA, 11 nt, Coxiella burnetii RSA 493
gucgguaaaac

SEQ ID NO: 2588154 - RNA, 21 nt, Coxiella burnetii RSA 493
gucggucaauuucaaugacuu

SEQ ID NO: 2588155 - RNA, 18 nt, Coxiella burnetii RSA 493
gucguauccaaauauuua

SEQ ID NO: 2588156 - RNA, 21 nt, Coxiella burnetii RSA 493
gucguauccaaauauuuaaau

SEQ ID NO: 2588157 - RNA, 22 nt, Coxiella burnetii RSA 493
gucguauuccuuuuucuuuuaa

SEQ ID NO: 2588158 - RNA, 23 nt, Coxiella burnetii RSA 493
gucguauuccuuuuucuuuuaau

SEQ ID NO: 2588159 - RNA, 14 nt, Coxiella burnetii RSA 493
gucguuaauacgau

SEQ ID NO: 2588160 - RNA, 15 nt, Coxiella burnetii RSA 493
gucucacaacauucc

SEQ ID NO: 2588161 - RNA, 16 nt, Coxiella burnetii RSA 493
gucucuauaucuuuua

SEQ ID NO: 2588162 - RNA, 22 nt, Coxiella burnetii RSA 493
gucucuauaucuuuuaaauuaa

SEQ ID NO: 2588163 - RNA, 15 nt, Coxiella burnetii RSA 493
gucucuuuuuuugcg

SEQ ID NO: 2588164 - RNA, 13 nt, Coxiella burnetii RSA 493
gucugaaaauaau

SEQ ID NO: 2588165 - RNA, 20 nt, Coxiella burnetii RSA 493
gucugucguuucugauuuuu

SEQ ID NO: 2588166 - RNA, 18 nt, Coxiella burnetii RSA 493
gucuguuuacaauucgcu

SEQ ID NO: 2588167 - RNA, 12 nt, Coxiella burnetii RSA 493
gucuguuucuuc

SEQ ID NO: 2588168 - RNA, 13 nt, Coxiella burnetii RSA 493
gucuuaauuucua

SEQ ID NO: 2588169 - RNA, 20 nt, Coxiella burnetii RSA 493
gucuuaauuucuaaaaauca

SEQ ID NO: 2588170 - RNA, 15 nt, Coxiella burnetii RSA 493
gucuuaauuuuaaaa

SEQ ID NO: 2588171 - RNA, 22 nt, Coxiella burnetii RSA 493
gucuucaaaagugauuuuucuu

SEQ ID NO: 2588172 - RNA, 21 nt, Coxiella burnetii RSA 493
gucuucucuugcgccuuaaua

SEQ ID NO: 2588173 - RNA, 14 nt, Coxiella burnetii RSA 493
gucuugcacauugc

SEQ ID NO: 2588174 - RNA, 17 nt, Coxiella burnetii RSA 493
gucuuggagauuuagcc

SEQ ID NO: 2588175 - RNA, 15 nt, Coxiella burnetii RSA 493
gucuugguuguuucu

SEQ ID NO: 2588176 - RNA, 22 nt, Coxiella burnetii RSA 493
gucuuugaugugaaaaauucua

SEQ ID NO: 2588177 - RNA, 14 nt, Coxiella burnetii RSA 493
gucuuuuauuuuca

SEQ ID NO: 2588178 - RNA, 19 nt, Coxiella burnetii RSA 493
gucuuuucugugaaauaaa

SEQ ID NO: 2588179 - RNA, 20 nt, Coxiella burnetii RSA 493
gucuuuucugugaaauaaac

SEQ ID NO: 2588180 - RNA, 17 nt, Coxiella burnetii RSA 493
gucuuuuuuucuuguug

SEQ ID NO: 2588181 - RNA, 19 nt, Coxiella burnetii RSA 493
gugaaaaauucuaaggcgu

SEQ ID NO: 2588182 - RNA, 13 nt, Coxiella burnetii RSA 493
gugaaaagccaaa

SEQ ID NO: 2588183 - RNA, 12 nt, Coxiella burnetii RSA 493
gugaaaguuuca

SEQ ID NO: 2588184 - RNA, 13 nt, Coxiella burnetii RSA 493
gugaaaguuucau

SEQ ID NO: 2588185 - RNA, 20 nt, Coxiella burnetii RSA 493
gugaaauaaccugagggaau

SEQ ID NO: 2588186 - RNA, 20 nt, Coxiella burnetii RSA 493
gugaacgucccuaaaguggg

SEQ ID NO: 2588187 - RNA, 11 nt, Coxiella burnetii RSA 493
gugaagaaccc

SEQ ID NO: 2588188 - RNA, 18 nt, Coxiella burnetii RSA 493
gugaagauugccacucuu

SEQ ID NO: 2588189 - RNA, 15 nt, Coxiella burnetii RSA 493
gugacgaggaaagau

SEQ ID NO: 2588190 - RNA, 13 nt, Coxiella burnetii RSA 493
gugacgcugcaau

SEQ ID NO: 2588191 - RNA, 22 nt, Coxiella burnetii RSA 493
gugagagagccgaucgcuguga

SEQ ID NO: 2588192 - RNA, 14 nt, Coxiella burnetii RSA 493
gugagcaauaucug

SEQ ID NO: 2588193 - RNA, 14 nt, Coxiella burnetii RSA 493
gugauaauuauaag

SEQ ID NO: 2588194 - RNA, 19 nt, Coxiella burnetii RSA 493
gugauaauugauaguucau

SEQ ID NO: 2588195 - RNA, 22 nt, Coxiella burnetii RSA 493
gugauaauugauaguucauaug

SEQ ID NO: 2588196 - RNA, 19 nt, Coxiella burnetii RSA 493
gugaugggauaaaaaaccc

SEQ ID NO: 2588197 - RNA, 23 nt, Coxiella burnetii RSA 493
gugauuaaauugcucuuuuucca

SEQ ID NO: 2588198 - RNA, 15 nt, Coxiella burnetii RSA 493
gugauucauuaucau

SEQ ID NO: 2588199 - RNA, 16 nt, Coxiella burnetii RSA 493
gugauucauuaucaug

SEQ ID NO: 2588200 - RNA, 22 nt, Coxiella burnetii RSA 493
gugcaauuguggcccgacgcuc

SEQ ID NO: 2588201 - RNA, 17 nt, Coxiella burnetii RSA 493
gugcaauuucuggcuug

SEQ ID NO: 2588202 - RNA, 15 nt, Coxiella burnetii RSA 493
gugcaugguaacgca

SEQ ID NO: 2588203 - RNA, 14 nt, Coxiella burnetii RSA 493
gugccaguauuuuu

SEQ ID NO: 2588204 - RNA, 15 nt, Coxiella burnetii RSA 493
gugccaguauuuuuc

SEQ ID NO: 2588205 - RNA, 11 nt, Coxiella burnetii RSA 493
gugcccaagaa

SEQ ID NO: 2588206 - RNA, 12 nt, Coxiella burnetii RSA 493
gugcccaagaac

SEQ ID NO: 2588207 - RNA, 16 nt, Coxiella burnetii RSA 493
gugccgguaaaaaaau

SEQ ID NO: 2588208 - RNA, 20 nt, Coxiella burnetii RSA 493
gugccuucguaaacuuuacc

SEQ ID NO: 2588209 - RNA, 15 nt, Coxiella burnetii RSA 493
gugcggauuaaauaa

SEQ ID NO: 2588210 - RNA, 16 nt, Coxiella burnetii RSA 493
gugcguaagcaaacac

SEQ ID NO: 2588211 - RNA, 23 nt, Coxiella burnetii RSA 493
gugcuauucccgccaucaccaca

SEQ ID NO: 2588212 - RNA, 15 nt, Coxiella burnetii RSA 493
gugcucuuuuucauu

SEQ ID NO: 2588213 - RNA, 16 nt, Coxiella burnetii RSA 493
gugcuggcguuuuuaa

SEQ ID NO: 2588214 - RNA, 21 nt, Coxiella burnetii RSA 493
guggaacgguuauaaacauaa

SEQ ID NO: 2588215 - RNA, 19 nt, Coxiella burnetii RSA 493
guuuaagcugauacaccau

SEQ ID NO: 2588216 - RNA, 15 nt, Coxiella burnetii RSA 493
guuuacauaagaaac

SEQ ID NO: 2588217 - RNA, 15 nt, Coxiella burnetii RSA 493
guuuacgucuuuucu

SEQ ID NO: 2588218 - RNA, 12 nt, Coxiella burnetii RSA 493
guuuagaaaaau

SEQ ID NO: 2588219 - RNA, 20 nt, Coxiella burnetii RSA 493
guuuagcuaacugauuagcu

SEQ ID NO: 2588220 - RNA, 21 nt, Coxiella burnetii RSA 493
guuuauauuuacugagaaaac

SEQ ID NO: 2588221 - RNA, 20 nt, Coxiella burnetii RSA 493
guuuaucacuccaauaauaa

SEQ ID NO: 2588222 - RNA, 19 nt, Coxiella burnetii RSA 493
guuuauuugagaauaaaac

SEQ ID NO: 2588223 - RNA, 16 nt, Coxiella burnetii RSA 493
guuuauuugaucgccc

SEQ ID NO: 2588224 - RNA, 13 nt, Coxiella burnetii RSA 493
guuucaaauuucu

SEQ ID NO: 2588225 - RNA, 16 nt, Coxiella burnetii RSA 493
guuucacgaauuaaaa

SEQ ID NO: 2588226 - RNA, 21 nt, Coxiella burnetii RSA 493
guuucauaaggccaauuucua

SEQ ID NO: 2588227 - RNA, 16 nt, Coxiella burnetii RSA 493
guuucaugcucaagcg

SEQ ID NO: 2588228 - RNA, 13 nt, Coxiella burnetii RSA 493
guuuccaaauaau

SEQ ID NO: 2588229 - RNA, 23 nt, Coxiella burnetii RSA 493
guuuccaauuguuugaaaaaaua

SEQ ID NO: 2588230 - RNA, 13 nt, Coxiella burnetii RSA 493
guuucccacaaaa

SEQ ID NO: 2588231 - RNA, 18 nt, Coxiella burnetii RSA 493
guuucccguauuucgcuu

SEQ ID NO: 2588232 - RNA, 19 nt, Coxiella burnetii RSA 493
guuucggauuuugaacagu

SEQ ID NO: 2588233 - RNA, 14 nt, Coxiella burnetii RSA 493
guuucgguuucguu

SEQ ID NO: 2588234 - RNA, 15 nt, Coxiella burnetii RSA 493
guuucgguuucguuc

SEQ ID NO: 2588235 - RNA, 17 nt, Coxiella burnetii RSA 493
guuucgguuuucgcugc

SEQ ID NO: 2588236 - RNA, 21 nt, Coxiella burnetii RSA 493
guuucuagagcaacgauuuuc

SEQ ID NO: 2588237 - RNA, 16 nt, Coxiella burnetii RSA 493
guuucugguuuccuuu

SEQ ID NO: 2588238 - RNA, 12 nt, Coxiella burnetii RSA 493
guuugaaaaaau

SEQ ID NO: 2588239 - RNA, 15 nt, Coxiella burnetii RSA 493
guuugaauauuuucg

SEQ ID NO: 2588240 - RNA, 23 nt, Coxiella burnetii RSA 493
guuugauaucaaucgaaaaaaau

SEQ ID NO: 2588241 - RNA, 20 nt, Coxiella burnetii RSA 493
guuugccauuacgcauguca

SEQ ID NO: 2588242 - RNA, 14 nt, Coxiella burnetii RSA 493
guuuuaagaaaaac

SEQ ID NO: 2588243 - RNA, 22 nt, Coxiella burnetii RSA 493
guuuuaagaaaaaccaguuuuc

SEQ ID NO: 2588244 - RNA, 17 nt, Coxiella burnetii RSA 493
guuuuaaguuuuuugcu

SEQ ID NO: 2588245 - RNA, 19 nt, Coxiella burnetii RSA 493
guuuuaccuuacuuucauc

SEQ ID NO: 2588246 - RNA, 20 nt, Coxiella burnetii RSA 493
guuuuaccuuacuuucauca

SEQ ID NO: 2588247 - RNA, 15 nt, Coxiella burnetii RSA 493
guuuuacguuuaaau

SEQ ID NO: 2588248 - RNA, 17 nt, Coxiella burnetii RSA 493
guuuuacugccuacaaa

SEQ ID NO: 2588249 - RNA, 19 nt, Coxiella burnetii RSA 493
guuuuauacacaucuuuua

SEQ ID NO: 2588250 - RNA, 21 nt, Coxiella burnetii RSA 493
guuuuaucccaauaguaaaac

SEQ ID NO: 2588251 - RNA, 16 nt, Coxiella burnetii RSA 493
guuuuauuuaaaaaac

SEQ ID NO: 2588252 - RNA, 17 nt, Coxiella burnetii RSA 493
guuuuauuuauaauuua

SEQ ID NO: 2588253 - RNA, 22 nt, Coxiella burnetii RSA 493
guuuuauuugaaaguagaaaac

SEQ ID NO: 2588254 - RNA, 14 nt, Coxiella burnetii RSA 493
guuuucagauuuuu

SEQ ID NO: 2588255 - RNA, 20 nt, Coxiella burnetii RSA 493
guuuucccguauuucgcuuc

SEQ ID NO: 2588256 - RNA, 18 nt, Coxiella burnetii RSA 493
guuuuccgcuaaauauuu

SEQ ID NO: 2588257 - RNA, 21 nt, Coxiella burnetii RSA 493
guuuugaaaaauaaaaggaga

SEQ ID NO: 2588258 - RNA, 15 nt, Coxiella burnetii RSA 493
guuuugaaauugguc

SEQ ID NO: 2588259 - RNA, 17 nt, Coxiella burnetii RSA 493
guuuugaucagagaaac

SEQ ID NO: 2588260 - RNA, 13 nt, Coxiella burnetii RSA 493
guuuugaugaaaa

SEQ ID NO: 2588261 - RNA, 11 nt, Coxiella burnetii RSA 493
guuuuggcugc

SEQ ID NO: 2588262 - RNA, 12 nt, Coxiella burnetii RSA 493
guuuuggcugca

SEQ ID NO: 2588263 - RNA, 20 nt, Coxiella burnetii RSA 493
guuuugugcauaaauuauuu

SEQ ID NO: 2588264 - RNA, 11 nt, Coxiella burnetii RSA 493
guuuuuaaaug

SEQ ID NO: 2588265 - RNA, 21 nt, Coxiella burnetii RSA 493
guuuuuaagucccaauuucuu

SEQ ID NO: 2588266 - RNA, 17 nt, Coxiella burnetii RSA 493
guuuuuccacaaaauaa

SEQ ID NO: 2588267 - RNA, 12 nt, Coxiella burnetii RSA 493
guuuuuccuuuu

SEQ ID NO: 2588268 - RNA, 16 nt, Coxiella burnetii RSA 493
guuuuugauugccaaa

SEQ ID NO: 2588269 - RNA, 23 nt, Coxiella burnetii RSA 493
guuuuuggcaugauguucucucc

SEQ ID NO: 2588270 - RNA, 13 nt, Coxiella burnetii RSA 493
guuuuuugauaaa

SEQ ID NO: 2588271 - RNA, 15 nt, Coxiella burnetii RSA 493
guuuuuugggaugcg

SEQ ID NO: 2588272 - RNA, 18 nt, Coxiella burnetii RSA 493
guuuuuuucuuuuugcca

SEQ ID NO: 2588273 - RNA, 21 nt, Coxiella burnetii RSA 493
uaaaaaaaauacucuuucaua

SEQ ID NO: 2588274 - RNA, 21 nt, Coxiella burnetii RSA 493
uaaaaaaccaauaccaauuca

SEQ ID NO: 2588275 - RNA, 12 nt, Coxiella burnetii RSA 493
uaaaaaacccca

SEQ ID NO: 2588276 - RNA, 11 nt, Coxiella burnetii RSA 493
uaaaaaagaaa

SEQ ID NO: 2588277 - RNA, 22 nt, Coxiella burnetii RSA 493
uaaaaaagcaagccgaauaaau

SEQ ID NO: 2588278 - RNA, 18 nt, Coxiella burnetii RSA 493
uaaaaaaucuuugcucua

SEQ ID NO: 2588279 - RNA, 17 nt, Coxiella burnetii RSA 493
uaaaaaauuacugaaag

SEQ ID NO: 2588280 - RNA, 14 nt, Coxiella burnetii RSA 493
uaaaaaauucaaua

SEQ ID NO: 2588281 - RNA, 18 nt, Coxiella burnetii RSA 493
uaaaaagcuagcgaaauu

SEQ ID NO: 2588282 - RNA, 15 nt, Coxiella burnetii RSA 493
uaaaaauaaauuaau

SEQ ID NO: 2588283 - RNA, 16 nt, Coxiella burnetii RSA 493
uaaaaauaaauuaauu

SEQ ID NO: 2588284 - RNA, 15 nt, Coxiella burnetii RSA 493
uaaaaaugaaauccc

SEQ ID NO: 2588285 - RNA, 13 nt, Coxiella burnetii RSA 493
uaaaaauuugauu

SEQ ID NO: 2588286 - RNA, 18 nt, Coxiella burnetii RSA 493
uaaaaauuuuaaaaaaau

SEQ ID NO: 2588287 - RNA, 20 nt, Coxiella burnetii RSA 493
uaaaacacagcccccgaauu

SEQ ID NO: 2588288 - RNA, 20 nt, Coxiella burnetii RSA 493
uaaaacgauauuaucaaaac

SEQ ID NO: 2588289 - RNA, 15 nt, Coxiella burnetii RSA 493
uaaaacgccaaaacc

SEQ ID NO: 2588290 - RNA, 18 nt, Coxiella burnetii RSA 493
uaaaacggcuugauuuca

SEQ ID NO: 2588291 - RNA, 21 nt, Coxiella burnetii RSA 493
uaaaacuucccauucuauaau

SEQ ID NO: 2588292 - RNA, 15 nt, Coxiella burnetii RSA 493
uaaaacuugauuauu

SEQ ID NO: 2588293 - RNA, 20 nt, Coxiella burnetii RSA 493
uaaaacuugauuauucaauu

SEQ ID NO: 2588294 - RNA, 21 nt, Coxiella burnetii RSA 493
uaaaacuugauuauucaauuu

SEQ ID NO: 2588295 - RNA, 14 nt, Coxiella burnetii RSA 493
uaaaagauuuaaug

SEQ ID NO: 2588296 - RNA, 16 nt, Coxiella burnetii RSA 493
uaaaagcgcaauuucc

SEQ ID NO: 2588297 - RNA, 21 nt, Coxiella burnetii RSA 493
uaaaagcgcaauuuccagauc

SEQ ID NO: 2588298 - RNA, 15 nt, Coxiella burnetii RSA 493
uaaaagugacaaugc

SEQ ID NO: 2588299 - RNA, 15 nt, Coxiella burnetii RSA 493
uaaaauaacaguguu

SEQ ID NO: 2588300 - RNA, 16 nt, Coxiella burnetii RSA 493
uaaaauaaugucucca

SEQ ID NO: 2588301 - RNA, 20 nt, Coxiella burnetii RSA 493
uaaaauacuggcaauaagug

SEQ ID NO: 2588302 - RNA, 21 nt, Coxiella burnetii RSA 493
uaaaauagcguguaauugaug

SEQ ID NO: 2588303 - RNA, 22 nt, Coxiella burnetii RSA 493
uaaaauccgcuuuauuuuucgc

SEQ ID NO: 2588304 - RNA, 13 nt, Coxiella burnetii RSA 493
uaaaauuacuauu

SEQ ID NO: 2588305 - RNA, 12 nt, Coxiella burnetii RSA 493
uaaaauuuaaua

SEQ ID NO: 2588306 - RNA, 15 nt, Coxiella burnetii RSA 493
uaaaauuucuuucca

SEQ ID NO: 2588307 - RNA, 11 nt, Coxiella burnetii RSA 493
uaaaauuuuuu

SEQ ID NO: 2588308 - RNA, 16 nt, Coxiella burnetii RSA 493
uaaacaaacugcugga

SEQ ID NO: 2588309 - RNA, 22 nt, Coxiella burnetii RSA 493
uaaacaagaauggcgggaaaaa

SEQ ID NO: 2588310 - RNA, 17 nt, Coxiella burnetii RSA 493
uaaacaaguuaacaaaa

SEQ ID NO: 2588311 - RNA, 18 nt, Coxiella burnetii RSA 493
uaaacagguccuaaaaaa

SEQ ID NO: 2588312 - RNA, 20 nt, Coxiella burnetii RSA 493
uaaacccagaaaaguaaaaa

SEQ ID NO: 2588313 - RNA, 22 nt, Coxiella burnetii RSA 493
uaaaccgcacgccaaggcuauu

SEQ ID NO: 2588314 - RNA, 16 nt, Coxiella burnetii RSA 493
uaaaccuauccaaaaa

SEQ ID NO: 2588315 - RNA, 13 nt, Coxiella burnetii RSA 493
uaaaccucaacag

SEQ ID NO: 2588316 - RNA, 13 nt, Coxiella burnetii RSA 493
uaaacgcuucaaa

SEQ ID NO: 2588317 - RNA, 23 nt, Coxiella burnetii RSA 493
uaaacggggaguggaauuuuaac

SEQ ID NO: 2588318 - RNA, 11 nt, Coxiella burnetii RSA 493
uaaacuuuacc

SEQ ID NO: 2588319 - RNA, 15 nt, Coxiella burnetii RSA 493
uaaacuuuauuccca

SEQ ID NO: 2588320 - RNA, 12 nt, Coxiella burnetii RSA 493
uaaagaaaaaau

SEQ ID NO: 2588321 - RNA, 21 nt, Coxiella burnetii RSA 493
uaacuuuagcuaauucuuuuu

SEQ ID NO: 2588322 - RNA, 14 nt, Coxiella burnetii RSA 493
uaacuuuuccaucu

SEQ ID NO: 2588323 - RNA, 18 nt, Coxiella burnetii RSA 493
uaagacacguucuggaau

SEQ ID NO: 2588324 - RNA, 23 nt, Coxiella burnetii RSA 493
uaagacacguucuggaaugacuc

SEQ ID NO: 2588325 - RNA, 14 nt, Coxiella burnetii RSA 493
uaagacgcuuucaa

SEQ ID NO: 2588326 - RNA, 13 nt, Coxiella burnetii RSA 493
uaagagaaaaaac

SEQ ID NO: 2588327 - RNA, 22 nt, Coxiella burnetii RSA 493
uaagagaaauuaaauuuuuaaa

SEQ ID NO: 2588328 - RNA, 19 nt, Coxiella burnetii RSA 493
uaagagauagugcuauuuu

SEQ ID NO: 2588329 - RNA, 23 nt, Coxiella burnetii RSA 493
uaagagauagugcuauuuuuccc

SEQ ID NO: 2588330 - RNA, 14 nt, Coxiella burnetii RSA 493
uaagagcauaucaa

SEQ ID NO: 2588331 - RNA, 15 nt, Coxiella burnetii RSA 493
uaagaggaccuguga

SEQ ID NO: 2588332 - RNA, 13 nt, Coxiella burnetii RSA 493
uaagauaauaauu

SEQ ID NO: 2588333 - RNA, 17 nt, Coxiella burnetii RSA 493
uaagauaauuacaaucc

SEQ ID NO: 2588334 - RNA, 18 nt, Coxiella burnetii RSA 493
uaagauucuugaacagga

SEQ ID NO: 2588335 - RNA, 13 nt, Coxiella burnetii RSA 493
uaagauuucuuca

SEQ ID NO: 2588336 - RNA, 13 nt, Coxiella burnetii RSA 493
uaagcaaagaucu

SEQ ID NO: 2588337 - RNA, 15 nt, Coxiella burnetii RSA 493
uaagcaauuuuuuau

SEQ ID NO: 2588338 - RNA, 14 nt, Coxiella burnetii RSA 493
uaagcacuucuuuu

SEQ ID NO: 2588339 - RNA, 16 nt, Coxiella burnetii RSA 493
uaagcauuaaaaaaua

SEQ ID NO: 2588340 - RNA, 19 nt, Coxiella burnetii RSA 493
uaagcauuaacgauaaauc

SEQ ID NO: 2588341 - RNA, 15 nt, Coxiella burnetii RSA 493
uaagcccuuuagcca

SEQ ID NO: 2588342 - RNA, 22 nt, Coxiella burnetii RSA 493
uaagcgugcucuuuuucauuuc

SEQ ID NO: 2588343 - RNA, 17 nt, Coxiella burnetii RSA 493
uaagcuagaaaauaacc

SEQ ID NO: 2588344 - RNA, 20 nt, Coxiella burnetii RSA 493
uaagcuaucagcaaucaaau

SEQ ID NO: 2588345 - RNA, 19 nt, Coxiella burnetii RSA 493
uaagcuaucagcagaaaag

SEQ ID NO: 2588346 - RNA, 23 nt, Coxiella burnetii RSA 493
uaagcugcccucaguugucaugu

SEQ ID NO: 2588347 - RNA, 15 nt, Coxiella burnetii RSA 493
uaagcuugaaaaaau

SEQ ID NO: 2588348 - RNA, 14 nt, Coxiella burnetii RSA 493
uaaggaaauugaug

SEQ ID NO: 2588349 - RNA, 22 nt, Coxiella burnetii RSA 493
uaaggaacaggggcuaaauaag

SEQ ID NO: 2588350 - RNA, 20 nt, Coxiella burnetii RSA 493
uaaggaaucacuccuaagca

SEQ ID NO: 2588351 - RNA, 20 nt, Coxiella burnetii RSA 493
uaaggcaucuuuuucuccuu

SEQ ID NO: 2588352 - RNA, 14 nt, Coxiella burnetii RSA 493
uaaggccaauucca

SEQ ID NO: 2588353 - RNA, 23 nt, Coxiella burnetii RSA 493
uaaggcugaagaggcugaauaag

SEQ ID NO: 2588354 - RNA, 18 nt, Coxiella burnetii RSA 493
uaaggucucaacagccuu

SEQ ID NO: 2588355 - RNA, 16 nt, Coxiella burnetii RSA 493
uaagguggauuuucaa

SEQ ID NO: 2588356 - RNA, 16 nt, Coxiella burnetii RSA 493
uaaguagcuaaaaaau

SEQ ID NO: 2588357 - RNA, 20 nt, Coxiella burnetii RSA 493
uaaguagucccugacguuuu

SEQ ID NO: 2588358 - RNA, 21 nt, Coxiella burnetii RSA 493
uaagucccaauuucuuuucua

SEQ ID NO: 2588359 - RNA, 18 nt, Coxiella burnetii RSA 493
uaaguccccuuauagcgu

SEQ ID NO: 2588360 - RNA, 17 nt, Coxiella burnetii RSA 493
uaaguccuccuucaagg

SEQ ID NO: 2588361 - RNA, 15 nt, Coxiella burnetii RSA 493
uaagucguuuuaaug

SEQ ID NO: 2588362 - RNA, 13 nt, Coxiella burnetii RSA 493
uaagucuauugaa

SEQ ID NO: 2588363 - RNA, 17 nt, Coxiella burnetii RSA 493
uaagucuauugaaaaaa

SEQ ID NO: 2588364 - RNA, 15 nt, Coxiella burnetii RSA 493
uaagucucugcuuca

SEQ ID NO: 2588365 - RNA, 11 nt, Coxiella burnetii RSA 493
uaauaaaacaa

SEQ ID NO: 2588366 - RNA, 13 nt, Coxiella burnetii RSA 493
uaauaaaacccgu

SEQ ID NO: 2588367 - RNA, 12 nt, Coxiella burnetii RSA 493
uaauaaaauuaa

SEQ ID NO: 2588368 - RNA, 13 nt, Coxiella burnetii RSA 493
uaauaaaauuaaa

SEQ ID NO: 2588369 - RNA, 19 nt, Coxiella burnetii RSA 493
uaauaaauggcguuguauu

SEQ ID NO: 2588370 - RNA, 16 nt, Coxiella burnetii RSA 493
uaauaacgcuaugaaa

SEQ ID NO: 2588371 - RNA, 23 nt, Coxiella burnetii RSA 493
uaauaacgcuaugaaaaccacaa

SEQ ID NO: 2588372 - RNA, 19 nt, Coxiella burnetii RSA 493
uaauaaggcuaauuuuccu

SEQ ID NO: 2588373 - RNA, 20 nt, Coxiella burnetii RSA 493
uaauaaggcuaauuuuccuu

SEQ ID NO: 2588374 - RNA, 16 nt, Coxiella burnetii RSA 493
uaauaagucuuugcua

SEQ ID NO: 2588375 - RNA, 13 nt, Coxiella burnetii RSA 493
uaauaauaacaaa

SEQ ID NO: 2588376 - RNA, 22 nt, Coxiella burnetii RSA 493
uaauaaugucugcauuuuuaau

SEQ ID NO: 2588377 - RNA, 16 nt, Coxiella burnetii RSA 493
uaauaauguuauuaaa

SEQ ID NO: 2588378 - RNA, 20 nt, Coxiella burnetii RSA 493
uaauaauuauacugcccagc

SEQ ID NO: 2588379 - RNA, 11 nt, Coxiella burnetii RSA 493
uaauaauucau

SEQ ID NO: 2588380 - RNA, 13 nt, Coxiella burnetii RSA 493
uaauaauuuuccg

SEQ ID NO: 2588381 - RNA, 16 nt, Coxiella burnetii RSA 493
uaauaauuuuuuauca

SEQ ID NO: 2588382 - RNA, 18 nt, Coxiella burnetii RSA 493
uaauacaggaaaaagaua

SEQ ID NO: 2588383 - RNA, 16 nt, Coxiella burnetii RSA 493
uaauacauaaaauuag

SEQ ID NO: 2588384 - RNA, 12 nt, Coxiella burnetii RSA 493
uaauacauucuu

SEQ ID NO: 2588385 - RNA, 17 nt, Coxiella burnetii RSA 493
uaauacccguuucuuau

SEQ ID NO: 2588386 - RNA, 22 nt, Coxiella burnetii RSA 493
uaauacccguuucuuauucauu

SEQ ID NO: 2588387 - RNA, 14 nt, Coxiella burnetii RSA 493
uaauacuaaacaaa

SEQ ID NO: 2588388 - RNA, 17 nt, Coxiella burnetii RSA 493
uaauagcaucaagggca

SEQ ID NO: 2588389 - RNA, 23 nt, Coxiella burnetii RSA 493
uaauagcaucaagggcaaaaaca

SEQ ID NO: 2588390 - RNA, 16 nt, Coxiella burnetii RSA 493
uaauaggucauuuuuu

SEQ ID NO: 2588391 - RNA, 16 nt, Coxiella burnetii RSA 493
uaauauaaucagcaag

SEQ ID NO: 2588392 - RNA, 15 nt, Coxiella burnetii RSA 493
uaauaucaaaaaacc

SEQ ID NO: 2588393 - RNA, 21 nt, Coxiella burnetii RSA 493
uaauaucgcuauaauuagaua

SEQ ID NO: 2588394 - RNA, 18 nt, Coxiella burnetii RSA 493
uaauaucuagauuuaaaa

SEQ ID NO: 2588395 - RNA, 19 nt, Coxiella burnetii RSA 493
uaauauguuuuuuauacau

SEQ ID NO: 2588396 - RNA, 23 nt, Coxiella burnetii RSA 493
uaauauguuuuuuauacauuggu

SEQ ID NO: 2588397 - RNA, 18 nt, Coxiella burnetii RSA 493
uaauauuauugagaaucu

SEQ ID NO: 2588398 - RNA, 21 nt, Coxiella burnetii RSA 493
uaaucaauaaaacucuugccg

SEQ ID NO: 2588399 - RNA, 17 nt, Coxiella burnetii RSA 493
uaaucaauugcuagucc

SEQ ID NO: 2588400 - RNA, 18 nt, Coxiella burnetii RSA 493
uaaucaauugcuaguccu

SEQ ID NO: 2588401 - RNA, 20 nt, Coxiella burnetii RSA 493
uaaucacaucccuuuucauu

SEQ ID NO: 2588402 - RNA, 19 nt, Coxiella burnetii RSA 493
uaaucaugcgcaacagccc

SEQ ID NO: 2588403 - RNA, 20 nt, Coxiella burnetii RSA 493
uaaucauuaacgaaucgucu

SEQ ID NO: 2588404 - RNA, 18 nt, Coxiella burnetii RSA 493
uaauccaaggaaagguca

SEQ ID NO: 2588405 - RNA, 20 nt, Coxiella burnetii RSA 493
uaauccgcauugcauuucuu

SEQ ID NO: 2588406 - RNA, 18 nt, Coxiella burnetii RSA 493
uaauccgccuaaauuaau

SEQ ID NO: 2588407 - RNA, 16 nt, Coxiella burnetii RSA 493
uaauccuuauacuaaa

SEQ ID NO: 2588408 - RNA, 14 nt, Coxiella burnetii RSA 493
uaauccuucuuuug

SEQ ID NO: 2588409 - RNA, 14 nt, Coxiella burnetii RSA 493
uaauccuuguugaa

SEQ ID NO: 2588410 - RNA, 19 nt, Coxiella burnetii RSA 493
uaaucgcuaagcgaaaaau

SEQ ID NO: 2588411 - RNA, 16 nt, Coxiella burnetii RSA 493
uaaucgcuccuaaauu

SEQ ID NO: 2588412 - RNA, 21 nt, Coxiella burnetii RSA 493
uaaucgcuccuaaauuuucuu

SEQ ID NO: 2588413 - RNA, 22 nt, Coxiella burnetii RSA 493
uaaucgcugauacuucuucauu

SEQ ID NO: 2588414 - RNA, 18 nt, Coxiella burnetii RSA 493
uaaucguaucgauuucuu

SEQ ID NO: 2588415 - RNA, 17 nt, Coxiella burnetii RSA 493
uaaucgucuugaccaau

SEQ ID NO: 2588416 - RNA, 16 nt, Coxiella burnetii RSA 493
uaaucguucggcuuca

SEQ ID NO: 2588417 - RNA, 14 nt, Coxiella burnetii RSA 493
uaaucucgucgccc

SEQ ID NO: 2588418 - RNA, 17 nt, Coxiella burnetii RSA 493
uaaucugcgcguauaau

SEQ ID NO: 2588419 - RNA, 19 nt, Coxiella burnetii RSA 493
uaaucugcuggcgaucgcc

SEQ ID NO: 2588420 - RNA, 19 nt, Coxiella burnetii RSA 493
uaaucuggguuucuuucuu

SEQ ID NO: 2588421 - RNA, 21 nt, Coxiella burnetii RSA 493
uaaucuuuuuagaguaacgcc

SEQ ID NO: 2588422 - RNA, 12 nt, Coxiella burnetii RSA 493
uaaugaaaaaua

SEQ ID NO: 2588423 - RNA, 14 nt, Coxiella burnetii RSA 493
uaaugaaaaauagg

SEQ ID NO: 2588424 - RNA, 22 nt, Coxiella burnetii RSA 493
uaaugaaacuaagcauuaaaaa

SEQ ID NO: 2588425 - RNA, 21 nt, Coxiella burnetii RSA 493
uaaugaauauucugagcgccu

SEQ ID NO: 2588426 - RNA, 16 nt, Coxiella burnetii RSA 493
uacguauucaugacaa

SEQ ID NO: 2588427 - RNA, 15 nt, Coxiella burnetii RSA 493
uacgugcuuugggau

SEQ ID NO: 2588428 - RNA, 19 nt, Coxiella burnetii RSA 493
uacuagcggauuguaaaca

SEQ ID NO: 2588429 - RNA, 21 nt, Coxiella burnetii RSA 493
uacuccccccaaaaaaaaacc

SEQ ID NO: 2588430 - RNA, 23 nt, Coxiella burnetii RSA 493
uacucgagguagacuuuugcgcu

SEQ ID NO: 2588431 - RNA, 15 nt, Coxiella burnetii RSA 493
uacucuacucccuaa

SEQ ID NO: 2588432 - RNA, 16 nt, Coxiella burnetii RSA 493
uacucucaaaaucacu

SEQ ID NO: 2588433 - RNA, 13 nt, Coxiella burnetii RSA 493
uacucuuauuuuc

SEQ ID NO: 2588434 - RNA, 22 nt, Coxiella burnetii RSA 493
uacugaagaguaaaaaaccaau

SEQ ID NO: 2588435 - RNA, 21 nt, Coxiella burnetii RSA 493
uacugacaaugcguuuuaaau

SEQ ID NO: 2588436 - RNA, 12 nt, Coxiella burnetii RSA 493
uacugagaaaac

SEQ ID NO: 2588437 - RNA, 20 nt, Coxiella burnetii RSA 493
uacugccuacaaauagagag

SEQ ID NO: 2588438 - RNA, 15 nt, Coxiella burnetii RSA 493
uacugcguuuuucag

SEQ ID NO: 2588439 - RNA, 19 nt, Coxiella burnetii RSA 493
uacugcuuguaccugccau

SEQ ID NO: 2588440 - RNA, 23 nt, Coxiella burnetii RSA 493
uacuggaauguccgcauagguau

SEQ ID NO: 2588441 - RNA, 16 nt, Coxiella burnetii RSA 493
uacuuaaaauuucuuu

SEQ ID NO: 2588442 - RNA, 21 nt, Coxiella burnetii RSA 493
uacuuagcugauuucucuuuu

SEQ ID NO: 2588443 - RNA, 22 nt, Coxiella burnetii RSA 493
uacuuagcugauuucucuuuua

SEQ ID NO: 2588444 - RNA, 16 nt, Coxiella burnetii RSA 493
uacuuccuucuuguca

SEQ ID NO: 2588445 - RNA, 17 nt, Coxiella burnetii RSA 493
uacuuucacuaauuaua

SEQ ID NO: 2588446 - RNA, 14 nt, Coxiella burnetii RSA 493
uacuuuuauaauca

SEQ ID NO: 2588447 - RNA, 14 nt, Coxiella burnetii RSA 493
uagaaaacuuucag

SEQ ID NO: 2588448 - RNA, 13 nt, Coxiella burnetii RSA 493
uagaaagaaaguu

SEQ ID NO: 2588449 - RNA, 23 nt, Coxiella burnetii RSA 493
uagaaagaaaguuucccacaaaa

SEQ ID NO: 2588450 - RNA, 20 nt, Coxiella burnetii RSA 493
uagaaagcggaauaagaaau

SEQ ID NO: 2588451 - RNA, 21 nt, Coxiella burnetii RSA 493
uagaaagcggaauaagaaauc

SEQ ID NO: 2588452 - RNA, 11 nt, Coxiella burnetii RSA 493
uagaaauauua

SEQ ID NO: 2588453 - RNA, 19 nt, Coxiella burnetii RSA 493
uagaagaugccagccacaa

SEQ ID NO: 2588454 - RNA, 23 nt, Coxiella burnetii RSA 493
uagaagaugccagccacaaagaa

SEQ ID NO: 2588455 - RNA, 17 nt, Coxiella burnetii RSA 493
uagaaguauuuccauuu

SEQ ID NO: 2588456 - RNA, 14 nt, Coxiella burnetii RSA 493
uagaaguuuaaagu

SEQ ID NO: 2588457 - RNA, 16 nt, Coxiella burnetii RSA 493
uagaaugauaccauca

SEQ ID NO: 2588458 - RNA, 20 nt, Coxiella burnetii RSA 493
uagaaugccggcuaauuuuu

SEQ ID NO: 2588459 - RNA, 13 nt, Coxiella burnetii RSA 493
uagaaugggaaga

SEQ ID NO: 2588460 - RNA, 23 nt, Coxiella burnetii RSA 493
uagaaugggaaguuuuauaacaa

SEQ ID NO: 2588461 - RNA, 21 nt, Coxiella burnetii RSA 493
uagaauuccuuuuaugaaaga

SEQ ID NO: 2588462 - RNA, 14 nt, Coxiella burnetii RSA 493
uagaauucucccau

SEQ ID NO: 2588463 - RNA, 13 nt, Coxiella burnetii RSA 493
uagaauugcugac

SEQ ID NO: 2588464 - RNA, 16 nt, Coxiella burnetii RSA 493
uagaauuuuugacuaa

SEQ ID NO: 2588465 - RNA, 16 nt, Coxiella burnetii RSA 493
uagacaaacgauuacc

SEQ ID NO: 2588466 - RNA, 17 nt, Coxiella burnetii RSA 493
uagacaaucaauuuacc

SEQ ID NO: 2588467 - RNA, 14 nt, Coxiella burnetii RSA 493
uagacaauuuuuuu

SEQ ID NO: 2588468 - RNA, 14 nt, Coxiella burnetii RSA 493
uagacaguuuagaa

SEQ ID NO: 2588469 - RNA, 17 nt, Coxiella burnetii RSA 493
uagaccucuaaaaaauc

SEQ ID NO: 2588470 - RNA, 14 nt, Coxiella burnetii RSA 493
uagacuaccgagaa

SEQ ID NO: 2588471 - RNA, 22 nt, Coxiella burnetii RSA 493
uagacuaccgagaaguuuugca

SEQ ID NO: 2588472 - RNA, 18 nt, Coxiella burnetii RSA 493
uagagacgggauaagucg

SEQ ID NO: 2588473 - RNA, 17 nt, Coxiella burnetii RSA 493
uagagagauccucaaca

SEQ ID NO: 2588474 - RNA, 23 nt, Coxiella burnetii RSA 493
uagaggagcguaggcacgaugca

SEQ ID NO: 2588475 - RNA, 18 nt, Coxiella burnetii RSA 493
uagaguaacgccagcgau

SEQ ID NO: 2588476 - RNA, 23 nt, Coxiella burnetii RSA 493
uagagucgggaaauaaaauuaau

SEQ ID NO: 2588477 - RNA, 19 nt, Coxiella burnetii RSA 493
uagagugaaccaaucuauu

SEQ ID NO: 2588478 - RNA, 14 nt, Coxiella burnetii RSA 493
uagaguuaauuuca

SEQ ID NO: 2588479 - RNA, 17 nt, Coxiella burnetii RSA 493
uagaguuaauuucauaa

SEQ ID NO: 2588480 - RNA, 16 nt, Coxiella burnetii RSA 493
uagaucguuuuuugau

SEQ ID NO: 2588481 - RNA, 18 nt, Coxiella burnetii RSA 493
uagaugacuuugguaguc

SEQ ID NO: 2588482 - RNA, 20 nt, Coxiella burnetii RSA 493
uagaugacuuugguaguccu

SEQ ID NO: 2588483 - RNA, 15 nt, Coxiella burnetii RSA 493
uagaugcuaucgaug

SEQ ID NO: 2588484 - RNA, 18 nt, Coxiella burnetii RSA 493
uagaugucgauaauggca

SEQ ID NO: 2588485 - RNA, 16 nt, Coxiella burnetii RSA 493
uagauucuuucugauu

SEQ ID NO: 2588486 - RNA, 13 nt, Coxiella burnetii RSA 493
uagcaaauaucug

SEQ ID NO: 2588487 - RNA, 20 nt, Coxiella burnetii RSA 493
uagcauaaucuuuuuagagu

SEQ ID NO: 2588488 - RNA, 12 nt, Coxiella burnetii RSA 493
uagcauaucgcc

SEQ ID NO: 2588489 - RNA, 19 nt, Coxiella burnetii RSA 493
uagcaucuugaaucauuga

SEQ ID NO: 2588490 - RNA, 20 nt, Coxiella burnetii RSA 493
uagcauuucguauaauucac

SEQ ID NO: 2588491 - RNA, 23 nt, Coxiella burnetii RSA 493
uagccauugguuuaaaaaguuca

SEQ ID NO: 2588492 - RNA, 15 nt, Coxiella burnetii RSA 493
uagcccacacuaaag

SEQ ID NO: 2588493 - RNA, 16 nt, Coxiella burnetii RSA 493
uagcccgaaaaaguag

SEQ ID NO: 2588494 - RNA, 16 nt, Coxiella burnetii RSA 493
uagcccguaugcagcg

SEQ ID NO: 2588495 - RNA, 13 nt, Coxiella burnetii RSA 493
uagccuucucaau

SEQ ID NO: 2588496 - RNA, 14 nt, Coxiella burnetii RSA 493
uagcgccagauaca

SEQ ID NO: 2588497 - RNA, 20 nt, Coxiella burnetii RSA 493
uagcgccagauacacauaau

SEQ ID NO: 2588498 - RNA, 14 nt, Coxiella burnetii RSA 493
uagcgcgcagcgca

SEQ ID NO: 2588499 - RNA, 13 nt, Coxiella burnetii RSA 493
uagcggaauacgg

SEQ ID NO: 2588500 - RNA, 22 nt, Coxiella burnetii RSA 493
uagcuaagaucaagaaagacau

SEQ ID NO: 2588501 - RNA, 15 nt, Coxiella burnetii RSA 493
uagcuaauucuuuuu

SEQ ID NO: 2588502 - RNA, 18 nt, Coxiella burnetii RSA 493
uagcucauugaaaucaau

SEQ ID NO: 2588503 - RNA, 17 nt, Coxiella burnetii RSA 493
uagcuccccgcuccaau

SEQ ID NO: 2588504 - RNA, 13 nt, Coxiella burnetii RSA 493
uagcucuuaaaag

SEQ ID NO: 2588505 - RNA, 21 nt, Coxiella burnetii RSA 493
uaggaaaaaauaauuauagaa

SEQ ID NO: 2588506 - RNA, 20 nt, Coxiella burnetii RSA 493
uaggaaaaaugauuauagaa

SEQ ID NO: 2588507 - RNA, 14 nt, Coxiella burnetii RSA 493
uaggagaucuuuua

SEQ ID NO: 2588508 - RNA, 19 nt, Coxiella burnetii RSA 493
uaggaguuggucaaagaga

SEQ ID NO: 2588509 - RNA, 16 nt, Coxiella burnetii RSA 493
uaggaucuuaagaaga

SEQ ID NO: 2588510 - RNA, 23 nt, Coxiella burnetii RSA 493
uaggauuuccuuuucauuuugau

SEQ ID NO: 2588511 - RNA, 21 nt, Coxiella burnetii RSA 493
uaggauuuuacgucuaaaaca

SEQ ID NO: 2588512 - RNA, 22 nt, Coxiella burnetii RSA 493
uaggccgccucgugggcccagu

SEQ ID NO: 2588513 - RNA, 21 nt, Coxiella burnetii RSA 493
uaggcugagccagcuaaguaa

SEQ ID NO: 2588514 - RNA, 18 nt, Coxiella burnetii RSA 493
uagggagaaaaauuuauu

SEQ ID NO: 2588515 - RNA, 19 nt, Coxiella burnetii RSA 493
uagggcugaaaaaauuaaa

SEQ ID NO: 2588516 - RNA, 22 nt, Coxiella burnetii RSA 493
uagggcuuuacaccuaagagaa

SEQ ID NO: 2588517 - RNA, 19 nt, Coxiella burnetii RSA 493
uaggggugaauuuuugcca

SEQ ID NO: 2588518 - RNA, 17 nt, Coxiella burnetii RSA 493
uaggguacuauuuccaa

SEQ ID NO: 2588519 - RNA, 18 nt, Coxiella burnetii RSA 493
uaggguagucaggaagca

SEQ ID NO: 2588520 - RNA, 18 nt, Coxiella burnetii RSA 493
uagggucuaguuauuuuu

SEQ ID NO: 2588521 - RNA, 18 nt, Coxiella burnetii RSA 493
uagguaacuuaaaaucac

SEQ ID NO: 2588522 - RNA, 21 nt, Coxiella burnetii RSA 493
uaggucauuuuuuauaaaauu

SEQ ID NO: 2588523 - RNA, 23 nt, Coxiella burnetii RSA 493
uagguuaaguuaagauaauaauu

SEQ ID NO: 2588524 - RNA, 15 nt, Coxiella burnetii RSA 493
uaguaaaagauccuu

SEQ ID NO: 2588525 - RNA, 22 nt, Coxiella burnetii RSA 493
uaguaacccuuucauuuaauuu

SEQ ID NO: 2588526 - RNA, 11 nt, Coxiella burnetii RSA 493
uaguaauauuu

SEQ ID NO: 2588527 - RNA, 15 nt, Coxiella burnetii RSA 493
uaguaauauuuugca

SEQ ID NO: 2588528 - RNA, 17 nt, Coxiella burnetii RSA 493
uaguaauauuuugcaga

SEQ ID NO: 2588529 - RNA, 20 nt, Coxiella burnetii RSA 493
uaguacccagggcuauuuua

SEQ ID NO: 2588530 - RNA, 17 nt, Coxiella burnetii RSA 493
uaguaugcuauaauuga

SEQ ID NO: 2588531 - RNA, 18 nt, Coxiella burnetii RSA 493
uaugagcgaacgaauacg

SEQ ID NO: 2588532 - RNA, 19 nt, Coxiella burnetii RSA 493
uaugagcgaagcgaaauac

SEQ ID NO: 2588533 - RNA, 20 nt, Coxiella burnetii RSA 493
uaugagcgaagcgaaauacg

SEQ ID NO: 2588534 - RNA, 20 nt, Coxiella burnetii RSA 493
uaugagcgaagcgaaguacg

SEQ ID NO: 2588535 - RNA, 22 nt, Coxiella burnetii RSA 493
uaugagcgaagcgaaguacggg

SEQ ID NO: 2588536 - RNA, 16 nt, Coxiella burnetii RSA 493
uaugaucauuuucuca

SEQ ID NO: 2588537 - RNA, 19 nt, Coxiella burnetii RSA 493
uaugcaagguugaugcuua

SEQ ID NO: 2588538 - RNA, 20 nt, Coxiella burnetii RSA 493
uaugcagcgaagcgaaauac

SEQ ID NO: 2588539 - RNA, 21 nt, Coxiella burnetii RSA 493
uaugcagcgaagcggaauacg

SEQ ID NO: 2588540 - RNA, 12 nt, Coxiella burnetii RSA 493
uaugcuucaaua

SEQ ID NO: 2588541 - RNA, 13 nt, Coxiella burnetii RSA 493
uaugcuucaauaa

SEQ ID NO: 2588542 - RNA, 17 nt, Coxiella burnetii RSA 493
uaugcuucaauaaaaaa

SEQ ID NO: 2588543 - RNA, 19 nt, Coxiella burnetii RSA 493
uauggaguucuugcuccca

SEQ ID NO: 2588544 - RNA, 14 nt, Coxiella burnetii RSA 493
uauggauaauuccg

SEQ ID NO: 2588545 - RNA, 21 nt, Coxiella burnetii RSA 493
uauggauaguuucaaauuucu

SEQ ID NO: 2588546 - RNA, 16 nt, Coxiella burnetii RSA 493
uauggcgcucuccuac

SEQ ID NO: 2588547 - RNA, 23 nt, Coxiella burnetii RSA 493
uauggcgcucuccuaccaaauaa

SEQ ID NO: 2588548 - RNA, 15 nt, Coxiella burnetii RSA 493
uauguauuuuuugga

SEQ ID NO: 2588549 - RNA, 18 nt, Coxiella burnetii RSA 493
uauguauuuuuuggaaug

SEQ ID NO: 2588550 - RNA, 23 nt, Coxiella burnetii RSA 493
uauguauuuuuuggaaugagcau

SEQ ID NO: 2588551 - RNA, 16 nt, Coxiella burnetii RSA 493
uaugucguucaauucu

SEQ ID NO: 2588552 - RNA, 14 nt, Coxiella burnetii RSA 493
uauguguaacaaaa

SEQ ID NO: 2588553 - RNA, 24 nt, Coxiella burnetii RSA 493
uauuaaaacaagacaacaaaaugu

SEQ ID NO: 2588554 - RNA, 15 nt, Coxiella burnetii RSA 493
uauuaacauuuggau

SEQ ID NO: 2588555 - RNA, 16 nt, Coxiella burnetii RSA 493
uauuaacauuuggauu

SEQ ID NO: 2588556 - RNA, 20 nt, Coxiella burnetii RSA 493
uauuaagccgaugccaauga

SEQ ID NO: 2588557 - RNA, 17 nt, Coxiella burnetii RSA 493
uauuaagcguuccuuuc

SEQ ID NO: 2588558 - RNA, 18 nt, Coxiella burnetii RSA 493
uauuaauacaggaaaaag

SEQ ID NO: 2588559 - RNA, 20 nt, Coxiella burnetii RSA 493
uauuaauccuuauacuaaau

SEQ ID NO: 2588560 - RNA, 15 nt, Coxiella burnetii RSA 493
uauuacauauuucuu

SEQ ID NO: 2588561 - RNA, 16 nt, Coxiella burnetii RSA 493
uauuacauauuucuuu

SEQ ID NO: 2588562 - RNA, 15 nt, Coxiella burnetii RSA 493
uauuagcuggcagau

SEQ ID NO: 2588563 - RNA, 18 nt, Coxiella burnetii RSA 493
uauuagucuuaauuuuaa

SEQ ID NO: 2588564 - RNA, 21 nt, Coxiella burnetii RSA 493
uauuaguggaauuaaauaucc

SEQ ID NO: 2588565 - RNA, 12 nt, Coxiella burnetii RSA 493
uauuauaaaaaa

SEQ ID NO: 2588566 - RNA, 20 nt, Coxiella burnetii RSA 493
uauuauaaaaaaaaguuuag

SEQ ID NO: 2588567 - RNA, 16 nt, Coxiella burnetii RSA 493
uauuaucaaaacguag

SEQ ID NO: 2588568 - RNA, 17 nt, Coxiella burnetii RSA 493
uauuauccgguuuugau

SEQ ID NO: 2588569 - RNA, 23 nt, Coxiella burnetii RSA 493
uauuaugggugggcgugauugaa

SEQ ID NO: 2588570 - RNA, 15 nt, Coxiella burnetii RSA 493
uauuauuaaaagagc

SEQ ID NO: 2588571 - RNA, 15 nt, Coxiella burnetii RSA 493
uauuauucauaucuu

SEQ ID NO: 2588572 - RNA, 17 nt, Coxiella burnetii RSA 493
uauuauucauaucuuuu

SEQ ID NO: 2588573 - RNA, 19 nt, Coxiella burnetii RSA 493
uauuauugagccauuaaga

SEQ ID NO: 2588574 - RNA, 11 nt, Coxiella burnetii RSA 493
uauuauuuauc

SEQ ID NO: 2588575 - RNA, 17 nt, Coxiella burnetii RSA 493
uauucaagguuauuuuu

SEQ ID NO: 2588576 - RNA, 13 nt, Coxiella burnetii RSA 493
uauucauaucuuu

SEQ ID NO: 2588577 - RNA, 22 nt, Coxiella burnetii RSA 493
uauucauauugcgcguaaauuu

SEQ ID NO: 2588578 - RNA, 14 nt, Coxiella burnetii RSA 493
uauucauuaaauau

SEQ ID NO: 2588579 - RNA, 14 nt, Coxiella burnetii RSA 493
uauucccgccauca

SEQ ID NO: 2588580 - RNA, 19 nt, Coxiella burnetii RSA 493
uauucccucuuuaccuccu

SEQ ID NO: 2588581 - RNA, 12 nt, Coxiella burnetii RSA 493
uauucgcuccau

SEQ ID NO: 2588582 - RNA, 13 nt, Coxiella burnetii RSA 493
uauucgcuccauu

SEQ ID NO: 2588583 - RNA, 20 nt, Coxiella burnetii RSA 493
uauucgguaacguuucacaa

SEQ ID NO: 2588584 - RNA, 20 nt, Coxiella burnetii RSA 493
uauucuaucucaaguggcuc

SEQ ID NO: 2588585 - RNA, 13 nt, Coxiella burnetii RSA 493
uauucuuaaaccc

SEQ ID NO: 2588586 - RNA, 21 nt, Coxiella burnetii RSA 493
uauucuuaauuuuuccuuucu

SEQ ID NO: 2588587 - RNA, 14 nt, Coxiella burnetii RSA 493
uauucuucaauacu

SEQ ID NO: 2588588 - RNA, 16 nt, Coxiella burnetii RSA 493
uauucuucauaggauu

SEQ ID NO: 2588589 - RNA, 13 nt, Coxiella burnetii RSA 493
uauucuuuuauuu

SEQ ID NO: 2588590 - RNA, 13 nt, Coxiella burnetii RSA 493
uauugaagucugg

SEQ ID NO: 2588591 - RNA, 15 nt, Coxiella burnetii RSA 493
uauugaucgcccaua

SEQ ID NO: 2588592 - RNA, 15 nt, Coxiella burnetii RSA 493
uauugauuuaaauuu

SEQ ID NO: 2588593 - RNA, 20 nt, Coxiella burnetii RSA 493
uauugcgcaaauugcaaaac

SEQ ID NO: 2588594 - RNA, 13 nt, Coxiella burnetii RSA 493
uauugcuaaaauc

SEQ ID NO: 2588595 - RNA, 15 nt, Coxiella burnetii RSA 493
uauuggauuuacuuc

SEQ ID NO: 2588596 - RNA, 20 nt, Coxiella burnetii RSA 493
uauuggauuuacuucuauac

SEQ ID NO: 2588597 - RNA, 15 nt, Coxiella burnetii RSA 493
uauugucaaaauuag

SEQ ID NO: 2588598 - RNA, 15 nt, Coxiella burnetii RSA 493
uauugucauccagcg

SEQ ID NO: 2588599 - RNA, 21 nt, Coxiella burnetii RSA 493
uauuuaagugauaauuauaag

SEQ ID NO: 2588600 - RNA, 16 nt, Coxiella burnetii RSA 493
uauuuacugagaaaac

SEQ ID NO: 2588601 - RNA, 22 nt, Coxiella burnetii RSA 493
uauuuaggggugaauuuuugcc

SEQ ID NO: 2588602 - RNA, 18 nt, Coxiella burnetii RSA 493
uauuuaucauguggucuc

SEQ ID NO: 2588603 - RNA, 16 nt, Coxiella burnetii RSA 493
uauuuauuuuucucuu

SEQ ID NO: 2588604 - RNA, 19 nt, Coxiella burnetii RSA 493
uauuucgcuucgcuacaua

SEQ ID NO: 2588605 - RNA, 18 nt, Coxiella burnetii RSA 493
uauuucgcuucgcucaua

SEQ ID NO: 2588606 - RNA, 19 nt, Coxiella burnetii RSA 493
uauuucgcuucgcucauac

SEQ ID NO: 2588607 - RNA, 23 nt, Coxiella burnetii RSA 493
uauuucgcuucgcucauacgggc

SEQ ID NO: 2588608 - RNA, 19 nt, Coxiella burnetii RSA 493
uauuucgcuucgcuccaua

SEQ ID NO: 2588609 - RNA, 23 nt, Coxiella burnetii RSA 493
uauuucuaucgccguuucugcuu

SEQ ID NO: 2588610 - RNA, 13 nt, Coxiella burnetii RSA 493
uauuucuuuucug

SEQ ID NO: 2588611 - RNA, 17 nt, Coxiella burnetii RSA 493
uauuugaaaguagaaaa

SEQ ID NO: 2588612 - RNA, 22 nt, Coxiella burnetii RSA 493
uauuugcggguggcggacuuuu

SEQ ID NO: 2588613 - RNA, 17 nt, Coxiella burnetii RSA 493
uauuugcuuucuuugaa

SEQ ID NO: 2588614 - RNA, 14 nt, Coxiella burnetii RSA 493
uauuuguguaaaau

SEQ ID NO: 2588615 - RNA, 15 nt, Coxiella burnetii RSA 493
uauuuguguaaaaua

SEQ ID NO: 2588616 - RNA, 19 nt, Coxiella burnetii RSA 493
uauuuuaaguaauuuuacu

SEQ ID NO: 2588617 - RNA, 17 nt, Coxiella burnetii RSA 493
uauuuuaauaugauaaa

SEQ ID NO: 2588618 - RNA, 22 nt, Coxiella burnetii RSA 493
uauuuucaaaugaauaagcaaa

SEQ ID NO: 2588619 - RNA, 12 nt, Coxiella burnetii RSA 493
uauuuucauucu

SEQ ID NO: 2588620 - RNA, 22 nt, Coxiella burnetii RSA 493
uauuuucugccgcugauauucc

SEQ ID NO: 2588621 - RNA, 18 nt, Coxiella burnetii RSA 493
uauuuuuaaaagauuuua

SEQ ID NO: 2588622 - RNA, 11 nt, Coxiella burnetii RSA 493
uauuuuucauc

SEQ ID NO: 2588623 - RNA, 11 nt, Coxiella burnetii RSA 493
uauuuuuccca

SEQ ID NO: 2588624 - RNA, 12 nt, Coxiella burnetii RSA 493
uauuuuucucuu

SEQ ID NO: 2588625 - RNA, 16 nt, Coxiella burnetii RSA 493
uauuuuucucuucuuu

SEQ ID NO: 2588626 - RNA, 15 nt, Coxiella burnetii RSA 493
uauuuuuuaaaucug

SEQ ID NO: 2588627 - RNA, 22 nt, Coxiella burnetii RSA 493
uauuuuuuaaaucugacguuau

SEQ ID NO: 2588628 - RNA, 16 nt, Coxiella burnetii RSA 493
uauuuuuucccgcaac

SEQ ID NO: 2588629 - RNA, 14 nt, Coxiella burnetii RSA 493
uauuuuuuggaaug

SEQ ID NO: 2588630 - RNA, 14 nt, Coxiella burnetii RSA 493
uauuuuuuugccag

SEQ ID NO: 2588631 - RNA, 19 nt, Coxiella burnetii RSA 493
ucaaaaaaccuuaucaauc

SEQ ID NO: 2588632 - RNA, 21 nt, Coxiella burnetii RSA 493
ucaaaaacuucaugcaaaaau

SEQ ID NO: 2588633 - RNA, 16 nt, Coxiella burnetii RSA 493
ucaaaacagcaauuaa

SEQ ID NO: 2588634 - RNA, 20 nt, Coxiella burnetii RSA 493
ucaaaacagcaauuaauccc

SEQ ID NO: 2588635 - RNA, 18 nt, Coxiella burnetii RSA 493
ucaaaagugauuuuucuu

SEQ ID NO: 2588636 - RNA, 19 nt, Coxiella burnetii RSA 493
ucaaaaguugaugaucuaa

SEQ ID NO: 2588637 - RNA, 21 nt, Coxiella burnetii RSA 493
ccuauuuggcggcgcucaugg

SEQ ID NO: 2588638 - RNA, 20 nt, Coxiella burnetii RSA 493
ccucaacaguaguuuaucaa

SEQ ID NO: 2588639 - RNA, 13 nt, Coxiella burnetii RSA 493
ccucaauuucaau

SEQ ID NO: 2588640 - RNA, 15 nt, Coxiella burnetii RSA 493
ccucagaaguuuuag

SEQ ID NO: 2588641 - RNA, 15 nt, Coxiella burnetii RSA 493
ccucagguuuuaccu

SEQ ID NO: 2588642 - RNA, 21 nt, Coxiella burnetii RSA 493
ccucauucaguucgcuaaaua

SEQ ID NO: 2588643 - RNA, 18 nt, Coxiella burnetii RSA 493
ccuccaaaaacugcaucg

SEQ ID NO: 2588644 - RNA, 16 nt, Coxiella burnetii RSA 493
ccucccauugauaaac

SEQ ID NO: 2588645 - RNA, 22 nt, Coxiella burnetii RSA 493
ccuccggcgcgcgcuugacuuu

SEQ ID NO: 2588646 - RNA, 18 nt, Coxiella burnetii RSA 493
ccucgacggguugucuga

SEQ ID NO: 2588647 - RNA, 15 nt, Coxiella burnetii RSA 493
ccucggaaguuagua

SEQ ID NO: 2588648 - RNA, 15 nt, Coxiella burnetii RSA 493
ccucgugggcccagu

SEQ ID NO: 2588649 - RNA, 12 nt, Coxiella burnetii RSA 493
ccucuacaaaau

SEQ ID NO: 2588650 - RNA, 16 nt, Coxiella burnetii RSA 493
ccucuacaucuucauu

SEQ ID NO: 2588651 - RNA, 17 nt, Coxiella burnetii RSA 493
ccucuauauaagcuuuc

SEQ ID NO: 2588652 - RNA, 20 nt, Coxiella burnetii RSA 493
ccucucgucggguauuuuca

SEQ ID NO: 2588653 - RNA, 18 nt, Coxiella burnetii RSA 493
ccucugaauguuaauuau

SEQ ID NO: 2588654 - RNA, 23 nt, Coxiella burnetii RSA 493
ccucugaauugaaguccuuauca

SEQ ID NO: 2588655 - RNA, 12 nt, Coxiella burnetii RSA 493
ccucuucuaaag

SEQ ID NO: 2588656 - RNA, 19 nt, Coxiella burnetii RSA 493
ccucuuuaccccgcucccu

SEQ ID NO: 2588657 - RNA, 13 nt, Coxiella burnetii RSA 493
ccucuuuuuaaaa

SEQ ID NO: 2588658 - RNA, 13 nt, Coxiella burnetii RSA 493
ccugaaaaauaau

SEQ ID NO: 2588659 - RNA, 17 nt, Coxiella burnetii RSA 493
ccugaacauuaagaaag

SEQ ID NO: 2588660 - RNA, 17 nt, Coxiella burnetii RSA 493
ccugaaugcuuuuaaag

SEQ ID NO: 2588661 - RNA, 15 nt, Coxiella burnetii RSA 493
ccugacguuuuccac

SEQ ID NO: 2588662 - RNA, 22 nt, Coxiella burnetii RSA 493
ccugagucggaaguucuauuuc

SEQ ID NO: 2588663 - RNA, 13 nt, Coxiella burnetii RSA 493
ccugauaaaauaa

SEQ ID NO: 2588664 - RNA, 15 nt, Coxiella burnetii RSA 493
ccugaucauaaagcg

SEQ ID NO: 2588665 - RNA, 14 nt, Coxiella burnetii RSA 493
ccugcgcgggaaug

SEQ ID NO: 2588666 - RNA, 21 nt, Coxiella burnetii RSA 493
ccugcuucgcuucauccaaaa

SEQ ID NO: 2588667 - RNA, 14 nt, Coxiella burnetii RSA 493
ccuggagaaggcau

SEQ ID NO: 2588668 - RNA, 22 nt, Coxiella burnetii RSA 493
ccugucugccgcaaguaauuca

SEQ ID NO: 2588669 - RNA, 19 nt, Coxiella burnetii RSA 493
ccuguggaagguugagaag

SEQ ID NO: 2588670 - RNA, 19 nt, Coxiella burnetii RSA 493
ccuguggcaauuaugaaaa

SEQ ID NO: 2588671 - RNA, 18 nt, Coxiella burnetii RSA 493
ccuguucuuuuuccaugu

SEQ ID NO: 2588672 - RNA, 21 nt, Coxiella burnetii RSA 493
ccuuaaauaguagcuauaagc

SEQ ID NO: 2588673 - RNA, 13 nt, Coxiella burnetii RSA 493
ccuuaaucgugaa

SEQ ID NO: 2588674 - RNA, 19 nt, Coxiella burnetii RSA 493
ccuuagcguaaucaucaau

SEQ ID NO: 2588675 - RNA, 11 nt, Coxiella burnetii RSA 493
ccuuaucacua

SEQ ID NO: 2588676 - RNA, 22 nt, Coxiella burnetii RSA 493
ccuucccggagcgaucaacgcg

SEQ ID NO: 2588677 - RNA, 18 nt, Coxiella burnetii RSA 493
ccuucgcauaaaacgcau

SEQ ID NO: 2588678 - RNA, 21 nt, Coxiella burnetii RSA 493
ccuucguaggccgcuuuuugu

SEQ ID NO: 2588679 - RNA, 14 nt, Coxiella burnetii RSA 493
ccuucucaauuuca

SEQ ID NO: 2588680 - RNA, 13 nt, Coxiella burnetii RSA 493
ccuucuucuuugg

SEQ ID NO: 2588681 - RNA, 14 nt, Coxiella burnetii RSA 493
ccuucuucuuugga

SEQ ID NO: 2588682 - RNA, 21 nt, Coxiella burnetii RSA 493
ccuucuugccgcccuugcugc

SEQ ID NO: 2588683 - RNA, 20 nt, Coxiella burnetii RSA 493
ccuucuugucauucccuuuu

SEQ ID NO: 2588684 - RNA, 22 nt, Coxiella burnetii RSA 493
ccuucuugucauucccuuuuuc

SEQ ID NO: 2588685 - RNA, 22 nt, Coxiella burnetii RSA 493
ccuucuuuuaaagugauuuuuu

SEQ ID NO: 2588686 - RNA, 13 nt, Coxiella burnetii RSA 493
ccuucuuuuucaa

SEQ ID NO: 2588687 - RNA, 16 nt, Coxiella burnetii RSA 493
ccuucuuuuucaaucg

SEQ ID NO: 2588688 - RNA, 14 nt, Coxiella burnetii RSA 493
ccuugacgcucaga

SEQ ID NO: 2588689 - RNA, 11 nt, Coxiella burnetii RSA 493
ccuugcaauaa

SEQ ID NO: 2588690 - RNA, 12 nt, Coxiella burnetii RSA 493
ccuugcaauaag

SEQ ID NO: 2588691 - RNA, 16 nt, Coxiella burnetii RSA 493
ccuugccccaugaguu

SEQ ID NO: 2588692 - RNA, 14 nt, Coxiella burnetii RSA 493
ccuugcucaagucc

SEQ ID NO: 2588693 - RNA, 22 nt, Coxiella burnetii RSA 493
ccuugcugaauucccuuuugaa

SEQ ID NO: 2588694 - RNA, 21 nt, Coxiella burnetii RSA 493
ccuugcugcaagcccuuuuga

SEQ ID NO: 2588695 - RNA, 14 nt, Coxiella burnetii RSA 493
ccuugucacaagug

SEQ ID NO: 2588696 - RNA, 13 nt, Coxiella burnetii RSA 493
ccuuguugaauuc

SEQ ID NO: 2588697 - RNA, 14 nt, Coxiella burnetii RSA 493
ccuuguuuuaaccu

SEQ ID NO: 2588698 - RNA, 13 nt, Coxiella burnetii RSA 493
ccuuguuuuaagc

SEQ ID NO: 2588699 - RNA, 18 nt, Coxiella burnetii RSA 493
ccuuuaauucgcgcugca

SEQ ID NO: 2588700 - RNA, 18 nt, Coxiella burnetii RSA 493
ccuuuaucguugcugagc

SEQ ID NO: 2588701 - RNA, 17 nt, Coxiella burnetii RSA 493
ccuuucauuuaauuuua

SEQ ID NO: 2588702 - RNA, 20 nt, Coxiella burnetii RSA 493
ccuuucauuuaauuuuaaau

SEQ ID NO: 2588703 - RNA, 15 nt, Coxiella burnetii RSA 493
ccuuucugacgcuuu

SEQ ID NO: 2588704 - RNA, 15 nt, Coxiella burnetii RSA 493
ccuuucuuucuucac

SEQ ID NO: 2588705 - RNA, 17 nt, Coxiella burnetii RSA 493
ccuuucuuucuucacuu

SEQ ID NO: 2588706 - RNA, 16 nt, Coxiella burnetii RSA 493
ccuuugcuaacaauug

SEQ ID NO: 2588707 - RNA, 14 nt, Coxiella burnetii RSA 493
ccuuuggcaauaau

SEQ ID NO: 2588708 - RNA, 19 nt, Coxiella burnetii RSA 493
ccuuuugaaggaauaaaac

SEQ ID NO: 2588709 - RNA, 17 nt, Coxiella burnetii RSA 493
ccuuuuguuaacuuuuc

SEQ ID NO: 2588710 - RNA, 19 nt, Coxiella burnetii RSA 493
ccuuuuuauaaaugauuuc

SEQ ID NO: 2588711 - RNA, 21 nt, Coxiella burnetii RSA 493
ccuuuuucuagggagaaaaau

SEQ ID NO: 2588712 - RNA, 13 nt, Coxiella burnetii RSA 493
ccuuuuugauuuc

SEQ ID NO: 2588713 - RNA, 13 nt, Coxiella burnetii RSA 493
ccuuuuuuuucaa

SEQ ID NO: 2588714 - RNA, 15 nt, Coxiella burnetii RSA 493
ccuuuuuuuucaaaa

SEQ ID NO: 2588715 - RNA, 11 nt, Coxiella burnetii RSA 493
cgaaaaaaauc

SEQ ID NO: 2588716 - RNA, 22 nt, Coxiella burnetii RSA 493
cgaaaacuaguuauuuuuaaaa

SEQ ID NO: 2588717 - RNA, 17 nt, Coxiella burnetii RSA 493
cgaaaagaucuccuuga

SEQ ID NO: 2588718 - RNA, 18 nt, Coxiella burnetii RSA 493
cgaaaccuuguuauaaau

SEQ ID NO: 2588719 - RNA, 16 nt, Coxiella burnetii RSA 493
cgaaacgacgaaagag

SEQ ID NO: 2588720 - RNA, 23 nt, Coxiella burnetii RSA 493
cgaaagccaaguuuuaagaaaaa

SEQ ID NO: 2588721 - RNA, 16 nt, Coxiella burnetii RSA 493
cgaaagcuaaaaaaga

SEQ ID NO: 2588722 - RNA, 16 nt, Coxiella burnetii RSA 493
cgaaauaauucgcaca

SEQ ID NO: 2588723 - RNA, 18 nt, Coxiella burnetii RSA 493
cgaaauacgggaaaacaa

SEQ ID NO: 2588724 - RNA, 12 nt, Coxiella burnetii RSA 493
cgaaauacgggg

SEQ ID NO: 2588725 - RNA, 14 nt, Coxiella burnetii RSA 493
cgaaauagaauuuu

SEQ ID NO: 2588726 - RNA, 20 nt, Coxiella burnetii RSA 493
cgaaauaucaucaacagaac

SEQ ID NO: 2588727 - RNA, 22 nt, Coxiella burnetii RSA 493
cgaaaucuaccguauuuaaucu

SEQ ID NO: 2588728 - RNA, 18 nt, Coxiella burnetii RSA 493
cgaaauuuaauaaaauua

SEQ ID NO: 2588729 - RNA, 21 nt, Coxiella burnetii RSA 493
cgaaauuuguuauugcuaaaa

SEQ ID NO: 2588730 - RNA, 21 nt, Coxiella burnetii RSA 493
cgaacagccgaugacaaauaa

SEQ ID NO: 2588731 - RNA, 18 nt, Coxiella burnetii RSA 493
cgaacgaauacggggacg

SEQ ID NO: 2588732 - RNA, 14 nt, Coxiella burnetii RSA 493
cgaacggcgauacg

SEQ ID NO: 2588733 - RNA, 13 nt, Coxiella burnetii RSA 493
cgaagaaaaagaa

SEQ ID NO: 2588734 - RNA, 23 nt, Coxiella burnetii RSA 493
cgaagaagcgucugauccgccuu

SEQ ID NO: 2588735 - RNA, 23 nt, Coxiella burnetii RSA 493
cgaagccuauuuuugauuacuua

SEQ ID NO: 2588736 - RNA, 19 nt, Coxiella burnetii RSA 493
cgaagcgaaauacgggaaa

SEQ ID NO: 2588737 - RNA, 17 nt, Coxiella burnetii RSA 493
cgaagcgaaauacgggg

SEQ ID NO: 2588738 - RNA, 20 nt, Coxiella burnetii RSA 493
cgaagcgaaauacggggacg

SEQ ID NO: 2588739 - RNA, 19 nt, Coxiella burnetii RSA 493
cgaagcgaaguacgggaaa

SEQ ID NO: 2588740 - RNA, 19 nt, Coxiella burnetii RSA 493
cgaagcggcucuugcuuua

SEQ ID NO: 2588741 - RNA, 23 nt, Coxiella burnetii RSA 493
cgaaggugauucucucaaagaaa

SEQ ID NO: 2588742 - RNA, 13 nt, Coxiella burnetii RSA 493
cgaaguucucaaa

SEQ ID NO: 2588743 - RNA, 15 nt, Coxiella burnetii RSA 493
cgcauugcauuucuu

SEQ ID NO: 2588744 - RNA, 18 nt, Coxiella burnetii RSA 493
cgcauugcauuucuuuca

SEQ ID NO: 2588745 - RNA, 23 nt, Coxiella burnetii RSA 493
cgcauugcauuucuuucaauaaa

SEQ ID NO: 2588746 - RNA, 23 nt, Coxiella burnetii RSA 493
cgccaaaagguauguugucauca

SEQ ID NO: 2588747 - RNA, 17 nt, Coxiella burnetii RSA 493
cgccacaauuaauuuau

SEQ ID NO: 2588748 - RNA, 16 nt, Coxiella burnetii RSA 493
cgccagcuuccuucaa

SEQ ID NO: 2588749 - RNA, 18 nt, Coxiella burnetii RSA 493
cgccauagggucgaauuc

SEQ ID NO: 2588750 - RNA, 16 nt, Coxiella burnetii RSA 493
cgccaucaaccaauaa

SEQ ID NO: 2588751 - RNA, 17 nt, Coxiella burnetii RSA 493
cgccauccgacauucuu

SEQ ID NO: 2588752 - RNA, 21 nt, Coxiella burnetii RSA 493
cgccauggggcgagcgcccau

SEQ ID NO: 2588753 - RNA, 22 nt, Coxiella burnetii RSA 493
cgccauuucgcuuuuauuuccu

SEQ ID NO: 2588754 - RNA, 17 nt, Coxiella burnetii RSA 493
cgcccuuucucuuuuuu

SEQ ID NO: 2588755 - RNA, 23 nt, Coxiella burnetii RSA 493
cgccgagaguaacgauuucucuu

SEQ ID NO: 2588756 - RNA, 22 nt, Coxiella burnetii RSA 493
cgccgagcuuuucacccaacca

SEQ ID NO: 2588757 - RNA, 17 nt, Coxiella burnetii RSA 493
cgccgauaauggggccg

SEQ ID NO: 2588758 - RNA, 22 nt, Coxiella burnetii RSA 493
cgccgcaaaguaaaaaugaaau

SEQ ID NO: 2588759 - RNA, 14 nt, Coxiella burnetii RSA 493
cgccggcguuugca

SEQ ID NO: 2588760 - RNA, 21 nt, Coxiella burnetii RSA 493
cgccucugaauugaaguccuu

SEQ ID NO: 2588761 - RNA, 20 nt, Coxiella burnetii RSA 493
cgccugacaaagcggccgcu

SEQ ID NO: 2588762 - RNA, 23 nt, Coxiella burnetii RSA 493
cgccugcuaaaauaagguuaaau

SEQ ID NO: 2588763 - RNA, 21 nt, Coxiella burnetii RSA 493
cgccuguaaggucucaacagc

SEQ ID NO: 2588764 - RNA, 12 nt, Coxiella burnetii RSA 493
cgccuuaauaug

SEQ ID NO: 2588765 - RNA, 18 nt, Coxiella burnetii RSA 493
cgcgaaauuuaauaaaau

SEQ ID NO: 2588766 - RNA, 23 nt, Coxiella burnetii RSA 493
cgcgacaagaauuuuuuuauaau

SEQ ID NO: 2588767 - RNA, 20 nt, Coxiella burnetii RSA 493
cgcgcuagauucccgccuac

SEQ ID NO: 2588768 - RNA, 18 nt, Coxiella burnetii RSA 493
cgcgcuuuagcgcgcagc

SEQ ID NO: 2588769 - RNA, 14 nt, Coxiella burnetii RSA 493
cgcggcaaggaauu

SEQ ID NO: 2588770 - RNA, 13 nt, Coxiella burnetii RSA 493
cgcggccgcggcu

SEQ ID NO: 2588771 - RNA, 21 nt, Coxiella burnetii RSA 493
cgcguucuugggcaauuugug

SEQ ID NO: 2588772 - RNA, 22 nt, Coxiella burnetii RSA 493
cgcguuuuuaaaugaauuacuu

SEQ ID NO: 2588773 - RNA, 16 nt, Coxiella burnetii RSA 493
cgcuaaaaucacgcca

SEQ ID NO: 2588774 - RNA, 17 nt, Coxiella burnetii RSA 493
cgcuaacagagggagca

SEQ ID NO: 2588775 - RNA, 12 nt, Coxiella burnetii RSA 493
cgcuaagcgaaa

SEQ ID NO: 2588776 - RNA, 11 nt, Coxiella burnetii RSA 493
cgcuaauugau

SEQ ID NO: 2588777 - RNA, 14 nt, Coxiella burnetii RSA 493
cgcuaauuguucag

SEQ ID NO: 2588778 - RNA, 14 nt, Coxiella burnetii RSA 493
cgcuacauacgggc

SEQ ID NO: 2588779 - RNA, 14 nt, Coxiella burnetii RSA 493
cgcuaguuuuuaag

SEQ ID NO: 2588780 - RNA, 14 nt, Coxiella burnetii RSA 493
cgcuauuuuuuaaa

SEQ ID NO: 2588781 - RNA, 23 nt, Coxiella burnetii RSA 493
cgcucaaugagugcuuuuaacca

SEQ ID NO: 2588782 - RNA, 20 nt, Coxiella burnetii RSA 493
cgcucauacgggcuacuuua

SEQ ID NO: 2588783 - RNA, 18 nt, Coxiella burnetii RSA 493
cgcucaugggaugucgcu

SEQ ID NO: 2588784 - RNA, 22 nt, Coxiella burnetii RSA 493
cgcucauuuucacuauuuguau

SEQ ID NO: 2588785 - RNA, 15 nt, Coxiella burnetii RSA 493
cgcuccaguauuuca

SEQ ID NO: 2588786 - RNA, 16 nt, Coxiella burnetii RSA 493
cgcuccauaccucuuc

SEQ ID NO: 2588787 - RNA, 14 nt, Coxiella burnetii RSA 493
cgcuccauacgggc

SEQ ID NO: 2588788 - RNA, 20 nt, Coxiella burnetii RSA 493
cgcuccuaaauuuucuuguu

SEQ ID NO: 2588789 - RNA, 19 nt, Coxiella burnetii RSA 493
cgcugacgucagaaaacag

SEQ ID NO: 2588790 - RNA, 12 nt, Coxiella burnetii RSA 493
cgcugcaauaau

SEQ ID NO: 2588791 - RNA, 18 nt, Coxiella burnetii RSA 493
cgcugcaauaauucuuuc

SEQ ID NO: 2588792 - RNA, 14 nt, Coxiella burnetii RSA 493
cgcuggcuuugauu

SEQ ID NO: 2588793 - RNA, 15 nt, Coxiella burnetii RSA 493
cgcuggcuuugauuc

SEQ ID NO: 2588794 - RNA, 18 nt, Coxiella burnetii RSA 493
cgcuguaaccgccuuuaa

SEQ ID NO: 2588795 - RNA, 21 nt, Coxiella burnetii RSA 493
cgcugugaaaaugucauucaa

SEQ ID NO: 2588796 - RNA, 23 nt, Coxiella burnetii RSA 493
cgcuucgaaaaucgaauuccaac

SEQ ID NO: 2588797 - RNA, 19 nt, Coxiella burnetii RSA 493
cgcuucgcuccauacgggc

SEQ ID NO: 2588798 - RNA, 17 nt, Coxiella burnetii RSA 493
cgcuuguuuuauaccuu

SEQ ID NO: 2588799 - RNA, 20 nt, Coxiella burnetii RSA 493
cgcuuucaacauauuucuug

SEQ ID NO: 2588800 - RNA, 21 nt, Coxiella burnetii RSA 493
cgcuuucaacauauuucuugu

SEQ ID NO: 2588801 - RNA, 15 nt, Coxiella burnetii RSA 493
cgcuuuccauuuuuu

SEQ ID NO: 2588802 - RNA, 23 nt, Coxiella burnetii RSA 493
cgcuuugggugggugagaagaau

SEQ ID NO: 2588803 - RNA, 22 nt, Coxiella burnetii RSA 493
cgcuuuuauuccuuuuuuuaau

SEQ ID NO: 2588804 - RNA, 21 nt, Coxiella burnetii RSA 493
cgcuuuuggcuacuuucucaa

SEQ ID NO: 2588805 - RNA, 17 nt, Coxiella burnetii RSA 493
cgcuuuuucccucucag

SEQ ID NO: 2588806 - RNA, 19 nt, Coxiella burnetii RSA 493
cgcuuuuuugcuucuucca

SEQ ID NO: 2588807 - RNA, 20 nt, Coxiella burnetii RSA 493
cgcuuuuuugcuucuuccaa

SEQ ID NO: 2588808 - RNA, 12 nt, Coxiella burnetii RSA 493
cggaaaaggaga

SEQ ID NO: 2588809 - RNA, 15 nt, Coxiella burnetii RSA 493
cggaaauuucgauuu

SEQ ID NO: 2588810 - RNA, 19 nt, Coxiella burnetii RSA 493
cggaacaccauucgcuaau

SEQ ID NO: 2588811 - RNA, 12 nt, Coxiella burnetii RSA 493
cggaauauaauu

SEQ ID NO: 2588812 - RNA, 13 nt, Coxiella burnetii RSA 493
cggaauugggaua

SEQ ID NO: 2588813 - RNA, 12 nt, Coxiella burnetii RSA 493
cggaauuugaua

SEQ ID NO: 2588814 - RNA, 23 nt, Coxiella burnetii RSA 493
cggaauuugugauuuuaaaaaua

SEQ ID NO: 2588815 - RNA, 18 nt, Coxiella burnetii RSA 493
cggaccguaagccgcccg

SEQ ID NO: 2588816 - RNA, 14 nt, Coxiella burnetii RSA 493
cggaccugcugccc

SEQ ID NO: 2588817 - RNA, 21 nt, Coxiella burnetii RSA 493
cggacgugaucgagaugagca

SEQ ID NO: 2588818 - RNA, 13 nt, Coxiella burnetii RSA 493
cggauaaucacgc

SEQ ID NO: 2588819 - RNA, 16 nt, Coxiella burnetii RSA 493
cggaucuaagucuauu

SEQ ID NO: 2588820 - RNA, 15 nt, Coxiella burnetii RSA 493
cggauguuuuuucac

SEQ ID NO: 2588821 - RNA, 19 nt, Coxiella burnetii RSA 493
cggauguuuuuucacuucu

SEQ ID NO: 2588822 - RNA, 19 nt, Coxiella burnetii RSA 493
cggauucucucgcucaaug

SEQ ID NO: 2588823 - RNA, 16 nt, Coxiella burnetii RSA 493
cggauuggcuuugccu

SEQ ID NO: 2588824 - RNA, 21 nt, Coxiella burnetii RSA 493
cggauuuuuucuucugaauua

SEQ ID NO: 2588825 - RNA, 13 nt, Coxiella burnetii RSA 493
cggcaucguuaaa

SEQ ID NO: 2588826 - RNA, 16 nt, Coxiella burnetii RSA 493
cggcauucaauggcgu

SEQ ID NO: 2588827 - RNA, 19 nt, Coxiella burnetii RSA 493
cggccgcugugccugccau

SEQ ID NO: 2588828 - RNA, 13 nt, Coxiella burnetii RSA 493
cggccuucauuau

SEQ ID NO: 2588829 - RNA, 15 nt, Coxiella burnetii RSA 493
cggcgaaauacagga

SEQ ID NO: 2588830 - RNA, 20 nt, Coxiella burnetii RSA 493
cggcgccaucgacaucucuc

SEQ ID NO: 2588831 - RNA, 12 nt, Coxiella burnetii RSA 493
cggcugcggcga

SEQ ID NO: 2588832 - RNA, 13 nt, Coxiella burnetii RSA 493
cggcuucacagag

SEQ ID NO: 2588833 - RNA, 14 nt, Coxiella burnetii RSA 493
cggcuucuaaguaa

SEQ ID NO: 2588834 - RNA, 22 nt, Coxiella burnetii RSA 493
cggcuugauuucaggcgccugc

SEQ ID NO: 2588835 - RNA, 21 nt, Coxiella burnetii RSA 493
cggcuuuauauguguaacaaa

SEQ ID NO: 2588836 - RNA, 17 nt, Coxiella burnetii RSA 493
cggcuuuugauuaacca

SEQ ID NO: 2588837 - RNA, 14 nt, Coxiella burnetii RSA 493
cggcuuuuuucgcu

SEQ ID NO: 2588838 - RNA, 15 nt, Coxiella burnetii RSA 493
cggcuuuuuucgcuu

SEQ ID NO: 2588839 - RNA, 13 nt, Coxiella burnetii RSA 493
cgggaaauaaaau

SEQ ID NO: 2588840 - RNA, 22 nt, Coxiella burnetii RSA 493
cgggaaccgccaaaagggaaca

SEQ ID NO: 2588841 - RNA, 21 nt, Coxiella burnetii RSA 493
cgggaaugacggaauuuguga

SEQ ID NO: 2588842 - RNA, 16 nt, Coxiella burnetii RSA 493
cgggaugauuuuuccc

SEQ ID NO: 2588843 - RNA, 15 nt, Coxiella burnetii RSA 493
cgggauucaauuuca

SEQ ID NO: 2588844 - RNA, 15 nt, Coxiella burnetii RSA 493
cgggcaucgaguuca

SEQ ID NO: 2588845 - RNA, 22 nt, Coxiella burnetii RSA 493
cgggcgggaugaccuccaacga

SEQ ID NO: 2588846 - RNA, 23 nt, Coxiella burnetii RSA 493
cgggcuacucuaauuuucuuucc

SEQ ID NO: 2588847 - RNA, 19 nt, Coxiella burnetii RSA 493
cggggaaauaaugacaauu

SEQ ID NO: 2588848 - RNA, 19 nt, Coxiella burnetii RSA 493
cguuucggauuuugaacag

SEQ ID NO: 2588849 - RNA, 21 nt, Coxiella burnetii RSA 493
cguuucgucgauauccaaaac

SEQ ID NO: 2588850 - RNA, 15 nt, Coxiella burnetii RSA 493
cguuucugauuuuug

SEQ ID NO: 2588851 - RNA, 18 nt, Coxiella burnetii RSA 493
cguuugagagguucagau

SEQ ID NO: 2588852 - RNA, 14 nt, Coxiella burnetii RSA 493
cguuugauuuucaa

SEQ ID NO: 2588853 - RNA, 19 nt, Coxiella burnetii RSA 493
cguuugcacauaagcgaau

SEQ ID NO: 2588854 - RNA, 23 nt, Coxiella burnetii RSA 493
cguuugguugguuugcaaaacua

SEQ ID NO: 2588855 - RNA, 20 nt, Coxiella burnetii RSA 493
cguuuuaauuccgccauuaa

SEQ ID NO: 2588856 - RNA, 15 nt, Coxiella burnetii RSA 493
cguuuugaaauuggu

SEQ ID NO: 2588857 - RNA, 11 nt, Coxiella burnetii RSA 493
cguuuuuaacc

SEQ ID NO: 2588858 - RNA, 22 nt, Coxiella burnetii RSA 493
cguuuuucauccagugaaaacc

SEQ ID NO: 2588859 - RNA, 11 nt, Coxiella burnetii RSA 493
cuaaaaaagaa

SEQ ID NO: 2588860 - RNA, 15 nt, Coxiella burnetii RSA 493
cuaaaaccuccugca

SEQ ID NO: 2588861 - RNA, 12 nt, Coxiella burnetii RSA 493
cuaaaacgacag

SEQ ID NO: 2588862 - RNA, 15 nt, Coxiella burnetii RSA 493
cuaaacaaaauaaua

SEQ ID NO: 2588863 - RNA, 17 nt, Coxiella burnetii RSA 493
cuaaacgugcgacuucu

SEQ ID NO: 2588864 - RNA, 21 nt, Coxiella burnetii RSA 493
cuaaagcaaaaguaauauuuc

SEQ ID NO: 2588865 - RNA, 20 nt, Coxiella burnetii RSA 493
cuaaagcgcgcuggauuccc

SEQ ID NO: 2588866 - RNA, 17 nt, Coxiella burnetii RSA 493
cuaaagggggaacgaac

SEQ ID NO: 2588867 - RNA, 13 nt, Coxiella burnetii RSA 493
cuaaagguaaaaa

SEQ ID NO: 2588868 - RNA, 14 nt, Coxiella burnetii RSA 493
cuaaagguaaaaag

SEQ ID NO: 2588869 - RNA, 17 nt, Coxiella burnetii RSA 493
cuaaaguacccaacaau

SEQ ID NO: 2588870 - RNA, 22 nt, Coxiella burnetii RSA 493
cuaaaguacccaacaauaaaac

SEQ ID NO: 2588871 - RNA, 21 nt, Coxiella burnetii RSA 493
cuaaauccagcgauuguaauu

SEQ ID NO: 2588872 - RNA, 21 nt, Coxiella burnetii RSA 493
cuaacaauuguugauuuaacu

SEQ ID NO: 2588873 - RNA, 14 nt, Coxiella burnetii RSA 493
cuaaccaagagugu

SEQ ID NO: 2588874 - RNA, 23 nt, Coxiella burnetii RSA 493
cuaaccccggaaaaucuuguuua

SEQ ID NO: 2588875 - RNA, 20 nt, Coxiella burnetii RSA 493
cuaacgcaaucggauuaacg

SEQ ID NO: 2588876 - RNA, 22 nt, Coxiella burnetii RSA 493
cuaacguuacuccgccccccca

SEQ ID NO: 2588877 - RNA, 14 nt, Coxiella burnetii RSA 493
cuaacuuugauaag

SEQ ID NO: 2588878 - RNA, 15 nt, Coxiella burnetii RSA 493
cuaagagcugucgcc

SEQ ID NO: 2588879 - RNA, 16 nt, Coxiella burnetii RSA 493
cuaagcauuaaaaaau

SEQ ID NO: 2588880 - RNA, 17 nt, Coxiella burnetii RSA 493
cuaagcauuaaaaaaua

SEQ ID NO: 2588881 - RNA, 18 nt, Coxiella burnetii RSA 493
cuaagcauuaaaaaauaa

SEQ ID NO: 2588882 - RNA, 19 nt, Coxiella burnetii RSA 493
cuaagcauuaaaaaauaag

SEQ ID NO: 2588883 - RNA, 23 nt, Coxiella burnetii RSA 493
cuaagcguaacgucacaaauaaa

SEQ ID NO: 2588884 - RNA, 19 nt, Coxiella burnetii RSA 493
cuaagcuaucagcaaucaa

SEQ ID NO: 2588885 - RNA, 23 nt, Coxiella burnetii RSA 493
cuaaguagucccugacguuuucc

SEQ ID NO: 2588886 - RNA, 15 nt, Coxiella burnetii RSA 493
cuaauaaaaauauua

SEQ ID NO: 2588887 - RNA, 17 nt, Coxiella burnetii RSA 493
cuaauaaaacaagauac

SEQ ID NO: 2588888 - RNA, 16 nt, Coxiella burnetii RSA 493
cuaauaacauugggau

SEQ ID NO: 2588889 - RNA, 23 nt, Coxiella burnetii RSA 493
cuaauaacauugggauauauuaa

SEQ ID NO: 2588890 - RNA, 20 nt, Coxiella burnetii RSA 493
cuaauaaucgauaauuacga

SEQ ID NO: 2588891 - RNA, 15 nt, Coxiella burnetii RSA 493
cuaauacuaaacaaa

SEQ ID NO: 2588892 - RNA, 20 nt, Coxiella burnetii RSA 493
cuaaucccgccccauuuuug

SEQ ID NO: 2588893 - RNA, 21 nt, Coxiella burnetii RSA 493
cuaaucggccuacuuuuucug

SEQ ID NO: 2588894 - RNA, 20 nt, Coxiella burnetii RSA 493
cuaaucgucgacaaaaagac

SEQ ID NO: 2588895 - RNA, 17 nt, Coxiella burnetii RSA 493
cuaaugagaaacgugag

SEQ ID NO: 2588896 - RNA, 18 nt, Coxiella burnetii RSA 493
cuaaugauugcucugacc

SEQ ID NO: 2588897 - RNA, 19 nt, Coxiella burnetii RSA 493
cuaaugcuuuuuuuacuuu

SEQ ID NO: 2588898 - RNA, 13 nt, Coxiella burnetii RSA 493
cuaauuaaauuac

SEQ ID NO: 2588899 - RNA, 18 nt, Coxiella burnetii RSA 493
cuaauuauaagacgcuuu

SEQ ID NO: 2588900 - RNA, 12 nt, Coxiella burnetii RSA 493
cuaauucuuuuu

SEQ ID NO: 2588901 - RNA, 13 nt, Coxiella burnetii RSA 493
cuaauucuuuuuu

SEQ ID NO: 2588902 - RNA, 15 nt, Coxiella burnetii RSA 493
cuaauucuuuuuuaa

SEQ ID NO: 2588903 - RNA, 11 nt, Coxiella burnetii RSA 493
cuaauuuaaug

SEQ ID NO: 2588904 - RNA, 15 nt, Coxiella burnetii RSA 493
cuaauuugaaaaacc

SEQ ID NO: 2588905 - RNA, 16 nt, Coxiella burnetii RSA 493
cuaauuugaaaaaccc

SEQ ID NO: 2588906 - RNA, 18 nt, Coxiella burnetii RSA 493
cuaauuugauuuuuuuug

SEQ ID NO: 2588907 - RNA, 20 nt, Coxiella burnetii RSA 493
cuaauuugauuuuuuuugcu

SEQ ID NO: 2588908 - RNA, 13 nt, Coxiella burnetii RSA 493
cuaauuuuccuuu

SEQ ID NO: 2588909 - RNA, 13 nt, Coxiella burnetii RSA 493
cuacaauaaacac

SEQ ID NO: 2588910 - RNA, 20 nt, Coxiella burnetii RSA 493
cuacacguuaaauagccaac

SEQ ID NO: 2588911 - RNA, 16 nt, Coxiella burnetii RSA 493
cuacacuauugaaguc

SEQ ID NO: 2588912 - RNA, 17 nt, Coxiella burnetii RSA 493
cuacacuuuuaaucaca

SEQ ID NO: 2588913 - RNA, 17 nt, Coxiella burnetii RSA 493
cuacauagcaaauaucu

SEQ ID NO: 2588914 - RNA, 20 nt, Coxiella burnetii RSA 493
cuacauagcaaauaucugcu

SEQ ID NO: 2588915 - RNA, 22 nt, Coxiella burnetii RSA 493
cuaccagcauccgggaauaguu

SEQ ID NO: 2588916 - RNA, 20 nt, Coxiella burnetii RSA 493
cuaccaugcuccucgguagc

SEQ ID NO: 2588917 - RNA, 15 nt, Coxiella burnetii RSA 493
cuaccguauuuaauc

SEQ ID NO: 2588918 - RNA, 17 nt, Coxiella burnetii RSA 493
cuaccucgcuuaaagca

SEQ ID NO: 2588919 - RNA, 15 nt, Coxiella burnetii RSA 493
cuaccugauaaaaua

SEQ ID NO: 2588920 - RNA, 21 nt, Coxiella burnetii RSA 493
cuaccuuccgucaauuuuucu

SEQ ID NO: 2588921 - RNA, 15 nt, Coxiella burnetii RSA 493
cuacgaauagccaau

SEQ ID NO: 2588922 - RNA, 13 nt, Coxiella burnetii RSA 493
cuacucuuuuucu

SEQ ID NO: 2588923 - RNA, 23 nt, Coxiella burnetii RSA 493
cuacucuuuuucuuagagagugg

SEQ ID NO: 2588924 - RNA, 19 nt, Coxiella burnetii RSA 493
cuacuuagcugauuucucu

SEQ ID NO: 2588925 - RNA, 15 nt, Coxiella burnetii RSA 493
cuacuugaaaaccua

SEQ ID NO: 2588926 - RNA, 16 nt, Coxiella burnetii RSA 493
cuacuugauauucccu

SEQ ID NO: 2588927 - RNA, 18 nt, Coxiella burnetii RSA 493
cuacuuguugaaaaccua

SEQ ID NO: 2588928 - RNA, 23 nt, Coxiella burnetii RSA 493
cuacuuuacuuguugaaaaccua

SEQ ID NO: 2588929 - RNA, 18 nt, Coxiella burnetii RSA 493
cuacuuucucaauuucuc

SEQ ID NO: 2588930 - RNA, 13 nt, Coxiella burnetii RSA 493
cuacuuuuucugc

SEQ ID NO: 2588931 - RNA, 15 nt, Coxiella burnetii RSA 493
cuagaaauauuagaa

SEQ ID NO: 2588932 - RNA, 22 nt, Coxiella burnetii RSA 493
cuagaaauauuagaaauaauac

SEQ ID NO: 2588933 - RNA, 15 nt, Coxiella burnetii RSA 493
cuagaaguauuucca

SEQ ID NO: 2588934 - RNA, 18 nt, Coxiella burnetii RSA 493
cuagaggcgggaauagcu

SEQ ID NO: 2588935 - RNA, 20 nt, Coxiella burnetii RSA 493
cuagcagagccgcaaucgac

SEQ ID NO: 2588936 - RNA, 14 nt, Coxiella burnetii RSA 493
cuagcaucaauaag

SEQ ID NO: 2588937 - RNA, 14 nt, Coxiella burnetii RSA 493
cuagccauuguuuu

SEQ ID NO: 2588938 - RNA, 20 nt, Coxiella burnetii RSA 493
cuagccgaauguuuaaauua

SEQ ID NO: 2588939 - RNA, 14 nt, Coxiella burnetii RSA 493
cuagcguugaaaac

SEQ ID NO: 2588940 - RNA, 16 nt, Coxiella burnetii RSA 493
cuagcuguuuuuucua

SEQ ID NO: 2588941 - RNA, 15 nt, Coxiella burnetii RSA 493
cuaggcccuguaucc

SEQ ID NO: 2588942 - RNA, 18 nt, Coxiella burnetii RSA 493
cuaggcuucgucauuucc

SEQ ID NO: 2588943 - RNA, 22 nt, Coxiella burnetii RSA 493
cuauaaaguaguugaaaaaucu

SEQ ID NO: 2588944 - RNA, 20 nt, Coxiella burnetii RSA 493
cuauaaauaacagcgaacau

SEQ ID NO: 2588945 - RNA, 14 nt, Coxiella burnetii RSA 493
cuauaaucauuuuu

SEQ ID NO: 2588946 - RNA, 13 nt, Coxiella burnetii RSA 493
cuauaauuagaua

SEQ ID NO: 2588947 - RNA, 16 nt, Coxiella burnetii RSA 493
cuauaccauacagaau

SEQ ID NO: 2588948 - RNA, 15 nt, Coxiella burnetii RSA 493
cuauaucuuuuaaau

SEQ ID NO: 2588949 - RNA, 20 nt, Coxiella burnetii RSA 493
cuaucagcaaucaaaugagc

SEQ ID NO: 2588950 - RNA, 19 nt, Coxiella burnetii RSA 493
cuauccagaaaccaaaagc

SEQ ID NO: 2588951 - RNA, 14 nt, Coxiella burnetii RSA 493
cuaucggcuucaca

SEQ ID NO: 2588952 - RNA, 21 nt, Coxiella burnetii RSA 493
cuaucguccccguauuucgcu

SEQ ID NO: 2588953 - RNA, 14 nt, Coxiella burnetii RSA 493
cugaaguccuuguu

SEQ ID NO: 2588954 - RNA, 15 nt, Coxiella burnetii RSA 493
cugaaguccuuguug

SEQ ID NO: 2588955 - RNA, 15 nt, Coxiella burnetii RSA 493
cugaaucacuucuuc

SEQ ID NO: 2588956 - RNA, 16 nt, Coxiella burnetii RSA 493
cugaaugagauaacuc

SEQ ID NO: 2588957 - RNA, 21 nt, Coxiella burnetii RSA 493
cugaauguuaauuauaaagaa

SEQ ID NO: 2588958 - RNA, 20 nt, Coxiella burnetii RSA 493
cugaauugaaguccuuauca

SEQ ID NO: 2588959 - RNA, 22 nt, Coxiella burnetii RSA 493
cugaauuuaugaaugcuggagu

SEQ ID NO: 2588960 - RNA, 15 nt, Coxiella burnetii RSA 493
cugacacccugaaca

SEQ ID NO: 2588961 - RNA, 20 nt, Coxiella burnetii RSA 493
cugacaguuggcuaaaucca

SEQ ID NO: 2588962 - RNA, 18 nt, Coxiella burnetii RSA 493
cugacguuaucacuugau

SEQ ID NO: 2588963 - RNA, 19 nt, Coxiella burnetii RSA 493
cugacuuccagauuuagua

SEQ ID NO: 2588964 - RNA, 23 nt, Coxiella burnetii RSA 493
cugacuuccagauuuaguaaagu

SEQ ID NO: 2588965 - RNA, 14 nt, Coxiella burnetii RSA 493
cugagauggccuua

SEQ ID NO: 2588966 - RNA, 18 nt, Coxiella burnetii RSA 493
cugagcaaacagcuagcc

SEQ ID NO: 2588967 - RNA, 19 nt, Coxiella burnetii RSA 493
cugagcgccuuuuuuaaau

SEQ ID NO: 2588968 - RNA, 11 nt, Coxiella burnetii RSA 493
cugagugucug

SEQ ID NO: 2588969 - RNA, 16 nt, Coxiella burnetii RSA 493
cugauacuucuucauu

SEQ ID NO: 2588970 - RNA, 19 nt, Coxiella burnetii RSA 493
cugauacuucuucauuaaa

SEQ ID NO: 2588971 - RNA, 14 nt, Coxiella burnetii RSA 493
cugauaguuaaaug

SEQ ID NO: 2588972 - RNA, 14 nt, Coxiella burnetii RSA 493
cugaucgauaaaaa

SEQ ID NO: 2588973 - RNA, 21 nt, Coxiella burnetii RSA 493
cugauguaaggcaucuuuuuc

SEQ ID NO: 2588974 - RNA, 20 nt, Coxiella burnetii RSA 493
cugauuggaguauaagcguu

SEQ ID NO: 2588975 - RNA, 16 nt, Coxiella burnetii RSA 493
cugauuucugguugaa

SEQ ID NO: 2588976 - RNA, 18 nt, Coxiella burnetii RSA 493
cugcaaccgacgaauaac

SEQ ID NO: 2588977 - RNA, 16 nt, Coxiella burnetii RSA 493
cugcaaucgcaucugc

SEQ ID NO: 2588978 - RNA, 22 nt, Coxiella burnetii RSA 493
cugcaauggcgguacgucauca

SEQ ID NO: 2588979 - RNA, 15 nt, Coxiella burnetii RSA 493
cugcaccauaacuaa

SEQ ID NO: 2588980 - RNA, 14 nt, Coxiella burnetii RSA 493
cugcacguaucuga

SEQ ID NO: 2588981 - RNA, 16 nt, Coxiella burnetii RSA 493
cugcagauuguaaauc

SEQ ID NO: 2588982 - RNA, 14 nt, Coxiella burnetii RSA 493
cugcauauauucca

SEQ ID NO: 2588983 - RNA, 12 nt, Coxiella burnetii RSA 493
cugcaugccaaa

SEQ ID NO: 2588984 - RNA, 14 nt, Coxiella burnetii RSA 493
cugccaccuuugau

SEQ ID NO: 2588985 - RNA, 22 nt, Coxiella burnetii RSA 493
cugccauuuguauggcgccuga

SEQ ID NO: 2588986 - RNA, 16 nt, Coxiella burnetii RSA 493
cugcgauuuuguuucu

SEQ ID NO: 2588987 - RNA, 14 nt, Coxiella burnetii RSA 493
cugcgcuaauuaac

SEQ ID NO: 2588988 - RNA, 17 nt, Coxiella burnetii RSA 493
cugcgcuccagaugaua

SEQ ID NO: 2588989 - RNA, 15 nt, Coxiella burnetii RSA 493
cugcggcgauucaug

SEQ ID NO: 2588990 - RNA, 22 nt, Coxiella burnetii RSA 493
cugcuaaaauaagguuaaaucc

SEQ ID NO: 2588991 - RNA, 22 nt, Coxiella burnetii RSA 493
cugcuaagguguucaaccgcau

SEQ ID NO: 2588992 - RNA, 19 nt, Coxiella burnetii RSA 493
cugcuaggauuuccuuuuc

SEQ ID NO: 2588993 - RNA, 16 nt, Coxiella burnetii RSA 493
cugcuaggauuuuuua

SEQ ID NO: 2588994 - RNA, 21 nt, Coxiella burnetii RSA 493
cugcugauugagaaucucuuc

SEQ ID NO: 2588995 - RNA, 23 nt, Coxiella burnetii RSA 493
cugcuguauaaacaguucaguuc

SEQ ID NO: 2588996 - RNA, 19 nt, Coxiella burnetii RSA 493
cugcuuccucuucuacugu

SEQ ID NO: 2588997 - RNA, 11 nt, Coxiella burnetii RSA 493
cugcuucuuua

SEQ ID NO: 2588998 - RNA, 19 nt, Coxiella burnetii RSA 493
cugcuuuugaauuuuuuga

SEQ ID NO: 2588999 - RNA, 14 nt, Coxiella burnetii RSA 493
cuggaaaaauaaau

SEQ ID NO: 2589000 - RNA, 15 nt, Coxiella burnetii RSA 493
cuggaaacuuuccug

SEQ ID NO: 2589001 - RNA, 22 nt, Coxiella burnetii RSA 493
cuggaagagaguaagucucugc

SEQ ID NO: 2589002 - RNA, 21 nt, Coxiella burnetii RSA 493
cuggauaagcauauugcaaua

SEQ ID NO: 2589003 - RNA, 18 nt, Coxiella burnetii RSA 493
cuggcauugaaaaucaau

SEQ ID NO: 2589004 - RNA, 22 nt, Coxiella burnetii RSA 493
cuggccugaucauaaagcgcuc

SEQ ID NO: 2589005 - RNA, 15 nt, Coxiella burnetii RSA 493
cuggcuaguaaauaa

SEQ ID NO: 2589006 - RNA, 15 nt, Coxiella burnetii RSA 493
cugggauaacgaauc

SEQ ID NO: 2589007 - RNA, 24 nt, Coxiella burnetii RSA 493
cugggaugguaaucucacuuggau

SEQ ID NO: 2589008 - RNA, 22 nt, Coxiella burnetii RSA 493
cuggugagacucaguggcagcu

SEQ ID NO: 2589009 - RNA, 14 nt, Coxiella burnetii RSA 493
cugguuuccuuucu

SEQ ID NO: 2589010 - RNA, 16 nt, Coxiella burnetii RSA 493
cugguuuccuuucuga

SEQ ID NO: 2589011 - RNA, 15 nt, Coxiella burnetii RSA 493
cuguaaaauaagaag

SEQ ID NO: 2589012 - RNA, 23 nt, Coxiella burnetii RSA 493
cuguaacuuuuccaucuccuuuu

SEQ ID NO: 2589013 - RNA, 11 nt, Coxiella burnetii RSA 493
cuguacuuuca

SEQ ID NO: 2589014 - RNA, 14 nt, Coxiella burnetii RSA 493
cuguauaaacaguu

SEQ ID NO: 2589015 - RNA, 15 nt, Coxiella burnetii RSA 493
cuguauaaacaguuc

SEQ ID NO: 2589016 - RNA, 15 nt, Coxiella burnetii RSA 493
cuguaucagcgcgga

SEQ ID NO: 2589017 - RNA, 18 nt, Coxiella burnetii RSA 493
cuguauuaacauuuggau

SEQ ID NO: 2589018 - RNA, 18 nt, Coxiella burnetii RSA 493
cugucaaacguccuucuc

SEQ ID NO: 2589019 - RNA, 21 nt, Coxiella burnetii RSA 493
cugucauauccauaucguuuu

SEQ ID NO: 2589020 - RNA, 18 nt, Coxiella burnetii RSA 493
cugucgauacccaaucaa

SEQ ID NO: 2589021 - RNA, 21 nt, Coxiella burnetii RSA 493
cugucgauacccaaucaauuc

SEQ ID NO: 2589022 - RNA, 22 nt, Coxiella burnetii RSA 493
cugucgcacgcgcaccaggggu

SEQ ID NO: 2589023 - RNA, 17 nt, Coxiella burnetii RSA 493
cugucguuucugauuuu

SEQ ID NO: 2589024 - RNA, 23 nt, Coxiella burnetii RSA 493
cugugcaucgguuagaguuaauu

SEQ ID NO: 2589025 - RNA, 19 nt, Coxiella burnetii RSA 493
cugugccacuuucgauaaa

SEQ ID NO: 2589026 - RNA, 16 nt, Coxiella burnetii RSA 493
cugugcggauuaaaua

SEQ ID NO: 2589027 - RNA, 20 nt, Coxiella burnetii RSA 493
cuguggcaauuaugaaaacg

SEQ ID NO: 2589028 - RNA, 14 nt, Coxiella burnetii RSA 493
cugugguuaauucu

SEQ ID NO: 2589029 - RNA, 20 nt, Coxiella burnetii RSA 493
cugugguuaauucuucuuca

SEQ ID NO: 2589030 - RNA, 16 nt, Coxiella burnetii RSA 493
cuguguccuaaaauga

SEQ ID NO: 2589031 - RNA, 18 nt, Coxiella burnetii RSA 493
cuguguccugcuuuugca

SEQ ID NO: 2589032 - RNA, 20 nt, Coxiella burnetii RSA 493
cuguguuccuuacucccgaa

SEQ ID NO: 2589033 - RNA, 22 nt, Coxiella burnetii RSA 493
cuguguugggcucgaaaaacuu

SEQ ID NO: 2589034 - RNA, 18 nt, Coxiella burnetii RSA 493
cuguucgccagaaacaac

SEQ ID NO: 2589035 - RNA, 21 nt, Coxiella burnetii RSA 493
cuguucuuuuuccauguuuac

SEQ ID NO: 2589036 - RNA, 20 nt, Coxiella burnetii RSA 493
cuguugauacuaaauuagua

SEQ ID NO: 2589037 - RNA, 19 nt, Coxiella burnetii RSA 493
cuguuucuuuuagagccuc

SEQ ID NO: 2589038 - RNA, 18 nt, Coxiella burnetii RSA 493
cuguuuucguaaucuuua

SEQ ID NO: 2589039 - RNA, 12 nt, Coxiella burnetii RSA 493
cuuaaagcaacg

SEQ ID NO: 2589040 - RNA, 22 nt, Coxiella burnetii RSA 493
cuuaaauaguagcuauaagcaa

SEQ ID NO: 2589041 - RNA, 15 nt, Coxiella burnetii RSA 493
cuuaacgccuaucuu

SEQ ID NO: 2589042 - RNA, 20 nt, Coxiella burnetii RSA 493
cuuaacuccuucgcuuuuuc

SEQ ID NO: 2589043 - RNA, 22 nt, Coxiella burnetii RSA 493
cuuaacuccuucgcuuuuucca

SEQ ID NO: 2589044 - RNA, 9 nt, Coxiella burnetii RSA 493
cuuaacuuc

SEQ ID NO: 2589045 - RNA, 23 nt, Coxiella burnetii RSA 493
cuuaagaaaguauccuccgaaua

SEQ ID NO: 2589046 - RNA, 23 nt, Coxiella burnetii RSA 493
cuuaagagauaagcuguuucuuu

SEQ ID NO: 2589047 - RNA, 23 nt, Coxiella burnetii RSA 493
cuuaagagauagugcuauuuuuc

SEQ ID NO: 2589048 - RNA, 15 nt, Coxiella burnetii RSA 493
cuuaaggacaguugg

SEQ ID NO: 2589049 - RNA, 20 nt, Coxiella burnetii RSA 493
cuuaauacccguuucuuauu

SEQ ID NO: 2589050 - RNA, 21 nt, Coxiella burnetii RSA 493
cuuaauacccguuucuuauuc

SEQ ID NO: 2589051 - RNA, 17 nt, Coxiella burnetii RSA 493
cuuaauuucuaaaaauc

SEQ ID NO: 2589052 - RNA, 18 nt, Coxiella burnetii RSA 493
cuuaauuucuaaaaauca

SEQ ID NO: 2589053 - RNA, 16 nt, Coxiella burnetii RSA 493
cuuaauuuuaaaaaac

SEQ ID NO: 2589054 - RNA, 18 nt, Coxiella burnetii RSA 493
cuuaauuuuaaaaaaccc

SEQ ID NO: 2589055 - RNA, 13 nt, Coxiella burnetii RSA 493
cuuaauuuuuccu

SEQ ID NO: 2589056 - RNA, 17 nt, Coxiella burnetii RSA 493
cuuaauuuuuccuuucu

SEQ ID NO: 2589057 - RNA, 23 nt, Coxiella burnetii RSA 493
cuuagcgcuaaugagaaacguga

SEQ ID NO: 2589058 - RNA, 17 nt, Coxiella burnetii RSA 493
cuuuacgcgcuucuuuu

SEQ ID NO: 2589059 - RNA, 16 nt, Coxiella burnetii RSA 493
cuuuacuuguugaaaa

SEQ ID NO: 2589060 - RNA, 19 nt, Coxiella burnetii RSA 493
cuuuagauucaugaaaauc

SEQ ID NO: 2589061 - RNA, 15 nt, Coxiella burnetii RSA 493
cuuuaguuuuucccu

SEQ ID NO: 2589062 - RNA, 14 nt, Coxiella burnetii RSA 493
cuuuauaguucauu

SEQ ID NO: 2589063 - RNA, 12 nt, Coxiella burnetii RSA 493
cuuuauuacccu

SEQ ID NO: 2589064 - RNA, 14 nt, Coxiella burnetii RSA 493
cuuucaacauauuu

SEQ ID NO: 2589065 - RNA, 17 nt, Coxiella burnetii RSA 493
cuuucaauaaacccguu

SEQ ID NO: 2589066 - RNA, 15 nt, Coxiella burnetii RSA 493
cuuucaauaaauaaa

SEQ ID NO: 2589067 - RNA, 15 nt, Coxiella burnetii RSA 493
cuuucaauuacuuuu

SEQ ID NO: 2589068 - RNA, 16 nt, Coxiella burnetii RSA 493
cuuucacaauuugaug

SEQ ID NO: 2589069 - RNA, 20 nt, Coxiella burnetii RSA 493
cuuucaggaaggugcguccc

SEQ ID NO: 2589070 - RNA, 22 nt, Coxiella burnetii RSA 493
cuuucaucaaaucaauaaucau

SEQ ID NO: 2589071 - RNA, 21 nt, Coxiella burnetii RSA 493
cuuucauguaauuuaucccac

SEQ ID NO: 2589072 - RNA, 15 nt, Coxiella burnetii RSA 493
cuuucauuaauucca

SEQ ID NO: 2589073 - RNA, 15 nt, Coxiella burnetii RSA 493
cuuucauuacuuggc

SEQ ID NO: 2589074 - RNA, 18 nt, Coxiella burnetii RSA 493
cuuucauuuaauuuuaaa

SEQ ID NO: 2589075 - RNA, 23 nt, Coxiella burnetii RSA 493
cuuuccaaacuacucucaaaauc

SEQ ID NO: 2589076 - RNA, 17 nt, Coxiella burnetii RSA 493
cuuucccuccacggaau

SEQ ID NO: 2589077 - RNA, 17 nt, Coxiella burnetii RSA 493
cuuuccuguuuuuccuc

SEQ ID NO: 2589078 - RNA, 13 nt, Coxiella burnetii RSA 493
cuuucgauaaauu

SEQ ID NO: 2589079 - RNA, 16 nt, Coxiella burnetii RSA 493
cuuucgauaaauuuug

SEQ ID NO: 2589080 - RNA, 20 nt, Coxiella burnetii RSA 493
cuuucgauaaauuuugaauc

SEQ ID NO: 2589081 - RNA, 14 nt, Coxiella burnetii RSA 493
cuuucgucauuccc

SEQ ID NO: 2589082 - RNA, 14 nt, Coxiella burnetii RSA 493
cuuucucaauuucu

SEQ ID NO: 2589083 - RNA, 14 nt, Coxiella burnetii RSA 493
cuuucucgcuuaau

SEQ ID NO: 2589084 - RNA, 23 nt, Coxiella burnetii RSA 493
cuuucugauuuuacgcuauuuuu

SEQ ID NO: 2589085 - RNA, 13 nt, Coxiella burnetii RSA 493
cuuucuucacuuu

SEQ ID NO: 2589086 - RNA, 14 nt, Coxiella burnetii RSA 493
cuuucuucacuuuc

SEQ ID NO: 2589087 - RNA, 20 nt, Coxiella burnetii RSA 493
cuuucuuuuaauucauaaau

SEQ ID NO: 2589088 - RNA, 15 nt, Coxiella burnetii RSA 493
cuuucuuuucuucug

SEQ ID NO: 2589089 - RNA, 13 nt, Coxiella burnetii RSA 493
cuuugaaccacua

SEQ ID NO: 2589090 - RNA, 17 nt, Coxiella burnetii RSA 493
cuuugacauaucauucc

SEQ ID NO: 2589091 - RNA, 20 nt, Coxiella burnetii RSA 493
cuuugauaagcauaauucau

SEQ ID NO: 2589092 - RNA, 15 nt, Coxiella burnetii RSA 493
cuuugcuaagauaau

SEQ ID NO: 2589093 - RNA, 16 nt, Coxiella burnetii RSA 493
cuuugcuaagauaauu

SEQ ID NO: 2589094 - RNA, 22 nt, Coxiella burnetii RSA 493
cuuugcuaagauaauuacaauc

SEQ ID NO: 2589095 - RNA, 13 nt, Coxiella burnetii RSA 493
cuuugcuuuaacu

SEQ ID NO: 2589096 - RNA, 15 nt, Coxiella burnetii RSA 493
cuuuggguuggcuuu

SEQ ID NO: 2589097 - RNA, 21 nt, Coxiella burnetii RSA 493
cuuuggguuggcuuuugacaa

SEQ ID NO: 2589098 - RNA, 13 nt, Coxiella burnetii RSA 493
cuuugguggcuuu

SEQ ID NO: 2589099 - RNA, 13 nt, Coxiella burnetii RSA 493
cuuugguuaugga

SEQ ID NO: 2589100 - RNA, 16 nt, Coxiella burnetii RSA 493
cuuugguuccacccgc

SEQ ID NO: 2589101 - RNA, 12 nt, Coxiella burnetii RSA 493
cuuuguuuuuuu

SEQ ID NO: 2589102 - RNA, 12 nt, Coxiella burnetii RSA 493
cuuuuaaauaag

SEQ ID NO: 2589103 - RNA, 22 nt, Coxiella burnetii RSA 493
cuuuuaaccacagacucuuuuu

SEQ ID NO: 2589104 - RNA, 21 nt, Coxiella burnetii RSA 493
cuuuuagcgaccaccauguga

SEQ ID NO: 2589105 - RNA, 19 nt, Coxiella burnetii RSA 493
cuuuuagcucauugaaauc

SEQ ID NO: 2589106 - RNA, 15 nt, Coxiella burnetii RSA 493
cuuuuauaaaaccug

SEQ ID NO: 2589107 - RNA, 20 nt, Coxiella burnetii RSA 493
cuuuuauacccaaaaaccca

SEQ ID NO: 2589108 - RNA, 23 nt, Coxiella burnetii RSA 493
cuuuuaugaaagaguauuuuuuu

SEQ ID NO: 2589109 - RNA, 20 nt, Coxiella burnetii RSA 493
cuuuuaugucguucaauucu

SEQ ID NO: 2589110 - RNA, 16 nt, Coxiella burnetii RSA 493
cuuuuauuucacguaa

SEQ ID NO: 2589111 - RNA, 22 nt, Coxiella burnetii RSA 493
cuuuucauuaagcaauuuuuua

SEQ ID NO: 2589112 - RNA, 14 nt, Coxiella burnetii RSA 493
cuuuucauuuugau

SEQ ID NO: 2589113 - RNA, 16 nt, Coxiella burnetii RSA 493
cuuuuccgugguuuaa

SEQ ID NO: 2589114 - RNA, 20 nt, Coxiella burnetii RSA 493
cuuuucggagaaaucuuuuu

SEQ ID NO: 2589115 - RNA, 21 nt, Coxiella burnetii RSA 493
cuuuucggagaaaucuuuuuu

SEQ ID NO: 2589116 - RNA, 16 nt, Coxiella burnetii RSA 493
cuuuucguaaaccuuu

SEQ ID NO: 2589117 - RNA, 20 nt, Coxiella burnetii RSA 493
cuuuucguucugaaauuuua

SEQ ID NO: 2589118 - RNA, 12 nt, Coxiella burnetii RSA 493
cuuuucuaaaua

SEQ ID NO: 2589119 - RNA, 22 nt, Coxiella burnetii RSA 493
cuuuucuaagacuaagaauaag

SEQ ID NO: 2589120 - RNA, 12 nt, Coxiella burnetii RSA 493
cuuuucuauuug

SEQ ID NO: 2589121 - RNA, 13 nt, Coxiella burnetii RSA 493
cuuuucuauuuuu

SEQ ID NO: 2589122 - RNA, 16 nt, Coxiella burnetii RSA 493
cuuuucuauuuuuuug

SEQ ID NO: 2589123 - RNA, 20 nt, Coxiella burnetii RSA 493
cuuuucucaacgcuucagaa

SEQ ID NO: 2589124 - RNA, 19 nt, Coxiella burnetii RSA 493
cuuuucuucuggcaaagcc

SEQ ID NO: 2589125 - RNA, 14 nt, Coxiella burnetii RSA 493
cuuuucuuucauua

SEQ ID NO: 2589126 - RNA, 18 nt, Coxiella burnetii RSA 493
cuuuugaauuccaaaccg

SEQ ID NO: 2589127 - RNA, 13 nt, Coxiella burnetii RSA 493
cuuuugcaaaccg

SEQ ID NO: 2589128 - RNA, 21 nt, Coxiella burnetii RSA 493
cuuuugccggaguuaacagcu

SEQ ID NO: 2589129 - RNA, 19 nt, Coxiella burnetii RSA 493
cuuuugccuuggagcucuu

SEQ ID NO: 2589130 - RNA, 23 nt, Coxiella burnetii RSA 493
cuuuugcgcuuauagcuuguucc

SEQ ID NO: 2589131 - RNA, 19 nt, Coxiella burnetii RSA 493
cuuuuggaagcggauaaau

SEQ ID NO: 2589132 - RNA, 16 nt, Coxiella burnetii RSA 493
cuuuuggcauuguucu

SEQ ID NO: 2589133 - RNA, 23 nt, Coxiella burnetii RSA 493
cuuuugugcgucuucugccucca

SEQ ID NO: 2589134 - RNA, 22 nt, Coxiella burnetii RSA 493
cuuuuuaaaaaauuccuucucc

SEQ ID NO: 2589135 - RNA, 19 nt, Coxiella burnetii RSA 493
cuuuuucauuucuucgagu

SEQ ID NO: 2589136 - RNA, 16 nt, Coxiella burnetii RSA 493
cuuuuucgauuuuuuu

SEQ ID NO: 2589137 - RNA, 22 nt, Coxiella burnetii RSA 493
cuuuuucuuucacuaaaagaac

SEQ ID NO: 2589138 - RNA, 19 nt, Coxiella burnetii RSA 493
cuuuuuuccuucguuucuu

SEQ ID NO: 2589139 - RNA, 15 nt, Coxiella burnetii RSA 493
cuuuuuugcaacuuc

SEQ ID NO: 2589140 - RNA, 15 nt, Coxiella burnetii RSA 493
cuuuuuuuucuucuu

SEQ ID NO: 2589141 - RNA, 17 nt, Coxiella burnetii RSA 493
cuuuuuuuucuucuuuu

SEQ ID NO: 2589142 - RNA, 13 nt, Coxiella burnetii RSA 493
cuuuuuuuugaaa

SEQ ID NO: 2589143 - RNA, 18 nt, Coxiella burnetii RSA 493
gaaaaaaaaccaaugaaa

SEQ ID NO: 2589144 - RNA, 13 nt, Coxiella burnetii RSA 493
gaaaaaauuaaau

SEQ ID NO: 2589145 - RNA, 19 nt, Coxiella burnetii RSA 493
gaaaaagcgauuccaaagc

SEQ ID NO: 2589146 - RNA, 20 nt, Coxiella burnetii RSA 493
gaaaaagcggauaagccauu

SEQ ID NO: 2589147 - RNA, 15 nt, Coxiella burnetii RSA 493
gaaaaauaaaaggag

SEQ ID NO: 2589148 - RNA, 11 nt, Coxiella burnetii RSA 493
gaaaaauaauu

SEQ ID NO: 2589149 - RNA, 21 nt, Coxiella burnetii RSA 493
gaaaaccgcagcucaaacaaa

SEQ ID NO: 2589150 - RNA, 22 nt, Coxiella burnetii RSA 493
gaaaaccuacacuuuuaaucac

SEQ ID NO: 2589151 - RNA, 23 nt, Coxiella burnetii RSA 493
gaaaacgauagucucuauaucuu

SEQ ID NO: 2589152 - RNA, 20 nt, Coxiella burnetii RSA 493
gaaaacuaguuauuuuuaaa

SEQ ID NO: 2589153 - RNA, 22 nt, Coxiella burnetii RSA 493
gaaaacuuucaggaaggugcgu

SEQ ID NO: 2589154 - RNA, 17 nt, Coxiella burnetii RSA 493
gaaaaggaaauguaaaa

SEQ ID NO: 2589155 - RNA, 11 nt, Coxiella burnetii RSA 493
gaaaauccaua

SEQ ID NO: 2589156 - RNA, 17 nt, Coxiella burnetii RSA 493
gaaaaucgauggaagaa

SEQ ID NO: 2589157 - RNA, 17 nt, Coxiella burnetii RSA 493
gaaaaugauuucauccu

SEQ ID NO: 2589158 - RNA, 21 nt, Coxiella burnetii RSA 493
gaaaaugcucgcgaaauuuaa

SEQ ID NO: 2589159 - RNA, 23 nt, Coxiella burnetii RSA 493
gaaaauugauuagcaucuugaau

SEQ ID NO: 2589160 - RNA, 23 nt, Coxiella burnetii RSA 493
gaaacaacuaccugauaaaauaa

SEQ ID NO: 2589161 - RNA, 20 nt, Coxiella burnetii RSA 493
gaaaccaaaagcaccccgug

SEQ ID NO: 2589162 - RNA, 16 nt, Coxiella burnetii RSA 493
gaaaccuuguuauaaa

SEQ ID NO: 2589163 - RNA, 18 nt, Coxiella burnetii RSA 493
gaauuagagguucaucgc

SEQ ID NO: 2589164 - RNA, 14 nt, Coxiella burnetii RSA 493
gaauucauaaucaa

SEQ ID NO: 2589165 - RNA, 20 nt, Coxiella burnetii RSA 493
gaauugccaauccuuaacgu

SEQ ID NO: 2589166 - RNA, 23 nt, Coxiella burnetii RSA 493
gaauugggcgcacucaaccagaa

SEQ ID NO: 2589167 - RNA, 21 nt, Coxiella burnetii RSA 493
gaauuugagaacguuucccaa

SEQ ID NO: 2589168 - RNA, 19 nt, Coxiella burnetii RSA 493
gaauuugcgcuugcguaaa

SEQ ID NO: 2589169 - RNA, 19 nt, Coxiella burnetii RSA 493
gaauuuuaacaagcuggca

SEQ ID NO: 2589170 - RNA, 16 nt, Coxiella burnetii RSA 493
gacaaaaauaucccuu

SEQ ID NO: 2589171 - RNA, 19 nt, Coxiella burnetii RSA 493
gacaaagguacgaaccacu

SEQ ID NO: 2589172 - RNA, 18 nt, Coxiella burnetii RSA 493
gacaaauaaacaaguuaa

SEQ ID NO: 2589173 - RNA, 14 nt, Coxiella burnetii RSA 493
gacaaauaaagaau

SEQ ID NO: 2589174 - RNA, 19 nt, Coxiella burnetii RSA 493
gacaaauguauuuaucauc

SEQ ID NO: 2589175 - RNA, 21 nt, Coxiella burnetii RSA 493
gacaagaauuuuuuuauaauu

SEQ ID NO: 2589176 - RNA, 23 nt, Coxiella burnetii RSA 493
gacaagcagggcaguaaauagaa

SEQ ID NO: 2589177 - RNA, 21 nt, Coxiella burnetii RSA 493
gacaagccccuuuaaugcauu

SEQ ID NO: 2589178 - RNA, 15 nt, Coxiella burnetii RSA 493
gacaauagaauaaug

SEQ ID NO: 2589179 - RNA, 20 nt, Coxiella burnetii RSA 493
gacaauagggcggcaaucag

SEQ ID NO: 2589180 - RNA, 23 nt, Coxiella burnetii RSA 493
gacaaugcuuucuuuuaauucau

SEQ ID NO: 2589181 - RNA, 16 nt, Coxiella burnetii RSA 493
gacaauucccccaaaa

SEQ ID NO: 2589182 - RNA, 17 nt, Coxiella burnetii RSA 493
gacacaugggacaaggc

SEQ ID NO: 2589183 - RNA, 22 nt, Coxiella burnetii RSA 493
gacacccugaacauuaagaaag

SEQ ID NO: 2589184 - RNA, 23 nt, Coxiella burnetii RSA 493
gacacccugaacauuaagaaagc

SEQ ID NO: 2589185 - RNA, 22 nt, Coxiella burnetii RSA 493
gacagaaaaagcggauaagcca

SEQ ID NO: 2589186 - RNA, 24 nt, Coxiella burnetii RSA 493
gacagaaaaagcggauaagccauu

SEQ ID NO: 2589187 - RNA, 15 nt, Coxiella burnetii RSA 493
gacagaaggcagagg

SEQ ID NO: 2589188 - RNA, 18 nt, Coxiella burnetii RSA 493
gacaguuggcuaaaucca

SEQ ID NO: 2589189 - RNA, 20 nt, Coxiella burnetii RSA 493
gacaguuggcuaaauccagc

SEQ ID NO: 2589190 - RNA, 23 nt, Coxiella burnetii RSA 493
gacauauucgcuccauuguuucg

SEQ ID NO: 2589191 - RNA, 14 nt, Coxiella burnetii RSA 493
gacaucauuguuuu

SEQ ID NO: 2589192 - RNA, 17 nt, Coxiella burnetii RSA 493
gacaucggcuuuuucaa

SEQ ID NO: 2589193 - RNA, 14 nt, Coxiella burnetii RSA 493
gacaucguuguuuu

SEQ ID NO: 2589194 - RNA, 18 nt, Coxiella burnetii RSA 493
gacauuguucauaaaaua

SEQ ID NO: 2589195 - RNA, 20 nt, Coxiella burnetii RSA 493
gacauuguucauaaaauaau

SEQ ID NO: 2589196 - RNA, 18 nt, Coxiella burnetii RSA 493
gaccaaaugcgacaauca

SEQ ID NO: 2589197 - RNA, 16 nt, Coxiella burnetii RSA 493
gaccaaggguauuuuu

SEQ ID NO: 2589198 - RNA, 17 nt, Coxiella burnetii RSA 493
gaccaaggguauuuuuu

SEQ ID NO: 2589199 - RNA, 19 nt, Coxiella burnetii RSA 493
gaccaaucguaaagaucau

SEQ ID NO: 2589200 - RNA, 21 nt, Coxiella burnetii RSA 493
gacccagccgaccaaggguau

SEQ ID NO: 2589201 - RNA, 22 nt, Coxiella burnetii RSA 493
gaccccaaugcuccgcguuuuu

SEQ ID NO: 2589202 - RNA, 22 nt, Coxiella burnetii RSA 493
gacccucuuuuuaaaaaauucc

SEQ ID NO: 2589203 - RNA, 15 nt, Coxiella burnetii RSA 493
gaccgagaauuaaug

SEQ ID NO: 2589204 - RNA, 15 nt, Coxiella burnetii RSA 493
gaccgcuaaagcaaa

SEQ ID NO: 2589205 - RNA, 19 nt, Coxiella burnetii RSA 493
gaccgcugauaaugcgcga

SEQ ID NO: 2589206 - RNA, 20 nt, Coxiella burnetii RSA 493
gaccuccaacgaggcacugc

SEQ ID NO: 2589207 - RNA, 16 nt, Coxiella burnetii RSA 493
gaccuuugcgcuguca

SEQ ID NO: 2589208 - RNA, 18 nt, Coxiella burnetii RSA 493
gacgacaucguuguuuuc

SEQ ID NO: 2589209 - RNA, 16 nt, Coxiella burnetii RSA 493
gacgacauuaaaaaug

SEQ ID NO: 2589210 - RNA, 17 nt, Coxiella burnetii RSA 493
gacgaccgcggcagcag

SEQ ID NO: 2589211 - RNA, 15 nt, Coxiella burnetii RSA 493
gacgacgaugccaaa

SEQ ID NO: 2589212 - RNA, 16 nt, Coxiella burnetii RSA 493
gacgacggguuuuaag

SEQ ID NO: 2589213 - RNA, 16 nt, Coxiella burnetii RSA 493
gacgaggaaagauaag

SEQ ID NO: 2589214 - RNA, 21 nt, Coxiella burnetii RSA 493
gacgauuaacaacgaaaccuu

SEQ ID NO: 2589215 - RNA, 20 nt, Coxiella burnetii RSA 493
gacgauuuuaauuuuuucuc

SEQ ID NO: 2589216 - RNA, 17 nt, Coxiella burnetii RSA 493
gacgcagaugcccauuc

SEQ ID NO: 2589217 - RNA, 20 nt, Coxiella burnetii RSA 493
gacgcauggauuaaacccgc

SEQ ID NO: 2589218 - RNA, 15 nt, Coxiella burnetii RSA 493
gacgcuaguuuuuaa

SEQ ID NO: 2589219 - RNA, 15 nt, Coxiella burnetii RSA 493
gacggaauuugugau

SEQ ID NO: 2589220 - RNA, 20 nt, Coxiella burnetii RSA 493
gacggaauuugugauuuuaa

SEQ ID NO: 2589221 - RNA, 17 nt, Coxiella burnetii RSA 493
gacgggagguuaaaaug

SEQ ID NO: 2589222 - RNA, 12 nt, Coxiella burnetii RSA 493
gacguuuuccac

SEQ ID NO: 2589223 - RNA, 12 nt, Coxiella burnetii RSA 493
gacuaaaauaaa

SEQ ID NO: 2589224 - RNA, 19 nt, Coxiella burnetii RSA 493
gacuaaaaugcuucauacc

SEQ ID NO: 2589225 - RNA, 19 nt, Coxiella burnetii RSA 493
gacuacgcauucagaaaau

SEQ ID NO: 2589226 - RNA, 18 nt, Coxiella burnetii RSA 493
gacuagucaacaaacgaa

SEQ ID NO: 2589227 - RNA, 21 nt, Coxiella burnetii RSA 493
gacucaguggcagcuucuuua

SEQ ID NO: 2589228 - RNA, 23 nt, Coxiella burnetii RSA 493
gacucguuucggauuuugaacag

SEQ ID NO: 2589229 - RNA, 20 nt, Coxiella burnetii RSA 493
gacucugcgauuguuuucuu

SEQ ID NO: 2589230 - RNA, 21 nt, Coxiella burnetii RSA 493
gacucugcgauuguuuucuua

SEQ ID NO: 2589231 - RNA, 20 nt, Coxiella burnetii RSA 493
gacugauaacuauuauuaaa

SEQ ID NO: 2589232 - RNA, 21 nt, Coxiella burnetii RSA 493
gacuuauuuguugaacagagu

SEQ ID NO: 2589233 - RNA, 12 nt, Coxiella burnetii RSA 493
gacuuauuuuua

SEQ ID NO: 2589234 - RNA, 17 nt, Coxiella burnetii RSA 493
gacuuauuuuuauucuu

SEQ ID NO: 2589235 - RNA, 16 nt, Coxiella burnetii RSA 493
gacuucgcuaaauaac

SEQ ID NO: 2589236 - RNA, 15 nt, Coxiella burnetii RSA 493
gacuucuaguuuuuc

SEQ ID NO: 2589237 - RNA, 17 nt, Coxiella burnetii RSA 493
gacuucuaguuuuucaa

SEQ ID NO: 2589238 - RNA, 15 nt, Coxiella burnetii RSA 493
gacuugcuuuuuucu

SEQ ID NO: 2589239 - RNA, 17 nt, Coxiella burnetii RSA 493
gagaaagcauuaccauu

SEQ ID NO: 2589240 - RNA, 16 nt, Coxiella burnetii RSA 493
gagaaauugacaaaua

SEQ ID NO: 2589241 - RNA, 21 nt, Coxiella burnetii RSA 493
gagaaauugcgcguaaaauuc

SEQ ID NO: 2589242 - RNA, 23 nt, Coxiella burnetii RSA 493
gagaaauugcgcguaaaauucca

SEQ ID NO: 2589243 - RNA, 21 nt, Coxiella burnetii RSA 493
gagaacguuucccaaggaauc

SEQ ID NO: 2589244 - RNA, 13 nt, Coxiella burnetii RSA 493
gagaauuaaaaau

SEQ ID NO: 2589245 - RNA, 18 nt, Coxiella burnetii RSA 493
gagacugcuuuagauacu

SEQ ID NO: 2589246 - RNA, 21 nt, Coxiella burnetii RSA 493
gagagaauuuucauggcauaa

SEQ ID NO: 2589247 - RNA, 18 nt, Coxiella burnetii RSA 493
gagaggaugcagcuucgu

SEQ ID NO: 2589248 - RNA, 24 nt, Coxiella burnetii RSA 493
gagaguaacgauuucucuuaccau

SEQ ID NO: 2589249 - RNA, 14 nt, Coxiella burnetii RSA 493
gagaguagauaacg

SEQ ID NO: 2589250 - RNA, 17 nt, Coxiella burnetii RSA 493
gagauaggacuuuucuc

SEQ ID NO: 2589251 - RNA, 22 nt, Coxiella burnetii RSA 493
gagcaaucaaaacagcaauuaa

SEQ ID NO: 2589252 - RNA, 23 nt, Coxiella burnetii RSA 493
gagcacgggaugauuuuucccaa

SEQ ID NO: 2589253 - RNA, 19 nt, Coxiella burnetii RSA 493
gagcaguugaacagcgcga

SEQ ID NO: 2589254 - RNA, 15 nt, Coxiella burnetii RSA 493
gagcauauaaaaguu

SEQ ID NO: 2589255 - RNA, 20 nt, Coxiella burnetii RSA 493
gagcaucuuuucugaaacau

SEQ ID NO: 2589256 - RNA, 17 nt, Coxiella burnetii RSA 493
gagcccaauaacaagcu

SEQ ID NO: 2589257 - RNA, 19 nt, Coxiella burnetii RSA 493
gagccgaucgcugugaaaa

SEQ ID NO: 2589258 - RNA, 14 nt, Coxiella burnetii RSA 493
gagcgaagcgaaau

SEQ ID NO: 2589259 - RNA, 20 nt, Coxiella burnetii RSA 493
gagcgaagcgaaauacgggg

SEQ ID NO: 2589260 - RNA, 16 nt, Coxiella burnetii RSA 493
gagcgacuuuuuucuu

SEQ ID NO: 2589261 - RNA, 14 nt, Coxiella burnetii RSA 493
gagcgauaaaauaa

SEQ ID NO: 2589262 - RNA, 11 nt, Coxiella burnetii RSA 493
gagcgggaauu

SEQ ID NO: 2589263 - RNA, 13 nt, Coxiella burnetii RSA 493
gagcguaaaacac

SEQ ID NO: 2589264 - RNA, 19 nt, Coxiella burnetii RSA 493
gagcucauugccaaagaaa

SEQ ID NO: 2589265 - RNA, 20 nt, Coxiella burnetii RSA 493
gagcucauugccaaagaaau

SEQ ID NO: 2589266 - RNA, 12 nt, Coxiella burnetii RSA 493
gaggacagaagg

SEQ ID NO: 2589267 - RNA, 15 nt, Coxiella burnetii RSA 493
gaucgcauugaagua

SEQ ID NO: 2589268 - RNA, 18 nt, Coxiella burnetii RSA 493
gaucgcccacuuguaaug

SEQ ID NO: 2589269 - RNA, 19 nt, Coxiella burnetii RSA 493
gaucgcccauauucaacac

SEQ ID NO: 2589270 - RNA, 12 nt, Coxiella burnetii RSA 493
gaucgcuguauu

SEQ ID NO: 2589271 - RNA, 17 nt, Coxiella burnetii RSA 493
gaucggcggcucauugu

SEQ ID NO: 2589272 - RNA, 21 nt, Coxiella burnetii RSA 493
gaucguuucugguuuccuuuc

SEQ ID NO: 2589273 - RNA, 12 nt, Coxiella burnetii RSA 493
gaucguuuuuug

SEQ ID NO: 2589274 - RNA, 23 nt, Coxiella burnetii RSA 493
gaucuaagucuauugaaaaaaac

SEQ ID NO: 2589275 - RNA, 15 nt, Coxiella burnetii RSA 493
gaucuccccuucuuu

SEQ ID NO: 2589276 - RNA, 21 nt, Coxiella burnetii RSA 493
gaucucuugcccccauugaua

SEQ ID NO: 2589277 - RNA, 15 nt, Coxiella burnetii RSA 493
gaucuugggcaaaaa

SEQ ID NO: 2589278 - RNA, 20 nt, Coxiella burnetii RSA 493
gaucuugggcaaaaaaagaa

SEQ ID NO: 2589279 - RNA, 15 nt, Coxiella burnetii RSA 493
gaucuuucgcccaua

SEQ ID NO: 2589280 - RNA, 18 nt, Coxiella burnetii RSA 493
gaugaaaucguuuuguuu

SEQ ID NO: 2589281 - RNA, 22 nt, Coxiella burnetii RSA 493
gaugaauuaugcaagguugaug

SEQ ID NO: 2589282 - RNA, 14 nt, Coxiella burnetii RSA 493
gaugacaaauaaac

SEQ ID NO: 2589283 - RNA, 14 nt, Coxiella burnetii RSA 493
gaugacaucauugu

SEQ ID NO: 2589284 - RNA, 19 nt, Coxiella burnetii RSA 493
gaugacccucuuuuuaaaa

SEQ ID NO: 2589285 - RNA, 22 nt, Coxiella burnetii RSA 493
gaugacuuugguaguccugagu

SEQ ID NO: 2589286 - RNA, 14 nt, Coxiella burnetii RSA 493
gaugagcaaugaca

SEQ ID NO: 2589287 - RNA, 22 nt, Coxiella burnetii RSA 493
gaugauccccaucgugcaauuu

SEQ ID NO: 2589288 - RNA, 12 nt, Coxiella burnetii RSA 493
gaugaugcauua

SEQ ID NO: 2589289 - RNA, 21 nt, Coxiella burnetii RSA 493
gaugauuaagcguaaauuuug

SEQ ID NO: 2589290 - RNA, 15 nt, Coxiella burnetii RSA 493
gaugcacucuuuaau

SEQ ID NO: 2589291 - RNA, 21 nt, Coxiella burnetii RSA 493
gaugcacucuuuaauuugcac

SEQ ID NO: 2589292 - RNA, 20 nt, Coxiella burnetii RSA 493
gaugccaaaauuagaauuac

SEQ ID NO: 2589293 - RNA, 17 nt, Coxiella burnetii RSA 493
gaugcccauucuuucau

SEQ ID NO: 2589294 - RNA, 18 nt, Coxiella burnetii RSA 493
gaugcugcgcauauucga

SEQ ID NO: 2589295 - RNA, 17 nt, Coxiella burnetii RSA 493
gaugcuucuuugauaaa

SEQ ID NO: 2589296 - RNA, 12 nt, Coxiella burnetii RSA 493
gauggaagaaca

SEQ ID NO: 2589297 - RNA, 16 nt, Coxiella burnetii RSA 493
gauggccuuauccggg

SEQ ID NO: 2589298 - RNA, 22 nt, Coxiella burnetii RSA 493
gauggcgaagucgggugauuga

SEQ ID NO: 2589299 - RNA, 19 nt, Coxiella burnetii RSA 493
gauggugccgcuaacagag

SEQ ID NO: 2589300 - RNA, 20 nt, Coxiella burnetii RSA 493
gauguauccuaauaaaaaua

SEQ ID NO: 2589301 - RNA, 21 nt, Coxiella burnetii RSA 493
gauguauccuaauaaaaauau

SEQ ID NO: 2589302 - RNA, 15 nt, Coxiella burnetii RSA 493
gaugucacaauuauc

SEQ ID NO: 2589303 - RNA, 12 nt, Coxiella burnetii RSA 493
gaugucaucuau

SEQ ID NO: 2589304 - RNA, 12 nt, Coxiella burnetii RSA 493
gaugucccccga

SEQ ID NO: 2589305 - RNA, 16 nt, Coxiella burnetii RSA 493
gaugucgugcauaucg

SEQ ID NO: 2589306 - RNA, 13 nt, Coxiella burnetii RSA 493
gauguuuuuucac

SEQ ID NO: 2589307 - RNA, 15 nt, Coxiella burnetii RSA 493
gauuaaaaauuuuaa

SEQ ID NO: 2589308 - RNA, 21 nt, Coxiella burnetii RSA 493
gauuaaaaauuuuaaaaaaau

SEQ ID NO: 2589309 - RNA, 13 nt, Coxiella burnetii RSA 493
gauuaaaagcaac

SEQ ID NO: 2589310 - RNA, 12 nt, Coxiella burnetii RSA 493
gauuaaaagugu

SEQ ID NO: 2589311 - RNA, 22 nt, Coxiella burnetii RSA 493
gauuaaacgcgauaucuccauu

SEQ ID NO: 2589312 - RNA, 21 nt, Coxiella burnetii RSA 493
gauuaaacguauuccaaauaa

SEQ ID NO: 2589313 - RNA, 22 nt, Coxiella burnetii RSA 493
gauuaaauaacucaucgaccuc

SEQ ID NO: 2589314 - RNA, 17 nt, Coxiella burnetii RSA 493
gauuaaucguuuuugcu

SEQ ID NO: 2589315 - RNA, 14 nt, Coxiella burnetii RSA 493
gauuacgccaaacu

SEQ ID NO: 2589316 - RNA, 13 nt, Coxiella burnetii RSA 493
gauuacuugauau

SEQ ID NO: 2589317 - RNA, 15 nt, Coxiella burnetii RSA 493
gauuagaaaaagcga

SEQ ID NO: 2589318 - RNA, 14 nt, Coxiella burnetii RSA 493
gauuaucuuucgac

SEQ ID NO: 2589319 - RNA, 20 nt, Coxiella burnetii RSA 493
gauuaugcuugaacuucaaa

SEQ ID NO: 2589320 - RNA, 20 nt, Coxiella burnetii RSA 493
gauuauuauacgggaaguug

SEQ ID NO: 2589321 - RNA, 18 nt, Coxiella burnetii RSA 493
gauuauucaauuucgcgg

SEQ ID NO: 2589322 - RNA, 13 nt, Coxiella burnetii RSA 493
gauucaaauucuu

SEQ ID NO: 2589323 - RNA, 15 nt, Coxiella burnetii RSA 493
gauucaauaaucuca

SEQ ID NO: 2589324 - RNA, 14 nt, Coxiella burnetii RSA 493
gauucacgcgcaua

SEQ ID NO: 2589325 - RNA, 22 nt, Coxiella burnetii RSA 493
gauucaggaaacguuucuguaa

SEQ ID NO: 2589326 - RNA, 15 nt, Coxiella burnetii RSA 493
gauucccaccaaaau

SEQ ID NO: 2589327 - RNA, 16 nt, Coxiella burnetii RSA 493
gauucccaccaaaauu

SEQ ID NO: 2589328 - RNA, 18 nt, Coxiella burnetii RSA 493
gauucgacauaaggcugc

SEQ ID NO: 2589329 - RNA, 18 nt, Coxiella burnetii RSA 493
gauucgcuugacgggcau

SEQ ID NO: 2589330 - RNA, 22 nt, Coxiella burnetii RSA 493
gauucguaauauuauugagaau

SEQ ID NO: 2589331 - RNA, 18 nt, Coxiella burnetii RSA 493
gauucuacagaacuuuuu

SEQ ID NO: 2589332 - RNA, 19 nt, Coxiella burnetii RSA 493
gauucuacgaaacgcuuau

SEQ ID NO: 2589333 - RNA, 17 nt, Coxiella burnetii RSA 493
gauucucucaaagaaac

SEQ ID NO: 2589334 - RNA, 14 nt, Coxiella burnetii RSA 493
gauucuguaacuuu

SEQ ID NO: 2589335 - RNA, 15 nt, Coxiella burnetii RSA 493
gauucuguaacuuuu

SEQ ID NO: 2589336 - RNA, 21 nt, Coxiella burnetii RSA 493
gauucuuuuucgucuguuucu

SEQ ID NO: 2589337 - RNA, 22 nt, Coxiella burnetii RSA 493
gauucuuuuucgucuguuucuu

SEQ ID NO: 2589338 - RNA, 17 nt, Coxiella burnetii RSA 493
gauugaaaccgacaauu

SEQ ID NO: 2589339 - RNA, 21 nt, Coxiella burnetii RSA 493
gauugaacuaagcgugcucuu

SEQ ID NO: 2589340 - RNA, 20 nt, Coxiella burnetii RSA 493
gauugacgacaucguuguuu

SEQ ID NO: 2589341 - RNA, 18 nt, Coxiella burnetii RSA 493
gauugauaguauguuauu

SEQ ID NO: 2589342 - RNA, 15 nt, Coxiella burnetii RSA 493
gauugauuuuguccu

SEQ ID NO: 2589343 - RNA, 23 nt, Coxiella burnetii RSA 493
gauugauuuuuuaaugaaaaaua

SEQ ID NO: 2589344 - RNA, 18 nt, Coxiella burnetii RSA 493
gauugccaaaguucauua

SEQ ID NO: 2589345 - RNA, 16 nt, Coxiella burnetii RSA 493
gauuuauugcuuaucg

SEQ ID NO: 2589346 - RNA, 18 nt, Coxiella burnetii RSA 493
gauuuauugcuuaucgca

SEQ ID NO: 2589347 - RNA, 14 nt, Coxiella burnetii RSA 493
gauuuauuucuucu

SEQ ID NO: 2589348 - RNA, 21 nt, Coxiella burnetii RSA 493
gauuucacuuuauuuucauac

SEQ ID NO: 2589349 - RNA, 21 nt, Coxiella burnetii RSA 493
gauuucaggcgccugcaaaau

SEQ ID NO: 2589350 - RNA, 19 nt, Coxiella burnetii RSA 493
gauuuccaacgcuuguuuu

SEQ ID NO: 2589351 - RNA, 16 nt, Coxiella burnetii RSA 493
gauuuccacuuguuuu

SEQ ID NO: 2589352 - RNA, 14 nt, Coxiella burnetii RSA 493
gauuucucuuuuaa

SEQ ID NO: 2589353 - RNA, 19 nt, Coxiella burnetii RSA 493
gauuucucuuuuaacuuau

SEQ ID NO: 2589354 - RNA, 16 nt, Coxiella burnetii RSA 493
gauuucugguugaauc

SEQ ID NO: 2589355 - RNA, 23 nt, Coxiella burnetii RSA 493
gauuucuuuacgcgcuucuuuua

SEQ ID NO: 2589356 - RNA, 13 nt, Coxiella burnetii RSA 493
gauuuuaauugaa

SEQ ID NO: 2589357 - RNA, 14 nt, Coxiella burnetii RSA 493
gauuuuaauugaau

SEQ ID NO: 2589358 - RNA, 15 nt, Coxiella burnetii RSA 493
gauuuuacgucuaaa

SEQ ID NO: 2589359 - RNA, 14 nt, Coxiella burnetii RSA 493
gauuuucaaaagag

SEQ ID NO: 2589360 - RNA, 19 nt, Coxiella burnetii RSA 493
gauuuucguuguaagucug

SEQ ID NO: 2589361 - RNA, 11 nt, Coxiella burnetii RSA 493
gauuuucucuu

SEQ ID NO: 2589362 - RNA, 16 nt, Coxiella burnetii RSA 493
gauuuugaauuuugcc

SEQ ID NO: 2589363 - RNA, 15 nt, Coxiella burnetii RSA 493
gauuuuguuucuuug

SEQ ID NO: 2589364 - RNA, 15 nt, Coxiella burnetii RSA 493
gauuuuuaugaaaaa

SEQ ID NO: 2589365 - RNA, 19 nt, Coxiella burnetii RSA 493
gauuuuugaagcuauccaa

SEQ ID NO: 2589366 - RNA, 16 nt, Coxiella burnetii RSA 493
gauuuuuuaaaucuuc

SEQ ID NO: 2589367 - RNA, 14 nt, Coxiella burnetii RSA 493
gauuuuuuauccaa

SEQ ID NO: 2589368 - RNA, 13 nt, Coxiella burnetii RSA 493
gcaaaaccaauag

SEQ ID NO: 2589369 - RNA, 16 nt, Coxiella burnetii RSA 493
gcaaaacuaaaucaau

SEQ ID NO: 2589370 - RNA, 15 nt, Coxiella burnetii RSA 493
gcaaaacuucccauu

SEQ ID NO: 2589371 - RNA, 20 nt, Coxiella burnetii RSA 493
gcaaacccacggcaaauaaa

SEQ ID NO: 2589372 - RNA, 19 nt, Coxiella burnetii RSA 493
gcaaaccgcgcugaagucc

SEQ ID NO: 2589373 - RNA, 16 nt, Coxiella burnetii RSA 493
gcauuuuuaaaaguga

SEQ ID NO: 2589374 - RNA, 17 nt, Coxiella burnetii RSA 493
gcauuuuuaaaagugac

SEQ ID NO: 2589375 - RNA, 15 nt, Coxiella burnetii RSA 493
gccaaaauaauaacc

SEQ ID NO: 2589376 - RNA, 18 nt, Coxiella burnetii RSA 493
gccaaaauaauaacccac

SEQ ID NO: 2589377 - RNA, 17 nt, Coxiella burnetii RSA 493
gccaaagaaauggaacg

SEQ ID NO: 2589378 - RNA, 12 nt, Coxiella burnetii RSA 493
gccaaccauaau

SEQ ID NO: 2589379 - RNA, 16 nt, Coxiella burnetii RSA 493
gccaacgcgacaagaa

SEQ ID NO: 2589380 - RNA, 22 nt, Coxiella burnetii RSA 493
gccaacgguaacccucgauuua

SEQ ID NO: 2589381 - RNA, 21 nt, Coxiella burnetii RSA 493
gccaacuguacugaaaaguaa

SEQ ID NO: 2589382 - RNA, 22 nt, Coxiella burnetii RSA 493
gccaacuuauagcccacacuaa

SEQ ID NO: 2589383 - RNA, 20 nt, Coxiella burnetii RSA 493
gccaaggcuauuccccuucu

SEQ ID NO: 2589384 - RNA, 19 nt, Coxiella burnetii RSA 493
gccaaucgccgucccuucu

SEQ ID NO: 2589385 - RNA, 16 nt, Coxiella burnetii RSA 493
gccaauguuugcucaa

SEQ ID NO: 2589386 - RNA, 15 nt, Coxiella burnetii RSA 493
gccaauuuaagcgcg

SEQ ID NO: 2589387 - RNA, 13 nt, Coxiella burnetii RSA 493
gccacacaaccac

SEQ ID NO: 2589388 - RNA, 14 nt, Coxiella burnetii RSA 493
gccacacaagcgcg

SEQ ID NO: 2589389 - RNA, 23 nt, Coxiella burnetii RSA 493
gccacacaagcgcgauucauucc

SEQ ID NO: 2589390 - RNA, 22 nt, Coxiella burnetii RSA 493
gccacauuucggacaacaaaua

SEQ ID NO: 2589391 - RNA, 17 nt, Coxiella burnetii RSA 493
gccagauacacauaaug

SEQ ID NO: 2589392 - RNA, 23 nt, Coxiella burnetii RSA 493
gccagcaauggugauuucuucca

SEQ ID NO: 2589393 - RNA, 15 nt, Coxiella burnetii RSA 493
gccagcuaaguaacc

SEQ ID NO: 2589394 - RNA, 13 nt, Coxiella burnetii RSA 493
gccaguauuuuuc

SEQ ID NO: 2589395 - RNA, 19 nt, Coxiella burnetii RSA 493
gccauaguaauucaucauu

SEQ ID NO: 2589396 - RNA, 14 nt, Coxiella burnetii RSA 493
gccauaucaggagc

SEQ ID NO: 2589397 - RNA, 18 nt, Coxiella burnetii RSA 493
gccaucaccacaauuaau

SEQ ID NO: 2589398 - RNA, 17 nt, Coxiella burnetii RSA 493
gccaucgcccaguacug

SEQ ID NO: 2589399 - RNA, 16 nt, Coxiella burnetii RSA 493
gccauuggcucuguuu

SEQ ID NO: 2589400 - RNA, 20 nt, Coxiella burnetii RSA 493
gccauugguuuaaaaaguuc

SEQ ID NO: 2589401 - RNA, 13 nt, Coxiella burnetii RSA 493
gccauuucgcuuu

SEQ ID NO: 2589402 - RNA, 18 nt, Coxiella burnetii RSA 493
gccauuuggucaaggcca

SEQ ID NO: 2589403 - RNA, 20 nt, Coxiella burnetii RSA 493
gccauuuuguguuaagucgu

SEQ ID NO: 2589404 - RNA, 12 nt, Coxiella burnetii RSA 493
gcccaaaugauc

SEQ ID NO: 2589405 - RNA, 22 nt, Coxiella burnetii RSA 493
gcccaacuacggacucuuuuca

SEQ ID NO: 2589406 - RNA, 14 nt, Coxiella burnetii RSA 493
gcccaauaaagaaa

SEQ ID NO: 2589407 - RNA, 17 nt, Coxiella burnetii RSA 493
gcccacuuggaaaucuu

SEQ ID NO: 2589408 - RNA, 17 nt, Coxiella burnetii RSA 493
gcccagcagcguauuug

SEQ ID NO: 2589409 - RNA, 14 nt, Coxiella burnetii RSA 493
gcccauaaauaacu

SEQ ID NO: 2589410 - RNA, 23 nt, Coxiella burnetii RSA 493
gcccauauucaacacaauaucgu

SEQ ID NO: 2589411 - RNA, 12 nt, Coxiella burnetii RSA 493
gcccaugacgac

SEQ ID NO: 2589412 - RNA, 20 nt, Coxiella burnetii RSA 493
gcccauuucccaaaugacga

SEQ ID NO: 2589413 - RNA, 15 nt, Coxiella burnetii RSA 493
gcccauuuuuucguu

SEQ ID NO: 2589414 - RNA, 17 nt, Coxiella burnetii RSA 493
gccccucaagcaaagcg

SEQ ID NO: 2589415 - RNA, 23 nt, Coxiella burnetii RSA 493
gccccuuugcggcuaaugcuuuu

SEQ ID NO: 2589416 - RNA, 16 nt, Coxiella burnetii RSA 493
gcccgaaaaaguagcg

SEQ ID NO: 2589417 - RNA, 20 nt, Coxiella burnetii RSA 493
gcccguaugcagcgaagcga

SEQ ID NO: 2589418 - RNA, 15 nt, Coxiella burnetii RSA 493
gcccucauuguuucg

SEQ ID NO: 2589419 - RNA, 14 nt, Coxiella burnetii RSA 493
gcccucgaucuuuc

SEQ ID NO: 2589420 - RNA, 14 nt, Coxiella burnetii RSA 493
gccgauaaaaaggc

SEQ ID NO: 2589421 - RNA, 11 nt, Coxiella burnetii RSA 493
gccgauaaguu

SEQ ID NO: 2589422 - RNA, 23 nt, Coxiella burnetii RSA 493
gccgauaauccgccgguacccca

SEQ ID NO: 2589423 - RNA, 18 nt, Coxiella burnetii RSA 493
gccgauauucuuuuucuu

SEQ ID NO: 2589424 - RNA, 19 nt, Coxiella burnetii RSA 493
gccgaugacaaauaaacaa

SEQ ID NO: 2589425 - RNA, 12 nt, Coxiella burnetii RSA 493
gccgcccuugcu

SEQ ID NO: 2589426 - RNA, 14 nt, Coxiella burnetii RSA 493
gccgccuguaaggu

SEQ ID NO: 2589427 - RNA, 23 nt, Coxiella burnetii RSA 493
gccgcgccauggggcgagcgccc

SEQ ID NO: 2589428 - RNA, 21 nt, Coxiella burnetii RSA 493
gccgcuauuucuagcguugaa

SEQ ID NO: 2589429 - RNA, 15 nt, Coxiella burnetii RSA 493
gccgcugugccugcc

SEQ ID NO: 2589430 - RNA, 16 nt, Coxiella burnetii RSA 493
gccgcuuuuuauugga

SEQ ID NO: 2589431 - RNA, 14 nt, Coxiella burnetii RSA 493
gccggucagcguuu

SEQ ID NO: 2589432 - RNA, 23 nt, Coxiella burnetii RSA 493
gccgucuaccgacagacaaagcu

SEQ ID NO: 2589433 - RNA, 16 nt, Coxiella burnetii RSA 493
gccguggccauuuguc

SEQ ID NO: 2589434 - RNA, 17 nt, Coxiella burnetii RSA 493
gccguuauaaaguguuu

SEQ ID NO: 2589435 - RNA, 24 nt, Coxiella burnetii RSA 493
gccuaaguuuaacagacagacgcu

SEQ ID NO: 2589436 - RNA, 22 nt, Coxiella burnetii RSA 493
gccuaaucggccuacuuuuucu

SEQ ID NO: 2589437 - RNA, 23 nt, Coxiella burnetii RSA 493
gccuaaucggccuacuuuuucug

SEQ ID NO: 2589438 - RNA, 12 nt, Coxiella burnetii RSA 493
gccuacaaauac

SEQ ID NO: 2589439 - RNA, 12 nt, Coxiella burnetii RSA 493
gccuaucuuuuu

SEQ ID NO: 2589440 - RNA, 14 nt, Coxiella burnetii RSA 493
gccuaucuuuuuca

SEQ ID NO: 2589441 - RNA, 22 nt, Coxiella burnetii RSA 493
gccuccagggcuuguucacgca

SEQ ID NO: 2589442 - RNA, 15 nt, Coxiella burnetii RSA 493
gccuccaucccuccu

SEQ ID NO: 2589443 - RNA, 23 nt, Coxiella burnetii RSA 493
gccucugaauugaaguccuuauc

SEQ ID NO: 2589444 - RNA, 13 nt, Coxiella burnetii RSA 493
gccugaaauauuu

SEQ ID NO: 2589445 - RNA, 12 nt, Coxiella burnetii RSA 493
gccuuaaaacau

SEQ ID NO: 2589446 - RNA, 15 nt, Coxiella burnetii RSA 493
gccuuaauaaccacc

SEQ ID NO: 2589447 - RNA, 15 nt, Coxiella burnetii RSA 493
gccuuaauuucuaaa

SEQ ID NO: 2589448 - RNA, 23 nt, Coxiella burnetii RSA 493
gccuuacuuaccguuucacgauu

SEQ ID NO: 2589449 - RNA, 20 nt, Coxiella burnetii RSA 493
gccuucaugaauauuuuucu

SEQ ID NO: 2589450 - RNA, 22 nt, Coxiella burnetii RSA 493
gccuucuugccgcccuugcugc

SEQ ID NO: 2589451 - RNA, 17 nt, Coxiella burnetii RSA 493
gccuugcaaacaaacga

SEQ ID NO: 2589452 - RNA, 22 nt, Coxiella burnetii RSA 493
gccuuuugaaggaauaaaaccu

SEQ ID NO: 2589453 - RNA, 17 nt, Coxiella burnetii RSA 493
gccuuuuuuaaauuucu

SEQ ID NO: 2589454 - RNA, 18 nt, Coxiella burnetii RSA 493
gccuuuuuuaaauuucuc

SEQ ID NO: 2589455 - RNA, 12 nt, Coxiella burnetii RSA 493
gccuuuuuugcg

SEQ ID NO: 2589456 - RNA, 18 nt, Coxiella burnetii RSA 493
gcgaaacgacgaaagagu

SEQ ID NO: 2589457 - RNA, 20 nt, Coxiella burnetii RSA 493
gcgaaagccaaguuuuaaga

SEQ ID NO: 2589458 - RNA, 22 nt, Coxiella burnetii RSA 493
gcgaaagccaaguuuuaagaaa

SEQ ID NO: 2589459 - RNA, 16 nt, Coxiella burnetii RSA 493
gcgaaauuuaauaaaa

SEQ ID NO: 2589460 - RNA, 21 nt, Coxiella burnetii RSA 493
gcgaaauuuguuauugcuaaa

SEQ ID NO: 2589461 - RNA, 23 nt, Coxiella burnetii RSA 493
gcgaacagccgaugacaaauaaa

SEQ ID NO: 2589462 - RNA, 19 nt, Coxiella burnetii RSA 493
gcgaagcgaaauacgggaa

SEQ ID NO: 2589463 - RNA, 20 nt, Coxiella burnetii RSA 493
gcgaagcgaaauacggggaa

SEQ ID NO: 2589464 - RNA, 20 nt, Coxiella burnetii RSA 493
gcgaagcgaaauacggggac

SEQ ID NO: 2589465 - RNA, 19 nt, Coxiella burnetii RSA 493
gcgaagcgaaguacgggaa

SEQ ID NO: 2589466 - RNA, 19 nt, Coxiella burnetii RSA 493
gcgaagcggaauacggaga

SEQ ID NO: 2589467 - RNA, 21 nt, Coxiella burnetii RSA 493
gcgaagcggaauacggagaaa

SEQ ID NO: 2589468 - RNA, 13 nt, Coxiella burnetii RSA 493
gcgaaggcgagga

SEQ ID NO: 2589469 - RNA, 21 nt, Coxiella burnetii RSA 493
gcgaaguacgggaaaacaaug

SEQ ID NO: 2589470 - RNA, 19 nt, Coxiella burnetii RSA 493
gcgaaugguugaaagaaaa

SEQ ID NO: 2589471 - RNA, 22 nt, Coxiella burnetii RSA 493
gcgacacaaccacuguccucug

SEQ ID NO: 2589472 - RNA, 21 nt, Coxiella burnetii RSA 493
gcgacgaauaccccuuuuguu

SEQ ID NO: 2589473 - RNA, 17 nt, Coxiella burnetii RSA 493
gcgacgggcuguacauu

SEQ ID NO: 2589474 - RNA, 13 nt, Coxiella burnetii RSA 493
gcgacuaaaccaa

SEQ ID NO: 2589475 - RNA, 14 nt, Coxiella burnetii RSA 493
gcgagcgcgcgaga

SEQ ID NO: 2589476 - RNA, 22 nt, Coxiella burnetii RSA 493
gcgaguaaaccgcucgggggag

SEQ ID NO: 2589477 - RNA, 21 nt, Coxiella burnetii RSA 493
gcgauaugggggcccauccag

SEQ ID NO: 2589478 - RNA, 17 nt, Coxiella burnetii RSA 493
gcugcgguauuguucaa

SEQ ID NO: 2589479 - RNA, 15 nt, Coxiella burnetii RSA 493
gcugcuuuugaauuu

SEQ ID NO: 2589480 - RNA, 21 nt, Coxiella burnetii RSA 493
gcugcuuuugaauuuuuugaa

SEQ ID NO: 2589481 - RNA, 18 nt, Coxiella burnetii RSA 493
gcuggaaaaauaaaucca

SEQ ID NO: 2589482 - RNA, 15 nt, Coxiella burnetii RSA 493
gcugguagagcacaa

SEQ ID NO: 2589483 - RNA, 22 nt, Coxiella burnetii RSA 493
gcuggugaggcugauucaaauu

SEQ ID NO: 2589484 - RNA, 15 nt, Coxiella burnetii RSA 493
gcuguacauuuuuca

SEQ ID NO: 2589485 - RNA, 12 nt, Coxiella burnetii RSA 493
gcugugauucac

SEQ ID NO: 2589486 - RNA, 15 nt, Coxiella burnetii RSA 493
gcugugguuguuucg

SEQ ID NO: 2589487 - RNA, 11 nt, Coxiella burnetii RSA 493
gcuguuuauag

SEQ ID NO: 2589488 - RNA, 13 nt, Coxiella burnetii RSA 493
gcuguuuuuucua

SEQ ID NO: 2589489 - RNA, 22 nt, Coxiella burnetii RSA 493
gcuuaauaacgcuggggacgca

SEQ ID NO: 2589490 - RNA, 21 nt, Coxiella burnetii RSA 493
gcuuagcaauguuucaaucug

SEQ ID NO: 2589491 - RNA, 17 nt, Coxiella burnetii RSA 493
gcuuauagcuuguuccu

SEQ ID NO: 2589492 - RNA, 17 nt, Coxiella burnetii RSA 493
gcuuauaggaaucugaa

SEQ ID NO: 2589493 - RNA, 15 nt, Coxiella burnetii RSA 493
gcuucaauucuuuuu

SEQ ID NO: 2589494 - RNA, 13 nt, Coxiella burnetii RSA 493
gcuucacagagcc

SEQ ID NO: 2589495 - RNA, 19 nt, Coxiella burnetii RSA 493
gcuucaggugacggauuaa

SEQ ID NO: 2589496 - RNA, 19 nt, Coxiella burnetii RSA 493
gcuucaucgauugcuaaag

SEQ ID NO: 2589497 - RNA, 18 nt, Coxiella burnetii RSA 493
gcuuccagaaauucauuu

SEQ ID NO: 2589498 - RNA, 19 nt, Coxiella burnetii RSA 493
gcuuccagaaauucauuuu

SEQ ID NO: 2589499 - RNA, 23 nt, Coxiella burnetii RSA 493
gcuuccagaaauucauuuuucag

SEQ ID NO: 2589500 - RNA, 18 nt, Coxiella burnetii RSA 493
gcuuccauugcucaaagg

SEQ ID NO: 2589501 - RNA, 17 nt, Coxiella burnetii RSA 493
gcuuccccaauuuauuc

SEQ ID NO: 2589502 - RNA, 16 nt, Coxiella burnetii RSA 493
gcuucgaaaaucgaau

SEQ ID NO: 2589503 - RNA, 14 nt, Coxiella burnetii RSA 493
gcuucgcaaagcuc

SEQ ID NO: 2589504 - RNA, 19 nt, Coxiella burnetii RSA 493
gcuucgcuacauacgggcu

SEQ ID NO: 2589505 - RNA, 15 nt, Coxiella burnetii RSA 493
gcuucgcucauacgg

SEQ ID NO: 2589506 - RNA, 18 nt, Coxiella burnetii RSA 493
gcuucgcucauacgggcu

SEQ ID NO: 2589507 - RNA, 19 nt, Coxiella burnetii RSA 493
gcuucgcuccauacgggcu

SEQ ID NO: 2589508 - RNA, 17 nt, Coxiella burnetii RSA 493
gcuucgucauuuccgug

SEQ ID NO: 2589509 - RNA, 18 nt, Coxiella burnetii RSA 493
gcuucuaaguaaacagca

SEQ ID NO: 2589510 - RNA, 23 nt, Coxiella burnetii RSA 493
gcuucuaaguaaacagcauuagc

SEQ ID NO: 2589511 - RNA, 14 nt, Coxiella burnetii RSA 493
gcuucuuuaaaaua

SEQ ID NO: 2589512 - RNA, 23 nt, Coxiella burnetii RSA 493
gcuucuuuuaauugacuuauuuu

SEQ ID NO: 2589513 - RNA, 21 nt, Coxiella burnetii RSA 493
gcuugaaaaauugaaagaauu

SEQ ID NO: 2589514 - RNA, 22 nt, Coxiella burnetii RSA 493
gcuugcuuaccgaggucuuuua

SEQ ID NO: 2589515 - RNA, 21 nt, Coxiella burnetii RSA 493
gcuugugcaauuccauuaaaa

SEQ ID NO: 2589516 - RNA, 23 nt, Coxiella burnetii RSA 493
gcuuguuccgccauuucccagcu

SEQ ID NO: 2589517 - RNA, 12 nt, Coxiella burnetii RSA 493
gcuuguuuauau

SEQ ID NO: 2589518 - RNA, 17 nt, Coxiella burnetii RSA 493
gcuuuaauacaguuuau

SEQ ID NO: 2589519 - RNA, 19 nt, Coxiella burnetii RSA 493
gcuuuauucccgaugggga

SEQ ID NO: 2589520 - RNA, 18 nt, Coxiella burnetii RSA 493
gcuuucaacauauuucuu

SEQ ID NO: 2589521 - RNA, 18 nt, Coxiella burnetii RSA 493
gcuuucaauaaauaaauc

SEQ ID NO: 2589522 - RNA, 20 nt, Coxiella burnetii RSA 493
gcuuucaauuacuuuuauaa

SEQ ID NO: 2589523 - RNA, 21 nt, Coxiella burnetii RSA 493
gcuuucaauuacuuuuauaau

SEQ ID NO: 2589524 - RNA, 13 nt, Coxiella burnetii RSA 493
gcuuucuuugaac

SEQ ID NO: 2589525 - RNA, 18 nt, Coxiella burnetii RSA 493
gcuuugcgcguucaauau

SEQ ID NO: 2589526 - RNA, 13 nt, Coxiella burnetii RSA 493
gcuuugcggccuc

SEQ ID NO: 2589527 - RNA, 12 nt, Coxiella burnetii RSA 493
aucguugcugag

SEQ ID NO: 2589528 - RNA, 14 nt, Coxiella burnetii RSA 493
aucguuugaucauu

SEQ ID NO: 2589529 - RNA, 13 nt, Coxiella burnetii RSA 493
aucguuuuauaca

SEQ ID NO: 2589530 - RNA, 22 nt, Coxiella burnetii RSA 493
aucguuuuguuuuaaguuuuca

SEQ ID NO: 2589531 - RNA, 17 nt, Coxiella burnetii RSA 493
aucuaaaggaauacaau

SEQ ID NO: 2589532 - RNA, 12 nt, Coxiella burnetii RSA 493
aucuaagucuau

SEQ ID NO: 2589533 - RNA, 21 nt, Coxiella burnetii RSA 493
aucuacuucagcguggauagc

SEQ ID NO: 2589534 - RNA, 22 nt, Coxiella burnetii RSA 493
aucuacuucccgcaaaugaucg

SEQ ID NO: 2589535 - RNA, 19 nt, Coxiella burnetii RSA 493
aucuauauuaauuugauca

SEQ ID NO: 2589536 - RNA, 14 nt, Coxiella burnetii RSA 493
aucucacacaacuc

SEQ ID NO: 2589537 - RNA, 23 nt, Coxiella burnetii RSA 493
aucucacgugagguuacauuaaa

SEQ ID NO: 2589538 - RNA, 22 nt, Coxiella burnetii RSA 493
aucucauuaggcuuuagaagau

SEQ ID NO: 2589539 - RNA, 21 nt, Coxiella burnetii RSA 493
aucuccuugaggaauuuuuca

SEQ ID NO: 2589540 - RNA, 14 nt, Coxiella burnetii RSA 493
aucucgaaauuauu

SEQ ID NO: 2589541 - RNA, 15 nt, Coxiella burnetii RSA 493
aucucgaaauuauuu

SEQ ID NO: 2589542 - RNA, 24 nt, Coxiella burnetii RSA 493
aucucguugagguucgcaaacgcu

SEQ ID NO: 2589543 - RNA, 21 nt, Coxiella burnetii RSA 493
aucucucggugcuugcucagg

SEQ ID NO: 2589544 - RNA, 19 nt, Coxiella burnetii RSA 493
aucucuuaaaauuccgauu

SEQ ID NO: 2589545 - RNA, 19 nt, Coxiella burnetii RSA 493
aucucuugcccccauugau

SEQ ID NO: 2589546 - RNA, 15 nt, Coxiella burnetii RSA 493
aucugaucaaaaaua

SEQ ID NO: 2589547 - RNA, 23 nt, Coxiella burnetii RSA 493
aucugauggaugaaagauuuuuu

SEQ ID NO: 2589548 - RNA, 24 nt, Coxiella burnetii RSA 493
aucugcuaaaaagcuagcgaaauu

SEQ ID NO: 2589549 - RNA, 16 nt, Coxiella burnetii RSA 493
aucugcuaggauuuuu

SEQ ID NO: 2589550 - RNA, 22 nt, Coxiella burnetii RSA 493
aucugcuaggauuuuuuaucca

SEQ ID NO: 2589551 - RNA, 16 nt, Coxiella burnetii RSA 493
aucugcuuccucuucu

SEQ ID NO: 2589552 - RNA, 22 nt, Coxiella burnetii RSA 493
aucugucaucaucgucaaaugg

SEQ ID NO: 2589553 - RNA, 21 nt, Coxiella burnetii RSA 493
aucuguuucaauuagcauuuu

SEQ ID NO: 2589554 - RNA, 20 nt, Coxiella burnetii RSA 493
aucuguuugcaauucuagua

SEQ ID NO: 2589555 - RNA, 18 nt, Coxiella burnetii RSA 493
aucuuaaugaaauuucuc

SEQ ID NO: 2589556 - RNA, 23 nt, Coxiella burnetii RSA 493
aucuuaucaccuuugcuaacaau

SEQ ID NO: 2589557 - RNA, 11 nt, Coxiella burnetii RSA 493
aucuucaaaac

SEQ ID NO: 2589558 - RNA, 14 nt, Coxiella burnetii RSA 493
aucuucaaaaccua

SEQ ID NO: 2589559 - RNA, 19 nt, Coxiella burnetii RSA 493
aucuucaacaucaacccca

SEQ ID NO: 2589560 - RNA, 15 nt, Coxiella burnetii RSA 493
aucuuccaauuuuuu

SEQ ID NO: 2589561 - RNA, 16 nt, Coxiella burnetii RSA 493
aucuuccaauuuuuug

SEQ ID NO: 2589562 - RNA, 21 nt, Coxiella burnetii RSA 493
aucuucugaucgauaaaaaua

SEQ ID NO: 2589563 - RNA, 23 nt, Coxiella burnetii RSA 493
aucuucugaucgauaaaaauaau

SEQ ID NO: 2589564 - RNA, 23 nt, Coxiella burnetii RSA 493
aucuugaucuugggcaaaaaaag

SEQ ID NO: 2589565 - RNA, 22 nt, Coxiella burnetii RSA 493
aucuugguccguggcaguuaaa

SEQ ID NO: 2589566 - RNA, 12 nt, Coxiella burnetii RSA 493
aucuuguuuaag

SEQ ID NO: 2589567 - RNA, 20 nt, Coxiella burnetii RSA 493
aucuuuauccaaaucggcaa

SEQ ID NO: 2589568 - RNA, 16 nt, Coxiella burnetii RSA 493
aucuuucgaccaggac

SEQ ID NO: 2589569 - RNA, 13 nt, Coxiella burnetii RSA 493
aucuuuuaaauua

SEQ ID NO: 2589570 - RNA, 17 nt, Coxiella burnetii RSA 493
aucuuuuucuccuuuuc

SEQ ID NO: 2589571 - RNA, 21 nt, Coxiella burnetii RSA 493
aucuuuuuucuuaucccaggc

SEQ ID NO: 2589572 - RNA, 22 nt, Coxiella burnetii RSA 493
aucuuuuuuuugaaauucuugu

SEQ ID NO: 2589573 - RNA, 13 nt, Coxiella burnetii RSA 493
augaaaaaaacag

SEQ ID NO: 2589574 - RNA, 17 nt, Coxiella burnetii RSA 493
augaaaggaauccuuuu

SEQ ID NO: 2589575 - RNA, 19 nt, Coxiella burnetii RSA 493
augaacaacacgaucaaca

SEQ ID NO: 2589576 - RNA, 23 nt, Coxiella burnetii RSA 493
augaacaacacgaucaacaaaau

SEQ ID NO: 2589577 - RNA, 18 nt, Coxiella burnetii RSA 493
augaagcgcggcgaaaua

SEQ ID NO: 2589578 - RNA, 20 nt, Coxiella burnetii RSA 493
augaagguacugaagaguaa

SEQ ID NO: 2589579 - RNA, 20 nt, Coxiella burnetii RSA 493
augaagugggggaacagagg

SEQ ID NO: 2589580 - RNA, 23 nt, Coxiella burnetii RSA 493
augaaguuccauuccaaaaacag

SEQ ID NO: 2589581 - RNA, 16 nt, Coxiella burnetii RSA 493
augaauaacaucaguu

SEQ ID NO: 2589582 - RNA, 15 nt, Coxiella burnetii RSA 493
augaauauuuuucuc

SEQ ID NO: 2589583 - RNA, 17 nt, Coxiella burnetii RSA 493
augaaucagcuuaauca

SEQ ID NO: 2589584 - RNA, 18 nt, Coxiella burnetii RSA 493
augaaugagcugcuuucg

SEQ ID NO: 2589585 - RNA, 13 nt, Coxiella burnetii RSA 493
augaaugcuggag

SEQ ID NO: 2589586 - RNA, 19 nt, Coxiella burnetii RSA 493
augaauggaauguuaaagg

SEQ ID NO: 2589587 - RNA, 23 nt, Coxiella burnetii RSA 493
augaauuuaaugucuuuuauuuu

SEQ ID NO: 2589588 - RNA, 14 nt, Coxiella burnetii RSA 493
augacauuuaaaaa

SEQ ID NO: 2589589 - RNA, 13 nt, Coxiella burnetii RSA 493
augaccaaauaau

SEQ ID NO: 2589590 - RNA, 19 nt, Coxiella burnetii RSA 493
augacgauuuuaauuuuuu

SEQ ID NO: 2589591 - RNA, 13 nt, Coxiella burnetii RSA 493
augacgcagaaua

SEQ ID NO: 2589592 - RNA, 13 nt, Coxiella burnetii RSA 493
augacggaauuug

SEQ ID NO: 2589593 - RNA, 22 nt, Coxiella burnetii RSA 493
augacguaaugucucaaggcuc

SEQ ID NO: 2589594 - RNA, 15 nt, Coxiella burnetii RSA 493
augacucgcgaaauu

SEQ ID NO: 2589595 - RNA, 20 nt, Coxiella burnetii RSA 493
augacuuugguaguccugag

SEQ ID NO: 2589596 - RNA, 13 nt, Coxiella burnetii RSA 493
augagacuuuaau

SEQ ID NO: 2589597 - RNA, 15 nt, Coxiella burnetii RSA 493
augagaugaucauca

SEQ ID NO: 2589598 - RNA, 12 nt, Coxiella burnetii RSA 493
augagcaaugac

SEQ ID NO: 2589599 - RNA, 13 nt, Coxiella burnetii RSA 493
augagcgaacgaa

SEQ ID NO: 2589600 - RNA, 19 nt, Coxiella burnetii RSA 493
augagcgaagcgaaauacg

SEQ ID NO: 2589601 - RNA, 21 nt, Coxiella burnetii RSA 493
augagcgaagcgaaauacggg

SEQ ID NO: 2589602 - RNA, 20 nt, Coxiella burnetii RSA 493
augagcguaaucaauaaaac

SEQ ID NO: 2589603 - RNA, 16 nt, Coxiella burnetii RSA 493
augagcuauaauucuc

SEQ ID NO: 2589604 - RNA, 13 nt, Coxiella burnetii RSA 493
augaguaaaaaag

SEQ ID NO: 2589605 - RNA, 23 nt, Coxiella burnetii RSA 493
augaguauggcuauuauuaauac

SEQ ID NO: 2589606 - RNA, 14 nt, Coxiella burnetii RSA 493
augaguucauuaau

SEQ ID NO: 2589607 - RNA, 18 nt, Coxiella burnetii RSA 493
augaguucugucacuaau

SEQ ID NO: 2589608 - RNA, 21 nt, Coxiella burnetii RSA 493
augaguugucauauuaauauu

SEQ ID NO: 2589609 - RNA, 23 nt, Coxiella burnetii RSA 493
augauaaaaggcagcuuccagaa

SEQ ID NO: 2589610 - RNA, 17 nt, Coxiella burnetii RSA 493
augauaagguguuuuac

SEQ ID NO: 2589611 - RNA, 13 nt, Coxiella burnetii RSA 493
augauaauccaca

SEQ ID NO: 2589612 - RNA, 14 nt, Coxiella burnetii RSA 493
augauacaaauuuu

SEQ ID NO: 2589613 - RNA, 17 nt, Coxiella burnetii RSA 493
augaucaucaucaaaau

SEQ ID NO: 2589614 - RNA, 20 nt, Coxiella burnetii RSA 493
augaucauuuucucagggau

SEQ ID NO: 2589615 - RNA, 18 nt, Coxiella burnetii RSA 493
augaucggaggaaauauu

SEQ ID NO: 2589616 - RNA, 12 nt, Coxiella burnetii RSA 493
augaugaaaagc

SEQ ID NO: 2589617 - RNA, 22 nt, Coxiella burnetii RSA 493
augaugcauuaaucauuacaga

SEQ ID NO: 2589618 - RNA, 15 nt, Coxiella burnetii RSA 493
augauguuuuaaaau

SEQ ID NO: 2589619 - RNA, 19 nt, Coxiella burnetii RSA 493
augauuaaacguauuccaa

SEQ ID NO: 2589620 - RNA, 20 nt, Coxiella burnetii RSA 493
augauuaaaucaacacccca

SEQ ID NO: 2589621 - RNA, 19 nt, Coxiella burnetii RSA 493
augauuaagcguaaauuuu

SEQ ID NO: 2589622 - RNA, 17 nt, Coxiella burnetii RSA 493
augauugcucugaccua

SEQ ID NO: 2589623 - RNA, 11 nt, Coxiella burnetii RSA 493
augauuuccaa

SEQ ID NO: 2589624 - RNA, 12 nt, Coxiella burnetii RSA 493
augauuuuuccc

SEQ ID NO: 2589625 - RNA, 13 nt, Coxiella burnetii RSA 493
augauuuuuccca

SEQ ID NO: 2589626 - RNA, 18 nt, Coxiella burnetii RSA 493
augcaaaaaccgacgcca

SEQ ID NO: 2589627 - RNA, 20 nt, Coxiella burnetii RSA 493
augcaaaaauuguuuaucau

SEQ ID NO: 2589628 - RNA, 15 nt, Coxiella burnetii RSA 493
augcacgggcaccau

SEQ ID NO: 2589629 - RNA, 13 nt, Coxiella burnetii RSA 493
augcacucuuuaa

SEQ ID NO: 2589630 - RNA, 16 nt, Coxiella burnetii RSA 493
augcagcacaaagcug

SEQ ID NO: 2589631 - RNA, 14 nt, Coxiella burnetii RSA 493
augcagccauucuc

SEQ ID NO: 2589632 - RNA, 15 nt, Coxiella burnetii RSA 493
auuaaccaaucaaua

SEQ ID NO: 2589633 - RNA, 18 nt, Coxiella burnetii RSA 493
auuaacguauaaauaaca

SEQ ID NO: 2589634 - RNA, 22 nt, Coxiella burnetii RSA 493
auuaacuucgccauugucucac

SEQ ID NO: 2589635 - RNA, 14 nt, Coxiella burnetii RSA 493
auuaacuuugcaaa

SEQ ID NO: 2589636 - RNA, 18 nt, Coxiella burnetii RSA 493
auuaagacuaggaaaaaa

SEQ ID NO: 2589637 - RNA, 19 nt, Coxiella burnetii RSA 493
auuaagcuugaaaaaauug

SEQ ID NO: 2589638 - RNA, 16 nt, Coxiella burnetii RSA 493
auuaaggucuggguga

SEQ ID NO: 2589639 - RNA, 19 nt, Coxiella burnetii RSA 493
auuaagguggauuuucaaa

SEQ ID NO: 2589640 - RNA, 18 nt, Coxiella burnetii RSA 493
auuaauacaggaaaaaga

SEQ ID NO: 2589641 - RNA, 18 nt, Coxiella burnetii RSA 493
auuaauacauucuucagu

SEQ ID NO: 2589642 - RNA, 19 nt, Coxiella burnetii RSA 493
auuaauacauucuucagua

SEQ ID NO: 2589643 - RNA, 15 nt, Coxiella burnetii RSA 493
auuaauauuaaaaca

SEQ ID NO: 2589644 - RNA, 20 nt, Coxiella burnetii RSA 493
auuaaucauucgaacgacuu

SEQ ID NO: 2589645 - RNA, 17 nt, Coxiella burnetii RSA 493
auuaauccuuauacuaa

SEQ ID NO: 2589646 - RNA, 18 nt, Coxiella burnetii RSA 493
auuaaugaucaaugaaac

SEQ ID NO: 2589647 - RNA, 16 nt, Coxiella burnetii RSA 493
auuaauuauccaaaau

SEQ ID NO: 2589648 - RNA, 23 nt, Coxiella burnetii RSA 493
auuaauucccaagcuuuugccuu

SEQ ID NO: 2589649 - RNA, 11 nt, Coxiella burnetii RSA 493
auuaauuuccg

SEQ ID NO: 2589650 - RNA, 14 nt, Coxiella burnetii RSA 493
auuacauaauuuaa

SEQ ID NO: 2589651 - RNA, 20 nt, Coxiella burnetii RSA 493
auuacauaauuuaaacucaa

SEQ ID NO: 2589652 - RNA, 15 nt, Coxiella burnetii RSA 493
auuacauauuucuuu

SEQ ID NO: 2589653 - RNA, 15 nt, Coxiella burnetii RSA 493
auuacgauuaaucau

SEQ ID NO: 2589654 - RNA, 16 nt, Coxiella burnetii RSA 493
auuacgccaaacuucu

SEQ ID NO: 2589655 - RNA, 17 nt, Coxiella burnetii RSA 493
auuacgcccuuucucuu

SEQ ID NO: 2589656 - RNA, 15 nt, Coxiella burnetii RSA 493
auuagacauuuuucg

SEQ ID NO: 2589657 - RNA, 16 nt, Coxiella burnetii RSA 493
auuagagcgauuaugu

SEQ ID NO: 2589658 - RNA, 15 nt, Coxiella burnetii RSA 493
auuagagguucaucg

SEQ ID NO: 2589659 - RNA, 17 nt, Coxiella burnetii RSA 493
auuagauuucuggauga

SEQ ID NO: 2589660 - RNA, 15 nt, Coxiella burnetii RSA 493
auuagccagcgaaua

SEQ ID NO: 2589661 - RNA, 13 nt, Coxiella burnetii RSA 493
auuagccuuaauu

SEQ ID NO: 2589662 - RNA, 18 nt, Coxiella burnetii RSA 493
auuagcugccauuuucau

SEQ ID NO: 2589663 - RNA, 13 nt, Coxiella burnetii RSA 493
auuagcuucguua

SEQ ID NO: 2589664 - RNA, 14 nt, Coxiella burnetii RSA 493
auuagcuucguuac

SEQ ID NO: 2589665 - RNA, 14 nt, Coxiella burnetii RSA 493
auuagcuucguuua

SEQ ID NO: 2589666 - RNA, 14 nt, Coxiella burnetii RSA 493
auuaguaauauuuu

SEQ ID NO: 2589667 - RNA, 19 nt, Coxiella burnetii RSA 493
auuagucuuaauuuuaaaa

SEQ ID NO: 2589668 - RNA, 12 nt, Coxiella burnetii RSA 493
auuauaaaugga

SEQ ID NO: 2589669 - RNA, 20 nt, Coxiella burnetii RSA 493
auuauaacuauuuuaaaucu

SEQ ID NO: 2589670 - RNA, 14 nt, Coxiella burnetii RSA 493
auuauaguuaucca

SEQ ID NO: 2589671 - RNA, 19 nt, Coxiella burnetii RSA 493
auuauaguuauccacuaau

SEQ ID NO: 2589672 - RNA, 19 nt, Coxiella burnetii RSA 493
auuaucaugcauuugauuu

SEQ ID NO: 2589673 - RNA, 20 nt, Coxiella burnetii RSA 493
auuauccaaaauccaggcug

SEQ ID NO: 2589674 - RNA, 14 nt, Coxiella burnetii RSA 493
auuaucggaugaug

SEQ ID NO: 2589675 - RNA, 19 nt, Coxiella burnetii RSA 493
auuaucucuuaaaauuccg

SEQ ID NO: 2589676 - RNA, 20 nt, Coxiella burnetii RSA 493
auuaucuuaaugaaauuucu

SEQ ID NO: 2589677 - RNA, 11 nt, Coxiella burnetii RSA 493
auuaugaaaac

SEQ ID NO: 2589678 - RNA, 19 nt, Coxiella burnetii RSA 493
auuaugcaagguugaugcu

SEQ ID NO: 2589679 - RNA, 20 nt, Coxiella burnetii RSA 493
auuaugcgaaauagaauuuu

SEQ ID NO: 2589680 - RNA, 23 nt, Coxiella burnetii RSA 493
auuauuaaaagagcgaauaaaaa

SEQ ID NO: 2589681 - RNA, 20 nt, Coxiella burnetii RSA 493
auuauuaauacaggaaaaag

SEQ ID NO: 2589682 - RNA, 14 nt, Coxiella burnetii RSA 493
auuauugaauuaua

SEQ ID NO: 2589683 - RNA, 16 nt, Coxiella burnetii RSA 493
auucaaacgguaaucg

SEQ ID NO: 2589684 - RNA, 11 nt, Coxiella burnetii RSA 493
auucaaauaau

SEQ ID NO: 2589685 - RNA, 16 nt, Coxiella burnetii RSA 493
auucaacucuuaucuu

SEQ ID NO: 2589686 - RNA, 14 nt, Coxiella burnetii RSA 493
auucaagguuauuu

SEQ ID NO: 2589687 - RNA, 17 nt, Coxiella burnetii RSA 493
auucaagguuauuuuuu

SEQ ID NO: 2589688 - RNA, 16 nt, Coxiella burnetii RSA 493
auucaauacagauuuu

SEQ ID NO: 2589689 - RNA, 17 nt, Coxiella burnetii RSA 493
auucaauacagauuuua

SEQ ID NO: 2589690 - RNA, 18 nt, Coxiella burnetii RSA 493
auucaauacagauuuuag

SEQ ID NO: 2589691 - RNA, 17 nt, Coxiella burnetii RSA 493
auucacgauuuucguug

SEQ ID NO: 2589692 - RNA, 16 nt, Coxiella burnetii RSA 493
auucaggacugaaaua

SEQ ID NO: 2589693 - RNA, 16 nt, Coxiella burnetii RSA 493
auucaggggcaaucaa

SEQ ID NO: 2589694 - RNA, 16 nt, Coxiella burnetii RSA 493
auucaguucgcuaaau

SEQ ID NO: 2589695 - RNA, 15 nt, Coxiella burnetii RSA 493
auucauaaaaaauga

SEQ ID NO: 2589696 - RNA, 18 nt, Coxiella burnetii RSA 493
auucauaucuuuuucaau

SEQ ID NO: 2589697 - RNA, 14 nt, Coxiella burnetii RSA 493
auucaucauuuucc

SEQ ID NO: 2589698 - RNA, 15 nt, Coxiella burnetii RSA 493
auucaucauuuucca

SEQ ID NO: 2589699 - RNA, 21 nt, Coxiella burnetii RSA 493
auucaucauuuuccaaaaaau

SEQ ID NO: 2589700 - RNA, 16 nt, Coxiella burnetii RSA 493
auucaugaaaaguaaa

SEQ ID NO: 2589701 - RNA, 21 nt, Coxiella burnetii RSA 493
auucaugaaaaguaaauuuau

SEQ ID NO: 2589702 - RNA, 19 nt, Coxiella burnetii RSA 493
auucauucgcuuuuuugcu

SEQ ID NO: 2589703 - RNA, 14 nt, Coxiella burnetii RSA 493
auucauuucaauau

SEQ ID NO: 2589704 - RNA, 20 nt, Coxiella burnetii RSA 493
auucauuucaauauuucuug

SEQ ID NO: 2589705 - RNA, 21 nt, Coxiella burnetii RSA 493
auucauuucaauauuucuuga

SEQ ID NO: 2589706 - RNA, 12 nt, Coxiella burnetii RSA 493
auuccaaaccgu

SEQ ID NO: 2589707 - RNA, 23 nt, Coxiella burnetii RSA 493
auuccaaauaaucguaucgauuu

SEQ ID NO: 2589708 - RNA, 16 nt, Coxiella burnetii RSA 493
auuccauuaaaaacaa

SEQ ID NO: 2589709 - RNA, 13 nt, Coxiella burnetii RSA 493
auucccaaacuca

SEQ ID NO: 2589710 - RNA, 16 nt, Coxiella burnetii RSA 493
auucccaccaaaauuc

SEQ ID NO: 2589711 - RNA, 13 nt, Coxiella burnetii RSA 493
auucccagauaaa

SEQ ID NO: 2589712 - RNA, 13 nt, Coxiella burnetii RSA 493
auucccauaaccg

SEQ ID NO: 2589713 - RNA, 22 nt, Coxiella burnetii RSA 493
auucccauagaagaacaauuaa

SEQ ID NO: 2589714 - RNA, 18 nt, Coxiella burnetii RSA 493
auuccccguauuucgcuu

SEQ ID NO: 2589715 - RNA, 13 nt, Coxiella burnetii RSA 493
auucccgcugccu

SEQ ID NO: 2589716 - RNA, 20 nt, Coxiella burnetii RSA 493
auucccuuuuucguguuuuu

SEQ ID NO: 2589717 - RNA, 22 nt, Coxiella burnetii RSA 493
auuccggagucacuaugaucau

SEQ ID NO: 2589718 - RNA, 16 nt, Coxiella burnetii RSA 493
auuccgguuucaaaug

SEQ ID NO: 2589719 - RNA, 21 nt, Coxiella burnetii RSA 493
auuccugccccgacaauuccc

SEQ ID NO: 2589720 - RNA, 20 nt, Coxiella burnetii RSA 493
auuccuguggaagguugaga

SEQ ID NO: 2589721 - RNA, 15 nt, Coxiella burnetii RSA 493
auuccuucaaucaca

SEQ ID NO: 2589722 - RNA, 14 nt, Coxiella burnetii RSA 493
auuccuuuuucuuu

SEQ ID NO: 2589723 - RNA, 16 nt, Coxiella burnetii RSA 493
auucgacauaaggcug

SEQ ID NO: 2589724 - RNA, 15 nt, Coxiella burnetii RSA 493
auucgauaugaaagu

SEQ ID NO: 2589725 - RNA, 15 nt, Coxiella burnetii RSA 493
auucgauauguuuca

SEQ ID NO: 2589726 - RNA, 14 nt, Coxiella burnetii RSA 493
auucgcgcaaguuu

SEQ ID NO: 2589727 - RNA, 16 nt, Coxiella burnetii RSA 493
auucgcguuuuuaaau

SEQ ID NO: 2589728 - RNA, 13 nt, Coxiella burnetii RSA 493
auucgcuuaaauu

SEQ ID NO: 2589729 - RNA, 15 nt, Coxiella burnetii RSA 493
auucgcuuaaauuuu

SEQ ID NO: 2589730 - RNA, 18 nt, Coxiella burnetii RSA 493
auucgcuuaaauuuugac

SEQ ID NO: 2589731 - RNA, 22 nt, Coxiella burnetii RSA 493
auucgcuuuuuugcuucuucca

SEQ ID NO: 2589732 - RNA, 14 nt, Coxiella burnetii RSA 493
auucguaauauuau

SEQ ID NO: 2589733 - RNA, 22 nt, Coxiella burnetii RSA 493
auucguauaggaacauucuaau

SEQ ID NO: 2589734 - RNA, 18 nt, Coxiella burnetii RSA 493
auucuaacguuaguuucu

SEQ ID NO: 2589735 - RNA, 18 nt, Coxiella burnetii RSA 493
auucuaauuaaauuacuu

SEQ ID NO: 2589736 - RNA, 18 nt, Coxiella burnetii RSA 493
auucuagugugauaauca

SEQ ID NO: 2589737 - RNA, 12 nt, Coxiella burnetii RSA 493
auucuauaauca

SEQ ID NO: 2589738 - RNA, 15 nt, Coxiella burnetii RSA 493
auuucccaaaugacg

SEQ ID NO: 2589739 - RNA, 18 nt, Coxiella burnetii RSA 493
auuucccguauuucgcuu

SEQ ID NO: 2589740 - RNA, 15 nt, Coxiella burnetii RSA 493
auuuccgcuucaaac

SEQ ID NO: 2589741 - RNA, 22 nt, Coxiella burnetii RSA 493
auuuccgcuucaaacaauugag

SEQ ID NO: 2589742 - RNA, 23 nt, Coxiella burnetii RSA 493
auuuccgcuucaaacaauugagc

SEQ ID NO: 2589743 - RNA, 17 nt, Coxiella burnetii RSA 493
auuuccgucaauuuuuc

SEQ ID NO: 2589744 - RNA, 16 nt, Coxiella burnetii RSA 493
auuucgagauuauuau

SEQ ID NO: 2589745 - RNA, 19 nt, Coxiella burnetii RSA 493
auuucgcucgcaagaaucu

SEQ ID NO: 2589746 - RNA, 16 nt, Coxiella burnetii RSA 493
auuucgcuucgcucau

SEQ ID NO: 2589747 - RNA, 19 nt, Coxiella burnetii RSA 493
auuucgcuucgcucauacg

SEQ ID NO: 2589748 - RNA, 20 nt, Coxiella burnetii RSA 493
auuucgcuucgcucauacgg

SEQ ID NO: 2589749 - RNA, 20 nt, Coxiella burnetii RSA 493
auuucgcuucgcuccauacg

SEQ ID NO: 2589750 - RNA, 22 nt, Coxiella burnetii RSA 493
auuucggauguuuuuucacuuc

SEQ ID NO: 2589751 - RNA, 13 nt, Coxiella burnetii RSA 493
auuucuaaaaauc

SEQ ID NO: 2589752 - RNA, 16 nt, Coxiella burnetii RSA 493
auuucuaaaaaucauc

SEQ ID NO: 2589753 - RNA, 18 nt, Coxiella burnetii RSA 493
auuucuaucgccguuucu

SEQ ID NO: 2589754 - RNA, 20 nt, Coxiella burnetii RSA 493
auuucucaucugucaucauc

SEQ ID NO: 2589755 - RNA, 16 nt, Coxiella burnetii RSA 493
auuucucuuuuaacuu

SEQ ID NO: 2589756 - RNA, 22 nt, Coxiella burnetii RSA 493
auuucugguugaaucaaauuaa

SEQ ID NO: 2589757 - RNA, 14 nt, Coxiella burnetii RSA 493
auuucuucacggau

SEQ ID NO: 2589758 - RNA, 22 nt, Coxiella burnetii RSA 493
auuucuuccacgggguauugaa

SEQ ID NO: 2589759 - RNA, 13 nt, Coxiella burnetii RSA 493
auuucuuccucaa

SEQ ID NO: 2589760 - RNA, 19 nt, Coxiella burnetii RSA 493
auuucuugucgaaaacuag

SEQ ID NO: 2589761 - RNA, 18 nt, Coxiella burnetii RSA 493
auuucuuuucuaaauaau

SEQ ID NO: 2589762 - RNA, 15 nt, Coxiella burnetii RSA 493
auuucuuuuuguguu

SEQ ID NO: 2589763 - RNA, 14 nt, Coxiella burnetii RSA 493
auuucuuuuuuugu

SEQ ID NO: 2589764 - RNA, 16 nt, Coxiella burnetii RSA 493
auuucuuuuuuugugc

SEQ ID NO: 2589765 - RNA, 14 nt, Coxiella burnetii RSA 493
auuugaaaaaccca

SEQ ID NO: 2589766 - RNA, 13 nt, Coxiella burnetii RSA 493
auuugaaauaaac

SEQ ID NO: 2589767 - RNA, 21 nt, Coxiella burnetii RSA 493
auuugaauuucuguuuuacug

SEQ ID NO: 2589768 - RNA, 19 nt, Coxiella burnetii RSA 493
auuugagaauaaaacggcu

SEQ ID NO: 2589769 - RNA, 21 nt, Coxiella burnetii RSA 493
auuugauaucgaccauuaacc

SEQ ID NO: 2589770 - RNA, 14 nt, Coxiella burnetii RSA 493
auuugauuuuuuuu

SEQ ID NO: 2589771 - RNA, 17 nt, Coxiella burnetii RSA 493
auuugcauuaaucuucc

SEQ ID NO: 2589772 - RNA, 18 nt, Coxiella burnetii RSA 493
auuugcauuaaucuucca

SEQ ID NO: 2589773 - RNA, 20 nt, Coxiella burnetii RSA 493
auuugcggaaaaggagaaag

SEQ ID NO: 2589774 - RNA, 22 nt, Coxiella burnetii RSA 493
auuugcggaaaaggagaaagug

SEQ ID NO: 2589775 - RNA, 18 nt, Coxiella burnetii RSA 493
auuugcugaauuuuauug

SEQ ID NO: 2589776 - RNA, 15 nt, Coxiella burnetii RSA 493
auuuggauugccaau

SEQ ID NO: 2589777 - RNA, 14 nt, Coxiella burnetii RSA 493
auuuggcuuuacau

SEQ ID NO: 2589778 - RNA, 23 nt, Coxiella burnetii RSA 493
auuuguauccgcuuuaauacagu

SEQ ID NO: 2589779 - RNA, 21 nt, Coxiella burnetii RSA 493
auuuguauggcgccugacaaa

SEQ ID NO: 2589780 - RNA, 23 nt, Coxiella burnetii RSA 493
auuuguauggcgccugacaaagc

SEQ ID NO: 2589781 - RNA, 23 nt, Coxiella burnetii RSA 493
auuugucuuuucgcauaauaauc

SEQ ID NO: 2589782 - RNA, 14 nt, Coxiella burnetii RSA 493
auuugugauuuuaa

SEQ ID NO: 2589783 - RNA, 23 nt, Coxiella burnetii RSA 493
auuuguuauugcuaaaaucgaug

SEQ ID NO: 2589784 - RNA, 22 nt, Coxiella burnetii RSA 493
auuuguucgauacagccuucau

SEQ ID NO: 2589785 - RNA, 24 nt, Coxiella burnetii RSA 493
auuuguucgauacagccuucauga

SEQ ID NO: 2589786 - RNA, 17 nt, Coxiella burnetii RSA 493
auuuguucguaauaaua

SEQ ID NO: 2589787 - RNA, 20 nt, Coxiella burnetii RSA 493
auuuguucguaauaauaagc

SEQ ID NO: 2589788 - RNA, 21 nt, Coxiella burnetii RSA 493
auuuguucuuuaacaagauca

SEQ ID NO: 2589789 - RNA, 16 nt, Coxiella burnetii RSA 493
auuuguugaacagagu

SEQ ID NO: 2589790 - RNA, 19 nt, Coxiella burnetii RSA 493
auuuguugaacagagugau

SEQ ID NO: 2589791 - RNA, 13 nt, Coxiella burnetii RSA 493
auuuguugagagu

SEQ ID NO: 2589792 - RNA, 16 nt, Coxiella burnetii RSA 493
auuuuaaaaaaaauac

SEQ ID NO: 2589793 - RNA, 14 nt, Coxiella burnetii RSA 493
auuuuaaaaaaauc

SEQ ID NO: 2589794 - RNA, 12 nt, Coxiella burnetii RSA 493
auuuuaaaaaua

SEQ ID NO: 2589795 - RNA, 21 nt, Coxiella burnetii RSA 493
auuuuaagauaaguucaaccu

SEQ ID NO: 2589796 - RNA, 14 nt, Coxiella burnetii RSA 493
auuuuaaguaauuu

SEQ ID NO: 2589797 - RNA, 13 nt, Coxiella burnetii RSA 493
auuuuaauuuuuu

SEQ ID NO: 2589798 - RNA, 16 nt, Coxiella burnetii RSA 493
auuuuaauuuuuucuc

SEQ ID NO: 2589799 - RNA, 16 nt, Coxiella burnetii RSA 493
auuuuacaauaaucca

SEQ ID NO: 2589800 - RNA, 18 nt, Coxiella burnetii RSA 493
auuuuacgcuauuuuuua

SEQ ID NO: 2589801 - RNA, 20 nt, Coxiella burnetii RSA 493
auuuuaguugcuaaugaaac

SEQ ID NO: 2589802 - RNA, 18 nt, Coxiella burnetii RSA 493
auuuuaucuuauuauuca

SEQ ID NO: 2589803 - RNA, 16 nt, Coxiella burnetii RSA 493
auuuuauuauuuauca

SEQ ID NO: 2589804 - RNA, 15 nt, Coxiella burnetii RSA 493
auuuucaaaagaggg

SEQ ID NO: 2589805 - RNA, 16 nt, Coxiella burnetii RSA 493
auuuucaaaugaauaa

SEQ ID NO: 2589806 - RNA, 19 nt, Coxiella burnetii RSA 493
auuuucauucucaauaguc

SEQ ID NO: 2589807 - RNA, 18 nt, Coxiella burnetii RSA 493
auuuucauuuucucuaau

SEQ ID NO: 2589808 - RNA, 21 nt, Coxiella burnetii RSA 493
auuuuccucacggcaauucuc

SEQ ID NO: 2589809 - RNA, 18 nt, Coxiella burnetii RSA 493
auuuuccucccauugaua

SEQ ID NO: 2589810 - RNA, 16 nt, Coxiella burnetii RSA 493
auuuucguccaauucu

SEQ ID NO: 2589811 - RNA, 21 nt, Coxiella burnetii RSA 493
auuuucgucguagacaaucaa

SEQ ID NO: 2589812 - RNA, 22 nt, Coxiella burnetii RSA 493
auuuucugggagauuuauuccu

SEQ ID NO: 2589813 - RNA, 20 nt, Coxiella burnetii RSA 493
auuuucugugguuaauucuu

SEQ ID NO: 2589814 - RNA, 14 nt, Coxiella burnetii RSA 493
auuuugaacaguuc

SEQ ID NO: 2589815 - RNA, 15 nt, Coxiella burnetii RSA 493
auuuugauucucuau

SEQ ID NO: 2589816 - RNA, 19 nt, Coxiella burnetii RSA 493
auuuugauuuuuuaauuca

SEQ ID NO: 2589817 - RNA, 16 nt, Coxiella burnetii RSA 493
auuuugcgcucauuuu

SEQ ID NO: 2589818 - RNA, 18 nt, Coxiella burnetii RSA 493
auuuugcgcucauuuuca

SEQ ID NO: 2589819 - RNA, 22 nt, Coxiella burnetii RSA 493
auuuuggcucccuaauacugug

SEQ ID NO: 2589820 - RNA, 23 nt, Coxiella burnetii RSA 493
auuuuggugcuggcguuuuuaac

SEQ ID NO: 2589821 - RNA, 22 nt, Coxiella burnetii RSA 493
auuuuguccuguucuuuuucca

SEQ ID NO: 2589822 - RNA, 14 nt, Coxiella burnetii RSA 493
auuuuuaaauuauc

SEQ ID NO: 2589823 - RNA, 21 nt, Coxiella burnetii RSA 493
auuuuuauucuuaauuuuucc

SEQ ID NO: 2589824 - RNA, 20 nt, Coxiella burnetii RSA 493
auuuuuauuuccagcaguaa

SEQ ID NO: 2589825 - RNA, 17 nt, Coxiella burnetii RSA 493
auuuuucgaugauuaag

SEQ ID NO: 2589826 - RNA, 16 nt, Coxiella burnetii RSA 493
auuuuucgcucaauug

SEQ ID NO: 2589827 - RNA, 17 nt, Coxiella burnetii RSA 493
auuuuucgcucaauugu

SEQ ID NO: 2589828 - RNA, 18 nt, Coxiella burnetii RSA 493
auuuuucgcucaauuguu

SEQ ID NO: 2589829 - RNA, 17 nt, Coxiella burnetii RSA 493
auuuuucucaucauuuu

SEQ ID NO: 2589830 - RNA, 14 nt, Coxiella burnetii RSA 493
auuuuucucuucuu

SEQ ID NO: 2589831 - RNA, 15 nt, Coxiella burnetii RSA 493
auuuuucucuuucau

SEQ ID NO: 2589832 - RNA, 16 nt, Coxiella burnetii RSA 493
auuuuucuuuguuccu

SEQ ID NO: 2589833 - RNA, 17 nt, Coxiella burnetii RSA 493
auuuuucuuuuuuuucu

SEQ ID NO: 2589834 - RNA, 22 nt, Coxiella burnetii RSA 493
auuuuugccaggacuuuaagau

SEQ ID NO: 2589835 - RNA, 20 nt, Coxiella burnetii RSA 493
auuuuuguaaauuaaucauc

SEQ ID NO: 2589836 - RNA, 12 nt, Coxiella burnetii RSA 493
auuuuuuaaauc

SEQ ID NO: 2589837 - RNA, 14 nt, Coxiella burnetii RSA 493
auuuuuuaaaucuu

SEQ ID NO: 2589838 - RNA, 13 nt, Coxiella burnetii RSA 493
auuuuuucaaauu

SEQ ID NO: 2589839 - RNA, 19 nt, Coxiella burnetii RSA 493
auuuuuucaaauugcugaa

SEQ ID NO: 2589840 - RNA, 13 nt, Coxiella burnetii RSA 493
auuuuuucgagug

SEQ ID NO: 2589841 - RNA, 13 nt, Coxiella burnetii RSA 493
auuuuuucuuugc

SEQ ID NO: 2589842 - RNA, 11 nt, Coxiella burnetii RSA 493
auuuuuuucuu

SEQ ID NO: 2589843 - RNA, 23 nt, Coxiella burnetii RSA 493
caacguuugauuuucaaguuuau

SEQ ID NO: 2589844 - RNA, 19 nt, Coxiella burnetii RSA 493
caacuaccugauaaaauaa

SEQ ID NO: 2589845 - RNA, 11 nt, Coxiella burnetii RSA 493
caacuacuuga

SEQ ID NO: 2589846 - RNA, 12 nt, Coxiella burnetii RSA 493
caacucuacuuc

SEQ ID NO: 2589847 - RNA, 13 nt, Coxiella burnetii RSA 493
caacucuuuggcg

SEQ ID NO: 2589848 - RNA, 19 nt, Coxiella burnetii RSA 493
caacugcgccgcaaaguaa

SEQ ID NO: 2589849 - RNA, 18 nt, Coxiella burnetii RSA 493
caacuuccgcuacguuuu

SEQ ID NO: 2589850 - RNA, 20 nt, Coxiella burnetii RSA 493
caacuucgaacauuuguuua

SEQ ID NO: 2589851 - RNA, 18 nt, Coxiella burnetii RSA 493
caacuugggugggauugu

SEQ ID NO: 2589852 - RNA, 21 nt, Coxiella burnetii RSA 493
caacuuuauaguucauuaaau

SEQ ID NO: 2589853 - RNA, 17 nt, Coxiella burnetii RSA 493
caagaaaaauuccaaaa

SEQ ID NO: 2589854 - RNA, 17 nt, Coxiella burnetii RSA 493
caagaaauugcggaaau

SEQ ID NO: 2589855 - RNA, 20 nt, Coxiella burnetii RSA 493
caagaaauugcggaaauuuc

SEQ ID NO: 2589856 - RNA, 18 nt, Coxiella burnetii RSA 493
caagaaccgcgacuaaac

SEQ ID NO: 2589857 - RNA, 21 nt, Coxiella burnetii RSA 493
caagaaccgcgacuaaaccaa

SEQ ID NO: 2589858 - RNA, 17 nt, Coxiella burnetii RSA 493
caagaauuuuuuuauaa

SEQ ID NO: 2589859 - RNA, 14 nt, Coxiella burnetii RSA 493
caagaccccuauca

SEQ ID NO: 2589860 - RNA, 16 nt, Coxiella burnetii RSA 493
caagaggaguucuaaa

SEQ ID NO: 2589861 - RNA, 17 nt, Coxiella burnetii RSA 493
caagaggaguucuaaaa

SEQ ID NO: 2589862 - RNA, 16 nt, Coxiella burnetii RSA 493
caagauuuuuuuaagu

SEQ ID NO: 2589863 - RNA, 20 nt, Coxiella burnetii RSA 493
caagcaaagcgcguaagcag

SEQ ID NO: 2589864 - RNA, 20 nt, Coxiella burnetii RSA 493
caagcacugcuuugguucca

SEQ ID NO: 2589865 - RNA, 20 nt, Coxiella burnetii RSA 493
caagcagggcaguaaauaga

SEQ ID NO: 2589866 - RNA, 21 nt, Coxiella burnetii RSA 493
caagccccuuuaaugcauuug

SEQ ID NO: 2589867 - RNA, 13 nt, Coxiella burnetii RSA 493
caagcccuuuuuu

SEQ ID NO: 2589868 - RNA, 18 nt, Coxiella burnetii RSA 493
caagcgaacgcggccuug

SEQ ID NO: 2589869 - RNA, 16 nt, Coxiella burnetii RSA 493
caagcguuguaaauuu

SEQ ID NO: 2589870 - RNA, 20 nt, Coxiella burnetii RSA 493
caagguuggggucgcgaguu

SEQ ID NO: 2589871 - RNA, 22 nt, Coxiella burnetii RSA 493
caaguaauucagcauucccaua

SEQ ID NO: 2589872 - RNA, 17 nt, Coxiella burnetii RSA 493
caaguagccaaaauaau

SEQ ID NO: 2589873 - RNA, 18 nt, Coxiella burnetii RSA 493
caaguagccaaaauaaua

SEQ ID NO: 2589874 - RNA, 20 nt, Coxiella burnetii RSA 493
caaguccuugcugaauuccc

SEQ ID NO: 2589875 - RNA, 22 nt, Coxiella burnetii RSA 493
caagucgagguugucaacaaaa

SEQ ID NO: 2589876 - RNA, 23 nt, Coxiella burnetii RSA 493
caagucgagguugucaacaaaau

SEQ ID NO: 2589877 - RNA, 13 nt, Coxiella burnetii RSA 493
caagugugggaaa

SEQ ID NO: 2589878 - RNA, 18 nt, Coxiella burnetii RSA 493
caagugugggaaaaauag

SEQ ID NO: 2589879 - RNA, 14 nt, Coxiella burnetii RSA 493
caaguucuucuaaa

SEQ ID NO: 2589880 - RNA, 18 nt, Coxiella burnetii RSA 493
caaguucuucuaaagaau

SEQ ID NO: 2589881 - RNA, 13 nt, Coxiella burnetii RSA 493
caaguugcagagu

SEQ ID NO: 2589882 - RNA, 14 nt, Coxiella burnetii RSA 493
caaguuuauaagau

SEQ ID NO: 2589883 - RNA, 15 nt, Coxiella burnetii RSA 493
caaguuuaucguaaa

SEQ ID NO: 2589884 - RNA, 20 nt, Coxiella burnetii RSA 493
caaguuuuaagaaaaaccag

SEQ ID NO: 2589885 - RNA, 17 nt, Coxiella burnetii RSA 493
caauaaaagcgccugcc

SEQ ID NO: 2589886 - RNA, 13 nt, Coxiella burnetii RSA 493
caauaaagaaagc

SEQ ID NO: 2589887 - RNA, 14 nt, Coxiella burnetii RSA 493
caauaaauaaauca

SEQ ID NO: 2589888 - RNA, 15 nt, Coxiella burnetii RSA 493
caauaaauaaaucaa

SEQ ID NO: 2589889 - RNA, 14 nt, Coxiella burnetii RSA 493
caauaacaaauaaa

SEQ ID NO: 2589890 - RNA, 18 nt, Coxiella burnetii RSA 493
caauaacagagauaaauu

SEQ ID NO: 2589891 - RNA, 17 nt, Coxiella burnetii RSA 493
caauaagcuagaaaaua

SEQ ID NO: 2589892 - RNA, 16 nt, Coxiella burnetii RSA 493
caauaaggcauuugca

SEQ ID NO: 2589893 - RNA, 15 nt, Coxiella burnetii RSA 493
caauaaguguuugau

SEQ ID NO: 2589894 - RNA, 15 nt, Coxiella burnetii RSA 493
caauaauaguuugca

SEQ ID NO: 2589895 - RNA, 21 nt, Coxiella burnetii RSA 493
caauaaucucacacaacucca

SEQ ID NO: 2589896 - RNA, 20 nt, Coxiella burnetii RSA 493
caauacaucuugauccuuuu

SEQ ID NO: 2589897 - RNA, 23 nt, Coxiella burnetii RSA 493
caauacaucuugauccuuuugau

SEQ ID NO: 2589898 - RNA, 20 nt, Coxiella burnetii RSA 493
caauaccgguaaucauuucc

SEQ ID NO: 2589899 - RNA, 18 nt, Coxiella burnetii RSA 493
caauacuguguuggaauu

SEQ ID NO: 2589900 - RNA, 23 nt, Coxiella burnetii RSA 493
caauacuuuccagugacucaucu

SEQ ID NO: 2589901 - RNA, 17 nt, Coxiella burnetii RSA 493
caauagaaaaaagaaau

SEQ ID NO: 2589902 - RNA, 14 nt, Coxiella burnetii RSA 493
caauagaauaauga

SEQ ID NO: 2589903 - RNA, 19 nt, Coxiella burnetii RSA 493
caauagagcgggaauuuuc

SEQ ID NO: 2589904 - RNA, 23 nt, Coxiella burnetii RSA 493
caauagaggucguaccuucaauu

SEQ ID NO: 2589905 - RNA, 16 nt, Coxiella burnetii RSA 493
caauagaguaauucca

SEQ ID NO: 2589906 - RNA, 15 nt, Coxiella burnetii RSA 493
caauagucuuuuuau

SEQ ID NO: 2589907 - RNA, 16 nt, Coxiella burnetii RSA 493
caauauuuagagaagg

SEQ ID NO: 2589908 - RNA, 23 nt, Coxiella burnetii RSA 493
caauauuucgucagugaaugauc

SEQ ID NO: 2589909 - RNA, 17 nt, Coxiella burnetii RSA 493
caauauuucuugaaaaa

SEQ ID NO: 2589910 - RNA, 19 nt, Coxiella burnetii RSA 493
caaucaauucgaaagaaau

SEQ ID NO: 2589911 - RNA, 20 nt, Coxiella burnetii RSA 493
caaucaauucgaaagaaaua

SEQ ID NO: 2589912 - RNA, 23 nt, Coxiella burnetii RSA 493
caaucaauuuaccaauuaaagaa

SEQ ID NO: 2589913 - RNA, 22 nt, Coxiella burnetii RSA 493
caaucacaaguucuucuaaaga

SEQ ID NO: 2589914 - RNA, 14 nt, Coxiella burnetii RSA 493
caaucacuacaaau

SEQ ID NO: 2589915 - RNA, 22 nt, Coxiella burnetii RSA 493
caaucaucauccuuaagccguc

SEQ ID NO: 2589916 - RNA, 19 nt, Coxiella burnetii RSA 493
caaucauuuuuguacugcu

SEQ ID NO: 2589917 - RNA, 21 nt, Coxiella burnetii RSA 493
caaucauuuuuguacugcugu

SEQ ID NO: 2589918 - RNA, 20 nt, Coxiella burnetii RSA 493
caauccucucucucacaaaa

SEQ ID NO: 2589919 - RNA, 15 nt, Coxiella burnetii RSA 493
caaucgacaggacaa

SEQ ID NO: 2589920 - RNA, 20 nt, Coxiella burnetii RSA 493
caaucgacaggacaaaccug

SEQ ID NO: 2589921 - RNA, 19 nt, Coxiella burnetii RSA 493
caaucgaccgagaauuaau

SEQ ID NO: 2589922 - RNA, 19 nt, Coxiella burnetii RSA 493
caaucggauuaacgugcuc

SEQ ID NO: 2589923 - RNA, 17 nt, Coxiella burnetii RSA 493
caaucguguagaaagaa

SEQ ID NO: 2589924 - RNA, 21 nt, Coxiella burnetii RSA 493
caaugaaacaaacaaaaaaua

SEQ ID NO: 2589925 - RNA, 17 nt, Coxiella burnetii RSA 493
caaugaaauauauaaag

SEQ ID NO: 2589926 - RNA, 18 nt, Coxiella burnetii RSA 493
caaugacgcagaauauaa

SEQ ID NO: 2589927 - RNA, 20 nt, Coxiella burnetii RSA 493
caaugcgcucugccacauaa

SEQ ID NO: 2589928 - RNA, 20 nt, Coxiella burnetii RSA 493
caauggcgugacccuuaauu

SEQ ID NO: 2589929 - RNA, 23 nt, Coxiella burnetii RSA 493
caaugguggucggcaccaaaauc

SEQ ID NO: 2589930 - RNA, 19 nt, Coxiella burnetii RSA 493
caauguaggugaaaacguc

SEQ ID NO: 2589931 - RNA, 13 nt, Coxiella burnetii RSA 493
caauguuaaaaca

SEQ ID NO: 2589932 - RNA, 18 nt, Coxiella burnetii RSA 493
caauguuuccaaauaaug

SEQ ID NO: 2589933 - RNA, 12 nt, Coxiella burnetii RSA 493
caauuaaagaau

SEQ ID NO: 2589934 - RNA, 18 nt, Coxiella burnetii RSA 493
caauuaacuuugcaaagc

SEQ ID NO: 2589935 - RNA, 22 nt, Coxiella burnetii RSA 493
caauuaaugcgccuacaaauac

SEQ ID NO: 2589936 - RNA, 19 nt, Coxiella burnetii RSA 493
caauuacgcccuuucucuu

SEQ ID NO: 2589937 - RNA, 20 nt, Coxiella burnetii RSA 493
caauuacgcccuuucucuuu

SEQ ID NO: 2589938 - RNA, 19 nt, Coxiella burnetii RSA 493
caauuacuccaauuucauu

SEQ ID NO: 2589939 - RNA, 15 nt, Coxiella burnetii RSA 493
caauuacuuuuauaa

SEQ ID NO: 2589940 - RNA, 15 nt, Coxiella burnetii RSA 493
caauuagcauuuucu

SEQ ID NO: 2589941 - RNA, 21 nt, Coxiella burnetii RSA 493
caauuagcauuuucuccaaag

SEQ ID NO: 2589942 - RNA, 14 nt, Coxiella burnetii RSA 493
caauuauacugaca

SEQ ID NO: 2589943 - RNA, 13 nt, Coxiella burnetii RSA 493
caauuaugaaaac

SEQ ID NO: 2589944 - RNA, 15 nt, Coxiella burnetii RSA 493
caauucaauuuuuuu

SEQ ID NO: 2589945 - RNA, 20 nt, Coxiella burnetii RSA 493
caauucccguauuucgcuuc

SEQ ID NO: 2589946 - RNA, 20 nt, Coxiella burnetii RSA 493
caauuccgguuucaaaugac

SEQ ID NO: 2589947 - RNA, 18 nt, Coxiella burnetii RSA 493
caauucgggggcaacggg

SEQ ID NO: 2589948 - RNA, 15 nt, Coxiella burnetii RSA 493
cagauaaugaccuua

SEQ ID NO: 2589949 - RNA, 13 nt, Coxiella burnetii RSA 493
cagauacacauaa

SEQ ID NO: 2589950 - RNA, 18 nt, Coxiella burnetii RSA 493
cagauacuguacuggaau

SEQ ID NO: 2589951 - RNA, 17 nt, Coxiella burnetii RSA 493
cagaugauuaaaagcaa

SEQ ID NO: 2589952 - RNA, 18 nt, Coxiella burnetii RSA 493
cagaugcuccaucaugau

SEQ ID NO: 2589953 - RNA, 15 nt, Coxiella burnetii RSA 493
cagauuguaaaucau

SEQ ID NO: 2589954 - RNA, 20 nt, Coxiella burnetii RSA 493
cagauuuuagugaaaguuuc

SEQ ID NO: 2589955 - RNA, 20 nt, Coxiella burnetii RSA 493
cagcaagaggaguucuaaaa

SEQ ID NO: 2589956 - RNA, 21 nt, Coxiella burnetii RSA 493
cagcaagaggaguucuaaaaa

SEQ ID NO: 2589957 - RNA, 16 nt, Coxiella burnetii RSA 493
cagcaaguugcagagu

SEQ ID NO: 2589958 - RNA, 18 nt, Coxiella burnetii RSA 493
cagcaauggugauuucuu

SEQ ID NO: 2589959 - RNA, 21 nt, Coxiella burnetii RSA 493
cagcaauggugauuucuucca

SEQ ID NO: 2589960 - RNA, 18 nt, Coxiella burnetii RSA 493
cagcagaaaagaugguug

SEQ ID NO: 2589961 - RNA, 19 nt, Coxiella burnetii RSA 493
cagcaggaaccaggaaagu

SEQ ID NO: 2589962 - RNA, 17 nt, Coxiella burnetii RSA 493
cagcaucccccaagaga

SEQ ID NO: 2589963 - RNA, 18 nt, Coxiella burnetii RSA 493
cagcauuagcuucguuua

SEQ ID NO: 2589964 - RNA, 16 nt, Coxiella burnetii RSA 493
cagccacaaagaauuu

SEQ ID NO: 2589965 - RNA, 23 nt, Coxiella burnetii RSA 493
cagccauauaaucgcaaaauuca

SEQ ID NO: 2589966 - RNA, 19 nt, Coxiella burnetii RSA 493
cagccccaacuacggccua

SEQ ID NO: 2589967 - RNA, 22 nt, Coxiella burnetii RSA 493
cagccgaagugcuaaaaaauua

SEQ ID NO: 2589968 - RNA, 20 nt, Coxiella burnetii RSA 493
cagccgaaugaucugcucuu

SEQ ID NO: 2589969 - RNA, 19 nt, Coxiella burnetii RSA 493
cagccgaugacaaauaaac

SEQ ID NO: 2589970 - RNA, 21 nt, Coxiella burnetii RSA 493
cagccgauucuucauacuaac

SEQ ID NO: 2589971 - RNA, 14 nt, Coxiella burnetii RSA 493
cagccgcuuuuuau

SEQ ID NO: 2589972 - RNA, 17 nt, Coxiella burnetii RSA 493
cagccuccaucccuccu

SEQ ID NO: 2589973 - RNA, 23 nt, Coxiella burnetii RSA 493
cagccuucaugaauauuuuucuc

SEQ ID NO: 2589974 - RNA, 21 nt, Coxiella burnetii RSA 493
cagccuuuaguuuuauuugaa

SEQ ID NO: 2589975 - RNA, 14 nt, Coxiella burnetii RSA 493
cagcgaaauacgag

SEQ ID NO: 2589976 - RNA, 19 nt, Coxiella burnetii RSA 493
cagcgaacauccaauuacu

SEQ ID NO: 2589977 - RNA, 21 nt, Coxiella burnetii RSA 493
cagcgaacauccaauuacucc

SEQ ID NO: 2589978 - RNA, 20 nt, Coxiella burnetii RSA 493
cagcgaagcgaaauacggga

SEQ ID NO: 2589979 - RNA, 21 nt, Coxiella burnetii RSA 493
cagcgaagcgaaauacgggga

SEQ ID NO: 2589980 - RNA, 14 nt, Coxiella burnetii RSA 493
cagcgaauaagauc

SEQ ID NO: 2589981 - RNA, 22 nt, Coxiella burnetii RSA 493
cagcgaugaaaaaguucuaagc

SEQ ID NO: 2589982 - RNA, 15 nt, Coxiella burnetii RSA 493
cagcgauuuauuucu

SEQ ID NO: 2589983 - RNA, 16 nt, Coxiella burnetii RSA 493
cagcgcccaauaagga

SEQ ID NO: 2589984 - RNA, 15 nt, Coxiella burnetii RSA 493
cagcggaacaccauu

SEQ ID NO: 2589985 - RNA, 23 nt, Coxiella burnetii RSA 493
cagcguauuuguguaaaauacug

SEQ ID NO: 2589986 - RNA, 14 nt, Coxiella burnetii RSA 493
cagcucaaacaaau

SEQ ID NO: 2589987 - RNA, 13 nt, Coxiella burnetii RSA 493
cagcuccauagau

SEQ ID NO: 2589988 - RNA, 21 nt, Coxiella burnetii RSA 493
cagcucguaagcgugcaacaa

SEQ ID NO: 2589989 - RNA, 23 nt, Coxiella burnetii RSA 493
cagcucguaagcgugcaacaagc

SEQ ID NO: 2589990 - RNA, 22 nt, Coxiella burnetii RSA 493
cagcuucgugcaauuucuggcu

SEQ ID NO: 2589991 - RNA, 22 nt, Coxiella burnetii RSA 493
cagcuugugcaauuccauuaaa

SEQ ID NO: 2589992 - RNA, 14 nt, Coxiella burnetii RSA 493
caggaaaaagauaa

SEQ ID NO: 2589993 - RNA, 15 nt, Coxiella burnetii RSA 493
caggacaaaccuggc

SEQ ID NO: 2589994 - RNA, 15 nt, Coxiella burnetii RSA 493
caggauaauguuuga

SEQ ID NO: 2589995 - RNA, 21 nt, Coxiella burnetii RSA 493
caggauaauguuugauaucaa

SEQ ID NO: 2589996 - RNA, 23 nt, Coxiella burnetii RSA 493
caggaucuugucgauaauaguua

SEQ ID NO: 2589997 - RNA, 17 nt, Coxiella burnetii RSA 493
caggauuauauuaguuu

SEQ ID NO: 2589998 - RNA, 13 nt, Coxiella burnetii RSA 493
caggcagaugauu

SEQ ID NO: 2589999 - RNA, 16 nt, Coxiella burnetii RSA 493
caggcagaugauuaaa

SEQ ID NO: 2590000 - RNA, 16 nt, Coxiella burnetii RSA 493
caggcaguagagacaa

SEQ ID NO: 2590001 - RNA, 12 nt, Coxiella burnetii RSA 493
caggcuucauac

SEQ ID NO: 2590002 - RNA, 22 nt, Coxiella burnetii RSA 493
cagggcuuguucacgcaaacag

SEQ ID NO: 2590003 - RNA, 14 nt, Coxiella burnetii RSA 493
cagguccuaaaaaa

SEQ ID NO: 2590004 - RNA, 17 nt, Coxiella burnetii RSA 493
caggugacuguuaauca

SEQ ID NO: 2590005 - RNA, 16 nt, Coxiella burnetii RSA 493
cagguucggauuucac

SEQ ID NO: 2590006 - RNA, 20 nt, Coxiella burnetii RSA 493
cagguucggauuucacuuua

SEQ ID NO: 2590007 - RNA, 18 nt, Coxiella burnetii RSA 493
caguaaauaaucauuuuu

SEQ ID NO: 2590008 - RNA, 18 nt, Coxiella burnetii RSA 493
caguaacucuaauuuucc

SEQ ID NO: 2590009 - RNA, 20 nt, Coxiella burnetii RSA 493
caguaacucuaauuuuccug

SEQ ID NO: 2590010 - RNA, 13 nt, Coxiella burnetii RSA 493
caguaaugagcau

SEQ ID NO: 2590011 - RNA, 18 nt, Coxiella burnetii RSA 493
caguaaugagcaucuuuu

SEQ ID NO: 2590012 - RNA, 19 nt, Coxiella burnetii RSA 493
caguaccgucauaaggaau

SEQ ID NO: 2590013 - RNA, 13 nt, Coxiella burnetii RSA 493
caguaguuuauca

SEQ ID NO: 2590014 - RNA, 16 nt, Coxiella burnetii RSA 493
caguaucuauuccugc

SEQ ID NO: 2590015 - RNA, 22 nt, Coxiella burnetii RSA 493
caguauuucuaucgccguuucu

SEQ ID NO: 2590016 - RNA, 20 nt, Coxiella burnetii RSA 493
cagucacucggccugggcaa

SEQ ID NO: 2590017 - RNA, 14 nt, Coxiella burnetii RSA 493
cagucauucauuuc

SEQ ID NO: 2590018 - RNA, 13 nt, Coxiella burnetii RSA 493
cagugaaaacccg

SEQ ID NO: 2590019 - RNA, 19 nt, Coxiella burnetii RSA 493
cagugaaaacccgagcgga

SEQ ID NO: 2590020 - RNA, 16 nt, Coxiella burnetii RSA 493
cagugauaaagcguuu

SEQ ID NO: 2590021 - RNA, 18 nt, Coxiella burnetii RSA 493
cagugccgguucccgcuu

SEQ ID NO: 2590022 - RNA, 12 nt, Coxiella burnetii RSA 493
caguuaaaauaa

SEQ ID NO: 2590023 - RNA, 13 nt, Coxiella burnetii RSA 493
caguuaaaauaau

SEQ ID NO: 2590024 - RNA, 16 nt, Coxiella burnetii RSA 493
caguuaaaauaaugag

SEQ ID NO: 2590025 - RNA, 23 nt, Coxiella burnetii RSA 493
caguuacguaauuauuaagccuu

SEQ ID NO: 2590026 - RNA, 20 nt, Coxiella burnetii RSA 493
caguucgggccuucacuuuu

SEQ ID NO: 2590027 - RNA, 14 nt, Coxiella burnetii RSA 493
caguucucuauucu

SEQ ID NO: 2590028 - RNA, 22 nt, Coxiella burnetii RSA 493
caguucucuauucuuaaacccu

SEQ ID NO: 2590029 - RNA, 23 nt, Coxiella burnetii RSA 493
caguucuuaacgaagguuucaua

SEQ ID NO: 2590030 - RNA, 16 nt, Coxiella burnetii RSA 493
caguuggcuaaaucca

SEQ ID NO: 2590031 - RNA, 14 nt, Coxiella burnetii RSA 493
caguuguuuuaaau

SEQ ID NO: 2590032 - RNA, 13 nt, Coxiella burnetii RSA 493
caguuugcagguu

SEQ ID NO: 2590033 - RNA, 14 nt, Coxiella burnetii RSA 493
caguuuguccuugc

SEQ ID NO: 2590034 - RNA, 14 nt, Coxiella burnetii RSA 493
caguuuucuucaau

SEQ ID NO: 2590035 - RNA, 18 nt, Coxiella burnetii RSA 493
caguuuugaugaaaagaa

SEQ ID NO: 2590036 - RNA, 20 nt, Coxiella burnetii RSA 493
cauaaaggcuaauaggaaaa

SEQ ID NO: 2590037 - RNA, 22 nt, Coxiella burnetii RSA 493
cauaaaggcuaauaggaaaaau

SEQ ID NO: 2590038 - RNA, 15 nt, Coxiella burnetii RSA 493
cauaaagguuuucuu

SEQ ID NO: 2590039 - RNA, 11 nt, Coxiella burnetii RSA 493
cauaaauaaaa

SEQ ID NO: 2590040 - RNA, 17 nt, Coxiella burnetii RSA 493
cauaaauaaaagcccgc

SEQ ID NO: 2590041 - RNA, 12 nt, Coxiella burnetii RSA 493
cauaaauaauuc

SEQ ID NO: 2590042 - RNA, 17 nt, Coxiella burnetii RSA 493
cauaaauagcauuaaua

SEQ ID NO: 2590043 - RNA, 22 nt, Coxiella burnetii RSA 493
cauaaauagcauuaauaagacc

SEQ ID NO: 2590044 - RNA, 17 nt, Coxiella burnetii RSA 493
cauaacaaugaauuguc

SEQ ID NO: 2590045 - RNA, 17 nt, Coxiella burnetii RSA 493
cauaacuucguccgaag

SEQ ID NO: 2590046 - RNA, 15 nt, Coxiella burnetii RSA 493
cauaaggaaauugau

SEQ ID NO: 2590047 - RNA, 20 nt, Coxiella burnetii RSA 493
cauaauaacgcuaugaaaac

SEQ ID NO: 2590048 - RNA, 21 nt, Coxiella burnetii RSA 493
cauaauagcgaucagcggaau

SEQ ID NO: 2590049 - RNA, 23 nt, Coxiella burnetii RSA 493
cauaauauuuucugccgcugaua

SEQ ID NO: 2590050 - RNA, 14 nt, Coxiella burnetii RSA 493
cauaaucaaaauca

SEQ ID NO: 2590051 - RNA, 21 nt, Coxiella burnetii RSA 493
cauaaucgguuauuucucgaa

SEQ ID NO: 2590052 - RNA, 12 nt, Coxiella burnetii RSA 493
cauaauucauca

SEQ ID NO: 2590053 - RNA, 19 nt, Coxiella burnetii RSA 493
cauuaucucuuaaaauucc

SEQ ID NO: 2590054 - RNA, 17 nt, Coxiella burnetii RSA 493
cauucaaggaauuauuu

SEQ ID NO: 2590055 - RNA, 14 nt, Coxiella burnetii RSA 493
cauucauucgcuuu

SEQ ID NO: 2590056 - RNA, 13 nt, Coxiella burnetii RSA 493
cauucauucuuuu

SEQ ID NO: 2590057 - RNA, 14 nt, Coxiella burnetii RSA 493
cauuccaaaaacag

SEQ ID NO: 2590058 - RNA, 22 nt, Coxiella burnetii RSA 493
cauuccaaaaacagauuuaaau

SEQ ID NO: 2590059 - RNA, 19 nt, Coxiella burnetii RSA 493
cauuccccaccacucacag

SEQ ID NO: 2590060 - RNA, 14 nt, Coxiella burnetii RSA 493
cauucccgcgcagg

SEQ ID NO: 2590061 - RNA, 19 nt, Coxiella burnetii RSA 493
cauucggguucgcagacau

SEQ ID NO: 2590062 - RNA, 17 nt, Coxiella burnetii RSA 493
cauucuagguuauuuuu

SEQ ID NO: 2590063 - RNA, 20 nt, Coxiella burnetii RSA 493
cauucuuauccuuacaaaaa

SEQ ID NO: 2590064 - RNA, 14 nt, Coxiella burnetii RSA 493
cauucuucuaauga

SEQ ID NO: 2590065 - RNA, 18 nt, Coxiella burnetii RSA 493
cauucuuuuuucaagccc

SEQ ID NO: 2590066 - RNA, 13 nt, Coxiella burnetii RSA 493
cauugaaaucaau

SEQ ID NO: 2590067 - RNA, 13 nt, Coxiella burnetii RSA 493
cauugacagccag

SEQ ID NO: 2590068 - RNA, 23 nt, Coxiella burnetii RSA 493
cauugacaugaagguacugaaga

SEQ ID NO: 2590069 - RNA, 21 nt, Coxiella burnetii RSA 493
cauugagaauaccccgcuguu

SEQ ID NO: 2590070 - RNA, 13 nt, Coxiella burnetii RSA 493
cauugagcgggau

SEQ ID NO: 2590071 - RNA, 19 nt, Coxiella burnetii RSA 493
cauugggcuggaguugucc

SEQ ID NO: 2590072 - RNA, 16 nt, Coxiella burnetii RSA 493
cauugguaaagccguu

SEQ ID NO: 2590073 - RNA, 18 nt, Coxiella burnetii RSA 493
cauugguauggucacaug

SEQ ID NO: 2590074 - RNA, 17 nt, Coxiella burnetii RSA 493
cauuggucaaugucagc

SEQ ID NO: 2590075 - RNA, 13 nt, Coxiella burnetii RSA 493
cauugguuuaaaa

SEQ ID NO: 2590076 - RNA, 20 nt, Coxiella burnetii RSA 493
agcuaagaucaagaaagaca

SEQ ID NO: 2590077 - RNA, 17 nt, Coxiella burnetii RSA 493
agcuauaagcaaugggu

SEQ ID NO: 2590078 - RNA, 18 nt, Coxiella burnetii RSA 493
agcuauaagcaauggguu

SEQ ID NO: 2590079 - RNA, 17 nt, Coxiella burnetii RSA 493
agcucaaacaaaucaau

SEQ ID NO: 2590080 - RNA, 19 nt, Coxiella burnetii RSA 493
agcucauugccaaagaaau

SEQ ID NO: 2590081 - RNA, 13 nt, Coxiella burnetii RSA 493
agcuccaaacggu

SEQ ID NO: 2590082 - RNA, 15 nt, Coxiella burnetii RSA 493
agcuccauagauggg

SEQ ID NO: 2590083 - RNA, 13 nt, Coxiella burnetii RSA 493
agcucuuaaaaga

SEQ ID NO: 2590084 - RNA, 12 nt, Coxiella burnetii RSA 493
agcugacaauag

SEQ ID NO: 2590085 - RNA, 20 nt, Coxiella burnetii RSA 493
agcugauuccgaucuugguc

SEQ ID NO: 2590086 - RNA, 13 nt, Coxiella burnetii RSA 493
agcugauuucucu

SEQ ID NO: 2590087 - RNA, 19 nt, Coxiella burnetii RSA 493
agcugccauuuucauuuuc

SEQ ID NO: 2590088 - RNA, 20 nt, Coxiella burnetii RSA 493
agcugcccucaguugucaug

SEQ ID NO: 2590089 - RNA, 18 nt, Coxiella burnetii RSA 493
agcugcuuuuuaaaacgc

SEQ ID NO: 2590090 - RNA, 14 nt, Coxiella burnetii RSA 493
agcuggugggaacg

SEQ ID NO: 2590091 - RNA, 14 nt, Coxiella burnetii RSA 493
agcuguuuuuucua

SEQ ID NO: 2590092 - RNA, 15 nt, Coxiella burnetii RSA 493
agcuguuuuuucuag

SEQ ID NO: 2590093 - RNA, 22 nt, Coxiella burnetii RSA 493
agcuuauacugcccaagaaauu

SEQ ID NO: 2590094 - RNA, 14 nt, Coxiella burnetii RSA 493
agcuuauauaaagg

SEQ ID NO: 2590095 - RNA, 13 nt, Coxiella burnetii RSA 493
agcuuccagaaau

SEQ ID NO: 2590096 - RNA, 15 nt, Coxiella burnetii RSA 493
agcuuccauugcuca

SEQ ID NO: 2590097 - RNA, 15 nt, Coxiella burnetii RSA 493
agcuugccuguaaaa

SEQ ID NO: 2590098 - RNA, 17 nt, Coxiella burnetii RSA 493
agcuugcgaagcccaac

SEQ ID NO: 2590099 - RNA, 15 nt, Coxiella burnetii RSA 493
agcuuguuuuuggca

SEQ ID NO: 2590100 - RNA, 22 nt, Coxiella burnetii RSA 493
agcuuuaauccguuuugaaaaa

SEQ ID NO: 2590101 - RNA, 14 nt, Coxiella burnetii RSA 493
agcuuuucuuuaaa

SEQ ID NO: 2590102 - RNA, 18 nt, Coxiella burnetii RSA 493
agcuuuuuucaaaauuua

SEQ ID NO: 2590103 - RNA, 22 nt, Coxiella burnetii RSA 493
agcuuuuuucaaaauuuacuuu

SEQ ID NO: 2590104 - RNA, 23 nt, Coxiella burnetii RSA 493
aggaaacgaaguucucaaauuuu

SEQ ID NO: 2590105 - RNA, 20 nt, Coxiella burnetii RSA 493
aggaaagauaaggugggggg

SEQ ID NO: 2590106 - RNA, 23 nt, Coxiella burnetii RSA 493
aggaaauuugcauuaaucuucca

SEQ ID NO: 2590107 - RNA, 21 nt, Coxiella burnetii RSA 493
aggaaccaccaaaucacgcuu

SEQ ID NO: 2590108 - RNA, 21 nt, Coxiella burnetii RSA 493
aggaaggacaaaaauaucccu

SEQ ID NO: 2590109 - RNA, 23 nt, Coxiella burnetii RSA 493
aggaaggugcgucccgcuuaaac

SEQ ID NO: 2590110 - RNA, 18 nt, Coxiella burnetii RSA 493
aggaauagggagaagaag

SEQ ID NO: 2590111 - RNA, 21 nt, Coxiella burnetii RSA 493
aggaaucuauugucauccagc

SEQ ID NO: 2590112 - RNA, 18 nt, Coxiella burnetii RSA 493
aggaaugaauagaaaaac

SEQ ID NO: 2590113 - RNA, 20 nt, Coxiella burnetii RSA 493
aggaaugucagguucggauu

SEQ ID NO: 2590114 - RNA, 20 nt, Coxiella burnetii RSA 493
aggaauugagaguccuaaaa

SEQ ID NO: 2590115 - RNA, 13 nt, Coxiella burnetii RSA 493
aggacagaaggca

SEQ ID NO: 2590116 - RNA, 17 nt, Coxiella burnetii RSA 493
aggaccagcucggggac

SEQ ID NO: 2590117 - RNA, 18 nt, Coxiella burnetii RSA 493
aggaccguuaugaaaaca

SEQ ID NO: 2590118 - RNA, 15 nt, Coxiella burnetii RSA 493
aggaccucuccaaau

SEQ ID NO: 2590119 - RNA, 24 nt, Coxiella burnetii RSA 493
aggacucugcgauuguuuucuuac

SEQ ID NO: 2590120 - RNA, 19 nt, Coxiella burnetii RSA 493
aggacugaaauaauguuua

SEQ ID NO: 2590121 - RNA, 16 nt, Coxiella burnetii RSA 493
aggacuuaagcccuuu

SEQ ID NO: 2590122 - RNA, 15 nt, Coxiella burnetii RSA 493
aggagauuuuuauga

SEQ ID NO: 2590123 - RNA, 18 nt, Coxiella burnetii RSA 493
aggagauuuuuaugaaaa

SEQ ID NO: 2590124 - RNA, 15 nt, Coxiella burnetii RSA 493
aggagcacgggauga

SEQ ID NO: 2590125 - RNA, 17 nt, Coxiella burnetii RSA 493
aggaguucuaaaaaauu

SEQ ID NO: 2590126 - RNA, 18 nt, Coxiella burnetii RSA 493
aggaguuggucaaagaga

SEQ ID NO: 2590127 - RNA, 19 nt, Coxiella burnetii RSA 493
aggaguuggucaaagagau

SEQ ID NO: 2590128 - RNA, 13 nt, Coxiella burnetii RSA 493
aggauaauguuug

SEQ ID NO: 2590129 - RNA, 21 nt, Coxiella burnetii RSA 493
aggauaauguuugauaucaau

SEQ ID NO: 2590130 - RNA, 14 nt, Coxiella burnetii RSA 493
aggaucaagcgcca

SEQ ID NO: 2590131 - RNA, 22 nt, Coxiella burnetii RSA 493
aggaugaacuaucguugccuuu

SEQ ID NO: 2590132 - RNA, 22 nt, Coxiella burnetii RSA 493
aggauuuuacgucuaaaacaac

SEQ ID NO: 2590133 - RNA, 12 nt, Coxiella burnetii RSA 493
aggauuuucacg

SEQ ID NO: 2590134 - RNA, 20 nt, Coxiella burnetii RSA 493
aggcaccucauuggcgguua

SEQ ID NO: 2590135 - RNA, 14 nt, Coxiella burnetii RSA 493
aggcagaggacaga

SEQ ID NO: 2590136 - RNA, 18 nt, Coxiella burnetii RSA 493
aggcagaggacagaggac

SEQ ID NO: 2590137 - RNA, 21 nt, Coxiella burnetii RSA 493
aggcagaugauuaaaagcaac

SEQ ID NO: 2590138 - RNA, 13 nt, Coxiella burnetii RSA 493
aggcagcauaaag

SEQ ID NO: 2590139 - RNA, 18 nt, Coxiella burnetii RSA 493
aggcaucuuuuucuccuu

SEQ ID NO: 2590140 - RNA, 15 nt, Coxiella burnetii RSA 493
aggccgcgcagaaua

SEQ ID NO: 2590141 - RNA, 20 nt, Coxiella burnetii RSA 493
aggcgaggacccagcgcacu

SEQ ID NO: 2590142 - RNA, 21 nt, Coxiella burnetii RSA 493
aggcgcauccgguuaauagca

SEQ ID NO: 2590143 - RNA, 21 nt, Coxiella burnetii RSA 493
aggcgcuccuacugcaugaau

SEQ ID NO: 2590144 - RNA, 20 nt, Coxiella burnetii RSA 493
aggcggggacccagcgcacu

SEQ ID NO: 2590145 - RNA, 16 nt, Coxiella burnetii RSA 493
aggcguagauuuuaaa

SEQ ID NO: 2590146 - RNA, 20 nt, Coxiella burnetii RSA 493
aggcuaauaggaaaaaugau

SEQ ID NO: 2590147 - RNA, 12 nt, Coxiella burnetii RSA 493
aggcuaugauua

SEQ ID NO: 2590148 - RNA, 14 nt, Coxiella burnetii RSA 493
aggcucuucauauc

SEQ ID NO: 2590149 - RNA, 17 nt, Coxiella burnetii RSA 493
aggcugagccagcuaag

SEQ ID NO: 2590150 - RNA, 19 nt, Coxiella burnetii RSA 493
aggcuguucgccagaaaca

SEQ ID NO: 2590151 - RNA, 16 nt, Coxiella burnetii RSA 493
aggcuucaaacaaagg

SEQ ID NO: 2590152 - RNA, 19 nt, Coxiella burnetii RSA 493
aggcuuucuuuuucuuuca

SEQ ID NO: 2590153 - RNA, 18 nt, Coxiella burnetii RSA 493
agggaaagagcggauaua

SEQ ID NO: 2590154 - RNA, 22 nt, Coxiella burnetii RSA 493
agggaaguugccgauaaaaagg

SEQ ID NO: 2590155 - RNA, 13 nt, Coxiella burnetii RSA 493
agggacuauaaag

SEQ ID NO: 2590156 - RNA, 14 nt, Coxiella burnetii RSA 493
agggacuauaaagu

SEQ ID NO: 2590157 - RNA, 22 nt, Coxiella burnetii RSA 493
agggacuauaaaguaguugaaa

SEQ ID NO: 2590158 - RNA, 21 nt, Coxiella burnetii RSA 493
agggaguaaucucaauagagg

SEQ ID NO: 2590159 - RNA, 18 nt, Coxiella burnetii RSA 493
agggauuuugcaggggau

SEQ ID NO: 2590160 - RNA, 22 nt, Coxiella burnetii RSA 493
agggcccacuuucacaauuuga

SEQ ID NO: 2590161 - RNA, 18 nt, Coxiella burnetii RSA 493
agggcccgacucggagaa

SEQ ID NO: 2590162 - RNA, 16 nt, Coxiella burnetii RSA 493
agggcuauuuuaagcu

SEQ ID NO: 2590163 - RNA, 15 nt, Coxiella burnetii RSA 493
agggcuguccucugc

SEQ ID NO: 2590164 - RNA, 23 nt, Coxiella burnetii RSA 493
agggcuuuacaccuaagagaaaa

SEQ ID NO: 2590165 - RNA, 22 nt, Coxiella burnetii RSA 493
aggggagcgagcauauaaaagu

SEQ ID NO: 2590166 - RNA, 15 nt, Coxiella burnetii RSA 493
agggguuacuucuuu

SEQ ID NO: 2590167 - RNA, 11 nt, Coxiella burnetii RSA 493
agggguuuuuu

SEQ ID NO: 2590168 - RNA, 22 nt, Coxiella burnetii RSA 493
aggguacuauuuccaacccagc

SEQ ID NO: 2590169 - RNA, 17 nt, Coxiella burnetii RSA 493
aggguagucaggaagca

SEQ ID NO: 2590170 - RNA, 18 nt, Coxiella burnetii RSA 493
agggucaauugcaaaaca

SEQ ID NO: 2590171 - RNA, 17 nt, Coxiella burnetii RSA 493
agggugcgauuaaaagu

SEQ ID NO: 2590172 - RNA, 15 nt, Coxiella burnetii RSA 493
agguaauuuauaacu

SEQ ID NO: 2590173 - RNA, 15 nt, Coxiella burnetii RSA 493
aggucauccauucuu

SEQ ID NO: 2590174 - RNA, 15 nt, Coxiella burnetii RSA 493
aggucguuaaaaaau

SEQ ID NO: 2590175 - RNA, 14 nt, Coxiella burnetii RSA 493
aggucugauaggaa

SEQ ID NO: 2590176 - RNA, 17 nt, Coxiella burnetii RSA 493
aggugacuguuaaucac

SEQ ID NO: 2590177 - RNA, 19 nt, Coxiella burnetii RSA 493
aggugauucucucaaagaa

SEQ ID NO: 2590178 - RNA, 22 nt, Coxiella burnetii RSA 493
aggugcgucccgcuuaaaccca

SEQ ID NO: 2590179 - RNA, 17 nt, Coxiella burnetii RSA 493
aggugucaaaauuauuc

SEQ ID NO: 2590180 - RNA, 22 nt, Coxiella burnetii RSA 493
agguguucaaccgcaugaauua

SEQ ID NO: 2590181 - RNA, 21 nt, Coxiella burnetii RSA 493
agguuaauaaaaagguaauga

SEQ ID NO: 2590182 - RNA, 17 nt, Coxiella burnetii RSA 493
aguucucaaauuuuccc

SEQ ID NO: 2590183 - RNA, 19 nt, Coxiella burnetii RSA 493
aguucuuaacgaagguuuc

SEQ ID NO: 2590184 - RNA, 16 nt, Coxiella burnetii RSA 493
aguucuucuaaagaau

SEQ ID NO: 2590185 - RNA, 20 nt, Coxiella burnetii RSA 493
aguucuucuaaagaauuuuu

SEQ ID NO: 2590186 - RNA, 20 nt, Coxiella burnetii RSA 493
aguugccgguauuuugcaaa

SEQ ID NO: 2590187 - RNA, 16 nt, Coxiella burnetii RSA 493
aguuggaggcgaaaac

SEQ ID NO: 2590188 - RNA, 15 nt, Coxiella burnetii RSA 493
aguuggcuaaaucca

SEQ ID NO: 2590189 - RNA, 13 nt, Coxiella burnetii RSA 493
aguugucauguaa

SEQ ID NO: 2590190 - RNA, 14 nt, Coxiella burnetii RSA 493
aguuuaaaguuauu

SEQ ID NO: 2590191 - RNA, 16 nt, Coxiella burnetii RSA 493
aguuuagaaaaaugcu

SEQ ID NO: 2590192 - RNA, 17 nt, Coxiella burnetii RSA 493
aguuuaucguaaauauu

SEQ ID NO: 2590193 - RNA, 21 nt, Coxiella burnetii RSA 493
aguuuaucguaaauauuuuua

SEQ ID NO: 2590194 - RNA, 14 nt, Coxiella burnetii RSA 493
aguuucccacaaaa

SEQ ID NO: 2590195 - RNA, 20 nt, Coxiella burnetii RSA 493
aguuucuucauauucuucau

SEQ ID NO: 2590196 - RNA, 21 nt, Coxiella burnetii RSA 493
aguuucuucauauucuucaua

SEQ ID NO: 2590197 - RNA, 15 nt, Coxiella burnetii RSA 493
aguuugacccgaaaa

SEQ ID NO: 2590198 - RNA, 16 nt, Coxiella burnetii RSA 493
aguuugcaauaccauu

SEQ ID NO: 2590199 - RNA, 23 nt, Coxiella burnetii RSA 493
aguuugcaauaccauuuuuaaau

SEQ ID NO: 2590200 - RNA, 13 nt, Coxiella burnetii RSA 493
aguuuuaagaaaa

SEQ ID NO: 2590201 - RNA, 14 nt, Coxiella burnetii RSA 493
aguuuuaagaaaaa

SEQ ID NO: 2590202 - RNA, 16 nt, Coxiella burnetii RSA 493
aguuuuagcgccagau

SEQ ID NO: 2590203 - RNA, 15 nt, Coxiella burnetii RSA 493
aguuuuauaacaagg

SEQ ID NO: 2590204 - RNA, 18 nt, Coxiella burnetii RSA 493
aguuuuauuuaaaaaacu

SEQ ID NO: 2590205 - RNA, 22 nt, Coxiella burnetii RSA 493
aguuuugauuugaguaagaaau

SEQ ID NO: 2590206 - RNA, 19 nt, Coxiella burnetii RSA 493
aguuuuucccucuacaaaa

SEQ ID NO: 2590207 - RNA, 20 nt, Coxiella burnetii RSA 493
aguuuuucccucuacaaaau

SEQ ID NO: 2590208 - RNA, 19 nt, Coxiella burnetii RSA 493
aguuuuuuacuugcuucau

SEQ ID NO: 2590209 - RNA, 13 nt, Coxiella burnetii RSA 493
aguuuuuugcucu

SEQ ID NO: 2590210 - RNA, 19 nt, Coxiella burnetii RSA 493
auaaaaaaaaguuuagaaa

SEQ ID NO: 2590211 - RNA, 12 nt, Coxiella burnetii RSA 493
auaaaaaacccc

SEQ ID NO: 2590212 - RNA, 19 nt, Coxiella burnetii RSA 493
auaaaaacaaagugaaaua

SEQ ID NO: 2590213 - RNA, 13 nt, Coxiella burnetii RSA 493
auaaaaacccauu

SEQ ID NO: 2590214 - RNA, 16 nt, Coxiella burnetii RSA 493
auaaaaccuucaaaaa

SEQ ID NO: 2590215 - RNA, 19 nt, Coxiella burnetii RSA 493
auaaaaccuuguuauaaaa

SEQ ID NO: 2590216 - RNA, 16 nt, Coxiella burnetii RSA 493
auaaaacuugauuauu

SEQ ID NO: 2590217 - RNA, 18 nt, Coxiella burnetii RSA 493
auaaaacuugauuauuca

SEQ ID NO: 2590218 - RNA, 21 nt, Coxiella burnetii RSA 493
auaaaacuugauuauucaauu

SEQ ID NO: 2590219 - RNA, 11 nt, Coxiella burnetii RSA 493
auaaaaggaga

SEQ ID NO: 2590220 - RNA, 17 nt, Coxiella burnetii RSA 493
auaaaaggagaaauuga

SEQ ID NO: 2590221 - RNA, 19 nt, Coxiella burnetii RSA 493
auaaaaggagaaauugaca

SEQ ID NO: 2590222 - RNA, 12 nt, Coxiella burnetii RSA 493
auaaaauaacag

SEQ ID NO: 2590223 - RNA, 13 nt, Coxiella burnetii RSA 493
auaaaauuaggua

SEQ ID NO: 2590224 - RNA, 19 nt, Coxiella burnetii RSA 493
auaaacaaguuaacaaaau

SEQ ID NO: 2590225 - RNA, 22 nt, Coxiella burnetii RSA 493
auaaacaaguuaacaaaaucac

SEQ ID NO: 2590226 - RNA, 14 nt, Coxiella burnetii RSA 493
auaaaccuauccaa

SEQ ID NO: 2590227 - RNA, 23 nt, Coxiella burnetii RSA 493
auaaacgggcuaaagguuucaaa

SEQ ID NO: 2590228 - RNA, 22 nt, Coxiella burnetii RSA 493
auaaacuuguuuaucacuccaa

SEQ ID NO: 2590229 - RNA, 23 nt, Coxiella burnetii RSA 493
auaaacuuuauucccagauaaag

SEQ ID NO: 2590230 - RNA, 17 nt, Coxiella burnetii RSA 493
auaaagauucuguaacu

SEQ ID NO: 2590231 - RNA, 19 nt, Coxiella burnetii RSA 493
auaaagauucuguaacuuu

SEQ ID NO: 2590232 - RNA, 16 nt, Coxiella burnetii RSA 493
auaaagcaaugaaaua

SEQ ID NO: 2590233 - RNA, 18 nt, Coxiella burnetii RSA 493
auaaagcgcuuacagcag

SEQ ID NO: 2590234 - RNA, 19 nt, Coxiella burnetii RSA 493
auaaagcgcuugagcgcaa

SEQ ID NO: 2590235 - RNA, 22 nt, Coxiella burnetii RSA 493
auaaaggagauccacuuucucg

SEQ ID NO: 2590236 - RNA, 19 nt, Coxiella burnetii RSA 493
auaaaggcgaccaaaaauc

SEQ ID NO: 2590237 - RNA, 23 nt, Coxiella burnetii RSA 493
auaaaggcuaauaggaaaaauga

SEQ ID NO: 2590238 - RNA, 19 nt, Coxiella burnetii RSA 493
auaaagggccguuccuaua

SEQ ID NO: 2590239 - RNA, 21 nt, Coxiella burnetii RSA 493
auaaagguuuuuccuuuuauu

SEQ ID NO: 2590240 - RNA, 14 nt, Coxiella burnetii RSA 493
auaaaguaauuuua

SEQ ID NO: 2590241 - RNA, 17 nt, Coxiella burnetii RSA 493
auaaaguaauuuuaaaa

SEQ ID NO: 2590242 - RNA, 17 nt, Coxiella burnetii RSA 493
auaaaguaguugaaaaa

SEQ ID NO: 2590243 - RNA, 18 nt, Coxiella burnetii RSA 493
auaaaguaguugaaaaau

SEQ ID NO: 2590244 - RNA, 16 nt, Coxiella burnetii RSA 493
auaaaguguuuuuuug

SEQ ID NO: 2590245 - RNA, 12 nt, Coxiella burnetii RSA 493
auaaaguuuuag

SEQ ID NO: 2590246 - RNA, 14 nt, Coxiella burnetii RSA 493
auaaauaaucuucc

SEQ ID NO: 2590247 - RNA, 11 nt, Coxiella burnetii RSA 493
auaaaugaucc

SEQ ID NO: 2590248 - RNA, 12 nt, Coxiella burnetii RSA 493
auaaaugaugcu

SEQ ID NO: 2590249 - RNA, 21 nt, Coxiella burnetii RSA 493
auaaaugcaauuuuuuagaaa

SEQ ID NO: 2590250 - RNA, 21 nt, Coxiella burnetii RSA 493
auaaauggacccuguuuuuuu

SEQ ID NO: 2590251 - RNA, 16 nt, Coxiella burnetii RSA 493
auaaauguuuuuuaau

SEQ ID NO: 2590252 - RNA, 14 nt, Coxiella burnetii RSA 493
auaaauuaaaaaaa

SEQ ID NO: 2590253 - RNA, 16 nt, Coxiella burnetii RSA 493
auaaauuauuuuaaua

SEQ ID NO: 2590254 - RNA, 12 nt, Coxiella burnetii RSA 493
auaaauuuuugu

SEQ ID NO: 2590255 - RNA, 12 nt, Coxiella burnetii RSA 493
auaacaaauaaa

SEQ ID NO: 2590256 - RNA, 20 nt, Coxiella burnetii RSA 493
auaacaagguuuuauuuuua

SEQ ID NO: 2590257 - RNA, 20 nt, Coxiella burnetii RSA 493
auaacaucccguuaaauuaa

SEQ ID NO: 2590258 - RNA, 22 nt, Coxiella burnetii RSA 493
auaacccgcguauaaaugggag

SEQ ID NO: 2590259 - RNA, 20 nt, Coxiella burnetii RSA 493
auaaccggcuucuaaguaaa

SEQ ID NO: 2590260 - RNA, 20 nt, Coxiella burnetii RSA 493
auaaccuuucgcuuguuuau

SEQ ID NO: 2590261 - RNA, 16 nt, Coxiella burnetii RSA 493
auaacgaagccuauuu

SEQ ID NO: 2590262 - RNA, 18 nt, Coxiella burnetii RSA 493
auaacgcuucuuuuagaa

SEQ ID NO: 2590263 - RNA, 21 nt, Coxiella burnetii RSA 493
auaacggaaaauggaaacgac

SEQ ID NO: 2590264 - RNA, 22 nt, Coxiella burnetii RSA 493
auaacgggaauguuuuuuaaua

SEQ ID NO: 2590265 - RNA, 16 nt, Coxiella burnetii RSA 493
auaacuauuauuaaaa

SEQ ID NO: 2590266 - RNA, 15 nt, Coxiella burnetii RSA 493
auaacuauuuuaaau

SEQ ID NO: 2590267 - RNA, 17 nt, Coxiella burnetii RSA 493
auaacuauuuuaaaucu

SEQ ID NO: 2590268 - RNA, 21 nt, Coxiella burnetii RSA 493
auaacucuucuuaaaccaaau

SEQ ID NO: 2590269 - RNA, 14 nt, Coxiella burnetii RSA 493
auaacugaauacca

SEQ ID NO: 2590270 - RNA, 14 nt, Coxiella burnetii RSA 493
auaacuguaaccuu

SEQ ID NO: 2590271 - RNA, 23 nt, Coxiella burnetii RSA 493
auaagaaacguauugccaaaauu

SEQ ID NO: 2590272 - RNA, 16 nt, Coxiella burnetii RSA 493
auaagaauaagaauaa

SEQ ID NO: 2590273 - RNA, 15 nt, Coxiella burnetii RSA 493
auaagacccgccaaa

SEQ ID NO: 2590274 - RNA, 17 nt, Coxiella burnetii RSA 493
auaagauucguaauauu

SEQ ID NO: 2590275 - RNA, 22 nt, Coxiella burnetii RSA 493
auaagcauaauucaucaaggua

SEQ ID NO: 2590276 - RNA, 15 nt, Coxiella burnetii RSA 493
auaagccauuaaaag

SEQ ID NO: 2590277 - RNA, 13 nt, Coxiella burnetii RSA 493
auaagcgcuuuug

SEQ ID NO: 2590278 - RNA, 19 nt, Coxiella burnetii RSA 493
auaagcguuccuugaauaa

SEQ ID NO: 2590279 - RNA, 19 nt, Coxiella burnetii RSA 493
auaagcguuugguugguuu

SEQ ID NO: 2590280 - RNA, 23 nt, Coxiella burnetii RSA 493
auaagcguuugguugguuugcaa

SEQ ID NO: 2590281 - RNA, 18 nt, Coxiella burnetii RSA 493
auaagcuaucagcagaaa

SEQ ID NO: 2590282 - RNA, 17 nt, Coxiella burnetii RSA 493
auaagcuguuucuuuua

SEQ ID NO: 2590283 - RNA, 12 nt, Coxiella burnetii RSA 493
auaagcuuucaa

SEQ ID NO: 2590284 - RNA, 17 nt, Coxiella burnetii RSA 493
auaagcuuucaauaaau

SEQ ID NO: 2590285 - RNA, 14 nt, Coxiella burnetii RSA 493
auaaggaggcaaua

SEQ ID NO: 2590286 - RNA, 21 nt, Coxiella burnetii RSA 493
auaaggucuuaauuucuaaaa

SEQ ID NO: 2590287 - RNA, 13 nt, Coxiella burnetii RSA 493
auaaggugggggg

SEQ ID NO: 2590288 - RNA, 14 nt, Coxiella burnetii RSA 493
auaagguguuuuac

SEQ ID NO: 2590289 - RNA, 11 nt, Coxiella burnetii RSA 493
auaaguaucca

SEQ ID NO: 2590290 - RNA, 22 nt, Coxiella burnetii RSA 493
auaaguccaagacugauaacua

SEQ ID NO: 2590291 - RNA, 12 nt, Coxiella burnetii RSA 493
auaauaaauggc

SEQ ID NO: 2590292 - RNA, 19 nt, Coxiella burnetii RSA 493
auaauaacgcuaugaaaac

SEQ ID NO: 2590293 - RNA, 13 nt, Coxiella burnetii RSA 493
auaauaacgcuug

SEQ ID NO: 2590294 - RNA, 13 nt, Coxiella burnetii RSA 493
auaauaauugcug

SEQ ID NO: 2590295 - RNA, 15 nt, Coxiella burnetii RSA 493
auaauacggcuuuau

SEQ ID NO: 2590296 - RNA, 16 nt, Coxiella burnetii RSA 493
auaauaucuagauuua

SEQ ID NO: 2590297 - RNA, 20 nt, Coxiella burnetii RSA 493
auaauaucuagauuuaaaac

SEQ ID NO: 2590298 - RNA, 23 nt, Coxiella burnetii RSA 493
auaaucaaaaucagaaacggcgc

SEQ ID NO: 2590299 - RNA, 15 nt, Coxiella burnetii RSA 493
auaaucaaugcgcca

SEQ ID NO: 2590300 - RNA, 22 nt, Coxiella burnetii RSA 493
auaaucaaugcgccauccgaca

SEQ ID NO: 2590301 - RNA, 16 nt, Coxiella burnetii RSA 493
auaaucauuuuuaugc

SEQ ID NO: 2590302 - RNA, 14 nt, Coxiella burnetii RSA 493
auaaucauuuuucc

SEQ ID NO: 2590303 - RNA, 21 nt, Coxiella burnetii RSA 493
auaauccaagggaucauaauc

SEQ ID NO: 2590304 - RNA, 24 nt, Coxiella burnetii RSA 493
auaauccaagggaucauaaucggu

SEQ ID NO: 2590305 - RNA, 16 nt, Coxiella burnetii RSA 493
auaauccgccuaaauu

SEQ ID NO: 2590306 - RNA, 16 nt, Coxiella burnetii RSA 493
auaaucgcaaaauuca

SEQ ID NO: 2590307 - RNA, 17 nt, Coxiella burnetii RSA 493
auaaucucaucaucuuc

SEQ ID NO: 2590308 - RNA, 11 nt, Coxiella burnetii RSA 493
auaaucuuccc

SEQ ID NO: 2590309 - RNA, 18 nt, Coxiella burnetii RSA 493
auaaugagaucaaagcgc

SEQ ID NO: 2590310 - RNA, 18 nt, Coxiella burnetii RSA 493
auaaugaguggcugcuuc

SEQ ID NO: 2590311 - RNA, 12 nt, Coxiella burnetii RSA 493
auaaugcacauc

SEQ ID NO: 2590312 - RNA, 18 nt, Coxiella burnetii RSA 493
auaaugcuugcucuucuu

SEQ ID NO: 2590313 - RNA, 23 nt, Coxiella burnetii RSA 493
auaaugggaguaaugacagaaaa

SEQ ID NO: 2590314 - RNA, 19 nt, Coxiella burnetii RSA 493
auaaugugacucauuacua

SEQ ID NO: 2590315 - RNA, 15 nt, Coxiella burnetii RSA 493
auaauuacgacaguu

SEQ ID NO: 2590316 - RNA, 14 nt, Coxiella burnetii RSA 493
auaauucauaaaua

SEQ ID NO: 2590317 - RNA, 14 nt, Coxiella burnetii RSA 493
auaauucgcacaau

SEQ ID NO: 2590318 - RNA, 18 nt, Coxiella burnetii RSA 493
auaauucgguuuuugcca

SEQ ID NO: 2590319 - RNA, 16 nt, Coxiella burnetii RSA 493
auaauucguuagcauu

SEQ ID NO: 2590320 - RNA, 17 nt, Coxiella burnetii RSA 493
auaauucguuagcauuu

SEQ ID NO: 2590321 - RNA, 21 nt, Coxiella burnetii RSA 493
auaauucguuuacuuguugcg

SEQ ID NO: 2590322 - RNA, 13 nt, Coxiella burnetii RSA 493
auaauugagcauc

SEQ ID NO: 2590323 - RNA, 12 nt, Coxiella burnetii RSA 493
auaauugaggaa

SEQ ID NO: 2590324 - RNA, 16 nt, Coxiella burnetii RSA 493
auaauugagguuuuaa

SEQ ID NO: 2590325 - RNA, 17 nt, Coxiella burnetii RSA 493
auaauugagguuuuaau

SEQ ID NO: 2590326 - RNA, 16 nt, Coxiella burnetii RSA 493
auaauuuaaugagguu

SEQ ID NO: 2590327 - RNA, 14 nt, Coxiella burnetii RSA 493
auaauuuuauaaag

SEQ ID NO: 2590328 - RNA, 17 nt, Coxiella burnetii RSA 493
auaauuuuguauuucac

SEQ ID NO: 2590329 - RNA, 14 nt, Coxiella burnetii RSA 493
auaauuuuugaguu

SEQ ID NO: 2590330 - RNA, 21 nt, Coxiella burnetii RSA 493
auaauuuuuuuaauuuuuuca

SEQ ID NO: 2590331 - RNA, 13 nt, Coxiella burnetii RSA 493
auacaaauucaau

SEQ ID NO: 2590332 - RNA, 13 nt, Coxiella burnetii RSA 493
auacacaucuuuu

SEQ ID NO: 2590333 - RNA, 14 nt, Coxiella burnetii RSA 493
auacagaaugauag

SEQ ID NO: 2590334 - RNA, 13 nt, Coxiella burnetii RSA 493
auacauacauaaa

SEQ ID NO: 2590335 - RNA, 14 nt, Coxiella burnetii RSA 493
auaccaaaaagcgu

SEQ ID NO: 2590336 - RNA, 14 nt, Coxiella burnetii RSA 493
auaccaaaaaguug

SEQ ID NO: 2590337 - RNA, 17 nt, Coxiella burnetii RSA 493
auaccaauucaaauaau

SEQ ID NO: 2590338 - RNA, 18 nt, Coxiella burnetii RSA 493
auaccaauucaaauaaua

SEQ ID NO: 2590339 - RNA, 19 nt, Coxiella burnetii RSA 493
auaccauacagaauuucuu

SEQ ID NO: 2590340 - RNA, 14 nt, Coxiella burnetii RSA 493
auaccauuuuuaaa

SEQ ID NO: 2590341 - RNA, 16 nt, Coxiella burnetii RSA 493
auaccauuuuuaaauu

SEQ ID NO: 2590342 - RNA, 14 nt, Coxiella burnetii RSA 493
auacccaaaaaccc

SEQ ID NO: 2590343 - RNA, 14 nt, Coxiella burnetii RSA 493
auacccgguuguau

SEQ ID NO: 2590344 - RNA, 21 nt, Coxiella burnetii RSA 493
auaccguuuaaaccaaaacca

SEQ ID NO: 2590345 - RNA, 16 nt, Coxiella burnetii RSA 493
auaccuuuugcuggga

SEQ ID NO: 2590346 - RNA, 15 nt, Coxiella burnetii RSA 493
auaccuuuuucccau

SEQ ID NO: 2590347 - RNA, 18 nt, Coxiella burnetii RSA 493
auacgaacaauuguucaa

SEQ ID NO: 2590348 - RNA, 15 nt, Coxiella burnetii RSA 493
auacgaccuucugaa

SEQ ID NO: 2590349 - RNA, 17 nt, Coxiella burnetii RSA 493
auacgcuuuuacccagg

SEQ ID NO: 2590350 - RNA, 16 nt, Coxiella burnetii RSA 493
auacggacgacuuauu

SEQ ID NO: 2590351 - RNA, 16 nt, Coxiella burnetii RSA 493
auacgggaaaacaaug

SEQ ID NO: 2590352 - RNA, 16 nt, Coxiella burnetii RSA 493
auacgggcuacucuaa

SEQ ID NO: 2590353 - RNA, 13 nt, Coxiella burnetii RSA 493
auacgggcuacuu

SEQ ID NO: 2590354 - RNA, 22 nt, Coxiella burnetii RSA 493
auacggggaaauaaugacaauu

SEQ ID NO: 2590355 - RNA, 23 nt, Coxiella burnetii RSA 493
auacggggacgauagauggcauc

SEQ ID NO: 2590356 - RNA, 17 nt, Coxiella burnetii RSA 493
auacggugcagaaggcc

SEQ ID NO: 2590357 - RNA, 17 nt, Coxiella burnetii RSA 493
auacuaauuucagggaa

SEQ ID NO: 2590358 - RNA, 21 nt, Coxiella burnetii RSA 493
auacuaauuucagggaacugc

SEQ ID NO: 2590359 - RNA, 20 nt, Coxiella burnetii RSA 493
auacucacccacaucuggaa

SEQ ID NO: 2590360 - RNA, 15 nt, Coxiella burnetii RSA 493
auacucuaaguuaug

SEQ ID NO: 2590361 - RNA, 19 nt, Coxiella burnetii RSA 493
auacugacaaugcguuuua

SEQ ID NO: 2590362 - RNA, 22 nt, Coxiella burnetii RSA 493
auacugacaaugcguuuuaaau

SEQ ID NO: 2590363 - RNA, 20 nt, Coxiella burnetii RSA 493
auacugcuuguaccugccau

SEQ ID NO: 2590364 - RNA, 11 nt, Coxiella burnetii RSA 493
auacuguucuu

SEQ ID NO: 2590365 - RNA, 14 nt, Coxiella burnetii RSA 493
auacuguucuuuca

SEQ ID NO: 2590366 - RNA, 19 nt, Coxiella burnetii RSA 493
auagaauaaugaacaacac

SEQ ID NO: 2590367 - RNA, 14 nt, Coxiella burnetii RSA 493
auagaaugggaaga

SEQ ID NO: 2590368 - RNA, 14 nt, Coxiella burnetii RSA 493
auagacaauuuuuu

SEQ ID NO: 2590369 - RNA, 23 nt, Coxiella burnetii RSA 493
auagaccaaauccgcauaaaaac

SEQ ID NO: 2590370 - RNA, 13 nt, Coxiella burnetii RSA 493
auagacuucgcua

SEQ ID NO: 2590371 - RNA, 16 nt, Coxiella burnetii RSA 493
auagacuucgcuaaau

SEQ ID NO: 2590372 - RNA, 20 nt, Coxiella burnetii RSA 493
auagacuucgcuaaauaaca

SEQ ID NO: 2590373 - RNA, 19 nt, Coxiella burnetii RSA 493
auagagucgggaaauaaaa

SEQ ID NO: 2590374 - RNA, 16 nt, Coxiella burnetii RSA 493
auagauggcaucauuu

SEQ ID NO: 2590375 - RNA, 16 nt, Coxiella burnetii RSA 493
auagcaaauaucugcu

SEQ ID NO: 2590376 - RNA, 12 nt, Coxiella burnetii RSA 493
auagcacagcgu

SEQ ID NO: 2590377 - RNA, 21 nt, Coxiella burnetii RSA 493
auagcaucaagggcaaaaaca

SEQ ID NO: 2590378 - RNA, 22 nt, Coxiella burnetii RSA 493
auagcaucaagggcaaaaacau

SEQ ID NO: 2590379 - RNA, 18 nt, Coxiella burnetii RSA 493
auagcauuaauaagaccc

SEQ ID NO: 2590380 - RNA, 20 nt, Coxiella burnetii RSA 493
auagcauuagacauuuuucg

SEQ ID NO: 2590381 - RNA, 16 nt, Coxiella burnetii RSA 493
auagccaauguuugcu

SEQ ID NO: 2590382 - RNA, 22 nt, Coxiella burnetii RSA 493
auagccuccucgcgauuuucgu

SEQ ID NO: 2590383 - RNA, 13 nt, Coxiella burnetii RSA 493
auagcgugagagg

SEQ ID NO: 2590384 - RNA, 21 nt, Coxiella burnetii RSA 493
auagcuccccgcuccaauugu

SEQ ID NO: 2590385 - RNA, 15 nt, Coxiella burnetii RSA 493
auaggaaaaaugauu

SEQ ID NO: 2590386 - RNA, 15 nt, Coxiella burnetii RSA 493
auaggcuuucuuuuu

SEQ ID NO: 2590387 - RNA, 22 nt, Coxiella burnetii RSA 493
auaggucauuuuuuauaaaauu

SEQ ID NO: 2590388 - RNA, 21 nt, Coxiella burnetii RSA 493
auaggugcuugacgucguuug

SEQ ID NO: 2590389 - RNA, 19 nt, Coxiella burnetii RSA 493
auaguaaaacgugcuuaau

SEQ ID NO: 2590390 - RNA, 23 nt, Coxiella burnetii RSA 493
auaguacuguauugagcagcauu

SEQ ID NO: 2590391 - RNA, 18 nt, Coxiella burnetii RSA 493
auagucgcguauaaauga

SEQ ID NO: 2590392 - RNA, 14 nt, Coxiella burnetii RSA 493
auagugcuauuuuu

SEQ ID NO: 2590393 - RNA, 18 nt, Coxiella burnetii RSA 493
auagugcuauuuuuccca

SEQ ID NO: 2590394 - RNA, 12 nt, Coxiella burnetii RSA 493
auagugcuuuua

SEQ ID NO: 2590395 - RNA, 14 nt, Coxiella burnetii RSA 493
auaguggaugaucg

SEQ ID NO: 2590396 - RNA, 16 nt, Coxiella burnetii RSA 493
auagugucaaaggccg

SEQ ID NO: 2590397 - RNA, 19 nt, Coxiella burnetii RSA 493
auaguuugcaauaccauuu

SEQ ID NO: 2590398 - RNA, 17 nt, Coxiella burnetii RSA 493
auaguuuuauuuaaaaa

SEQ ID NO: 2590399 - RNA, 20 nt, Coxiella burnetii RSA 493
auaguuuuauuuaaaaaacu

SEQ ID NO: 2590400 - RNA, 21 nt, Coxiella burnetii RSA 493
auaguuuuauuuaaaaaacua

SEQ ID NO: 2590401 - RNA, 21 nt, Coxiella burnetii RSA 493
auaguuuuggcguaugaauaa

SEQ ID NO: 2590402 - RNA, 23 nt, Coxiella burnetii RSA 493
auaguuuuggcguaugaauaauu

SEQ ID NO: 2590403 - RNA, 17 nt, Coxiella burnetii RSA 493
auauaaauaaucuuccc

SEQ ID NO: 2590404 - RNA, 20 nt, Coxiella burnetii RSA 493
auauaagcuuucaauaaaua

SEQ ID NO: 2590405 - RNA, 20 nt, Coxiella burnetii RSA 493
auauaaugggaguaaugaca

SEQ ID NO: 2590406 - RNA, 12 nt, Coxiella burnetii RSA 493
auauaauugagg

SEQ ID NO: 2590407 - RNA, 24 nt, Coxiella burnetii RSA 493
auauaauugagguuuuaauuugcc

SEQ ID NO: 2590408 - RNA, 16 nt, Coxiella burnetii RSA 493
auauaauuuuugaguu

SEQ ID NO: 2590409 - RNA, 21 nt, Coxiella burnetii RSA 493
auauaauuuuugaguucuuua

SEQ ID NO: 2590410 - RNA, 21 nt, Coxiella burnetii RSA 493
auauacccgaggaugaugaaa

SEQ ID NO: 2590411 - RNA, 13 nt, Coxiella burnetii RSA 493
auauaggcgaauc

SEQ ID NO: 2590412 - RNA, 20 nt, Coxiella burnetii RSA 493
auauauuuaccucuaaaaau

SEQ ID NO: 2590413 - RNA, 24 nt, Coxiella burnetii RSA 493
auaucaaaaaaccauaaauggaua

SEQ ID NO: 2590414 - RNA, 23 nt, Coxiella burnetii RSA 493
auaucauugggccauuuaacaaa

SEQ ID NO: 2590415 - RNA, 19 nt, Coxiella burnetii RSA 493
auauccagcacccaauuaa

SEQ ID NO: 2590416 - RNA, 12 nt, Coxiella burnetii RSA 493
auauccauaucg

SEQ ID NO: 2590417 - RNA, 22 nt, Coxiella burnetii RSA 493
auauccggcaucacgauuuaaa

SEQ ID NO: 2590418 - RNA, 14 nt, Coxiella burnetii RSA 493
auauccuucuuuua

SEQ ID NO: 2590419 - RNA, 17 nt, Coxiella burnetii RSA 493
auauccuucuuuuaaag

SEQ ID NO: 2590420 - RNA, 21 nt, Coxiella burnetii RSA 493
auaucguagccuucuuuuuca

SEQ ID NO: 2590421 - RNA, 13 nt, Coxiella burnetii RSA 493
auaucguuuucac

SEQ ID NO: 2590422 - RNA, 14 nt, Coxiella burnetii RSA 493
auaucguuuucacg

SEQ ID NO: 2590423 - RNA, 16 nt, Coxiella burnetii RSA 493
auaucguuuucacgaa

SEQ ID NO: 2590424 - RNA, 15 nt, Coxiella burnetii RSA 493
auaucuagauuuaaa

SEQ ID NO: 2590425 - RNA, 16 nt, Coxiella burnetii RSA 493
auaucuagauuuaaaa

SEQ ID NO: 2590426 - RNA, 15 nt, Coxiella burnetii RSA 493
auaucuccauuuuca

SEQ ID NO: 2590427 - RNA, 17 nt, Coxiella burnetii RSA 493
auaucugaucaaaaaua

SEQ ID NO: 2590428 - RNA, 19 nt, Coxiella burnetii RSA 493
auaucuuuuucaauuauac

SEQ ID NO: 2590429 - RNA, 13 nt, Coxiella burnetii RSA 493
auaugacgaauac

SEQ ID NO: 2590430 - RNA, 23 nt, Coxiella burnetii RSA 493
auaugcaagcugcgcauaaacuu

SEQ ID NO: 2590431 - RNA, 16 nt, Coxiella burnetii RSA 493
auauguuguuugcuug

SEQ ID NO: 2590432 - RNA, 14 nt, Coxiella burnetii RSA 493
auauguuucaauaa

SEQ ID NO: 2590433 - RNA, 21 nt, Coxiella burnetii RSA 493
auauuaaaacaagacaacaaa

SEQ ID NO: 2590434 - RNA, 13 nt, Coxiella burnetii RSA 493
auauuaauauuaa

SEQ ID NO: 2590435 - RNA, 23 nt, Coxiella burnetii RSA 493
auauuaauuuugguauaaaugau

SEQ ID NO: 2590436 - RNA, 17 nt, Coxiella burnetii RSA 493
auauuagaaauaauacu

SEQ ID NO: 2590437 - RNA, 17 nt, Coxiella burnetii RSA 493
auauuauugagaaucuc

SEQ ID NO: 2590438 - RNA, 11 nt, Coxiella burnetii RSA 493
auauucccaug

SEQ ID NO: 2590439 - RNA, 22 nt, Coxiella burnetii RSA 493
auauuccugaaguaauuuuucg

SEQ ID NO: 2590440 - RNA, 21 nt, Coxiella burnetii RSA 493
auauucgcgcaaguuuugaau

SEQ ID NO: 2590441 - RNA, 22 nt, Coxiella burnetii RSA 493
auauucgcuccauuguuucgaa

SEQ ID NO: 2590442 - RNA, 14 nt, Coxiella burnetii RSA 493
auauucuaucucaa

SEQ ID NO: 2590443 - RNA, 23 nt, Coxiella burnetii RSA 493
auauucugagcgccuuuuuuaaa

SEQ ID NO: 2590444 - RNA, 20 nt, Coxiella burnetii RSA 493
auauugaugcguuuuuuuau

SEQ ID NO: 2590445 - RNA, 13 nt, Coxiella burnetii RSA 493
auauugauuuaaa

SEQ ID NO: 2590446 - RNA, 22 nt, Coxiella burnetii RSA 493
auauugcugauaguuaaauggg

SEQ ID NO: 2590447 - RNA, 21 nt, Coxiella burnetii RSA 493
auauuuaccucuaaaaauuaa

SEQ ID NO: 2590448 - RNA, 22 nt, Coxiella burnetii RSA 493
auauuuagggucaauugcaaaa

SEQ ID NO: 2590449 - RNA, 15 nt, Coxiella burnetii RSA 493
auauuucgcaauccu

SEQ ID NO: 2590450 - RNA, 22 nt, Coxiella burnetii RSA 493
auauuucgcaauccucucucuc

SEQ ID NO: 2590451 - RNA, 19 nt, Coxiella burnetii RSA 493
auauuucgucagugaauga

SEQ ID NO: 2590452 - RNA, 15 nt, Coxiella burnetii RSA 493
auauuucguuccaug

SEQ ID NO: 2590453 - RNA, 19 nt, Coxiella burnetii RSA 493
auauuuggguuuucuuuug

SEQ ID NO: 2590454 - RNA, 20 nt, Coxiella burnetii RSA 493
auauuuguauccgcuuuaau

SEQ ID NO: 2590455 - RNA, 21 nt, Coxiella burnetii RSA 493
auauuuucucaauagaaaaaa

SEQ ID NO: 2590456 - RNA, 12 nt, Coxiella burnetii RSA 493
auauuuuuuaac

SEQ ID NO: 2590457 - RNA, 22 nt, Coxiella burnetii RSA 493
aucaaaauucuccuuaauaaag

SEQ ID NO: 2590458 - RNA, 16 nt, Coxiella burnetii RSA 493
aucaaacgcugccaua

SEQ ID NO: 2590459 - RNA, 15 nt, Coxiella burnetii RSA 493
aucaaaggccgcgca

SEQ ID NO: 2590460 - RNA, 23 nt, Coxiella burnetii RSA 493
aucaaauaaugguagcuaccagu

SEQ ID NO: 2590461 - RNA, 14 nt, Coxiella burnetii RSA 493
aucaaaugaacuuu

SEQ ID NO: 2590462 - RNA, 22 nt, Coxiella burnetii RSA 493
aucaaaugcuaauuccuuuggu

SEQ ID NO: 2590463 - RNA, 20 nt, Coxiella burnetii RSA 493
aucaaauuaaaauaauccaa

SEQ ID NO: 2590464 - RNA, 12 nt, Coxiella burnetii RSA 493
aucaacaaaaua

SEQ ID NO: 2590465 - RNA, 13 nt, Coxiella burnetii RSA 493
aucaacaaaauau

SEQ ID NO: 2590466 - RNA, 14 nt, Coxiella burnetii RSA 493
aucaacaaaauaua

SEQ ID NO: 2590467 - RNA, 11 nt, Coxiella burnetii RSA 493
aucaaccaaua

SEQ ID NO: 2590468 - RNA, 12 nt, Coxiella burnetii RSA 493
aucaaccaauaa

SEQ ID NO: 2590469 - RNA, 17 nt, Coxiella burnetii RSA 493
aucaaccaauccuacuu

SEQ ID NO: 2590470 - RNA, 18 nt, Coxiella burnetii RSA 493
aucaaccccagccgccac

SEQ ID NO: 2590471 - RNA, 16 nt, Coxiella burnetii RSA 493
aucaaccucagguuuu

SEQ ID NO: 2590472 - RNA, 20 nt, Coxiella burnetii RSA 493
aucaacgcgggcauggccag

SEQ ID NO: 2590473 - RNA, 15 nt, Coxiella burnetii RSA 493
aucaacggaaaaaca

SEQ ID NO: 2590474 - RNA, 17 nt, Coxiella burnetii RSA 493
aucaaguagccaaaaua

SEQ ID NO: 2590475 - RNA, 19 nt, Coxiella burnetii RSA 493
aucaaguagccaaaauaau

SEQ ID NO: 2590476 - RNA, 17 nt, Coxiella burnetii RSA 493
aucaaguccaauuauaa

SEQ ID NO: 2590477 - RNA, 14 nt, Coxiella burnetii RSA 493
aucaaguguucaca

SEQ ID NO: 2590478 - RNA, 18 nt, Coxiella burnetii RSA 493
aucaaguguucacaaguc

SEQ ID NO: 2590479 - RNA, 15 nt, Coxiella burnetii RSA 493
aucaaucgaaaaaaa

SEQ ID NO: 2590480 - RNA, 16 nt, Coxiella burnetii RSA 493
aucaaucgaaaaaaau

SEQ ID NO: 2590481 - RNA, 20 nt, Coxiella burnetii RSA 493
aucaaucgcagcauuuuucg

SEQ ID NO: 2590482 - RNA, 23 nt, Coxiella burnetii RSA 493
aucaaucguguagaaagaaaguu

SEQ ID NO: 2590483 - RNA, 15 nt, Coxiella burnetii RSA 493
aucaaugcaguuaac

SEQ ID NO: 2590484 - RNA, 17 nt, Coxiella burnetii RSA 493
aucacagcaucuaaccu

SEQ ID NO: 2590485 - RNA, 12 nt, Coxiella burnetii RSA 493
aucaccaaaaua

SEQ ID NO: 2590486 - RNA, 20 nt, Coxiella burnetii RSA 493
aucaccugcuccuuuucuuc

SEQ ID NO: 2590487 - RNA, 19 nt, Coxiella burnetii RSA 493
aucaccuuugcuaacaauu

SEQ ID NO: 2590488 - RNA, 22 nt, Coxiella burnetii RSA 493
aucaccuuugcuaacaauuguu

SEQ ID NO: 2590489 - RNA, 17 nt, Coxiella burnetii RSA 493
aucacgccgcaucacgc

SEQ ID NO: 2590490 - RNA, 14 nt, Coxiella burnetii RSA 493
aucacuaagucacu

SEQ ID NO: 2590491 - RNA, 13 nt, Coxiella burnetii RSA 493
aucacuacaaauu

SEQ ID NO: 2590492 - RNA, 19 nt, Coxiella burnetii RSA 493
aucacuagcuauucuuuug

SEQ ID NO: 2590493 - RNA, 14 nt, Coxiella burnetii RSA 493
aucagaaaccguuu

SEQ ID NO: 2590494 - RNA, 14 nt, Coxiella burnetii RSA 493
aucagcccucauug

SEQ ID NO: 2590495 - RNA, 20 nt, Coxiella burnetii RSA 493
aucagcggggagauuaaaaa

SEQ ID NO: 2590496 - RNA, 21 nt, Coxiella burnetii RSA 493
aucagcuuaaucaaccucagg

SEQ ID NO: 2590497 - RNA, 14 nt, Coxiella burnetii RSA 493
aucaggcagugaau

SEQ ID NO: 2590498 - RNA, 21 nt, Coxiella burnetii RSA 493
aucaguuuugaugaaaagaaa

SEQ ID NO: 2590499 - RNA, 17 nt, Coxiella burnetii RSA 493
aucauaaucgguuauuu

SEQ ID NO: 2590500 - RNA, 23 nt, Coxiella burnetii RSA 493
aucauacgcuuguaauucacgau

SEQ ID NO: 2590501 - RNA, 17 nt, Coxiella burnetii RSA 493
aucauacuuaauuucgc

SEQ ID NO: 2590502 - RNA, 19 nt, Coxiella burnetii RSA 493
aucauacuuaauuucgcuc

SEQ ID NO: 2590503 - RNA, 16 nt, Coxiella burnetii RSA 493
aauaaucuucccaggc

SEQ ID NO: 2590504 - RNA, 21 nt, Coxiella burnetii RSA 493
aauaaugaauauucugagcgc

SEQ ID NO: 2590505 - RNA, 21 nt, Coxiella burnetii RSA 493
aauaaugaucccgaaacggau

SEQ ID NO: 2590506 - RNA, 16 nt, Coxiella burnetii RSA 493
aauaauggaucguuaa

SEQ ID NO: 2590507 - RNA, 18 nt, Coxiella burnetii RSA 493
aauaaugguagcuaccag

SEQ ID NO: 2590508 - RNA, 13 nt, Coxiella burnetii RSA 493
aauaauucgguuu

SEQ ID NO: 2590509 - RNA, 21 nt, Coxiella burnetii RSA 493
aauaauugcugaacaaaagcc

SEQ ID NO: 2590510 - RNA, 22 nt, Coxiella burnetii RSA 493
aauaauugcugaacaaaagcca

SEQ ID NO: 2590511 - RNA, 23 nt, Coxiella burnetii RSA 493
aauaauugcugaacaaaagccau

SEQ ID NO: 2590512 - RNA, 14 nt, Coxiella burnetii RSA 493
aauaauuguaguuc

SEQ ID NO: 2590513 - RNA, 12 nt, Coxiella burnetii RSA 493
aauaauuuuccg

SEQ ID NO: 2590514 - RNA, 17 nt, Coxiella burnetii RSA 493
aauaauuuuuuuaauuu

SEQ ID NO: 2590515 - RNA, 19 nt, Coxiella burnetii RSA 493
aauacaagcugacaauagg

SEQ ID NO: 2590516 - RNA, 19 nt, Coxiella burnetii RSA 493
aauacaccggaaauuuuuu

SEQ ID NO: 2590517 - RNA, 17 nt, Coxiella burnetii RSA 493
aauacagauuuuaguga

SEQ ID NO: 2590518 - RNA, 15 nt, Coxiella burnetii RSA 493
aauacaggaaaaaga

SEQ ID NO: 2590519 - RNA, 18 nt, Coxiella burnetii RSA 493
aauacaggaaaaagauaa

SEQ ID NO: 2590520 - RNA, 15 nt, Coxiella burnetii RSA 493
aauacauacauaaag

SEQ ID NO: 2590521 - RNA, 16 nt, Coxiella burnetii RSA 493
aauacaucuugauccu

SEQ ID NO: 2590522 - RNA, 15 nt, Coxiella burnetii RSA 493
aauacaugacuuuau

SEQ ID NO: 2590523 - RNA, 23 nt, Coxiella burnetii RSA 493
aauacauucuucaguaauuuuua

SEQ ID NO: 2590524 - RNA, 15 nt, Coxiella burnetii RSA 493
aauaccagcagugaa

SEQ ID NO: 2590525 - RNA, 13 nt, Coxiella burnetii RSA 493
aauaccauuuuua

SEQ ID NO: 2590526 - RNA, 17 nt, Coxiella burnetii RSA 493
aauaccccgcuguuuuc

SEQ ID NO: 2590527 - RNA, 20 nt, Coxiella burnetii RSA 493
aauaccccgcuguuuucaga

SEQ ID NO: 2590528 - RNA, 17 nt, Coxiella burnetii RSA 493
aauaccccuuuuguuaa

SEQ ID NO: 2590529 - RNA, 20 nt, Coxiella burnetii RSA 493
aauaccggaaacaaguauaa

SEQ ID NO: 2590530 - RNA, 16 nt, Coxiella burnetii RSA 493
aauaccuuugcaaaca

SEQ ID NO: 2590531 - RNA, 19 nt, Coxiella burnetii RSA 493
aauaccuuugcaaacaugc

SEQ ID NO: 2590532 - RNA, 19 nt, Coxiella burnetii RSA 493
aauacggcuuuauuuugga

SEQ ID NO: 2590533 - RNA, 14 nt, Coxiella burnetii RSA 493
aauacgggaaaaca

SEQ ID NO: 2590534 - RNA, 15 nt, Coxiella burnetii RSA 493
aauacgggaaaacaa

SEQ ID NO: 2590535 - RNA, 16 nt, Coxiella burnetii RSA 493
aauacgggaaaacaau

SEQ ID NO: 2590536 - RNA, 18 nt, Coxiella burnetii RSA 493
aauacuagcuuuugaagc

SEQ ID NO: 2590537 - RNA, 15 nt, Coxiella burnetii RSA 493
aauacucuuauuuuc

SEQ ID NO: 2590538 - RNA, 14 nt, Coxiella burnetii RSA 493
aauagaauuguaaa

SEQ ID NO: 2590539 - RNA, 22 nt, Coxiella burnetii RSA 493
aauagaauuuuugacuaaguca

SEQ ID NO: 2590540 - RNA, 19 nt, Coxiella burnetii RSA 493
aauagacuucgcuaaauaa

SEQ ID NO: 2590541 - RNA, 21 nt, Coxiella burnetii RSA 493
aauagacuucgcuaaauaaca

SEQ ID NO: 2590542 - RNA, 17 nt, Coxiella burnetii RSA 493
aauagagcgcgcugccu

SEQ ID NO: 2590543 - RNA, 21 nt, Coxiella burnetii RSA 493
aauagagucgggaaauaaaau

SEQ ID NO: 2590544 - RNA, 22 nt, Coxiella burnetii RSA 493
aauagagucgggaaauaaaauu

SEQ ID NO: 2590545 - RNA, 18 nt, Coxiella burnetii RSA 493
aauagauuagugaaucua

SEQ ID NO: 2590546 - RNA, 17 nt, Coxiella burnetii RSA 493
aauagcauuucguauaa

SEQ ID NO: 2590547 - RNA, 15 nt, Coxiella burnetii RSA 493
aauagccuucucaau

SEQ ID NO: 2590548 - RNA, 23 nt, Coxiella burnetii RSA 493
aauagccuucucaauuucaacgc

SEQ ID NO: 2590549 - RNA, 17 nt, Coxiella burnetii RSA 493
aauagcgaucagcggaa

SEQ ID NO: 2590550 - RNA, 23 nt, Coxiella burnetii RSA 493
aauagcucagcugguagagcaca

SEQ ID NO: 2590551 - RNA, 18 nt, Coxiella burnetii RSA 493
aauaggcuuucuuuuucu

SEQ ID NO: 2590552 - RNA, 19 nt, Coxiella burnetii RSA 493
aauagggcggcaaucagaa

SEQ ID NO: 2590553 - RNA, 21 nt, Coxiella burnetii RSA 493
aauaguacuguauugagcagc

SEQ ID NO: 2590554 - RNA, 23 nt, Coxiella burnetii RSA 493
aauaguacuguauugagcagcau

SEQ ID NO: 2590555 - RNA, 15 nt, Coxiella burnetii RSA 493
aauaguggcauuaaa

SEQ ID NO: 2590556 - RNA, 18 nt, Coxiella burnetii RSA 493
aauauaaauaaucuuccc

SEQ ID NO: 2590557 - RNA, 23 nt, Coxiella burnetii RSA 493
aauauaaugggaguaaugacaga

SEQ ID NO: 2590558 - RNA, 21 nt, Coxiella burnetii RSA 493
aauauaggcgaaucaucuuuu

SEQ ID NO: 2590559 - RNA, 19 nt, Coxiella burnetii RSA 493
aauauauucauauccuuuu

SEQ ID NO: 2590560 - RNA, 15 nt, Coxiella burnetii RSA 493
aauaucaaaaaacca

SEQ ID NO: 2590561 - RNA, 18 nt, Coxiella burnetii RSA 493
aauaucaaaaaaccauaa

SEQ ID NO: 2590562 - RNA, 22 nt, Coxiella burnetii RSA 493
aauaucccaugacgauuuuaau

SEQ ID NO: 2590563 - RNA, 15 nt, Coxiella burnetii RSA 493
aauauccuuacuauu

SEQ ID NO: 2590564 - RNA, 15 nt, Coxiella burnetii RSA 493
aauaucgcuauaauu

SEQ ID NO: 2590565 - RNA, 20 nt, Coxiella burnetii RSA 493
aauaucgcuauaauuagaua

SEQ ID NO: 2590566 - RNA, 15 nt, Coxiella burnetii RSA 493
aauaugagcugucac

SEQ ID NO: 2590567 - RNA, 15 nt, Coxiella burnetii RSA 493
aauaugauaaaaggc

SEQ ID NO: 2590568 - RNA, 16 nt, Coxiella burnetii RSA 493
aauaugauaaaaggca

SEQ ID NO: 2590569 - RNA, 19 nt, Coxiella burnetii RSA 493
aauaugauaaaaggcagcu

SEQ ID NO: 2590570 - RNA, 18 nt, Coxiella burnetii RSA 493
aauauggcgaucuauagc

SEQ ID NO: 2590571 - RNA, 14 nt, Coxiella burnetii RSA 493
aauauuaaaacaag

SEQ ID NO: 2590572 - RNA, 15 nt, Coxiella burnetii RSA 493
aauauuagaaauaau

SEQ ID NO: 2590573 - RNA, 20 nt, Coxiella burnetii RSA 493
aauauuaucguuuucauucu

SEQ ID NO: 2590574 - RNA, 14 nt, Coxiella burnetii RSA 493
aauauuauugagaa

SEQ ID NO: 2590575 - RNA, 22 nt, Coxiella burnetii RSA 493
aauauucuaaccacccugucau

SEQ ID NO: 2590576 - RNA, 23 nt, Coxiella burnetii RSA 493
aauauucuaaccacccugucaua

SEQ ID NO: 2590577 - RNA, 12 nt, Coxiella burnetii RSA 493
aauauugaauaa

SEQ ID NO: 2590578 - RNA, 19 nt, Coxiella burnetii RSA 493
aauauuggccuuagcguaa

SEQ ID NO: 2590579 - RNA, 18 nt, Coxiella burnetii RSA 493
aauauuuaaauugaauca

SEQ ID NO: 2590580 - RNA, 20 nt, Coxiella burnetii RSA 493
aauauuuuuauucuucugcc

SEQ ID NO: 2590581 - RNA, 16 nt, Coxiella burnetii RSA 493
aauauuuuuauuucca

SEQ ID NO: 2590582 - RNA, 17 nt, Coxiella burnetii RSA 493
aauauuuuucucuuuca

SEQ ID NO: 2590583 - RNA, 21 nt, Coxiella burnetii RSA 493
aauauuuuucucuuucauaau

SEQ ID NO: 2590584 - RNA, 12 nt, Coxiella burnetii RSA 493
aaucaaauauca

SEQ ID NO: 2590585 - RNA, 23 nt, Coxiella burnetii RSA 493
aaucaaaugcugcgccauuggca

SEQ ID NO: 2590586 - RNA, 18 nt, Coxiella burnetii RSA 493
aaucaaauuaaaauaauc

SEQ ID NO: 2590587 - RNA, 19 nt, Coxiella burnetii RSA 493
aaucaaccucagguuuuac

SEQ ID NO: 2590588 - RNA, 18 nt, Coxiella burnetii RSA 493
aaucaacucgcccaugga

SEQ ID NO: 2590589 - RNA, 21 nt, Coxiella burnetii RSA 493
aaucaaguagccaaaauaaua

SEQ ID NO: 2590590 - RNA, 15 nt, Coxiella burnetii RSA 493
aaucaaguccaauua

SEQ ID NO: 2590591 - RNA, 18 nt, Coxiella burnetii RSA 493
aaucaaguccaauuauaa

SEQ ID NO: 2590592 - RNA, 22 nt, Coxiella burnetii RSA 493
aaucaaucgaccgagaauuaau

SEQ ID NO: 2590593 - RNA, 18 nt, Coxiella burnetii RSA 493
aaucaaugcaguuaacca

SEQ ID NO: 2590594 - RNA, 21 nt, Coxiella burnetii RSA 493
aaucaauucgaaagaaauaac

SEQ ID NO: 2590595 - RNA, 15 nt, Coxiella burnetii RSA 493
aaucacaaaagguaa

SEQ ID NO: 2590596 - RNA, 17 nt, Coxiella burnetii RSA 493
aaucacagcaucuaacc

SEQ ID NO: 2590597 - RNA, 16 nt, Coxiella burnetii RSA 493
aaucaccugcuccuuu

SEQ ID NO: 2590598 - RNA, 22 nt, Coxiella burnetii RSA 493
aaucagaaugcugauaauugaa

SEQ ID NO: 2590599 - RNA, 18 nt, Coxiella burnetii RSA 493
aaucagcaaguugcagag

SEQ ID NO: 2590600 - RNA, 14 nt, Coxiella burnetii RSA 493
aaucagcaucgguu

SEQ ID NO: 2590601 - RNA, 16 nt, Coxiella burnetii RSA 493
aaucaucaauccggug

SEQ ID NO: 2590602 - RNA, 14 nt, Coxiella burnetii RSA 493
aaucauuaacgaau

SEQ ID NO: 2590603 - RNA, 14 nt, Coxiella burnetii RSA 493
aaucauuacagaca

SEQ ID NO: 2590604 - RNA, 13 nt, Coxiella burnetii RSA 493
aaucauugaagaa

SEQ ID NO: 2590605 - RNA, 12 nt, Coxiella burnetii RSA 493
aaucauugguuu

SEQ ID NO: 2590606 - RNA, 12 nt, Coxiella burnetii RSA 493
aaucauuuuucc

SEQ ID NO: 2590607 - RNA, 18 nt, Coxiella burnetii RSA 493
aaucauuuuuguacugcu

SEQ ID NO: 2590608 - RNA, 14 nt, Coxiella burnetii RSA 493
acaaauaaagcagc

SEQ ID NO: 2590609 - RNA, 18 nt, Coxiella burnetii RSA 493
acaaauaaagcagcaauu

SEQ ID NO: 2590610 - RNA, 16 nt, Coxiella burnetii RSA 493
acaaaugcgccauugc

SEQ ID NO: 2590611 - RNA, 17 nt, Coxiella burnetii RSA 493
acaaauguauuuaucau

SEQ ID NO: 2590612 - RNA, 16 nt, Coxiella burnetii RSA 493
acaaauuuuuaagacg

SEQ ID NO: 2590613 - RNA, 14 nt, Coxiella burnetii RSA 493
acaacaaaauguuu

SEQ ID NO: 2590614 - RNA, 13 nt, Coxiella burnetii RSA 493
acaacaacaaagu

SEQ ID NO: 2590615 - RNA, 23 nt, Coxiella burnetii RSA 493
acaaccauugucucguuagaaaa

SEQ ID NO: 2590616 - RNA, 14 nt, Coxiella burnetii RSA 493
acaacgaaaucuac

SEQ ID NO: 2590617 - RNA, 14 nt, Coxiella burnetii RSA 493
acaacgcuguuaaa

SEQ ID NO: 2590618 - RNA, 17 nt, Coxiella burnetii RSA 493
acaacguaacugaugua

SEQ ID NO: 2590619 - RNA, 13 nt, Coxiella burnetii RSA 493
acaacuaccugau

SEQ ID NO: 2590620 - RNA, 15 nt, Coxiella burnetii RSA 493
acaacuaccugauaa

SEQ ID NO: 2590621 - RNA, 18 nt, Coxiella burnetii RSA 493
acaacuaccugauaaaau

SEQ ID NO: 2590622 - RNA, 20 nt, Coxiella burnetii RSA 493
acaacuaccugauaaaauaa

SEQ ID NO: 2590623 - RNA, 21 nt, Coxiella burnetii RSA 493
acaacuaccugauaaaauaac

SEQ ID NO: 2590624 - RNA, 17 nt, Coxiella burnetii RSA 493
acaacuacuaagccacc

SEQ ID NO: 2590625 - RNA, 20 nt, Coxiella burnetii RSA 493
acaacugccugcuaggauuu

SEQ ID NO: 2590626 - RNA, 13 nt, Coxiella burnetii RSA 493
acaagaauuuuuu

SEQ ID NO: 2590627 - RNA, 19 nt, Coxiella burnetii RSA 493
acaagaccccuaucaauca

SEQ ID NO: 2590628 - RNA, 17 nt, Coxiella burnetii RSA 493
acaagcagggcaguaaa

SEQ ID NO: 2590629 - RNA, 21 nt, Coxiella burnetii RSA 493
acaagcagggcaguaaauaga

SEQ ID NO: 2590630 - RNA, 13 nt, Coxiella burnetii RSA 493
acaagccccuuua

SEQ ID NO: 2590631 - RNA, 17 nt, Coxiella burnetii RSA 493
acaagcugacaauaggg

SEQ ID NO: 2590632 - RNA, 22 nt, Coxiella burnetii RSA 493
acaagcuggcauugaaaaucaa

SEQ ID NO: 2590633 - RNA, 13 nt, Coxiella burnetii RSA 493
acaaggaaaaucc

SEQ ID NO: 2590634 - RNA, 16 nt, Coxiella burnetii RSA 493
acaaggccggcccuaa

SEQ ID NO: 2590635 - RNA, 19 nt, Coxiella burnetii RSA 493
acaaggccggcccuaacau

SEQ ID NO: 2590636 - RNA, 14 nt, Coxiella burnetii RSA 493
acaagucucagaau

SEQ ID NO: 2590637 - RNA, 15 nt, Coxiella burnetii RSA 493
acaaguuaacaaaau

SEQ ID NO: 2590638 - RNA, 13 nt, Coxiella burnetii RSA 493
acaauaaaaccga

SEQ ID NO: 2590639 - RNA, 17 nt, Coxiella burnetii RSA 493
acaauaagagcuccaaa

SEQ ID NO: 2590640 - RNA, 18 nt, Coxiella burnetii RSA 493
acaauagaauaaugaaca

SEQ ID NO: 2590641 - RNA, 15 nt, Coxiella burnetii RSA 493
acaaucaguuuugau

SEQ ID NO: 2590642 - RNA, 19 nt, Coxiella burnetii RSA 493
acaaugaugucaucuaucg

SEQ ID NO: 2590643 - RNA, 16 nt, Coxiella burnetii RSA 493
acaaugcguuuuaaau

SEQ ID NO: 2590644 - RNA, 17 nt, Coxiella burnetii RSA 493
acaaugcguuuuaaaug

SEQ ID NO: 2590645 - RNA, 18 nt, Coxiella burnetii RSA 493
acaauguuaaaacacaua

SEQ ID NO: 2590646 - RNA, 17 nt, Coxiella burnetii RSA 493
acaauuaacuuugcaaa

SEQ ID NO: 2590647 - RNA, 23 nt, Coxiella burnetii RSA 493
acaauuaaugcgccuacaaauac

SEQ ID NO: 2590648 - RNA, 17 nt, Coxiella burnetii RSA 493
acaauucccccaaaaac

SEQ ID NO: 2590649 - RNA, 18 nt, Coxiella burnetii RSA 493
acaauucccccaaaaacu

SEQ ID NO: 2590650 - RNA, 14 nt, Coxiella burnetii RSA 493
acaauuugaugauc

SEQ ID NO: 2590651 - RNA, 23 nt, Coxiella burnetii RSA 493
acacaaccacuguccucuguccu

SEQ ID NO: 2590652 - RNA, 22 nt, Coxiella burnetii RSA 493
acacaugggacaaggcucacaa

SEQ ID NO: 2590653 - RNA, 12 nt, Coxiella burnetii RSA 493
acaccaagaaau

SEQ ID NO: 2590654 - RNA, 16 nt, Coxiella burnetii RSA 493
acaccgcccauuuccc

SEQ ID NO: 2590655 - RNA, 13 nt, Coxiella burnetii RSA 493
acaccuaagagaa

SEQ ID NO: 2590656 - RNA, 14 nt, Coxiella burnetii RSA 493
acacguauuuucau

SEQ ID NO: 2590657 - RNA, 14 nt, Coxiella burnetii RSA 493
acacuauugaaguc

SEQ ID NO: 2590658 - RNA, 19 nt, Coxiella burnetii RSA 493
acacuuucaaucgcacccu

SEQ ID NO: 2590659 - RNA, 14 nt, Coxiella burnetii RSA 493
acacuuugaugagu

SEQ ID NO: 2590660 - RNA, 14 nt, Coxiella burnetii RSA 493
acagaaaaagcgga

SEQ ID NO: 2590661 - RNA, 16 nt, Coxiella burnetii RSA 493
acagaacaacugcgcc

SEQ ID NO: 2590662 - RNA, 19 nt, Coxiella burnetii RSA 493
acagacagacgcuggaaaa

SEQ ID NO: 2590663 - RNA, 21 nt, Coxiella burnetii RSA 493
acagcaauuaaucccuuugca

SEQ ID NO: 2590664 - RNA, 19 nt, Coxiella burnetii RSA 493
acagcaucuaaccuauugc

SEQ ID NO: 2590665 - RNA, 18 nt, Coxiella burnetii RSA 493
acagccaccccguguuga

SEQ ID NO: 2590666 - RNA, 19 nt, Coxiella burnetii RSA 493
acagccgaugacaaauaaa

SEQ ID NO: 2590667 - RNA, 21 nt, Coxiella burnetii RSA 493
acagccgaugacaaauaaaca

SEQ ID NO: 2590668 - RNA, 14 nt, Coxiella burnetii RSA 493
acagcgaaaacaaa

SEQ ID NO: 2590669 - RNA, 15 nt, Coxiella burnetii RSA 493
acagcgaaauacgag

SEQ ID NO: 2590670 - RNA, 20 nt, Coxiella burnetii RSA 493
acagcggcaguuucuggcuc

SEQ ID NO: 2590671 - RNA, 15 nt, Coxiella burnetii RSA 493
acagcucugaaagca

SEQ ID NO: 2590672 - RNA, 16 nt, Coxiella burnetii RSA 493
acaggagcgauaaaau

SEQ ID NO: 2590673 - RNA, 19 nt, Coxiella burnetii RSA 493
acaggagcgauaaaauaac

SEQ ID NO: 2590674 - RNA, 21 nt, Coxiella burnetii RSA 493
acagguauuuuaaguaauuuu

SEQ ID NO: 2590675 - RNA, 16 nt, Coxiella burnetii RSA 493
acagguccuaaaaaag

SEQ ID NO: 2590676 - RNA, 12 nt, Coxiella burnetii RSA 493
acaguauuucua

SEQ ID NO: 2590677 - RNA, 23 nt, Coxiella burnetii RSA 493
acaguccuaccucgcuuaaagca

SEQ ID NO: 2590678 - RNA, 12 nt, Coxiella burnetii RSA 493
acagucuucacg

SEQ ID NO: 2590679 - RNA, 17 nt, Coxiella burnetii RSA 493
acagugaaagucccauu

SEQ ID NO: 2590680 - RNA, 17 nt, Coxiella burnetii RSA 493
acaguuggcuaaaucca

SEQ ID NO: 2590681 - RNA, 21 nt, Coxiella burnetii RSA 493
acauaaaauuagguaauuuau

SEQ ID NO: 2590682 - RNA, 23 nt, Coxiella burnetii RSA 493
acauaaaauuagguaauuuauaa

SEQ ID NO: 2590683 - RNA, 16 nt, Coxiella burnetii RSA 493
acauaagcgaauaaua

SEQ ID NO: 2590684 - RNA, 13 nt, Coxiella burnetii RSA 493
acauaauuuaaac

SEQ ID NO: 2590685 - RNA, 17 nt, Coxiella burnetii RSA 493
acauacgacuucauuuc

SEQ ID NO: 2590686 - RNA, 23 nt, Coxiella burnetii RSA 493
acauacgggcuacucuuuuucuu

SEQ ID NO: 2590687 - RNA, 15 nt, Coxiella burnetii RSA 493
acauagccucuauaa

SEQ ID NO: 2590688 - RNA, 16 nt, Coxiella burnetii RSA 493
acauaggagauuuuua

SEQ ID NO: 2590689 - RNA, 17 nt, Coxiella burnetii RSA 493
acauaucgcuccccuug

SEQ ID NO: 2590690 - RNA, 21 nt, Coxiella burnetii RSA 493
acauaucgcuccccuugccga

SEQ ID NO: 2590691 - RNA, 15 nt, Coxiella burnetii RSA 493
acauauggcccacuu

SEQ ID NO: 2590692 - RNA, 14 nt, Coxiella burnetii RSA 493
acauauuucuuguc

SEQ ID NO: 2590693 - RNA, 21 nt, Coxiella burnetii RSA 493
acaucagcggggagauuaaaa

SEQ ID NO: 2590694 - RNA, 17 nt, Coxiella burnetii RSA 493
acaucccuggauaauua

SEQ ID NO: 2590695 - RNA, 17 nt, Coxiella burnetii RSA 493
acaucgcucccaaaucg

SEQ ID NO: 2590696 - RNA, 14 nt, Coxiella burnetii RSA 493
acaucguuguuuuc

SEQ ID NO: 2590697 - RNA, 19 nt, Coxiella burnetii RSA 493
acaucuguaauuuuucuug

SEQ ID NO: 2590698 - RNA, 12 nt, Coxiella burnetii RSA 493
acaucuucacgc

SEQ ID NO: 2590699 - RNA, 21 nt, Coxiella burnetii RSA 493
acaugaagguacugaagagua

SEQ ID NO: 2590700 - RNA, 14 nt, Coxiella burnetii RSA 493
acaugauuuuucug

SEQ ID NO: 2590701 - RNA, 19 nt, Coxiella burnetii RSA 493
acaugcgccacuaaaacgc

SEQ ID NO: 2590702 - RNA, 19 nt, Coxiella burnetii RSA 493
acaugcugcuaucugcaau

SEQ ID NO: 2590703 - RNA, 22 nt, Coxiella burnetii RSA 493
acauggccuuugcgguuaaaaa

SEQ ID NO: 2590704 - RNA, 17 nt, Coxiella burnetii RSA 493
acauuauugaugucaca

SEQ ID NO: 2590705 - RNA, 17 nt, Coxiella burnetii RSA 493
acauucgauauguuuca

SEQ ID NO: 2590706 - RNA, 17 nt, Coxiella burnetii RSA 493
acauucuaauaaaauag

SEQ ID NO: 2590707 - RNA, 11 nt, Coxiella burnetii RSA 493
acauucuuuga

SEQ ID NO: 2590708 - RNA, 18 nt, Coxiella burnetii RSA 493
acauuggcaguguaaauu

SEQ ID NO: 2590709 - RNA, 17 nt, Coxiella burnetii RSA 493
acauuguucauaaaaua

SEQ ID NO: 2590710 - RNA, 22 nt, Coxiella burnetii RSA 493
acauuucggacaacaaauaaau

SEQ ID NO: 2590711 - RNA, 12 nt, Coxiella burnetii RSA 493
acauuuggauug

SEQ ID NO: 2590712 - RNA, 16 nt, Coxiella burnetii RSA 493
accaaaauccaaauuu

SEQ ID NO: 2590713 - RNA, 14 nt, Coxiella burnetii RSA 493
accaaaauuccucg

SEQ ID NO: 2590714 - RNA, 13 nt, Coxiella burnetii RSA 493
accuuuuaaauaa

SEQ ID NO: 2590715 - RNA, 14 nt, Coxiella burnetii RSA 493
acgaaaccuuguua

SEQ ID NO: 2590716 - RNA, 23 nt, Coxiella burnetii RSA 493
acgaaagcuaaaaaagaaauauu

SEQ ID NO: 2590717 - RNA, 15 nt, Coxiella burnetii RSA 493
acgaaauaauuacaa

SEQ ID NO: 2590718 - RNA, 22 nt, Coxiella burnetii RSA 493
acgaaauugacccuuuucaauu

SEQ ID NO: 2590719 - RNA, 21 nt, Coxiella burnetii RSA 493
acgaaccacuggaaucaaucg

SEQ ID NO: 2590720 - RNA, 19 nt, Coxiella burnetii RSA 493
acgaaccgacauuucaccc

SEQ ID NO: 2590721 - RNA, 18 nt, Coxiella burnetii RSA 493
acgaaccgccggguuuuu

SEQ ID NO: 2590722 - RNA, 14 nt, Coxiella burnetii RSA 493
acgaagauuaugaa

SEQ ID NO: 2590723 - RNA, 17 nt, Coxiella burnetii RSA 493
acgaauagccaauguuu

SEQ ID NO: 2590724 - RNA, 18 nt, Coxiella burnetii RSA 493
acgaaugugcucaucuuc

SEQ ID NO: 2590725 - RNA, 13 nt, Coxiella burnetii RSA 493
acgaauuaaaaaa

SEQ ID NO: 2590726 - RNA, 20 nt, Coxiella burnetii RSA 493
acgaauuucaagaacgauuu

SEQ ID NO: 2590727 - RNA, 14 nt, Coxiella burnetii RSA 493
acgacagguauuuu

SEQ ID NO: 2590728 - RNA, 19 nt, Coxiella burnetii RSA 493
acgaccucgcgggaggacg

SEQ ID NO: 2590729 - RNA, 16 nt, Coxiella burnetii RSA 493
acgacggguuuuaagu

SEQ ID NO: 2590730 - RNA, 23 nt, Coxiella burnetii RSA 493
acgagugcgcccgucugggaugg

SEQ ID NO: 2590731 - RNA, 15 nt, Coxiella burnetii RSA 493
acgauaaaauuacua

SEQ ID NO: 2590732 - RNA, 13 nt, Coxiella burnetii RSA 493
acgauagaggcgc

SEQ ID NO: 2590733 - RNA, 18 nt, Coxiella burnetii RSA 493
acgauagccagcaauauc

SEQ ID NO: 2590734 - RNA, 15 nt, Coxiella burnetii RSA 493
acgauauaaaagcau

SEQ ID NO: 2590735 - RNA, 16 nt, Coxiella burnetii RSA 493
acgauauuaucaaaac

SEQ ID NO: 2590736 - RNA, 23 nt, Coxiella burnetii RSA 493
acgaucugagugucugagauggc

SEQ ID NO: 2590737 - RNA, 14 nt, Coxiella burnetii RSA 493
acgaugauuaaauc

SEQ ID NO: 2590738 - RNA, 21 nt, Coxiella burnetii RSA 493
acgaugauucccaccaaaauu

SEQ ID NO: 2590739 - RNA, 14 nt, Coxiella burnetii RSA 493
acgaugccaaaauu

SEQ ID NO: 2590740 - RNA, 19 nt, Coxiella burnetii RSA 493
acgauggucaaaccaauca

SEQ ID NO: 2590741 - RNA, 21 nt, Coxiella burnetii RSA 493
acgaugucuuuaaguggcaaa

SEQ ID NO: 2590742 - RNA, 12 nt, Coxiella burnetii RSA 493
acgauuaaaaau

SEQ ID NO: 2590743 - RNA, 23 nt, Coxiella burnetii RSA 493
acgauuaaaaauuuuaaaaaaau

SEQ ID NO: 2590744 - RNA, 12 nt, Coxiella burnetii RSA 493
acgauuaacaac

SEQ ID NO: 2590745 - RNA, 23 nt, Coxiella burnetii RSA 493
acgauuaacaacaaaaccgugcg

SEQ ID NO: 2590746 - RNA, 18 nt, Coxiella burnetii RSA 493
acgauugcuaaaccacgc

SEQ ID NO: 2590747 - RNA, 14 nt, Coxiella burnetii RSA 493
acgauuuaaacaaa

SEQ ID NO: 2590748 - RNA, 20 nt, Coxiella burnetii RSA 493
acgauuucucuuaccauggu

SEQ ID NO: 2590749 - RNA, 22 nt, Coxiella burnetii RSA 493
acgcaaugcuuccgauuccaau

SEQ ID NO: 2590750 - RNA, 16 nt, Coxiella burnetii RSA 493
acgcacucugugcauc

SEQ ID NO: 2590751 - RNA, 19 nt, Coxiella burnetii RSA 493
acgcaucggccuuuuucau

SEQ ID NO: 2590752 - RNA, 22 nt, Coxiella burnetii RSA 493
acgcaucggccuuuuucauuuc

SEQ ID NO: 2590753 - RNA, 16 nt, Coxiella burnetii RSA 493
acgcaugucaauaacc

SEQ ID NO: 2590754 - RNA, 21 nt, Coxiella burnetii RSA 493
acgcaugucaauaacccacag

SEQ ID NO: 2590755 - RNA, 15 nt, Coxiella burnetii RSA 493
acgccaagcugacac

SEQ ID NO: 2590756 - RNA, 18 nt, Coxiella burnetii RSA 493
acgccccaaaguuccgcu

SEQ ID NO: 2590757 - RNA, 15 nt, Coxiella burnetii RSA 493
acgccgaauccgccg

SEQ ID NO: 2590758 - RNA, 16 nt, Coxiella burnetii RSA 493
acgccugaaauauuuu

SEQ ID NO: 2590759 - RNA, 14 nt, Coxiella burnetii RSA 493
acgcgaaaagauuc

SEQ ID NO: 2590760 - RNA, 18 nt, Coxiella burnetii RSA 493
acgcgacaagaauuuuuu

SEQ ID NO: 2590761 - RNA, 23 nt, Coxiella burnetii RSA 493
acgcgauaucuccauuuucaagu

SEQ ID NO: 2590762 - RNA, 20 nt, Coxiella burnetii RSA 493
acgcgccccucaagcaaagc

SEQ ID NO: 2590763 - RNA, 13 nt, Coxiella burnetii RSA 493
acgcgcccgcccc

SEQ ID NO: 2590764 - RNA, 15 nt, Coxiella burnetii RSA 493
acgcgcucaaugaau

SEQ ID NO: 2590765 - RNA, 15 nt, Coxiella burnetii RSA 493
acgcuaguuuuuaag

SEQ ID NO: 2590766 - RNA, 17 nt, Coxiella burnetii RSA 493
acgcuaugaaaaccaca

SEQ ID NO: 2590767 - RNA, 16 nt, Coxiella burnetii RSA 493
acgcuauuuuuuaaau

SEQ ID NO: 2590768 - RNA, 24 nt, Coxiella burnetii RSA 493
acgcucagauaaaugaugcuucuu

SEQ ID NO: 2590769 - RNA, 17 nt, Coxiella burnetii RSA 493
acgcucgagggaaaccu

SEQ ID NO: 2590770 - RNA, 22 nt, Coxiella burnetii RSA 493
acgcucgauggaacugauauac

SEQ ID NO: 2590771 - RNA, 19 nt, Coxiella burnetii RSA 493
acgcucgguuccaaaaauu

SEQ ID NO: 2590772 - RNA, 17 nt, Coxiella burnetii RSA 493
acgcugaaguugacgca

SEQ ID NO: 2590773 - RNA, 19 nt, Coxiella burnetii RSA 493
acgcugaguggaaaaccac

SEQ ID NO: 2590774 - RNA, 13 nt, Coxiella burnetii RSA 493
acgcugcaauaau

SEQ ID NO: 2590775 - RNA, 16 nt, Coxiella burnetii RSA 493
acgcuggaaaaauaaa

SEQ ID NO: 2590776 - RNA, 13 nt, Coxiella burnetii RSA 493
acgcuuauaggaa

SEQ ID NO: 2590777 - RNA, 13 nt, Coxiella burnetii RSA 493
acggaaaaacaaa

SEQ ID NO: 2590778 - RNA, 21 nt, Coxiella burnetii RSA 493
acggauaauaucuagauuuaa

SEQ ID NO: 2590779 - RNA, 12 nt, Coxiella burnetii RSA 493
acggcaaauaaa

SEQ ID NO: 2590780 - RNA, 13 nt, Coxiella burnetii RSA 493
acggcaaauaaag

SEQ ID NO: 2590781 - RNA, 16 nt, Coxiella burnetii RSA 493
acggcggauuaaaaaa

SEQ ID NO: 2590782 - RNA, 21 nt, Coxiella burnetii RSA 493
acggcucacguauugcaauau

SEQ ID NO: 2590783 - RNA, 19 nt, Coxiella burnetii RSA 493
acggcuugauuucaggcgc

SEQ ID NO: 2590784 - RNA, 18 nt, Coxiella burnetii RSA 493
acggcuuuauuuuggaua

SEQ ID NO: 2590785 - RNA, 17 nt, Coxiella burnetii RSA 493
acgggagguuaaaaugg

SEQ ID NO: 2590786 - RNA, 20 nt, Coxiella burnetii RSA 493
acgggcuacuuggcgacagc

SEQ ID NO: 2590787 - RNA, 17 nt, Coxiella burnetii RSA 493
acggggaaauaaugaca

SEQ ID NO: 2590788 - RNA, 21 nt, Coxiella burnetii RSA 493
acggggucgcggaaaauuuaa

SEQ ID NO: 2590789 - RNA, 22 nt, Coxiella burnetii RSA 493
acggguggguaaugauaugaga

SEQ ID NO: 2590790 - RNA, 12 nt, Coxiella burnetii RSA 493
acgguaauaaua

SEQ ID NO: 2590791 - RNA, 14 nt, Coxiella burnetii RSA 493
acgguaauaauaua

SEQ ID NO: 2590792 - RNA, 14 nt, Coxiella burnetii RSA 493
acggugcagaaggc

SEQ ID NO: 2590793 - RNA, 18 nt, Coxiella burnetii RSA 493
acggugcgauuuuccgca

SEQ ID NO: 2590794 - RNA, 23 nt, Coxiella burnetii RSA 493
acguaauggaauauguuguccac

SEQ ID NO: 2590795 - RNA, 18 nt, Coxiella burnetii RSA 493
acguaauuauuaagccuu

SEQ ID NO: 2590796 - RNA, 18 nt, Coxiella burnetii RSA 493
acguauauggacccaccc

SEQ ID NO: 2590797 - RNA, 15 nt, Coxiella burnetii RSA 493
acguauugccaaaau

SEQ ID NO: 2590798 - RNA, 16 nt, Coxiella burnetii RSA 493
acgucacgaauuuuuu

SEQ ID NO: 2590799 - RNA, 21 nt, Coxiella burnetii RSA 493
acgucacgaauuuuuucagga

SEQ ID NO: 2590800 - RNA, 14 nt, Coxiella burnetii RSA 493
acgucagaaaacag

SEQ ID NO: 2590801 - RNA, 13 nt, Coxiella burnetii RSA 493
acgucauaaaggu

SEQ ID NO: 2590802 - RNA, 15 nt, Coxiella burnetii RSA 493
acgucgcaaauaaua

SEQ ID NO: 2590803 - RNA, 19 nt, Coxiella burnetii RSA 493
acgugccgccgaaauuuaa

SEQ ID NO: 2590804 - RNA, 20 nt, Coxiella burnetii RSA 493
acgugcuuugggauaauuca

SEQ ID NO: 2590805 - RNA, 20 nt, Coxiella burnetii RSA 493
acguuaucacuugauaauca

SEQ ID NO: 2590806 - RNA, 21 nt, Coxiella burnetii RSA 493
acguugaccgcuaaagcaaaa

SEQ ID NO: 2590807 - RNA, 20 nt, Coxiella burnetii RSA 493
acguuuuuugcauuuuuaaa

SEQ ID NO: 2590808 - RNA, 12 nt, Coxiella burnetii RSA 493
acuaaacaaaau

SEQ ID NO: 2590809 - RNA, 13 nt, Coxiella burnetii RSA 493
acuaaacaaaaua

SEQ ID NO: 2590810 - RNA, 15 nt, Coxiella burnetii RSA 493
acuaaacaaaauaau

SEQ ID NO: 2590811 - RNA, 20 nt, Coxiella burnetii RSA 493
acuaaaccaacgaacgccaa

SEQ ID NO: 2590812 - RNA, 19 nt, Coxiella burnetii RSA 493
acuaaagguaaaaagauca

SEQ ID NO: 2590813 - RNA, 23 nt, Coxiella burnetii RSA 493
acuaaaugacguaaugucucaag

SEQ ID NO: 2590814 - RNA, 22 nt, Coxiella burnetii RSA 493
acuaaauuuucucaauuucuuu

SEQ ID NO: 2590815 - RNA, 12 nt, Coxiella burnetii RSA 493
acuaagcauuaa

SEQ ID NO: 2590816 - RNA, 11 nt, Coxiella burnetii RSA 493
acuaagucgcc

SEQ ID NO: 2590817 - RNA, 22 nt, Coxiella burnetii RSA 493
acuaauagcucauauuccgugu

SEQ ID NO: 2590818 - RNA, 19 nt, Coxiella burnetii RSA 493
acuaaucccgccccauuuu

SEQ ID NO: 2590819 - RNA, 17 nt, Coxiella burnetii RSA 493
agaaaaaagaaauggau

SEQ ID NO: 2590820 - RNA, 11 nt, Coxiella burnetii RSA 493
agaaaaaauga

SEQ ID NO: 2590821 - RNA, 19 nt, Coxiella burnetii RSA 493
agaaaaaccaguuuucagc

SEQ ID NO: 2590822 - RNA, 17 nt, Coxiella burnetii RSA 493
agaaaaccgcagcucaa

SEQ ID NO: 2590823 - RNA, 21 nt, Coxiella burnetii RSA 493
agaaaaccgcagcucaaacaa

SEQ ID NO: 2590824 - RNA, 22 nt, Coxiella burnetii RSA 493
agaaaaccgcagcucaaacaaa

SEQ ID NO: 2590825 - RNA, 12 nt, Coxiella burnetii RSA 493
agaaaaguaaaa

SEQ ID NO: 2590826 - RNA, 15 nt, Coxiella burnetii RSA 493
agaaaaguaaaaaau

SEQ ID NO: 2590827 - RNA, 11 nt, Coxiella burnetii RSA 493
agaaaaugauu

SEQ ID NO: 2590828 - RNA, 15 nt, Coxiella burnetii RSA 493
agaaaaugauuucau

SEQ ID NO: 2590829 - RNA, 14 nt, Coxiella burnetii RSA 493
agaaacgauuaaaa

SEQ ID NO: 2590830 - RNA, 20 nt, Coxiella burnetii RSA 493
agaaacguauugccaaaauu

SEQ ID NO: 2590831 - RNA, 19 nt, Coxiella burnetii RSA 493
agaaacucaaccaccacuu

SEQ ID NO: 2590832 - RNA, 11 nt, Coxiella burnetii RSA 493
agaaagacaac

SEQ ID NO: 2590833 - RNA, 17 nt, Coxiella burnetii RSA 493
agaaagcgagcaaucaa

SEQ ID NO: 2590834 - RNA, 20 nt, Coxiella burnetii RSA 493
agaaagcgagcaaucaaaac

SEQ ID NO: 2590835 - RNA, 23 nt, Coxiella burnetii RSA 493
agaaagcgagcaaucaaaacagc

SEQ ID NO: 2590836 - RNA, 20 nt, Coxiella burnetii RSA 493
agaaaguuucccacaaaaua

SEQ ID NO: 2590837 - RNA, 18 nt, Coxiella burnetii RSA 493
agaaauauuagaaauaau

SEQ ID NO: 2590838 - RNA, 15 nt, Coxiella burnetii RSA 493
agaaauauuuucuca

SEQ ID NO: 2590839 - RNA, 17 nt, Coxiella burnetii RSA 493
agaaauugacaaauaaa

SEQ ID NO: 2590840 - RNA, 18 nt, Coxiella burnetii RSA 493
agaaauugacaaauaaag

SEQ ID NO: 2590841 - RNA, 21 nt, Coxiella burnetii RSA 493
agaaauugacaaauaaagaau

SEQ ID NO: 2590842 - RNA, 21 nt, Coxiella burnetii RSA 493
agaaauugcgcguaaaauucc

SEQ ID NO: 2590843 - RNA, 19 nt, Coxiella burnetii RSA 493
agaacaacugcgccgcaaa

SEQ ID NO: 2590844 - RNA, 23 nt, Coxiella burnetii RSA 493
agaacaacugcgccgcaaaguaa

SEQ ID NO: 2590845 - RNA, 24 nt, Coxiella burnetii RSA 493
agaacaacugcgccgcaaaguaaa

SEQ ID NO: 2590846 - RNA, 13 nt, Coxiella burnetii RSA 493
agaacaauuaacu

SEQ ID NO: 2590847 - RNA, 22 nt, Coxiella burnetii RSA 493
agaacauccggcucgaugcaau

SEQ ID NO: 2590848 - RNA, 23 nt, Coxiella burnetii RSA 493
agaacggauagucgcguauaaau

SEQ ID NO: 2590849 - RNA, 10 nt, Coxiella burnetii RSA 493
agaagaauaa

SEQ ID NO: 2590850 - RNA, 14 nt, Coxiella burnetii RSA 493
agaagcaucagaua

SEQ ID NO: 2590851 - RNA, 23 nt, Coxiella burnetii RSA 493
agaaguaaaaagagucauuguau

SEQ ID NO: 2590852 - RNA, 22 nt, Coxiella burnetii RSA 493
agaaguaugaucauuuucucag

SEQ ID NO: 2590853 - RNA, 14 nt, Coxiella burnetii RSA 493
agaaguauuuccau

SEQ ID NO: 2590854 - RNA, 22 nt, Coxiella burnetii RSA 493
agaauaccccgcuguuuucaga

SEQ ID NO: 2590855 - RNA, 22 nt, Coxiella burnetii RSA 493
agaauccaacgguucucaaauu

SEQ ID NO: 2590856 - RNA, 23 nt, Coxiella burnetii RSA 493
agaaucucacgugagguuacauu

SEQ ID NO: 2590857 - RNA, 20 nt, Coxiella burnetii RSA 493
agaauggcgggaaaaaauag

SEQ ID NO: 2590858 - RNA, 13 nt, Coxiella burnetii RSA 493
agaauuaaaaaua

SEQ ID NO: 2590859 - RNA, 14 nt, Coxiella burnetii RSA 493
agaauuaaaaauau

SEQ ID NO: 2590860 - RNA, 20 nt, Coxiella burnetii RSA 493
agaauuucucgauaaaaaca

SEQ ID NO: 2590861 - RNA, 13 nt, Coxiella burnetii RSA 493
agaauuucuuugu

SEQ ID NO: 2590862 - RNA, 14 nt, Coxiella burnetii RSA 493
agaauuugacaagc

SEQ ID NO: 2590863 - RNA, 22 nt, Coxiella burnetii RSA 493
agaauuuuuuuauaauuaucca

SEQ ID NO: 2590864 - RNA, 12 nt, Coxiella burnetii RSA 493
agacaaagcuag

SEQ ID NO: 2590865 - RNA, 16 nt, Coxiella burnetii RSA 493
agacaaaguuucuuca

SEQ ID NO: 2590866 - RNA, 19 nt, Coxiella burnetii RSA 493
agacaacuuuauaguucau

SEQ ID NO: 2590867 - RNA, 20 nt, Coxiella burnetii RSA 493
agacaagcgagggcuauauu

SEQ ID NO: 2590868 - RNA, 15 nt, Coxiella burnetii RSA 493
agacaauagaauaau

SEQ ID NO: 2590869 - RNA, 17 nt, Coxiella burnetii RSA 493
agacaauguuaaaacac

SEQ ID NO: 2590870 - RNA, 18 nt, Coxiella burnetii RSA 493
agacaauguuaaaacaca

SEQ ID NO: 2590871 - RNA, 14 nt, Coxiella burnetii RSA 493
agacaucggauaau

SEQ ID NO: 2590872 - RNA, 20 nt, Coxiella burnetii RSA 493
agacauuguucauaaaauaa

SEQ ID NO: 2590873 - RNA, 21 nt, Coxiella burnetii RSA 493
agacauuguucauaaaauaau

SEQ ID NO: 2590874 - RNA, 19 nt, Coxiella burnetii RSA 493
agaccaaauccgcauaaaa

SEQ ID NO: 2590875 - RNA, 19 nt, Coxiella burnetii RSA 493
agacccauuuuuuugauuc

SEQ ID NO: 2590876 - RNA, 21 nt, Coxiella burnetii RSA 493
agacccgccaaagcaaaaaua

SEQ ID NO: 2590877 - RNA, 16 nt, Coxiella burnetii RSA 493
agaccuguuaaaaacg

SEQ ID NO: 2590878 - RNA, 17 nt, Coxiella burnetii RSA 493
agaccuguuaaaaacgc

SEQ ID NO: 2590879 - RNA, 16 nt, Coxiella burnetii RSA 493
agacgcuaguuuuuaa

SEQ ID NO: 2590880 - RNA, 18 nt, Coxiella burnetii RSA 493
agacgcuggaaaaauaaa

SEQ ID NO: 2590881 - RNA, 14 nt, Coxiella burnetii RSA 493
agacguauuuggaa

SEQ ID NO: 2590882 - RNA, 13 nt, Coxiella burnetii RSA 493
agacucuuuuuau

SEQ ID NO: 2590883 - RNA, 17 nt, Coxiella burnetii RSA 493
agacuucgcuaaauaac

SEQ ID NO: 2590884 - RNA, 18 nt, Coxiella burnetii RSA 493
agacuucgcuaaauaaca

SEQ ID NO: 2590885 - RNA, 15 nt, Coxiella burnetii RSA 493
agacuucuuuaagcg

SEQ ID NO: 2590886 - RNA, 17 nt, Coxiella burnetii RSA 493
agagaaauuaaauuuuu

SEQ ID NO: 2590887 - RNA, 16 nt, Coxiella burnetii RSA 493
agagagcgagguaaag

SEQ ID NO: 2590888 - RNA, 22 nt, Coxiella burnetii RSA 493
agagaugggaucguuaugggaa

SEQ ID NO: 2590889 - RNA, 15 nt, Coxiella burnetii RSA 493
agaggagugggguug

SEQ ID NO: 2590890 - RNA, 19 nt, Coxiella burnetii RSA 493
agaggcuguucgccagaaa

SEQ ID NO: 2590891 - RNA, 21 nt, Coxiella burnetii RSA 493
agaggggguuaggagcaagua

SEQ ID NO: 2590892 - RNA, 18 nt, Coxiella burnetii RSA 493
agaggucaucauuuuugu

SEQ ID NO: 2590893 - RNA, 22 nt, Coxiella burnetii RSA 493
agaggucguaccuucaauuccg

SEQ ID NO: 2590894 - RNA, 15 nt, Coxiella burnetii RSA 493
agaggugaaccaaaa

SEQ ID NO: 2590895 - RNA, 22 nt, Coxiella burnetii RSA 493
agagguuuuaaguuuuuugcuc

SEQ ID NO: 2590896 - RNA, 14 nt, Coxiella burnetii RSA 493
agaguaaauguuuc

SEQ ID NO: 2590897 - RNA, 17 nt, Coxiella burnetii RSA 493
agaguaaauguuucuuu

SEQ ID NO: 2590898 - RNA, 18 nt, Coxiella burnetii RSA 493
agaguaacgauuucucuu

SEQ ID NO: 2590899 - RNA, 19 nt, Coxiella burnetii RSA 493
agaguacgccaaccauaau

SEQ ID NO: 2590900 - RNA, 13 nt, Coxiella burnetii RSA 493
agagucauuguau

SEQ ID NO: 2590901 - RNA, 21 nt, Coxiella burnetii RSA 493
agagucgcaacaagcaacgau

SEQ ID NO: 2590902 - RNA, 15 nt, Coxiella burnetii RSA 493
agagugcaauuaggg

SEQ ID NO: 2590903 - RNA, 17 nt, Coxiella burnetii RSA 493
agauaacgcuucuuuua

SEQ ID NO: 2590904 - RNA, 17 nt, Coxiella burnetii RSA 493
agauaagccgggcggga

SEQ ID NO: 2590905 - RNA, 17 nt, Coxiella burnetii RSA 493
agauaagcuguuucuuu

SEQ ID NO: 2590906 - RNA, 19 nt, Coxiella burnetii RSA 493
agauaagcuguuucuuuua

SEQ ID NO: 2590907 - RNA, 14 nt, Coxiella burnetii RSA 493
agauaauaauuaua

SEQ ID NO: 2590908 - RNA, 18 nt, Coxiella burnetii RSA 493
agauaaucccaauaaaac

SEQ ID NO: 2590909 - RNA, 22 nt, Coxiella burnetii RSA 493
agauaaugaccuuaaucgugaa

SEQ ID NO: 2590910 - RNA, 14 nt, Coxiella burnetii RSA 493
agauaauuacaauc

SEQ ID NO: 2590911 - RNA, 14 nt, Coxiella burnetii RSA 493
agauaccagauacu

SEQ ID NO: 2590912 - RNA, 16 nt, Coxiella burnetii RSA 493
agauacuguacuggaa

SEQ ID NO: 2590913 - RNA, 18 nt, Coxiella burnetii RSA 493
agauaggacuuuucucga

SEQ ID NO: 2590914 - RNA, 21 nt, Coxiella burnetii RSA 493
agauaucaauagcgcaauugg

SEQ ID NO: 2590915 - RNA, 14 nt, Coxiella burnetii RSA 493
agaucacuggacca

SEQ ID NO: 2590916 - RNA, 20 nt, Coxiella burnetii RSA 493
agaucauacauaugaauauu

SEQ ID NO: 2590917 - RNA, 22 nt, Coxiella burnetii RSA 493
agauccgucgucguugacaaac

SEQ ID NO: 2590918 - RNA, 20 nt, Coxiella burnetii RSA 493
agauccuugcgagcgcaaau

SEQ ID NO: 2590919 - RNA, 19 nt, Coxiella burnetii RSA 493
agaucgcaaaauccugucu

SEQ ID NO: 2590920 - RNA, 19 nt, Coxiella burnetii RSA 493
agaucguuuuuugauaaaa

SEQ ID NO: 2590921 - RNA, 12 nt, Coxiella burnetii RSA 493
agaugauuaaaa

SEQ ID NO: 2590922 - RNA, 19 nt, Coxiella burnetii RSA 493
agaugccaacgguaacccu

SEQ ID NO: 2590923 - RNA, 16 nt, Coxiella burnetii RSA 493
agauggcaucauuucc

SEQ ID NO: 2590924 - RNA, 20 nt, Coxiella burnetii RSA 493
ucaauaaugccagauugauu

SEQ ID NO: 2590925 - RNA, 15 nt, Coxiella burnetii RSA 493
ucaauacagauuuua

SEQ ID NO: 2590926 - RNA, 15 nt, Coxiella burnetii RSA 493
ucaauaccaagcuca

SEQ ID NO: 2590927 - RNA, 21 nt, Coxiella burnetii RSA 493
ucaauaccaagcucaugaaaa

SEQ ID NO: 2590928 - RNA, 16 nt, Coxiella burnetii RSA 493
ucaauacuacagcaca

SEQ ID NO: 2590929 - RNA, 16 nt, Coxiella burnetii RSA 493
ucaauagaaaaaagaa

SEQ ID NO: 2590930 - RNA, 22 nt, Coxiella burnetii RSA 493
ucaauagagcgggaauuuucga

SEQ ID NO: 2590931 - RNA, 21 nt, Coxiella burnetii RSA 493
ucaauaggguagucaggaagc

SEQ ID NO: 2590932 - RNA, 17 nt, Coxiella burnetii RSA 493
ucaauauggaacccguu

SEQ ID NO: 2590933 - RNA, 13 nt, Coxiella burnetii RSA 493
ucaauauuucuug

SEQ ID NO: 2590934 - RNA, 21 nt, Coxiella burnetii RSA 493
ucaauauuucuugaaaaacuu

SEQ ID NO: 2590935 - RNA, 18 nt, Coxiella burnetii RSA 493
ucaaucgcagcauuuuuc

SEQ ID NO: 2590936 - RNA, 20 nt, Coxiella burnetii RSA 493
ucaaugagugcuuuuaacca

SEQ ID NO: 2590937 - RNA, 22 nt, Coxiella burnetii RSA 493
ucaauggauucuucuuuugcca

SEQ ID NO: 2590938 - RNA, 14 nt, Coxiella burnetii RSA 493
ucaauggcuuuauu

SEQ ID NO: 2590939 - RNA, 13 nt, Coxiella burnetii RSA 493
ucaauuaaauuua

SEQ ID NO: 2590940 - RNA, 17 nt, Coxiella burnetii RSA 493
ucaauuacuuuuauaau

SEQ ID NO: 2590941 - RNA, 23 nt, Coxiella burnetii RSA 493
ucaauuauuaacgccagaugcca

SEQ ID NO: 2590942 - RNA, 19 nt, Coxiella burnetii RSA 493
ucaauuccgauaagcguuu

SEQ ID NO: 2590943 - RNA, 21 nt, Coxiella burnetii RSA 493
ucaauucgcuuaaauuuugac

SEQ ID NO: 2590944 - RNA, 13 nt, Coxiella burnetii RSA 493
ucaauugcuuucc

SEQ ID NO: 2590945 - RNA, 17 nt, Coxiella burnetii RSA 493
ucaauuuaccaauuaaa

SEQ ID NO: 2590946 - RNA, 18 nt, Coxiella burnetii RSA 493
ucaauuucaacgccucuc

SEQ ID NO: 2590947 - RNA, 19 nt, Coxiella burnetii RSA 493
ucaauuucaauuagaaugc

SEQ ID NO: 2590948 - RNA, 13 nt, Coxiella burnetii RSA 493
ucaauuuccuauu

SEQ ID NO: 2590949 - RNA, 23 nt, Coxiella burnetii RSA 493
ucaauuucucguugauaaagauu

SEQ ID NO: 2590950 - RNA, 20 nt, Coxiella burnetii RSA 493
ucaauuuugcgcucauuuuc

SEQ ID NO: 2590951 - RNA, 19 nt, Coxiella burnetii RSA 493
ucaauuuuuuugauaggau

SEQ ID NO: 2590952 - RNA, 16 nt, Coxiella burnetii RSA 493
ucacaaaagguaaaaa

SEQ ID NO: 2590953 - RNA, 15 nt, Coxiella burnetii RSA 493
ucacaaauuauauca

SEQ ID NO: 2590954 - RNA, 20 nt, Coxiella burnetii RSA 493
ucacaagucucagaaucugu

SEQ ID NO: 2590955 - RNA, 21 nt, Coxiella burnetii RSA 493
ucacaaguucuucuaaagaau

SEQ ID NO: 2590956 - RNA, 15 nt, Coxiella burnetii RSA 493
ucacaccaagaaauu

SEQ ID NO: 2590957 - RNA, 20 nt, Coxiella burnetii RSA 493
ucacacguaucugcuaaaaa

SEQ ID NO: 2590958 - RNA, 22 nt, Coxiella burnetii RSA 493
ucacacguaucugcuaaaaagc

SEQ ID NO: 2590959 - RNA, 15 nt, Coxiella burnetii RSA 493
ucacaugauuuuucu

SEQ ID NO: 2590960 - RNA, 14 nt, Coxiella burnetii RSA 493
ucacccaaaucaug

SEQ ID NO: 2590961 - RNA, 20 nt, Coxiella burnetii RSA 493
ucacccacaucuggaaucaa

SEQ ID NO: 2590962 - RNA, 21 nt, Escherichia coli CFT073
aaaaacgcauaccccaucagc

SEQ ID NO: 2590963 - RNA, 17 nt, Escherichia coli CFT073
aaaaacggaaagcagau

SEQ ID NO: 2590964 - RNA, 19 nt, Escherichia coli CFT073
aaaaacucaaaaaaaauuu

SEQ ID NO: 2590965 - RNA, 13 nt, Escherichia coli CFT073
aaaaagaaggaaa

SEQ ID NO: 2590966 - RNA, 15 nt, Escherichia coli CFT073
aaaaagaaggaaaau

SEQ ID NO: 2590967 - RNA, 18 nt, Escherichia coli CFT073
aaaaagaaggaaaauaca

SEQ ID NO: 2590968 - RNA, 18 nt, Escherichia coli CFT073
aaaaagcaagauuaaaau

SEQ ID NO: 2590969 - RNA, 19 nt, Escherichia coli CFT073
aaaaagcaagauuaaaaua

SEQ ID NO: 2590970 - RNA, 15 nt, Escherichia coli CFT073
aaaaagccccgcagc

SEQ ID NO: 2590971 - RNA, 19 nt, Escherichia coli CFT073
aaaaagcgauauccgggca

SEQ ID NO: 2590972 - RNA, 22 nt, Escherichia coli CFT073
aaaaagcggcgaguguguggaa

SEQ ID NO: 2590973 - RNA, 20 nt, Escherichia coli CFT073
aaaaagcgucucgccagagu

SEQ ID NO: 2590974 - RNA, 20 nt, Escherichia coli CFT073
aaaaagcuugucauuaccac

SEQ ID NO: 2590975 - RNA, 17 nt, Escherichia coli CFT073
aaaaaguaguuccagca

SEQ ID NO: 2590976 - RNA, 23 nt, Escherichia coli CFT073
aaaaagugcauauacaaccaaua

SEQ ID NO: 2590977 - RNA, 18 nt, Escherichia coli CFT073
aaaaauaaaagcgugaaa

SEQ ID NO: 2590978 - RNA, 12 nt, Escherichia coli CFT073
aaaaauaaaugc

SEQ ID NO: 2590979 - RNA, 14 nt, Escherichia coli CFT073
aaaaauaacaguga

SEQ ID NO: 2590980 - RNA, 17 nt, Escherichia coli CFT073
aaaaauaaucucaccau

SEQ ID NO: 2590981 - RNA, 21 nt, Escherichia coli CFT073
aaaaauaccauuagucacauu

SEQ ID NO: 2590982 - RNA, 14 nt, Escherichia coli CFT073
aaaaauaccgagca

SEQ ID NO: 2590983 - RNA, 16 nt, Escherichia coli CFT073
aaaaauacgcaucaua

SEQ ID NO: 2590984 - RNA, 15 nt, Escherichia coli CFT073
aaaaauagaacugaa

SEQ ID NO: 2590985 - RNA, 18 nt, Escherichia coli CFT073
aaaaauauauuccuauau

SEQ ID NO: 2590986 - RNA, 18 nt, Escherichia coli CFT073
aaaaaucgacagcaggau

SEQ ID NO: 2590987 - RNA, 17 nt, Escherichia coli CFT073
aaaaaucgacuguggua

SEQ ID NO: 2590988 - RNA, 17 nt, Escherichia coli CFT073
aaaaaugagcgaacaau

SEQ ID NO: 2590989 - RNA, 12 nt, Escherichia coli CFT073
aaaaaugcagca

SEQ ID NO: 2590990 - RNA, 22 nt, Escherichia coli CFT073
aaaaaugcugcaaucauugcuu

SEQ ID NO: 2590991 - RNA, 17 nt, Escherichia coli CFT073
aaaaauggagagaacca

SEQ ID NO: 2590992 - RNA, 15 nt, Escherichia coli CFT073
aaaaauuaauuuuuu

SEQ ID NO: 2590993 - RNA, 21 nt, Escherichia coli CFT073
aaaaauuacucucgugccaga

SEQ ID NO: 2590994 - RNA, 21 nt, Escherichia coli CFT073
aaaaauugcgcaacuuuuucu

SEQ ID NO: 2590995 - RNA, 13 nt, Escherichia coli CFT073
aaaacaaaaaccg

SEQ ID NO: 2590996 - RNA, 15 nt, Escherichia coli CFT073
aaaacaagcagcugc

SEQ ID NO: 2590997 - RNA, 10 nt, Escherichia coli CFT073
aaaacaccgc

SEQ ID NO: 2590998 - RNA, 23 nt, Escherichia coli CFT073
aaaacaccgcuguugccagcagc

SEQ ID NO: 2590999 - RNA, 16 nt, Escherichia coli CFT073
aaaacacgacaugacc

SEQ ID NO: 2591000 - RNA, 15 nt, Escherichia coli CFT073
aaaacacucuucaac

SEQ ID NO: 2591001 - RNA, 14 nt, Escherichia coli CFT073
aaaacacucuuuuu

SEQ ID NO: 2591002 - RNA, 11 nt, Escherichia coli CFT073
aaaacagccaa

SEQ ID NO: 2591003 - RNA, 13 nt, Escherichia coli CFT073
aaaacagccagca

SEQ ID NO: 2591004 - RNA, 15 nt, Escherichia coli CFT073
aaaacagccagcagc

SEQ ID NO: 2591005 - RNA, 20 nt, Escherichia coli CFT073
aaaacagcgcccaacacuuc

SEQ ID NO: 2591006 - RNA, 20 nt, Escherichia coli CFT073
aaaacaggucgccagucccu

SEQ ID NO: 2591007 - RNA, 20 nt, Escherichia coli CFT073
aaaacaguaccagaccaaca

SEQ ID NO: 2591008 - RNA, 21 nt, Escherichia coli CFT073
aaaacauaucccaccagcgcc

SEQ ID NO: 2591009 - RNA, 19 nt, Escherichia coli CFT073
aaaacauuacuaauuaaua

SEQ ID NO: 2591010 - RNA, 20 nt, Escherichia coli CFT073
aaaacauuacuaauuaauaa

SEQ ID NO: 2591011 - RNA, 18 nt, Escherichia coli CFT073
aaaacauuuuaaacauca

SEQ ID NO: 2591012 - RNA, 22 nt, Escherichia coli CFT073
aaaaccacacuucuucagccag

SEQ ID NO: 2591013 - RNA, 21 nt, Escherichia coli CFT073
aaaaccaccgaccacggccag

SEQ ID NO: 2591014 - RNA, 19 nt, Escherichia coli CFT073
aaaaccacuaauuccugca

SEQ ID NO: 2591015 - RNA, 21 nt, Escherichia coli CFT073
aaaaccauuaccaaucugcuc

SEQ ID NO: 2591016 - RNA, 14 nt, Escherichia coli CFT073
aaaacccaucaacc

SEQ ID NO: 2591017 - RNA, 17 nt, Escherichia coli CFT073
aaaacccgcugauuaag

SEQ ID NO: 2591018 - RNA, 20 nt, Escherichia coli CFT073
aaaacccgcuuuuugaagcg

SEQ ID NO: 2591019 - RNA, 15 nt, Escherichia coli CFT073
aaaaccgacuuaaaa

SEQ ID NO: 2591020 - RNA, 14 nt, Escherichia coli CFT073
aaaacgaaugacug

SEQ ID NO: 2591021 - RNA, 17 nt, Escherichia coli CFT073
aaaacgaccaccuucaa

SEQ ID NO: 2591022 - RNA, 23 nt, Escherichia coli CFT073
aaaacgcacgcugucgccaguga

SEQ ID NO: 2591023 - RNA, 16 nt, Escherichia coli CFT073
aaaacgcauaccccau

SEQ ID NO: 2591024 - RNA, 16 nt, Escherichia coli CFT073
aaaacgccgcugguga

SEQ ID NO: 2591025 - RNA, 11 nt, Escherichia coli CFT073
aaaacgccugc

SEQ ID NO: 2591026 - RNA, 13 nt, Escherichia coli CFT073
aaaacgccugcuc

SEQ ID NO: 2591027 - RNA, 16 nt, Escherichia coli CFT073
aaaacgcgcgcgaaua

SEQ ID NO: 2591028 - RNA, 18 nt, Escherichia coli CFT073
aaaacgcgcucacugcac

SEQ ID NO: 2591029 - RNA, 22 nt, Escherichia coli CFT073
aaaacgcggcagguaacugacu

SEQ ID NO: 2591030 - RNA, 13 nt, Escherichia coli CFT073
aaaacgcuccaac

SEQ ID NO: 2591031 - RNA, 16 nt, Escherichia coli CFT073
aaaacggaaagcagau

SEQ ID NO: 2591032 - RNA, 19 nt, Escherichia coli CFT073
aaaacggaagcucagacgg

SEQ ID NO: 2591033 - RNA, 13 nt, Escherichia coli CFT073
aaaacggcaacgg

SEQ ID NO: 2591034 - RNA, 17 nt, Escherichia coli CFT073
aaaacggcgcauugccu

SEQ ID NO: 2591035 - RNA, 19 nt, Escherichia coli CFT073
aaaacgguaguugaacucg

SEQ ID NO: 2591036 - RNA, 17 nt, Escherichia coli CFT073
aaaacgguggccacagc

SEQ ID NO: 2591037 - RNA, 19 nt, Escherichia coli CFT073
aaaacguccggcaauauag

SEQ ID NO: 2591038 - RNA, 17 nt, Escherichia coli CFT073
aaaacgucgccagcgcc

SEQ ID NO: 2591039 - RNA, 16 nt, Escherichia coli CFT073
aaaacgugcagcugcc

SEQ ID NO: 2591040 - RNA, 18 nt, Escherichia coli CFT073
aaaacguggccuccaaaa

SEQ ID NO: 2591041 - RNA, 19 nt, Escherichia coli CFT073
aaaacguggccuccaaaaa

SEQ ID NO: 2591042 - RNA, 20 nt, Escherichia coli CFT073
aaaacguggccuccaaaaaa

SEQ ID NO: 2591043 - RNA, 18 nt, Escherichia coli CFT073
aaaacuaucugaaaauga

SEQ ID NO: 2591044 - RNA, 14 nt, Escherichia coli CFT073
aaaacucaaaaaaa

SEQ ID NO: 2591045 - RNA, 21 nt, Escherichia coli CFT073
aaaacugaagcgcgccuggcg

SEQ ID NO: 2591046 - RNA, 21 nt, Escherichia coli CFT073
aaaacugcccgugaugcaacu

SEQ ID NO: 2591047 - RNA, 23 nt, Escherichia coli CFT073
aaaacugcgcccgcuuuucgcca

SEQ ID NO: 2591048 - RNA, 16 nt, Escherichia coli CFT073
aaaacuguaucccagc

SEQ ID NO: 2591049 - RNA, 17 nt, Escherichia coli CFT073
aaaacuguuuacgcagc

SEQ ID NO: 2591050 - RNA, 21 nt, Escherichia coli CFT073
aaaacuucauuugucucaaaa

SEQ ID NO: 2591051 - RNA, 11 nt, Escherichia coli CFT073
aaaagaaacug

SEQ ID NO: 2591052 - RNA, 17 nt, Escherichia coli CFT073
aaaagaaauaucccuga

SEQ ID NO: 2591053 - RNA, 22 nt, Escherichia coli CFT073
aaaagaaugacccauuuguuau

SEQ ID NO: 2591054 - RNA, 19 nt, Escherichia coli CFT073
aaaagaauugcagauacca

SEQ ID NO: 2591055 - RNA, 23 nt, Escherichia coli CFT073
aaaagacuauauuaaagauguuu

SEQ ID NO: 2591056 - RNA, 15 nt, Escherichia coli CFT073
aaaagagaugaauga

SEQ ID NO: 2591057 - RNA, 13 nt, Escherichia coli CFT073
aaaagauuaagaa

SEQ ID NO: 2591058 - RNA, 23 nt, Escherichia coli CFT073
aaaagcaaacugugcaaugaaaa

SEQ ID NO: 2591059 - RNA, 15 nt, Escherichia coli CFT073
aaaagcacagaaucu

SEQ ID NO: 2591060 - RNA, 21 nt, Escherichia coli CFT073
aaaagcacagaaucuaagauc

SEQ ID NO: 2591061 - RNA, 12 nt, Escherichia coli CFT073
aaaagcaccgua

SEQ ID NO: 2591062 - RNA, 23 nt, Escherichia coli CFT073
aaaagcccaucauugacagaccg

SEQ ID NO: 2591063 - RNA, 16 nt, Escherichia coli CFT073
aaaagcccuggcaguu

SEQ ID NO: 2591064 - RNA, 22 nt, Escherichia coli CFT073
aaaagccgacucacuugcaguc

SEQ ID NO: 2591065 - RNA, 22 nt, Escherichia coli CFT073
aaaagcgauauccgggcaaaaa

SEQ ID NO: 2591066 - RNA, 22 nt, Escherichia coli CFT073
aaaagcuguacaucgcgccaac

SEQ ID NO: 2591067 - RNA, 20 nt, Escherichia coli CFT073
aaaaggccuaaugucguggu

SEQ ID NO: 2591068 - RNA, 14 nt, Escherichia coli CFT073
aaaagggcagcagg

SEQ ID NO: 2591069 - RNA, 19 nt, Escherichia coli CFT073
aaaagguaaggauaaaaaa

SEQ ID NO: 2591070 - RNA, 15 nt, Escherichia coli CFT073
aaacacaucagugau

SEQ ID NO: 2591071 - RNA, 18 nt, Escherichia coli CFT073
aaacaccagaaugcccca

SEQ ID NO: 2591072 - RNA, 12 nt, Escherichia coli CFT073
aaacaccagcaa

SEQ ID NO: 2591073 - RNA, 23 nt, Escherichia coli CFT073
aaacacccaucgccguaccuuug

SEQ ID NO: 2591074 - RNA, 21 nt, Escherichia coli CFT073
aaacaccgcuguugccagcag

SEQ ID NO: 2591075 - RNA, 22 nt, Escherichia coli CFT073
aaacaccgcuguugccagcagc

SEQ ID NO: 2591076 - RNA, 23 nt, Escherichia coli CFT073
aaacaccgcuguugccagcagca

SEQ ID NO: 2591077 - RNA, 24 nt, Escherichia coli CFT073
aaacaccgcuguugccagcagcaa

SEQ ID NO: 2591078 - RNA, 15 nt, Escherichia coli CFT073
aaacacgcaaucccg

SEQ ID NO: 2591079 - RNA, 23 nt, Escherichia coli CFT073
aaacacugagguaacucucaugc

SEQ ID NO: 2591080 - RNA, 22 nt, Escherichia coli CFT073
aaacacugccucaggcaacggu

SEQ ID NO: 2591081 - RNA, 16 nt, Escherichia coli CFT073
aaacagaaaaaaaaca

SEQ ID NO: 2591082 - RNA, 12 nt, Escherichia coli CFT073
aaacagaaauac

SEQ ID NO: 2591083 - RNA, 16 nt, Escherichia coli CFT073
aaacagaauggcaucu

SEQ ID NO: 2591084 - RNA, 16 nt, Escherichia coli CFT073
aaacagccaaucauaa

SEQ ID NO: 2591085 - RNA, 14 nt, Escherichia coli CFT073
aaacagccagcagc

SEQ ID NO: 2591086 - RNA, 23 nt, Escherichia coli CFT073
aaacagccagcagcgaaucagcc

SEQ ID NO: 2591087 - RNA, 13 nt, Escherichia coli CFT073
aaacagccugcgu

SEQ ID NO: 2591088 - RNA, 22 nt, Escherichia coli CFT073
aaacagccugcguucaguugau

SEQ ID NO: 2591089 - RNA, 13 nt, Escherichia coli CFT073
aaacagcgccaga

SEQ ID NO: 2591090 - RNA, 22 nt, Escherichia coli CFT073
aaacagcgcgccagcuaccaga

SEQ ID NO: 2591091 - RNA, 18 nt, Escherichia coli CFT073
aaacagcguaaauaugcc

SEQ ID NO: 2591092 - RNA, 17 nt, Escherichia coli CFT073
aaacagcguaaugccaa

SEQ ID NO: 2591093 - RNA, 15 nt, Escherichia coli CFT073
aaacaggcggucugc

SEQ ID NO: 2591094 - RNA, 23 nt, Escherichia coli CFT073
aaacaggcuguuguucagugcau

SEQ ID NO: 2591095 - RNA, 20 nt, Escherichia coli CFT073
aaacaguaacccagcaccaa

SEQ ID NO: 2591096 - RNA, 17 nt, Escherichia coli CFT073
aaacagucgcucggcga

SEQ ID NO: 2591097 - RNA, 19 nt, Escherichia coli CFT073
aaacauacccacgaaaucu

SEQ ID NO: 2591098 - RNA, 14 nt, Escherichia coli CFT073
aaacaucaccaaug

SEQ ID NO: 2591099 - RNA, 19 nt, Escherichia coli CFT073
aaacaucaccaaugacagc

SEQ ID NO: 2591100 - RNA, 21 nt, Escherichia coli CFT073
aaacaucaccaaugacagccc

SEQ ID NO: 2591101 - RNA, 16 nt, Escherichia coli CFT073
aaacaucauaauaauu

SEQ ID NO: 2591102 - RNA, 23 nt, Escherichia coli CFT073
aaacauccccagcgucagcagca

SEQ ID NO: 2591103 - RNA, 20 nt, Escherichia coli CFT073
aaacaucggcaguaaugguu

SEQ ID NO: 2591104 - RNA, 22 nt, Escherichia coli CFT073
aaacaucggcuuauucauauca

SEQ ID NO: 2591105 - RNA, 24 nt, Escherichia coli CFT073
aaacaucgucaggaagaagcccau

SEQ ID NO: 2591106 - RNA, 14 nt, Escherichia coli CFT073
aaacaucucuuccc

SEQ ID NO: 2591107 - RNA, 12 nt, Escherichia coli CFT073
aaacaugcagcc

SEQ ID NO: 2591108 - RNA, 16 nt, Escherichia coli CFT073
aaacaugcuaaugguu

SEQ ID NO: 2591109 - RNA, 18 nt, Escherichia coli CFT073
aaacauguggauuaaauu

SEQ ID NO: 2591110 - RNA, 13 nt, Escherichia coli CFT073
aaacauugcugcc

SEQ ID NO: 2591111 - RNA, 22 nt, Escherichia coli CFT073
aaacauugguccgauuguacuu

SEQ ID NO: 2591112 - RNA, 19 nt, Escherichia coli CFT073
aaacauuuuaaacaucagg

SEQ ID NO: 2591113 - RNA, 13 nt, Escherichia coli CFT073
aaaccaaccagcg

SEQ ID NO: 2591114 - RNA, 15 nt, Escherichia coli CFT073
aaaccaagcugggca

SEQ ID NO: 2591115 - RNA, 20 nt, Escherichia coli CFT073
aaaccacauggagcuuuaaa

SEQ ID NO: 2591116 - RNA, 23 nt, Escherichia coli CFT073
aaaccacccgcggcgaucugcac

SEQ ID NO: 2591117 - RNA, 17 nt, Escherichia coli CFT073
aaaccaccgaagaucac

SEQ ID NO: 2591118 - RNA, 17 nt, Escherichia coli CFT073
aaaccagaaagggaaga

SEQ ID NO: 2591119 - RNA, 19 nt, Escherichia coli CFT073
aaaccagaaagggaagaac

SEQ ID NO: 2591120 - RNA, 12 nt, Escherichia coli CFT073
aaaccagaccua

SEQ ID NO: 2591121 - RNA, 15 nt, Escherichia coli CFT073
aaaccagagaauauu

SEQ ID NO: 2591122 - RNA, 14 nt, Escherichia coli CFT073
aaaccagccgccaa

SEQ ID NO: 2591123 - RNA, 19 nt, Escherichia coli CFT073
aaaccagcgcauggcggua

SEQ ID NO: 2591124 - RNA, 21 nt, Escherichia coli CFT073
aaaccagcgucauaaaaaucc

SEQ ID NO: 2591125 - RNA, 13 nt, Escherichia coli CFT073
aaaccaggaacag

SEQ ID NO: 2591126 - RNA, 17 nt, Escherichia coli CFT073
aaaccaggaacagugaa

SEQ ID NO: 2591127 - RNA, 22 nt, Escherichia coli CFT073
aaaccagguaucguuacgccag

SEQ ID NO: 2591128 - RNA, 23 nt, Escherichia coli CFT073
aaaccauaauauuuaaugacgaa

SEQ ID NO: 2591129 - RNA, 21 nt, Escherichia coli CFT073
aaaccauacucacaucaacaa

SEQ ID NO: 2591130 - RNA, 13 nt, Escherichia coli CFT073
aaaccauauuaaa

SEQ ID NO: 2591131 - RNA, 16 nt, Escherichia coli CFT073
aaaccauauuaaaugg

SEQ ID NO: 2591132 - RNA, 16 nt, Escherichia coli CFT073
aaaccaucaauccacu

SEQ ID NO: 2591133 - RNA, 17 nt, Escherichia coli CFT073
aaaccaucacuccccuc

SEQ ID NO: 2591134 - RNA, 14 nt, Escherichia coli CFT073
aaaccaucagcagu

SEQ ID NO: 2591135 - RNA, 13 nt, Escherichia coli CFT073
aaaccaucccugg

SEQ ID NO: 2591136 - RNA, 19 nt, Escherichia coli CFT073
aaaccauuaccaaucugcu

SEQ ID NO: 2591137 - RNA, 13 nt, Escherichia coli CFT073
aaacccagccgcg

SEQ ID NO: 2591138 - RNA, 15 nt, Escherichia coli CFT073
aaacccagccgcguc

SEQ ID NO: 2591139 - RNA, 14 nt, Escherichia coli CFT073
aaacccaggcuuaa

SEQ ID NO: 2591140 - RNA, 20 nt, Escherichia coli CFT073
aaacccgcgaugaccaaaaa

SEQ ID NO: 2591141 - RNA, 23 nt, Escherichia coli CFT073
aaacccgcgaugaccaaaaacgu

SEQ ID NO: 2591142 - RNA, 11 nt, Escherichia coli CFT073
aaacccgcuca

SEQ ID NO: 2591143 - RNA, 17 nt, Escherichia coli CFT073
aaacccgcucaucagcg

SEQ ID NO: 2591144 - RNA, 13 nt, Escherichia coli CFT073
aaacccggcauca

SEQ ID NO: 2591145 - RNA, 15 nt, Escherichia coli CFT073
aaacccucaauaauc

SEQ ID NO: 2591146 - RNA, 19 nt, Escherichia coli CFT073
aaacccugccgucugggca

SEQ ID NO: 2591147 - RNA, 19 nt, Escherichia coli CFT073
aaacccugcgccagcgcau

SEQ ID NO: 2591148 - RNA, 15 nt, Escherichia coli CFT073
aaacccuuucugcug

SEQ ID NO: 2591149 - RNA, 14 nt, Escherichia coli CFT073
aaaccgaccaauca

SEQ ID NO: 2591150 - RNA, 16 nt, Escherichia coli CFT073
aaaccgagauaaaugc

SEQ ID NO: 2591151 - RNA, 18 nt, Escherichia coli CFT073
aaaccgagauaaaugcca

SEQ ID NO: 2591152 - RNA, 20 nt, Escherichia coli CFT073
aaaccgaugccgugcggcug

SEQ ID NO: 2591153 - RNA, 22 nt, Escherichia coli CFT073
aaaccgcaucauguaaaucaau

SEQ ID NO: 2591154 - RNA, 19 nt, Escherichia coli CFT073
aaaccgccgacgcgaagca

SEQ ID NO: 2591155 - RNA, 22 nt, Escherichia coli CFT073
aaaccgccgacgcgaagcacac

SEQ ID NO: 2591156 - RNA, 18 nt, Escherichia coli CFT073
aaaccgcucucauccauu

SEQ ID NO: 2591157 - RNA, 21 nt, Escherichia coli CFT073
aaaccgguauguucagaaagc

SEQ ID NO: 2591158 - RNA, 21 nt, Escherichia coli CFT073
aaaccgguuuugguuaacuga

SEQ ID NO: 2591159 - RNA, 23 nt, Escherichia coli CFT073
aaaccguaaguaagauaaaagca

SEQ ID NO: 2591160 - RNA, 17 nt, Escherichia coli CFT073
aaaccguccccaaaaaa

SEQ ID NO: 2591161 - RNA, 18 nt, Escherichia coli CFT073
aaaccgucuucccgcagc

SEQ ID NO: 2591162 - RNA, 18 nt, Escherichia coli CFT073
aaaccguggcaaaaucca

SEQ ID NO: 2591163 - RNA, 12 nt, Escherichia coli CFT073
aaaccguuaauc

SEQ ID NO: 2591164 - RNA, 19 nt, Escherichia coli CFT073
aaaccguuaauccgcccua

SEQ ID NO: 2591165 - RNA, 23 nt, Escherichia coli CFT073
aaaccucaccucaauggcagcau

SEQ ID NO: 2591166 - RNA, 22 nt, Escherichia coli CFT073
aaaccuuaaagcgaaacagcgc

SEQ ID NO: 2591167 - RNA, 22 nt, Escherichia coli CFT073
aaaccuuagguugugaucaucc

SEQ ID NO: 2591168 - RNA, 22 nt, Escherichia coli CFT073
aaaccuucagcaucgacauuca

SEQ ID NO: 2591169 - RNA, 17 nt, Escherichia coli CFT073
aaaccuucguucacaaa

SEQ ID NO: 2591170 - RNA, 23 nt, Escherichia coli CFT073
aaaccuucguucacaaacagcgc

SEQ ID NO: 2591171 - RNA, 21 nt, Escherichia coli CFT073
aaaccuuguuggaucaugcuc

SEQ ID NO: 2591172 - RNA, 14 nt, Escherichia coli CFT073
aaaccuuguuuaau

SEQ ID NO: 2591173 - RNA, 13 nt, Escherichia coli CFT073
aaacgaaacccaa

SEQ ID NO: 2591174 - RNA, 14 nt, Escherichia coli CFT073
aaacgaaacccaaa

SEQ ID NO: 2591175 - RNA, 23 nt, Escherichia coli CFT073
aaacgaaucugcaaaucugcgcc

SEQ ID NO: 2591176 - RNA, 23 nt, Escherichia coli CFT073
aaacgacagcguguuaaugccca

SEQ ID NO: 2591177 - RNA, 22 nt, Escherichia coli CFT073
aaacuucauuugucucaaaacu

SEQ ID NO: 2591178 - RNA, 19 nt, Escherichia coli CFT073
aaacuuccggcaagauuug

SEQ ID NO: 2591179 - RNA, 18 nt, Escherichia coli CFT073
aaacuugcgugauauuac

SEQ ID NO: 2591180 - RNA, 16 nt, Escherichia coli CFT073
aaacuuucauaaacac

SEQ ID NO: 2591181 - RNA, 12 nt, Escherichia coli CFT073
aaacuuuuaaau

SEQ ID NO: 2591182 - RNA, 14 nt, Escherichia coli CFT073
aaacuuuucaccag

SEQ ID NO: 2591183 - RNA, 23 nt, Escherichia coli CFT073
aaacuuuucaccagcgucaguuc

SEQ ID NO: 2591184 - RNA, 17 nt, Escherichia coli CFT073
aaagaaaagaacuauug

SEQ ID NO: 2591185 - RNA, 13 nt, Escherichia coli CFT073
aaagaaacgccau

SEQ ID NO: 2591186 - RNA, 13 nt, Escherichia coli CFT073
aaagaaccaaugc

SEQ ID NO: 2591187 - RNA, 18 nt, Escherichia coli CFT073
aaagaacgcaccgaccau

SEQ ID NO: 2591188 - RNA, 18 nt, Escherichia coli CFT073
aaagaagaucaucaccag

SEQ ID NO: 2591189 - RNA, 17 nt, Escherichia coli CFT073
aaagaagugcucuuugc

SEQ ID NO: 2591190 - RNA, 17 nt, Escherichia coli CFT073
aaagaauauaggcaccg

SEQ ID NO: 2591191 - RNA, 13 nt, Escherichia coli CFT073
aaagaaugacacu

SEQ ID NO: 2591192 - RNA, 21 nt, Escherichia coli CFT073
aaagaaugcgcucaauauaac

SEQ ID NO: 2591193 - RNA, 12 nt, Escherichia coli CFT073
aaagaauugcag

SEQ ID NO: 2591194 - RNA, 14 nt, Escherichia coli CFT073
aaagaccagccagc

SEQ ID NO: 2591195 - RNA, 17 nt, Escherichia coli CFT073
aaagaccagccagcaau

SEQ ID NO: 2591196 - RNA, 14 nt, Escherichia coli CFT073
aaagaccauaauga

SEQ ID NO: 2591197 - RNA, 12 nt, Escherichia coli CFT073
aaagaccauuga

SEQ ID NO: 2591198 - RNA, 15 nt, Escherichia coli CFT073
aaagacgaugaaugc

SEQ ID NO: 2591199 - RNA, 22 nt, Escherichia coli CFT073
aaagacgguggcacauaauuga

SEQ ID NO: 2591200 - RNA, 15 nt, Escherichia coli CFT073
aaagacuauccgcca

SEQ ID NO: 2591201 - RNA, 17 nt, Escherichia coli CFT073
aaagacuauccgccaua

SEQ ID NO: 2591202 - RNA, 23 nt, Escherichia coli CFT073
aaagacugaauugccagcaucag

SEQ ID NO: 2591203 - RNA, 18 nt, Escherichia coli CFT073
aaagacuuugcugccuuu

SEQ ID NO: 2591204 - RNA, 16 nt, Escherichia coli CFT073
aaagagaguuacuggc

SEQ ID NO: 2591205 - RNA, 14 nt, Escherichia coli CFT073
aaagagaugaauga

SEQ ID NO: 2591206 - RNA, 21 nt, Escherichia coli CFT073
aaagaggcguugaucgcuuuc

SEQ ID NO: 2591207 - RNA, 18 nt, Escherichia coli CFT073
aaagagugcgccagucac

SEQ ID NO: 2591208 - RNA, 21 nt, Escherichia coli CFT073
aaagagugugaauauucagaa

SEQ ID NO: 2591209 - RNA, 19 nt, Escherichia coli CFT073
aaagauaaaauaaccgucu

SEQ ID NO: 2591210 - RNA, 14 nt, Escherichia coli CFT073
aaagauaaugccag

SEQ ID NO: 2591211 - RNA, 14 nt, Escherichia coli CFT073
aaagauacaaaaca

SEQ ID NO: 2591212 - RNA, 18 nt, Escherichia coli CFT073
aaagauacaaaacaugug

SEQ ID NO: 2591213 - RNA, 21 nt, Escherichia coli CFT073
aaagauacaaaacauguggau

SEQ ID NO: 2591214 - RNA, 18 nt, Escherichia coli CFT073
aaagaucuuauugccauu

SEQ ID NO: 2591215 - RNA, 12 nt, Escherichia coli CFT073
aaagaucuuugc

SEQ ID NO: 2591216 - RNA, 21 nt, Escherichia coli CFT073
aaagaugucaccauuggcauu

SEQ ID NO: 2591217 - RNA, 20 nt, Escherichia coli CFT073
aaagaugugucagcaucgca

SEQ ID NO: 2591218 - RNA, 17 nt, Escherichia coli CFT073
aaagauguuuugccuga

SEQ ID NO: 2591219 - RNA, 20 nt, Escherichia coli CFT073
aaagauguuuugccugaaaa

SEQ ID NO: 2591220 - RNA, 22 nt, Escherichia coli CFT073
aaagauguuuugccugaaaaau

SEQ ID NO: 2591221 - RNA, 23 nt, Escherichia coli CFT073
aaagauuauugcuugaucaggaa

SEQ ID NO: 2591222 - RNA, 21 nt, Escherichia coli CFT073
aaagauuguucuuuauccggc

SEQ ID NO: 2591223 - RNA, 19 nt, Escherichia coli CFT073
aaagcaaaaaagaaggaaa

SEQ ID NO: 2591224 - RNA, 13 nt, Escherichia coli CFT073
aaagcaaaaauaa

SEQ ID NO: 2591225 - RNA, 17 nt, Escherichia coli CFT073
aaagcaaauaaugucca

SEQ ID NO: 2591226 - RNA, 16 nt, Escherichia coli CFT073
aaagcaacaaccacca

SEQ ID NO: 2591227 - RNA, 12 nt, Escherichia coli CFT073
aaagcaacucca

SEQ ID NO: 2591228 - RNA, 20 nt, Escherichia coli CFT073
aaagcaacuccaucaagcua

SEQ ID NO: 2591229 - RNA, 21 nt, Escherichia coli CFT073
aaagcaagaccaacacccaca

SEQ ID NO: 2591230 - RNA, 23 nt, Escherichia coli CFT073
aaagcaagaccaacacccacagc

SEQ ID NO: 2591231 - RNA, 18 nt, Escherichia coli CFT073
aaagcaagauuaaaauau

SEQ ID NO: 2591232 - RNA, 11 nt, Escherichia coli CFT073
aaagcaauaaa

SEQ ID NO: 2591233 - RNA, 14 nt, Escherichia coli CFT073
aaagcaauuccagc

SEQ ID NO: 2591234 - RNA, 24 nt, Escherichia coli CFT073
aaagcaccugauuaguggcacacu

SEQ ID NO: 2591235 - RNA, 15 nt, Escherichia coli CFT073
aaagcagacaaccca

SEQ ID NO: 2591236 - RNA, 20 nt, Escherichia coli CFT073
aaagcagacuuuuugcggca

SEQ ID NO: 2591237 - RNA, 15 nt, Escherichia coli CFT073
aaagcagagugugaa

SEQ ID NO: 2591238 - RNA, 16 nt, Escherichia coli CFT073
aaagcagauaacccag

SEQ ID NO: 2591239 - RNA, 17 nt, Escherichia coli CFT073
aaagcagauaacccagc

SEQ ID NO: 2591240 - RNA, 15 nt, Escherichia coli CFT073
aaagcagcaagaacu

SEQ ID NO: 2591241 - RNA, 12 nt, Escherichia coli CFT073
aaagcagcgaag

SEQ ID NO: 2591242 - RNA, 16 nt, Escherichia coli CFT073
aaagcauacaaugcaa

SEQ ID NO: 2591243 - RNA, 17 nt, Escherichia coli CFT073
aaagcauacaaugcaau

SEQ ID NO: 2591244 - RNA, 18 nt, Escherichia coli CFT073
aaagcaucagacugcuuu

SEQ ID NO: 2591245 - RNA, 22 nt, Escherichia coli CFT073
aaagcaucagacugcuuuuccc

SEQ ID NO: 2591246 - RNA, 23 nt, Escherichia coli CFT073
aaagcaucagacugcuuuucccu

SEQ ID NO: 2591247 - RNA, 15 nt, Escherichia coli CFT073
aaagccaacagcagc

SEQ ID NO: 2591248 - RNA, 22 nt, Escherichia coli CFT073
aaagccaauuaacgaaaucuca

SEQ ID NO: 2591249 - RNA, 14 nt, Escherichia coli CFT073
aaagccaauuacaa

SEQ ID NO: 2591250 - RNA, 21 nt, Escherichia coli CFT073
aaagccaccaccucuuccagc

SEQ ID NO: 2591251 - RNA, 20 nt, Escherichia coli CFT073
aaagcccaccccaauguuuu

SEQ ID NO: 2591252 - RNA, 17 nt, Escherichia coli CFT073
aaagcccauaccacagc

SEQ ID NO: 2591253 - RNA, 14 nt, Escherichia coli CFT073
aaagcccaucaccg

SEQ ID NO: 2591254 - RNA, 21 nt, Escherichia coli CFT073
aaagcccaucaccgccaggcc

SEQ ID NO: 2591255 - RNA, 23 nt, Escherichia coli CFT073
aaagcccaucaccgccaggccua

SEQ ID NO: 2591256 - RNA, 20 nt, Escherichia coli CFT073
aaagcccaucguugaaaaaa

SEQ ID NO: 2591257 - RNA, 17 nt, Escherichia coli CFT073
aaagcccccacaacauu

SEQ ID NO: 2591258 - RNA, 23 nt, Escherichia coli CFT073
aaagcccccacaacauugcgccu

SEQ ID NO: 2591259 - RNA, 13 nt, Escherichia coli CFT073
aaagccccgcagc

SEQ ID NO: 2591260 - RNA, 14 nt, Escherichia coli CFT073
aaagcccgccgcca

SEQ ID NO: 2591261 - RNA, 15 nt, Escherichia coli CFT073
aaagcccgcuucaaa

SEQ ID NO: 2591262 - RNA, 14 nt, Escherichia coli CFT073
aaagcccugcucgc

SEQ ID NO: 2591263 - RNA, 12 nt, Escherichia coli CFT073
aaagccgacuca

SEQ ID NO: 2591264 - RNA, 13 nt, Escherichia coli CFT073
aaagccgcuuaau

SEQ ID NO: 2591265 - RNA, 21 nt, Escherichia coli CFT073
aaagccggaggaaacuugccu

SEQ ID NO: 2591266 - RNA, 20 nt, Escherichia coli CFT073
aaagccggaugaucauccgg

SEQ ID NO: 2591267 - RNA, 19 nt, Escherichia coli CFT073
aaagccgugccagauggca

SEQ ID NO: 2591268 - RNA, 21 nt, Escherichia coli CFT073
aaagccucaaugcugaaagca

SEQ ID NO: 2591269 - RNA, 12 nt, Escherichia coli CFT073
aaagccugauac

SEQ ID NO: 2591270 - RNA, 14 nt, Escherichia coli CFT073
aaagccugcuggca

SEQ ID NO: 2591271 - RNA, 16 nt, Escherichia coli CFT073
aaagccuguaaugccu

SEQ ID NO: 2591272 - RNA, 20 nt, Escherichia coli CFT073
aaagcgacacaaucaaaucc

SEQ ID NO: 2591273 - RNA, 18 nt, Escherichia coli CFT073
aaagcgaccaaccaucau

SEQ ID NO: 2591274 - RNA, 19 nt, Escherichia coli CFT073
aaagcgacuuugccuggcg

SEQ ID NO: 2591275 - RNA, 16 nt, Escherichia coli CFT073
aaagcgauuauagcua

SEQ ID NO: 2591276 - RNA, 23 nt, Escherichia coli CFT073
aaagcgcaaaauaccagcaauuu

SEQ ID NO: 2591277 - RNA, 12 nt, Escherichia coli CFT073
aaagcgccagcg

SEQ ID NO: 2591278 - RNA, 19 nt, Escherichia coli CFT073
aaagcgccucaagcucgca

SEQ ID NO: 2591279 - RNA, 15 nt, Escherichia coli CFT073
aaagcgcugaauauc

SEQ ID NO: 2591280 - RNA, 14 nt, Escherichia coli CFT073
aaagcguauuaugc

SEQ ID NO: 2591281 - RNA, 23 nt, Escherichia coli CFT073
aaagcgucaagauggcucucauc

SEQ ID NO: 2591282 - RNA, 16 nt, Escherichia coli CFT073
aaagcgucgcaucagg

SEQ ID NO: 2591283 - RNA, 19 nt, Escherichia coli CFT073
aaagcgucgccgccgccag

SEQ ID NO: 2591284 - RNA, 22 nt, Escherichia coli CFT073
aaagcgucgccgccgccagcgc

SEQ ID NO: 2591285 - RNA, 21 nt, Escherichia coli CFT073
aaauagacauuacgcauuuga

SEQ ID NO: 2591286 - RNA, 16 nt, Escherichia coli CFT073
aaauagaucgccagaa

SEQ ID NO: 2591287 - RNA, 15 nt, Escherichia coli CFT073
aaauagauuuucaga

SEQ ID NO: 2591288 - RNA, 20 nt, Escherichia coli CFT073
aaauagcaaaguaguaauga

SEQ ID NO: 2591289 - RNA, 17 nt, Escherichia coli CFT073
aaauagccaauucccag

SEQ ID NO: 2591290 - RNA, 16 nt, Escherichia coli CFT073
aaauagccagcagagc

SEQ ID NO: 2591291 - RNA, 23 nt, Escherichia coli CFT073
aaauagccagcagagcaaaaauc

SEQ ID NO: 2591292 - RNA, 21 nt, Escherichia coli CFT073
aaauagcccgguuuaccauca

SEQ ID NO: 2591293 - RNA, 17 nt, Escherichia coli CFT073
aaauagcgccauaaaac

SEQ ID NO: 2591294 - RNA, 18 nt, Escherichia coli CFT073
aaauagcgccauaaaacu

SEQ ID NO: 2591295 - RNA, 15 nt, Escherichia coli CFT073
aaauagcucaaugaa

SEQ ID NO: 2591296 - RNA, 23 nt, Escherichia coli CFT073
aaauaggaauccgggucuguaaa

SEQ ID NO: 2591297 - RNA, 21 nt, Escherichia coli CFT073
aaauauaaaccguccccaaaa

SEQ ID NO: 2591298 - RNA, 14 nt, Escherichia coli CFT073
aaauauacacgaaa

SEQ ID NO: 2591299 - RNA, 14 nt, Escherichia coli CFT073
aaauaucaaaaaca

SEQ ID NO: 2591300 - RNA, 23 nt, Escherichia coli CFT073
aaauaucaaaaacaaauuuugaa

SEQ ID NO: 2591301 - RNA, 13 nt, Escherichia coli CFT073
aaauaucaccaau

SEQ ID NO: 2591302 - RNA, 23 nt, Escherichia coli CFT073
aaauaucacucggggcuuuucuc

SEQ ID NO: 2591303 - RNA, 14 nt, Escherichia coli CFT073
aaauaucgagcagc

SEQ ID NO: 2591304 - RNA, 17 nt, Escherichia coli CFT073
aaauaucgauauacacc

SEQ ID NO: 2591305 - RNA, 16 nt, Escherichia coli CFT073
aaauaugaaaaugccg

SEQ ID NO: 2591306 - RNA, 15 nt, Escherichia coli CFT073
aaauaugaugaagga

SEQ ID NO: 2591307 - RNA, 19 nt, Escherichia coli CFT073
aaauaugcuuuuauucaug

SEQ ID NO: 2591308 - RNA, 21 nt, Escherichia coli CFT073
aaauaugcuuuuauucauguu

SEQ ID NO: 2591309 - RNA, 23 nt, Escherichia coli CFT073
aaauauguugcuuuaaaucgucg

SEQ ID NO: 2591310 - RNA, 11 nt, Escherichia coli CFT073
aaauauuauug

SEQ ID NO: 2591311 - RNA, 17 nt, Escherichia coli CFT073
aaauauugcuguaaagu

SEQ ID NO: 2591312 - RNA, 19 nt, Escherichia coli CFT073
aaaucaaaaucaccgauga

SEQ ID NO: 2591313 - RNA, 15 nt, Escherichia coli CFT073
aaaucaaacagaaua

SEQ ID NO: 2591314 - RNA, 13 nt, Escherichia coli CFT073
aaaucaaauacau

SEQ ID NO: 2591315 - RNA, 11 nt, Escherichia coli CFT073
aaaucaaauca

SEQ ID NO: 2591316 - RNA, 22 nt, Escherichia coli CFT073
aaaucaacauguuccugccagu

SEQ ID NO: 2591317 - RNA, 22 nt, Escherichia coli CFT073
aaaucaacgacaaaaauaccac

SEQ ID NO: 2591318 - RNA, 13 nt, Escherichia coli CFT073
aaaucaagcgccg

SEQ ID NO: 2591319 - RNA, 14 nt, Escherichia coli CFT073
aaaucaagcgccgc

SEQ ID NO: 2591320 - RNA, 14 nt, Escherichia coli CFT073
aaaucaauacauca

SEQ ID NO: 2591321 - RNA, 13 nt, Escherichia coli CFT073
aaaucaaugccac

SEQ ID NO: 2591322 - RNA, 14 nt, Escherichia coli CFT073
aaaucaccaccagc

SEQ ID NO: 2591323 - RNA, 17 nt, Escherichia coli CFT073
aaaucaccaccagcacc

SEQ ID NO: 2591324 - RNA, 21 nt, Escherichia coli CFT073
aaaucaccauauucagcagca

SEQ ID NO: 2591325 - RNA, 13 nt, Escherichia coli CFT073
aaaucaccaucac

SEQ ID NO: 2591326 - RNA, 17 nt, Escherichia coli CFT073
aaaucaccgccaccagc

SEQ ID NO: 2591327 - RNA, 18 nt, Escherichia coli CFT073
aaaucaccgccaccagcg

SEQ ID NO: 2591328 - RNA, 14 nt, Escherichia coli CFT073
aaaucacgauggcg

SEQ ID NO: 2591329 - RNA, 20 nt, Escherichia coli CFT073
aaaucacgcgccugccaggc

SEQ ID NO: 2591330 - RNA, 16 nt, Escherichia coli CFT073
aaaucacuaaacccga

SEQ ID NO: 2591331 - RNA, 22 nt, Escherichia coli CFT073
aaaucacuaaacccgaccacuu

SEQ ID NO: 2591332 - RNA, 22 nt, Escherichia coli CFT073
aaaucacuauuaaagaaaguaa

SEQ ID NO: 2591333 - RNA, 20 nt, Escherichia coli CFT073
aaaucacucgccgcugcgga

SEQ ID NO: 2591334 - RNA, 19 nt, Escherichia coli CFT073
aaaucagcaucaacccgcu

SEQ ID NO: 2591335 - RNA, 22 nt, Escherichia coli CFT073
aaaucagcaucaacccgcucau

SEQ ID NO: 2591336 - RNA, 16 nt, Escherichia coli CFT073
aaaucagccauaauaa

SEQ ID NO: 2591337 - RNA, 18 nt, Escherichia coli CFT073
aaaucagccguuucacca

SEQ ID NO: 2591338 - RNA, 16 nt, Escherichia coli CFT073
aaaucagccuuaaucu

SEQ ID NO: 2591339 - RNA, 18 nt, Escherichia coli CFT073
aaaucaguugauuaugau

SEQ ID NO: 2591340 - RNA, 22 nt, Escherichia coli CFT073
aaaucaguugccgaauaccgua

SEQ ID NO: 2591341 - RNA, 11 nt, Escherichia coli CFT073
aaaucaucacu

SEQ ID NO: 2591342 - RNA, 21 nt, Escherichia coli CFT073
aaaucaucaguaccaguccua

SEQ ID NO: 2591343 - RNA, 22 nt, Escherichia coli CFT073
aaaucaucauugcuguuuuaca

SEQ ID NO: 2591344 - RNA, 12 nt, Escherichia coli CFT073
aaaucauccagc

SEQ ID NO: 2591345 - RNA, 14 nt, Escherichia coli CFT073
aaaucauccagcac

SEQ ID NO: 2591346 - RNA, 20 nt, Escherichia coli CFT073
aaaucaucggcaucuucuuc

SEQ ID NO: 2591347 - RNA, 21 nt, Escherichia coli CFT073
aaaucaucggcaucuucuucu

SEQ ID NO: 2591348 - RNA, 22 nt, Escherichia coli CFT073
aaaucaugaauuuugaaggaaa

SEQ ID NO: 2591349 - RNA, 16 nt, Escherichia coli CFT073
aaaucaugcaaauuca

SEQ ID NO: 2591350 - RNA, 13 nt, Escherichia coli CFT073
aaaucauuuaucu

SEQ ID NO: 2591351 - RNA, 20 nt, Escherichia coli CFT073
aaauccaaccucuucuuuua

SEQ ID NO: 2591352 - RNA, 24 nt, Escherichia coli CFT073
aaauccagaaaaaaagcaucugcu

SEQ ID NO: 2591353 - RNA, 14 nt, Escherichia coli CFT073
aaauccagccagcg

SEQ ID NO: 2591354 - RNA, 21 nt, Escherichia coli CFT073
aaauccagccagcgccgcgcg

SEQ ID NO: 2591355 - RNA, 23 nt, Escherichia coli CFT073
aaaucccacauccgaccaaagaa

SEQ ID NO: 2591356 - RNA, 14 nt, Escherichia coli CFT073
aaaucccgcugaau

SEQ ID NO: 2591357 - RNA, 20 nt, Escherichia coli CFT073
aaaucccugccgccaucacc

SEQ ID NO: 2591358 - RNA, 20 nt, Escherichia coli CFT073
aaaucccuuaggucggauaa

SEQ ID NO: 2591359 - RNA, 18 nt, Escherichia coli CFT073
aaauccgccgccacuuga

SEQ ID NO: 2591360 - RNA, 22 nt, Escherichia coli CFT073
aaauccucuuuuaccaucagcg

SEQ ID NO: 2591361 - RNA, 20 nt, Escherichia coli CFT073
aaauccugccaacgcaccgu

SEQ ID NO: 2591362 - RNA, 22 nt, Escherichia coli CFT073
aaauccuucagcaauuuguuca

SEQ ID NO: 2591363 - RNA, 16 nt, Escherichia coli CFT073
aaaucgaacagguugg

SEQ ID NO: 2591364 - RNA, 12 nt, Escherichia coli CFT073
aaaucgacaucu

SEQ ID NO: 2591365 - RNA, 21 nt, Escherichia coli CFT073
aaaucgagaagacaauccccg

SEQ ID NO: 2591366 - RNA, 15 nt, Escherichia coli CFT073
aaaucgcaauaucau

SEQ ID NO: 2591367 - RNA, 19 nt, Escherichia coli CFT073
aaaucgcacguugccagca

SEQ ID NO: 2591368 - RNA, 12 nt, Escherichia coli CFT073
aaaucgccauuc

SEQ ID NO: 2591369 - RNA, 23 nt, Escherichia coli CFT073
aaaucgcccgucaguucauccau

SEQ ID NO: 2591370 - RNA, 18 nt, Escherichia coli CFT073
aaaucgccggaugcggca

SEQ ID NO: 2591371 - RNA, 22 nt, Escherichia coli CFT073
aaaucgccggaugcggcaggcg

SEQ ID NO: 2591372 - RNA, 13 nt, Escherichia coli CFT073
aaaucgccgggau

SEQ ID NO: 2591373 - RNA, 21 nt, Escherichia coli CFT073
aaaucgccgggauauauguca

SEQ ID NO: 2591374 - RNA, 22 nt, Escherichia coli CFT073
aaaucggacuggguccgguggc

SEQ ID NO: 2591375 - RNA, 18 nt, Escherichia coli CFT073
aaaucggcaccgccgcca

SEQ ID NO: 2591376 - RNA, 17 nt, Escherichia coli CFT073
aaaucggggaucauuaa

SEQ ID NO: 2591377 - RNA, 23 nt, Escherichia coli CFT073
aaaucgggugaaguuuugucgcu

SEQ ID NO: 2591378 - RNA, 14 nt, Escherichia coli CFT073
aaaucgguuuguaa

SEQ ID NO: 2591379 - RNA, 17 nt, Escherichia coli CFT073
aaaucgucgagggauuu

SEQ ID NO: 2591380 - RNA, 15 nt, Escherichia coli CFT073
aaaucguuaaaacgu

SEQ ID NO: 2591381 - RNA, 17 nt, Escherichia coli CFT073
aaaucguuugcauccag

SEQ ID NO: 2591382 - RNA, 22 nt, Escherichia coli CFT073
aaaucucacccgguacaucaau

SEQ ID NO: 2591383 - RNA, 19 nt, Escherichia coli CFT073
aaaucucacuacaacaacc

SEQ ID NO: 2591384 - RNA, 12 nt, Escherichia coli CFT073
aaaucuccagau

SEQ ID NO: 2591385 - RNA, 13 nt, Escherichia coli CFT073
aaaucuccauuuc

SEQ ID NO: 2591386 - RNA, 22 nt, Escherichia coli CFT073
aaaucucuugcuggcauuacaa

SEQ ID NO: 2591387 - RNA, 18 nt, Escherichia coli CFT073
aaaucugauuaauauuga

SEQ ID NO: 2591388 - RNA, 18 nt, Escherichia coli CFT073
aaaucugccgauuucaac

SEQ ID NO: 2591389 - RNA, 13 nt, Escherichia coli CFT073
aaaucugccguca

SEQ ID NO: 2591390 - RNA, 18 nt, Escherichia coli CFT073
aaaucugcgccuacggca

SEQ ID NO: 2591391 - RNA, 20 nt, Escherichia coli CFT073
aaaucugcgggaacauaugc

SEQ ID NO: 2591392 - RNA, 17 nt, Escherichia coli CFT073
aaaucuguugaaauuau

SEQ ID NO: 2591393 - RNA, 14 nt, Escherichia coli CFT073
aacaaacgcauaaa

SEQ ID NO: 2591394 - RNA, 21 nt, Escherichia coli CFT073
aacaaacggcgguaaaaggga

SEQ ID NO: 2591395 - RNA, 20 nt, Escherichia coli CFT073
aacaaacuccccgcaaacca

SEQ ID NO: 2591396 - RNA, 21 nt, Escherichia coli CFT073
aacaaacuuaugcugcgccag

SEQ ID NO: 2591397 - RNA, 15 nt, Escherichia coli CFT073
aacaaagaaauguuc

SEQ ID NO: 2591398 - RNA, 18 nt, Escherichia coli CFT073
aacaaagaaugccauaaa

SEQ ID NO: 2591399 - RNA, 18 nt, Escherichia coli CFT073
aacaaagcucacuuuguc

SEQ ID NO: 2591400 - RNA, 21 nt, Escherichia coli CFT073
aacaaagugcgcguuguucau

SEQ ID NO: 2591401 - RNA, 22 nt, Escherichia coli CFT073
aacaaagugcgcguuguucaug

SEQ ID NO: 2591402 - RNA, 10 nt, Escherichia coli CFT073
aacaaauaaa

SEQ ID NO: 2591403 - RNA, 20 nt, Escherichia coli CFT073
aacaaauaguacacagacga

SEQ ID NO: 2591404 - RNA, 12 nt, Escherichia coli CFT073
aacaaauuuuga

SEQ ID NO: 2591405 - RNA, 20 nt, Escherichia coli CFT073
aacaaccaagacuauuaaua

SEQ ID NO: 2591406 - RNA, 15 nt, Escherichia coli CFT073
aacaaccauccccaa

SEQ ID NO: 2591407 - RNA, 13 nt, Escherichia coli CFT073
aacaaccgccaug

SEQ ID NO: 2591408 - RNA, 24 nt, Escherichia coli CFT073
aacaaccggagucaggguugacuu

SEQ ID NO: 2591409 - RNA, 20 nt, Escherichia coli CFT073
aacaaccugcauuugcgcag

SEQ ID NO: 2591410 - RNA, 17 nt, Escherichia coli CFT073
aacaacggacuaaacgu

SEQ ID NO: 2591411 - RNA, 15 nt, Escherichia coli CFT073
aacaacggcacuuca

SEQ ID NO: 2591412 - RNA, 17 nt, Escherichia coli CFT073
aacaacugcgcacgagu

SEQ ID NO: 2591413 - RNA, 23 nt, Escherichia coli CFT073
aacaacuuucgggcgcaaaaaca

SEQ ID NO: 2591414 - RNA, 15 nt, Escherichia coli CFT073
aacaagacaucacuc

SEQ ID NO: 2591415 - RNA, 21 nt, Escherichia coli CFT073
aacaagaugugguuagcugga

SEQ ID NO: 2591416 - RNA, 14 nt, Escherichia coli CFT073
aacaagauuagcca

SEQ ID NO: 2591417 - RNA, 14 nt, Escherichia coli CFT073
aacaagcagcugcc

SEQ ID NO: 2591418 - RNA, 19 nt, Escherichia coli CFT073
aacaagccaaauccagcac

SEQ ID NO: 2591419 - RNA, 19 nt, Escherichia coli CFT073
aacaagccacgcaccaucc

SEQ ID NO: 2591420 - RNA, 19 nt, Escherichia coli CFT073
aacaaggcgggagaaaugc

SEQ ID NO: 2591421 - RNA, 23 nt, Escherichia coli CFT073
aacaaggguaugcuguaaacaac

SEQ ID NO: 2591422 - RNA, 13 nt, Escherichia coli CFT073
aacaauaacaauu

SEQ ID NO: 2591423 - RNA, 14 nt, Escherichia coli CFT073
aacaauacaaaaua

SEQ ID NO: 2591424 - RNA, 21 nt, Escherichia coli CFT073
aacaauaucgccagcuugcag

SEQ ID NO: 2591425 - RNA, 19 nt, Escherichia coli CFT073
aacaaucaccaaaccaaca

SEQ ID NO: 2591426 - RNA, 22 nt, Escherichia coli CFT073
aacaaucaccaaaccaacaagc

SEQ ID NO: 2591427 - RNA, 23 nt, Escherichia coli CFT073
aacaaucaccaaaccaacaagca

SEQ ID NO: 2591428 - RNA, 15 nt, Escherichia coli CFT073
aacaauccaaaugcc

SEQ ID NO: 2591429 - RNA, 18 nt, Escherichia coli CFT073
aacaauccucccuuaccc

SEQ ID NO: 2591430 - RNA, 20 nt, Escherichia coli CFT073
aacaauccucccuuacccuu

SEQ ID NO: 2591431 - RNA, 17 nt, Escherichia coli CFT073
aacaaucgcucacaaca

SEQ ID NO: 2591432 - RNA, 23 nt, Escherichia coli CFT073
aacaaugucuucacaaccgccau

SEQ ID NO: 2591433 - RNA, 16 nt, Escherichia coli CFT073
aacaauugaagaauau

SEQ ID NO: 2591434 - RNA, 22 nt, Escherichia coli CFT073
aacaauuuccgcagcuccagcc

SEQ ID NO: 2591435 - RNA, 22 nt, Escherichia coli CFT073
aacacaagccaaucugcuggaa

SEQ ID NO: 2591436 - RNA, 23 nt, Escherichia coli CFT073
aacacaauuuguggcccuugcgc

SEQ ID NO: 2591437 - RNA, 21 nt, Escherichia coli CFT073
aacacacaauuaccuuccaca

SEQ ID NO: 2591438 - RNA, 11 nt, Escherichia coli CFT073
aacacaccaca

SEQ ID NO: 2591439 - RNA, 13 nt, Escherichia coli CFT073
aacacaccacagc

SEQ ID NO: 2591440 - RNA, 15 nt, Escherichia coli CFT073
aacacaccacagcac

SEQ ID NO: 2591441 - RNA, 20 nt, Escherichia coli CFT073
aacacaccguaauugccaga

SEQ ID NO: 2591442 - RNA, 20 nt, Escherichia coli CFT073
aacacacguaggccggauaa

SEQ ID NO: 2591443 - RNA, 14 nt, Escherichia coli CFT073
aacacagcaauaau

SEQ ID NO: 2591444 - RNA, 17 nt, Escherichia coli CFT073
aacacaggauacgcaua

SEQ ID NO: 2591445 - RNA, 15 nt, Escherichia coli CFT073
aacacaggcagaaca

SEQ ID NO: 2591446 - RNA, 20 nt, Escherichia coli CFT073
aacacaguacgaugauugcc

SEQ ID NO: 2591447 - RNA, 22 nt, Escherichia coli CFT073
aacacaguuguaauaagagguu

SEQ ID NO: 2591448 - RNA, 19 nt, Escherichia coli CFT073
aacacaucagugauacauc

SEQ ID NO: 2591449 - RNA, 17 nt, Escherichia coli CFT073
aacacauuuaucaagau

SEQ ID NO: 2591450 - RNA, 14 nt, Escherichia coli CFT073
aacaccaccagcgc

SEQ ID NO: 2591451 - RNA, 15 nt, Escherichia coli CFT073
aacaccaccagcgcc

SEQ ID NO: 2591452 - RNA, 18 nt, Escherichia coli CFT073
aacaccacgccagccgcc

SEQ ID NO: 2591453 - RNA, 13 nt, Escherichia coli CFT073
aacaccacgcgcc

SEQ ID NO: 2591454 - RNA, 15 nt, Escherichia coli CFT073
aacaccacucuugcc

SEQ ID NO: 2591455 - RNA, 21 nt, Escherichia coli CFT073
aacaccagaaccagcaaccac

SEQ ID NO: 2591456 - RNA, 15 nt, Escherichia coli CFT073
aacaccagcaauaau

SEQ ID NO: 2591457 - RNA, 13 nt, Escherichia coli CFT073
aacaccagcagca

SEQ ID NO: 2591458 - RNA, 16 nt, Escherichia coli CFT073
aacaccagcagcagcg

SEQ ID NO: 2591459 - RNA, 18 nt, Escherichia coli CFT073
aacaccaggcuaaauugc

SEQ ID NO: 2591460 - RNA, 16 nt, Escherichia coli CFT073
aacaccaguucaccac

SEQ ID NO: 2591461 - RNA, 12 nt, Escherichia coli CFT073
aacaccauaaug

SEQ ID NO: 2591462 - RNA, 18 nt, Escherichia coli CFT073
aacaccaugggcauccac

SEQ ID NO: 2591463 - RNA, 15 nt, Escherichia coli CFT073
aacacccaucgccgu

SEQ ID NO: 2591464 - RNA, 16 nt, Escherichia coli CFT073
aacacccaucgccgua

SEQ ID NO: 2591465 - RNA, 21 nt, Escherichia coli CFT073
aacaccgagucgccuuuuucc

SEQ ID NO: 2591466 - RNA, 18 nt, Escherichia coli CFT073
aacaccgcuucaacagcg

SEQ ID NO: 2591467 - RNA, 19 nt, Escherichia coli CFT073
aacaccggugaccaucagc

SEQ ID NO: 2591468 - RNA, 21 nt, Escherichia coli CFT073
aacaccguaagaaaggcggga

SEQ ID NO: 2591469 - RNA, 15 nt, Escherichia coli CFT073
aacaccguaccauca

SEQ ID NO: 2591470 - RNA, 14 nt, Escherichia coli CFT073
aacaccgugacaaa

SEQ ID NO: 2591471 - RNA, 19 nt, Escherichia coli CFT073
aacaccgugaucgacccau

SEQ ID NO: 2591472 - RNA, 15 nt, Escherichia coli CFT073
aacaccuaccggcug

SEQ ID NO: 2591473 - RNA, 14 nt, Escherichia coli CFT073
aacaccucagccag

SEQ ID NO: 2591474 - RNA, 17 nt, Escherichia coli CFT073
aacaccucauccgaugg

SEQ ID NO: 2591475 - RNA, 18 nt, Escherichia coli CFT073
aacaccugggcaauggug

SEQ ID NO: 2591476 - RNA, 13 nt, Escherichia coli CFT073
aacaccugucuuc

SEQ ID NO: 2591477 - RNA, 22 nt, Escherichia coli CFT073
aacaccuuaaccucaggaaauu

SEQ ID NO: 2591478 - RNA, 20 nt, Escherichia coli CFT073
aacaccuuauccggccuacg

SEQ ID NO: 2591479 - RNA, 15 nt, Escherichia coli CFT073
aacaccuucguccag

SEQ ID NO: 2591480 - RNA, 16 nt, Escherichia coli CFT073
aacaccuucguccagc

SEQ ID NO: 2591481 - RNA, 19 nt, Escherichia coli CFT073
aacaccuucguccagcauc

SEQ ID NO: 2591482 - RNA, 15 nt, Escherichia coli CFT073
aacacgaauaccaag

SEQ ID NO: 2591483 - RNA, 17 nt, Escherichia coli CFT073
aacacgaauaccaagca

SEQ ID NO: 2591484 - RNA, 23 nt, Escherichia coli CFT073
aacacgaaucaggcggcucaccu

SEQ ID NO: 2591485 - RNA, 19 nt, Escherichia coli CFT073
aacacgaucuucugccaau

SEQ ID NO: 2591486 - RNA, 24 nt, Escherichia coli CFT073
aacacgauucguauaauuuauuag

SEQ ID NO: 2591487 - RNA, 17 nt, Escherichia coli CFT073
aacacgcaacaccagca

SEQ ID NO: 2591488 - RNA, 16 nt, Escherichia coli CFT073
aacacgccagcguuau

SEQ ID NO: 2591489 - RNA, 12 nt, Escherichia coli CFT073
aacacgccgccg

SEQ ID NO: 2591490 - RNA, 23 nt, Escherichia coli CFT073
aacacggcuuucugcaaccagaa

SEQ ID NO: 2591491 - RNA, 14 nt, Escherichia coli CFT073
aacacguugcaacu

SEQ ID NO: 2591492 - RNA, 15 nt, Escherichia coli CFT073
aacacguugcaacug

SEQ ID NO: 2591493 - RNA, 15 nt, Escherichia coli CFT073
aacacucacauccag

SEQ ID NO: 2591494 - RNA, 23 nt, Escherichia coli CFT073
aacacucguccagucgccugcuu

SEQ ID NO: 2591495 - RNA, 23 nt, Escherichia coli CFT073
aacacucuuuuugacguuuuuac

SEQ ID NO: 2591496 - RNA, 21 nt, Escherichia coli CFT073
aacacugagguaacucucaug

SEQ ID NO: 2591497 - RNA, 15 nt, Escherichia coli CFT073
aacacugccucaggc

SEQ ID NO: 2591498 - RNA, 21 nt, Escherichia coli CFT073
aacacugcgcucuucuggcac

SEQ ID NO: 2591499 - RNA, 14 nt, Escherichia coli CFT073
aacacugcuuuuaa

SEQ ID NO: 2591500 - RNA, 20 nt, Escherichia coli CFT073
aacacuguuaccgcugcugg

SEQ ID NO: 2591501 - RNA, 21 nt, Escherichia coli CFT073
aacaucacugcaaauacccaa

SEQ ID NO: 2591502 - RNA, 12 nt, Escherichia coli CFT073
aacaucauaaua

SEQ ID NO: 2591503 - RNA, 14 nt, Escherichia coli CFT073
aacaucaucacgca

SEQ ID NO: 2591504 - RNA, 14 nt, Escherichia coli CFT073
aacaucauccccau

SEQ ID NO: 2591505 - RNA, 20 nt, Escherichia coli CFT073
aacaucaugccggccagcgc

SEQ ID NO: 2591506 - RNA, 14 nt, Escherichia coli CFT073
aacauccagcucgc

SEQ ID NO: 2591507 - RNA, 13 nt, Escherichia coli CFT073
aacauccaucagc

SEQ ID NO: 2591508 - RNA, 11 nt, Escherichia coli CFT073
aacauccccac

SEQ ID NO: 2591509 - RNA, 22 nt, Escherichia coli CFT073
aacauccccagcgucagcagca

SEQ ID NO: 2591510 - RNA, 23 nt, Escherichia coli CFT073
aacauccccagcgucagcagcaa

SEQ ID NO: 2591511 - RNA, 17 nt, Escherichia coli CFT073
aacauccggcaaauuaa

SEQ ID NO: 2591512 - RNA, 14 nt, Escherichia coli CFT073
aacauccggcucca

SEQ ID NO: 2591513 - RNA, 18 nt, Escherichia coli CFT073
aacauccgguuucaucag

SEQ ID NO: 2591514 - RNA, 19 nt, Escherichia coli CFT073
aacauccuuuccuuaagcc

SEQ ID NO: 2591515 - RNA, 19 nt, Escherichia coli CFT073
aacauccuuuucaccuuca

SEQ ID NO: 2591516 - RNA, 16 nt, Escherichia coli CFT073
aacaucgcaaaauaca

SEQ ID NO: 2591517 - RNA, 21 nt, Escherichia coli CFT073
aacaucgccauuuucugccgc

SEQ ID NO: 2591518 - RNA, 21 nt, Escherichia coli CFT073
aacaucggcccgugucccagg

SEQ ID NO: 2591519 - RNA, 20 nt, Escherichia coli CFT073
aacaugacaccaagcaccau

SEQ ID NO: 2591520 - RNA, 22 nt, Escherichia coli CFT073
aacaugacgcgcaucacgacaa

SEQ ID NO: 2591521 - RNA, 19 nt, Escherichia coli CFT073
aacaugagaacaguucagc

SEQ ID NO: 2591522 - RNA, 16 nt, Escherichia coli CFT073
aacaugcgcagaagca

SEQ ID NO: 2591523 - RNA, 18 nt, Escherichia coli CFT073
aacaugcgcagaagcaua

SEQ ID NO: 2591524 - RNA, 20 nt, Escherichia coli CFT073
aacauggagaguuuucauga

SEQ ID NO: 2591525 - RNA, 23 nt, Escherichia coli CFT073
aacauggcgcggcacaccagcca

SEQ ID NO: 2591526 - RNA, 14 nt, Escherichia coli CFT073
aacauggucaucau

SEQ ID NO: 2591527 - RNA, 21 nt, Escherichia coli CFT073
aacauuaagaggcauuuuuug

SEQ ID NO: 2591528 - RNA, 17 nt, Escherichia coli CFT073
aacauuacuaaacauuu

SEQ ID NO: 2591529 - RNA, 21 nt, Escherichia coli CFT073
aacauuacuaauuaauaauau

SEQ ID NO: 2591530 - RNA, 13 nt, Escherichia coli CFT073
aacauuagcgcau

SEQ ID NO: 2591531 - RNA, 14 nt, Escherichia coli CFT073
aacauuaugucugu

SEQ ID NO: 2591532 - RNA, 12 nt, Escherichia coli CFT073
aacauucaucau

SEQ ID NO: 2591533 - RNA, 15 nt, Escherichia coli CFT073
aacauucaucauuuc

SEQ ID NO: 2591534 - RNA, 18 nt, Escherichia coli CFT073
aacauucggcaaugguuu

SEQ ID NO: 2591535 - RNA, 14 nt, Escherichia coli CFT073
aacauugauaagca

SEQ ID NO: 2591536 - RNA, 19 nt, Escherichia coli CFT073
aacauugauuucuuauuca

SEQ ID NO: 2591537 - RNA, 22 nt, Escherichia coli CFT073
aacauugccggaagcgccacca

SEQ ID NO: 2591538 - RNA, 16 nt, Escherichia coli CFT073
aacauugcugcugaag

SEQ ID NO: 2591539 - RNA, 19 nt, Escherichia coli CFT073
aacauugcugcugaagcaa

SEQ ID NO: 2591540 - RNA, 22 nt, Escherichia coli CFT073
aacauuggcucaucaaacaacg

SEQ ID NO: 2591541 - RNA, 16 nt, Escherichia coli CFT073
aacauuuuaaacauca

SEQ ID NO: 2591542 - RNA, 21 nt, Escherichia coli CFT073
aacauuuuaguuuacauuaau

SEQ ID NO: 2591543 - RNA, 14 nt, Escherichia coli CFT073
aaccaaacagucac

SEQ ID NO: 2591544 - RNA, 14 nt, Escherichia coli CFT073
aaccaaaccagccg

SEQ ID NO: 2591545 - RNA, 20 nt, Escherichia coli CFT073
aaccaaacguggucgccagc

SEQ ID NO: 2591546 - RNA, 19 nt, Escherichia coli CFT073
aaccaaccagucacgguua

SEQ ID NO: 2591547 - RNA, 14 nt, Escherichia coli CFT073
aaccaaccgcaaua

SEQ ID NO: 2591548 - RNA, 22 nt, Escherichia coli CFT073
aaccaaccgcaauaaccaucag

SEQ ID NO: 2591549 - RNA, 23 nt, Escherichia coli CFT073
aaccaaccgcaauaaccaucagc

SEQ ID NO: 2591550 - RNA, 20 nt, Escherichia coli CFT073
aaccaacgcuagcagcagcg

SEQ ID NO: 2591551 - RNA, 20 nt, Escherichia coli CFT073
aaccaauaaagaacccggca

SEQ ID NO: 2591552 - RNA, 18 nt, Escherichia coli CFT073
aaccaauaaguaagcauu

SEQ ID NO: 2591553 - RNA, 13 nt, Escherichia coli CFT073
aaccaaucuccca

SEQ ID NO: 2591554 - RNA, 20 nt, Escherichia coli CFT073
aaccaauuucugugcagcca

SEQ ID NO: 2591555 - RNA, 18 nt, Escherichia coli CFT073
aaccacaaccacuuugua

SEQ ID NO: 2591556 - RNA, 17 nt, Escherichia coli CFT073
aaccacacccacaucaa

SEQ ID NO: 2591557 - RNA, 14 nt, Escherichia coli CFT073
aaccacaggcuggc

SEQ ID NO: 2591558 - RNA, 13 nt, Escherichia coli CFT073
aaccacaguucaa

SEQ ID NO: 2591559 - RNA, 13 nt, Escherichia coli CFT073
aaccacaucaauc

SEQ ID NO: 2591560 - RNA, 23 nt, Escherichia coli CFT073
aaccaccacaccugccaccagca

SEQ ID NO: 2591561 - RNA, 21 nt, Escherichia coli CFT073
aaccaccccacuuuacccgug

SEQ ID NO: 2591562 - RNA, 15 nt, Escherichia coli CFT073
aaccaccgaagauca

SEQ ID NO: 2591563 - RNA, 17 nt, Escherichia coli CFT073
aaccaccggaaugguca

SEQ ID NO: 2591564 - RNA, 15 nt, Escherichia coli CFT073
aaccaccuccacgcc

SEQ ID NO: 2591565 - RNA, 16 nt, Escherichia coli CFT073
aaccacgcaaaggcgu

SEQ ID NO: 2591566 - RNA, 23 nt, Escherichia coli CFT073
aaccacgccuaaaauccacaucg

SEQ ID NO: 2591567 - RNA, 23 nt, Escherichia coli CFT073
aaccacggaguugaccagcucca

SEQ ID NO: 2591568 - RNA, 22 nt, Escherichia coli CFT073
aaccacuaauuccugcaaacag

SEQ ID NO: 2591569 - RNA, 22 nt, Escherichia coli CFT073
aaccacugauggaauuucauca

SEQ ID NO: 2591570 - RNA, 15 nt, Escherichia coli CFT073
aaccacugcucugac

SEQ ID NO: 2591571 - RNA, 12 nt, Escherichia coli CFT073
aaccacugugag

SEQ ID NO: 2591572 - RNA, 21 nt, Escherichia coli CFT073
aaccacuugcagcucauauuc

SEQ ID NO: 2591573 - RNA, 23 nt, Escherichia coli CFT073
aaccagaaauagaccggagaaaa

SEQ ID NO: 2591574 - RNA, 15 nt, Escherichia coli CFT073
aaccagaauuuccag

SEQ ID NO: 2591575 - RNA, 19 nt, Escherichia coli CFT073
aaccagacgauuuucccug

SEQ ID NO: 2591576 - RNA, 17 nt, Escherichia coli CFT073
aaccagagacagaccaa

SEQ ID NO: 2591577 - RNA, 19 nt, Escherichia coli CFT073
aaccagaucugacgauuau

SEQ ID NO: 2591578 - RNA, 17 nt, Escherichia coli CFT073
aaccagauucggcgcaa

SEQ ID NO: 2591579 - RNA, 12 nt, Escherichia coli CFT073
aaccagcaccag

SEQ ID NO: 2591580 - RNA, 20 nt, Escherichia coli CFT073
aaccagcaccggcaaauugg

SEQ ID NO: 2591581 - RNA, 15 nt, Escherichia coli CFT073
aaccagcagcaucac

SEQ ID NO: 2591582 - RNA, 18 nt, Escherichia coli CFT073
aaccagccaaauaaaauc

SEQ ID NO: 2591583 - RNA, 17 nt, Escherichia coli CFT073
aaccagccacgggaaau

SEQ ID NO: 2591584 - RNA, 13 nt, Escherichia coli CFT073
aaccagccgccaa

SEQ ID NO: 2591585 - RNA, 17 nt, Escherichia coli CFT073
aaccagccguuauguug

SEQ ID NO: 2591586 - RNA, 20 nt, Escherichia coli CFT073
aaccagccguuauguugauu

SEQ ID NO: 2591587 - RNA, 13 nt, Escherichia coli CFT073
aaccagcgagaag

SEQ ID NO: 2591588 - RNA, 18 nt, Escherichia coli CFT073
aaccagcgcagacaccag

SEQ ID NO: 2591589 - RNA, 12 nt, Escherichia coli CFT073
aaccagcgccgg

SEQ ID NO: 2591590 - RNA, 19 nt, Escherichia coli CFT073
aaccagcggcgcauccgcc

SEQ ID NO: 2591591 - RNA, 18 nt, Escherichia coli CFT073
aaccagcgucgcaucagg

SEQ ID NO: 2591592 - RNA, 21 nt, Escherichia coli CFT073
aaccagcguuuccagcaccag

SEQ ID NO: 2591593 - RNA, 22 nt, Escherichia coli CFT073
aaccagcguuuccagcaccagu

SEQ ID NO: 2591594 - RNA, 11 nt, Escherichia coli CFT073
aaccagcuaau

SEQ ID NO: 2591595 - RNA, 21 nt, Escherichia coli CFT073
aaccagcugaccgguugcugg

SEQ ID NO: 2591596 - RNA, 11 nt, Escherichia coli CFT073
aaccaggaaca

SEQ ID NO: 2591597 - RNA, 12 nt, Escherichia coli CFT073
aaccaggaacag

SEQ ID NO: 2591598 - RNA, 16 nt, Escherichia coli CFT073
aaccaggaugauauuc

SEQ ID NO: 2591599 - RNA, 19 nt, Escherichia coli CFT073
aaccagggaaaaaagcccc

SEQ ID NO: 2591600 - RNA, 21 nt, Escherichia coli CFT073
aaccaggucaaugcaacccca

SEQ ID NO: 2591601 - RNA, 19 nt, Escherichia coli CFT073
aaccagugaauacugcgcg

SEQ ID NO: 2591602 - RNA, 19 nt, Escherichia coli CFT073
aaccagugacggaacucuu

SEQ ID NO: 2591603 - RNA, 23 nt, Escherichia coli CFT073
aaccagugcuccaccuugcggaa

SEQ ID NO: 2591604 - RNA, 20 nt, Escherichia coli CFT073
aaccaguugugcaccaccaa

SEQ ID NO: 2591605 - RNA, 17 nt, Escherichia coli CFT073
aaccaguuuaugccugu

SEQ ID NO: 2591606 - RNA, 21 nt, Escherichia coli CFT073
aaccauaauuugugauuuguc

SEQ ID NO: 2591607 - RNA, 21 nt, Escherichia coli CFT073
aaccaucaccaguuguugcgu

SEQ ID NO: 2591608 - RNA, 14 nt, Escherichia coli CFT073
aaccaucagcagua

SEQ ID NO: 2591609 - RNA, 21 nt, Escherichia coli CFT073
aaccuucauccaucggcgcuu

SEQ ID NO: 2591610 - RNA, 23 nt, Escherichia coli CFT073
aaccuucauccaucggcgcuuca

SEQ ID NO: 2591611 - RNA, 22 nt, Escherichia coli CFT073
aaccuucguuagcuaauuuguu

SEQ ID NO: 2591612 - RNA, 19 nt, Escherichia coli CFT073
aaccuucguucacaaacag

SEQ ID NO: 2591613 - RNA, 13 nt, Escherichia coli CFT073
aaccuuguuggau

SEQ ID NO: 2591614 - RNA, 22 nt, Escherichia coli CFT073
aaccuuugaacagccagaauga

SEQ ID NO: 2591615 - RNA, 23 nt, Escherichia coli CFT073
aaccuuuucccgauauaaccauc

SEQ ID NO: 2591616 - RNA, 14 nt, Escherichia coli CFT073
aacgaaagauuuaa

SEQ ID NO: 2591617 - RNA, 20 nt, Escherichia coli CFT073
aacgaaaguuaauccacagc

SEQ ID NO: 2591618 - RNA, 20 nt, Escherichia coli CFT073
aacgaaauagccaggcagau

SEQ ID NO: 2591619 - RNA, 13 nt, Escherichia coli CFT073
aacgaaccgcuau

SEQ ID NO: 2591620 - RNA, 16 nt, Escherichia coli CFT073
aacgaacucuucgccc

SEQ ID NO: 2591621 - RNA, 19 nt, Escherichia coli CFT073
aacgaacucuucgcccagg

SEQ ID NO: 2591622 - RNA, 20 nt, Escherichia coli CFT073
aacgaagacagcgaaaacga

SEQ ID NO: 2591623 - RNA, 16 nt, Escherichia coli CFT073
aacgaagcgccauuca

SEQ ID NO: 2591624 - RNA, 17 nt, Escherichia coli CFT073
aacgaaggccggagcau

SEQ ID NO: 2591625 - RNA, 13 nt, Escherichia coli CFT073
aacgaauaaucca

SEQ ID NO: 2591626 - RNA, 23 nt, Escherichia coli CFT073
aacgaauugucccauuugccagc

SEQ ID NO: 2591627 - RNA, 18 nt, Escherichia coli CFT073
aacgacaaaaauaccacc

SEQ ID NO: 2591628 - RNA, 17 nt, Escherichia coli CFT073
aacgacaaaucauacag

SEQ ID NO: 2591629 - RNA, 14 nt, Escherichia coli CFT073
aacgacaccacgcg

SEQ ID NO: 2591630 - RNA, 20 nt, Escherichia coli CFT073
aacgacacugcucgcagaaa

SEQ ID NO: 2591631 - RNA, 16 nt, Escherichia coli CFT073
aacgacauccgccagc

SEQ ID NO: 2591632 - RNA, 18 nt, Escherichia coli CFT073
aacgacauccgccagcgc

SEQ ID NO: 2591633 - RNA, 14 nt, Escherichia coli CFT073
aacgaccagaaaug

SEQ ID NO: 2591634 - RNA, 15 nt, Escherichia coli CFT073
aacgaccagaaaugc

SEQ ID NO: 2591635 - RNA, 17 nt, Escherichia coli CFT073
aacgaccagcgccgcaa

SEQ ID NO: 2591636 - RNA, 17 nt, Escherichia coli CFT073
aacgaccgcgagcaaaa

SEQ ID NO: 2591637 - RNA, 20 nt, Escherichia coli CFT073
aacgaccgcgggacaaauaa

SEQ ID NO: 2591638 - RNA, 23 nt, Escherichia coli CFT073
aacgaccgcgggacaaauaauga

SEQ ID NO: 2591639 - RNA, 17 nt, Escherichia coli CFT073
aacgaccuccaucgcac

SEQ ID NO: 2591640 - RNA, 22 nt, Escherichia coli CFT073
aacgaccuggaaaacgucgguu

SEQ ID NO: 2591641 - RNA, 14 nt, Escherichia coli CFT073
aacgacggcguggu

SEQ ID NO: 2591642 - RNA, 15 nt, Escherichia coli CFT073
aacgacgggcgcugg

SEQ ID NO: 2591643 - RNA, 15 nt, Escherichia coli CFT073
aacgacgguaaacca

SEQ ID NO: 2591644 - RNA, 12 nt, Escherichia coli CFT073
aacgagaacguc

SEQ ID NO: 2591645 - RNA, 14 nt, Escherichia coli CFT073
aacgagaacgucgc

SEQ ID NO: 2591646 - RNA, 21 nt, Escherichia coli CFT073
aacgagccauaaaaucacagg

SEQ ID NO: 2591647 - RNA, 16 nt, Escherichia coli CFT073
aacgagcgauccaacu

SEQ ID NO: 2591648 - RNA, 17 nt, Escherichia coli CFT073
aacgaguacaaaaauaa

SEQ ID NO: 2591649 - RNA, 20 nt, Escherichia coli CFT073
aacgaguugcgguuucaacu

SEQ ID NO: 2591650 - RNA, 17 nt, Escherichia coli CFT073
aacgauaacaaucacca

SEQ ID NO: 2591651 - RNA, 18 nt, Escherichia coli CFT073
aacgauaacaaucaccaa

SEQ ID NO: 2591652 - RNA, 19 nt, Escherichia coli CFT073
aacgauaacaaucaccaaa

SEQ ID NO: 2591653 - RNA, 22 nt, Escherichia coli CFT073
aacgauaacaaucaccaaacca

SEQ ID NO: 2591654 - RNA, 17 nt, Escherichia coli CFT073
aacgauaauccagcaga

SEQ ID NO: 2591655 - RNA, 14 nt, Escherichia coli CFT073
aacgauacgcuggc

SEQ ID NO: 2591656 - RNA, 18 nt, Escherichia coli CFT073
aacgauccuggucaggaa

SEQ ID NO: 2591657 - RNA, 22 nt, Escherichia coli CFT073
aacgaucgcccggcaccagcac

SEQ ID NO: 2591658 - RNA, 12 nt, Escherichia coli CFT073
aacgaucgccga

SEQ ID NO: 2591659 - RNA, 21 nt, Escherichia coli CFT073
aacgauggcguaaccaaugcc

SEQ ID NO: 2591660 - RNA, 13 nt, Escherichia coli CFT073
aacgcaaaaccaa

SEQ ID NO: 2591661 - RNA, 21 nt, Escherichia coli CFT073
aacgcaaaaccaagcugggca

SEQ ID NO: 2591662 - RNA, 18 nt, Escherichia coli CFT073
aacgcaaacaccagcuga

SEQ ID NO: 2591663 - RNA, 16 nt, Escherichia coli CFT073
aacgcaaauacugacu

SEQ ID NO: 2591664 - RNA, 14 nt, Escherichia coli CFT073
aacgcaaucaaauu

SEQ ID NO: 2591665 - RNA, 16 nt, Escherichia coli CFT073
aacgcacgcugaccgc

SEQ ID NO: 2591666 - RNA, 18 nt, Escherichia coli CFT073
aacgcacgucugauguaa

SEQ ID NO: 2591667 - RNA, 13 nt, Escherichia coli CFT073
aacgcacuggcgc

SEQ ID NO: 2591668 - RNA, 15 nt, Escherichia coli CFT073
aacgcacuggcgcgc

SEQ ID NO: 2591669 - RNA, 21 nt, Escherichia coli CFT073
aacgcagacgccguuccagau

SEQ ID NO: 2591670 - RNA, 16 nt, Escherichia coli CFT073
aacgcagcaucgccau

SEQ ID NO: 2591671 - RNA, 15 nt, Escherichia coli CFT073
aacgcagcauuuccu

SEQ ID NO: 2591672 - RNA, 20 nt, Escherichia coli CFT073
aacgcagcauuuccucaaca

SEQ ID NO: 2591673 - RNA, 12 nt, Escherichia coli CFT073
aacgcaggaugu

SEQ ID NO: 2591674 - RNA, 18 nt, Escherichia coli CFT073
aacgcauaccccaucagc

SEQ ID NO: 2591675 - RNA, 17 nt, Escherichia coli CFT073
aacgcauaucuucugaa

SEQ ID NO: 2591676 - RNA, 14 nt, Escherichia coli CFT073
aacgcaucccgguu

SEQ ID NO: 2591677 - RNA, 13 nt, Escherichia coli CFT073
aacgcaucgccaa

SEQ ID NO: 2591678 - RNA, 15 nt, Escherichia coli CFT073
aacgcaucuuuuuca

SEQ ID NO: 2591679 - RNA, 13 nt, Escherichia coli CFT073
aacgccaaauucu

SEQ ID NO: 2591680 - RNA, 22 nt, Escherichia coli CFT073
aacgccaauucauuccuugaaa

SEQ ID NO: 2591681 - RNA, 21 nt, Escherichia coli CFT073
aacgccaccacucaaaagcgu

SEQ ID NO: 2591682 - RNA, 22 nt, Escherichia coli CFT073
aacgccaccauuuuacgcccgc

SEQ ID NO: 2591683 - RNA, 18 nt, Escherichia coli CFT073
aacgccaccccacaccag

SEQ ID NO: 2591684 - RNA, 15 nt, Escherichia coli CFT073
aacgccacgcucacu

SEQ ID NO: 2591685 - RNA, 20 nt, Escherichia coli CFT073
aacgccagauccgggcuaau

SEQ ID NO: 2591686 - RNA, 18 nt, Escherichia coli CFT073
aacgccagccacaaacca

SEQ ID NO: 2591687 - RNA, 13 nt, Escherichia coli CFT073
aacgccagcgaag

SEQ ID NO: 2591688 - RNA, 19 nt, Escherichia coli CFT073
aacgccagcgaagccagcu

SEQ ID NO: 2591689 - RNA, 14 nt, Escherichia coli CFT073
aacgccauccggca

SEQ ID NO: 2591690 - RNA, 15 nt, Escherichia coli CFT073
aacgccaugccaaag

SEQ ID NO: 2591691 - RNA, 18 nt, Escherichia coli CFT073
aacgcccacgcuacucgc

SEQ ID NO: 2591692 - RNA, 19 nt, Escherichia coli CFT073
aacgcccacgcuacucgcc

SEQ ID NO: 2591693 - RNA, 18 nt, Escherichia coli CFT073
aacgcccagcuaaucgag

SEQ ID NO: 2591694 - RNA, 22 nt, Escherichia coli CFT073
aacgcccagcuaaucgagccga

SEQ ID NO: 2591695 - RNA, 14 nt, Escherichia coli CFT073
aacgccccagcggc

SEQ ID NO: 2591696 - RNA, 18 nt, Escherichia coli CFT073
aacgccccuucugccgca

SEQ ID NO: 2591697 - RNA, 18 nt, Escherichia coli CFT073
aacgcccgagcuuccagc

SEQ ID NO: 2591698 - RNA, 13 nt, Escherichia coli CFT073
aacgcccgcaacu

SEQ ID NO: 2591699 - RNA, 20 nt, Escherichia coli CFT073
aacgcccucuaaaauaacga

SEQ ID NO: 2591700 - RNA, 19 nt, Escherichia coli CFT073
aacgcccuguaaaaaagaa

SEQ ID NO: 2591701 - RNA, 23 nt, Escherichia coli CFT073
aacgccgauaagguaucgcgaaa

SEQ ID NO: 2591702 - RNA, 16 nt, Escherichia coli CFT073
aacgccgccagaccac

SEQ ID NO: 2591703 - RNA, 16 nt, Escherichia coli CFT073
aacgccgcgugccacc

SEQ ID NO: 2591704 - RNA, 14 nt, Escherichia coli CFT073
aacgccgcuauacg

SEQ ID NO: 2591705 - RNA, 14 nt, Escherichia coli CFT073
aacgccgcugguga

SEQ ID NO: 2591706 - RNA, 22 nt, Escherichia coli CFT073
aacgccggaaaaacguuucaaa

SEQ ID NO: 2591707 - RNA, 15 nt, Escherichia coli CFT073
aacgccgucgccuuc

SEQ ID NO: 2591708 - RNA, 23 nt, Escherichia coli CFT073
aacgccgucgccuucauaccaua

SEQ ID NO: 2591709 - RNA, 21 nt, Escherichia coli CFT073
aacgccuaacucuugccagau

SEQ ID NO: 2591710 - RNA, 20 nt, Escherichia coli CFT073
aacgccucauccggccuaca

SEQ ID NO: 2591711 - RNA, 20 nt, Escherichia coli CFT073
aacgccucguuugcggcaau

SEQ ID NO: 2591712 - RNA, 18 nt, Escherichia coli CFT073
aacgccugaugcgacgcu

SEQ ID NO: 2591713 - RNA, 15 nt, Escherichia coli CFT073
aacgccuuauccgac

SEQ ID NO: 2591714 - RNA, 20 nt, Escherichia coli CFT073
aacgccuuauccgaccuaca

SEQ ID NO: 2591715 - RNA, 20 nt, Escherichia coli CFT073
aacgccuuauccggccuaca

SEQ ID NO: 2591716 - RNA, 20 nt, Escherichia coli CFT073
aacgccuuauccggccuacg

SEQ ID NO: 2591717 - RNA, 22 nt, Escherichia coli CFT073
aacgucugccugguuucucucc

SEQ ID NO: 2591718 - RNA, 13 nt, Escherichia coli CFT073
aacgucuugcugu

SEQ ID NO: 2591719 - RNA, 16 nt, Escherichia coli CFT073
aacgugaauuuuuacu

SEQ ID NO: 2591720 - RNA, 17 nt, Escherichia coli CFT073
aacgugaauuuuuacuu

SEQ ID NO: 2591721 - RNA, 15 nt, Escherichia coli CFT073
aacgugaccaugagc

SEQ ID NO: 2591722 - RNA, 16 nt, Escherichia coli CFT073
aacgugcaaaaucaaa

SEQ ID NO: 2591723 - RNA, 17 nt, Escherichia coli CFT073
aacgugccacugacauc

SEQ ID NO: 2591724 - RNA, 18 nt, Escherichia coli CFT073
aacgugccauagcgggca

SEQ ID NO: 2591725 - RNA, 19 nt, Escherichia coli CFT073
aacgugcucugcgccgccu

SEQ ID NO: 2591726 - RNA, 21 nt, Escherichia coli CFT073
aacguggccuccaaaaaacaa

SEQ ID NO: 2591727 - RNA, 15 nt, Escherichia coli CFT073
aacgugguuugcggc

SEQ ID NO: 2591728 - RNA, 22 nt, Escherichia coli CFT073
aacguguacccagcagcgccac

SEQ ID NO: 2591729 - RNA, 16 nt, Escherichia coli CFT073
aacguguauaucacca

SEQ ID NO: 2591730 - RNA, 16 nt, Escherichia coli CFT073
aacgugucaacgcuuc

SEQ ID NO: 2591731 - RNA, 13 nt, Escherichia coli CFT073
aacgugucguuga

SEQ ID NO: 2591732 - RNA, 21 nt, Escherichia coli CFT073
aacguguuuauauuugaacau

SEQ ID NO: 2591733 - RNA, 14 nt, Escherichia coli CFT073
aacguuaacgcguc

SEQ ID NO: 2591734 - RNA, 19 nt, Escherichia coli CFT073
aacguuaccaagaaagaua

SEQ ID NO: 2591735 - RNA, 15 nt, Escherichia coli CFT073
aacguuaccuuuaau

SEQ ID NO: 2591736 - RNA, 19 nt, Escherichia coli CFT073
aacguuauccguuaacgcc

SEQ ID NO: 2591737 - RNA, 15 nt, Escherichia coli CFT073
aacguuauuuugcua

SEQ ID NO: 2591738 - RNA, 21 nt, Escherichia coli CFT073
aacguucugcuguucuucugc

SEQ ID NO: 2591739 - RNA, 13 nt, Escherichia coli CFT073
aacguugccggau

SEQ ID NO: 2591740 - RNA, 21 nt, Escherichia coli CFT073
aacguugcucaaggguuucgc

SEQ ID NO: 2591741 - RNA, 18 nt, Escherichia coli CFT073
aacguuuagcgguggcaa

SEQ ID NO: 2591742 - RNA, 18 nt, Escherichia coli CFT073
aacguuuccauucgcugc

SEQ ID NO: 2591743 - RNA, 22 nt, Escherichia coli CFT073
aacguuucuuucaucagaucaa

SEQ ID NO: 2591744 - RNA, 16 nt, Escherichia coli CFT073
aacguuuuaagcaaau

SEQ ID NO: 2591745 - RNA, 12 nt, Escherichia coli CFT073
aacguuuucacc

SEQ ID NO: 2591746 - RNA, 14 nt, Escherichia coli CFT073
aacuaacagcacau

SEQ ID NO: 2591747 - RNA, 22 nt, Escherichia coli CFT073
aacuaacugacuuucuuuuccc

SEQ ID NO: 2591748 - RNA, 15 nt, Escherichia coli CFT073
aacuacagcauuuug

SEQ ID NO: 2591749 - RNA, 17 nt, Escherichia coli CFT073
aacuacagcauuuugag

SEQ ID NO: 2591750 - RNA, 20 nt, Escherichia coli CFT073
aacuaccagcaguuugguaa

SEQ ID NO: 2591751 - RNA, 21 nt, Escherichia coli CFT073
aacuacggcuuuuuucauuuc

SEQ ID NO: 2591752 - RNA, 23 nt, Escherichia coli CFT073
aacuacggcuuuuuucauuuccc

SEQ ID NO: 2591753 - RNA, 18 nt, Escherichia coli CFT073
aacuaucccaucagcggg

SEQ ID NO: 2591754 - RNA, 12 nt, Escherichia coli CFT073
aacuauggcauu

SEQ ID NO: 2591755 - RNA, 12 nt, Escherichia coli CFT073
aacuauuguaua

SEQ ID NO: 2591756 - RNA, 16 nt, Escherichia coli CFT073
aacuauuguauaccaa

SEQ ID NO: 2591757 - RNA, 17 nt, Escherichia coli CFT073
aacucaaaaaaaauuuu

SEQ ID NO: 2591758 - RNA, 19 nt, Escherichia coli CFT073
aacucaaaaauaaucaucu

SEQ ID NO: 2591759 - RNA, 20 nt, Escherichia coli CFT073
aacucaaaaauaaucaucuc

SEQ ID NO: 2591760 - RNA, 13 nt, Escherichia coli CFT073
aacucaacgugga

SEQ ID NO: 2591761 - RNA, 16 nt, Escherichia coli CFT073
aacucaaucaggcuau

SEQ ID NO: 2591762 - RNA, 14 nt, Escherichia coli CFT073
aacucaaugccgga

SEQ ID NO: 2591763 - RNA, 15 nt, Escherichia coli CFT073
aacucaauucacgcc

SEQ ID NO: 2591764 - RNA, 14 nt, Escherichia coli CFT073
aacucaccgaugau

SEQ ID NO: 2591765 - RNA, 21 nt, Escherichia coli CFT073
aacucaccgaugaucgccauc

SEQ ID NO: 2591766 - RNA, 18 nt, Escherichia coli CFT073
aacucaccggcauuuuuu

SEQ ID NO: 2591767 - RNA, 14 nt, Escherichia coli CFT073
aacucaccuuuaaa

SEQ ID NO: 2591768 - RNA, 18 nt, Escherichia coli CFT073
aacucaccuuuuuucuua

SEQ ID NO: 2591769 - RNA, 12 nt, Escherichia coli CFT073
aacucacgcaga

SEQ ID NO: 2591770 - RNA, 16 nt, Escherichia coli CFT073
aacucacucugcaccg

SEQ ID NO: 2591771 - RNA, 15 nt, Escherichia coli CFT073
aacucacugccagca

SEQ ID NO: 2591772 - RNA, 16 nt, Escherichia coli CFT073
aacucaggaacaucag

SEQ ID NO: 2591773 - RNA, 19 nt, Escherichia coli CFT073
aacucaggaacaucagcau

SEQ ID NO: 2591774 - RNA, 23 nt, Escherichia coli CFT073
aacucaggaacuuaguaggccug

SEQ ID NO: 2591775 - RNA, 20 nt, Escherichia coli CFT073
aacucauaaaccagcggcac

SEQ ID NO: 2591776 - RNA, 14 nt, Escherichia coli CFT073
aacucauacugagc

SEQ ID NO: 2591777 - RNA, 14 nt, Escherichia coli CFT073
aacucauccaccac

SEQ ID NO: 2591778 - RNA, 17 nt, Escherichia coli CFT073
aacucauccaccacaaa

SEQ ID NO: 2591779 - RNA, 20 nt, Escherichia coli CFT073
aacucaugacaaccugcugu

SEQ ID NO: 2591780 - RNA, 17 nt, Escherichia coli CFT073
aacucauugccagcccu

SEQ ID NO: 2591781 - RNA, 19 nt, Escherichia coli CFT073
aacucauugccagcccuaa

SEQ ID NO: 2591782 - RNA, 14 nt, Escherichia coli CFT073
aacuccaccaauaa

SEQ ID NO: 2591783 - RNA, 12 nt, Escherichia coli CFT073
aacuccacuuca

SEQ ID NO: 2591784 - RNA, 22 nt, Escherichia coli CFT073
aacuccacuucaccgcgaauau

SEQ ID NO: 2591785 - RNA, 15 nt, Escherichia coli CFT073
aacuccccuucuggc

SEQ ID NO: 2591786 - RNA, 21 nt, Escherichia coli CFT073
aacuccccuuuaaauuauuug

SEQ ID NO: 2591787 - RNA, 15 nt, Escherichia coli CFT073
aacuccggcauaaua

SEQ ID NO: 2591788 - RNA, 19 nt, Escherichia coli CFT073
aacuccggccugcacugca

SEQ ID NO: 2591789 - RNA, 15 nt, Escherichia coli CFT073
aacuccgucauccug

SEQ ID NO: 2591790 - RNA, 15 nt, Escherichia coli CFT073
aacuccgugaagcuc

SEQ ID NO: 2591791 - RNA, 22 nt, Escherichia coli CFT073
aacuccugauuccaggucaauc

SEQ ID NO: 2591792 - RNA, 15 nt, Escherichia coli CFT073
aacucgaauuauuca

SEQ ID NO: 2591793 - RNA, 16 nt, Escherichia coli CFT073
aacucgaccugcaacu

SEQ ID NO: 2591794 - RNA, 17 nt, Escherichia coli CFT073
aacucgaccugcaacug

SEQ ID NO: 2591795 - RNA, 13 nt, Escherichia coli CFT073
aacucgaugacaa

SEQ ID NO: 2591796 - RNA, 13 nt, Escherichia coli CFT073
aacucgccaaacc

SEQ ID NO: 2591797 - RNA, 13 nt, Escherichia coli CFT073
aacucgccuucag

SEQ ID NO: 2591798 - RNA, 16 nt, Escherichia coli CFT073
aacucgccuucagguu

SEQ ID NO: 2591799 - RNA, 22 nt, Escherichia coli CFT073
aacucgccuuugucuuucugga

SEQ ID NO: 2591800 - RNA, 15 nt, Escherichia coli CFT073
aacucgcuggcggcu

SEQ ID NO: 2591801 - RNA, 22 nt, Escherichia coli CFT073
aacucgcuuaagccaucaucaa

SEQ ID NO: 2591802 - RNA, 16 nt, Escherichia coli CFT073
aacucggaaaaugcau

SEQ ID NO: 2591803 - RNA, 18 nt, Escherichia coli CFT073
aacucgucugauuucuua

SEQ ID NO: 2591804 - RNA, 20 nt, Escherichia coli CFT073
aacucguuaacuucaucccg

SEQ ID NO: 2591805 - RNA, 20 nt, Escherichia coli CFT073
aacucuaccuggucaccgac

SEQ ID NO: 2591806 - RNA, 23 nt, Escherichia coli CFT073
aacucuaccuggucaccgacaac

SEQ ID NO: 2591807 - RNA, 13 nt, Escherichia coli CFT073
aacucucaugcuu

SEQ ID NO: 2591808 - RNA, 23 nt, Escherichia coli CFT073
aacucuggauguuucaugaagca

SEQ ID NO: 2591809 - RNA, 19 nt, Escherichia coli CFT073
aacucuucugaaaagguua

SEQ ID NO: 2591810 - RNA, 17 nt, Escherichia coli CFT073
aacucuucuucugacac

SEQ ID NO: 2591811 - RNA, 11 nt, Escherichia coli CFT073
aacucuugaau

SEQ ID NO: 2591812 - RNA, 14 nt, Escherichia coli CFT073
aacucuuucacuuu

SEQ ID NO: 2591813 - RNA, 13 nt, Escherichia coli CFT073
aacucuuucugac

SEQ ID NO: 2591814 - RNA, 23 nt, Escherichia coli CFT073
aacucuuucugacgaauuaccaa

SEQ ID NO: 2591815 - RNA, 23 nt, Escherichia coli CFT073
aacucuuugggcagaaaauccag

SEQ ID NO: 2591816 - RNA, 13 nt, Escherichia coli CFT073
aacugaacuugcu

SEQ ID NO: 2591817 - RNA, 23 nt, Escherichia coli CFT073
aacugaagauugaacagcagaac

SEQ ID NO: 2591818 - RNA, 18 nt, Escherichia coli CFT073
aacugaauaauacacaca

SEQ ID NO: 2591819 - RNA, 22 nt, Escherichia coli CFT073
aacugacgaaugcguugcguca

SEQ ID NO: 2591820 - RNA, 21 nt, Escherichia coli CFT073
aacugacggucgguaaacccg

SEQ ID NO: 2591821 - RNA, 20 nt, Escherichia coli CFT073
aacugacgguuucucccgcc

SEQ ID NO: 2591822 - RNA, 16 nt, Escherichia coli CFT073
aacugacuuucuuuuc

SEQ ID NO: 2591823 - RNA, 13 nt, Escherichia coli CFT073
aacugaguucaua

SEQ ID NO: 2591824 - RNA, 23 nt, Escherichia coli CFT073
aacugauacucgucgcgcacgcc

SEQ ID NO: 2591825 - RNA, 11 nt, Escherichia coli CFT073
aagaaacggaa

SEQ ID NO: 2591826 - RNA, 22 nt, Escherichia coli CFT073
aagaaacggaagccccagguca

SEQ ID NO: 2591827 - RNA, 19 nt, Escherichia coli CFT073
aagaaacucuauccacauu

SEQ ID NO: 2591828 - RNA, 12 nt, Escherichia coli CFT073
aagaaagaagcc

SEQ ID NO: 2591829 - RNA, 12 nt, Escherichia coli CFT073
aagaaagcuuug

SEQ ID NO: 2591830 - RNA, 14 nt, Escherichia coli CFT073
aagaacaccagcac

SEQ ID NO: 2591831 - RNA, 17 nt, Escherichia coli CFT073
aagaaccagaauuucca

SEQ ID NO: 2591832 - RNA, 12 nt, Escherichia coli CFT073
aagaaccaugca

SEQ ID NO: 2591833 - RNA, 15 nt, Escherichia coli CFT073
aagaaccccagccag

SEQ ID NO: 2591834 - RNA, 21 nt, Escherichia coli CFT073
aagaaccgcaccaggcaguuu

SEQ ID NO: 2591835 - RNA, 19 nt, Escherichia coli CFT073
aagaacgcaccgaccaucg

SEQ ID NO: 2591836 - RNA, 14 nt, Escherichia coli CFT073
aagaacuccggcgc

SEQ ID NO: 2591837 - RNA, 16 nt, Escherichia coli CFT073
aagaacuccggcgcgu

SEQ ID NO: 2591838 - RNA, 16 nt, Escherichia coli CFT073
aagaagaucagcaaau

SEQ ID NO: 2591839 - RNA, 20 nt, Escherichia coli CFT073
aagaagaucagcaaauaauu

SEQ ID NO: 2591840 - RNA, 12 nt, Escherichia coli CFT073
aagaagaucauc

SEQ ID NO: 2591841 - RNA, 17 nt, Escherichia coli CFT073
aagaagcggcuauucug

SEQ ID NO: 2591842 - RNA, 19 nt, Escherichia coli CFT073
aagaagcuuuucgggaaca

SEQ ID NO: 2591843 - RNA, 13 nt, Escherichia coli CFT073
aagaaggaaaaua

SEQ ID NO: 2591844 - RNA, 15 nt, Escherichia coli CFT073
aagaaggaaaauaca

SEQ ID NO: 2591845 - RNA, 16 nt, Escherichia coli CFT073
aagaagugcucuuugc

SEQ ID NO: 2591846 - RNA, 21 nt, Escherichia coli CFT073
aagaaguuagagccgauaucc

SEQ ID NO: 2591847 - RNA, 17 nt, Escherichia coli CFT073
aagaaucaugccaaaaa

SEQ ID NO: 2591848 - RNA, 21 nt, Escherichia coli CFT073
aagaaucuauuaaccaauaag

SEQ ID NO: 2591849 - RNA, 13 nt, Escherichia coli CFT073
aagaaugaaauuc

SEQ ID NO: 2591850 - RNA, 20 nt, Escherichia coli CFT073
aagaaugaaauucgagagaa

SEQ ID NO: 2591851 - RNA, 15 nt, Escherichia coli CFT073
aagaaugcagucagu

SEQ ID NO: 2591852 - RNA, 14 nt, Escherichia coli CFT073
aagaauuaaaauau

SEQ ID NO: 2591853 - RNA, 16 nt, Escherichia coli CFT073
aagaauugcagauacc

SEQ ID NO: 2591854 - RNA, 21 nt, Escherichia coli CFT073
aagaauuucucaguuguuugc

SEQ ID NO: 2591855 - RNA, 21 nt, Escherichia coli CFT073
aagaauuucuuuacugacagg

SEQ ID NO: 2591856 - RNA, 14 nt, Escherichia coli CFT073
aagacaacauugau

SEQ ID NO: 2591857 - RNA, 16 nt, Escherichia coli CFT073
aagacaacauugauuu

SEQ ID NO: 2591858 - RNA, 16 nt, Escherichia coli CFT073
aagacacgccaguguc

SEQ ID NO: 2591859 - RNA, 16 nt, Escherichia coli CFT073
aagacaucgcccgauu

SEQ ID NO: 2591860 - RNA, 22 nt, Escherichia coli CFT073
aagacaucgcccgauucacaua

SEQ ID NO: 2591861 - RNA, 13 nt, Escherichia coli CFT073
aagaccaauccag

SEQ ID NO: 2591862 - RNA, 22 nt, Escherichia coli CFT073
aagaccaauccgccagccaauu

SEQ ID NO: 2591863 - RNA, 22 nt, Escherichia coli CFT073
aagaccagcgaaaccugaaucc

SEQ ID NO: 2591864 - RNA, 17 nt, Escherichia coli CFT073
aagaccaggaaacccaa

SEQ ID NO: 2591865 - RNA, 16 nt, Escherichia coli CFT073
aagaccgugagcaaug

SEQ ID NO: 2591866 - RNA, 20 nt, Escherichia coli CFT073
aagaccgugagcaaugcaca

SEQ ID NO: 2591867 - RNA, 22 nt, Escherichia coli CFT073
aagaccgugagcaaugcacaca

SEQ ID NO: 2591868 - RNA, 19 nt, Escherichia coli CFT073
aagaccguuucggugauga

SEQ ID NO: 2591869 - RNA, 18 nt, Escherichia coli CFT073
aagaccugucucuuauac

SEQ ID NO: 2591870 - RNA, 14 nt, Escherichia coli CFT073
aagacgaaaaauga

SEQ ID NO: 2591871 - RNA, 10 nt, Escherichia coli CFT073
aagacgacga

SEQ ID NO: 2591872 - RNA, 12 nt, Escherichia coli CFT073
aagacgacgaac

SEQ ID NO: 2591873 - RNA, 13 nt, Escherichia coli CFT073
aagacgaguagaa

SEQ ID NO: 2591874 - RNA, 21 nt, Escherichia coli CFT073
aagacgcaaccagcgucgcau

SEQ ID NO: 2591875 - RNA, 21 nt, Escherichia coli CFT073
aagacgcgaacagcgucgcau

SEQ ID NO: 2591876 - RNA, 13 nt, Escherichia coli CFT073
aagacgcgccagc

SEQ ID NO: 2591877 - RNA, 20 nt, Escherichia coli CFT073
aagacgcgccagcgucgcau

SEQ ID NO: 2591878 - RNA, 20 nt, Escherichia coli CFT073
aagacgcgucugcgucgcau

SEQ ID NO: 2591879 - RNA, 19 nt, Escherichia coli CFT073
aagacgcguggcgucgcau

SEQ ID NO: 2591880 - RNA, 16 nt, Escherichia coli CFT073
aagacgcguuaagcgu

SEQ ID NO: 2591881 - RNA, 17 nt, Escherichia coli CFT073
aagacggccaucccagu

SEQ ID NO: 2591882 - RNA, 14 nt, Escherichia coli CFT073
aagacuauuaauau

SEQ ID NO: 2591883 - RNA, 18 nt, Escherichia coli CFT073
aagacuccagcgccagcg

SEQ ID NO: 2591884 - RNA, 22 nt, Escherichia coli CFT073
aagacugaguuuuauucuuuuu

SEQ ID NO: 2591885 - RNA, 15 nt, Escherichia coli CFT073
aagacuguaaauacu

SEQ ID NO: 2591886 - RNA, 16 nt, Escherichia coli CFT073
aagagaaccagcugcc

SEQ ID NO: 2591887 - RNA, 13 nt, Escherichia coli CFT073
aagagaacugagc

SEQ ID NO: 2591888 - RNA, 13 nt, Escherichia coli CFT073
aagagagaagcca

SEQ ID NO: 2591889 - RNA, 15 nt, Escherichia coli CFT073
aagagagaagccagg

SEQ ID NO: 2591890 - RNA, 18 nt, Escherichia coli CFT073
aagagagcaacagcagau

SEQ ID NO: 2591891 - RNA, 14 nt, Escherichia coli CFT073
aagagauaaacuca

SEQ ID NO: 2591892 - RNA, 15 nt, Escherichia coli CFT073
aagagaucaaagucu

SEQ ID NO: 2591893 - RNA, 16 nt, Escherichia coli CFT073
aagagaucaaagucuc

SEQ ID NO: 2591894 - RNA, 18 nt, Escherichia coli CFT073
aagagaucaaagucucug

SEQ ID NO: 2591895 - RNA, 14 nt, Escherichia coli CFT073
aagagauccaggcc

SEQ ID NO: 2591896 - RNA, 17 nt, Escherichia coli CFT073
aagagauccaggccaga

SEQ ID NO: 2591897 - RNA, 18 nt, Escherichia coli CFT073
aagagauccgcacucaac

SEQ ID NO: 2591898 - RNA, 21 nt, Escherichia coli CFT073
aagagauccgcacucaacuua

SEQ ID NO: 2591899 - RNA, 15 nt, Escherichia coli CFT073
aagagcaaauaaaac

SEQ ID NO: 2591900 - RNA, 15 nt, Escherichia coli CFT073
aagagcgacaauccc

SEQ ID NO: 2591901 - RNA, 17 nt, Escherichia coli CFT073
aagagcgacaaucccug

SEQ ID NO: 2591902 - RNA, 19 nt, Escherichia coli CFT073
aagagcgauccguucagau

SEQ ID NO: 2591903 - RNA, 17 nt, Escherichia coli CFT073
aagagcgcaccgcgcgg

SEQ ID NO: 2591904 - RNA, 16 nt, Escherichia coli CFT073
aagaggaggacagcca

SEQ ID NO: 2591905 - RNA, 14 nt, Escherichia coli CFT073
aagaggcgcugacg

SEQ ID NO: 2591906 - RNA, 21 nt, Escherichia coli CFT073
aagaggcggagguuuuuuccu

SEQ ID NO: 2591907 - RNA, 22 nt, Escherichia coli CFT073
aagagugugaauauucagaaua

SEQ ID NO: 2591908 - RNA, 18 nt, Escherichia coli CFT073
aagaguuucaacaucauu

SEQ ID NO: 2591909 - RNA, 13 nt, Escherichia coli CFT073
aagaguuuuaaaa

SEQ ID NO: 2591910 - RNA, 21 nt, Escherichia coli CFT073
aagaguuuuaaaaccauuagu

SEQ ID NO: 2591911 - RNA, 20 nt, Escherichia coli CFT073
aagaguuuucuuaagauaag

SEQ ID NO: 2591912 - RNA, 15 nt, Escherichia coli CFT073
aagauaacccugcau

SEQ ID NO: 2591913 - RNA, 23 nt, Escherichia coli CFT073
aagauaaggugucaauccuucuu

SEQ ID NO: 2591914 - RNA, 21 nt, Escherichia coli CFT073
aagauaaguggcaauauauuu

SEQ ID NO: 2591915 - RNA, 15 nt, Escherichia coli CFT073
aagauaauccaggac

SEQ ID NO: 2591916 - RNA, 13 nt, Escherichia coli CFT073
aagauaaugccag

SEQ ID NO: 2591917 - RNA, 21 nt, Escherichia coli CFT073
aagauagacuguugaaauaca

SEQ ID NO: 2591918 - RNA, 22 nt, Escherichia coli CFT073
aagauagacuguugaaauacaa

SEQ ID NO: 2591919 - RNA, 15 nt, Escherichia coli CFT073
aagauaguaaccguu

SEQ ID NO: 2591920 - RNA, 20 nt, Escherichia coli CFT073
aagauauucaucagcaucac

SEQ ID NO: 2591921 - RNA, 21 nt, Escherichia coli CFT073
aagauauuggggguaauuccc

SEQ ID NO: 2591922 - RNA, 16 nt, Escherichia coli CFT073
aagaucaaaccucacc

SEQ ID NO: 2591923 - RNA, 16 nt, Escherichia coli CFT073
aagaucacaauguaaa

SEQ ID NO: 2591924 - RNA, 22 nt, Escherichia coli CFT073
aagaucagcaaauaauucaucu

SEQ ID NO: 2591925 - RNA, 14 nt, Escherichia coli CFT073
aagaucaucaccag

SEQ ID NO: 2591926 - RNA, 20 nt, Escherichia coli CFT073
aagaucaugaugaugccaaa

SEQ ID NO: 2591927 - RNA, 11 nt, Escherichia coli CFT073
aagauccauga

SEQ ID NO: 2591928 - RNA, 21 nt, Escherichia coli CFT073
aagaucgcccugagggacguu

SEQ ID NO: 2591929 - RNA, 14 nt, Escherichia coli CFT073
aagaucggaagauc

SEQ ID NO: 2591930 - RNA, 18 nt, Escherichia coli CFT073
aagaucggagccaaaauc

SEQ ID NO: 2591931 - RNA, 17 nt, Escherichia coli CFT073
aagaucgugcagcaccg

SEQ ID NO: 2591932 - RNA, 15 nt, Escherichia coli CFT073
aagaucuuauugcca

SEQ ID NO: 2591933 - RNA, 23 nt, Escherichia coli CFT073
aagaucuuauugccauuuucacg

SEQ ID NO: 2591934 - RNA, 14 nt, Escherichia coli CFT073
aagcccgccagacc

SEQ ID NO: 2591935 - RNA, 17 nt, Escherichia coli CFT073
aagcccgccagaccagc

SEQ ID NO: 2591936 - RNA, 13 nt, Escherichia coli CFT073
aagcccgccgcca

SEQ ID NO: 2591937 - RNA, 23 nt, Escherichia coli CFT073
aagcccgcuucaaacgcugacgg

SEQ ID NO: 2591938 - RNA, 20 nt, Escherichia coli CFT073
aagcccguguuucugauaca

SEQ ID NO: 2591939 - RNA, 18 nt, Escherichia coli CFT073
aagcccugaucgcgcgcc

SEQ ID NO: 2591940 - RNA, 13 nt, Escherichia coli CFT073
aagcccugcaggg

SEQ ID NO: 2591941 - RNA, 13 nt, Escherichia coli CFT073
aagcccugcucgc

SEQ ID NO: 2591942 - RNA, 22 nt, Escherichia coli CFT073
aagcccuuaagaaaacugcgcc

SEQ ID NO: 2591943 - RNA, 17 nt, Escherichia coli CFT073
aagccgaacagucgcug

SEQ ID NO: 2591944 - RNA, 23 nt, Escherichia coli CFT073
aagccgaacagucgcugaucacc

SEQ ID NO: 2591945 - RNA, 19 nt, Escherichia coli CFT073
aagccgaccagcaccgcca

SEQ ID NO: 2591946 - RNA, 14 nt, Escherichia coli CFT073
aagccgaugucugc

SEQ ID NO: 2591947 - RNA, 11 nt, Escherichia coli CFT073
aagccgcaacc

SEQ ID NO: 2591948 - RNA, 17 nt, Escherichia coli CFT073
aagccgcgaaacugcgu

SEQ ID NO: 2591949 - RNA, 19 nt, Escherichia coli CFT073
aagccgcuccggcagcagc

SEQ ID NO: 2591950 - RNA, 17 nt, Escherichia coli CFT073
aagccgcucugcuucgc

SEQ ID NO: 2591951 - RNA, 14 nt, Escherichia coli CFT073
aagccggaggaaac

SEQ ID NO: 2591952 - RNA, 17 nt, Escherichia coli CFT073
aagccggaugaucaucc

SEQ ID NO: 2591953 - RNA, 23 nt, Escherichia coli CFT073
aagccggaugaucauccggcuuu

SEQ ID NO: 2591954 - RNA, 15 nt, Escherichia coli CFT073
aagccgggcagguga

SEQ ID NO: 2591955 - RNA, 19 nt, Escherichia coli CFT073
aagccgguaaucaccagca

SEQ ID NO: 2591956 - RNA, 20 nt, Escherichia coli CFT073
aagccgguaaucaccagcaa

SEQ ID NO: 2591957 - RNA, 16 nt, Escherichia coli CFT073
aagccggucauauugc

SEQ ID NO: 2591958 - RNA, 16 nt, Escherichia coli CFT073
aagccguauauucgcc

SEQ ID NO: 2591959 - RNA, 16 nt, Escherichia coli CFT073
aagccguccaccaccg

SEQ ID NO: 2591960 - RNA, 13 nt, Escherichia coli CFT073
aagccgugaauca

SEQ ID NO: 2591961 - RNA, 14 nt, Escherichia coli CFT073
aagccgugccagau

SEQ ID NO: 2591962 - RNA, 18 nt, Escherichia coli CFT073
aagccguuggucaucauc

SEQ ID NO: 2591963 - RNA, 17 nt, Escherichia coli CFT073
aagccuaagaagucauu

SEQ ID NO: 2591964 - RNA, 15 nt, Escherichia coli CFT073
aagccugcaucacga

SEQ ID NO: 2591965 - RNA, 20 nt, Escherichia coli CFT073
aagccuuacuucacaucauc

SEQ ID NO: 2591966 - RNA, 17 nt, Escherichia coli CFT073
aagccuuccgcaaacag

SEQ ID NO: 2591967 - RNA, 18 nt, Escherichia coli CFT073
aagccuuccgcaaacagg

SEQ ID NO: 2591968 - RNA, 22 nt, Escherichia coli CFT073
aagccuucgccuuucaguucaa

SEQ ID NO: 2591969 - RNA, 16 nt, Escherichia coli CFT073
aagccuuuuaccgccu

SEQ ID NO: 2591970 - RNA, 15 nt, Escherichia coli CFT073
aagcgaccaaccauc

SEQ ID NO: 2591971 - RNA, 20 nt, Escherichia coli CFT073
aagcgacgugcaguagcagc

SEQ ID NO: 2591972 - RNA, 22 nt, Escherichia coli CFT073
aagcgacgugcaguagcagcag

SEQ ID NO: 2591973 - RNA, 19 nt, Escherichia coli CFT073
aagcgagcaguacagccgc

SEQ ID NO: 2591974 - RNA, 22 nt, Escherichia coli CFT073
aagcgagcaguacagccgccag

SEQ ID NO: 2591975 - RNA, 15 nt, Escherichia coli CFT073
aagcgauaaccuuca

SEQ ID NO: 2591976 - RNA, 14 nt, Escherichia coli CFT073
aagcgauaacgcug

SEQ ID NO: 2591977 - RNA, 21 nt, Escherichia coli CFT073
aagcgauaacgcuggcagcaa

SEQ ID NO: 2591978 - RNA, 15 nt, Escherichia coli CFT073
aagcgcaaaggccag

SEQ ID NO: 2591979 - RNA, 17 nt, Escherichia coli CFT073
aagcgcaaaggccagca

SEQ ID NO: 2591980 - RNA, 20 nt, Escherichia coli CFT073
aagcgcacuuugcuggucug

SEQ ID NO: 2591981 - RNA, 16 nt, Escherichia coli CFT073
aagcgcaucaggcaac

SEQ ID NO: 2591982 - RNA, 17 nt, Escherichia coli CFT073
aagcgcaugaugucugc

SEQ ID NO: 2591983 - RNA, 22 nt, Escherichia coli CFT073
aagcgcaugaugucugcaagag

SEQ ID NO: 2591984 - RNA, 16 nt, Escherichia coli CFT073
aagcgccacaaucgcu

SEQ ID NO: 2591985 - RNA, 23 nt, Escherichia coli CFT073
aagcgccagauaugaucgaaaau

SEQ ID NO: 2591986 - RNA, 18 nt, Escherichia coli CFT073
aagcgccaggaaucuggu

SEQ ID NO: 2591987 - RNA, 14 nt, Escherichia coli CFT073
aagcgccaucaaug

SEQ ID NO: 2591988 - RNA, 19 nt, Escherichia coli CFT073
aagcgccgaguaaaaaaac

SEQ ID NO: 2591989 - RNA, 20 nt, Escherichia coli CFT073
aagcgccggaugcgacgcau

SEQ ID NO: 2591990 - RNA, 13 nt, Escherichia coli CFT073
aagcgccgggaau

SEQ ID NO: 2591991 - RNA, 15 nt, Escherichia coli CFT073
aagcgccucaagcuc

SEQ ID NO: 2591992 - RNA, 17 nt, Escherichia coli CFT073
aagcgcgaucgcuaccu

SEQ ID NO: 2591993 - RNA, 22 nt, Escherichia coli CFT073
aagcgcgccguaugcgaagcuu

SEQ ID NO: 2591994 - RNA, 18 nt, Escherichia coli CFT073
aagcgcggauuuuauuca

SEQ ID NO: 2591995 - RNA, 18 nt, Escherichia coli CFT073
aagcgcggcagugacagc

SEQ ID NO: 2591996 - RNA, 17 nt, Escherichia coli CFT073
aagcgcguccugaucga

SEQ ID NO: 2591997 - RNA, 20 nt, Escherichia coli CFT073
aagcgcguuucugcgcuucu

SEQ ID NO: 2591998 - RNA, 14 nt, Escherichia coli CFT073
aagcggaugcgauu

SEQ ID NO: 2591999 - RNA, 13 nt, Escherichia coli CFT073
aagcggcacugcu

SEQ ID NO: 2592000 - RNA, 13 nt, Escherichia coli CFT073
aagcggcagagga

SEQ ID NO: 2592001 - RNA, 22 nt, Escherichia coli CFT073
aagcggcagaggaggagagcag

SEQ ID NO: 2592002 - RNA, 20 nt, Escherichia coli CFT073
aagcggcaguuucagccagu

SEQ ID NO: 2592003 - RNA, 21 nt, Escherichia coli CFT073
aagcggguuuuuuaucagaca

SEQ ID NO: 2592004 - RNA, 15 nt, Escherichia coli CFT073
aagcgguguuuucag

SEQ ID NO: 2592005 - RNA, 17 nt, Escherichia coli CFT073
aagcgguguuuucaggu

SEQ ID NO: 2592006 - RNA, 22 nt, Escherichia coli CFT073
aagcguccauuuacccacagac

SEQ ID NO: 2592007 - RNA, 21 nt, Escherichia coli CFT073
aagcgucgcauccggcaucaa

SEQ ID NO: 2592008 - RNA, 21 nt, Escherichia coli CFT073
aagcgucgccgccgccagcgc

SEQ ID NO: 2592009 - RNA, 18 nt, Escherichia coli CFT073
aagcgugaaacaaaucac

SEQ ID NO: 2592010 - RNA, 13 nt, Escherichia coli CFT073
aagcguugucagc

SEQ ID NO: 2592011 - RNA, 16 nt, Escherichia coli CFT073
aagcguuuucugccag

SEQ ID NO: 2592012 - RNA, 17 nt, Escherichia coli CFT073
aagcguuuucugccaga

SEQ ID NO: 2592013 - RNA, 23 nt, Escherichia coli CFT073
aagcuauuaauccauaaccauaa

SEQ ID NO: 2592014 - RNA, 19 nt, Escherichia coli CFT073
aagcuccgguacucaucag

SEQ ID NO: 2592015 - RNA, 14 nt, Escherichia coli CFT073
aagcucguuguuua

SEQ ID NO: 2592016 - RNA, 13 nt, Escherichia coli CFT073
aagcucucagcau

SEQ ID NO: 2592017 - RNA, 16 nt, Escherichia coli CFT073
aagcucucuuccaguu

SEQ ID NO: 2592018 - RNA, 15 nt, Escherichia coli CFT073
aagcugaacagucgc

SEQ ID NO: 2592019 - RNA, 17 nt, Escherichia coli CFT073
aagcugaacagucgcug

SEQ ID NO: 2592020 - RNA, 20 nt, Escherichia coli CFT073
aagcugacaggcgcugauga

SEQ ID NO: 2592021 - RNA, 16 nt, Escherichia coli CFT073
aagcugaccagacagu

SEQ ID NO: 2592022 - RNA, 23 nt, Escherichia coli CFT073
aagcugagguauuucgucuaagc

SEQ ID NO: 2592023 - RNA, 23 nt, Escherichia coli CFT073
aagcugauuuuauuucaaaauua

SEQ ID NO: 2592024 - RNA, 15 nt, Escherichia coli CFT073
aagcugcaucuggcg

SEQ ID NO: 2592025 - RNA, 18 nt, Escherichia coli CFT073
aagcugccgcuccuucac

SEQ ID NO: 2592026 - RNA, 16 nt, Escherichia coli CFT073
aagcugccuugccagg

SEQ ID NO: 2592027 - RNA, 20 nt, Escherichia coli CFT073
aagcugcucggcaauuugug

SEQ ID NO: 2592028 - RNA, 13 nt, Escherichia coli CFT073
aagcugcugacau

SEQ ID NO: 2592029 - RNA, 20 nt, Escherichia coli CFT073
aagcugcugaccaccagcac

SEQ ID NO: 2592030 - RNA, 11 nt, Escherichia coli CFT073
aagcugcugcu

SEQ ID NO: 2592031 - RNA, 17 nt, Escherichia coli CFT073
aagcuggaaaucaaugg

SEQ ID NO: 2592032 - RNA, 17 nt, Escherichia coli CFT073
aagcuggcgaauggcgu

SEQ ID NO: 2592033 - RNA, 20 nt, Escherichia coli CFT073
aagcuggguuaauaccgagc

SEQ ID NO: 2592034 - RNA, 14 nt, Escherichia coli CFT073
aagcuguacccguu

SEQ ID NO: 2592035 - RNA, 19 nt, Escherichia coli CFT073
aagcuguucagauacacca

SEQ ID NO: 2592036 - RNA, 15 nt, Escherichia coli CFT073
aagcuguuucagugu

SEQ ID NO: 2592037 - RNA, 13 nt, Escherichia coli CFT073
aagcuugucauua

SEQ ID NO: 2592038 - RNA, 17 nt, Escherichia coli CFT073
aagcuuuccggaaaaau

SEQ ID NO: 2592039 - RNA, 19 nt, Escherichia coli CFT073
aagcuuuccggaaaaauca

SEQ ID NO: 2592040 - RNA, 18 nt, Escherichia coli CFT073
aaggaaauguuccggguu

SEQ ID NO: 2592041 - RNA, 24 nt, Escherichia coli CFT073
aaggaacgcugcauacucugcaac

SEQ ID NO: 2592042 - RNA, 23 nt, Escherichia coli CFT073
aaguaccauugaucgauaagcca

SEQ ID NO: 2592043 - RNA, 21 nt, Escherichia coli CFT073
aaguacgauacaaaagcaccg

SEQ ID NO: 2592044 - RNA, 17 nt, Escherichia coli CFT073
aaguacgcuucacgcac

SEQ ID NO: 2592045 - RNA, 18 nt, Escherichia coli CFT073
aaguacgcuucacgcacc

SEQ ID NO: 2592046 - RNA, 16 nt, Escherichia coli CFT073
aaguacguuuucuucu

SEQ ID NO: 2592047 - RNA, 21 nt, Escherichia coli CFT073
aaguacucuuugaacagccag

SEQ ID NO: 2592048 - RNA, 22 nt, Escherichia coli CFT073
aaguacugauugacgcguucgc

SEQ ID NO: 2592049 - RNA, 20 nt, Escherichia coli CFT073
aaguagagcgaaacgaaagu

SEQ ID NO: 2592050 - RNA, 14 nt, Escherichia coli CFT073
aaguagcagguaau

SEQ ID NO: 2592051 - RNA, 17 nt, Escherichia coli CFT073
aaguagcgcagcagaua

SEQ ID NO: 2592052 - RNA, 22 nt, Escherichia coli CFT073
aaguaggccguacagcccagga

SEQ ID NO: 2592053 - RNA, 15 nt, Escherichia coli CFT073
aaguaguaaugauca

SEQ ID NO: 2592054 - RNA, 23 nt, Escherichia coli CFT073
aaguaguacgcgggaauagcuca

SEQ ID NO: 2592055 - RNA, 13 nt, Escherichia coli CFT073
aaguaucaaacag

SEQ ID NO: 2592056 - RNA, 16 nt, Escherichia coli CFT073
aaguaucaaacagaaa

SEQ ID NO: 2592057 - RNA, 21 nt, Escherichia coli CFT073
aaguaucaaacagaaaaacga

SEQ ID NO: 2592058 - RNA, 13 nt, Escherichia coli CFT073
aagucaaacugau

SEQ ID NO: 2592059 - RNA, 13 nt, Escherichia coli CFT073
aagucaaacuggu

SEQ ID NO: 2592060 - RNA, 19 nt, Escherichia coli CFT073
aagucacccgauaaauaau

SEQ ID NO: 2592061 - RNA, 20 nt, Escherichia coli CFT073
aagucagauuagaacugaua

SEQ ID NO: 2592062 - RNA, 12 nt, Escherichia coli CFT073
aagucaggcaau

SEQ ID NO: 2592063 - RNA, 19 nt, Escherichia coli CFT073
aagucaggcaauucuuucc

SEQ ID NO: 2592064 - RNA, 21 nt, Escherichia coli CFT073
aagucauccggcgucaucuua

SEQ ID NO: 2592065 - RNA, 13 nt, Escherichia coli CFT073
aagucauugauaa

SEQ ID NO: 2592066 - RNA, 16 nt, Escherichia coli CFT073
aaguccagcaccguca

SEQ ID NO: 2592067 - RNA, 18 nt, Escherichia coli CFT073
aagucccgaccacacaaa

SEQ ID NO: 2592068 - RNA, 19 nt, Escherichia coli CFT073
aagucccgaccacacaaag

SEQ ID NO: 2592069 - RNA, 22 nt, Escherichia coli CFT073
aagucccgaccacacaaagugc

SEQ ID NO: 2592070 - RNA, 21 nt, Escherichia coli CFT073
aagucgaacgguaacaggaaa

SEQ ID NO: 2592071 - RNA, 17 nt, Escherichia coli CFT073
aagucggggagaaaguu

SEQ ID NO: 2592072 - RNA, 14 nt, Escherichia coli CFT073
aagucggucacagu

SEQ ID NO: 2592073 - RNA, 20 nt, Escherichia coli CFT073
aagucguaggccugauaaga

SEQ ID NO: 2592074 - RNA, 18 nt, Escherichia coli CFT073
aagucucaagagugaaca

SEQ ID NO: 2592075 - RNA, 16 nt, Escherichia coli CFT073
aagucucagaaaguaa

SEQ ID NO: 2592076 - RNA, 18 nt, Escherichia coli CFT073
aagucuccauuuuuuugc

SEQ ID NO: 2592077 - RNA, 22 nt, Escherichia coli CFT073
aagucugcgucaucggcagcau

SEQ ID NO: 2592078 - RNA, 17 nt, Escherichia coli CFT073
aagucuggcaggaaaua

SEQ ID NO: 2592079 - RNA, 23 nt, Escherichia coli CFT073
aagucuuccggugcaucaacaua

SEQ ID NO: 2592080 - RNA, 14 nt, Escherichia coli CFT073
aagugaacuuucuc

SEQ ID NO: 2592081 - RNA, 15 nt, Escherichia coli CFT073
aagugaacuuucucu

SEQ ID NO: 2592082 - RNA, 16 nt, Escherichia coli CFT073
aagugacacugucacc

SEQ ID NO: 2592083 - RNA, 20 nt, Escherichia coli CFT073
aagugagcgauucaaauucg

SEQ ID NO: 2592084 - RNA, 14 nt, Escherichia coli CFT073
aagugaucauccau

SEQ ID NO: 2592085 - RNA, 15 nt, Escherichia coli CFT073
aagugaucccacauc

SEQ ID NO: 2592086 - RNA, 19 nt, Escherichia coli CFT073
aagugcagccauuuuacuc

SEQ ID NO: 2592087 - RNA, 18 nt, Escherichia coli CFT073
aagugcauauacaaccaa

SEQ ID NO: 2592088 - RNA, 17 nt, Escherichia coli CFT073
aagugcgagucgucagu

SEQ ID NO: 2592089 - RNA, 16 nt, Escherichia coli CFT073
aagugcgcguuguuca

SEQ ID NO: 2592090 - RNA, 17 nt, Escherichia coli CFT073
aagugcggcgcaccagc

SEQ ID NO: 2592091 - RNA, 13 nt, Escherichia coli CFT073
aagugcugcaacc

SEQ ID NO: 2592092 - RNA, 14 nt, Escherichia coli CFT073
aaguggaaaucccc

SEQ ID NO: 2592093 - RNA, 21 nt, Escherichia coli CFT073
aaguggaaauccccaucaggu

SEQ ID NO: 2592094 - RNA, 14 nt, Escherichia coli CFT073
aaguggacgaacag

SEQ ID NO: 2592095 - RNA, 17 nt, Escherichia coli CFT073
aaguggagcccucaagc

SEQ ID NO: 2592096 - RNA, 23 nt, Escherichia coli CFT073
aaguggcggggucgugcagaacg

SEQ ID NO: 2592097 - RNA, 15 nt, Escherichia coli CFT073
aaguggcugaccauc

SEQ ID NO: 2592098 - RNA, 16 nt, Escherichia coli CFT073
aagugggcgacaaagu

SEQ ID NO: 2592099 - RNA, 17 nt, Escherichia coli CFT073
aagugggcgacaaaguu

SEQ ID NO: 2592100 - RNA, 22 nt, Escherichia coli CFT073
aagugggcgacaaaguugaagc

SEQ ID NO: 2592101 - RNA, 15 nt, Escherichia coli CFT073
aagugguauugaauc

SEQ ID NO: 2592102 - RNA, 18 nt, Escherichia coli CFT073
aaguggugaugauacuug

SEQ ID NO: 2592103 - RNA, 20 nt, Escherichia coli CFT073
aaguggugucagaagaaaaa

SEQ ID NO: 2592104 - RNA, 18 nt, Escherichia coli CFT073
aagugugaugguauucau

SEQ ID NO: 2592105 - RNA, 19 nt, Escherichia coli CFT073
aaguguucgaccaccgguu

SEQ ID NO: 2592106 - RNA, 18 nt, Escherichia coli CFT073
aaguguuggcgacaucga

SEQ ID NO: 2592107 - RNA, 15 nt, Escherichia coli CFT073
aaguguuguauuaua

SEQ ID NO: 2592108 - RNA, 16 nt, Escherichia coli CFT073
aaguuaauccacagca

SEQ ID NO: 2592109 - RNA, 13 nt, Escherichia coli CFT073
aaguuaccgcgcc

SEQ ID NO: 2592110 - RNA, 21 nt, Escherichia coli CFT073
aaguuaccggaagcgccaccc

SEQ ID NO: 2592111 - RNA, 16 nt, Escherichia coli CFT073
aaguuacuaaaaguaa

SEQ ID NO: 2592112 - RNA, 22 nt, Escherichia coli CFT073
aaguuacuaaaaguaaauaaga

SEQ ID NO: 2592113 - RNA, 20 nt, Escherichia coli CFT073
aaguuaguaaaacuauugua

SEQ ID NO: 2592114 - RNA, 14 nt, Escherichia coli CFT073
aaguuauuggcacu

SEQ ID NO: 2592115 - RNA, 23 nt, Escherichia coli CFT073
aaguucaaguuugcuucagaaga

SEQ ID NO: 2592116 - RNA, 17 nt, Escherichia coli CFT073
aaguucauccauaccac

SEQ ID NO: 2592117 - RNA, 17 nt, Escherichia coli CFT073
aaguuccuguaaagagu

SEQ ID NO: 2592118 - RNA, 18 nt, Escherichia coli CFT073
aaguucgaaccaacaaua

SEQ ID NO: 2592119 - RNA, 15 nt, Escherichia coli CFT073
aaguucgguaggccg

SEQ ID NO: 2592120 - RNA, 20 nt, Escherichia coli CFT073
aaguucguccccaccaguga

SEQ ID NO: 2592121 - RNA, 23 nt, Escherichia coli CFT073
aaguugaagccgaacagucgcug

SEQ ID NO: 2592122 - RNA, 21 nt, Escherichia coli CFT073
aaguugaagcugaacagucgc

SEQ ID NO: 2592123 - RNA, 16 nt, Escherichia coli CFT073
aaguugaucgcccaug

SEQ ID NO: 2592124 - RNA, 12 nt, Escherichia coli CFT073
aaguugcaaugg

SEQ ID NO: 2592125 - RNA, 19 nt, Escherichia coli CFT073
aaguugccggauguguugc

SEQ ID NO: 2592126 - RNA, 19 nt, Escherichia coli CFT073
aaguuggcguucacugccg

SEQ ID NO: 2592127 - RNA, 20 nt, Escherichia coli CFT073
aaguuggugauguauaucgg

SEQ ID NO: 2592128 - RNA, 16 nt, Escherichia coli CFT073
aaguuguaauuccuga

SEQ ID NO: 2592129 - RNA, 21 nt, Escherichia coli CFT073
aaguuuaauccguauuccuga

SEQ ID NO: 2592130 - RNA, 21 nt, Escherichia coli CFT073
aaguuugaucggagaacagga

SEQ ID NO: 2592131 - RNA, 22 nt, Escherichia coli CFT073
aaguuuggaagaccuuccagaa

SEQ ID NO: 2592132 - RNA, 22 nt, Escherichia coli CFT073
aaguuugugccgccggaaucaa

SEQ ID NO: 2592133 - RNA, 16 nt, Escherichia coli CFT073
aaguuuguuaaccacc

SEQ ID NO: 2592134 - RNA, 22 nt, Escherichia coli CFT073
aaguuuuccgcuucuucuucca

SEQ ID NO: 2592135 - RNA, 23 nt, Escherichia coli CFT073
aaguuuuccguacucaaugccag

SEQ ID NO: 2592136 - RNA, 19 nt, Escherichia coli CFT073
aaguuuugucgcugauucg

SEQ ID NO: 2592137 - RNA, 16 nt, Escherichia coli CFT073
aaguuuuuaaauaaca

SEQ ID NO: 2592138 - RNA, 23 nt, Escherichia coli CFT073
aaguuuuuauauuuuuugcuugu

SEQ ID NO: 2592139 - RNA, 14 nt, Escherichia coli CFT073
aaguuuuucaacac

SEQ ID NO: 2592140 - RNA, 21 nt, Escherichia coli CFT073
aaguuuuuugcgaaaaauaaa

SEQ ID NO: 2592141 - RNA, 17 nt, Escherichia coli CFT073
aauaaaaaaacgccaga

SEQ ID NO: 2592142 - RNA, 14 nt, Escherichia coli CFT073
aauaaaaaaugcgc

SEQ ID NO: 2592143 - RNA, 12 nt, Escherichia coli CFT073
aauaaaaagcgg

SEQ ID NO: 2592144 - RNA, 13 nt, Escherichia coli CFT073
aauaaaacaaaua

SEQ ID NO: 2592145 - RNA, 14 nt, Escherichia coli CFT073
aauaaaacagggcg

SEQ ID NO: 2592146 - RNA, 14 nt, Escherichia coli CFT073
aauaaaacaucacc

SEQ ID NO: 2592147 - RNA, 11 nt, Escherichia coli CFT073
aauaaaagaaa

SEQ ID NO: 2592148 - RNA, 14 nt, Escherichia coli CFT073
aauaaacaaugauu

SEQ ID NO: 2592149 - RNA, 14 nt, Escherichia coli CFT073
aauaaacaccagca

SEQ ID NO: 2592150 - RNA, 19 nt, Escherichia coli CFT073
aauaccgaagaguaaccaa

SEQ ID NO: 2592151 - RNA, 23 nt, Escherichia coli CFT073
aauaccgaagaguaaccaaacgu

SEQ ID NO: 2592152 - RNA, 18 nt, Escherichia coli CFT073
aauaccgacuucagccag

SEQ ID NO: 2592153 - RNA, 20 nt, Escherichia coli CFT073
aauaccgauaaguacguuuu

SEQ ID NO: 2592154 - RNA, 15 nt, Escherichia coli CFT073
aauaccgauaucgcc

SEQ ID NO: 2592155 - RNA, 15 nt, Escherichia coli CFT073
aauaccgccaacaug

SEQ ID NO: 2592156 - RNA, 16 nt, Escherichia coli CFT073
aauaccgccaacaugc

SEQ ID NO: 2592157 - RNA, 19 nt, Escherichia coli CFT073
aauaccgccugcaaauaaa

SEQ ID NO: 2592158 - RNA, 21 nt, Escherichia coli CFT073
aauaccgcgagauauccacau

SEQ ID NO: 2592159 - RNA, 15 nt, Escherichia coli CFT073
aauaccggcauccag

SEQ ID NO: 2592160 - RNA, 21 nt, Escherichia coli CFT073
aauaccggcgucccaucggca

SEQ ID NO: 2592161 - RNA, 14 nt, Escherichia coli CFT073
aauaccguaaaacu

SEQ ID NO: 2592162 - RNA, 22 nt, Escherichia coli CFT073
aauaccguucauuaacgcccca

SEQ ID NO: 2592163 - RNA, 19 nt, Escherichia coli CFT073
aauaccguucucuuuauaa

SEQ ID NO: 2592164 - RNA, 24 nt, Escherichia coli CFT073
aauaccguucucuuuauaaaguaa

SEQ ID NO: 2592165 - RNA, 23 nt, Escherichia coli CFT073
aauaccugagacaaacagucuca

SEQ ID NO: 2592166 - RNA, 14 nt, Escherichia coli CFT073
aauaccugcaccaa

SEQ ID NO: 2592167 - RNA, 15 nt, Escherichia coli CFT073
aauaccugcaccaac

SEQ ID NO: 2592168 - RNA, 14 nt, Escherichia coli CFT073
aauacgaaucacau

SEQ ID NO: 2592169 - RNA, 15 nt, Escherichia coli CFT073
aauacgauccugagc

SEQ ID NO: 2592170 - RNA, 13 nt, Escherichia coli CFT073
aauacgcaccaca

SEQ ID NO: 2592171 - RNA, 21 nt, Escherichia coli CFT073
aauacgcaucaccucaccggu

SEQ ID NO: 2592172 - RNA, 13 nt, Escherichia coli CFT073
aauacgccccaga

SEQ ID NO: 2592173 - RNA, 15 nt, Escherichia coli CFT073
aauacgccccagaau

SEQ ID NO: 2592174 - RNA, 24 nt, Escherichia coli CFT073
aauacgcccgguggcgguuuuguc

SEQ ID NO: 2592175 - RNA, 17 nt, Escherichia coli CFT073
aauacgccgauaucgcu

SEQ ID NO: 2592176 - RNA, 15 nt, Escherichia coli CFT073
aauacgcgauuuuuc

SEQ ID NO: 2592177 - RNA, 20 nt, Escherichia coli CFT073
aauacgcgguacguuuucca

SEQ ID NO: 2592178 - RNA, 20 nt, Escherichia coli CFT073
aauacgcucgaacagcuggu

SEQ ID NO: 2592179 - RNA, 15 nt, Escherichia coli CFT073
aauacgucuuuagga

SEQ ID NO: 2592180 - RNA, 23 nt, Escherichia coli CFT073
aauacguugcaaauauuccauca

SEQ ID NO: 2592181 - RNA, 19 nt, Escherichia coli CFT073
aauacguugugauuucuga

SEQ ID NO: 2592182 - RNA, 22 nt, Escherichia coli CFT073
aauacguugugauuucugacuu

SEQ ID NO: 2592183 - RNA, 16 nt, Escherichia coli CFT073
aauacguuuaugucgc

SEQ ID NO: 2592184 - RNA, 20 nt, Escherichia coli CFT073
aauacguuuaugucgcaucc

SEQ ID NO: 2592185 - RNA, 21 nt, Escherichia coli CFT073
aauacguuuaugucgcauccu

SEQ ID NO: 2592186 - RNA, 13 nt, Escherichia coli CFT073
aauacguuucaua

SEQ ID NO: 2592187 - RNA, 20 nt, Escherichia coli CFT073
aauacuaaauaugaaaaugc

SEQ ID NO: 2592188 - RNA, 13 nt, Escherichia coli CFT073
aauacucauuaau

SEQ ID NO: 2592189 - RNA, 14 nt, Escherichia coli CFT073
aauacucauuaauu

SEQ ID NO: 2592190 - RNA, 22 nt, Escherichia coli CFT073
aauacucauuaauuucaggcug

SEQ ID NO: 2592191 - RNA, 17 nt, Escherichia coli CFT073
aauacucugcacguuuu

SEQ ID NO: 2592192 - RNA, 20 nt, Escherichia coli CFT073
aauacucuucgcggcuguug

SEQ ID NO: 2592193 - RNA, 19 nt, Escherichia coli CFT073
aauacugcaacuucacggc

SEQ ID NO: 2592194 - RNA, 19 nt, Escherichia coli CFT073
aauacugccuauugcucua

SEQ ID NO: 2592195 - RNA, 21 nt, Escherichia coli CFT073
aauacuucaacauaagcaaau

SEQ ID NO: 2592196 - RNA, 19 nt, Escherichia coli CFT073
aauacuuugcagaucgcgg

SEQ ID NO: 2592197 - RNA, 19 nt, Escherichia coli CFT073
aauagaaaguugccagaua

SEQ ID NO: 2592198 - RNA, 15 nt, Escherichia coli CFT073
aauagaccggagaaa

SEQ ID NO: 2592199 - RNA, 21 nt, Escherichia coli CFT073
aauagacugcacugaauggca

SEQ ID NO: 2592200 - RNA, 11 nt, Escherichia coli CFT073
aauagagaaau

SEQ ID NO: 2592201 - RNA, 16 nt, Escherichia coli CFT073
aauagagacaaaguaa

SEQ ID NO: 2592202 - RNA, 21 nt, Escherichia coli CFT073
aauagagugguuagagcacag

SEQ ID NO: 2592203 - RNA, 21 nt, Escherichia coli CFT073
aauagaguuacuauccacagc

SEQ ID NO: 2592204 - RNA, 16 nt, Escherichia coli CFT073
aauagauaauuuugaa

SEQ ID NO: 2592205 - RNA, 23 nt, Escherichia coli CFT073
aauagauauagccuaacacagca

SEQ ID NO: 2592206 - RNA, 22 nt, Escherichia coli CFT073
aauagaucgccagaaaguggca

SEQ ID NO: 2592207 - RNA, 15 nt, Escherichia coli CFT073
aauagauuuucagaa

SEQ ID NO: 2592208 - RNA, 16 nt, Escherichia coli CFT073
aauagcaaaauauaaa

SEQ ID NO: 2592209 - RNA, 18 nt, Escherichia coli CFT073
aauagcagacaaugccga

SEQ ID NO: 2592210 - RNA, 20 nt, Escherichia coli CFT073
aauagccagcagagcaaaaa

SEQ ID NO: 2592211 - RNA, 12 nt, Escherichia coli CFT073
aauagccagcgc

SEQ ID NO: 2592212 - RNA, 11 nt, Escherichia coli CFT073
aauagccugau

SEQ ID NO: 2592213 - RNA, 20 nt, Escherichia coli CFT073
aauagcgaacagacaaaaag

SEQ ID NO: 2592214 - RNA, 14 nt, Escherichia coli CFT073
aauagcgaagaaua

SEQ ID NO: 2592215 - RNA, 20 nt, Escherichia coli CFT073
aauagcgucuacuaacgcuu

SEQ ID NO: 2592216 - RNA, 17 nt, Escherichia coli CFT073
aauagcgugcuuaccuu

SEQ ID NO: 2592217 - RNA, 16 nt, Escherichia coli CFT073
aauagcguugcagaug

SEQ ID NO: 2592218 - RNA, 14 nt, Escherichia coli CFT073
aauagcucaaugaa

SEQ ID NO: 2592219 - RNA, 14 nt, Escherichia coli CFT073
aauagcucugcuaa

SEQ ID NO: 2592220 - RNA, 23 nt, Escherichia coli CFT073
aauagcugccagccccucagcgg

SEQ ID NO: 2592221 - RNA, 12 nt, Escherichia coli CFT073
aauagcuuuaac

SEQ ID NO: 2592222 - RNA, 14 nt, Escherichia coli CFT073
aauagcuuuaccca

SEQ ID NO: 2592223 - RNA, 19 nt, Escherichia coli CFT073
aauaggcauauagccgcca

SEQ ID NO: 2592224 - RNA, 23 nt, Escherichia coli CFT073
aauagguguuaauggaauaacga

SEQ ID NO: 2592225 - RNA, 18 nt, Escherichia coli CFT073
aauaguaagaaccacagc

SEQ ID NO: 2592226 - RNA, 20 nt, Escherichia coli CFT073
aauaguacacagacgaaggu

SEQ ID NO: 2592227 - RNA, 11 nt, Escherichia coli CFT073
aauaguacauu

SEQ ID NO: 2592228 - RNA, 18 nt, Escherichia coli CFT073
aauagucaguauuuuccc

SEQ ID NO: 2592229 - RNA, 12 nt, Escherichia coli CFT073
aauagucaguuc

SEQ ID NO: 2592230 - RNA, 14 nt, Escherichia coli CFT073
aauagucaguucac

SEQ ID NO: 2592231 - RNA, 18 nt, Escherichia coli CFT073
aauagucgccagcucugc

SEQ ID NO: 2592232 - RNA, 15 nt, Escherichia coli CFT073
aauagugauguucug

SEQ ID NO: 2592233 - RNA, 18 nt, Escherichia coli CFT073
aauagugcuucaaauauu

SEQ ID NO: 2592234 - RNA, 18 nt, Escherichia coli CFT073
aauaguuacgaaaaggau

SEQ ID NO: 2592235 - RNA, 23 nt, Escherichia coli CFT073
aauauaagcgcuaugcgcauccu

SEQ ID NO: 2592236 - RNA, 13 nt, Escherichia coli CFT073
aauauaagguucu

SEQ ID NO: 2592237 - RNA, 21 nt, Escherichia coli CFT073
aauauacagccuuaacaagau

SEQ ID NO: 2592238 - RNA, 19 nt, Escherichia coli CFT073
aauauacauacuguaaaua

SEQ ID NO: 2592239 - RNA, 13 nt, Escherichia coli CFT073
aauauauaaagau

SEQ ID NO: 2592240 - RNA, 21 nt, Escherichia coli CFT073
aauauaucagccugaaugcuu

SEQ ID NO: 2592241 - RNA, 16 nt, Escherichia coli CFT073
aauauauucauauuuu

SEQ ID NO: 2592242 - RNA, 23 nt, Escherichia coli CFT073
aauauauuccccggucagcagca

SEQ ID NO: 2592243 - RNA, 21 nt, Escherichia coli CFT073
aauauauuccuauauauuuag

SEQ ID NO: 2592244 - RNA, 21 nt, Escherichia coli CFT073
aauaucagcccaaaaauugcc

SEQ ID NO: 2592245 - RNA, 22 nt, Escherichia coli CFT073
aauaucagcccaaaaauugccc

SEQ ID NO: 2592246 - RNA, 12 nt, Escherichia coli CFT073
aauaucaucacc

SEQ ID NO: 2592247 - RNA, 18 nt, Escherichia coli CFT073
aauaucaucgauuuucug

SEQ ID NO: 2592248 - RNA, 20 nt, Escherichia coli CFT073
aauaucauuaagccgaucgu

SEQ ID NO: 2592249 - RNA, 20 nt, Escherichia coli CFT073
aauaucauucgguugccagc

SEQ ID NO: 2592250 - RNA, 13 nt, Escherichia coli CFT073
aauauccagcagg

SEQ ID NO: 2592251 - RNA, 22 nt, Escherichia coli CFT073
aauauccauguaccagacugac

SEQ ID NO: 2592252 - RNA, 13 nt, Escherichia coli CFT073
aauauccauuaaa

SEQ ID NO: 2592253 - RNA, 18 nt, Escherichia coli CFT073
aauauccauuaaaacuga

SEQ ID NO: 2592254 - RNA, 20 nt, Escherichia coli CFT073
aauaucccaacgcaaaacca

SEQ ID NO: 2592255 - RNA, 23 nt, Escherichia coli CFT073
aauaucccaacgcaaaaccaagc

SEQ ID NO: 2592256 - RNA, 15 nt, Escherichia coli CFT073
aauauccccagccua

SEQ ID NO: 2592257 - RNA, 14 nt, Escherichia coli CFT073
aauauccgccguau

SEQ ID NO: 2592258 - RNA, 14 nt, Escherichia coli CFT073
aaucaccgccacgc

SEQ ID NO: 2592259 - RNA, 14 nt, Escherichia coli CFT073
aaucaccgcuucac

SEQ ID NO: 2592260 - RNA, 17 nt, Escherichia coli CFT073
aaucaccucaucaccac

SEQ ID NO: 2592261 - RNA, 22 nt, Escherichia coli CFT073
aaucaccucaucaccacagaca

SEQ ID NO: 2592262 - RNA, 20 nt, Escherichia coli CFT073
aaucaccucuuuguaccagu

SEQ ID NO: 2592263 - RNA, 15 nt, Escherichia coli CFT073
aaucaccuuacauca

SEQ ID NO: 2592264 - RNA, 12 nt, Escherichia coli CFT073
aaucacggcaaa

SEQ ID NO: 2592265 - RNA, 16 nt, Escherichia coli CFT073
aaucacgucauauucg

SEQ ID NO: 2592266 - RNA, 18 nt, Escherichia coli CFT073
aaucacgucauauucgcc

SEQ ID NO: 2592267 - RNA, 14 nt, Escherichia coli CFT073
aaucacugccagaa

SEQ ID NO: 2592268 - RNA, 14 nt, Escherichia coli CFT073
aaucacuuucugcg

SEQ ID NO: 2592269 - RNA, 21 nt, Escherichia coli CFT073
aaucacuuucugcgccagcga

SEQ ID NO: 2592270 - RNA, 16 nt, Escherichia coli CFT073
aaucagaaacaaauac

SEQ ID NO: 2592271 - RNA, 13 nt, Escherichia coli CFT073
aaucagaaaggcg

SEQ ID NO: 2592272 - RNA, 14 nt, Escherichia coli CFT073
aaucagaaucgcgc

SEQ ID NO: 2592273 - RNA, 12 nt, Escherichia coli CFT073
aaucagauaaaa

SEQ ID NO: 2592274 - RNA, 19 nt, Escherichia coli CFT073
aaucagauacaccgcgaag

SEQ ID NO: 2592275 - RNA, 11 nt, Escherichia coli CFT073
aaucagaucaa

SEQ ID NO: 2592276 - RNA, 19 nt, Escherichia coli CFT073
aaucagaucguugaccugg

SEQ ID NO: 2592277 - RNA, 18 nt, Escherichia coli CFT073
aaucagauggcggcuggc

SEQ ID NO: 2592278 - RNA, 15 nt, Escherichia coli CFT073
aaucagauugaucau

SEQ ID NO: 2592279 - RNA, 11 nt, Escherichia coli CFT073
aaucagcacac

SEQ ID NO: 2592280 - RNA, 16 nt, Escherichia coli CFT073
aaucagcacacauaac

SEQ ID NO: 2592281 - RNA, 15 nt, Escherichia coli CFT073
aaucagcacagagau

SEQ ID NO: 2592282 - RNA, 20 nt, Escherichia coli CFT073
aaucagcacuacugccagau

SEQ ID NO: 2592283 - RNA, 14 nt, Escherichia coli CFT073
aaucagcaucaacc

SEQ ID NO: 2592284 - RNA, 16 nt, Escherichia coli CFT073
aaucagcaucaacccg

SEQ ID NO: 2592285 - RNA, 18 nt, Escherichia coli CFT073
aaucagccaguaaaccaa

SEQ ID NO: 2592286 - RNA, 22 nt, Escherichia coli CFT073
aaucagccauacggucugccag

SEQ ID NO: 2592287 - RNA, 18 nt, Escherichia coli CFT073
aaucagccccuucgccag

SEQ ID NO: 2592288 - RNA, 19 nt, Escherichia coli CFT073
aaucagccccuucgccagu

SEQ ID NO: 2592289 - RNA, 16 nt, Escherichia coli CFT073
aaucagcccugcccag

SEQ ID NO: 2592290 - RNA, 17 nt, Escherichia coli CFT073
aaucagccuuaaucuuc

SEQ ID NO: 2592291 - RNA, 22 nt, Escherichia coli CFT073
aaucagcgagauaaugcgccag

SEQ ID NO: 2592292 - RNA, 15 nt, Escherichia coli CFT073
aaucagcgccagcgc

SEQ ID NO: 2592293 - RNA, 22 nt, Escherichia coli CFT073
aaucagcgccguagccauuacc

SEQ ID NO: 2592294 - RNA, 19 nt, Escherichia coli CFT073
aaucagcggaaaugcagag

SEQ ID NO: 2592295 - RNA, 22 nt, Escherichia coli CFT073
aaucagcggcguagggcaggcg

SEQ ID NO: 2592296 - RNA, 18 nt, Escherichia coli CFT073
aaucagcggugccgcgau

SEQ ID NO: 2592297 - RNA, 23 nt, Escherichia coli CFT073
aaucagcguaaaggccggaaccg

SEQ ID NO: 2592298 - RNA, 22 nt, Escherichia coli CFT073
aaucagcguaacgauggcaauu

SEQ ID NO: 2592299 - RNA, 16 nt, Escherichia coli CFT073
aaucagcuuauccagc

SEQ ID NO: 2592300 - RNA, 23 nt, Escherichia coli CFT073
aaucaggcaaacgcccuuaccuu

SEQ ID NO: 2592301 - RNA, 21 nt, Escherichia coli CFT073
aaucaggcgauuagcgauaaa

SEQ ID NO: 2592302 - RNA, 20 nt, Escherichia coli CFT073
aaucagguaagcgaaggugc

SEQ ID NO: 2592303 - RNA, 22 nt, Escherichia coli CFT073
aaucagguaagcgauaaaaaua

SEQ ID NO: 2592304 - RNA, 20 nt, Escherichia coli CFT073
aaucaguccacggcugcggc

SEQ ID NO: 2592305 - RNA, 22 nt, Escherichia coli CFT073
aaucaguccacggcugcggcca

SEQ ID NO: 2592306 - RNA, 21 nt, Escherichia coli CFT073
aaucagugccgcgccgcgcgg

SEQ ID NO: 2592307 - RNA, 18 nt, Escherichia coli CFT073
aaucaguucguugaucaa

SEQ ID NO: 2592308 - RNA, 22 nt, Escherichia coli CFT073
aaucaguuugcgggacaacuug

SEQ ID NO: 2592309 - RNA, 14 nt, Escherichia coli CFT073
aaucauaaaacacc

SEQ ID NO: 2592310 - RNA, 24 nt, Escherichia coli CFT073
aaucauaaacgccugacgauaggu

SEQ ID NO: 2592311 - RNA, 19 nt, Escherichia coli CFT073
aaucauaauguugcugccu

SEQ ID NO: 2592312 - RNA, 22 nt, Escherichia coli CFT073
aaucauacaggcggaaacguaa

SEQ ID NO: 2592313 - RNA, 14 nt, Escherichia coli CFT073
aaucauacucccag

SEQ ID NO: 2592314 - RNA, 13 nt, Escherichia coli CFT073
aaucauauucuuu

SEQ ID NO: 2592315 - RNA, 15 nt, Escherichia coli CFT073
aaucaucaaugccag

SEQ ID NO: 2592316 - RNA, 18 nt, Escherichia coli CFT073
aaucaucacgaucacggu

SEQ ID NO: 2592317 - RNA, 16 nt, Escherichia coli CFT073
aaucaucauaucguca

SEQ ID NO: 2592318 - RNA, 12 nt, Escherichia coli CFT073
aaucaucaugcu

SEQ ID NO: 2592319 - RNA, 13 nt, Escherichia coli CFT073
aaucaucaugcuu

SEQ ID NO: 2592320 - RNA, 13 nt, Escherichia coli CFT073
aaucauccagcac

SEQ ID NO: 2592321 - RNA, 16 nt, Escherichia coli CFT073
aaucauccgucgggcg

SEQ ID NO: 2592322 - RNA, 14 nt, Escherichia coli CFT073
aaucauccugcggc

SEQ ID NO: 2592323 - RNA, 21 nt, Escherichia coli CFT073
aaucauccugcggcagcucca

SEQ ID NO: 2592324 - RNA, 19 nt, Escherichia coli CFT073
aaucauccuguucauuuuu

SEQ ID NO: 2592325 - RNA, 17 nt, Escherichia coli CFT073
aaucaucgacuccagcg

SEQ ID NO: 2592326 - RNA, 20 nt, Escherichia coli CFT073
aaucaucgcauccagcgugu

SEQ ID NO: 2592327 - RNA, 16 nt, Escherichia coli CFT073
aaucaucgccuucauc

SEQ ID NO: 2592328 - RNA, 22 nt, Escherichia coli CFT073
aaucaucugccgguuccagcuu

SEQ ID NO: 2592329 - RNA, 17 nt, Escherichia coli CFT073
aaucaucugcgcccugg

SEQ ID NO: 2592330 - RNA, 17 nt, Escherichia coli CFT073
aaucaugcuccgcacgc

SEQ ID NO: 2592331 - RNA, 17 nt, Escherichia coli CFT073
aaucauucgcagcugca

SEQ ID NO: 2592332 - RNA, 12 nt, Escherichia coli CFT073
aaucauugauaa

SEQ ID NO: 2592333 - RNA, 18 nt, Escherichia coli CFT073
aaucauugauaauaacgu

SEQ ID NO: 2592334 - RNA, 14 nt, Escherichia coli CFT073
aaucauuucugcaa

SEQ ID NO: 2592335 - RNA, 13 nt, Escherichia coli CFT073
aauccaaaugccu

SEQ ID NO: 2592336 - RNA, 18 nt, Escherichia coli CFT073
aauccaaccucuucuuuu

SEQ ID NO: 2592337 - RNA, 14 nt, Escherichia coli CFT073
aauccacagcaaug

SEQ ID NO: 2592338 - RNA, 22 nt, Escherichia coli CFT073
aauccaccauauacuccgcacc

SEQ ID NO: 2592339 - RNA, 20 nt, Escherichia coli CFT073
aauccacucaucgccuuuca

SEQ ID NO: 2592340 - RNA, 16 nt, Escherichia coli CFT073
aauccacuucgccaga

SEQ ID NO: 2592341 - RNA, 17 nt, Escherichia coli CFT073
aauccagaaaaaaagca

SEQ ID NO: 2592342 - RNA, 15 nt, Escherichia coli CFT073
aauccagaacaccau

SEQ ID NO: 2592343 - RNA, 20 nt, Escherichia coli CFT073
aauccagacugcgcauuaaa

SEQ ID NO: 2592344 - RNA, 13 nt, Escherichia coli CFT073
aauccagcaagcu

SEQ ID NO: 2592345 - RNA, 14 nt, Escherichia coli CFT073
aauccagcaccaca

SEQ ID NO: 2592346 - RNA, 12 nt, Escherichia coli CFT073
aauccagcccca

SEQ ID NO: 2592347 - RNA, 17 nt, Escherichia coli CFT073
aauccagcgaaauaaaa

SEQ ID NO: 2592348 - RNA, 22 nt, Escherichia coli CFT073
aauccagcuaaccauccacauu

SEQ ID NO: 2592349 - RNA, 21 nt, Escherichia coli CFT073
aauccagcucggcgcuaauca

SEQ ID NO: 2592350 - RNA, 14 nt, Escherichia coli CFT073
aauccaggcaucag

SEQ ID NO: 2592351 - RNA, 15 nt, Escherichia coli CFT073
aauccaguacaugaa

SEQ ID NO: 2592352 - RNA, 20 nt, Escherichia coli CFT073
aauccagucagcgguuuuga

SEQ ID NO: 2592353 - RNA, 15 nt, Escherichia coli CFT073
aauccagucuuucgc

SEQ ID NO: 2592354 - RNA, 18 nt, Escherichia coli CFT073
aauccagucuuucgccau

SEQ ID NO: 2592355 - RNA, 21 nt, Escherichia coli CFT073
aauccagugccggaugauuca

SEQ ID NO: 2592356 - RNA, 14 nt, Escherichia coli CFT073
aauccaguugcgua

SEQ ID NO: 2592357 - RNA, 20 nt, Escherichia coli CFT073
aauccaucccgcucuguaag

SEQ ID NO: 2592358 - RNA, 18 nt, Escherichia coli CFT073
aaucccaaacaguguuuu

SEQ ID NO: 2592359 - RNA, 14 nt, Escherichia coli CFT073
aaucccaggaagcc

SEQ ID NO: 2592360 - RNA, 22 nt, Escherichia coli CFT073
aaucccaguacuguacaacaca

SEQ ID NO: 2592361 - RNA, 20 nt, Escherichia coli CFT073
aaucccaucuucgaguaaaa

SEQ ID NO: 2592362 - RNA, 21 nt, Escherichia coli CFT073
aaucccaucuucgaguaaaaa

SEQ ID NO: 2592363 - RNA, 18 nt, Escherichia coli CFT073
aauccccacaaaccaccg

SEQ ID NO: 2592364 - RNA, 15 nt, Escherichia coli CFT073
aauccccaguugugc

SEQ ID NO: 2592365 - RNA, 20 nt, Escherichia coli CFT073
aaucccgccauaacggcugu

SEQ ID NO: 2592366 - RNA, 18 nt, Escherichia coli CFT073
aaucucguggucaauauc

SEQ ID NO: 2592367 - RNA, 21 nt, Escherichia coli CFT073
aaucucguggucaauaucauc

SEQ ID NO: 2592368 - RNA, 16 nt, Escherichia coli CFT073
aaucucuaacaaccuc

SEQ ID NO: 2592369 - RNA, 12 nt, Escherichia coli CFT073
aaucucugcaag

SEQ ID NO: 2592370 - RNA, 14 nt, Escherichia coli CFT073
aaucucuucaccau

SEQ ID NO: 2592371 - RNA, 14 nt, Escherichia coli CFT073
aaucucuucaccug

SEQ ID NO: 2592372 - RNA, 18 nt, Escherichia coli CFT073
aaucucuuccagcgacac

SEQ ID NO: 2592373 - RNA, 18 nt, Escherichia coli CFT073
aaucucuuuacccagcgg

SEQ ID NO: 2592374 - RNA, 20 nt, Escherichia coli CFT073
aaucucuuuccauucuuucc

SEQ ID NO: 2592375 - RNA, 14 nt, Escherichia coli CFT073
aaucugaaaaccag

SEQ ID NO: 2592376 - RNA, 15 nt, Escherichia coli CFT073
aaucugaaaccagcg

SEQ ID NO: 2592377 - RNA, 19 nt, Escherichia coli CFT073
aaucugcucuggcagcacc

SEQ ID NO: 2592378 - RNA, 22 nt, Escherichia coli CFT073
aaucugcuuuucauacaaucgg

SEQ ID NO: 2592379 - RNA, 16 nt, Escherichia coli CFT073
aaucuggucuggugaa

SEQ ID NO: 2592380 - RNA, 21 nt, Escherichia coli CFT073
aaucuguaacaaggugaauca

SEQ ID NO: 2592381 - RNA, 14 nt, Escherichia coli CFT073
aaucuguccuucca

SEQ ID NO: 2592382 - RNA, 16 nt, Escherichia coli CFT073
aaucuguccuuccagu

SEQ ID NO: 2592383 - RNA, 23 nt, Escherichia coli CFT073
aaucuguccuuccaguaaccagc

SEQ ID NO: 2592384 - RNA, 23 nt, Escherichia coli CFT073
aaucugugugggcacucgaagau

SEQ ID NO: 2592385 - RNA, 15 nt, Escherichia coli CFT073
aaucuguugaaaaaa

SEQ ID NO: 2592386 - RNA, 22 nt, Escherichia coli CFT073
aaucuguugauuuaacagcaaa

SEQ ID NO: 2592387 - RNA, 15 nt, Escherichia coli CFT073
aaucuucaaauaaac

SEQ ID NO: 2592388 - RNA, 12 nt, Escherichia coli CFT073
aaucuuccagaa

SEQ ID NO: 2592389 - RNA, 17 nt, Escherichia coli CFT073
aaucuuccagaaugccu

SEQ ID NO: 2592390 - RNA, 18 nt, Escherichia coli CFT073
aaucuuuaccggucagga

SEQ ID NO: 2592391 - RNA, 10 nt, Escherichia coli CFT073
aaucuuuuca

SEQ ID NO: 2592392 - RNA, 11 nt, Escherichia coli CFT073
aaugaaaaacc

SEQ ID NO: 2592393 - RNA, 22 nt, Escherichia coli CFT073
aaugaaagaugaagaguggaac

SEQ ID NO: 2592394 - RNA, 12 nt, Escherichia coli CFT073
aaugaaauaaaa

SEQ ID NO: 2592395 - RNA, 14 nt, Escherichia coli CFT073
aaugaaauaaaaca

SEQ ID NO: 2592396 - RNA, 15 nt, Escherichia coli CFT073
aaugaaauaaaacaa

SEQ ID NO: 2592397 - RNA, 16 nt, Escherichia coli CFT073
aaugaaauauuuuaaa

SEQ ID NO: 2592398 - RNA, 22 nt, Escherichia coli CFT073
aaugaacgccaccccacaccag

SEQ ID NO: 2592399 - RNA, 15 nt, Escherichia coli CFT073
aaugaagucaccaaa

SEQ ID NO: 2592400 - RNA, 15 nt, Escherichia coli CFT073
aaugaauaacuuccu

SEQ ID NO: 2592401 - RNA, 18 nt, Escherichia coli CFT073
aaugaauaaguuucagca

SEQ ID NO: 2592402 - RNA, 13 nt, Escherichia coli CFT073
aaugaaugaugcg

SEQ ID NO: 2592403 - RNA, 13 nt, Escherichia coli CFT073
aaugaaugcguuc

SEQ ID NO: 2592404 - RNA, 14 nt, Escherichia coli CFT073
aaugacaacauuuu

SEQ ID NO: 2592405 - RNA, 21 nt, Escherichia coli CFT073
aaugacaauuacaaaaugaca

SEQ ID NO: 2592406 - RNA, 14 nt, Escherichia coli CFT073
aaugacagccccac

SEQ ID NO: 2592407 - RNA, 22 nt, Escherichia coli CFT073
aaugacagccccaccagcaaau

SEQ ID NO: 2592408 - RNA, 23 nt, Escherichia coli CFT073
aaugacagccccaccagcaaaua

SEQ ID NO: 2592409 - RNA, 17 nt, Escherichia coli CFT073
aaugacaguaucaccaa

SEQ ID NO: 2592410 - RNA, 18 nt, Escherichia coli CFT073
aaugacaguaucaccaac

SEQ ID NO: 2592411 - RNA, 16 nt, Escherichia coli CFT073
aaugacauaaugcaaa

SEQ ID NO: 2592412 - RNA, 14 nt, Escherichia coli CFT073
aaugacaucugcau

SEQ ID NO: 2592413 - RNA, 14 nt, Escherichia coli CFT073
aaugaccaccaaau

SEQ ID NO: 2592414 - RNA, 15 nt, Escherichia coli CFT073
aaugacccauuuucu

SEQ ID NO: 2592415 - RNA, 21 nt, Escherichia coli CFT073
aaugaccgcuaauagcgcagc

SEQ ID NO: 2592416 - RNA, 20 nt, Escherichia coli CFT073
aaugacgacaaagaccugaa

SEQ ID NO: 2592417 - RNA, 14 nt, Escherichia coli CFT073
aaugacgaugcacc

SEQ ID NO: 2592418 - RNA, 21 nt, Escherichia coli CFT073
aaugacgcgaauuaucucccc

SEQ ID NO: 2592419 - RNA, 18 nt, Escherichia coli CFT073
aaugacggacgcaacuga

SEQ ID NO: 2592420 - RNA, 19 nt, Escherichia coli CFT073
aaugacggaucuuccagcg

SEQ ID NO: 2592421 - RNA, 17 nt, Escherichia coli CFT073
aaugacguguaugcaua

SEQ ID NO: 2592422 - RNA, 21 nt, Escherichia coli CFT073
aaugacuaagcgaucgcuaaa

SEQ ID NO: 2592423 - RNA, 21 nt, Escherichia coli CFT073
aaugagaaaacuaucugaaaa

SEQ ID NO: 2592424 - RNA, 18 nt, Escherichia coli CFT073
aaugagaucaaacugccc

SEQ ID NO: 2592425 - RNA, 21 nt, Escherichia coli CFT073
aaugagauucaacaucucuau

SEQ ID NO: 2592426 - RNA, 22 nt, Escherichia coli CFT073
aaugagcgauuuguaggccuga

SEQ ID NO: 2592427 - RNA, 23 nt, Escherichia coli CFT073
aaugaggcacgacacaaugccau

SEQ ID NO: 2592428 - RNA, 22 nt, Escherichia coli CFT073
aaugaguggugaugaccacaga

SEQ ID NO: 2592429 - RNA, 18 nt, Escherichia coli CFT073
aaugauaaguuucacugg

SEQ ID NO: 2592430 - RNA, 21 nt, Escherichia coli CFT073
aaugauaauucaacagauuuc

SEQ ID NO: 2592431 - RNA, 13 nt, Escherichia coli CFT073
aaugauaugugca

SEQ ID NO: 2592432 - RNA, 19 nt, Escherichia coli CFT073
aaugauaugugcagaagcc

SEQ ID NO: 2592433 - RNA, 15 nt, Escherichia coli CFT073
aaugaucaauaauua

SEQ ID NO: 2592434 - RNA, 16 nt, Escherichia coli CFT073
aaugaucaauaauuaa

SEQ ID NO: 2592435 - RNA, 22 nt, Escherichia coli CFT073
aaugaucacuuguucagcgaug

SEQ ID NO: 2592436 - RNA, 19 nt, Escherichia coli CFT073
aaugaucagcgguuuugcc

SEQ ID NO: 2592437 - RNA, 14 nt, Escherichia coli CFT073
aaugaucugaucaa

SEQ ID NO: 2592438 - RNA, 21 nt, Escherichia coli CFT073
aaugaugcggcgcuuucagca

SEQ ID NO: 2592439 - RNA, 19 nt, Escherichia coli CFT073
aaugauggcgcguuuggug

SEQ ID NO: 2592440 - RNA, 19 nt, Escherichia coli CFT073
aaugauggugaaagcaaaa

SEQ ID NO: 2592441 - RNA, 21 nt, Escherichia coli CFT073
aaugauggugaaagcaaaaaa

SEQ ID NO: 2592442 - RNA, 15 nt, Escherichia coli CFT073
aaugauuaacagccc

SEQ ID NO: 2592443 - RNA, 18 nt, Escherichia coli CFT073
aaugauucauaaacaaua

SEQ ID NO: 2592444 - RNA, 12 nt, Escherichia coli CFT073
aaugauuuugau

SEQ ID NO: 2592445 - RNA, 14 nt, Escherichia coli CFT073
aaugcaacugccca

SEQ ID NO: 2592446 - RNA, 20 nt, Escherichia coli CFT073
aaugcaacugcccaggcaaa

SEQ ID NO: 2592447 - RNA, 15 nt, Escherichia coli CFT073
aaugcaauuacauau

SEQ ID NO: 2592448 - RNA, 17 nt, Escherichia coli CFT073
aaugcaauuuaucgcag

SEQ ID NO: 2592449 - RNA, 18 nt, Escherichia coli CFT073
aaugcacacaaaauugcc

SEQ ID NO: 2592450 - RNA, 14 nt, Escherichia coli CFT073
aaugcacccgccag

SEQ ID NO: 2592451 - RNA, 13 nt, Escherichia coli CFT073
aaugcacuccgcc

SEQ ID NO: 2592452 - RNA, 16 nt, Escherichia coli CFT073
aaugcacuuccagcgg

SEQ ID NO: 2592453 - RNA, 15 nt, Escherichia coli CFT073
aaugcagcaaccaga

SEQ ID NO: 2592454 - RNA, 17 nt, Escherichia coli CFT073
aaugcagcaaccagagc

SEQ ID NO: 2592455 - RNA, 12 nt, Escherichia coli CFT073
aaugcagcagca

SEQ ID NO: 2592456 - RNA, 12 nt, Escherichia coli CFT073
aaugcaggcguu

SEQ ID NO: 2592457 - RNA, 21 nt, Escherichia coli CFT073
aaugcagguccacgaccagcg

SEQ ID NO: 2592458 - RNA, 12 nt, Escherichia coli CFT073
aaugcaucagcu

SEQ ID NO: 2592459 - RNA, 15 nt, Escherichia coli CFT073
aaugcaucagcuggc

SEQ ID NO: 2592460 - RNA, 18 nt, Escherichia coli CFT073
aaugcauggccugaauaa

SEQ ID NO: 2592461 - RNA, 19 nt, Escherichia coli CFT073
aaugccaaauauuucuuua

SEQ ID NO: 2592462 - RNA, 21 nt, Escherichia coli CFT073
aaugccaaucuucacaucauc

SEQ ID NO: 2592463 - RNA, 20 nt, Escherichia coli CFT073
aaugccaccacaccagacca

SEQ ID NO: 2592464 - RNA, 15 nt, Escherichia coli CFT073
aaugccaccagaaac

SEQ ID NO: 2592465 - RNA, 13 nt, Escherichia coli CFT073
aaugccacccagc

SEQ ID NO: 2592466 - RNA, 17 nt, Escherichia coli CFT073
aaugccagaaacaucgg

SEQ ID NO: 2592467 - RNA, 18 nt, Escherichia coli CFT073
aaugccagcaacuggcuu

SEQ ID NO: 2592468 - RNA, 19 nt, Escherichia coli CFT073
aaugccagcgauaucgcga

SEQ ID NO: 2592469 - RNA, 15 nt, Escherichia coli CFT073
aaugccaggcuccag

SEQ ID NO: 2592470 - RNA, 17 nt, Escherichia coli CFT073
aaugccaggcuccagau

SEQ ID NO: 2592471 - RNA, 17 nt, Escherichia coli CFT073
aaugccaguucaguaaa

SEQ ID NO: 2592472 - RNA, 13 nt, Escherichia coli CFT073
aaugccauaaaag

SEQ ID NO: 2592473 - RNA, 12 nt, Escherichia coli CFT073
aaugccauauaa

SEQ ID NO: 2592474 - RNA, 15 nt, Escherichia coli CFT073
aaugccaucaccaac

SEQ ID NO: 2592475 - RNA, 16 nt, Escherichia coli CFT073
aauguggcaucagguu

SEQ ID NO: 2592476 - RNA, 17 nt, Escherichia coli CFT073
aauguggugaaaugccu

SEQ ID NO: 2592477 - RNA, 16 nt, Escherichia coli CFT073
aauguguuaauaaugc

SEQ ID NO: 2592478 - RNA, 19 nt, Escherichia coli CFT073
aauguguuuauaagccaua

SEQ ID NO: 2592479 - RNA, 17 nt, Escherichia coli CFT073
aauguugcgccucaaga

SEQ ID NO: 2592480 - RNA, 21 nt, Escherichia coli CFT073
aauguugcgcgguuagaaaau

SEQ ID NO: 2592481 - RNA, 23 nt, Escherichia coli CFT073
aauguuggcgcgcgcuuuuacug

SEQ ID NO: 2592482 - RNA, 18 nt, Escherichia coli CFT073
aauguugucgcagacgac

SEQ ID NO: 2592483 - RNA, 20 nt, Escherichia coli CFT073
aauguuuuccuguuucacgc

SEQ ID NO: 2592484 - RNA, 14 nt, Escherichia coli CFT073
aauuaaacacgggg

SEQ ID NO: 2592485 - RNA, 18 nt, Escherichia coli CFT073
aauuaaacagcccuuuga

SEQ ID NO: 2592486 - RNA, 22 nt, Escherichia coli CFT073
aauuaaacgccucugucagaaa

SEQ ID NO: 2592487 - RNA, 22 nt, Escherichia coli CFT073
aauuaaauuguucauauuaacc

SEQ ID NO: 2592488 - RNA, 17 nt, Escherichia coli CFT073
aauuaaccagaaauaga

SEQ ID NO: 2592489 - RNA, 16 nt, Escherichia coli CFT073
aauuaacgaaaucuca

SEQ ID NO: 2592490 - RNA, 13 nt, Escherichia coli CFT073
aauuaagcggcaa

SEQ ID NO: 2592491 - RNA, 19 nt, Escherichia coli CFT073
aauuacacacaacacaucg

SEQ ID NO: 2592492 - RNA, 14 nt, Escherichia coli CFT073
aauuacaccaucac

SEQ ID NO: 2592493 - RNA, 13 nt, Escherichia coli CFT073
aauuaccaacaca

SEQ ID NO: 2592494 - RNA, 22 nt, Escherichia coli CFT073
aauuaccaccagcgacagccag

SEQ ID NO: 2592495 - RNA, 14 nt, Escherichia coli CFT073
aauuaccgcaccac

SEQ ID NO: 2592496 - RNA, 19 nt, Escherichia coli CFT073
aauuaccgcaccaccagca

SEQ ID NO: 2592497 - RNA, 22 nt, Escherichia coli CFT073
aauuaccgcaccaccagcagcu

SEQ ID NO: 2592498 - RNA, 18 nt, Escherichia coli CFT073
aauuaccgcaugacaauc

SEQ ID NO: 2592499 - RNA, 19 nt, Escherichia coli CFT073
aauuaccuuuuuaccaaca

SEQ ID NO: 2592500 - RNA, 19 nt, Escherichia coli CFT073
aauuacgcaaccaguucau

SEQ ID NO: 2592501 - RNA, 16 nt, Escherichia coli CFT073
aauuacgcggugcgcc

SEQ ID NO: 2592502 - RNA, 16 nt, Escherichia coli CFT073
aauuacucaguaugca

SEQ ID NO: 2592503 - RNA, 21 nt, Escherichia coli CFT073
aauuacucucgugccagagca

SEQ ID NO: 2592504 - RNA, 22 nt, Escherichia coli CFT073
aauuacucucgugccagagcau

SEQ ID NO: 2592505 - RNA, 15 nt, Escherichia coli CFT073
aauuacugcuuaaau

SEQ ID NO: 2592506 - RNA, 15 nt, Escherichia coli CFT073
aauuacuggcggcga

SEQ ID NO: 2592507 - RNA, 15 nt, Escherichia coli CFT073
aauuacuguugucga

SEQ ID NO: 2592508 - RNA, 15 nt, Escherichia coli CFT073
aauuacuucucuuuc

SEQ ID NO: 2592509 - RNA, 14 nt, Escherichia coli CFT073
aauuagcaagacuu

SEQ ID NO: 2592510 - RNA, 21 nt, Escherichia coli CFT073
aauuagcacgauuuuguaggc

SEQ ID NO: 2592511 - RNA, 19 nt, Escherichia coli CFT073
aauuagccagucggccaug

SEQ ID NO: 2592512 - RNA, 19 nt, Escherichia coli CFT073
aauuagcggccagcgggcg

SEQ ID NO: 2592513 - RNA, 18 nt, Escherichia coli CFT073
aauuaguaggccggauaa

SEQ ID NO: 2592514 - RNA, 16 nt, Escherichia coli CFT073
aauuaguggcuaaccg

SEQ ID NO: 2592515 - RNA, 23 nt, Escherichia coli CFT073
aauuaucaacguagaauaaaagc

SEQ ID NO: 2592516 - RNA, 13 nt, Escherichia coli CFT073
aauuaucauuuuu

SEQ ID NO: 2592517 - RNA, 15 nt, Escherichia coli CFT073
aauuauccauauuca

SEQ ID NO: 2592518 - RNA, 20 nt, Escherichia coli CFT073
aauuaucggcgucgcaucag

SEQ ID NO: 2592519 - RNA, 22 nt, Escherichia coli CFT073
aauuauucccgcgcuaccacuu

SEQ ID NO: 2592520 - RNA, 18 nt, Escherichia coli CFT073
aauuauugccuugaugaa

SEQ ID NO: 2592521 - RNA, 22 nt, Escherichia coli CFT073
aauuauugccuugaugaaaaaa

SEQ ID NO: 2592522 - RNA, 22 nt, Escherichia coli CFT073
aauuauuguaagcugucgaaaa

SEQ ID NO: 2592523 - RNA, 15 nt, Escherichia coli CFT073
aauuauuuuaccaua

SEQ ID NO: 2592524 - RNA, 11 nt, Escherichia coli CFT073
aauucaaaugg

SEQ ID NO: 2592525 - RNA, 18 nt, Escherichia coli CFT073
aauucacugucguucauu

SEQ ID NO: 2592526 - RNA, 12 nt, Escherichia coli CFT073
aauucagccauu

SEQ ID NO: 2592527 - RNA, 21 nt, Escherichia coli CFT073
aauucagcguggcgaaucgcu

SEQ ID NO: 2592528 - RNA, 12 nt, Escherichia coli CFT073
aauucaggaggc

SEQ ID NO: 2592529 - RNA, 10 nt, Escherichia coli CFT073
aauucaggcc

SEQ ID NO: 2592530 - RNA, 11 nt, Escherichia coli CFT073
aauucaggccg

SEQ ID NO: 2592531 - RNA, 20 nt, Escherichia coli CFT073
aauucauccaguagaauaau

SEQ ID NO: 2592532 - RNA, 22 nt, Escherichia coli CFT073
aauucaucguaaucucuuucca

SEQ ID NO: 2592533 - RNA, 20 nt, Escherichia coli CFT073
aauucauguucgguaaacgg

SEQ ID NO: 2592534 - RNA, 16 nt, Escherichia coli CFT073
aauucauugaauuuaa

SEQ ID NO: 2592535 - RNA, 17 nt, Escherichia coli CFT073
aauucauugaauuuaau

SEQ ID NO: 2592536 - RNA, 13 nt, Escherichia coli CFT073
aauuccacaccaa

SEQ ID NO: 2592537 - RNA, 19 nt, Escherichia coli CFT073
aauuccacgcgccacgcac

SEQ ID NO: 2592538 - RNA, 14 nt, Escherichia coli CFT073
aauuccagaauucu

SEQ ID NO: 2592539 - RNA, 14 nt, Escherichia coli CFT073
aauuccagcgccag

SEQ ID NO: 2592540 - RNA, 14 nt, Escherichia coli CFT073
aauuccaguugauu

SEQ ID NO: 2592541 - RNA, 15 nt, Escherichia coli CFT073
aauuccauuuucacc

SEQ ID NO: 2592542 - RNA, 18 nt, Escherichia coli CFT073
aauucccaguuacugcca

SEQ ID NO: 2592543 - RNA, 14 nt, Escherichia coli CFT073
aauuccccacccca

SEQ ID NO: 2592544 - RNA, 17 nt, Escherichia coli CFT073
aauucccgacaauggcg

SEQ ID NO: 2592545 - RNA, 22 nt, Escherichia coli CFT073
aauucccugugccagcggcagu

SEQ ID NO: 2592546 - RNA, 21 nt, Escherichia coli CFT073
aauuccgcccucgauaugcca

SEQ ID NO: 2592547 - RNA, 24 nt, Escherichia coli CFT073
aauuccgcccucgauaugccagac

SEQ ID NO: 2592548 - RNA, 22 nt, Escherichia coli CFT073
aauuccgccuccgcucaucacc

SEQ ID NO: 2592549 - RNA, 17 nt, Escherichia coli CFT073
aauuccggcagagaaag

SEQ ID NO: 2592550 - RNA, 18 nt, Escherichia coli CFT073
aauuccggcagagaaagc

SEQ ID NO: 2592551 - RNA, 22 nt, Escherichia coli CFT073
aauuccggcguuuugauuuuca

SEQ ID NO: 2592552 - RNA, 18 nt, Escherichia coli CFT073
aauuccggcuucuucugc

SEQ ID NO: 2592553 - RNA, 14 nt, Escherichia coli CFT073
aauucgaagcugua

SEQ ID NO: 2592554 - RNA, 18 nt, Escherichia coli CFT073
aauucgacuuucucuggc

SEQ ID NO: 2592555 - RNA, 22 nt, Escherichia coli CFT073
aauucgacuuucucuggcuguu

SEQ ID NO: 2592556 - RNA, 24 nt, Escherichia coli CFT073
aauucgagcaucaucucacgcagu

SEQ ID NO: 2592557 - RNA, 16 nt, Escherichia coli CFT073
aauucgcagaccggga

SEQ ID NO: 2592558 - RNA, 12 nt, Escherichia coli CFT073
aauucgccaccg

SEQ ID NO: 2592559 - RNA, 13 nt, Escherichia coli CFT073
aauucgcccuucg

SEQ ID NO: 2592560 - RNA, 15 nt, Escherichia coli CFT073
aauucgcccuucggc

SEQ ID NO: 2592561 - RNA, 23 nt, Escherichia coli CFT073
aauucgcggauguugcugcacca

SEQ ID NO: 2592562 - RNA, 19 nt, Escherichia coli CFT073
aauucgcuguaauucuuca

SEQ ID NO: 2592563 - RNA, 16 nt, Escherichia coli CFT073
aauucgcuuucacuca

SEQ ID NO: 2592564 - RNA, 18 nt, Escherichia coli CFT073
aauucgcuuucacucagu

SEQ ID NO: 2592565 - RNA, 23 nt, Escherichia coli CFT073
aauucgggcgcugauucuuccca

SEQ ID NO: 2592566 - RNA, 15 nt, Escherichia coli CFT073
aauucggucagcgua

SEQ ID NO: 2592567 - RNA, 20 nt, Escherichia coli CFT073
aauucgugugguaaaaccuu

SEQ ID NO: 2592568 - RNA, 13 nt, Escherichia coli CFT073
aauucguuuucgc

SEQ ID NO: 2592569 - RNA, 18 nt, Escherichia coli CFT073
aauucuauuuugccaggc

SEQ ID NO: 2592570 - RNA, 19 nt, Escherichia coli CFT073
aauucucccgcccccgcca

SEQ ID NO: 2592571 - RNA, 22 nt, Escherichia coli CFT073
aauucucgccaguguucuuccg

SEQ ID NO: 2592572 - RNA, 21 nt, Escherichia coli CFT073
aauucuguccuccaugaugac

SEQ ID NO: 2592573 - RNA, 14 nt, Escherichia coli CFT073
aauucuucauucca

SEQ ID NO: 2592574 - RNA, 21 nt, Escherichia coli CFT073
aauucuugcugacguaucuua

SEQ ID NO: 2592575 - RNA, 17 nt, Escherichia coli CFT073
aauucuuuuucugaaga

SEQ ID NO: 2592576 - RNA, 21 nt, Escherichia coli CFT073
aauugaaagagccgauaaaca

SEQ ID NO: 2592577 - RNA, 13 nt, Escherichia coli CFT073
aauugaagaguuu

SEQ ID NO: 2592578 - RNA, 16 nt, Escherichia coli CFT073
aauugaccugauaaga

SEQ ID NO: 2592579 - RNA, 19 nt, Escherichia coli CFT073
aauugagauaagcaacaaa

SEQ ID NO: 2592580 - RNA, 23 nt, Escherichia coli CFT073
aauugagauaagcaacaaacuca

SEQ ID NO: 2592581 - RNA, 12 nt, Escherichia coli CFT073
aauugauaacca

SEQ ID NO: 2592582 - RNA, 17 nt, Escherichia coli CFT073
aauugauugauaaugaa

SEQ ID NO: 2592583 - RNA, 22 nt, Escherichia coli CFT073
aauuuuuccguuuuccagccuu

SEQ ID NO: 2592584 - RNA, 14 nt, Escherichia coli CFT073
aauuuuucuuucgu

SEQ ID NO: 2592585 - RNA, 14 nt, Escherichia coli CFT073
aauuuuuugaucaa

SEQ ID NO: 2592586 - RNA, 19 nt, Escherichia coli CFT073
aauuuuuuuaaucuauaua

SEQ ID NO: 2592587 - RNA, 20 nt, Escherichia coli CFT073
acaaaaaaaccaucaccuaa

SEQ ID NO: 2592588 - RNA, 16 nt, Escherichia coli CFT073
acaaaaaaagccacgg

SEQ ID NO: 2592589 - RNA, 15 nt, Escherichia coli CFT073
acaaaaaacccauca

SEQ ID NO: 2592590 - RNA, 20 nt, Escherichia coli CFT073
acaaaaaagccggagcgaca

SEQ ID NO: 2592591 - RNA, 17 nt, Escherichia coli CFT073
acaaaaacccgcucauc

SEQ ID NO: 2592592 - RNA, 18 nt, Escherichia coli CFT073
acaaaaacgccgcucagu

SEQ ID NO: 2592593 - RNA, 19 nt, Escherichia coli CFT073
acaaaaacuuuuguauuuu

SEQ ID NO: 2592594 - RNA, 19 nt, Escherichia coli CFT073
acaaaaauuauugccuuga

SEQ ID NO: 2592595 - RNA, 18 nt, Escherichia coli CFT073
acaaaacauacuuucuca

SEQ ID NO: 2592596 - RNA, 20 nt, Escherichia coli CFT073
acaaaacauaucccaccagc

SEQ ID NO: 2592597 - RNA, 21 nt, Escherichia coli CFT073
acaaaacuguaucccagccca

SEQ ID NO: 2592598 - RNA, 18 nt, Escherichia coli CFT073
acaaaagcgaagcgaaca

SEQ ID NO: 2592599 - RNA, 17 nt, Escherichia coli CFT073
acaaaagcggugauaaa

SEQ ID NO: 2592600 - RNA, 22 nt, Escherichia coli CFT073
acaaaagcggugauaaacccaa

SEQ ID NO: 2592601 - RNA, 18 nt, Escherichia coli CFT073
acaaaaguggacauguuu

SEQ ID NO: 2592602 - RNA, 20 nt, Escherichia coli CFT073
acaaaauaaccgccaccagg

SEQ ID NO: 2592603 - RNA, 14 nt, Escherichia coli CFT073
acaaaauaccgaug

SEQ ID NO: 2592604 - RNA, 17 nt, Escherichia coli CFT073
acaaaauaggcaaaaaa

SEQ ID NO: 2592605 - RNA, 13 nt, Escherichia coli CFT073
acaaaaucaauau

SEQ ID NO: 2592606 - RNA, 20 nt, Escherichia coli CFT073
acaaaaucaauauaaacagc

SEQ ID NO: 2592607 - RNA, 17 nt, Escherichia coli CFT073
acaaaaucagaaacaaa

SEQ ID NO: 2592608 - RNA, 18 nt, Escherichia coli CFT073
acaaaaucagaaacaaau

SEQ ID NO: 2592609 - RNA, 14 nt, Escherichia coli CFT073
acaaaaucccggcg

SEQ ID NO: 2592610 - RNA, 14 nt, Escherichia coli CFT073
acaaaauccugcca

SEQ ID NO: 2592611 - RNA, 21 nt, Escherichia coli CFT073
acaaaauccugccagcgugag

SEQ ID NO: 2592612 - RNA, 13 nt, Escherichia coli CFT073
acaaaaugccagc

SEQ ID NO: 2592613 - RNA, 17 nt, Escherichia coli CFT073
acaaaaugccagcaacu

SEQ ID NO: 2592614 - RNA, 15 nt, Escherichia coli CFT073
acaaaauugccgcua

SEQ ID NO: 2592615 - RNA, 15 nt, Escherichia coli CFT073
acaaaauuuauccag

SEQ ID NO: 2592616 - RNA, 16 nt, Escherichia coli CFT073
acaaaauuuucagcgu

SEQ ID NO: 2592617 - RNA, 15 nt, Escherichia coli CFT073
acaaaauuuuugcca

SEQ ID NO: 2592618 - RNA, 15 nt, Escherichia coli CFT073
acaaacaaugccaga

SEQ ID NO: 2592619 - RNA, 23 nt, Escherichia coli CFT073
acaaacacagcagucggaaccgg

SEQ ID NO: 2592620 - RNA, 16 nt, Escherichia coli CFT073
acaaacacugcuuuua

SEQ ID NO: 2592621 - RNA, 11 nt, Escherichia coli CFT073
acaaacagaau

SEQ ID NO: 2592622 - RNA, 12 nt, Escherichia coli CFT073
acaaacagaaug

SEQ ID NO: 2592623 - RNA, 24 nt, Escherichia coli CFT073
acaaacagcguauaaaccauauca

SEQ ID NO: 2592624 - RNA, 12 nt, Escherichia coli CFT073
acaaacaucauc

SEQ ID NO: 2592625 - RNA, 13 nt, Escherichia coli CFT073
acaaacaucaucc

SEQ ID NO: 2592626 - RNA, 20 nt, Escherichia coli CFT073
acaaacaucauccagugccg

SEQ ID NO: 2592627 - RNA, 13 nt, Escherichia coli CFT073
acaaaccaccgaa

SEQ ID NO: 2592628 - RNA, 22 nt, Escherichia coli CFT073
acaaaccaccgaagaucaccac

SEQ ID NO: 2592629 - RNA, 14 nt, Escherichia coli CFT073
acaaaccagcccga

SEQ ID NO: 2592630 - RNA, 18 nt, Escherichia coli CFT073
acaaaccauaagguggga

SEQ ID NO: 2592631 - RNA, 19 nt, Escherichia coli CFT073
acaaaccaugauuccccag

SEQ ID NO: 2592632 - RNA, 19 nt, Escherichia coli CFT073
acaaacgcaaacaccagcu

SEQ ID NO: 2592633 - RNA, 18 nt, Escherichia coli CFT073
acaaacgcaauccagugg

SEQ ID NO: 2592634 - RNA, 20 nt, Escherichia coli CFT073
acaaacgccauaaacuucau

SEQ ID NO: 2592635 - RNA, 17 nt, Escherichia coli CFT073
acaaacgccggauggca

SEQ ID NO: 2592636 - RNA, 19 nt, Escherichia coli CFT073
acaaacgccggauggcaca

SEQ ID NO: 2592637 - RNA, 22 nt, Escherichia coli CFT073
acaaacgccggauggcacauga

SEQ ID NO: 2592638 - RNA, 20 nt, Escherichia coli CFT073
acaaacgccgugcacaccga

SEQ ID NO: 2592639 - RNA, 17 nt, Escherichia coli CFT073
acaaacgcugacauauu

SEQ ID NO: 2592640 - RNA, 13 nt, Escherichia coli CFT073
acaaacuaaccag

SEQ ID NO: 2592641 - RNA, 13 nt, Escherichia coli CFT073
acaaacucauuaa

SEQ ID NO: 2592642 - RNA, 21 nt, Escherichia coli CFT073
acaaacuccccgcaaaccaga

SEQ ID NO: 2592643 - RNA, 17 nt, Escherichia coli CFT073
acaaacuuccagaauau

SEQ ID NO: 2592644 - RNA, 18 nt, Escherichia coli CFT073
acaaagacgccaucaauu

SEQ ID NO: 2592645 - RNA, 18 nt, Escherichia coli CFT073
acaaagacgucaaacccu

SEQ ID NO: 2592646 - RNA, 18 nt, Escherichia coli CFT073
acaaagcucaccugagua

SEQ ID NO: 2592647 - RNA, 14 nt, Escherichia coli CFT073
acaaaggcacgcca

SEQ ID NO: 2592648 - RNA, 16 nt, Escherichia coli CFT073
acaaaggcuugcugca

SEQ ID NO: 2592649 - RNA, 20 nt, Escherichia coli CFT073
acaaagucuaaaaaugugcc

SEQ ID NO: 2592650 - RNA, 20 nt, Escherichia coli CFT073
acaaagugcgaggaucaucg

SEQ ID NO: 2592651 - RNA, 18 nt, Escherichia coli CFT073
acaaaguggcggcagcgg

SEQ ID NO: 2592652 - RNA, 16 nt, Escherichia coli CFT073
acaaauaccccaccgc

SEQ ID NO: 2592653 - RNA, 15 nt, Escherichia coli CFT073
acaaauagauaaaau

SEQ ID NO: 2592654 - RNA, 15 nt, Escherichia coli CFT073
acaaauagccaauuc

SEQ ID NO: 2592655 - RNA, 19 nt, Escherichia coli CFT073
acaaauaucuuucuaccau

SEQ ID NO: 2592656 - RNA, 20 nt, Escherichia coli CFT073
acaaaucgugacagcauacc

SEQ ID NO: 2592657 - RNA, 21 nt, Escherichia coli CFT073
acaaaucuuucacuuuugcca

SEQ ID NO: 2592658 - RNA, 13 nt, Escherichia coli CFT073
acaaaugaguuau

SEQ ID NO: 2592659 - RNA, 15 nt, Escherichia coli CFT073
acaaaugcgccgcca

SEQ ID NO: 2592660 - RNA, 19 nt, Escherichia coli CFT073
acaaauguggcaucagguu

SEQ ID NO: 2592661 - RNA, 23 nt, Escherichia coli CFT073
acaaauguugcaucgccugcgcg

SEQ ID NO: 2592662 - RNA, 18 nt, Escherichia coli CFT073
acaacaacuucuaauuuu

SEQ ID NO: 2592663 - RNA, 16 nt, Escherichia coli CFT073
acaacaccaucgaaau

SEQ ID NO: 2592664 - RNA, 18 nt, Escherichia coli CFT073
acaacacgccgauaauca

SEQ ID NO: 2592665 - RNA, 13 nt, Escherichia coli CFT073
acaacacucucug

SEQ ID NO: 2592666 - RNA, 22 nt, Escherichia coli CFT073
acaacagcaucgguaucgaaua

SEQ ID NO: 2592667 - RNA, 23 nt, Escherichia coli CFT073
acaacagccagguuuugcucugg

SEQ ID NO: 2592668 - RNA, 20 nt, Escherichia coli CFT073
acaacaucacaccugcucag

SEQ ID NO: 2592669 - RNA, 21 nt, Escherichia coli CFT073
acaacaugcuauuacgccagc

SEQ ID NO: 2592670 - RNA, 19 nt, Escherichia coli CFT073
acaacauugauaagcaagu

SEQ ID NO: 2592671 - RNA, 14 nt, Escherichia coli CFT073
acaacauugauuuc

SEQ ID NO: 2592672 - RNA, 17 nt, Escherichia coli CFT073
acaaccaauaacucaag

SEQ ID NO: 2592673 - RNA, 17 nt, Escherichia coli CFT073
acaaccagcacaugcuu

SEQ ID NO: 2592674 - RNA, 12 nt, Escherichia coli CFT073
acaaccaucccc

SEQ ID NO: 2592675 - RNA, 20 nt, Escherichia coli CFT073
acaaccauggaacucuuucu

SEQ ID NO: 2592676 - RNA, 22 nt, Escherichia coli CFT073
acaaccauggaacucuuucuga

SEQ ID NO: 2592677 - RNA, 17 nt, Escherichia coli CFT073
acaacccagacaaauaa

SEQ ID NO: 2592678 - RNA, 20 nt, Escherichia coli CFT073
acaacccagacaaauaacga

SEQ ID NO: 2592679 - RNA, 21 nt, Escherichia coli CFT073
acaacccgugagucuccuuua

SEQ ID NO: 2592680 - RNA, 19 nt, Escherichia coli CFT073
acaaccgccagaugcggcg

SEQ ID NO: 2592681 - RNA, 19 nt, Escherichia coli CFT073
acaaccgccggaugcggcg

SEQ ID NO: 2592682 - RNA, 16 nt, Escherichia coli CFT073
acaaccguucacgcau

SEQ ID NO: 2592683 - RNA, 22 nt, Escherichia coli CFT073
acaaccguucgcguaccgcuga

SEQ ID NO: 2592684 - RNA, 18 nt, Escherichia coli CFT073
acaaccguuucaugccau

SEQ ID NO: 2592685 - RNA, 15 nt, Escherichia coli CFT073
acaacgaaugccgcc

SEQ ID NO: 2592686 - RNA, 13 nt, Escherichia coli CFT073
acaacgauaaucc

SEQ ID NO: 2592687 - RNA, 15 nt, Escherichia coli CFT073
acaacgccgauuaau

SEQ ID NO: 2592688 - RNA, 21 nt, Escherichia coli CFT073
acaacggcaaacacgccgccg

SEQ ID NO: 2592689 - RNA, 16 nt, Escherichia coli CFT073
acaacguacaccgcag

SEQ ID NO: 2592690 - RNA, 19 nt, Escherichia coli CFT073
acaacucauuacuguaggc

SEQ ID NO: 2592691 - RNA, 15 nt, Escherichia coli CFT073
acacacacgcccagu

SEQ ID NO: 2592692 - RNA, 19 nt, Escherichia coli CFT073
acacaccgcaaacugcugu

SEQ ID NO: 2592693 - RNA, 21 nt, Escherichia coli CFT073
acacacuuuccaguuccggca

SEQ ID NO: 2592694 - RNA, 12 nt, Escherichia coli CFT073
acacagauaaac

SEQ ID NO: 2592695 - RNA, 15 nt, Escherichia coli CFT073
acacagcaauaauaa

SEQ ID NO: 2592696 - RNA, 17 nt, Escherichia coli CFT073
acacagcgugcauagca

SEQ ID NO: 2592697 - RNA, 13 nt, Escherichia coli CFT073
acacagcuuucuc

SEQ ID NO: 2592698 - RNA, 15 nt, Escherichia coli CFT073
acacaggcagcaauc

SEQ ID NO: 2592699 - RNA, 22 nt, Escherichia coli CFT073
acacaguacgaugauugccaca

SEQ ID NO: 2592700 - RNA, 21 nt, Escherichia coli CFT073
acacagugaaucucuuaucau

SEQ ID NO: 2592701 - RNA, 19 nt, Escherichia coli CFT073
acacaguucuucaaaaaua

SEQ ID NO: 2592702 - RNA, 15 nt, Escherichia coli CFT073
acacauaaauaacau

SEQ ID NO: 2592703 - RNA, 20 nt, Escherichia coli CFT073
acacauaaccagguaaagac

SEQ ID NO: 2592704 - RNA, 22 nt, Escherichia coli CFT073
acacauaaugaugccgucuuua

SEQ ID NO: 2592705 - RNA, 23 nt, Escherichia coli CFT073
acacaucagugauacaucuggua

SEQ ID NO: 2592706 - RNA, 13 nt, Escherichia coli CFT073
acacaucgucgcc

SEQ ID NO: 2592707 - RNA, 14 nt, Escherichia coli CFT073
acacaugcugacua

SEQ ID NO: 2592708 - RNA, 18 nt, Escherichia coli CFT073
acacaugguuuacggcgg

SEQ ID NO: 2592709 - RNA, 20 nt, Escherichia coli CFT073
acacauugugaaugaucagc

SEQ ID NO: 2592710 - RNA, 12 nt, Escherichia coli CFT073
acaccaaaauaa

SEQ ID NO: 2592711 - RNA, 13 nt, Escherichia coli CFT073
acaccaacaucac

SEQ ID NO: 2592712 - RNA, 14 nt, Escherichia coli CFT073
acaccaacaucacg

SEQ ID NO: 2592713 - RNA, 14 nt, Escherichia coli CFT073
acaccaacgccccg

SEQ ID NO: 2592714 - RNA, 14 nt, Escherichia coli CFT073
acaccaacugccuc

SEQ ID NO: 2592715 - RNA, 14 nt, Escherichia coli CFT073
acaccaacuucaug

SEQ ID NO: 2592716 - RNA, 21 nt, Escherichia coli CFT073
acaccaauaccgcccacuacc

SEQ ID NO: 2592717 - RNA, 18 nt, Escherichia coli CFT073
acaccaaucuucaacacu

SEQ ID NO: 2592718 - RNA, 14 nt, Escherichia coli CFT073
acaccaccacaagc

SEQ ID NO: 2592719 - RNA, 15 nt, Escherichia coli CFT073
acaccaccagcgcca

SEQ ID NO: 2592720 - RNA, 13 nt, Escherichia coli CFT073
acaccaccaugcu

SEQ ID NO: 2592721 - RNA, 15 nt, Escherichia coli CFT073
acaccaccgcccggu

SEQ ID NO: 2592722 - RNA, 20 nt, Escherichia coli CFT073
acaccaccgcccgguuuuuu

SEQ ID NO: 2592723 - RNA, 18 nt, Escherichia coli CFT073
acaccacgcgccugcagc

SEQ ID NO: 2592724 - RNA, 13 nt, Escherichia coli CFT073
acaccacuucauu

SEQ ID NO: 2592725 - RNA, 20 nt, Escherichia coli CFT073
acaccacuucauugguuuuc

SEQ ID NO: 2592726 - RNA, 12 nt, Escherichia coli CFT073
acaccagaacca

SEQ ID NO: 2592727 - RNA, 21 nt, Escherichia coli CFT073
acaccagaaccagcaaccacu

SEQ ID NO: 2592728 - RNA, 16 nt, Escherichia coli CFT073
acaccagaaugcccca

SEQ ID NO: 2592729 - RNA, 18 nt, Escherichia coli CFT073
acaccagauccagcaagg

SEQ ID NO: 2592730 - RNA, 12 nt, Escherichia coli CFT073
acaccagcaaua

SEQ ID NO: 2592731 - RNA, 16 nt, Escherichia coli CFT073
acaccagcaauaaugc

SEQ ID NO: 2592732 - RNA, 15 nt, Escherichia coli CFT073
acaccagcacaucau

SEQ ID NO: 2592733 - RNA, 19 nt, Escherichia coli CFT073
acaccagccaguagcaccu

SEQ ID NO: 2592734 - RNA, 22 nt, Escherichia coli CFT073
acaccaggcuaaauugcauugg

SEQ ID NO: 2592735 - RNA, 15 nt, Escherichia coli CFT073
acaccagggaaauaa

SEQ ID NO: 2592736 - RNA, 14 nt, Escherichia coli CFT073
acaccauauccagc

SEQ ID NO: 2592737 - RNA, 17 nt, Escherichia coli CFT073
acaccauauccagcgca

SEQ ID NO: 2592738 - RNA, 15 nt, Escherichia coli CFT073
acaccaucacccaac

SEQ ID NO: 2592739 - RNA, 15 nt, Escherichia coli CFT073
acaccauccagcaac

SEQ ID NO: 2592740 - RNA, 21 nt, Escherichia coli CFT073
acaccauccagcaacaacagc

SEQ ID NO: 2592741 - RNA, 11 nt, Escherichia coli CFT073
acaccaugcca

SEQ ID NO: 2592742 - RNA, 14 nt, Escherichia coli CFT073
acaccaugccagaa

SEQ ID NO: 2592743 - RNA, 13 nt, Escherichia coli CFT073
acaccccagcgua

SEQ ID NO: 2592744 - RNA, 21 nt, Escherichia coli CFT073
acacccccugcaaaacuggca

SEQ ID NO: 2592745 - RNA, 22 nt, Escherichia coli CFT073
acaccccgcgccgcugagaaaa

SEQ ID NO: 2592746 - RNA, 22 nt, Escherichia coli CFT073
acaccccgguaaagcgcaugau

SEQ ID NO: 2592747 - RNA, 17 nt, Escherichia coli CFT073
acacccggagacaaaca

SEQ ID NO: 2592748 - RNA, 15 nt, Escherichia coli CFT073
acacccggucagcca

SEQ ID NO: 2592749 - RNA, 21 nt, Escherichia coli CFT073
acaccgaaccgaaauggcugc

SEQ ID NO: 2592750 - RNA, 16 nt, Escherichia coli CFT073
acaccgauugccccug

SEQ ID NO: 2592751 - RNA, 21 nt, Escherichia coli CFT073
acaccgcagccgccacaauaa

SEQ ID NO: 2592752 - RNA, 14 nt, Escherichia coli CFT073
acaccgcccagcga

SEQ ID NO: 2592753 - RNA, 17 nt, Escherichia coli CFT073
acaccgccuaccgccag

SEQ ID NO: 2592754 - RNA, 13 nt, Escherichia coli CFT073
acaccgcggaacg

SEQ ID NO: 2592755 - RNA, 21 nt, Escherichia coli CFT073
acaccgcuguugccagcagca

SEQ ID NO: 2592756 - RNA, 13 nt, Escherichia coli CFT073
acaccggcagcgg

SEQ ID NO: 2592757 - RNA, 16 nt, Escherichia coli CFT073
acaccggugaccauca

SEQ ID NO: 2592758 - RNA, 17 nt, Escherichia coli CFT073
acaccggugaccaucag

SEQ ID NO: 2592759 - RNA, 23 nt, Escherichia coli CFT073
acaccggugaccaucagcaugac

SEQ ID NO: 2592760 - RNA, 23 nt, Escherichia coli CFT073
acaccggugauuauugucgugcc

SEQ ID NO: 2592761 - RNA, 19 nt, Escherichia coli CFT073
acaccguaauugccagacu

SEQ ID NO: 2592762 - RNA, 18 nt, Escherichia coli CFT073
acaccgucagccagcacu

SEQ ID NO: 2592763 - RNA, 23 nt, Escherichia coli CFT073
acaccguccggcgggcaaauucu

SEQ ID NO: 2592764 - RNA, 22 nt, Escherichia coli CFT073
acaccgugaucgacccauaaug

SEQ ID NO: 2592765 - RNA, 22 nt, Escherichia coli CFT073
acaccguuuccauaucgcuggc

SEQ ID NO: 2592766 - RNA, 16 nt, Escherichia coli CFT073
acaccguuuuaccauc

SEQ ID NO: 2592767 - RNA, 13 nt, Escherichia coli CFT073
acaccucaacccg

SEQ ID NO: 2592768 - RNA, 16 nt, Escherichia coli CFT073
acaccucacaccccgg

SEQ ID NO: 2592769 - RNA, 16 nt, Escherichia coli CFT073
acaccucauccgaugg

SEQ ID NO: 2592770 - RNA, 23 nt, Escherichia coli CFT073
acaccucaucgcgcaacgucgcg

SEQ ID NO: 2592771 - RNA, 17 nt, Escherichia coli CFT073
acaccugccaccagcac

SEQ ID NO: 2592772 - RNA, 18 nt, Escherichia coli CFT073
acaccuguaaaaaaggca

SEQ ID NO: 2592773 - RNA, 12 nt, Escherichia coli CFT073
acacgaaucagg

SEQ ID NO: 2592774 - RNA, 13 nt, Escherichia coli CFT073
acacgacaugacc

SEQ ID NO: 2592775 - RNA, 21 nt, Escherichia coli CFT073
acacgaccaugggcaauuucu

SEQ ID NO: 2592776 - RNA, 18 nt, Escherichia coli CFT073
acacgacgcgccagcagc

SEQ ID NO: 2592777 - RNA, 21 nt, Escherichia coli CFT073
acacgauucguauaauuuauu

SEQ ID NO: 2592778 - RNA, 14 nt, Escherichia coli CFT073
acacgcaacaccag

SEQ ID NO: 2592779 - RNA, 14 nt, Escherichia coli CFT073
acacgcagaccaac

SEQ ID NO: 2592780 - RNA, 18 nt, Escherichia coli CFT073
acacgcaggagauugaag

SEQ ID NO: 2592781 - RNA, 20 nt, Escherichia coli CFT073
acacgccagugucgcaucag

SEQ ID NO: 2592782 - RNA, 16 nt, Escherichia coli CFT073
acacgcccgucauacc

SEQ ID NO: 2592783 - RNA, 18 nt, Escherichia coli CFT073
acacgccugcaagcgucg

SEQ ID NO: 2592784 - RNA, 15 nt, Escherichia coli CFT073
acacgcggagccagu

SEQ ID NO: 2592785 - RNA, 15 nt, Escherichia coli CFT073
acacgcguguaagca

SEQ ID NO: 2592786 - RNA, 19 nt, Escherichia coli CFT073
acacggcucaaccuucuuc

SEQ ID NO: 2592787 - RNA, 23 nt, Escherichia coli CFT073
acacggcucgccuuuucgcccgu

SEQ ID NO: 2592788 - RNA, 22 nt, Escherichia coli CFT073
acacggcuuucugcaaccagaa

SEQ ID NO: 2592789 - RNA, 16 nt, Escherichia coli CFT073
acacgggguuaaauug

SEQ ID NO: 2592790 - RNA, 21 nt, Escherichia coli CFT073
acacggugcuccagugcgcuu

SEQ ID NO: 2592791 - RNA, 23 nt, Escherichia coli CFT073
acacguaauucauuacgaaguuu

SEQ ID NO: 2592792 - RNA, 14 nt, Escherichia coli CFT073
acacguucguccuc

SEQ ID NO: 2592793 - RNA, 15 nt, Escherichia coli CFT073
acacuaccgccgagc

SEQ ID NO: 2592794 - RNA, 12 nt, Escherichia coli CFT073
acacuauaucuc

SEQ ID NO: 2592795 - RNA, 12 nt, Escherichia coli CFT073
acacucacaucc

SEQ ID NO: 2592796 - RNA, 16 nt, Escherichia coli CFT073
acacucacgcauacag

SEQ ID NO: 2592797 - RNA, 17 nt, Escherichia coli CFT073
acacuccagucccaguu

SEQ ID NO: 2592798 - RNA, 23 nt, Escherichia coli CFT073
acacuccagucccaguucauguu

SEQ ID NO: 2592799 - RNA, 17 nt, Escherichia coli CFT073
acacucggcgcggaugc

SEQ ID NO: 2592800 - RNA, 22 nt, Escherichia coli CFT073
acagcgcgaggguaaacaacau

SEQ ID NO: 2592801 - RNA, 13 nt, Escherichia coli CFT073
acagcggagcaag

SEQ ID NO: 2592802 - RNA, 13 nt, Escherichia coli CFT073
acagcggcaucaa

SEQ ID NO: 2592803 - RNA, 20 nt, Escherichia coli CFT073
acagcggcaucaaccgccgg

SEQ ID NO: 2592804 - RNA, 21 nt, Escherichia coli CFT073
acagcggugcaccugccagca

SEQ ID NO: 2592805 - RNA, 17 nt, Escherichia coli CFT073
acagcguuucgccgccc

SEQ ID NO: 2592806 - RNA, 19 nt, Escherichia coli CFT073
acagcuacgcaucaugccg

SEQ ID NO: 2592807 - RNA, 16 nt, Escherichia coli CFT073
acagcuauaccgccag

SEQ ID NO: 2592808 - RNA, 17 nt, Escherichia coli CFT073
acagcuauaccgccagg

SEQ ID NO: 2592809 - RNA, 15 nt, Escherichia coli CFT073
acagcucacgcgcca

SEQ ID NO: 2592810 - RNA, 22 nt, Escherichia coli CFT073
acagcucgguauggccuuucug

SEQ ID NO: 2592811 - RNA, 12 nt, Escherichia coli CFT073
acagcucugaau

SEQ ID NO: 2592812 - RNA, 16 nt, Escherichia coli CFT073
acagcugcaacagcgc

SEQ ID NO: 2592813 - RNA, 22 nt, Escherichia coli CFT073
acagcugcgaccaguggcggga

SEQ ID NO: 2592814 - RNA, 23 nt, Escherichia coli CFT073
acagcuuagacaacgccgcuuuu

SEQ ID NO: 2592815 - RNA, 12 nt, Escherichia coli CFT073
acagcuuguuau

SEQ ID NO: 2592816 - RNA, 21 nt, Escherichia coli CFT073
acagcuuuuacaaaaucuucg

SEQ ID NO: 2592817 - RNA, 20 nt, Escherichia coli CFT073
acagcuuuuacagccaaugc

SEQ ID NO: 2592818 - RNA, 16 nt, Escherichia coli CFT073
acagcuuuuuccugcg

SEQ ID NO: 2592819 - RNA, 15 nt, Escherichia coli CFT073
acaggaaaccggcga

SEQ ID NO: 2592820 - RNA, 18 nt, Escherichia coli CFT073
acaggaaauaagaagcca

SEQ ID NO: 2592821 - RNA, 15 nt, Escherichia coli CFT073
acaggaaccaaaugc

SEQ ID NO: 2592822 - RNA, 17 nt, Escherichia coli CFT073
acaggaaccaaaugccg

SEQ ID NO: 2592823 - RNA, 20 nt, Escherichia coli CFT073
acaggaaccaaaugccggau

SEQ ID NO: 2592824 - RNA, 18 nt, Escherichia coli CFT073
acaggagacaccagcguc

SEQ ID NO: 2592825 - RNA, 19 nt, Escherichia coli CFT073
acaggagcacggaucacuc

SEQ ID NO: 2592826 - RNA, 14 nt, Escherichia coli CFT073
acaggauauauuuc

SEQ ID NO: 2592827 - RNA, 21 nt, Escherichia coli CFT073
acaggauauauuucaucaacu

SEQ ID NO: 2592828 - RNA, 20 nt, Escherichia coli CFT073
acaggcaagcauaugacgaa

SEQ ID NO: 2592829 - RNA, 14 nt, Escherichia coli CFT073
acaggcagcaauca

SEQ ID NO: 2592830 - RNA, 20 nt, Escherichia coli CFT073
acaggcagcuuagaaaggaa

SEQ ID NO: 2592831 - RNA, 23 nt, Escherichia coli CFT073
acaggcagcuuagaaaggaacaa

SEQ ID NO: 2592832 - RNA, 22 nt, Escherichia coli CFT073
acaggccaucacauccugauag

SEQ ID NO: 2592833 - RNA, 15 nt, Escherichia coli CFT073
acaggccgccaggca

SEQ ID NO: 2592834 - RNA, 13 nt, Escherichia coli CFT073
acaggcgauuuca

SEQ ID NO: 2592835 - RNA, 20 nt, Escherichia coli CFT073
acaggcgcugaucgucagca

SEQ ID NO: 2592836 - RNA, 15 nt, Escherichia coli CFT073
acaggcgggaagaac

SEQ ID NO: 2592837 - RNA, 16 nt, Escherichia coli CFT073
acaggcggucgccguc

SEQ ID NO: 2592838 - RNA, 18 nt, Escherichia coli CFT073
acaggcuacugccguggu

SEQ ID NO: 2592839 - RNA, 13 nt, Escherichia coli CFT073
acaggcugcugcc

SEQ ID NO: 2592840 - RNA, 20 nt, Escherichia coli CFT073
acaggcuggcgucacgccga

SEQ ID NO: 2592841 - RNA, 20 nt, Escherichia coli CFT073
acaggcuguuguucagugca

SEQ ID NO: 2592842 - RNA, 16 nt, Escherichia coli CFT073
acagggcaacggccaa

SEQ ID NO: 2592843 - RNA, 15 nt, Escherichia coli CFT073
acaggggagccgcac

SEQ ID NO: 2592844 - RNA, 13 nt, Escherichia coli CFT073
acaggguaaaaag

SEQ ID NO: 2592845 - RNA, 19 nt, Escherichia coli CFT073
acagggugagcagggcgcu

SEQ ID NO: 2592846 - RNA, 14 nt, Escherichia coli CFT073
acagguaagcacac

SEQ ID NO: 2592847 - RNA, 21 nt, Escherichia coli CFT073
acaggucaaaguaaccuuuga

SEQ ID NO: 2592848 - RNA, 23 nt, Escherichia coli CFT073
acaggucgcaaacggcgaaggau

SEQ ID NO: 2592849 - RNA, 22 nt, Escherichia coli CFT073
acaggucgccagucccuuucag

SEQ ID NO: 2592850 - RNA, 15 nt, Escherichia coli CFT073
acaggugccggauuu

SEQ ID NO: 2592851 - RNA, 21 nt, Escherichia coli CFT073
acaggugcgagagguaauuug

SEQ ID NO: 2592852 - RNA, 22 nt, Escherichia coli CFT073
acagguggucacagucugcucc

SEQ ID NO: 2592853 - RNA, 19 nt, Escherichia coli CFT073
acagguugccguccagcgc

SEQ ID NO: 2592854 - RNA, 23 nt, Escherichia coli CFT073
acaguaaagcgcaaaauaccagc

SEQ ID NO: 2592855 - RNA, 17 nt, Escherichia coli CFT073
acaguaacccagcacca

SEQ ID NO: 2592856 - RNA, 20 nt, Escherichia coli CFT073
acaguaacccagcaccaaca

SEQ ID NO: 2592857 - RNA, 17 nt, Escherichia coli CFT073
acaguaagcccaccaca

SEQ ID NO: 2592858 - RNA, 21 nt, Escherichia coli CFT073
acaguaagccgguaaucacca

SEQ ID NO: 2592859 - RNA, 22 nt, Escherichia coli CFT073
acaguaagccgguaaucaccag

SEQ ID NO: 2592860 - RNA, 16 nt, Escherichia coli CFT073
acaguaauuuccugcc

SEQ ID NO: 2592861 - RNA, 14 nt, Escherichia coli CFT073
acaguaccagcagu

SEQ ID NO: 2592862 - RNA, 13 nt, Escherichia coli CFT073
acaguagagaucu

SEQ ID NO: 2592863 - RNA, 16 nt, Escherichia coli CFT073
acaguagagccgccag

SEQ ID NO: 2592864 - RNA, 13 nt, Escherichia coli CFT073
acaguaucaccaa

SEQ ID NO: 2592865 - RNA, 20 nt, Escherichia coli CFT073
acaguccauugcgcaaccgc

SEQ ID NO: 2592866 - RNA, 23 nt, Escherichia coli CFT073
acaguccauugcgcaaccgcccg

SEQ ID NO: 2592867 - RNA, 22 nt, Escherichia coli CFT073
acagucgaugcagccccacggc

SEQ ID NO: 2592868 - RNA, 17 nt, Escherichia coli CFT073
acagucugcuccaucgc

SEQ ID NO: 2592869 - RNA, 13 nt, Escherichia coli CFT073
acagugaaauaca

SEQ ID NO: 2592870 - RNA, 14 nt, Escherichia coli CFT073
acagugaaucucuu

SEQ ID NO: 2592871 - RNA, 20 nt, Escherichia coli CFT073
acagugaccaucuuccagca

SEQ ID NO: 2592872 - RNA, 22 nt, Escherichia coli CFT073
acagugaccaucuuccagcauc

SEQ ID NO: 2592873 - RNA, 17 nt, Escherichia coli CFT073
acagugacccgcagcca

SEQ ID NO: 2592874 - RNA, 21 nt, Escherichia coli CFT073
acagugacccgcagccagcac

SEQ ID NO: 2592875 - RNA, 19 nt, Escherichia coli CFT073
acagugaugacgccagccg

SEQ ID NO: 2592876 - RNA, 18 nt, Escherichia coli CFT073
acagugauugcuuuuguu

SEQ ID NO: 2592877 - RNA, 14 nt, Escherichia coli CFT073
acagugcaggaugc

SEQ ID NO: 2592878 - RNA, 16 nt, Escherichia coli CFT073
acagugccccaaaugu

SEQ ID NO: 2592879 - RNA, 17 nt, Escherichia coli CFT073
acagugccgcgcauagc

SEQ ID NO: 2592880 - RNA, 23 nt, Escherichia coli CFT073
acaguggcgacaagcauaacaaa

SEQ ID NO: 2592881 - RNA, 17 nt, Escherichia coli CFT073
acaguuaaccaguuuua

SEQ ID NO: 2592882 - RNA, 12 nt, Escherichia coli CFT073
acaguucaaucu

SEQ ID NO: 2592883 - RNA, 18 nt, Escherichia coli CFT073
acaguuucagccccauca

SEQ ID NO: 2592884 - RNA, 16 nt, Escherichia coli CFT073
acaguuugccaaacca

SEQ ID NO: 2592885 - RNA, 18 nt, Escherichia coli CFT073
acaguuuuacugcagcca

SEQ ID NO: 2592886 - RNA, 21 nt, Escherichia coli CFT073
acaguuuuaucuccauccggg

SEQ ID NO: 2592887 - RNA, 24 nt, Escherichia coli CFT073
acaguuuuucaccguugcucaugu

SEQ ID NO: 2592888 - RNA, 15 nt, Escherichia coli CFT073
acauaaaaaacgcga

SEQ ID NO: 2592889 - RNA, 14 nt, Escherichia coli CFT073
acauaaacaccagc

SEQ ID NO: 2592890 - RNA, 14 nt, Escherichia coli CFT073
acauaaauaacauc

SEQ ID NO: 2592891 - RNA, 18 nt, Escherichia coli CFT073
acauaaccgguuccgcaa

SEQ ID NO: 2592892 - RNA, 13 nt, Escherichia coli CFT073
acauaacgccaau

SEQ ID NO: 2592893 - RNA, 23 nt, Escherichia coli CFT073
acauaagcugaauguucuucuuc

SEQ ID NO: 2592894 - RNA, 13 nt, Escherichia coli CFT073
acauaaucgaaaa

SEQ ID NO: 2592895 - RNA, 13 nt, Escherichia coli CFT073
acauaaucgccgu

SEQ ID NO: 2592896 - RNA, 17 nt, Escherichia coli CFT073
acauaaugccgacauca

SEQ ID NO: 2592897 - RNA, 18 nt, Escherichia coli CFT073
acauaaugccgacaucaa

SEQ ID NO: 2592898 - RNA, 20 nt, Escherichia coli CFT073
acauaaugccgacaucaaac

SEQ ID NO: 2592899 - RNA, 16 nt, Escherichia coli CFT073
acauacaaauagccaa

SEQ ID NO: 2592900 - RNA, 17 nt, Escherichia coli CFT073
acauacaaaucgugcau

SEQ ID NO: 2592901 - RNA, 21 nt, Escherichia coli CFT073
acauacaggggaucgacgccc

SEQ ID NO: 2592902 - RNA, 17 nt, Escherichia coli CFT073
acauacauguauaaaaa

SEQ ID NO: 2592903 - RNA, 13 nt, Escherichia coli CFT073
acauaccagcagc

SEQ ID NO: 2592904 - RNA, 18 nt, Escherichia coli CFT073
acauaccagcagcaucac

SEQ ID NO: 2592905 - RNA, 15 nt, Escherichia coli CFT073
acauaccuaaaagca

SEQ ID NO: 2592906 - RNA, 21 nt, Escherichia coli CFT073
acauaccuaaaagcacgccag

SEQ ID NO: 2592907 - RNA, 22 nt, Escherichia coli CFT073
acauaccuaaaagcacgccaga

SEQ ID NO: 2592908 - RNA, 14 nt, Escherichia coli CFT073
acaugcagggcaaa

SEQ ID NO: 2592909 - RNA, 16 nt, Escherichia coli CFT073
acaugcccuucacgua

SEQ ID NO: 2592910 - RNA, 16 nt, Escherichia coli CFT073
acaugccgucaaucca

SEQ ID NO: 2592911 - RNA, 15 nt, Escherichia coli CFT073
acaugccugcauaaa

SEQ ID NO: 2592912 - RNA, 21 nt, Escherichia coli CFT073
acaugcgaacuuuacugccuc

SEQ ID NO: 2592913 - RNA, 18 nt, Escherichia coli CFT073
acaugcggcgugccuuca

SEQ ID NO: 2592914 - RNA, 19 nt, Escherichia coli CFT073
acaugcggcgugccuucac

SEQ ID NO: 2592915 - RNA, 16 nt, Escherichia coli CFT073
acaugcgggucuuacu

SEQ ID NO: 2592916 - RNA, 23 nt, Escherichia coli CFT073
acaugcgguucacgcgccagaga

SEQ ID NO: 2592917 - RNA, 17 nt, Escherichia coli CFT073
acaugcuauuacgccag

SEQ ID NO: 2592918 - RNA, 14 nt, Escherichia coli CFT073
acaugcucaucccc

SEQ ID NO: 2592919 - RNA, 11 nt, Escherichia coli CFT073
acaugcugcuu

SEQ ID NO: 2592920 - RNA, 16 nt, Escherichia coli CFT073
acaugcuggaaccaca

SEQ ID NO: 2592921 - RNA, 16 nt, Escherichia coli CFT073
acaugcuggauggcgu

SEQ ID NO: 2592922 - RNA, 20 nt, Escherichia coli CFT073
acaugcuuaacacacggaua

SEQ ID NO: 2592923 - RNA, 21 nt, Escherichia coli CFT073
acauggcacugcgaucccggc

SEQ ID NO: 2592924 - RNA, 18 nt, Escherichia coli CFT073
acauggcagaccaaacgg

SEQ ID NO: 2592925 - RNA, 16 nt, Escherichia coli CFT073
acauggcuaugcguug

SEQ ID NO: 2592926 - RNA, 13 nt, Escherichia coli CFT073
acauggucaucau

SEQ ID NO: 2592927 - RNA, 21 nt, Escherichia coli CFT073
acauguccgagcuuaaugaaa

SEQ ID NO: 2592928 - RNA, 22 nt, Escherichia coli CFT073
acauguccgagcuuaaugaaaa

SEQ ID NO: 2592929 - RNA, 19 nt, Escherichia coli CFT073
acauguguucccuguaggu

SEQ ID NO: 2592930 - RNA, 23 nt, Escherichia coli CFT073
acauguugcuuaaugcgggaagg

SEQ ID NO: 2592931 - RNA, 17 nt, Escherichia coli CFT073
acauguuuuccagcaca

SEQ ID NO: 2592932 - RNA, 18 nt, Escherichia coli CFT073
acauguuuuccagcacau

SEQ ID NO: 2592933 - RNA, 22 nt, Escherichia coli CFT073
acauuaagcgcaucgacgccau

SEQ ID NO: 2592934 - RNA, 14 nt, Escherichia coli CFT073
acauuaauuuucaa

SEQ ID NO: 2592935 - RNA, 15 nt, Escherichia coli CFT073
acauuaauuuucaau

SEQ ID NO: 2592936 - RNA, 14 nt, Escherichia coli CFT073
acauuacaaaauac

SEQ ID NO: 2592937 - RNA, 17 nt, Escherichia coli CFT073
acauuacaaaauacaaa

SEQ ID NO: 2592938 - RNA, 16 nt, Escherichia coli CFT073
acauuacuaaacauuu

SEQ ID NO: 2592939 - RNA, 20 nt, Escherichia coli CFT073
acauuacuaauuaauaauau

SEQ ID NO: 2592940 - RNA, 13 nt, Escherichia coli CFT073
acauuaucagaca

SEQ ID NO: 2592941 - RNA, 14 nt, Escherichia coli CFT073
acauuccagaugcg

SEQ ID NO: 2592942 - RNA, 11 nt, Escherichia coli CFT073
acauuccuguu

SEQ ID NO: 2592943 - RNA, 19 nt, Escherichia coli CFT073
acauucgcgcacggugcau

SEQ ID NO: 2592944 - RNA, 17 nt, Escherichia coli CFT073
acauucggcguuaacaa

SEQ ID NO: 2592945 - RNA, 21 nt, Escherichia coli CFT073
acauucggucgaaauaucacu

SEQ ID NO: 2592946 - RNA, 14 nt, Escherichia coli CFT073
acauucuccgccga

SEQ ID NO: 2592947 - RNA, 16 nt, Escherichia coli CFT073
acauugagcaaagacg

SEQ ID NO: 2592948 - RNA, 16 nt, Escherichia coli CFT073
acauugauagcccaac

SEQ ID NO: 2592949 - RNA, 19 nt, Escherichia coli CFT073
acauugaugaaaagauuaa

SEQ ID NO: 2592950 - RNA, 20 nt, Escherichia coli CFT073
acauugaugaaaagauuaac

SEQ ID NO: 2592951 - RNA, 20 nt, Escherichia coli CFT073
acauugauuucuuauucaua

SEQ ID NO: 2592952 - RNA, 23 nt, Escherichia coli CFT073
acauugccaccaccagcguaccg

SEQ ID NO: 2592953 - RNA, 18 nt, Escherichia coli CFT073
acauugccgaauggcugc

SEQ ID NO: 2592954 - RNA, 20 nt, Escherichia coli CFT073
acauugccguaauggucugc

SEQ ID NO: 2592955 - RNA, 21 nt, Escherichia coli CFT073
acauugcgggcgagauuuuac

SEQ ID NO: 2592956 - RNA, 18 nt, Escherichia coli CFT073
acauugcucauuccgccg

SEQ ID NO: 2592957 - RNA, 16 nt, Escherichia coli CFT073
acauuggcaaaaccaa

SEQ ID NO: 2592958 - RNA, 18 nt, Escherichia coli CFT073
acauuggcucaucaaaca

SEQ ID NO: 2592959 - RNA, 21 nt, Escherichia coli CFT073
acauuggcucaucaaacaacg

SEQ ID NO: 2592960 - RNA, 21 nt, Escherichia coli CFT073
acauugguacagagaacaccc

SEQ ID NO: 2592961 - RNA, 14 nt, Escherichia coli CFT073
acauuggugccgga

SEQ ID NO: 2592962 - RNA, 18 nt, Escherichia coli CFT073
acauugugauguaagcgc

SEQ ID NO: 2592963 - RNA, 14 nt, Escherichia coli CFT073
acauuguuuuccag

SEQ ID NO: 2592964 - RNA, 17 nt, Escherichia coli CFT073
acauuuagcguuaaaau

SEQ ID NO: 2592965 - RNA, 19 nt, Escherichia coli CFT073
acauuuauuucaacgacau

SEQ ID NO: 2592966 - RNA, 17 nt, Escherichia coli CFT073
acauuucagcuaacaaa

SEQ ID NO: 2592967 - RNA, 14 nt, Escherichia coli CFT073
acauuucauucacg

SEQ ID NO: 2592968 - RNA, 19 nt, Escherichia coli CFT073
acauuucccgcauaaagag

SEQ ID NO: 2592969 - RNA, 18 nt, Escherichia coli CFT073
acauuuccguaauaucuu

SEQ ID NO: 2592970 - RNA, 19 nt, Escherichia coli CFT073
acauuuccguaauaucuuc

SEQ ID NO: 2592971 - RNA, 20 nt, Escherichia coli CFT073
acauuuuaaccguggugcgu

SEQ ID NO: 2592972 - RNA, 11 nt, Escherichia coli CFT073
acauuuuccau

SEQ ID NO: 2592973 - RNA, 21 nt, Escherichia coli CFT073
acauuuuuuacucucguucca

SEQ ID NO: 2592974 - RNA, 22 nt, Escherichia coli CFT073
accaaaacagcgacaccagcca

SEQ ID NO: 2592975 - RNA, 15 nt, Escherichia coli CFT073
accaaaaccggcucu

SEQ ID NO: 2592976 - RNA, 15 nt, Escherichia coli CFT073
accaaaacgugcagc

SEQ ID NO: 2592977 - RNA, 20 nt, Escherichia coli CFT073
accaaaacgugcagcugccu

SEQ ID NO: 2592978 - RNA, 15 nt, Escherichia coli CFT073
accaaaauaacgauc

SEQ ID NO: 2592979 - RNA, 18 nt, Escherichia coli CFT073
accaaaaucuaccagcgg

SEQ ID NO: 2592980 - RNA, 12 nt, Escherichia coli CFT073
accaaaccagcc

SEQ ID NO: 2592981 - RNA, 19 nt, Escherichia coli CFT073
accaaaccagccgccaacu

SEQ ID NO: 2592982 - RNA, 13 nt, Escherichia coli CFT073
accaaaccaucac

SEQ ID NO: 2592983 - RNA, 20 nt, Escherichia coli CFT073
accaaaccuucguuagcuaa

SEQ ID NO: 2592984 - RNA, 17 nt, Escherichia coli CFT073
accaaacgggcaagcca

SEQ ID NO: 2592985 - RNA, 20 nt, Escherichia coli CFT073
accaaacguggucgccagca

SEQ ID NO: 2592986 - RNA, 17 nt, Escherichia coli CFT073
accaaacuuauccgcca

SEQ ID NO: 2592987 - RNA, 17 nt, Escherichia coli CFT073
accaaagaauccgcccu

SEQ ID NO: 2592988 - RNA, 21 nt, Escherichia coli CFT073
accaaagaaugacacuuucag

SEQ ID NO: 2592989 - RNA, 18 nt, Escherichia coli CFT073
accaaagccacccacacc

SEQ ID NO: 2592990 - RNA, 19 nt, Escherichia coli CFT073
accaaaggugacuggcaga

SEQ ID NO: 2592991 - RNA, 17 nt, Escherichia coli CFT073
accaaaguagauaaucg

SEQ ID NO: 2592992 - RNA, 17 nt, Escherichia coli CFT073
accaaaucgaaaugaug

SEQ ID NO: 2592993 - RNA, 20 nt, Escherichia coli CFT073
accaaaucgaaaugauguuu

SEQ ID NO: 2592994 - RNA, 14 nt, Escherichia coli CFT073
accaaaucugauua

SEQ ID NO: 2592995 - RNA, 12 nt, Escherichia coli CFT073
accaaaugacuc

SEQ ID NO: 2592996 - RNA, 16 nt, Escherichia coli CFT073
accaaauugguaaaau

SEQ ID NO: 2592997 - RNA, 23 nt, Escherichia coli CFT073
accaacaaaacauaucccaccag

SEQ ID NO: 2592998 - RNA, 13 nt, Escherichia coli CFT073
accaacaagcacc

SEQ ID NO: 2592999 - RNA, 15 nt, Escherichia coli CFT073
accaacaauacaaaa

SEQ ID NO: 2593000 - RNA, 19 nt, Escherichia coli CFT073
accaacaauauuggguugu

SEQ ID NO: 2593001 - RNA, 15 nt, Escherichia coli CFT073
accaacaucgacaua

SEQ ID NO: 2593002 - RNA, 13 nt, Escherichia coli CFT073
accaaccaccgcc

SEQ ID NO: 2593003 - RNA, 15 nt, Escherichia coli CFT073
accaaccaccgccac

SEQ ID NO: 2593004 - RNA, 23 nt, Escherichia coli CFT073
accaaccagcguguuaggaucac

SEQ ID NO: 2593005 - RNA, 16 nt, Escherichia coli CFT073
accaaccgcaauaacc

SEQ ID NO: 2593006 - RNA, 17 nt, Escherichia coli CFT073
accaaccuuucaucugu

SEQ ID NO: 2593007 - RNA, 12 nt, Escherichia coli CFT073
accaacgcgccg

SEQ ID NO: 2593008 - RNA, 15 nt, Escherichia coli CFT073
accaacggcgagcca

SEQ ID NO: 2593009 - RNA, 14 nt, Escherichia coli CFT073
accaacgucccugg

SEQ ID NO: 2593010 - RNA, 23 nt, Escherichia coli CFT073
accaacuccaguggcgcaucagc

SEQ ID NO: 2593011 - RNA, 21 nt, Escherichia coli CFT073
accaacugugccgcgaccacc

SEQ ID NO: 2593012 - RNA, 16 nt, Escherichia coli CFT073
accaacuucauacauu

SEQ ID NO: 2593013 - RNA, 12 nt, Escherichia coli CFT073
accaagaaagau

SEQ ID NO: 2593014 - RNA, 19 nt, Escherichia coli CFT073
accaagaccaauccgccag

SEQ ID NO: 2593015 - RNA, 22 nt, Escherichia coli CFT073
accaagacuauuaauauauauu

SEQ ID NO: 2593016 - RNA, 15 nt, Escherichia coli CFT073
accacggcaacgccg

SEQ ID NO: 2593017 - RNA, 14 nt, Escherichia coli CFT073
accacggccagucc

SEQ ID NO: 2593018 - RNA, 16 nt, Escherichia coli CFT073
accacgguacgccaga

SEQ ID NO: 2593019 - RNA, 19 nt, Escherichia coli CFT073
accacgguacgccagagug

SEQ ID NO: 2593020 - RNA, 19 nt, Escherichia coli CFT073
accacgguguugguaaacg

SEQ ID NO: 2593021 - RNA, 16 nt, Escherichia coli CFT073
accacguaacgacuga

SEQ ID NO: 2593022 - RNA, 23 nt, Escherichia coli CFT073
accacguucggugauauacgcca

SEQ ID NO: 2593023 - RNA, 17 nt, Escherichia coli CFT073
accacuaccgugucugc

SEQ ID NO: 2593024 - RNA, 18 nt, Escherichia coli CFT073
accacuaucaaccacggc

SEQ ID NO: 2593025 - RNA, 21 nt, Escherichia coli CFT073
accacuaucaaccacggcaac

SEQ ID NO: 2593026 - RNA, 15 nt, Escherichia coli CFT073
accacuauuguugaa

SEQ ID NO: 2593027 - RNA, 23 nt, Escherichia coli CFT073
accacucaaaagcguaccgccaa

SEQ ID NO: 2593028 - RNA, 23 nt, Escherichia coli CFT073
accacuccgguaauaucgcgcag

SEQ ID NO: 2593029 - RNA, 19 nt, Escherichia coli CFT073
accacucgauuaacucaua

SEQ ID NO: 2593030 - RNA, 13 nt, Escherichia coli CFT073
accacugacaauc

SEQ ID NO: 2593031 - RNA, 22 nt, Escherichia coli CFT073
accacugacacaggcagcaauc

SEQ ID NO: 2593032 - RNA, 18 nt, Escherichia coli CFT073
accacugacacggaacaa

SEQ ID NO: 2593033 - RNA, 18 nt, Escherichia coli CFT073
accacugaccgcccggcc

SEQ ID NO: 2593034 - RNA, 22 nt, Escherichia coli CFT073
accacugcgacgcggcgguucu

SEQ ID NO: 2593035 - RNA, 15 nt, Escherichia coli CFT073
accacuggcacaaga

SEQ ID NO: 2593036 - RNA, 14 nt, Escherichia coli CFT073
accacuguuuuuca

SEQ ID NO: 2593037 - RNA, 16 nt, Escherichia coli CFT073
accacuucagaaccgu

SEQ ID NO: 2593038 - RNA, 16 nt, Escherichia coli CFT073
accacuucauacuccg

SEQ ID NO: 2593039 - RNA, 21 nt, Escherichia coli CFT073
accacuucauacuccgucugc

SEQ ID NO: 2593040 - RNA, 21 nt, Escherichia coli CFT073
accacuucauccggauacagc

SEQ ID NO: 2593041 - RNA, 20 nt, Escherichia coli CFT073
accacuuccagcagaccagc

SEQ ID NO: 2593042 - RNA, 14 nt, Escherichia coli CFT073
accacuucuucuug

SEQ ID NO: 2593043 - RNA, 12 nt, Escherichia coli CFT073
accacuugcugg

SEQ ID NO: 2593044 - RNA, 16 nt, Escherichia coli CFT073
accacuuuaccgcuca

SEQ ID NO: 2593045 - RNA, 17 nt, Escherichia coli CFT073
accacuuuacgcaaaau

SEQ ID NO: 2593046 - RNA, 18 nt, Escherichia coli CFT073
accacuuuacgcaaaaua

SEQ ID NO: 2593047 - RNA, 18 nt, Escherichia coli CFT073
accacuuuaucggcaccc

SEQ ID NO: 2593048 - RNA, 22 nt, Escherichia coli CFT073
accacuuuggugaaugccugau

SEQ ID NO: 2593049 - RNA, 13 nt, Escherichia coli CFT073
accagaaacgcca

SEQ ID NO: 2593050 - RNA, 17 nt, Escherichia coli CFT073
accagaaagcgacccgg

SEQ ID NO: 2593051 - RNA, 20 nt, Escherichia coli CFT073
accagaaagcgacccgguuc

SEQ ID NO: 2593052 - RNA, 16 nt, Escherichia coli CFT073
accagaaccagcaacc

SEQ ID NO: 2593053 - RNA, 23 nt, Escherichia coli CFT073
accagaaccgccgcugucugaau

SEQ ID NO: 2593054 - RNA, 19 nt, Escherichia coli CFT073
accagaauagcggcuucau

SEQ ID NO: 2593055 - RNA, 22 nt, Escherichia coli CFT073
accagaaucaucauaucgucau

SEQ ID NO: 2593056 - RNA, 14 nt, Escherichia coli CFT073
accagaaucgccag

SEQ ID NO: 2593057 - RNA, 16 nt, Escherichia coli CFT073
accagaaucgccagca

SEQ ID NO: 2593058 - RNA, 18 nt, Escherichia coli CFT073
accagaaucgccagcauc

SEQ ID NO: 2593059 - RNA, 19 nt, Escherichia coli CFT073
accagaaucgccagcaucg

SEQ ID NO: 2593060 - RNA, 15 nt, Escherichia coli CFT073
accagaauugaccag

SEQ ID NO: 2593061 - RNA, 21 nt, Escherichia coli CFT073
accagaauugaccaguaauau

SEQ ID NO: 2593062 - RNA, 16 nt, Escherichia coli CFT073
accagacaacagucaa

SEQ ID NO: 2593063 - RNA, 23 nt, Escherichia coli CFT073
accagacaacagucaaccgccug

SEQ ID NO: 2593064 - RNA, 19 nt, Escherichia coli CFT073
accagacaucaaguaaccu

SEQ ID NO: 2593065 - RNA, 17 nt, Escherichia coli CFT073
accagaccaauggcuuu

SEQ ID NO: 2593066 - RNA, 20 nt, Escherichia coli CFT073
accagaccauacagugucca

SEQ ID NO: 2593067 - RNA, 17 nt, Escherichia coli CFT073
accagacgcaacagaaa

SEQ ID NO: 2593068 - RNA, 21 nt, Escherichia coli CFT073
accagacgcgcguccccugcc

SEQ ID NO: 2593069 - RNA, 13 nt, Escherichia coli CFT073
accagagauaaaa

SEQ ID NO: 2593070 - RNA, 21 nt, Escherichia coli CFT073
accagagauagcgaaccgcag

SEQ ID NO: 2593071 - RNA, 23 nt, Escherichia coli CFT073
accagagauguugaagaagucga

SEQ ID NO: 2593072 - RNA, 15 nt, Escherichia coli CFT073
accagauccugccau

SEQ ID NO: 2593073 - RNA, 12 nt, Escherichia coli CFT073
accagaucgccu

SEQ ID NO: 2593074 - RNA, 18 nt, Escherichia coli CFT073
accagaucuuccagcggc

SEQ ID NO: 2593075 - RNA, 18 nt, Escherichia coli CFT073
accagauggcuuuccacc

SEQ ID NO: 2593076 - RNA, 18 nt, Escherichia coli CFT073
accagauuaccgccuuca

SEQ ID NO: 2593077 - RNA, 14 nt, Escherichia coli CFT073
accagcaaagugcg

SEQ ID NO: 2593078 - RNA, 12 nt, Escherichia coli CFT073
accagcaaugcc

SEQ ID NO: 2593079 - RNA, 16 nt, Escherichia coli CFT073
accagcaaugccagcg

SEQ ID NO: 2593080 - RNA, 16 nt, Escherichia coli CFT073
accagcacaccgucag

SEQ ID NO: 2593081 - RNA, 15 nt, Escherichia coli CFT073
accagcacaucauca

SEQ ID NO: 2593082 - RNA, 14 nt, Escherichia coli CFT073
accagcacaugcuu

SEQ ID NO: 2593083 - RNA, 15 nt, Escherichia coli CFT073
accagcaccagcaac

SEQ ID NO: 2593084 - RNA, 20 nt, Escherichia coli CFT073
accagcaccagcaacaacaa

SEQ ID NO: 2593085 - RNA, 18 nt, Escherichia coli CFT073
accagcaccgccagcagc

SEQ ID NO: 2593086 - RNA, 21 nt, Escherichia coli CFT073
accagcaccuuuuccaguggc

SEQ ID NO: 2593087 - RNA, 15 nt, Escherichia coli CFT073
accagcacguuaauc

SEQ ID NO: 2593088 - RNA, 14 nt, Escherichia coli CFT073
accagcagcaucac

SEQ ID NO: 2593089 - RNA, 15 nt, Escherichia coli CFT073
accagcagcaucacg

SEQ ID NO: 2593090 - RNA, 15 nt, Escherichia coli CFT073
accagcagcccugcc

SEQ ID NO: 2593091 - RNA, 19 nt, Escherichia coli CFT073
accagcagcgucagcacuu

SEQ ID NO: 2593092 - RNA, 16 nt, Escherichia coli CFT073
accagcaggccgucgc

SEQ ID NO: 2593093 - RNA, 15 nt, Escherichia coli CFT073
accagcagggugcua

SEQ ID NO: 2593094 - RNA, 22 nt, Escherichia coli CFT073
accagcaggucgauaauuuuca

SEQ ID NO: 2593095 - RNA, 16 nt, Escherichia coli CFT073
accagcaguaaaccgc

SEQ ID NO: 2593096 - RNA, 18 nt, Escherichia coli CFT073
accagcaguaaaccgcuc

SEQ ID NO: 2593097 - RNA, 13 nt, Escherichia coli CFT073
accagcaucaaca

SEQ ID NO: 2593098 - RNA, 15 nt, Escherichia coli CFT073
accagcaucaacaac

SEQ ID NO: 2593099 - RNA, 11 nt, Escherichia coli CFT073
accagcaucgc

SEQ ID NO: 2593100 - RNA, 22 nt, Escherichia coli CFT073
accagcauuccuaaaccaucag

SEQ ID NO: 2593101 - RNA, 14 nt, Escherichia coli CFT073
accagccacggcgc

SEQ ID NO: 2593102 - RNA, 16 nt, Escherichia coli CFT073
accagccagacucagc

SEQ ID NO: 2593103 - RNA, 17 nt, Escherichia coli CFT073
accagccaggccgccag

SEQ ID NO: 2593104 - RNA, 19 nt, Escherichia coli CFT073
accagccaguagaacaauu

SEQ ID NO: 2593105 - RNA, 21 nt, Escherichia coli CFT073
accagccaguagaacaauuaa

SEQ ID NO: 2593106 - RNA, 17 nt, Escherichia coli CFT073
accagccaguagcaccu

SEQ ID NO: 2593107 - RNA, 21 nt, Escherichia coli CFT073
accagccauuaaccagccacu

SEQ ID NO: 2593108 - RNA, 23 nt, Escherichia coli CFT073
accagccauuaaccagccacugc

SEQ ID NO: 2593109 - RNA, 12 nt, Escherichia coli CFT073
accagccgccaa

SEQ ID NO: 2593110 - RNA, 15 nt, Escherichia coli CFT073
accagccuucuucau

SEQ ID NO: 2593111 - RNA, 15 nt, Escherichia coli CFT073
accagcgaaaccuga

SEQ ID NO: 2593112 - RNA, 15 nt, Escherichia coli CFT073
accagcgaaacgcaa

SEQ ID NO: 2593113 - RNA, 19 nt, Escherichia coli CFT073
accagcgacagccagccca

SEQ ID NO: 2593114 - RNA, 17 nt, Escherichia coli CFT073
accagcgcaauauguuu

SEQ ID NO: 2593115 - RNA, 18 nt, Escherichia coli CFT073
accagcgcacugccgcca

SEQ ID NO: 2593116 - RNA, 19 nt, Escherichia coli CFT073
accagcgcacugccgccau

SEQ ID NO: 2593117 - RNA, 14 nt, Escherichia coli CFT073
accagcgcaggaac

SEQ ID NO: 2593118 - RNA, 13 nt, Escherichia coli CFT073
accagcgccacca

SEQ ID NO: 2593119 - RNA, 22 nt, Escherichia coli CFT073
accagcgccaccacccagaaca

SEQ ID NO: 2593120 - RNA, 18 nt, Escherichia coli CFT073
accagcgccaccacgccg

SEQ ID NO: 2593121 - RNA, 17 nt, Escherichia coli CFT073
accagcgccgccacuac

SEQ ID NO: 2593122 - RNA, 13 nt, Escherichia coli CFT073
accagcgccucuu

SEQ ID NO: 2593123 - RNA, 18 nt, Escherichia coli CFT073
accagcgcgccgucgaug

SEQ ID NO: 2593124 - RNA, 17 nt, Escherichia coli CFT073
accaucggaucggccau

SEQ ID NO: 2593125 - RNA, 15 nt, Escherichia coli CFT073
accaucggcgcuggc

SEQ ID NO: 2593126 - RNA, 17 nt, Escherichia coli CFT073
accaucggcgcuggcgu

SEQ ID NO: 2593127 - RNA, 14 nt, Escherichia coli CFT073
accaucgguacgcu

SEQ ID NO: 2593128 - RNA, 20 nt, Escherichia coli CFT073
accaucgguuguuuucagua

SEQ ID NO: 2593129 - RNA, 19 nt, Escherichia coli CFT073
accaucuauccgaugcaaa

SEQ ID NO: 2593130 - RNA, 17 nt, Escherichia coli CFT073
accaucugauucuuccc

SEQ ID NO: 2593131 - RNA, 18 nt, Escherichia coli CFT073
accaucugauucuuccca

SEQ ID NO: 2593132 - RNA, 21 nt, Escherichia coli CFT073
accaucuucacuguccgccag

SEQ ID NO: 2593133 - RNA, 15 nt, Escherichia coli CFT073
accaucuuuuuuuug

SEQ ID NO: 2593134 - RNA, 15 nt, Escherichia coli CFT073
accaugaauuucacg

SEQ ID NO: 2593135 - RNA, 21 nt, Escherichia coli CFT073
accaugacgcaccuuguucau

SEQ ID NO: 2593136 - RNA, 14 nt, Escherichia coli CFT073
accaugaucugcaa

SEQ ID NO: 2593137 - RNA, 15 nt, Escherichia coli CFT073
accaugauuccccag

SEQ ID NO: 2593138 - RNA, 20 nt, Escherichia coli CFT073
accaugauuucguauacugc

SEQ ID NO: 2593139 - RNA, 23 nt, Escherichia coli CFT073
accaugauuucguauacugcagc

SEQ ID NO: 2593140 - RNA, 14 nt, Escherichia coli CFT073
accaugcaaucacu

SEQ ID NO: 2593141 - RNA, 21 nt, Escherichia coli CFT073
accaugcaaucacugccacca

SEQ ID NO: 2593142 - RNA, 14 nt, Escherichia coli CFT073
accaugcaccaacc

SEQ ID NO: 2593143 - RNA, 18 nt, Escherichia coli CFT073
accaugcagcgccgcgua

SEQ ID NO: 2593144 - RNA, 16 nt, Escherichia coli CFT073
accaugccaacgcgga

SEQ ID NO: 2593145 - RNA, 17 nt, Escherichia coli CFT073
accaugccaguuucuuu

SEQ ID NO: 2593146 - RNA, 16 nt, Escherichia coli CFT073
accaugcugaugcuac

SEQ ID NO: 2593147 - RNA, 13 nt, Escherichia coli CFT073
accaugucaucaa

SEQ ID NO: 2593148 - RNA, 14 nt, Escherichia coli CFT073
accaugucaucaau

SEQ ID NO: 2593149 - RNA, 22 nt, Escherichia coli CFT073
accauguugcgcagaguuucca

SEQ ID NO: 2593150 - RNA, 20 nt, Escherichia coli CFT073
accauuaccaaucugcucug

SEQ ID NO: 2593151 - RNA, 14 nt, Escherichia coli CFT073
accauuaccccuga

SEQ ID NO: 2593152 - RNA, 22 nt, Escherichia coli CFT073
accauuagucuggauugcagag

SEQ ID NO: 2593153 - RNA, 12 nt, Escherichia coli CFT073
accauucccaga

SEQ ID NO: 2593154 - RNA, 12 nt, Escherichia coli CFT073
accauucccugg

SEQ ID NO: 2593155 - RNA, 16 nt, Escherichia coli CFT073
accauugaagcaaucc

SEQ ID NO: 2593156 - RNA, 23 nt, Escherichia coli CFT073
accauugaagcaauccauaccag

SEQ ID NO: 2593157 - RNA, 18 nt, Escherichia coli CFT073
accauuggugcuguucug

SEQ ID NO: 2593158 - RNA, 19 nt, Escherichia coli CFT073
accauuggugcuguucugc

SEQ ID NO: 2593159 - RNA, 14 nt, Escherichia coli CFT073
accauuucugcgag

SEQ ID NO: 2593160 - RNA, 16 nt, Escherichia coli CFT073
acccaaaaaauagcaa

SEQ ID NO: 2593161 - RNA, 17 nt, Escherichia coli CFT073
acccaaaaaauagcaaa

SEQ ID NO: 2593162 - RNA, 20 nt, Escherichia coli CFT073
acccaacauggucaucauca

SEQ ID NO: 2593163 - RNA, 18 nt, Escherichia coli CFT073
acccaaccgauaaccacg

SEQ ID NO: 2593164 - RNA, 15 nt, Escherichia coli CFT073
acccaaccggcaaug

SEQ ID NO: 2593165 - RNA, 21 nt, Escherichia coli CFT073
acccaacuuuguuguuuacca

SEQ ID NO: 2593166 - RNA, 18 nt, Escherichia coli CFT073
acccaagcgggaauagcu

SEQ ID NO: 2593167 - RNA, 20 nt, Escherichia coli CFT073
acccaaucccccacuuuuaa

SEQ ID NO: 2593168 - RNA, 21 nt, Escherichia coli CFT073
acccacaccgcagaacagauc

SEQ ID NO: 2593169 - RNA, 14 nt, Escherichia coli CFT073
acccacacuucaau

SEQ ID NO: 2593170 - RNA, 12 nt, Escherichia coli CFT073
acccacagccau

SEQ ID NO: 2593171 - RNA, 16 nt, Escherichia coli CFT073
acccacauguugcgcu

SEQ ID NO: 2593172 - RNA, 22 nt, Escherichia coli CFT073
acccacauguugcgcuucacca

SEQ ID NO: 2593173 - RNA, 12 nt, Escherichia coli CFT073
acccaccgcagc

SEQ ID NO: 2593174 - RNA, 14 nt, Escherichia coli CFT073
acccacgaaaucuu

SEQ ID NO: 2593175 - RNA, 19 nt, Escherichia coli CFT073
acccacgguacucaucacg

SEQ ID NO: 2593176 - RNA, 21 nt, Escherichia coli CFT073
acccacuaacugaucacguuu

SEQ ID NO: 2593177 - RNA, 20 nt, Escherichia coli CFT073
acccagaaccauugagcuuu

SEQ ID NO: 2593178 - RNA, 16 nt, Escherichia coli CFT073
acccagacaaaauuca

SEQ ID NO: 2593179 - RNA, 15 nt, Escherichia coli CFT073
acccagcaaugccag

SEQ ID NO: 2593180 - RNA, 18 nt, Escherichia coli CFT073
acccagcaaugccaggcu

SEQ ID NO: 2593181 - RNA, 18 nt, Escherichia coli CFT073
acccagcaccaguaccau

SEQ ID NO: 2593182 - RNA, 22 nt, Escherichia coli CFT073
acccagccccgguuuuucuggc

SEQ ID NO: 2593183 - RNA, 16 nt, Escherichia coli CFT073
acccagcgccagcaua

SEQ ID NO: 2593184 - RNA, 21 nt, Escherichia coli CFT073
acccagcggauaaagcagggc

SEQ ID NO: 2593185 - RNA, 23 nt, Escherichia coli CFT073
acccagcggauguuggguuagcc

SEQ ID NO: 2593186 - RNA, 20 nt, Escherichia coli CFT073
acccagcguguugaggaagc

SEQ ID NO: 2593187 - RNA, 13 nt, Escherichia coli CFT073
acccagcuucagc

SEQ ID NO: 2593188 - RNA, 15 nt, Escherichia coli CFT073
acccaggccaucaga

SEQ ID NO: 2593189 - RNA, 22 nt, Escherichia coli CFT073
acccaguaacgggccgcccaua

SEQ ID NO: 2593190 - RNA, 18 nt, Escherichia coli CFT073
acccagucccaccaucag

SEQ ID NO: 2593191 - RNA, 15 nt, Escherichia coli CFT073
acccaguuuaccgaa

SEQ ID NO: 2593192 - RNA, 13 nt, Escherichia coli CFT073
acccaguuucaug

SEQ ID NO: 2593193 - RNA, 16 nt, Escherichia coli CFT073
acccauccagcagaga

SEQ ID NO: 2593194 - RNA, 14 nt, Escherichia coli CFT073
acccaucgccagca

SEQ ID NO: 2593195 - RNA, 17 nt, Escherichia coli CFT073
acccaucuugucauugu

SEQ ID NO: 2593196 - RNA, 19 nt, Escherichia coli CFT073
acccaugaagaaaauucca

SEQ ID NO: 2593197 - RNA, 14 nt, Escherichia coli CFT073
acccauugccugau

SEQ ID NO: 2593198 - RNA, 15 nt, Escherichia coli CFT073
acccauuuauccagc

SEQ ID NO: 2593199 - RNA, 21 nt, Escherichia coli CFT073
acccauuuauccagcggcagc

SEQ ID NO: 2593200 - RNA, 23 nt, Escherichia coli CFT073
acccauuuauccagcggcagcca

SEQ ID NO: 2593201 - RNA, 18 nt, Escherichia coli CFT073
accccaauaauucuuccu

SEQ ID NO: 2593202 - RNA, 14 nt, Escherichia coli CFT073
accccaauguuuuu

SEQ ID NO: 2593203 - RNA, 15 nt, Escherichia coli CFT073
accccaccgccgagg

SEQ ID NO: 2593204 - RNA, 15 nt, Escherichia coli CFT073
accccagaugaguaa

SEQ ID NO: 2593205 - RNA, 14 nt, Escherichia coli CFT073
accccagauggauc

SEQ ID NO: 2593206 - RNA, 11 nt, Escherichia coli CFT073
accccagccag

SEQ ID NO: 2593207 - RNA, 21 nt, Escherichia coli CFT073
accccagcggcaaccagcagc

SEQ ID NO: 2593208 - RNA, 14 nt, Escherichia coli CFT073
accccagcuggcgc

SEQ ID NO: 2593209 - RNA, 16 nt, Escherichia coli CFT073
accccaggcugugcgc

SEQ ID NO: 2593210 - RNA, 16 nt, Escherichia coli CFT073
accccauagccagcga

SEQ ID NO: 2593211 - RNA, 20 nt, Escherichia coli CFT073
accccauauuggcaacagcc

SEQ ID NO: 2593212 - RNA, 18 nt, Escherichia coli CFT073
accccauuaauaccgcca

SEQ ID NO: 2593213 - RNA, 13 nt, Escherichia coli CFT073
acccccagacgac

SEQ ID NO: 2593214 - RNA, 23 nt, Escherichia coli CFT073
acccccguguuuuugugccagag

SEQ ID NO: 2593215 - RNA, 16 nt, Escherichia coli CFT073
accccgccagcagaau

SEQ ID NO: 2593216 - RNA, 21 nt, Escherichia coli CFT073
accccgccagcagaaugacau

SEQ ID NO: 2593217 - RNA, 19 nt, Escherichia coli CFT073
accccggauuacgcaucag

SEQ ID NO: 2593218 - RNA, 22 nt, Escherichia coli CFT073
accccgguuguuacugauuaac

SEQ ID NO: 2593219 - RNA, 15 nt, Escherichia coli CFT073
accccguauccaccg

SEQ ID NO: 2593220 - RNA, 16 nt, Escherichia coli CFT073
accccguugcuucgcc

SEQ ID NO: 2593221 - RNA, 22 nt, Escherichia coli CFT073
accccuacggcgacagcaaaau

SEQ ID NO: 2593222 - RNA, 12 nt, Escherichia coli CFT073
accccugcauaa

SEQ ID NO: 2593223 - RNA, 14 nt, Escherichia coli CFT073
acccgaagcgccaa

SEQ ID NO: 2593224 - RNA, 16 nt, Escherichia coli CFT073
acccgacgugcagcau

SEQ ID NO: 2593225 - RNA, 22 nt, Escherichia coli CFT073
acccgagagaacugcugcaucc

SEQ ID NO: 2593226 - RNA, 13 nt, Escherichia coli CFT073
acccgagcgccag

SEQ ID NO: 2593227 - RNA, 15 nt, Escherichia coli CFT073
acccgaugaucaaaa

SEQ ID NO: 2593228 - RNA, 18 nt, Escherichia coli CFT073
acccgaugaucaaaaaaa

SEQ ID NO: 2593229 - RNA, 14 nt, Escherichia coli CFT073
acccgaugcgcuuu

SEQ ID NO: 2593230 - RNA, 17 nt, Escherichia coli CFT073
acccgauggcgugcccg

SEQ ID NO: 2593231 - RNA, 20 nt, Escherichia coli CFT073
acccgcaaagagcagcaacc

SEQ ID NO: 2593232 - RNA, 13 nt, Escherichia coli CFT073
acccgcaaauaau

SEQ ID NO: 2593233 - RNA, 12 nt, Escherichia coli CFT073
acccgcaacagc

SEQ ID NO: 2593234 - RNA, 19 nt, Escherichia coli CFT073
acccgcaacgcccugcaac

SEQ ID NO: 2593235 - RNA, 13 nt, Escherichia coli CFT073
acccgcaaucauc

SEQ ID NO: 2593236 - RNA, 22 nt, Escherichia coli CFT073
acccgcacaaauagccagcaga

SEQ ID NO: 2593237 - RNA, 15 nt, Escherichia coli CFT073
acccgcacggucacu

SEQ ID NO: 2593238 - RNA, 15 nt, Escherichia coli CFT073
acccgcagccagcac

SEQ ID NO: 2593239 - RNA, 17 nt, Escherichia coli CFT073
acccgcagccagcacug

SEQ ID NO: 2593240 - RNA, 13 nt, Escherichia coli CFT073
acccgccagaauc

SEQ ID NO: 2593241 - RNA, 21 nt, Escherichia coli CFT073
acccgccagaauccccggcag

SEQ ID NO: 2593242 - RNA, 23 nt, Escherichia coli CFT073
acccgccagaauccccggcagga

SEQ ID NO: 2593243 - RNA, 13 nt, Escherichia coli CFT073
acccgccagugua

SEQ ID NO: 2593244 - RNA, 15 nt, Escherichia coli CFT073
acccgccaucgcccg

SEQ ID NO: 2593245 - RNA, 23 nt, Escherichia coli CFT073
acccgcccagugcugagaguaac

SEQ ID NO: 2593246 - RNA, 14 nt, Escherichia coli CFT073
acccgccguggaga

SEQ ID NO: 2593247 - RNA, 13 nt, Escherichia coli CFT073
acccgccugauag

SEQ ID NO: 2593248 - RNA, 15 nt, Escherichia coli CFT073
acccgccuucacuuc

SEQ ID NO: 2593249 - RNA, 15 nt, Escherichia coli CFT073
acccgcggcugcagc

SEQ ID NO: 2593250 - RNA, 16 nt, Escherichia coli CFT073
acccgcguuacgccau

SEQ ID NO: 2593251 - RNA, 17 nt, Escherichia coli CFT073
acccgcucaaacaccgu

SEQ ID NO: 2593252 - RNA, 20 nt, Escherichia coli CFT073
acccggagccauugcccgau

SEQ ID NO: 2593253 - RNA, 20 nt, Escherichia coli CFT073
acccggauuuuucagcgcca

SEQ ID NO: 2593254 - RNA, 13 nt, Escherichia coli CFT073
acccggccacagc

SEQ ID NO: 2593255 - RNA, 14 nt, Escherichia coli CFT073
acccggccacagcg

SEQ ID NO: 2593256 - RNA, 18 nt, Escherichia coli CFT073
acccggccacagcgccag

SEQ ID NO: 2593257 - RNA, 14 nt, Escherichia coli CFT073
acccggcguuuuca

SEQ ID NO: 2593258 - RNA, 16 nt, Escherichia coli CFT073
acccggcuaacagucu

SEQ ID NO: 2593259 - RNA, 13 nt, Escherichia coli CFT073
acccgggucauca

SEQ ID NO: 2593260 - RNA, 16 nt, Escherichia coli CFT073
acccgguaaacaaaaa

SEQ ID NO: 2593261 - RNA, 20 nt, Escherichia coli CFT073
acccgguacaucaauaccau

SEQ ID NO: 2593262 - RNA, 15 nt, Escherichia coli CFT073
acccggugccgccgu

SEQ ID NO: 2593263 - RNA, 23 nt, Escherichia coli CFT073
acccgguucaauuuccaguuuca

SEQ ID NO: 2593264 - RNA, 18 nt, Escherichia coli CFT073
acccguaaaaaucggcaa

SEQ ID NO: 2593265 - RNA, 15 nt, Escherichia coli CFT073
acccgucgcggcaaa

SEQ ID NO: 2593266 - RNA, 19 nt, Escherichia coli CFT073
acccgucguugcaaucagc

SEQ ID NO: 2593267 - RNA, 21 nt, Escherichia coli CFT073
acccgugcagguucuuuuaaa

SEQ ID NO: 2593268 - RNA, 14 nt, Escherichia coli CFT073
acccgugcauccca

SEQ ID NO: 2593269 - RNA, 15 nt, Escherichia coli CFT073
acccgugcaucccag

SEQ ID NO: 2593270 - RNA, 16 nt, Escherichia coli CFT073
acccguguuuugcauc

SEQ ID NO: 2593271 - RNA, 19 nt, Escherichia coli CFT073
acccguguuuugcaucaac

SEQ ID NO: 2593272 - RNA, 23 nt, Escherichia coli CFT073
acccguucgaugcgauaaccagg

SEQ ID NO: 2593273 - RNA, 18 nt, Escherichia coli CFT073
acccguugguuugauagc

SEQ ID NO: 2593274 - RNA, 23 nt, Escherichia coli CFT073
acccguugguuugauagcaaugc

SEQ ID NO: 2593275 - RNA, 14 nt, Escherichia coli CFT073
acccuaacaucauc

SEQ ID NO: 2593276 - RNA, 21 nt, Escherichia coli CFT073
acccucaaaauuucucuuuca

SEQ ID NO: 2593277 - RNA, 16 nt, Escherichia coli CFT073
acccucaaacgccagc

SEQ ID NO: 2593278 - RNA, 13 nt, Escherichia coli CFT073
acccucacgcauu

SEQ ID NO: 2593279 - RNA, 21 nt, Escherichia coli CFT073
acccucacgcauucucuuuuc

SEQ ID NO: 2593280 - RNA, 23 nt, Escherichia coli CFT073
acccucgaccaucuccuuacugc

SEQ ID NO: 2593281 - RNA, 17 nt, Escherichia coli CFT073
acccucuccccggaggg

SEQ ID NO: 2593282 - RNA, 17 nt, Escherichia coli CFT073
acccucuguccgccagg

SEQ ID NO: 2593283 - RNA, 13 nt, Escherichia coli CFT073
acccugacccaga

SEQ ID NO: 2593284 - RNA, 23 nt, Escherichia coli CFT073
acccugacuguuuuuccagcuua

SEQ ID NO: 2593285 - RNA, 21 nt, Escherichia coli CFT073
acccugaguuuucaguaccgc

SEQ ID NO: 2593286 - RNA, 19 nt, Escherichia coli CFT073
acccugaugcccaaaaaaa

SEQ ID NO: 2593287 - RNA, 14 nt, Escherichia coli CFT073
acccugauggcuga

SEQ ID NO: 2593288 - RNA, 13 nt, Escherichia coli CFT073
acccugccacagu

SEQ ID NO: 2593289 - RNA, 12 nt, Escherichia coli CFT073
acccugcgcaug

SEQ ID NO: 2593290 - RNA, 16 nt, Escherichia coli CFT073
acccugcgccagcgca

SEQ ID NO: 2593291 - RNA, 20 nt, Escherichia coli CFT073
acccugcgccagcgcaucau

SEQ ID NO: 2593292 - RNA, 22 nt, Escherichia coli CFT073
acccuggucgguuucagccagg

SEQ ID NO: 2593293 - RNA, 15 nt, Escherichia coli CFT073
acccugguuagcaac

SEQ ID NO: 2593294 - RNA, 18 nt, Escherichia coli CFT073
acccuguggaucuucccc

SEQ ID NO: 2593295 - RNA, 20 nt, Escherichia coli CFT073
acccuguggaucuuccccuu

SEQ ID NO: 2593296 - RNA, 20 nt, Escherichia coli CFT073
acccuugacccguuuuaaau

SEQ ID NO: 2593297 - RNA, 19 nt, Escherichia coli CFT073
acccuuuuugauucaccac

SEQ ID NO: 2593298 - RNA, 15 nt, Escherichia coli CFT073
accgaaaaucacgcu

SEQ ID NO: 2593299 - RNA, 13 nt, Escherichia coli CFT073
accgaaagcacug

SEQ ID NO: 2593300 - RNA, 13 nt, Escherichia coli CFT073
accgaaaucgcca

SEQ ID NO: 2593301 - RNA, 15 nt, Escherichia coli CFT073
accgaacaaaacagc

SEQ ID NO: 2593302 - RNA, 14 nt, Escherichia coli CFT073
accgaacagcauac

SEQ ID NO: 2593303 - RNA, 16 nt, Escherichia coli CFT073
accgaacaugccgcca

SEQ ID NO: 2593304 - RNA, 15 nt, Escherichia coli CFT073
accgaacggagucgg

SEQ ID NO: 2593305 - RNA, 18 nt, Escherichia coli CFT073
accgaacggagucggguc

SEQ ID NO: 2593306 - RNA, 15 nt, Escherichia coli CFT073
accgaagaguaacca

SEQ ID NO: 2593307 - RNA, 19 nt, Escherichia coli CFT073
accgaagaguaaccaaacg

SEQ ID NO: 2593308 - RNA, 20 nt, Escherichia coli CFT073
accgaagggaucuuccaguu

SEQ ID NO: 2593309 - RNA, 15 nt, Escherichia coli CFT073
accgaagucaguaau

SEQ ID NO: 2593310 - RNA, 14 nt, Escherichia coli CFT073
accgaauccagcaa

SEQ ID NO: 2593311 - RNA, 16 nt, Escherichia coli CFT073
accgaauccagcaagc

SEQ ID NO: 2593312 - RNA, 12 nt, Escherichia coli CFT073
accgaauucugc

SEQ ID NO: 2593313 - RNA, 17 nt, Escherichia coli CFT073
accgacaauauugaugc

SEQ ID NO: 2593314 - RNA, 14 nt, Escherichia coli CFT073
accgacaauccagu

SEQ ID NO: 2593315 - RNA, 22 nt, Escherichia coli CFT073
accgacaauccaguugguucaa

SEQ ID NO: 2593316 - RNA, 16 nt, Escherichia coli CFT073
accgacacuacaaauu

SEQ ID NO: 2593317 - RNA, 20 nt, Escherichia coli CFT073
accgaccacggccaguccgu

SEQ ID NO: 2593318 - RNA, 16 nt, Escherichia coli CFT073
accgacgaucaacaga

SEQ ID NO: 2593319 - RNA, 17 nt, Escherichia coli CFT073
accgacgaucaacagaa

SEQ ID NO: 2593320 - RNA, 22 nt, Escherichia coli CFT073
accgacgaucgggaacagccac

SEQ ID NO: 2593321 - RNA, 15 nt, Escherichia coli CFT073
accgacgggccugca

SEQ ID NO: 2593322 - RNA, 13 nt, Escherichia coli CFT073
accgacguucagg

SEQ ID NO: 2593323 - RNA, 16 nt, Escherichia coli CFT073
accgacugacgcucug

SEQ ID NO: 2593324 - RNA, 14 nt, Escherichia coli CFT073
accgacuucagcca

SEQ ID NO: 2593325 - RNA, 14 nt, Escherichia coli CFT073
accgagaaaaucau

SEQ ID NO: 2593326 - RNA, 16 nt, Escherichia coli CFT073
accgagauaaaugcca

SEQ ID NO: 2593327 - RNA, 21 nt, Escherichia coli CFT073
accgagaugguaaagcaccug

SEQ ID NO: 2593328 - RNA, 13 nt, Escherichia coli CFT073
accgagcacaccu

SEQ ID NO: 2593329 - RNA, 19 nt, Escherichia coli CFT073
accgagcagccacugcggc

SEQ ID NO: 2593330 - RNA, 18 nt, Escherichia coli CFT073
accgaggaugaauaacgc

SEQ ID NO: 2593331 - RNA, 19 nt, Escherichia coli CFT073
accgaggccaaaaccacag

SEQ ID NO: 2593332 - RNA, 16 nt, Escherichia coli CFT073
accgagggaagcaaua

SEQ ID NO: 2593333 - RNA, 19 nt, Escherichia coli CFT073
accgauaccuaacgccagc

SEQ ID NO: 2593334 - RNA, 20 nt, Escherichia coli CFT073
accgauagcagcccagauca

SEQ ID NO: 2593335 - RNA, 12 nt, Escherichia coli CFT073
accgaucaccac

SEQ ID NO: 2593336 - RNA, 15 nt, Escherichia coli CFT073
accgaucaccacaau

SEQ ID NO: 2593337 - RNA, 16 nt, Escherichia coli CFT073
accgaucgccagcagg

SEQ ID NO: 2593338 - RNA, 13 nt, Escherichia coli CFT073
accgaugaagccc

SEQ ID NO: 2593339 - RNA, 12 nt, Escherichia coli CFT073
accgaugaucgc

SEQ ID NO: 2593340 - RNA, 14 nt, Escherichia coli CFT073
accgaugccaccca

SEQ ID NO: 2593341 - RNA, 21 nt, Escherichia coli CFT073
accgauggcaaacaaacugcg

SEQ ID NO: 2593342 - RNA, 14 nt, Escherichia coli CFT073
accggaacuuucac

SEQ ID NO: 2593343 - RNA, 12 nt, Escherichia coli CFT073
accggaauuuac

SEQ ID NO: 2593344 - RNA, 13 nt, Escherichia coli CFT073
accggacaauaaa

SEQ ID NO: 2593345 - RNA, 22 nt, Escherichia coli CFT073
accggacgaaauccccccggug

SEQ ID NO: 2593346 - RNA, 15 nt, Escherichia coli CFT073
accggacggcucacu

SEQ ID NO: 2593347 - RNA, 22 nt, Escherichia coli CFT073
accggagcacagacuccgguuu

SEQ ID NO: 2593348 - RNA, 12 nt, Escherichia coli CFT073
accggagcugca

SEQ ID NO: 2593349 - RNA, 14 nt, Escherichia coli CFT073
accggagcugcagc

SEQ ID NO: 2593350 - RNA, 23 nt, Escherichia coli CFT073
accggauaagaggcgccagcauc

SEQ ID NO: 2593351 - RNA, 19 nt, Escherichia coli CFT073
accggauaaucggcaauac

SEQ ID NO: 2593352 - RNA, 19 nt, Escherichia coli CFT073
accggauacugcaauuuca

SEQ ID NO: 2593353 - RNA, 23 nt, Escherichia coli CFT073
accggauauagcguaaagccagc

SEQ ID NO: 2593354 - RNA, 17 nt, Escherichia coli CFT073
accggaucgaugccaaa

SEQ ID NO: 2593355 - RNA, 18 nt, Escherichia coli CFT073
accggaugcguucgcacc

SEQ ID NO: 2593356 - RNA, 18 nt, Escherichia coli CFT073
accggauuuucaccaucg

SEQ ID NO: 2593357 - RNA, 16 nt, Escherichia coli CFT073
accggcaaacuucguc

SEQ ID NO: 2593358 - RNA, 20 nt, Escherichia coli CFT073
accggcaaacuucgucaacu

SEQ ID NO: 2593359 - RNA, 13 nt, Escherichia coli CFT073
accggcaaauugg

SEQ ID NO: 2593360 - RNA, 21 nt, Escherichia coli CFT073
accggcaaauuggcguggcgg

SEQ ID NO: 2593361 - RNA, 22 nt, Escherichia coli CFT073
accggcaacagaacgcgccuua

SEQ ID NO: 2593362 - RNA, 16 nt, Escherichia coli CFT073
accggcaaccagcacc

SEQ ID NO: 2593363 - RNA, 16 nt, Escherichia coli CFT073
accggcaauaauuaac

SEQ ID NO: 2593364 - RNA, 13 nt, Escherichia coli CFT073
accggcaggugau

SEQ ID NO: 2593365 - RNA, 16 nt, Escherichia coli CFT073
accggcccaccaaaga

SEQ ID NO: 2593366 - RNA, 15 nt, Escherichia coli CFT073
accggcgaaaacggu

SEQ ID NO: 2593367 - RNA, 15 nt, Escherichia coli CFT073
accggcgauauccca

SEQ ID NO: 2593368 - RNA, 23 nt, Escherichia coli CFT073
accggcggcgacuggcugaacag

SEQ ID NO: 2593369 - RNA, 16 nt, Escherichia coli CFT073
accggcguaacgccgc

SEQ ID NO: 2593370 - RNA, 14 nt, Escherichia coli CFT073
accggcguuacgaa

SEQ ID NO: 2593371 - RNA, 19 nt, Escherichia coli CFT073
accggcguuucacauucuc

SEQ ID NO: 2593372 - RNA, 14 nt, Escherichia coli CFT073
accggcguuucugg

SEQ ID NO: 2593373 - RNA, 16 nt, Escherichia coli CFT073
accggcucuaucugga

SEQ ID NO: 2593374 - RNA, 12 nt, Escherichia coli CFT073
accggcuggcgc

SEQ ID NO: 2593375 - RNA, 15 nt, Escherichia coli CFT073
accggcuggcgcaua

SEQ ID NO: 2593376 - RNA, 19 nt, Escherichia coli CFT073
accggcuggcgcauaccaa

SEQ ID NO: 2593377 - RNA, 22 nt, Escherichia coli CFT073
accggcuggcuaacaugcccau

SEQ ID NO: 2593378 - RNA, 19 nt, Escherichia coli CFT073
accggcuuucgcuucaacc

SEQ ID NO: 2593379 - RNA, 20 nt, Escherichia coli CFT073
accggcuuucgcuucaacca

SEQ ID NO: 2593380 - RNA, 13 nt, Escherichia coli CFT073
accgggagaucca

SEQ ID NO: 2593381 - RNA, 21 nt, Escherichia coli CFT073
accgggcgcgaggccagcggc

SEQ ID NO: 2593382 - RNA, 18 nt, Escherichia coli CFT073
accggguagggcgaaacc

SEQ ID NO: 2593383 - RNA, 19 nt, Escherichia coli CFT073
accggguguucuuucucgc

SEQ ID NO: 2593384 - RNA, 13 nt, Escherichia coli CFT073
accggguuuucaa

SEQ ID NO: 2593385 - RNA, 13 nt, Escherichia coli CFT073
accgguacgccgc

SEQ ID NO: 2593386 - RNA, 15 nt, Escherichia coli CFT073
accgguacgccgcgu

SEQ ID NO: 2593387 - RNA, 18 nt, Escherichia coli CFT073
accgguacggauacgaau

SEQ ID NO: 2593388 - RNA, 18 nt, Escherichia coli CFT073
accgguaucugccagcac

SEQ ID NO: 2593389 - RNA, 17 nt, Escherichia coli CFT073
accgguauugcuccaga

SEQ ID NO: 2593390 - RNA, 20 nt, Escherichia coli CFT073
accgguccacuuccugcgcc

SEQ ID NO: 2593391 - RNA, 23 nt, Escherichia coli CFT073
accgguccuaacaaccaucccca

SEQ ID NO: 2593392 - RNA, 18 nt, Escherichia coli CFT073
accggucggggccagcgc

SEQ ID NO: 2593393 - RNA, 22 nt, Escherichia coli CFT073
accggucggggccagcgcaucc

SEQ ID NO: 2593394 - RNA, 19 nt, Escherichia coli CFT073
accggugaccaucagcaug

SEQ ID NO: 2593395 - RNA, 23 nt, Escherichia coli CFT073
accgguuccgggcuguuuuccag

SEQ ID NO: 2593396 - RNA, 18 nt, Escherichia coli CFT073
accgguugucgugguugg

SEQ ID NO: 2593397 - RNA, 19 nt, Escherichia coli CFT073
accgguugucgugguuggu

SEQ ID NO: 2593398 - RNA, 16 nt, Escherichia coli CFT073
accgguuucaauccag

SEQ ID NO: 2593399 - RNA, 17 nt, Escherichia coli CFT073
accgguuucaauccagg

SEQ ID NO: 2593400 - RNA, 12 nt, Escherichia coli CFT073
accguaaaaaua

SEQ ID NO: 2593401 - RNA, 18 nt, Escherichia coli CFT073
accguaaacccuaacauc

SEQ ID NO: 2593402 - RNA, 15 nt, Escherichia coli CFT073
accguaaacuuuagc

SEQ ID NO: 2593403 - RNA, 14 nt, Escherichia coli CFT073
accguaaagcacug

SEQ ID NO: 2593404 - RNA, 13 nt, Escherichia coli CFT073
accguaaauugca

SEQ ID NO: 2593405 - RNA, 23 nt, Escherichia coli CFT073
accguaacaggugauaauccaga

SEQ ID NO: 2593406 - RNA, 21 nt, Escherichia coli CFT073
accguaacgcauucgccguua

SEQ ID NO: 2593407 - RNA, 13 nt, Escherichia coli CFT073
accguaccaggca

SEQ ID NO: 2593408 - RNA, 19 nt, Escherichia coli CFT073
accguaccaggcauauuca

SEQ ID NO: 2593409 - RNA, 22 nt, Escherichia coli CFT073
accguaccaucauaagcgccag

SEQ ID NO: 2593410 - RNA, 20 nt, Escherichia coli CFT073
accguacucggcaguaucgg

SEQ ID NO: 2593411 - RNA, 13 nt, Escherichia coli CFT073
accguagaaggcg

SEQ ID NO: 2593412 - RNA, 16 nt, Escherichia coli CFT073
accguagaaggcgaca

SEQ ID NO: 2593413 - RNA, 20 nt, Escherichia coli CFT073
accguagaaggcgacaaagc

SEQ ID NO: 2593414 - RNA, 18 nt, Escherichia coli CFT073
accguagcguaaaucauc

SEQ ID NO: 2593415 - RNA, 19 nt, Escherichia coli CFT073
accguagcguaaaucaucg

SEQ ID NO: 2593416 - RNA, 19 nt, Escherichia coli CFT073
accguaggucggauaagac

SEQ ID NO: 2593417 - RNA, 20 nt, Escherichia coli CFT073
accguaggucggauaagacg

SEQ ID NO: 2593418 - RNA, 16 nt, Escherichia coli CFT073
accguaucuaccacug

SEQ ID NO: 2593419 - RNA, 19 nt, Escherichia coli CFT073
accguaugauguauauuuc

SEQ ID NO: 2593420 - RNA, 17 nt, Escherichia coli CFT073
accguauucaucgccau

SEQ ID NO: 2593421 - RNA, 18 nt, Escherichia coli CFT073
accgucaauaaaaacggc

SEQ ID NO: 2593422 - RNA, 18 nt, Escherichia coli CFT073
accgucacaucaauuaca

SEQ ID NO: 2593423 - RNA, 23 nt, Escherichia coli CFT073
accgucacguugcgacaaaccag

SEQ ID NO: 2593424 - RNA, 19 nt, Escherichia coli CFT073
accgucacuguugcuguag

SEQ ID NO: 2593425 - RNA, 15 nt, Escherichia coli CFT073
accgucagccagcac

SEQ ID NO: 2593426 - RNA, 17 nt, Escherichia coli CFT073
accgucagccagcacug

SEQ ID NO: 2593427 - RNA, 12 nt, Escherichia coli CFT073
accgucagcgca

SEQ ID NO: 2593428 - RNA, 14 nt, Escherichia coli CFT073
accgucaggauaaa

SEQ ID NO: 2593429 - RNA, 13 nt, Escherichia coli CFT073
accguccaccaga

SEQ ID NO: 2593430 - RNA, 13 nt, Escherichia coli CFT073
accguccagcguu

SEQ ID NO: 2593431 - RNA, 23 nt, Escherichia coli CFT073
accgucgagcagagaaacgccag

SEQ ID NO: 2593432 - RNA, 23 nt, Escherichia coli CFT073
accgucgcaauacccugacccag

SEQ ID NO: 2593433 - RNA, 22 nt, Escherichia coli CFT073
accgucgccucgccgagcagcu

SEQ ID NO: 2593434 - RNA, 17 nt, Escherichia coli CFT073
accgucgccuucaacgu

SEQ ID NO: 2593435 - RNA, 21 nt, Escherichia coli CFT073
accgucgucccuuccgcaaua

SEQ ID NO: 2593436 - RNA, 21 nt, Escherichia coli CFT073
accgucguggucgugaucgug

SEQ ID NO: 2593437 - RNA, 20 nt, Escherichia coli CFT073
accgucguuuugcggcguga

SEQ ID NO: 2593438 - RNA, 22 nt, Escherichia coli CFT073
accgucugaagggaugcugugc

SEQ ID NO: 2593439 - RNA, 12 nt, Escherichia coli CFT073
accgucuguaac

SEQ ID NO: 2593440 - RNA, 22 nt, Escherichia coli CFT073
accgucuucccgcagccacguc

SEQ ID NO: 2593441 - RNA, 21 nt, Escherichia coli CFT073
accgucuuuauccagcaccac

SEQ ID NO: 2593442 - RNA, 14 nt, Escherichia coli CFT073
accgugaaagagau

SEQ ID NO: 2593443 - RNA, 16 nt, Escherichia coli CFT073
accgugaaagagauca

SEQ ID NO: 2593444 - RNA, 14 nt, Escherichia coli CFT073
accgugaauugcac

SEQ ID NO: 2593445 - RNA, 17 nt, Escherichia coli CFT073
accgugaccgccugcgg

SEQ ID NO: 2593446 - RNA, 14 nt, Escherichia coli CFT073
accgugagcaaugc

SEQ ID NO: 2593447 - RNA, 15 nt, Escherichia coli CFT073
accgugagcaaugca

SEQ ID NO: 2593448 - RNA, 19 nt, Escherichia coli CFT073
accgugauccgccgcuggc

SEQ ID NO: 2593449 - RNA, 17 nt, Escherichia coli CFT073
accgugcacuucugcgg

SEQ ID NO: 2593450 - RNA, 15 nt, Escherichia coli CFT073
accuguaggccgaau

SEQ ID NO: 2593451 - RNA, 12 nt, Escherichia coli CFT073
accuguccagac

SEQ ID NO: 2593452 - RNA, 22 nt, Escherichia coli CFT073
accuguuaaugcgaaugaaaga

SEQ ID NO: 2593453 - RNA, 19 nt, Escherichia coli CFT073
accuguuaauucucccugc

SEQ ID NO: 2593454 - RNA, 14 nt, Escherichia coli CFT073
accuguucuucgcu

SEQ ID NO: 2593455 - RNA, 17 nt, Escherichia coli CFT073
accuguugugcgcggcu

SEQ ID NO: 2593456 - RNA, 12 nt, Escherichia coli CFT073
accuguuuucac

SEQ ID NO: 2593457 - RNA, 21 nt, Escherichia coli CFT073
accuguuuucgauuuuuucca

SEQ ID NO: 2593458 - RNA, 17 nt, Escherichia coli CFT073
accuguuuugccaggcu

SEQ ID NO: 2593459 - RNA, 18 nt, Escherichia coli CFT073
accuuacauauauuacuc

SEQ ID NO: 2593460 - RNA, 17 nt, Escherichia coli CFT073
accuuaccaaugcugca

SEQ ID NO: 2593461 - RNA, 12 nt, Escherichia coli CFT073
accuuauccagc

SEQ ID NO: 2593462 - RNA, 14 nt, Escherichia coli CFT073
accuuauccagcag

SEQ ID NO: 2593463 - RNA, 15 nt, Escherichia coli CFT073
accuuauccagcaga

SEQ ID NO: 2593464 - RNA, 16 nt, Escherichia coli CFT073
accuucaaaauuuaac

SEQ ID NO: 2593465 - RNA, 13 nt, Escherichia coli CFT073
accuucagcaaga

SEQ ID NO: 2593466 - RNA, 21 nt, Escherichia coli CFT073
accuucauagguaaacaucac

SEQ ID NO: 2593467 - RNA, 21 nt, Escherichia coli CFT073
accuucaucccuuucgcuuca

SEQ ID NO: 2593468 - RNA, 19 nt, Escherichia coli CFT073
accuucgcuaucaaacuga

SEQ ID NO: 2593469 - RNA, 20 nt, Escherichia coli CFT073
accuucggugaauuucacuu

SEQ ID NO: 2593470 - RNA, 16 nt, Escherichia coli CFT073
accuucguccauccca

SEQ ID NO: 2593471 - RNA, 22 nt, Escherichia coli CFT073
accuucuccggccuacaaaaca

SEQ ID NO: 2593472 - RNA, 17 nt, Escherichia coli CFT073
accuucugaauaaugac

SEQ ID NO: 2593473 - RNA, 13 nt, Escherichia coli CFT073
accuucugcgccc

SEQ ID NO: 2593474 - RNA, 15 nt, Escherichia coli CFT073
accuucuguuauaua

SEQ ID NO: 2593475 - RNA, 18 nt, Escherichia coli CFT073
accuucuguuauauauua

SEQ ID NO: 2593476 - RNA, 19 nt, Escherichia coli CFT073
accuucuguuauauauuac

SEQ ID NO: 2593477 - RNA, 20 nt, Escherichia coli CFT073
accuucuguuauauauuacc

SEQ ID NO: 2593478 - RNA, 13 nt, Escherichia coli CFT073
accuucuuccugc

SEQ ID NO: 2593479 - RNA, 15 nt, Escherichia coli CFT073
accuugauccugcag

SEQ ID NO: 2593480 - RNA, 19 nt, Escherichia coli CFT073
accuugcggaaacugucaa

SEQ ID NO: 2593481 - RNA, 20 nt, Escherichia coli CFT073
accuugcgggcaggcaaagu

SEQ ID NO: 2593482 - RNA, 16 nt, Escherichia coli CFT073
accuuguuucagcgca

SEQ ID NO: 2593483 - RNA, 22 nt, Escherichia coli CFT073
accuuuccccggcagcaucagu

SEQ ID NO: 2593484 - RNA, 16 nt, Escherichia coli CFT073
accuuucuccgcgacc

SEQ ID NO: 2593485 - RNA, 21 nt, Escherichia coli CFT073
accuuugaacagccagaauga

SEQ ID NO: 2593486 - RNA, 15 nt, Escherichia coli CFT073
accuuugaacugcug

SEQ ID NO: 2593487 - RNA, 16 nt, Escherichia coli CFT073
accuuuguauuuuucc

SEQ ID NO: 2593488 - RNA, 14 nt, Escherichia coli CFT073
accuuuuccagugg

SEQ ID NO: 2593489 - RNA, 22 nt, Escherichia coli CFT073
accuuuucgguggcguuuuuau

SEQ ID NO: 2593490 - RNA, 15 nt, Escherichia coli CFT073
acgaaaaggauaaau

SEQ ID NO: 2593491 - RNA, 23 nt, Escherichia coli CFT073
acgaaacaccggugaccaucagc

SEQ ID NO: 2593492 - RNA, 16 nt, Escherichia coli CFT073
acgaaacagacggcag

SEQ ID NO: 2593493 - RNA, 14 nt, Escherichia coli CFT073
acgaaacagugccg

SEQ ID NO: 2593494 - RNA, 12 nt, Escherichia coli CFT073
acgaaaccacuc

SEQ ID NO: 2593495 - RNA, 12 nt, Escherichia coli CFT073
acgaaagcgcgg

SEQ ID NO: 2593496 - RNA, 21 nt, Escherichia coli CFT073
acgaaaucggcaccgccgcca

SEQ ID NO: 2593497 - RNA, 18 nt, Escherichia coli CFT073
acgaaaucucacccggua

SEQ ID NO: 2593498 - RNA, 13 nt, Escherichia coli CFT073
acgaaaucuucca

SEQ ID NO: 2593499 - RNA, 14 nt, Escherichia coli CFT073
acgaaaugaauaau

SEQ ID NO: 2593500 - RNA, 15 nt, Escherichia coli CFT073
acgaacaauaucgcc

SEQ ID NO: 2593501 - RNA, 14 nt, Escherichia coli CFT073
acgaaccaaucacc

SEQ ID NO: 2593502 - RNA, 14 nt, Escherichia coli CFT073
acgaaccgagcggu

SEQ ID NO: 2593503 - RNA, 16 nt, Escherichia coli CFT073
acgaacgcagugauaa

SEQ ID NO: 2593504 - RNA, 22 nt, Escherichia coli CFT073
acgaacguuccccgcgauggcu

SEQ ID NO: 2593505 - RNA, 15 nt, Escherichia coli CFT073
acgaacucuucgccc

SEQ ID NO: 2593506 - RNA, 17 nt, Escherichia coli CFT073
acgaagcagcaucagca

SEQ ID NO: 2593507 - RNA, 13 nt, Escherichia coli CFT073
acgaagcggcugc

SEQ ID NO: 2593508 - RNA, 17 nt, Escherichia coli CFT073
acgaaggccggagcaug

SEQ ID NO: 2593509 - RNA, 13 nt, Escherichia coli CFT073
acgaaguacucaa

SEQ ID NO: 2593510 - RNA, 14 nt, Escherichia coli CFT073
acgaaguugaagug

SEQ ID NO: 2593511 - RNA, 17 nt, Escherichia coli CFT073
acgaaguuuaauucuuu

SEQ ID NO: 2593512 - RNA, 15 nt, Escherichia coli CFT073
acgaauaauccagcg

SEQ ID NO: 2593513 - RNA, 14 nt, Escherichia coli CFT073
acgaauaauugccu

SEQ ID NO: 2593514 - RNA, 15 nt, Escherichia coli CFT073
acgaauagucaguuc

SEQ ID NO: 2593515 - RNA, 13 nt, Escherichia coli CFT073
acgaaucacagcu

SEQ ID NO: 2593516 - RNA, 15 nt, Escherichia coli CFT073
acgaaucacuggugu

SEQ ID NO: 2593517 - RNA, 15 nt, Escherichia coli CFT073
acgaaucagauuuac

SEQ ID NO: 2593518 - RNA, 11 nt, Escherichia coli CFT073
acgaaucgccu

SEQ ID NO: 2593519 - RNA, 23 nt, Escherichia coli CFT073
acgaaugacuaagcgaucgcuaa

SEQ ID NO: 2593520 - RNA, 17 nt, Escherichia coli CFT073
acgaaugguuucacgcu

SEQ ID NO: 2593521 - RNA, 13 nt, Escherichia coli CFT073
acgaauugcugcg

SEQ ID NO: 2593522 - RNA, 21 nt, Escherichia coli CFT073
acgacaaaaauaccaccaaug

SEQ ID NO: 2593523 - RNA, 16 nt, Escherichia coli CFT073
acgacaaaauccccuu

SEQ ID NO: 2593524 - RNA, 17 nt, Escherichia coli CFT073
acgacaaaugcgccgcc

SEQ ID NO: 2593525 - RNA, 14 nt, Escherichia coli CFT073
acgacacaaugcca

SEQ ID NO: 2593526 - RNA, 14 nt, Escherichia coli CFT073
acgacaccacggua

SEQ ID NO: 2593527 - RNA, 17 nt, Escherichia coli CFT073
acgacacugcucgcaga

SEQ ID NO: 2593528 - RNA, 18 nt, Escherichia coli CFT073
acgacacugcucgcagaa

SEQ ID NO: 2593529 - RNA, 12 nt, Escherichia coli CFT073
acgacaggcaag

SEQ ID NO: 2593530 - RNA, 15 nt, Escherichia coli CFT073
acgacaggcuuacgu

SEQ ID NO: 2593531 - RNA, 21 nt, Escherichia coli CFT073
acgacaguaucgugacaauaa

SEQ ID NO: 2593532 - RNA, 17 nt, Escherichia coli CFT073
acgacagucaauauuca

SEQ ID NO: 2593533 - RNA, 20 nt, Escherichia coli CFT073
acgacagucaauauucaauu

SEQ ID NO: 2593534 - RNA, 22 nt, Escherichia coli CFT073
acgacauaugcguagcaacggu

SEQ ID NO: 2593535 - RNA, 14 nt, Escherichia coli CFT073
acgacauccgccag

SEQ ID NO: 2593536 - RNA, 17 nt, Escherichia coli CFT073
acgacauccgccagcgc

SEQ ID NO: 2593537 - RNA, 21 nt, Escherichia coli CFT073
acgacaucgacucaccacggu

SEQ ID NO: 2593538 - RNA, 14 nt, Escherichia coli CFT073
acgacaugugccag

SEQ ID NO: 2593539 - RNA, 17 nt, Escherichia coli CFT073
acgacaugugccagcga

SEQ ID NO: 2593540 - RNA, 18 nt, Escherichia coli CFT073
acgaccacccaccgcagc

SEQ ID NO: 2593541 - RNA, 14 nt, Escherichia coli CFT073
acgaccaccuucaa

SEQ ID NO: 2593542 - RNA, 19 nt, Escherichia coli CFT073
acgaccagcggcaacauca

SEQ ID NO: 2593543 - RNA, 17 nt, Escherichia coli CFT073
acgaccaggaacgccau

SEQ ID NO: 2593544 - RNA, 23 nt, Escherichia coli CFT073
acgaccaguucacaccgaccacc

SEQ ID NO: 2593545 - RNA, 14 nt, Escherichia coli CFT073
acgaccaucaaccu

SEQ ID NO: 2593546 - RNA, 17 nt, Escherichia coli CFT073
acgacccgauucgguca

SEQ ID NO: 2593547 - RNA, 23 nt, Escherichia coli CFT073
acgacccucagcugccagggcac

SEQ ID NO: 2593548 - RNA, 21 nt, Escherichia coli CFT073
acgaccgccauuaaacgcagu

SEQ ID NO: 2593549 - RNA, 17 nt, Escherichia coli CFT073
acgaccgccgcucaccu

SEQ ID NO: 2593550 - RNA, 18 nt, Escherichia coli CFT073
acgaccgccgcucaccug

SEQ ID NO: 2593551 - RNA, 20 nt, Escherichia coli CFT073
acgaccgccuaccggaaucg

SEQ ID NO: 2593552 - RNA, 23 nt, Escherichia coli CFT073
acgaccgccuaccggaaucgcgc

SEQ ID NO: 2593553 - RNA, 18 nt, Escherichia coli CFT073
acgaccggaugcgguuua

SEQ ID NO: 2593554 - RNA, 14 nt, Escherichia coli CFT073
acgaccggguuuuc

SEQ ID NO: 2593555 - RNA, 21 nt, Escherichia coli CFT073
acgaccuacacgcccgcgaag

SEQ ID NO: 2593556 - RNA, 20 nt, Escherichia coli CFT073
acgaccuugccaaggucggg

SEQ ID NO: 2593557 - RNA, 14 nt, Escherichia coli CFT073
acgaccuuuuccau

SEQ ID NO: 2593558 - RNA, 19 nt, Escherichia coli CFT073
acgacgagucacggaaucc

SEQ ID NO: 2593559 - RNA, 17 nt, Escherichia coli CFT073
acgcaggagcagaacag

SEQ ID NO: 2593560 - RNA, 22 nt, Escherichia coli CFT073
acgcaggcaucuuuuucaaugc

SEQ ID NO: 2593561 - RNA, 23 nt, Escherichia coli CFT073
acgcaggcaucuuuuucaaugca

SEQ ID NO: 2593562 - RNA, 18 nt, Escherichia coli CFT073
acgcaggccacgaaucag

SEQ ID NO: 2593563 - RNA, 22 nt, Escherichia coli CFT073
acgcagguucucaauuaccguu

SEQ ID NO: 2593564 - RNA, 16 nt, Escherichia coli CFT073
acgcaguaaacgccag

SEQ ID NO: 2593565 - RNA, 17 nt, Escherichia coli CFT073
acgcaguaaacgccagg

SEQ ID NO: 2593566 - RNA, 21 nt, Escherichia coli CFT073
acgcagucgcugaccacgacu

SEQ ID NO: 2593567 - RNA, 13 nt, Escherichia coli CFT073
acgcagugauaac

SEQ ID NO: 2593568 - RNA, 17 nt, Escherichia coli CFT073
acgcagugauaacucaa

SEQ ID NO: 2593569 - RNA, 23 nt, Escherichia coli CFT073
acgcaguugcugacgaucggcau

SEQ ID NO: 2593570 - RNA, 19 nt, Escherichia coli CFT073
acgcaguuuaaucguugau

SEQ ID NO: 2593571 - RNA, 23 nt, Escherichia coli CFT073
acgcaguuuauccaucucuugcg

SEQ ID NO: 2593572 - RNA, 14 nt, Escherichia coli CFT073
acgcauaauccagg

SEQ ID NO: 2593573 - RNA, 16 nt, Escherichia coli CFT073
acgcauaauccaggca

SEQ ID NO: 2593574 - RNA, 19 nt, Escherichia coli CFT073
acgcauaccuaccugcagu

SEQ ID NO: 2593575 - RNA, 16 nt, Escherichia coli CFT073
acgcauacugauuacc

SEQ ID NO: 2593576 - RNA, 14 nt, Escherichia coli CFT073
acgcaucaacgcgg

SEQ ID NO: 2593577 - RNA, 17 nt, Escherichia coli CFT073
acgcaucaugccgccca

SEQ ID NO: 2593578 - RNA, 16 nt, Escherichia coli CFT073
acgcauccccagcgca

SEQ ID NO: 2593579 - RNA, 18 nt, Escherichia coli CFT073
acgcaucgcgcaccagcg

SEQ ID NO: 2593580 - RNA, 14 nt, Escherichia coli CFT073
acgcaucuuuuuca

SEQ ID NO: 2593581 - RNA, 22 nt, Escherichia coli CFT073
acgcauuauuuugcggauuauu

SEQ ID NO: 2593582 - RNA, 21 nt, Escherichia coli CFT073
acgcauucucgcuacccauga

SEQ ID NO: 2593583 - RNA, 21 nt, Escherichia coli CFT073
acgcauuuacacucgccccug

SEQ ID NO: 2593584 - RNA, 22 nt, Escherichia coli CFT073
acgcauuucucgguauuacaau

SEQ ID NO: 2593585 - RNA, 14 nt, Escherichia coli CFT073
acgccaaaagcgau

SEQ ID NO: 2593586 - RNA, 20 nt, Escherichia coli CFT073
acgccaacaaaaaugcaggc

SEQ ID NO: 2593587 - RNA, 16 nt, Escherichia coli CFT073
acgccaaccaccggaa

SEQ ID NO: 2593588 - RNA, 14 nt, Escherichia coli CFT073
acgccaaccagcug

SEQ ID NO: 2593589 - RNA, 15 nt, Escherichia coli CFT073
acgccaaccagcuga

SEQ ID NO: 2593590 - RNA, 11 nt, Escherichia coli CFT073
acgccaauaau

SEQ ID NO: 2593591 - RNA, 23 nt, Escherichia coli CFT073
acgccaauaaucugcccggcauu

SEQ ID NO: 2593592 - RNA, 17 nt, Escherichia coli CFT073
acgccaauaccgaucag

SEQ ID NO: 2593593 - RNA, 14 nt, Escherichia coli CFT073
acgccaaucugcaa

SEQ ID NO: 2593594 - RNA, 15 nt, Escherichia coli CFT073
acgccaaucugcaaa

SEQ ID NO: 2593595 - RNA, 21 nt, Escherichia coli CFT073
acgccaauuuaagugguauug

SEQ ID NO: 2593596 - RNA, 23 nt, Escherichia coli CFT073
acgccacaacgauaauccagcag

SEQ ID NO: 2593597 - RNA, 19 nt, Escherichia coli CFT073
acgccaccauucgccaaga

SEQ ID NO: 2593598 - RNA, 15 nt, Escherichia coli CFT073
acgccaccccacacc

SEQ ID NO: 2593599 - RNA, 17 nt, Escherichia coli CFT073
acgccaccccacaccag

SEQ ID NO: 2593600 - RNA, 16 nt, Escherichia coli CFT073
acgccacgacucaaau

SEQ ID NO: 2593601 - RNA, 17 nt, Escherichia coli CFT073
acgccacgccaccagcg

SEQ ID NO: 2593602 - RNA, 15 nt, Escherichia coli CFT073
acgccacuaagcagg

SEQ ID NO: 2593603 - RNA, 17 nt, Escherichia coli CFT073
acgccacucacuaccag

SEQ ID NO: 2593604 - RNA, 17 nt, Escherichia coli CFT073
acgccacucacugaugc

SEQ ID NO: 2593605 - RNA, 19 nt, Escherichia coli CFT073
acgccagaaaaccuggcgc

SEQ ID NO: 2593606 - RNA, 14 nt, Escherichia coli CFT073
acgccagacagccu

SEQ ID NO: 2593607 - RNA, 18 nt, Escherichia coli CFT073
acgccagacagcgcaaua

SEQ ID NO: 2593608 - RNA, 17 nt, Escherichia coli CFT073
acgccagacagcguaau

SEQ ID NO: 2593609 - RNA, 21 nt, Escherichia coli CFT073
acgccagacucucgccagaga

SEQ ID NO: 2593610 - RNA, 14 nt, Escherichia coli CFT073
acgccagcauguug

SEQ ID NO: 2593611 - RNA, 13 nt, Escherichia coli CFT073
acgccagccaauc

SEQ ID NO: 2593612 - RNA, 20 nt, Escherichia coli CFT073
acgccagccaaucaucguac

SEQ ID NO: 2593613 - RNA, 13 nt, Escherichia coli CFT073
acgccagccacaa

SEQ ID NO: 2593614 - RNA, 21 nt, Escherichia coli CFT073
acgccagccugcgcuaccaga

SEQ ID NO: 2593615 - RNA, 15 nt, Escherichia coli CFT073
acgccagcgaagcca

SEQ ID NO: 2593616 - RNA, 21 nt, Escherichia coli CFT073
acgccagcgaagccagcuccc

SEQ ID NO: 2593617 - RNA, 20 nt, Escherichia coli CFT073
acgccagcggucauaacgcu

SEQ ID NO: 2593618 - RNA, 22 nt, Escherichia coli CFT073
acgccagucgcgaugcagcucg

SEQ ID NO: 2593619 - RNA, 21 nt, Escherichia coli CFT073
acgccagugucgcaucaggca

SEQ ID NO: 2593620 - RNA, 16 nt, Escherichia coli CFT073
acgccauacccgcaca

SEQ ID NO: 2593621 - RNA, 23 nt, Escherichia coli CFT073
acgccauagggcgugaagacugc

SEQ ID NO: 2593622 - RNA, 14 nt, Escherichia coli CFT073
acgccaucaacgaa

SEQ ID NO: 2593623 - RNA, 13 nt, Escherichia coli CFT073
acgccaucauucg

SEQ ID NO: 2593624 - RNA, 18 nt, Escherichia coli CFT073
acgccauccggcagcaaa

SEQ ID NO: 2593625 - RNA, 14 nt, Escherichia coli CFT073
acgccaucucuuua

SEQ ID NO: 2593626 - RNA, 16 nt, Escherichia coli CFT073
acgccaugaagauggu

SEQ ID NO: 2593627 - RNA, 15 nt, Escherichia coli CFT073
acgccaugccaaaga

SEQ ID NO: 2593628 - RNA, 23 nt, Escherichia coli CFT073
acgcccaaugcccagaaaccagu

SEQ ID NO: 2593629 - RNA, 22 nt, Escherichia coli CFT073
acgcccagcgaccacaaauacc

SEQ ID NO: 2593630 - RNA, 12 nt, Escherichia coli CFT073
acgcccagcgca

SEQ ID NO: 2593631 - RNA, 22 nt, Escherichia coli CFT073
acgcccagcgcaggaaagauaa

SEQ ID NO: 2593632 - RNA, 21 nt, Escherichia coli CFT073
acgcccaguccgcucgccgca

SEQ ID NO: 2593633 - RNA, 13 nt, Escherichia coli CFT073
acgcccaguucaa

SEQ ID NO: 2593634 - RNA, 21 nt, Escherichia coli CFT073
acgcccauaacgcgcgcgaua

SEQ ID NO: 2593635 - RNA, 15 nt, Escherichia coli CFT073
acgcccauacauacc

SEQ ID NO: 2593636 - RNA, 15 nt, Escherichia coli CFT073
acgccccagauugcc

SEQ ID NO: 2593637 - RNA, 21 nt, Escherichia coli CFT073
acgcccccaaaauaaagggua

SEQ ID NO: 2593638 - RNA, 18 nt, Escherichia coli CFT073
acgccccucuaaacgcuc

SEQ ID NO: 2593639 - RNA, 22 nt, Escherichia coli CFT073
acgccccuggugcuugccagag

SEQ ID NO: 2593640 - RNA, 16 nt, Escherichia coli CFT073
acgcccgacgaggcgc

SEQ ID NO: 2593641 - RNA, 21 nt, Escherichia coli CFT073
acgcccgcaacuuuaccgcaa

SEQ ID NO: 2593642 - RNA, 12 nt, Escherichia coli CFT073
acgcccgccagu

SEQ ID NO: 2593643 - RNA, 18 nt, Escherichia coli CFT073
acgcccggcauucaccuc

SEQ ID NO: 2593644 - RNA, 14 nt, Escherichia coli CFT073
acgcccgguaaucg

SEQ ID NO: 2593645 - RNA, 18 nt, Escherichia coli CFT073
acgcccguuuucaccuua

SEQ ID NO: 2593646 - RNA, 16 nt, Escherichia coli CFT073
acgcccugaccgucaa

SEQ ID NO: 2593647 - RNA, 22 nt, Escherichia coli CFT073
acgcccugaccgucaaacaugc

SEQ ID NO: 2593648 - RNA, 21 nt, Escherichia coli CFT073
acgcccugaugcaucaacauc

SEQ ID NO: 2593649 - RNA, 18 nt, Escherichia coli CFT073
acgcccugcaacugcugc

SEQ ID NO: 2593650 - RNA, 19 nt, Escherichia coli CFT073
acgcccugcaacugcugca

SEQ ID NO: 2593651 - RNA, 20 nt, Escherichia coli CFT073
acgcccugcaacugcugcau

SEQ ID NO: 2593652 - RNA, 19 nt, Escherichia coli CFT073
acgcccuuaaucaacucac

SEQ ID NO: 2593653 - RNA, 11 nt, Escherichia coli CFT073
acgcccuuccc

SEQ ID NO: 2593654 - RNA, 13 nt, Escherichia coli CFT073
acgcccuuccccc

SEQ ID NO: 2593655 - RNA, 16 nt, Escherichia coli CFT073
acgccgaaccauguca

SEQ ID NO: 2593656 - RNA, 19 nt, Escherichia coli CFT073
acgccgaauaacgcgcagc

SEQ ID NO: 2593657 - RNA, 15 nt, Escherichia coli CFT073
acgccgaccagaccg

SEQ ID NO: 2593658 - RNA, 14 nt, Escherichia coli CFT073
acgccgagagaagc

SEQ ID NO: 2593659 - RNA, 17 nt, Escherichia coli CFT073
acgccgagcgccagcca

SEQ ID NO: 2593660 - RNA, 18 nt, Escherichia coli CFT073
acgccgagcgccagccau

SEQ ID NO: 2593661 - RNA, 18 nt, Escherichia coli CFT073
acgccgauaucgcuggca

SEQ ID NO: 2593662 - RNA, 12 nt, Escherichia coli CFT073
acgccgcaucag

SEQ ID NO: 2593663 - RNA, 19 nt, Escherichia coli CFT073
acgccgcauccgacaucaa

SEQ ID NO: 2593664 - RNA, 17 nt, Escherichia coli CFT073
acgccgcauccggcaau

SEQ ID NO: 2593665 - RNA, 24 nt, Escherichia coli CFT073
acgccgcauccggcaugaacaaag

SEQ ID NO: 2593666 - RNA, 13 nt, Escherichia coli CFT073
acgccgccagacc

SEQ ID NO: 2593667 - RNA, 12 nt, Escherichia coli CFT073
acgcuccggguu

SEQ ID NO: 2593668 - RNA, 16 nt, Escherichia coli CFT073
acgcucgaacagcugg

SEQ ID NO: 2593669 - RNA, 14 nt, Escherichia coli CFT073
acgcucgcugcaaa

SEQ ID NO: 2593670 - RNA, 13 nt, Escherichia coli CFT073
acgcucuuccagg

SEQ ID NO: 2593671 - RNA, 16 nt, Escherichia coli CFT073
acgcucuuccagggua

SEQ ID NO: 2593672 - RNA, 18 nt, Escherichia coli CFT073
acgcucuuccaggguaaa

SEQ ID NO: 2593673 - RNA, 19 nt, Escherichia coli CFT073
acgcugaauaauccccaca

SEQ ID NO: 2593674 - RNA, 23 nt, Escherichia coli CFT073
acgcugaauaauccccacaucag

SEQ ID NO: 2593675 - RNA, 18 nt, Escherichia coli CFT073
acgcugaaugcugccuuc

SEQ ID NO: 2593676 - RNA, 15 nt, Escherichia coli CFT073
acgcugacaaacugc

SEQ ID NO: 2593677 - RNA, 15 nt, Escherichia coli CFT073
acgcugacgcaucug

SEQ ID NO: 2593678 - RNA, 17 nt, Escherichia coli CFT073
acgcugacgugcugcau

SEQ ID NO: 2593679 - RNA, 15 nt, Escherichia coli CFT073
acgcugaucgacgaa

SEQ ID NO: 2593680 - RNA, 13 nt, Escherichia coli CFT073
acgcugauugcau

SEQ ID NO: 2593681 - RNA, 17 nt, Escherichia coli CFT073
acgcugauugcauaaug

SEQ ID NO: 2593682 - RNA, 17 nt, Escherichia coli CFT073
acgcugcaaaaagccuu

SEQ ID NO: 2593683 - RNA, 18 nt, Escherichia coli CFT073
acgcugcauacucugcaa

SEQ ID NO: 2593684 - RNA, 19 nt, Escherichia coli CFT073
acgcugcauggcaacuuua

SEQ ID NO: 2593685 - RNA, 12 nt, Escherichia coli CFT073
acgcugccgcgc

SEQ ID NO: 2593686 - RNA, 19 nt, Escherichia coli CFT073
acgcugcgcugcaccagua

SEQ ID NO: 2593687 - RNA, 23 nt, Escherichia coli CFT073
acgcuggauuucaauaucguuau

SEQ ID NO: 2593688 - RNA, 19 nt, Escherichia coli CFT073
acgcuggcagcagaaccag

SEQ ID NO: 2593689 - RNA, 22 nt, Escherichia coli CFT073
acgcuggcagcagaaccaggga

SEQ ID NO: 2593690 - RNA, 20 nt, Escherichia coli CFT073
acgcuggccgcgucuuaucc

SEQ ID NO: 2593691 - RNA, 18 nt, Escherichia coli CFT073
acgcuggcgcgucuuauc

SEQ ID NO: 2593692 - RNA, 18 nt, Escherichia coli CFT073
acgcuggggaaugccaug

SEQ ID NO: 2593693 - RNA, 19 nt, Escherichia coli CFT073
acgcuggggaaugccauga

SEQ ID NO: 2593694 - RNA, 22 nt, Escherichia coli CFT073
acgcuggguuucgccugccaga

SEQ ID NO: 2593695 - RNA, 23 nt, Escherichia coli CFT073
acgcugguaguuguacaacugcu

SEQ ID NO: 2593696 - RNA, 13 nt, Escherichia coli CFT073
acgcugucgcguc

SEQ ID NO: 2593697 - RNA, 15 nt, Escherichia coli CFT073
acgcugucgcgucuu

SEQ ID NO: 2593698 - RNA, 20 nt, Escherichia coli CFT073
acgcugucggcaagauacug

SEQ ID NO: 2593699 - RNA, 13 nt, Escherichia coli CFT073
acgcugucggcac

SEQ ID NO: 2593700 - RNA, 16 nt, Escherichia coli CFT073
acgcugucuuaucagg

SEQ ID NO: 2593701 - RNA, 17 nt, Escherichia coli CFT073
acgcuguggcgcuggca

SEQ ID NO: 2593702 - RNA, 21 nt, Escherichia coli CFT073
acgcuguucaucccgaccagu

SEQ ID NO: 2593703 - RNA, 22 nt, Escherichia coli CFT073
acgcuguucgcgucuuaucagg

SEQ ID NO: 2593704 - RNA, 13 nt, Escherichia coli CFT073
acgcuuaaucgaa

SEQ ID NO: 2593705 - RNA, 13 nt, Escherichia coli CFT073
acgcuuaucaggc

SEQ ID NO: 2593706 - RNA, 19 nt, Escherichia coli CFT073
acgcuuaucaggccugcaa

SEQ ID NO: 2593707 - RNA, 20 nt, Escherichia coli CFT073
acgcuucaaaccuucaucca

SEQ ID NO: 2593708 - RNA, 13 nt, Escherichia coli CFT073
acgcuucaaccag

SEQ ID NO: 2593709 - RNA, 17 nt, Escherichia coli CFT073
acgcuucaaccagugca

SEQ ID NO: 2593710 - RNA, 17 nt, Escherichia coli CFT073
acgcuucacgcaccaua

SEQ ID NO: 2593711 - RNA, 21 nt, Escherichia coli CFT073
acgcuucggcaauuucagugc

SEQ ID NO: 2593712 - RNA, 17 nt, Escherichia coli CFT073
acgcuugauucuguuca

SEQ ID NO: 2593713 - RNA, 20 nt, Escherichia coli CFT073
acgcuugauucuguucagua

SEQ ID NO: 2593714 - RNA, 22 nt, Escherichia coli CFT073
acgcuuucaacaaccuugcguu

SEQ ID NO: 2593715 - RNA, 14 nt, Escherichia coli CFT073
acgcuuucacccgg

SEQ ID NO: 2593716 - RNA, 22 nt, Escherichia coli CFT073
acgcuuucagcacuucggcauc

SEQ ID NO: 2593717 - RNA, 18 nt, Escherichia coli CFT073
acgcuuucuggcgcgcgg

SEQ ID NO: 2593718 - RNA, 13 nt, Escherichia coli CFT073
acgcuuugcugcc

SEQ ID NO: 2593719 - RNA, 20 nt, Escherichia coli CFT073
acgcuuuguccagugcaacu

SEQ ID NO: 2593720 - RNA, 22 nt, Escherichia coli CFT073
acgcuuuuccacucacacagcu

SEQ ID NO: 2593721 - RNA, 15 nt, Escherichia coli CFT073
acggaaagcagauaa

SEQ ID NO: 2593722 - RNA, 14 nt, Escherichia coli CFT073
acggaaagcagcau

SEQ ID NO: 2593723 - RNA, 14 nt, Escherichia coli CFT073
acggaacgggccau

SEQ ID NO: 2593724 - RNA, 18 nt, Escherichia coli CFT073
acggaacucuuccgggaa

SEQ ID NO: 2593725 - RNA, 23 nt, Escherichia coli CFT073
acggaacucuuccgggaaaacau

SEQ ID NO: 2593726 - RNA, 18 nt, Escherichia coli CFT073
acggaacugcuccagggc

SEQ ID NO: 2593727 - RNA, 22 nt, Escherichia coli CFT073
acggaacugcuccagggcaggu

SEQ ID NO: 2593728 - RNA, 22 nt, Escherichia coli CFT073
acggaagcuuaucacagaggaa

SEQ ID NO: 2593729 - RNA, 13 nt, Escherichia coli CFT073
acggaauaaaccc

SEQ ID NO: 2593730 - RNA, 16 nt, Escherichia coli CFT073
acggaaugauauuggu

SEQ ID NO: 2593731 - RNA, 20 nt, Escherichia coli CFT073
acggacaguacugccgggaa

SEQ ID NO: 2593732 - RNA, 19 nt, Escherichia coli CFT073
acggaccaauaaacgccag

SEQ ID NO: 2593733 - RNA, 17 nt, Escherichia coli CFT073
acggaccgcaugcagca

SEQ ID NO: 2593734 - RNA, 22 nt, Escherichia coli CFT073
acggacucggcgucgguaaaga

SEQ ID NO: 2593735 - RNA, 24 nt, Escherichia coli CFT073
acggacuucaagcggacgaucgcu

SEQ ID NO: 2593736 - RNA, 16 nt, Escherichia coli CFT073
acggagaauccagccc

SEQ ID NO: 2593737 - RNA, 20 nt, Escherichia coli CFT073
acggaguaacaaaugugcca

SEQ ID NO: 2593738 - RNA, 23 nt, Escherichia coli CFT073
acggaguaacaaaugugccauuc

SEQ ID NO: 2593739 - RNA, 17 nt, Escherichia coli CFT073
acggaguugaccagcuc

SEQ ID NO: 2593740 - RNA, 18 nt, Escherichia coli CFT073
acggauaaacguggugcg

SEQ ID NO: 2593741 - RNA, 21 nt, Escherichia coli CFT073
acggauaacguuuagcggugg

SEQ ID NO: 2593742 - RNA, 13 nt, Escherichia coli CFT073
acggauacgguca

SEQ ID NO: 2593743 - RNA, 12 nt, Escherichia coli CFT073
acggaucaggca

SEQ ID NO: 2593744 - RNA, 15 nt, Escherichia coli CFT073
acggaugcgcccacu

SEQ ID NO: 2593745 - RNA, 14 nt, Escherichia coli CFT073
acggcaacaauuuc

SEQ ID NO: 2593746 - RNA, 20 nt, Escherichia coli CFT073
acggcaacaauuuccgcagc

SEQ ID NO: 2593747 - RNA, 22 nt, Escherichia coli CFT073
acggcaagaucagcauccauau

SEQ ID NO: 2593748 - RNA, 20 nt, Escherichia coli CFT073
acggcaccagccauuaacca

SEQ ID NO: 2593749 - RNA, 17 nt, Escherichia coli CFT073
acggcacggaaagcagc

SEQ ID NO: 2593750 - RNA, 15 nt, Escherichia coli CFT073
acggcacuucaauga

SEQ ID NO: 2593751 - RNA, 15 nt, Escherichia coli CFT073
acggcagaagcagca

SEQ ID NO: 2593752 - RNA, 21 nt, Escherichia coli CFT073
acggcagaaguaguugcuguc

SEQ ID NO: 2593753 - RNA, 13 nt, Escherichia coli CFT073
acggcagaaucuu

SEQ ID NO: 2593754 - RNA, 15 nt, Escherichia coli CFT073
acggcagagaaacca

SEQ ID NO: 2593755 - RNA, 18 nt, Escherichia coli CFT073
acggcagagaaaccacau

SEQ ID NO: 2593756 - RNA, 21 nt, Escherichia coli CFT073
acggcagagaaaccacaucaa

SEQ ID NO: 2593757 - RNA, 14 nt, Escherichia coli CFT073
acggcagcaacagc

SEQ ID NO: 2593758 - RNA, 22 nt, Escherichia coli CFT073
acggcaggucaaggucaugaug

SEQ ID NO: 2593759 - RNA, 16 nt, Escherichia coli CFT073
acggcauaaauuucag

SEQ ID NO: 2593760 - RNA, 13 nt, Escherichia coli CFT073
acggcaucgccau

SEQ ID NO: 2593761 - RNA, 13 nt, Escherichia coli CFT073
acggcauuaacga

SEQ ID NO: 2593762 - RNA, 20 nt, Escherichia coli CFT073
acggcauuaucgagcugccu

SEQ ID NO: 2593763 - RNA, 22 nt, Escherichia coli CFT073
acggcauuuccgccaaucaaga

SEQ ID NO: 2593764 - RNA, 23 nt, Escherichia coli CFT073
acggcauuucuggcggcgugaug

SEQ ID NO: 2593765 - RNA, 12 nt, Escherichia coli CFT073
acggcauuuucc

SEQ ID NO: 2593766 - RNA, 18 nt, Escherichia coli CFT073
acggcauuuugcugaugc

SEQ ID NO: 2593767 - RNA, 23 nt, Escherichia coli CFT073
acggccacgaugcacagcucuga

SEQ ID NO: 2593768 - RNA, 14 nt, Escherichia coli CFT073
acggccaucacgga

SEQ ID NO: 2593769 - RNA, 18 nt, Escherichia coli CFT073
acggccaucacggaucag

SEQ ID NO: 2593770 - RNA, 13 nt, Escherichia coli CFT073
acggcccagcaug

SEQ ID NO: 2593771 - RNA, 22 nt, Escherichia coli CFT073
acggcccagcaugcgaaugccg

SEQ ID NO: 2593772 - RNA, 16 nt, Escherichia coli CFT073
acggcccauaacccac

SEQ ID NO: 2593773 - RNA, 18 nt, Escherichia coli CFT073
acggccccaaauaccugg

SEQ ID NO: 2593774 - RNA, 21 nt, Escherichia coli CFT073
acggccccagagcuaaaaucg

SEQ ID NO: 2593775 - RNA, 18 nt, Escherichia coli CFT073
acgucagacagcgcaaua

SEQ ID NO: 2593776 - RNA, 22 nt, Escherichia coli CFT073
acgucaggccaacauccaucag

SEQ ID NO: 2593777 - RNA, 18 nt, Escherichia coli CFT073
acgucagugacugcuuuu

SEQ ID NO: 2593778 - RNA, 23 nt, Escherichia coli CFT073
acgucagugacugcuuuuucaau

SEQ ID NO: 2593779 - RNA, 23 nt, Escherichia coli CFT073
acgucauauucgccaucagccac

SEQ ID NO: 2593780 - RNA, 16 nt, Escherichia coli CFT073
acgucaucagcaauuu

SEQ ID NO: 2593781 - RNA, 14 nt, Escherichia coli CFT073
acgucaucuguaag

SEQ ID NO: 2593782 - RNA, 16 nt, Escherichia coli CFT073
acgucauugcaaucuc

SEQ ID NO: 2593783 - RNA, 17 nt, Escherichia coli CFT073
acguccaccaaugccaa

SEQ ID NO: 2593784 - RNA, 12 nt, Escherichia coli CFT073
acguccaccaga

SEQ ID NO: 2593785 - RNA, 13 nt, Escherichia coli CFT073
acguccagccggg

SEQ ID NO: 2593786 - RNA, 22 nt, Escherichia coli CFT073
acguccauguagcucaucugac

SEQ ID NO: 2593787 - RNA, 19 nt, Escherichia coli CFT073
acguccggcagcagaaagc

SEQ ID NO: 2593788 - RNA, 16 nt, Escherichia coli CFT073
acguccgugacuucau

SEQ ID NO: 2593789 - RNA, 22 nt, Escherichia coli CFT073
acguccucgucgagcagaaucg

SEQ ID NO: 2593790 - RNA, 15 nt, Escherichia coli CFT073
acguccugcccgacg

SEQ ID NO: 2593791 - RNA, 20 nt, Escherichia coli CFT073
acgucgcaagacgaaaaaug

SEQ ID NO: 2593792 - RNA, 21 nt, Escherichia coli CFT073
acgucgcaagacgaaaaauga

SEQ ID NO: 2593793 - RNA, 23 nt, Escherichia coli CFT073
acgucgcaagacgaaaaaugaau

SEQ ID NO: 2593794 - RNA, 17 nt, Escherichia coli CFT073
acgucgcaucuggucag

SEQ ID NO: 2593795 - RNA, 21 nt, Escherichia coli CFT073
acgucgccagaaaucagcagc

SEQ ID NO: 2593796 - RNA, 14 nt, Escherichia coli CFT073
acgucgcgcaugcg

SEQ ID NO: 2593797 - RNA, 16 nt, Escherichia coli CFT073
acgucggcauauuuaa

SEQ ID NO: 2593798 - RNA, 22 nt, Escherichia coli CFT073
acgucggcauauuuaaaaacga

SEQ ID NO: 2593799 - RNA, 19 nt, Escherichia coli CFT073
acgucggguauauaaagcc

SEQ ID NO: 2593800 - RNA, 18 nt, Escherichia coli CFT073
acgucucaaucaccacca

SEQ ID NO: 2593801 - RNA, 19 nt, Escherichia coli CFT073
acgucucaaucaccaccag

SEQ ID NO: 2593802 - RNA, 23 nt, Escherichia coli CFT073
acgucucaauuuauauucacuuc

SEQ ID NO: 2593803 - RNA, 23 nt, Escherichia coli CFT073
acgucugaaguaagucuuccggu

SEQ ID NO: 2593804 - RNA, 20 nt, Escherichia coli CFT073
acgucugaucggcaaucacg

SEQ ID NO: 2593805 - RNA, 15 nt, Escherichia coli CFT073
acgucugccacggca

SEQ ID NO: 2593806 - RNA, 16 nt, Escherichia coli CFT073
acgucugccacggcag

SEQ ID NO: 2593807 - RNA, 12 nt, Escherichia coli CFT073
acgucugccugg

SEQ ID NO: 2593808 - RNA, 21 nt, Escherichia coli CFT073
acgucugccugguuucucucc

SEQ ID NO: 2593809 - RNA, 21 nt, Escherichia coli CFT073
acgucuugcugugcagcaagc

SEQ ID NO: 2593810 - RNA, 20 nt, Escherichia coli CFT073
acgucuuugcgcuccaucag

SEQ ID NO: 2593811 - RNA, 15 nt, Escherichia coli CFT073
acgugaauccagcgc

SEQ ID NO: 2593812 - RNA, 20 nt, Escherichia coli CFT073
acgugacauagagauaacug

SEQ ID NO: 2593813 - RNA, 22 nt, Escherichia coli CFT073
acgugacauagagauaacuggc

SEQ ID NO: 2593814 - RNA, 15 nt, Escherichia coli CFT073
acgugaccaguacca

SEQ ID NO: 2593815 - RNA, 14 nt, Escherichia coli CFT073
acgugagagaaaau

SEQ ID NO: 2593816 - RNA, 22 nt, Escherichia coli CFT073
acgugaucgucuucaaccgcag

SEQ ID NO: 2593817 - RNA, 19 nt, Escherichia coli CFT073
acgugauuccugcaauuua

SEQ ID NO: 2593818 - RNA, 13 nt, Escherichia coli CFT073
acgugauugguuu

SEQ ID NO: 2593819 - RNA, 13 nt, Escherichia coli CFT073
acgugcaaaauca

SEQ ID NO: 2593820 - RNA, 23 nt, Escherichia coli CFT073
acgugcaaaaucaaacagaauau

SEQ ID NO: 2593821 - RNA, 14 nt, Escherichia coli CFT073
acgugcccuuucag

SEQ ID NO: 2593822 - RNA, 22 nt, Escherichia coli CFT073
acgugcguaccauuaucaccaa

SEQ ID NO: 2593823 - RNA, 20 nt, Escherichia coli CFT073
acgugcuuauaacugcccgc

SEQ ID NO: 2593824 - RNA, 20 nt, Escherichia coli CFT073
acguggugaaaucgccgaca

SEQ ID NO: 2593825 - RNA, 20 nt, Escherichia coli CFT073
acgugguuuaccaccagcgg

SEQ ID NO: 2593826 - RNA, 21 nt, Escherichia coli CFT073
acgugguuuaccaccagcgga

SEQ ID NO: 2593827 - RNA, 16 nt, Escherichia coli CFT073
acguguacccagcagc

SEQ ID NO: 2593828 - RNA, 17 nt, Escherichia coli CFT073
acgugucauaacugguc

SEQ ID NO: 2593829 - RNA, 18 nt, Escherichia coli CFT073
acguguggucuuuucaac

SEQ ID NO: 2593830 - RNA, 13 nt, Escherichia coli CFT073
acguguugcugca

SEQ ID NO: 2593831 - RNA, 16 nt, Escherichia coli CFT073
acguuaaaacacacua

SEQ ID NO: 2593832 - RNA, 13 nt, Escherichia coli CFT073
acguuaagaaaac

SEQ ID NO: 2593833 - RNA, 16 nt, Escherichia coli CFT073
acguuaauccgcucug

SEQ ID NO: 2593834 - RNA, 14 nt, Escherichia coli CFT073
acguuaauccugau

SEQ ID NO: 2593835 - RNA, 14 nt, Escherichia coli CFT073
acguuacccagcac

SEQ ID NO: 2593836 - RNA, 16 nt, Escherichia coli CFT073
acguuaccggguguuc

SEQ ID NO: 2593837 - RNA, 16 nt, Escherichia coli CFT073
acguuacugaucaccu

SEQ ID NO: 2593838 - RNA, 21 nt, Escherichia coli CFT073
acguuaugcaccgacaaucca

SEQ ID NO: 2593839 - RNA, 22 nt, Escherichia coli CFT073
acguuaugcaccgacaauccag

SEQ ID NO: 2593840 - RNA, 19 nt, Escherichia coli CFT073
acguuauucgcuuccucca

SEQ ID NO: 2593841 - RNA, 16 nt, Escherichia coli CFT073
acguuauugguggugu

SEQ ID NO: 2593842 - RNA, 16 nt, Escherichia coli CFT073
acguucacgcagcuca

SEQ ID NO: 2593843 - RNA, 13 nt, Escherichia coli CFT073
acguucagccaua

SEQ ID NO: 2593844 - RNA, 16 nt, Escherichia coli CFT073
acguucagccgcuuua

SEQ ID NO: 2593845 - RNA, 20 nt, Escherichia coli CFT073
acguucauggcgugacaugg

SEQ ID NO: 2593846 - RNA, 12 nt, Escherichia coli CFT073
acguuccagcaa

SEQ ID NO: 2593847 - RNA, 19 nt, Escherichia coli CFT073
acguuccccaaccgcuuuc

SEQ ID NO: 2593848 - RNA, 17 nt, Escherichia coli CFT073
acguucccuucuugcgc

SEQ ID NO: 2593849 - RNA, 19 nt, Escherichia coli CFT073
acguuccguauaccgucag

SEQ ID NO: 2593850 - RNA, 13 nt, Escherichia coli CFT073
acguucgcccacu

SEQ ID NO: 2593851 - RNA, 22 nt, Escherichia coli CFT073
acguucggcaaagcgcugaaga

SEQ ID NO: 2593852 - RNA, 16 nt, Escherichia coli CFT073
acguucguccucaaug

SEQ ID NO: 2593853 - RNA, 19 nt, Escherichia coli CFT073
acguucucuuucaggccgc

SEQ ID NO: 2593854 - RNA, 23 nt, Escherichia coli CFT073
acguucucuuucaggccgcgcag

SEQ ID NO: 2593855 - RNA, 18 nt, Escherichia coli CFT073
acguugaacugacuguuu

SEQ ID NO: 2593856 - RNA, 17 nt, Escherichia coli CFT073
acguugauaaccacggc

SEQ ID NO: 2593857 - RNA, 14 nt, Escherichia coli CFT073
acguugcaacugcg

SEQ ID NO: 2593858 - RNA, 15 nt, Escherichia coli CFT073
acguugcaacugcga

SEQ ID NO: 2593859 - RNA, 21 nt, Escherichia coli CFT073
acguugcaacugcgacacugu

SEQ ID NO: 2593860 - RNA, 13 nt, Escherichia coli CFT073
acguugccagcaa

SEQ ID NO: 2593861 - RNA, 16 nt, Escherichia coli CFT073
acguugccaguaccau

SEQ ID NO: 2593862 - RNA, 20 nt, Escherichia coli CFT073
acguugccggauacgaucuc

SEQ ID NO: 2593863 - RNA, 21 nt, Escherichia coli CFT073
acguugccguaagcaacgcca

SEQ ID NO: 2593864 - RNA, 18 nt, Escherichia coli CFT073
acguugcuuauugccgga

SEQ ID NO: 2593865 - RNA, 12 nt, Escherichia coli CFT073
acguuggaucgc

SEQ ID NO: 2593866 - RNA, 13 nt, Escherichia coli CFT073
acguuggcagugc

SEQ ID NO: 2593867 - RNA, 21 nt, Escherichia coli CFT073
acguuggcagugccaucaaua

SEQ ID NO: 2593868 - RNA, 21 nt, Escherichia coli CFT073
acguugguuucgcauuucgca

SEQ ID NO: 2593869 - RNA, 19 nt, Escherichia coli CFT073
acguuguccagcuuaauuc

SEQ ID NO: 2593870 - RNA, 21 nt, Escherichia coli CFT073
acguugucuggcgucuccucc

SEQ ID NO: 2593871 - RNA, 17 nt, Escherichia coli CFT073
acguuuaacacgcucug

SEQ ID NO: 2593872 - RNA, 14 nt, Escherichia coli CFT073
acguuuacuucgcu

SEQ ID NO: 2593873 - RNA, 17 nt, Escherichia coli CFT073
acguuucaaacaggcug

SEQ ID NO: 2593874 - RNA, 18 nt, Escherichia coli CFT073
acguuucaaacaggcugc

SEQ ID NO: 2593875 - RNA, 17 nt, Escherichia coli CFT073
acguuucgcgccauccg

SEQ ID NO: 2593876 - RNA, 18 nt, Escherichia coli CFT073
acguuugauuaacgccag

SEQ ID NO: 2593877 - RNA, 15 nt, Escherichia coli CFT073
acguuugauuuuuaa

SEQ ID NO: 2593878 - RNA, 16 nt, Escherichia coli CFT073
acguuugauuuuuaac

SEQ ID NO: 2593879 - RNA, 14 nt, Escherichia coli CFT073
acguuugccagcca

SEQ ID NO: 2593880 - RNA, 19 nt, Escherichia coli CFT073
acguuugccagccacacca

SEQ ID NO: 2593881 - RNA, 21 nt, Escherichia coli CFT073
acguuugccagccacaccacg

SEQ ID NO: 2593882 - RNA, 19 nt, Escherichia coli CFT073
acguuuggccacaccaucg

SEQ ID NO: 2593883 - RNA, 22 nt, Escherichia coli CFT073
acucaggaugagaaaagagaug

SEQ ID NO: 2593884 - RNA, 12 nt, Escherichia coli CFT073
acucagguggcg

SEQ ID NO: 2593885 - RNA, 19 nt, Escherichia coli CFT073
acucagguggcgguauuug

SEQ ID NO: 2593886 - RNA, 22 nt, Escherichia coli CFT073
acucaguguuggauggcggcuu

SEQ ID NO: 2593887 - RNA, 16 nt, Escherichia coli CFT073
acucauaaaccagcgg

SEQ ID NO: 2593888 - RNA, 18 nt, Escherichia coli CFT073
acucauacugagcaaggc

SEQ ID NO: 2593889 - RNA, 16 nt, Escherichia coli CFT073
acucauagccucugcc

SEQ ID NO: 2593890 - RNA, 13 nt, Escherichia coli CFT073
acucaucaaaaaa

SEQ ID NO: 2593891 - RNA, 19 nt, Escherichia coli CFT073
acucaucagagaaacaucc

SEQ ID NO: 2593892 - RNA, 20 nt, Escherichia coli CFT073
acucaucagagaaacauccg

SEQ ID NO: 2593893 - RNA, 22 nt, Escherichia coli CFT073
acucaucagcuuacgguaggca

SEQ ID NO: 2593894 - RNA, 23 nt, Escherichia coli CFT073
acucauccaccacaaaagcaaag

SEQ ID NO: 2593895 - RNA, 12 nt, Escherichia coli CFT073
acucauccaucu

SEQ ID NO: 2593896 - RNA, 21 nt, Escherichia coli CFT073
acucauccaucucgguuuuca

SEQ ID NO: 2593897 - RNA, 18 nt, Escherichia coli CFT073
acucaucgccuuucagau

SEQ ID NO: 2593898 - RNA, 16 nt, Escherichia coli CFT073
acucaucucggggcaa

SEQ ID NO: 2593899 - RNA, 12 nt, Escherichia coli CFT073
acucaucuucca

SEQ ID NO: 2593900 - RNA, 16 nt, Escherichia coli CFT073
acucauuaaaacggau

SEQ ID NO: 2593901 - RNA, 13 nt, Escherichia coli CFT073
acucauuaaacca

SEQ ID NO: 2593902 - RNA, 15 nt, Escherichia coli CFT073
acucauuaaaccacu

SEQ ID NO: 2593903 - RNA, 20 nt, Escherichia coli CFT073
acucauuaaucaauuuuuug

SEQ ID NO: 2593904 - RNA, 17 nt, Escherichia coli CFT073
acucauugauuuucaaa

SEQ ID NO: 2593905 - RNA, 12 nt, Escherichia coli CFT073
acucauugccag

SEQ ID NO: 2593906 - RNA, 15 nt, Escherichia coli CFT073
acucauuguuaucag

SEQ ID NO: 2593907 - RNA, 18 nt, Escherichia coli CFT073
acucauuguuaucagcaa

SEQ ID NO: 2593908 - RNA, 20 nt, Escherichia coli CFT073
acucauuguuaucagcaaua

SEQ ID NO: 2593909 - RNA, 18 nt, Escherichia coli CFT073
acucauuuuuaacagugu

SEQ ID NO: 2593910 - RNA, 17 nt, Escherichia coli CFT073
acuccaacucuuuuacc

SEQ ID NO: 2593911 - RNA, 23 nt, Escherichia coli CFT073
acuccacaugguuuucaauuauc

SEQ ID NO: 2593912 - RNA, 14 nt, Escherichia coli CFT073
acuccacuucaccg

SEQ ID NO: 2593913 - RNA, 11 nt, Escherichia coli CFT073
acuccagcccu

SEQ ID NO: 2593914 - RNA, 21 nt, Escherichia coli CFT073
acuccagcgcuucgcucccca

SEQ ID NO: 2593915 - RNA, 17 nt, Escherichia coli CFT073
acuccaguccaccccca

SEQ ID NO: 2593916 - RNA, 16 nt, Escherichia coli CFT073
acuccagucccaguuc

SEQ ID NO: 2593917 - RNA, 17 nt, Escherichia coli CFT073
acuccagucuuuuaacc

SEQ ID NO: 2593918 - RNA, 17 nt, Escherichia coli CFT073
acuccauugucuuuucg

SEQ ID NO: 2593919 - RNA, 17 nt, Escherichia coli CFT073
acuccccgcaaaccaga

SEQ ID NO: 2593920 - RNA, 13 nt, Escherichia coli CFT073
acuccccuucugg

SEQ ID NO: 2593921 - RNA, 21 nt, Escherichia coli CFT073
acucccuauaaugcgccacca

SEQ ID NO: 2593922 - RNA, 18 nt, Escherichia coli CFT073
acucccugcugauaguaa

SEQ ID NO: 2593923 - RNA, 13 nt, Escherichia coli CFT073
acucccuugccug

SEQ ID NO: 2593924 - RNA, 19 nt, Escherichia coli CFT073
acucccuuucugccacgcc

SEQ ID NO: 2593925 - RNA, 22 nt, Escherichia coli CFT073
acucccuuucugccacgccacg

SEQ ID NO: 2593926 - RNA, 21 nt, Escherichia coli CFT073
acuccgccagcaacugauaca

SEQ ID NO: 2593927 - RNA, 22 nt, Escherichia coli CFT073
acuccgcuuaccauccacacca

SEQ ID NO: 2593928 - RNA, 20 nt, Escherichia coli CFT073
acuccggauucaagcauuau

SEQ ID NO: 2593929 - RNA, 23 nt, Escherichia coli CFT073
acuccgguuuagugauaugggca

SEQ ID NO: 2593930 - RNA, 20 nt, Escherichia coli CFT073
acuccucgccuuaacgcaaa

SEQ ID NO: 2593931 - RNA, 15 nt, Escherichia coli CFT073
acuccugaaagcgaa

SEQ ID NO: 2593932 - RNA, 16 nt, Escherichia coli CFT073
acuccugacagguaug

SEQ ID NO: 2593933 - RNA, 17 nt, Escherichia coli CFT073
acuccuucguguauuuu

SEQ ID NO: 2593934 - RNA, 22 nt, Escherichia coli CFT073
acuccuucguguauuuugcauc

SEQ ID NO: 2593935 - RNA, 14 nt, Escherichia coli CFT073
acucgaacaaggca

SEQ ID NO: 2593936 - RNA, 18 nt, Escherichia coli CFT073
acucgaaggaauaagcug

SEQ ID NO: 2593937 - RNA, 18 nt, Escherichia coli CFT073
acucgaauuauucagagu

SEQ ID NO: 2593938 - RNA, 14 nt, Escherichia coli CFT073
acucgaccugcaac

SEQ ID NO: 2593939 - RNA, 15 nt, Escherichia coli CFT073
acucgaccugcaacu

SEQ ID NO: 2593940 - RNA, 16 nt, Escherichia coli CFT073
acucgauuaacucaua

SEQ ID NO: 2593941 - RNA, 18 nt, Escherichia coli CFT073
acucgauuuuauaaaggg

SEQ ID NO: 2593942 - RNA, 23 nt, Escherichia coli CFT073
acucgcacguucaguuuugggga

SEQ ID NO: 2593943 - RNA, 20 nt, Escherichia coli CFT073
acucgccaggaugggcugcc

SEQ ID NO: 2593944 - RNA, 19 nt, Escherichia coli CFT073
acucgccgcaaaacccagg

SEQ ID NO: 2593945 - RNA, 14 nt, Escherichia coli CFT073
acucgcggcuaaca

SEQ ID NO: 2593946 - RNA, 16 nt, Escherichia coli CFT073
acucgcuggcggcugg

SEQ ID NO: 2593947 - RNA, 18 nt, Escherichia coli CFT073
acucgcuggcggcuggca

SEQ ID NO: 2593948 - RNA, 21 nt, Escherichia coli CFT073
acucggaaaaugcauucuuau

SEQ ID NO: 2593949 - RNA, 23 nt, Escherichia coli CFT073
acucggaaaaugcauucuuaucc

SEQ ID NO: 2593950 - RNA, 17 nt, Escherichia coli CFT073
acucggcgaccaguucg

SEQ ID NO: 2593951 - RNA, 14 nt, Escherichia coli CFT073
acucggcugcugcc

SEQ ID NO: 2593952 - RNA, 16 nt, Escherichia coli CFT073
acucggggcuuuucuc

SEQ ID NO: 2593953 - RNA, 14 nt, Escherichia coli CFT073
acucggugcgcccg

SEQ ID NO: 2593954 - RNA, 15 nt, Escherichia coli CFT073
acucguaagaggcgu

SEQ ID NO: 2593955 - RNA, 16 nt, Escherichia coli CFT073
acucgucgcugauauu

SEQ ID NO: 2593956 - RNA, 21 nt, Escherichia coli CFT073
acucgugcgucgcauccggca

SEQ ID NO: 2593957 - RNA, 19 nt, Escherichia coli CFT073
acucguuaacuucaucccg

SEQ ID NO: 2593958 - RNA, 13 nt, Escherichia coli CFT073
acucguuguguga

SEQ ID NO: 2593959 - RNA, 19 nt, Escherichia coli CFT073
acucuaaauaauucgaguu

SEQ ID NO: 2593960 - RNA, 13 nt, Escherichia coli CFT073
acucuacucccug

SEQ ID NO: 2593961 - RNA, 14 nt, Escherichia coli CFT073
acucuacucccugc

SEQ ID NO: 2593962 - RNA, 23 nt, Escherichia coli CFT073
acucuacugaaggcgcauugcug

SEQ ID NO: 2593963 - RNA, 13 nt, Escherichia coli CFT073
acucuacuucuuc

SEQ ID NO: 2593964 - RNA, 17 nt, Escherichia coli CFT073
acucuccagacugcugc

SEQ ID NO: 2593965 - RNA, 16 nt, Escherichia coli CFT073
acucucccaugcgcug

SEQ ID NO: 2593966 - RNA, 15 nt, Escherichia coli CFT073
acucuccuguuuaau

SEQ ID NO: 2593967 - RNA, 21 nt, Escherichia coli CFT073
acucucgggaaggcccuuucc

SEQ ID NO: 2593968 - RNA, 15 nt, Escherichia coli CFT073
acucugaaaacgcug

SEQ ID NO: 2593969 - RNA, 17 nt, Escherichia coli CFT073
acucugacccagaagac

SEQ ID NO: 2593970 - RNA, 12 nt, Escherichia coli CFT073
acucugaugacu

SEQ ID NO: 2593971 - RNA, 19 nt, Escherichia coli CFT073
acucugcaagucuugcugc

SEQ ID NO: 2593972 - RNA, 17 nt, Escherichia coli CFT073
acucugcacguuuugcu

SEQ ID NO: 2593973 - RNA, 13 nt, Escherichia coli CFT073
acucugccaggca

SEQ ID NO: 2593974 - RNA, 14 nt, Escherichia coli CFT073
acucugccaggcag

SEQ ID NO: 2593975 - RNA, 22 nt, Escherichia coli CFT073
acucugccauccguaauuauua

SEQ ID NO: 2593976 - RNA, 12 nt, Escherichia coli CFT073
acucugcccuuc

SEQ ID NO: 2593977 - RNA, 20 nt, Escherichia coli CFT073
acucugccguaccaucgcca

SEQ ID NO: 2593978 - RNA, 21 nt, Escherichia coli CFT073
acucugcgcauguaauggggc

SEQ ID NO: 2593979 - RNA, 22 nt, Escherichia coli CFT073
acucugcgcuaaaauuucuuuu

SEQ ID NO: 2593980 - RNA, 14 nt, Escherichia coli CFT073
acucugcggcauca

SEQ ID NO: 2593981 - RNA, 17 nt, Escherichia coli CFT073
acucugcuaacucauug

SEQ ID NO: 2593982 - RNA, 22 nt, Escherichia coli CFT073
acucuggauguuucaugaagca

SEQ ID NO: 2593983 - RNA, 18 nt, Escherichia coli CFT073
acucuguggaaagagcaa

SEQ ID NO: 2593984 - RNA, 14 nt, Escherichia coli CFT073
acucuuaaagcuac
